United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 112

SEQ ID NO: 217692 - DNA, 1593 bp, Artificial Sequence
  Description of Artificial Sequence: Synthetic coding sequence
aaggtgaggaggagccagaagctagacatgtcagcaagattggaactccaatccgctttggaagccgaaattcgcgcaaaacagctcgttcaggaagaacttcggaaggtgaaagatgccaatttaaccctcgagtctaaactgaaagacagcgaagcaaaaaatagggagcttctagaagaaatggagatcctcaaaaaaaagatggaggaaaaatttagagccgacactggcctgaaactgcctgactttcaggacagcatttttgaatattttaacacagctcctctggcacacgatctcactttcaggacatccagcgcctccgagcaggaaactcaggcaccgaaaccagaagccagtccctccatgagcgtggccgcatcagagcagcaagagcctaaagctcatcagttttccattaagtcctttagcagtccaacccagtgttcgcattgcactagcttaatggtgggactgattagacagggctacgcatgtgaggtttgttcgtttgcatgtcatgtttcctgcaaggatggggcacctcaggtgtgccctatcccccctgagcagtctaaaaggcccttgggcgttgatgttcaaagaggaatcggtactgcttacaaaggtcacgtgaaagttcctaagcccaccggagtgaagaagggatggcagagggcatacgccgttgtctgtgactgcaaattattcttatacgacctgcccgaggggaagtctacccagcctggagtgatagcctcccaggtgctggatctaagagacgacgagttttcggtatcctctgtacttgcttctgatgtgatacatgccacccggcgagacatcccctgcattttccgggttaccgcctcactcttgggcgctccatcgaagacaagtagcctcctgattttgacagagaacgaaaacgagaaacgaaagtgggttgggatcttggaggggctacagtcaattttgcacaagaataggttgaggaatcaggtcgtgcacgtgcctctggaggcctacgattcatctctgccactgatcaaggccattctgacagccgctatcgttgacgcggatcgtatcgctgtcggactggaagaaggcctctacgtcatcgaggtcacccgagacgtcatcgttcgtgcagcagattgcaaaaaggtgcaccaaatcgagcttgctcctagagaaaagatcgtaattctgctctgtggccgaaaccaccacgtgcatctttacccttggtcgagtctagacggggcagaaggctcgtttgacattaagctgcctgagaccaaggggtgccagctgatggcaaccgctacactcaagagaaattccggcacttgtctcttcgtcgccgtgaaacgcctgatcttatgttatgagatccagcggacaaagcccttccaccgtaaattcaacgagattgtggctcccggaagcgtgcagtgcttggctgtgctgagggacaggctgtgcgtgggatacccctcaggtttctgcttgttatctatccagggagacggtcagccccttaacttggtgaatcctaacgatccctcactggcatttctgtag

SEQ ID NO: 217693 - DNA, 4656 bp, Artificial Sequence
  Description of Artificial Sequence: Synthetic coding sequence
atggagcgccgtctgcgggcactggagcagctcgctcgcggagaggctggagggtgcccgggactagatggcctattggacctgctgttggccctgcaccacgaattgtctagcggacctcttcggagagagagatcggtggcccagttcctcagttgggcctctcctttcgtgagcaaggtcaaagagctgcgcctgcagcgtgacgatttcgagattttgaaggtgattggaagaggggcttttggcgaggttaccgtggttaggcagcgggacaccggacagattttcgccatgaagatgctgcacaaatgggaaatgcttaaaagggccgaaacggcctgcttcagggaggagcgggacgtgctggtaaaaggagatagccgatgggtcactaccctgcattacgcctttcaggatgaggaatatctttaccttgtgatggactattatgccggaggagatttattgactctcttgtcaagatttgaggacagactgcctcctgaactagcgcaattttacttggcggaaatggtgctcgctatacactctctccaccagctgggctacgtccatagagacgttaagcccgacaatgtgctccttgatgtgaatggtcacattagactggctgacttcggttcctgtctgcgactgaatactaacggaatggtcgattcaagtgtggccgtgggtacccccgattatatctctcctgaaatactacaggctatggaggagggaaaaggacattatggaccgcagtgcgattggtggagcctgggcgtgtgtgcttatgaactcctgttcggcgaaaccccattctacgcagaaagcctggtggaaacatatggtaaaattatgaaccatgaggatcacttgcaatttccccctgatgtccctgacgtacctgcttccgcgcaggacttgatcagacagctactgtgtaggcaagaggagcgactggggagaggtggactggacgacttccgcaaccaccccttttttgaaggtgtggactgggagcgccttgcctcatctaccgctccatacattccagagctccgaggacctatggacacttccaactttgatgtcgacgatgacaccttaaatcatcctgggactctaccccctccgtctcacggggcattttcgggtcatcatctgccattcgtggggttcacctacacgtcagggagccattcccccgagtcttcatctgaagcttgggccgcactcgagcgaaagctgcaatgtcttgaacaggaaaaagtcgagttaagcaggaaacaccaggaagccctgcacgcccctaccgatcatagggagcttgagcaattgaggaaagaggtccagacgctccgtgaccggcttccagagatgttacgcgacaaggccagcttatctcagaccgacggtcctcctgccggttctcccggacaggactccgatctgcggcaggaactggacagactgcatagggagcttgcagagggccgtgcaggcctgcaagcacaggaacaggagctgtgtcgggctcagggccagcaagaggaattacttcagcgactgcaagaagcccaggagcgggaggccgcaacagccagccagacccgtgccctttcaagtcagctggaagaggcaagagccgctcagagagaattggaagcccaggttagttcactgtctcggcaggtgacccagctccagggtcaatgggaacagaggctggaggagtccagtcaggcaaaaaccattcacaccgcaagcgagactaatggaatgggtccgccagagggagggccacaggaagcgcagctccgaaaggaagtggccgctctccgggagcaattagagcaagctcattcccatcggccatccggcaaagaagaggccttgtgtcagctccaggaagaaaaccggaggttgtcacgcgagcaagagaggttagaggctgagctagcccaggagcaggagtctaaacagagactcgagggggagcgaagggaaacagagagtaattgggaggcccagctggctgacattttgtcttgggtcaacgacgagaaggtttcacggggttacctgcaagcattggccaccaaaatggccgaggaactggagagcttacggaatgtgggtacccaaacactgcccgcacgcccacttgatcaccagtggaaagctcgaagactgcaaaagatggaggcaagtgccaggctggaactgcaatccgctctcgaggctgagatcagggctaagcagggcctgcaagagaggttgacacaagtgcaagaagcccagctgcaggctgaacgcaggttgcaggaagcggagaagcagtcccaggctctccaacaggaactggctatgctccgcgaagagctgagagccagaggacccgtcgacactaagccttcaaatagccttattccctttttgtcttttagatcctcagagaaggacagtgccaaagaccctgggattagcggcgaagctacgagacacggtggcgagcctgacctgaggcccgaggggagacggagcctccggatgggcgctgtgttccctagggctccgaccgccaatactgccagtacggagggcctgcctgctaagccgggaagccatacacttcgaccacggtctttcccaagccccactaaatgccttagatgtactagtttgatgctcggcctaggacgccagggcctgggctgtgatgcctgcggctacttttgtcacacgacttgcgcgcctcaagcaccaccgtgcccagtcccccctgatctgctcagaacggcattaggtgtacacccagaaacaggcacggggacagcgtacgagggctttttgtccgtcccacgaccatctggagtccgcagaggatggcagcgagtgtttgcagcactgtctgactctcgtctcctgctgttcgacgcccctgatctgcgactgtcaccgccatctggcgcattgctgcaagtgctggatctgcgagaccctcagttttccgccacgcccgtactggcgtccgacgtgatccacgcacaaagcagggacctacccagaatcttccgggtgacaacgagccaactggcagtgcctcctacaacttgcacagttctcctgctggcagaatctgaaggcgagcgcgaaaggtggctgcaggtcctaggcgagctacaacgcttactgctggatgccaggccacggccacgtccagtgtatactctgaaagaagcgtatgacaatggcctccccctacttccccacaccctgtgtgccgctatcctcgaccaggaccgtctggccctagggacagaggaggggctctttgtaatccatctgcgatccaacgacattttccaagtcggagagtgtcggagggtccagcagttgaccttaagcccttctgctggccttctggtggtactttgcggacgaggtccgagcgtgaggctctttgctctcgcagaattggagaacattgaagtcgcaggagcaaaaatccctgagagtcgcggatgtcaggtgctcgccgctggatccatcctgcaagctaggacccccgttctatgtgtcgccgtgaagagacaggtgctgtgttatcaactagggcctggcccagggccatggcaacgccgtatccgcgaacttcaggctcctgctaccgtccagtccctgggactgctgggcgatcgactctgcgtgggcgctgccggtggattcgccctctatccccttctgaatgaagccgctcctcttgcgctcggtgccggtcttgtccccgaagagctgcctccctcccgaggagggttaggggaggctctaggagctgtggaattgtctctcagcgaatttctgctgttgttcacaaccgctggcatctatgtcgacggcgctggtcgcaaatccaggggtcacgagcttctctggcctgccgctcccatgggatggggatacgctgcaccgtacttgaccgtattctcggaaaatagcatcgatgtttttgacgtgagaagggccgaatgggtgcagaccgtgccgcttaagaaggttagacccctcaatccagaaggctccttatttctctacggaactgagaaggtcagactgacctacctgcgaaaccagctggcggagaaggacgaatttgatatccccgatcttactgacaacagccgtagacagctctttcgaacaaagtccaaacggcgattcttctttcgcgtgtccgaggagcagcaaaaacagcagcgcagagaaatgctcaaggacccattcgtgaggtcaaaacttatttcccctcctaccaacttcaaccatctcgtccacgtgggccctgcaaacggccgtcctggcgcaagggataagtcaccggctccagaggagaaggggcgtgtcgcaagggggtcgggtcctcagcgtccacattcctttagcgaagccctccgacgccctgcatccatggggagtgaggggctgggaggggacgctgatccaatgaagcgcaagccatggaccagtctgagcagcgagagcgtgtcttgcccccagggtagtcttagccctgccacatccttaatgcaggtgagtgagaggcctcgctctttacctctctctcctgagctagagtctagcccatag

SEQ ID NO: 217694 - DNA, 1176 bp, Artificial Sequence
  Description of Artificial Sequence: Synthetic coding sequence
atgccaggccctcagggtggtcggggagccgctactatgagcctcggaaagttaagtccagtcggctgggtgagcagtagccagggcaagaggagattaacagctgatatgatctcccatcctctcggcgattttcggcataccatgcatgttgggaggggaggcgatgtctttggcgacacttcattcttaagcaatcacgggggtagctccggatccacgcataggagccctagatccttcctggccaagaagctgcagctggtccgaagggtgggagcacctccgcgtagaatggcttctccacccgcacctagtcctgctccacccgctatctctcctattatcaaaaatgctattagcctgccccagttaaaccaggctgcttacgactcactggtggtgggtaagctctccttcgactcatcaccaaccagcagcactgatggccatagcagctacgggttagattcgggattctgcacaatatcgcggttgccacgctcagaaaaaccacatgacagggatcgagatggtagcttcccaagcgagcccggtctgcgacggagtgattctctgttgtcattccggctggaccttgatctgggcccaagcttgctgtctgaactgctgggggtaatgtccctgccagaggcccctgctgctgagactccagcccctgccgcaaatcctcctgccccaactgcaaaccccactggacccgctgccaacccacctgcgacgacagcaaacccccctgcacccgcagctaacccatccgcacctgccgcaacccccactgggccagctgccaatccgcctgcacccgctgcaagttccaccccacatggccattgtccaaatggcgtgacagccggactgggacccgtggctgaggtgaagagctcccctgtgggtggcggaccgagggggccagcgggacctgcattgggcaggcactggggagccggttgggacgggggacatcactaccccgagatggacgctcgacaggagagggtggaagttcttccccaggccagagcttcctgggaatctctggacgaggagtggcgggctccccaggccggatctagaactccggtgccatccacagtccaggccaatacgtttgagtttgccgatgctgaggaggacgatgaagtcaaagtgtag

SEQ ID NO: 217695 - DNA, 183 bp, Artificial Sequence
  Description of Artificial Sequence: Synthetic coding sequence
atgcccggaccacagggtggcaggggcgctgctacgatgagtctgggtaagctgtcccccgtcggctgggtgtctagttcccaaggcaaaaggcgcctaactgcggatatgataagccatcccctaggagactttcgacatactatgcacgtgggtcgaggaggggatgtttttggagattag

SEQ ID NO: 217696 - DNA, 213 bp, Artificial Sequence
  Description of Artificial Sequence: Synthetic coding sequence
atgcccggacctcagggcggacgcggtgcagccacaatgtccctgggaaaactcagtcccgtggggtgggtcagttcctctcaaggaaagcgtagattgacagctgatatgatttcacaccctcttggggactttcggcatactatgcacgtcggacgcggaggagacgtgtttggggacactagtttcctttcaaaccatggcggtagctag

SEQ ID NO: 217697 - DNA, 147 bp, Artificial Sequence
  Description of Artificial Sequence: Synthetic coding sequence
atgcctggtcctcagggaggtagaggagctgctaccatgtccctgggaaagctgagccctgtgggctgggtgtcgtcaagtcagggcaagcgtagactgaccgctgacatgatctcccatcccctgggagacttccggcacacctag

SEQ ID NO: 217698 - DNA, 633 bp, Artificial Sequence
  Description of Artificial Sequence: Synthetic coding sequence
atgtctacaaaagtgcccatctatctgaaaaggggatccaggaaaggcaaaaaggagaagttacgtgacttactgtctagtgatatgattagcccaccccttggcgattttcgccataccattcacattggaagcggtggtgggtctgatatgtttggtgacatatcctttttgcagggcaaattccacctcttgccaggcaccatggtcgagggtcccgaggaagatggaacatttgacctccctttccagttcacacggactgccactgtgtgcgggcgtgagctgccagacggcccatccccactccttaagaatgccattagtctgcctgttatcgggggaccacaggcgttaacactgccgaccgctcaggcacccccaaaacctcctcggctgcatcttgagaccccccagcctagcccgcaagaggggggatctgtggatatctggcgaatccctgagacgggaagcccaaatagcggcctgactcctgagtccggagcagaggagccatttttatctaatgcatcatctctgctcagcctgcacgttgatttaggcccttctattctggatgacgtgctgcagatcatggatcaagacctggatagtatgcagatccccacatag

SEQ ID NO: 217699 - DNA, 633 bp, Artificial Sequence
  Description of Artificial Sequence: Synthetic coding sequence
atgagcaccaaagtacccatctacctcaagaggggctctcggaagggcaagaaagaaaaactgcgggaccttttgtcctctgacatgatctcgcccccattgggagatttcaggcacacgattcatattggtagcggcggtgggtcggatatgttcggagatatatcttttctacaaggcaagtttcacctgctgccaggaacaatggttgaggggcctgaggaggacggcacgtttgatcttccgttccagtttacaagaaccgctaccgtttgtgggagggagttgcccgacgggccttcacccttactgaagaacgcgatctccctgcctgtgatcggaggaccgcaggctctaaccctgccaacagcccaagctcctcccaagcccccaaggctgcaccttgagactcctcaaccatcgccacaggagggaggcagtgtggacatctggcgtatacccgagaccggcagccctaacagcggcctcaccccagagagcggcgctgaggaaccctttctttctaacgcgtcaagcctcctcagcctccatgtcgacctgggcccttccatcctggacgatgtgctgcagatcatggatcaggaccttgatagcatgcagatacctacctag

SEQ ID NO: 217700 - DNA, 633 bp, Artificial Sequence
  Description of Artificial Sequence: Synthetic coding sequence
atgagcactaaagtacctatttacttgaagaggggttcaaggaagggtaagaaggaaaagttgcgagacctcctttctagcgacatgattagtccccctctgggggactttaggcacacaatccacatcggatcaggagggggttcagacatgtttggcgatatctcatttctacagggcaagtttcacttacttccaggcaccatggtagagggaccagaggaggacggaacatttgacttgccctttcaattcactaggacggcaactgtgtgtggcagagagctgcccgacggcccttcaccactgctgaaaaatgctatctctctgcccgtaatcggcggtccacaggctctgactctgcccactgcacaggctcccccaaaaccaccccgactgcacctggagacgccgcagccatctccacaggaaggaggttccgtggatatctggaggatccccgagacgggctctccaaattcaggtctgacccccgagtccggagctgaggagcctttcctgtctaacgcctcatcattgctcagcctccatgtggatctggggccatcgatactggatgatgttctccaaataatggatcaggacttggattctatgcagatccccacctag

SEQ ID NO: 217701 - DNA, 765 bp, Artificial Sequence
  Description of Artificial Sequence: Synthetic coding sequence
atgcctgccaaaactccgatatatctgaaggccgctaacaataagaagggcaagaagttcaagttacgagatatactgagcccggatatgatctctccccctctgggagattttcggcacacgatccacattgggaaagaaggccagcacgatgttttcggggatatctcattcctccaggggaattatgaactgctccctggcaatcaggagaaggctcacctgggacagtttccaggccataatgaattcttccgggctaactctacgagtgactcagtatttacggaaaccccttcaccagtgctgaagaacgcaatttctctgcccacaatcggcggatcccaggcccttatgctgcccttgctttctccagtgacattcaactccaaacaggaatcttttggtccggctaaactgcctcgcctgtcatgcgaacctgtgatggaagagaaggcgcaggagaaatcttccttacttgagaatgggaccgtccaccagggggatacctcctggggctcttcaggctctgcctcacagagtagccagggcagggacagtcattctagttctctcagcgagcaataccccgattggccggcagaagatatgtttgaccatcctactccttgtgaattgatcaaaggcaaaacaaaaagtgaggagtcactcagtgacctgaccggctctctcctgtctctgcagctggacttgggtccctctctgctggacgaggtcctgaacgtgatggataaaaacaaatag

SEQ ID NO: 217702 - DNA, 45 bp, Artificial Sequence
  Description of Artificial Sequence: Synthetic coding sequence
atgcccgctaagacacccatctatttgaaggctgctaataactag

SEQ ID NO: 217703 - DNA, 108 bp, Artificial Sequence
  Description of Artificial Sequence: Synthetic coding sequence
atgcccgcaaaaaccccaatctatctgaaggctgccaacaacaaaaaagggaagaagttcaagctgagagatatcctgtcaccagatatgattagcccaccactgtag

SEQ ID NO: 217704 - DNA, 651 bp, Artificial Sequence
  Description of Artificial Sequence: Synthetic coding sequence
atgccagccaaaaccccaatttaccttaaggcagcaaacaacaaaaagggcaagaaattcaagctgagggatattctgtctccggacatgatatccccgccactgggagattttaggcacacaattcacatagggaaggaaggtcaacacgacgtgtttggagatatcagctttctgcagggaaattacgagctgctcccaggcaaccaagaaaaagctcacctgggacagttccctggccacaatgagttcttcagagccaactccacgagcgattcagtgttcacagagaccccttccccggtgctgaagaatgccataagtctgcccactatcggcggaagtcaggcccttatgctgcccttgctaagccctgtgacctttaattctaaacaggaatcttttggcccagctaagctacctagactgtcctgcgagcccgtgatggaggaaaaagcccaggagaaatcttccctgcttgagaatggcaccgtgcaccagggtgacacttcatggggctcttctggatctgcatcacagtcctcacaggggcgagattcccattcatcctccttatctgagcaataccctgactggcccgcagaggacatgtttgatcacccgacaccctgcgagctgattaaggggtag

SEQ ID NO: 217705 - DNA, 1071 bp, Artificial Sequence
  Description of Artificial Sequence: Synthetic coding sequence
atgccaatattgaagcagctggtgagctcatcagttcattcaaagcggaggtctcgagcagacctgaccgctgaaatgatctccgcacccttgggcgacttccggcacaccatgcacgtggggagggctggggatgcatttggagatacatcgttcctgaattcaaaagcgggagagcccgatggtgaatcccttgacgagcagcccagtagctcttcatccaaacgaagcctcttatcccgaaagtttcggggtagtaagcgcagccagtccgttacaagaggagaaagggagcagcgcgacatgctgggatccttacgcgactcagcgctcttcgtcaaaaacgctatgtctctgccgcagctgaacgaaaaggaggcagcagagaagggtacctctaagctgcccaagtctctatcttcctcaccagtgaagaaagccaatgacggtgaggggggagatgaagaggcgggtactgaggaggcagtgcctcgtcggaatggcgcagccggaccacactccccagatccattactggacgaacaggcatttggcgatttaacagacctgcccgtggtacctaaagccacctatggacttaagcacgctgagagcataatgtcgttccacatcgatctcgggccttccatgctgggcgacgtgctgagcataatggacaaagaggagtgggacccagaggaaggagagggcggataccacggcgacgaaggcgcagcgggaactatcacccaggcgccaccgtacgccgtggccgctcctccactggctaggcaggaaggaaaagcaggcccagacctaccaagccttccatcacatgcgctggaggacgagggatgggccgcagccgctccctcccctggcagcgcacgctccatgggctcccacactacccgcgacagcagttcactgtccagctgtactagtggaattcttgaagaacggtcaccggcattcaggggcccagatagagcccgtgccgctgtgagcaggcagccggacaaagagttcagctttatggacgaagaagaggaggatgaaatccgggtgtag

SEQ ID NO: 217706 - DNA, 861 bp, Artificial Sequence
  Description of Artificial Sequence: Synthetic coding sequence
atgcctatcctgaaacaactggtgtcctcttcagtgcacagcaaacggagaagcagggctgatctgactgccgagatgatttctgccccattgggcgactttcggcacacaatgcacgtcgggcgagcgggtgacgccttcggggatacatccttcctgaactctaaagctgctgagaagggtactagcaaacttccaaaaagtctttcttctagccccgtgaagaaagctaacgacggagaagggggtgacgaggaggccggaaccgaggaggcggtccctcgaaggaacggcgcagcagggcctcacagcccagacccgctgttggacgaacaggcgtttggggatctgactgacttgccggtggttccaaaagctacctacggcttgaagcacgccgagagtatcatgtccttccacatagatctgggaccctccatgctgggcgatgtgctaagcatcatggataaagaggagtgggatcccgaagagggcgaggggggatatcacggagacgaaggtgccgctgggacaattacccaggcccctccttatgctgtcgccgctccccctctcgcacgccaggaaggcaaagccggtccagatctaccaagtttaccctctcatgctcttgaggatgaggggtgggcagctgccgcaccaagccccggtagtgccaggagcatggggtcacatacgacacgagattcaagcagtctcagctcatgcacaagtggcatcctggaagagcggtcgcccgctttccgaggacctgatcgtgcgagagccgctgtaagcagacagcccgacaaagagtttagctttatggatgaggaggaagaggacgaaattcgggtatag

SEQ ID NO: 217707 - DNA, 1551 bp, Artificial Sequence
  Description of Artificial Sequence: Synthetic coding sequence
atgactctgttgatcaccggcgactcgatcgtttcagctgaggccgtctgggaccacgtaacaatggctaaccgggagttagcatttaaggcgggtgacgtaatcaaggtgctggacgcttctaacaaagattggtggtgggggcaaatcgatgacgaagagggatggttccccgcttcttttgttcggctctgggtgaaccaggaagacgaggtggaggaaggccctagcgacgtgcagaacggccatcttgaccctaacagcgattgcctgtgcctgggtagaccacttcaaaacagggaccagatgcgggctaatgttatcaatgaaataatgagcaccgaaagacactacatcaagcatctgaaggacatctgcgaaggttacctgaaacagtgtcgcaagaggagggatatgttctcagacgaacaactaaaagtgattttcggaaatatcgaagatatttaccgcttccagatgggatttgtaagagacctcgaaaaacagtataataacgatgaccctcacctgtctgaaatcggtccatgcttcctggagcaccaggatgggttttggatttacagcgagtactgcaacaaccaccttgacgcatgtatggaactgtccaagctaatgaaagactccagataccagcattttttcgaggcttgtaggttgttgcagcagatgatcgatatcgccatagacggttttttgttgacaccagtccagaaaatctgcaagtatccccttcaactggccgaactactgaagtacaccgctcaagaccactccgattaccgatatgttgccgctgctctcgcagtgatgcggaacgtgactcagcaaataaatgagcggaaaaggaggctcgaaaatatagacaagatcgcacagtggcaggcaagcgtgctggattgggagggtgaggacattttggaccggtcctcagaactgatttacactggagagatggcttggatttatcagccctatggacggaatcagcagcgcgtgttcttcctttttgaccaccaaatggttctctgcaaaaaggatcttattcgcagagacatactgtactacaaggggcgtatcgatatggacaagtatgaagtggttgacattgaggacgggagagacgacgattttaatgtctctatgaagaacgcctttaaacttcataacaaagagacagaagaaattcacttgttttttgccaaaaaactggaggaaaagattaggtggctaagagccttccgcgaagagcggaagatggtccaggaggatgaaaagatcggtttcgaaatcagtgagaaccagaagcgacaggcggcaatgacggttcggaaagtgccaaagcagaagggcgtgaactcggcccgttccgttcccccaagctacccacccccacaggaccccctgaaccacggccagtacctggtcccagatggaattgcacagagccaagtctttgagtttacagaaccaaaaagatcccagagtcctttttggcagaatttttcacgactcaccccatttaaaaagtag

SEQ ID NO: 217708 - DNA, 1245 bp, Artificial Sequence
  Description of Artificial Sequence: Synthetic coding sequence
atgcgagcaaacgtcataaacgagatcatgtctaccgaaaggcactacatcaagcacctgaaagacatctgtgaagggtatctgaaacagtgtcggaagcggagagacatgttctccgatgagcaactcaaggtgatttttggaaatatcgaggacatttaccggtttcagatggggtttgttcgggatttagaaaagcagtataataacgatgatccccatctcagcgagatcgggccttgcttccttgagcatcaggacggtttttggatctatagtgaatactgcaataatcaccttgatgcttgcatggaattgtctaagctgatgaaggattcacgttaccagcatttttttgaggcttgccgcctgctccagcagatgatcgatatcgcgattgatggcttcctcctcacaccagtccaaaagatttgtaaatatcccctgcagctagctgaattgctgaaatacaccgctcaggaccacagcgattacagatatgttgcagctgcactcgcagtgatgcggaatgttacccagcaaatcaacgagagaaagagaagactcgagaatatcgataagattgcacagtggcaggcatctgtactagattgggagggtgaggacatcctggataggtctagtgaactcatctacacaggcgaaatggcatggatttaccagccctacggacggaatcagcagcgagtgttctttctttttgaccatcagatggtgttgtgtaagaaagatttgatccgtagggacatactatactataagggaaggatcgatatggacaagtacgaggtggtggacatcgaagatgggagggatgacgattttaatgtctcgatgaagaatgcttttaagctgcacaataaagagaccgaggaaattcatctgttcttcgccaagaaacttgaagagaaaattaggtggcttagggcttttagggaagagcgcaagatggttcaggaggacgaaaagataggattcgagatatctgaaaatcaaaagcgacaagcagctatgacagtccggaaggtgcccaagcaaaaaggcgttaattcagctcgatcagtccctccctcatatcctccgccacaggatccactgaatcatggccaatatctggtgccagatggcatcgcacagtctcaggtgttcgaatttacagagcctaagcggagccagagtcctttttggcagaacttctcccggctgacaccctttaagaagtag

SEQ ID NO: 217709 - DNA, 1488 bp, Artificial Sequence
  Description of Artificial Sequence: Synthetic coding sequence
atggctaacagagaattggcttttaaagctggcgatgtgataaaggtgcttgatgcctcgaataaggattggtggtggggccagattgacgatgaagagggctggtttcccgctagcttcgtcagattatgggtgaaccaggaagatgaagtggaggagggtccatcagacgtgcagaatgggcacttagatcccaactcagactgcctctgccttggcaggccactgcagaacagagaccagatgagagccaatgttatcaatgaaattatgtctacagagaggcactacattaagcatctgaaagatatctgcgaaggctatctgaagcagtgtaggaaaagaagggatatgttcagtgacgaacagttgaaggtcatttttggcaacattgaagatatatacagattccagatgggctttgtgagggatctagaaaagcagtataataacgatgatcctcacctaagtgaaattggaccatgttttctcgaacaccaggacggattttggatctacagtgaatactgcaataaccacctggacgcctgcatggagttgtctaaacttatgaaagattcccggtatcagcattttttcgaggcctgccggttactgcagcaaatgattgacatcgccattgacgggtttcttctgacacccgtgcagaaaatctgcaagtaccccttacaactggccgagctactcaaatacacggctcaagaccattccgattacagatacgtcgccgctgcccttgctgtcatgagaaacgtcacccagcagatcaatgaaaggaaacgacgactcgagaacatcgataaaatagcacagtggcaggcttctgtcttggattgggagggcgaagacatcttggacagatcctcagagctaatctacaccggcgaaatggcatggatctatcaaccgtacggacgtaatcagcaacgtgtattcttcctgttcgaccatcagatggttctctgcaaaaaggacctgatccgtcgggacatcctatactacaaaggcagaattgatatggacaaatatgaggttgtagacattgaagacggccgagacgacgacttcaatgtctccatgaagaacgctttcaagttgcacaataaggagacagaagagattcaccttttcttcgccaaaaagctcgaggaaaaaatccgttggctgagagcttttagggaagagagaaagatggtacaagaagacgaaaagatcgggttcgagattagtgagaaccaaaagagacaggccgcaatgaccgtgcgcaaggttccaaaacagaaaggggtgaacagcgcccgaagcgttcccccttcctacccccctccgcaggacccactgaatcatgggcagtatctggttcccgacggaatcgctcagtctcaggtattcgagttcacagaacctaagcggagccagtcacctttctggcagaacttctccagactgacaccatttaagaaatag

SEQ ID NO: 217710 - DNA, 1437 bp, Artificial Sequence
  Description of Artificial Sequence: Synthetic coding sequence
atgttaatcactggcgatagtatagtctcagccgaagctgtctgggatcacgtcacgatggcaaatagagagcttgctttcaaagccggtgatgttatcaaggtgctagatgcaagtaataaagattggtggtgggggcagattgatgacgaggaggggtggtttccggcttccttcgtgcgattatgggttaaccaagaggacgaggttgaggagggtccatcggatgttcagaatgggcacctcgatccaaatagtgactgtctttgtttgggcagacctttgcagaaccgggaccaaatgagagcaaacgttataaacgagatcatgagcactgagagacactatatcaagcaccttaaggatatctgcgaggggtatcttaagcagtgtaggaaacgcagagacatgttctctgacgaacaattgaaagtaatttttgggaatatcgaggatatctatcgctttcagatggggtttgtgcgcgatctcgaaaaacaatataacaacgacgatccgcacctctccgagataggaccctgtttcctggaacaccaggatggattttggatttactcagagtactgtaacaatcacctggacgcatgcatggagcttagtaagctaatgaaggatagtagatatcagcacttcttcgaagcttgccgattgctgcagcaaatgattgacatcgccattgatggctttttgctcactccggtccagaaaatttgcaagtatcctctccagctggcagaattacttaagtataccgctcaagaccacagtgattatagatacgtggccgctgccctagccgtaatgcgaaacgtgacccagcagatcaatgaaaggaagaggcggttggagaacattgacaaaatcgcacaatggcaggcttctgttctggattgggaaggtgaggacattctcgaccgaagttcagaactgatctacaccggcgagatggcatggatttaccagccttatggtcgaaaccagcagcgggtgtttttcctgttcgaccatcagatggtgctgtgtaagaaggatcttattcggagggacatcctctattataagggccgtattgacatggacaagtatgaggtcgtggacatagaggacggacgggacgacgattttaacgtgagcatgaaaaacgcattcaaactgcataataaggaaacggaggagatacatttgttttttgccaagaagctagaagaaaaaattcgttggctcagggctttccgtgaggagaggaagatggtgcaggaagatgagaagatcgggttcgagatcagcgagaaccaaaagaggcaggccgcaatgaccgtccgcaaactgcctttcccccagctctctgaagctcggatctgcagtccaaagggctttgctagtgtgtttaacgggacgtgctgcggggagtcatag

SEQ ID NO: 217711 - DNA, 732 bp, Artificial Sequence
  Description of Artificial Sequence: Synthetic coding sequence
atgattgatatcgctatcgacgggttcctgttgacaccagtgcagaaaatctgcaaatatcctctgcagctggctgaattgttgaagtataccgctcaggatcattcagattaccgatacgtggctgcagctctagccgtgatgcgtaacgtcacgcaacaaatcaacgagcggaaaaggcgtttagagaatatcgataaaattgcacagtggcaggcatccgttctggactgggaggatttaatcaggcgcgacatcctttattacaagggcaggatcgacatggataagtacgaagtcgttgatatcgaagacgggagggatgatgacttcaatgtttctatgaaaaatgcttttaagcttcataataaagagactgaagagatccatctattttttgccaagaaattagaagagaaaatccgatggctcagggcatttagggaagagcggaagatggtccaagaggacgaaaagatcggatttgaaatcagcgagaaccaaaagcgtcaggctgctatgactgtgaggaaggtgccaaaacagaaaggcgtgaactcagccagatccgtacctccttcgtatcctccacctcaggatcccctcaatcacggccagtatctagtccccgacggcatcgctcaatctcaggtgtttgaattcactgaaccaaaaaggagtcagtctcctttttggcaaaacttctctaggctaacacccttcaagaagtag

SEQ ID NO: 217712 - DNA, 1392 bp, Artificial Sequence
  Description of Artificial Sequence: Synthetic coding sequence
atgcagtggatccggggaggatccggcatgctttgggttaaccaagaggacgaagtcgaagagggcccatcagatgtacagaacggacatctcgatcccaacagtgactgcctgtgtttgggtagacccctgcagaatagagaccaaatgagggccaatgttattaacgaaatcatgtctacagaacgtcattatattaagcatttaaaggatatatgtgaaggttaccttaaacagtgccgtaagcggcgtgacatgttcagtgacgaacagcttaaagtcatatttggcaatatcgaggatatctaccgcttccagatgggcttcgttagagatctggaaaaacagtataacaatgacgacccacacttatcagagatcggaccctgttttcttgagcatcaggacggtttttggatctatagcgagtactgcaacaatcatctcgatgcctgtatggagctgagtaagctcatgaaggatagtcgatatcaacacttcttcgaggcatgcagacttctgcagcagatgattgacatcgccatcgacggctttctgctaactcccgttcagaagatatgcaagtatcccctgcagttggctgaactcttgaaatacacagcccaggatcattcagactacagatatgtggccgctgcgcttgccgtgatgcgaaatgtcacccagcagattaacgaacgcaagcgaagactggaaaacatagataagattgctcagtggcaggcctccgtccttgactgggagggcgaagacatcctggacagaagcagcgagctgatatacacaggcgagatggcgtggatataccagccttacggaaggaatcagcaacgagtttttttcctgttcgaccatcagatggtgctctgcaagaaggacctaataagacgcgatattctatattacaaagggcgtatcgacatggacaaatatgaggtagtggacatcgaagacgggagagacgatgattttaacgtgtccatgaagaatgcctttaaactccataacaaggagacagaagaaattcacctattcttcgccaagaagctggaggaaaagattaggtggctacgcgcattccgagaggaacggaagatggtgcaagaggacgagaaaatcgggttcgaaatctctgaaaaccagaagagacaggcagcaatgaccgtccgcaaggtgcctaaacagaagggcgtaaactctgcccgatcagtaccacccagctatccccctcctcaagaccctcttaatcatgggcagtatctcgtgccagatggcattgctcagtcgcaggtgtttgagttcacagaaccaaaaaggtcccagtctcctttctggcaaaatttttcacggcttaccccctttaaaaagtag

SEQ ID NO: 217713 - DNA, 2409 bp, Artificial Sequence
  Description of Artificial Sequence: Synthetic coding sequence
atgcctaggatcatgattaagggaggtgtgtggcgaaataccgaagacgagattctgaaggccgctgtgatgaagtacggaaaaaatcaatggtccaggatcgcttctctcttacacaggaagagtgcgaaacaatgtaaggccaggtggtacgaatggctggatcctagtatcaagaagactgagtggtcaagggaggaggaggaaaaattactgcatttggcgaagctgatgcctacccagtggcgcactatcgccccaatcatcggtagaaccgcggctcaatgcttggagcactatgaattccttctggacaaggccgctcagcgcgacaacgaagaggagacaacggatgacccgaggaagttgaaaccaggcgaaatcgacccgaacccagagacaaagccagctaggccggaccctatagatatggacgaagacgaactggagatgctctcagaggctcgggctaggctcgccaacacccaaggaaagaaagccaagaggaaagccagagaaaagcagctggaggaggcgagacggctagccgctcttcagaaaagacgggagctgagggccgctgggatcgagattcagaagaagaggaaacggaaacgcggagtggattataatgctgaaatcccatttgagaagaagcccgcacttggattctatgatacatctgaggagaactaccaggctctggatgctgatttcagaaaactgaggcagcaggaccttgatggagagttgcgaagtgaaaaagaaggtcgggatcgtaagaaagataagcagcacttaaaacgaaagaaggaatcagatctgccttccgccatcctgcaaacctcgggagtgagcgaattcacaaaaaaacgtagtaagctggtgctccccgctccacagatctcggacgctgaattacaagaggtggtgaaggtcggtcaggctagcgaaatagctcgacagaccgcagaggaatccggaatcaccaactccgctagctcaactttgctctcagagtacaatgtgaccaataactcagtggctctgcggacaccccgaaccccggcttcccaggaccgcatacttcaggaggctcagaatctaatggcccttaccaatgtggacacaccactaaaaggcggactgaacacccccctccatgaatcagactttagcggcgtgactccacagaggcaggtggtgcagacgccaaatactgttctgagcactccgttcagaacaccatccaacggagcagaggggctgacgccaagaagcggcactacccccaaaccagtgatcaatagcacccctggtaggacaccactgagagacaagttgaatattaatcctgaggacgggatggcagattactcagatcccagttatgtcaagcagatggaacgcgaatctcgagagcatctgcgactgggtctgctcggcctccctgcccctaagaacgacttcgagatcgtcctgccagaaaacgccgagaaggagctcgaagagagggagattgatgacacatacatcgaggatgccgctgacgttgatgctaggaagcaggcaatacgtgatgcagagcgcgtgaaggaaatgaagcgcatgcacaaagccgtccagaaggatcttccccgtccctcagaggtcaatgaaaccattttaagaccattgaacgtagaaccacccttaacagatttacagaagtccgaagagctgatcaagaaagagatgattactatgcttcattatgacctgctgcaccatccctacgaaccatccggcaacaagaaaggtaaaactgtcggattcggaactaacaactctgagcacattacatacttggagcataacccttacgaaaaattcagcaaggaagagctaaaaaaagctcaggatgttcttgttcaggagatggaggtggtgaagcagggaatgagccatggagagctttcgtctgaagcctataaccaggtttgggaagagtgctatagccaggtactctatcttcctggccaatcacgctatacccgcgcaaacctggcctcgaaaaaggatcgaatcgaatcattagagaagagacttgagataaacagaggccacatgaccacagaggccaagagagctgcgaagatggagaaaaaaatgaaaatactgctggggggatatcaaagccgggctatgggcttaatgaaacagttaaatgacctctgggatcagattgagcaggcgcacctggaattacgcaccttcgaagagctgaaaaagcacgaggattcggcaatcccacggagacttgagtgtctgaaggaagatgtgcagaggcagcaggagagggagaaggagctgcagcaccggtatgccgacctgctgctggagaaggagaccctaaagtcaaaattctag

SEQ ID NO: 217714 - DNA, 1455 bp, Artificial Sequence
  Description of Artificial Sequence: Synthetic coding sequence
atgagacactctaagagaacttattgcccggattgggacgacaaagattgggattacggtaagtggcgatcaagcagcagccacaagcgtagaaaacggtcacactcttctgctcaggaaaacaaacgttgcaagtacaaccacagtaaaatgtgtgattcccactacctcgaatcacgctcaattaatgaaaaggattaccactcacggagatacatagacgagtacagaaatgactatacacaaggctgcgagcccggtcatcggcagagggaccatgagagtcgctatcagaaccactccagtaagagtagcggtcggagtggcagatcatcctacaagagtaagcaccggattcatcactccacctctcacagaagaagtcacggcaagagtcatcgcagaaagcgaacaaggagcgtcgaggatgacgaagaaggtcatctcatctgccaaagcggcgatgtgctcagcgccaggtacgagatagtggacaccctgggagagggcgcattcgggaaggtggttgagtgcatcgatcacaaagcgggtggtcgccacgtggctgtgaagatcgtgaaaaatgtggatcggtactgcgaagcagcgaggtcagaaatacaggtgctggagcaccttaacaccactgatccaaattcaacttttaggtgcgtgcagatgttggaatggtttgagcaccatgggcacatctgcattgtgtttgagctgcttggcttatcaacctacgattttattaaggaaaacgggttcctcccgttccggctagatcatattcggaaaatggcctatcagatatgcaagtctgtcaacttcctccattctaataaactgactcacacagatctgaagccagaaaatatcctgtttgtacagtcagactacactgaagcgtataatcctaagattaagcgcgatgagaggactctgattaatcccgacatcaaggtggtcgacttcgggtcagccacttatgacgatgagcaccactctactttagtctccacaagacactacagggcccctgaggtaatcctggcgctcgggtggtcacagccatgcgatgtgtggagcatcggctgcattttaatagagtactacttaggcttcactgttttcccaacacacgacagcaaagaacaccttgcaatgatggagcggattttaggacccctgcccaagcacatgattcagaagacccgaaaacgcaagtactttcaccacgatagactggactgggatgaacacagctccgctggtcgctatgtcagcagaaggtgcaaacccctgaaggaattcatgttatctcaagatgtagagcatgagcggctttttgacctaattcagaaaatgctcgaatacgacccagccaagaggatcactttaagggaggccctgaaacacccatttttcgatttactcaagaagtccatctag

SEQ ID NO: 217715 - DNA, 1365 bp, Artificial Sequence
  Description of Artificial Sequence: Synthetic coding sequence
atgaggcattccaagcgcacttactgtcccgactgggacgacaaagactgggattacggaaagtggcgatccagctcctctcacaagaggaggaagcgatcccactctagcgctcaggaaaacaaacgatgcaagtataatcatagtaagatgtgtgactcccattacctcgagtctaggtcaattaacgaaaaagactaccactcccggcgatatatcgatgagtatcggaatgactatacgcagggatgcgaaccaggccaccggcagcgagaccatgagtctcgttatcagaaccactcttccaagtcatccggtaggagtggcaggtcatcgtacaagtcaaaacaccgcatacatcactcgaccagccaccgccgttcacacggcgacgagatagtggacaccctgggtgaaggcgcattcggcaaagtggtagagtgcattgatcacaaggcaggaggaagacatgtggctgttaagattgtcaagaatgtggatcgctattgcgaggccgcaagatctgagatccaagtattagaacacctgaatactactgaccccaattctacttttcgctgcgtgcagatgctcgaatggtttgagcaccacggccatatttgcatcgtgtttgagctgctgggcctcagtacatacgatttcatcaaagagaacggtttcctcccgtttcgcctcgaccatataaggaagatggcttatcaaatctgtaagtctgtgaactttcttcattcaaacaagctgacccacacagatctgaaacctgagaacattcttttcgtccagtctgactataccgaagcctacaatcccaaaataaagcgggacgagcgaacgctgattaaccccgatatcaaggtagtggactttgggtcagcgacgtatgatgacgagcatcatagcacactcgtgagcaccaggcattatcgagccccagaggtcatcctcgcactcggctggtctcagccatgtgacgtgtggtctattggttgcatcctaattgagtactatctgggattcaccgtattccccacccatgactccaaggaacacttagctatgatggagaggatcctcgggccactgcccaaacatatgatccagaagaccagaaagaggaagtattttcaccatgacaggctggactgggacgagcatagctcggccggacgctacgtgtccagacggtgtaaacctttgaaagaatttatgctgtcccaggatgttgaacatgagcgcctgtttgatctgattcagaagatgctggagtatgatcctgcaaaaagaatcaccctccgggaggccctgaaacaccctttttttgatcttctaaagaagagcatatag

SEQ ID NO: 217716 - DNA, 1581 bp, Artificial Sequence
  Description of Artificial Sequence: Synthetic coding sequence
atggctgccggacgcagaccagcctccgcactgtggcccgagcggcgagggtctcctttaaggggcgacttgctgggttttcagaatgtcagagagccgtcttcttgcggcgaaacactttcaggtatgcgacactccaaaaggacctactgtcctgattgggatgataaggattgggattatggcaagtggcggtcaagctcctcacacaaaaggcgcaagcggtcccactccagcgcccaggagaacaaaagatgcaagtacaaccacagcaagatgtgtgattcacactacctggagtcaaggagtatcaacgagaaggactaccacagccggaggtatattgacgaataccggaacgattacacccaggggtgcgagccagggcaccgccagagagaccacgagagtagatatcagaatcatagctcaaaatcatcgggtcggtcggggaggagttcctacaaatccaaacataggattcatcattcgacctcccacaggcgatcacatggtaaatcccatagaaggaaaagaaccaggtccgttgaggatgatgaggagggccacctgatctgccagtccggcgatgtattgagcgcacgctacgagattgtggatacccttggagaaggcgctttcgggaaggtggtggagtgtatcgaccacaaggcagggggaaggcacgtggccgttaagatcgtgaagaatgttgacaggtattgtgaggctgcacggagtgagatccaagtgctcgaacatttaaacacaaccgacccaaattccacttttagatgcgtccaaatgctggaatggttcgaacaccacggacacatctgcattgtatttgagctcctcggcttaagtacttacgatttcattaaggaaaatggcttcctcccctttagattggaccacattcggaaaatggcttaccagatctgtaaatccgtgaattttcttcactctaataagttaacccacaccgacctcaagccggagaatatcctgtttgtgcagtctgattatacggaggcctataaccccaaaatcaagcgggatgaacggacattaatcaacccagacattaaagtcgtcgactttggtagcgcaacgtacgacgatgagcaccacagtactctggtttccactcgtcactaccgcgcaccagaggttatcttggcgttgggatggtctcagccatgtgacgtgtggtcaattggctgtatcttgatagaatactacctggggtttaccgttttcccaacacacgatagcaaagagcatctggcaatgatggaaaggatcctgggacctttacccaaacacatgattcaaaaaactcggaaacgaaagtatttccatcacgatcgactggattgggatgagcactcttcagccggaaggtacgtgagtcgcagatgcaagccactcaaggagtttatgctatctcaggacgtagagcacgagcggttgtttgacctcatccaaaaaatgttggagtatgaccctgctaaacgtatcaccttgagggaggccctgaaacatccctttttcgatctgcttaaaaagtcaatctag

SEQ ID NO: 217717 - DNA, 1494 bp, Artificial Sequence
  Description of Artificial Sequence: Synthetic coding sequence
atgccccaccctaggagataccactcgagtgaacgcggttcacgcggatcttatcgcgaacattatagatctcgtaagcataagaggcgtcgatccaggtcgtggagcagttcatccgaccggaccaggagacgtcgcagggaagattcttatcatgtgcggtctcggtcctatgacgaccgtagcagcgacaggcgtgtgtacgacaggaggtactgcggctcctacaggcgaaacgattactcaagggacaggggggatgcctactacgacacagattaccgccactcctacgaatatcaaagggaaaacagctcctaccggtcacagcgcagctctcgaagaaaacaccgtcgacggcgaaggaggtctcggaccttttcccgctccagttcccatagtagcaggagagcaaaatcagtggaggacgatgccgagggtcacctcatctaccatgtgggagactggctacaggagcgatacgaaattgtttccacgctcggggagggaacattcgggagggtcgtccaatgtgtggatcacagacggggaggagcccgagtggctctcaagatcattaagaacgtagaaaagtacaaagaggccgcacgcctggagatcaatgtgctggagaagatcaatgagaaagaccctgacaataagaacctgtgtgtgcagatgtttgattggtttgactaccacggtcatatgtgtatttccttcgagctgctaggactgtcaacctttgactttctaaaggacaataactacctgccgtaccctatccaccaggtgaggcacatggcctttcaattatgccaggccgtaaagttcctacacgacaacaagcttacgcacaccgacctgaagcctgagaatatattgtttgtgaactccgattacgagcttacatacaacctggagaaaaaacgggatgagagatcagtaaagtctaccgccgtgcgagttgtcgattttggatctgccacattcgaccacgaacatcatagtacaattgtgtccacccggcattaccgagccccagaagtaattctggaactcggctggagccagccctgtgacgtatggtctattggttgtattatattcgagtattatgtgggcttcacattattccaaacacatgataatagagagcatttagccatgatggagcggatcttgggacccatcccaagtaggatgatacgaaagaccagaaagcagaaatacttctatcgtgggagacttgactgggatgaaaatacttccgctgggagatatgtgcgagagaactgcaagcccctccggaggtacctgaccagtgaggctgaggaacaccaccagttgtttgacctgatagagtctatgctggagtatgagcctgcaaaaaggctaactctgggcgaggccctccaacaccccttttttgccaggttgcgagcagagccacctaacaaactgtgggactcatcacgagatatctcgagatag

SEQ ID NO: 217718 - DNA, 1497 bp, Artificial Sequence
  Description of Artificial Sequence: Synthetic coding sequence
atgccacacccccgtcggtaccattctagtgagcgaggatctcgagggtcttacagggagcactaccgctctcgaaagcacaagcgcaggaggagccgatcgtggagtagttcttctgaccgaacccggcgtcggagacgggaagactcatatcacgtgcggagtaggtccagctacgacgacaggtccagtgaccggcgtgtgtacgatcgtagatattgtggttcctaccgtagaaacgactacagccgagacaggggtgacgcgtattacgacaccgactaccgacattcttatgaataccaaagggagaatagttcctacaggagtcagcggtccagtcgcaggaagcacaggcgtcgccgtcgaagaagccgcaccttcagtagatcgtcttctcactcctctaggagggcaaaatcagtcgaagatgacgctgagggtcacctcatctaccatgtcggcgactggctccaagagagatatgaaatcgtatctacactgggagaggggacttttggtcgcgtggtgcagtgcgttgaccacaggcgaggtggcgcacgagtggcattgaagatcataaagaatgtggagaaatacaaggaagctgccaggttagagattaacgtcctagaaaaaatcaatgaaaaggatcctgataacaaaaatttgtgtgtacagatgttcgattggtttgactatcatggtcacatgtgtatctcttttgagttgttggggctgagcaccttcgattttttgaaagacaacaactatctaccgtaccctatacatcaggtccgacacatggcttttcaattgtgtcaggctgtgaagtttctgcacgataacaaattgacccacacggatctcaaaccagaaaatattttattcgtcaatagcgattacgaactgacttacaatttggagaagaagagagacgagagatccgtgaagtctactgcggtaagggtggtggacttcggctccgcaacgtttgaccacgagcaccattccaccatcgtgtcaacgcgacactatcgagctccagaagtgattcttgagcttggatggtcgcagccatgcgatgtgtggtccattggatgcataatttttgaatactatgtgggctttactctctttcagacccatgataacagggagcaccttgcaatgatggagcggattctgggtcccattccgagtcggatgattcgtaaaacccggaagcagaaatacttctaccggggacggctcgactgggacgaaaatacatccgccggacggtatgttcgtgagaactgcaaacccctgcgaaggtacttgacctccgaagcagaagagcaccaccagctgttcgatctcattgaaagcatgctagagtatgagccggctaagaggcttaccttgggtgaagctctgcagcaccccttttttgcacgcctgagggcagaacctcctaacaagctatgggactcctcgcgcgacatatctcggtag

SEQ ID NO: 217719 - DNA, 1500 bp, Artificial Sequence
  Description of Artificial Sequence: Synthetic coding sequence
atgccacaccctcggcgttaccactctagcgagagaggcagcaggggcagctatagagagcactatcgtagcagaaagcacaagaggcgacgcagccggtcctggagttcttcgagtgaccggactcggcgtaggcgaagggaggactcataccacgtgagatcccggtcttcctacgatgatcgttcttcggatcggagggtttacgacagacgatactgcggttcctatcgccgtaatgactattccagagatagaggtgatgcctactacgacacagattataggcattcttacgagtatcaaagagagaatagctcatatagaagtcagcgctcctcgcggagaaaacatagacgaaggcgacggagatccagaaccttcagtcggtcttcctcccaacattctagccgccgtgccaaaagtgtcgaagatgacgcagagggccatctaatataccacgtgggcgactggctgcaggaaaggtatgaaatagtcagcacccttggggagggaacgttcgggagagtggttcaatgcgttgatcacaggagagggggagctcgtgtggcgctgaagattattaaaaatgtggagaaatacaaggaagccgctcgactggaaatcaacgtgctcgaaaaaatcaacgagaaggatccagataacaagaacctctgcgtgcagatgtttgattggtttgattaccacggtcacatgtgtatctcattcgagctgctggggttgtcaacctttgatttcttgaaggacaacaattatctcccgtacccaattcaccaggttcgacacatggcattccagctctgccaggccgttaagttcctccacgataacaagttaactcataccgatctcaaacctgagaacatactattcgtgaatagtgactacgaattgacgtataacctggagaaaaaaagggatgaacgctctgtgaagagtaccgctgttcgggttgtggattttggctctgcaactttcgaccacgagcaccacagtaccatagtttcaacaaggcactacagagcacccgaggtgattctggaactgggatggagccaaccgtgcgatgtgtggagcattggttgtattatcttcgaatactacgtaggattcacactgtttcagactcatgacaatcgtgaacatctggcaatgatggaacggatactcgggcctataccgagtaggatgattagaaaaacccgaaaacagaaatacttttatcgagggaggctggactgggacgagaataccagtgcaggccgatatgttcgggagaattgcaagcccttaagaaggtatttgacatctgaagcagaagagcatcaccaactgtttgaccttatcgaaagtatgctggaatatgagcctgctaaaaggctgactctgggtgaagcactccagcaccctttctttgctcgcctaagggcggagccccctaacaaattgtgggacagttctagagatatctctcgatag

SEQ ID NO: 217720 - DNA, 816 bp, Artificial Sequence
  Description of Artificial Sequence: Synthetic coding sequence
atgtttgactggttcgactaccatggacatatgtgtatatctttcgaattactcggcttgagtacattcgattttttgaaggataacaactatttaccttaccctatccatcaggttaggcacatggcttttcaactctgccaagccgtaaaattcctccatgataataaactcacacatacggatttgaaaccggaaaacatcttgtttgtcaactcagattatgagcttacttataatcttgagaagaaaagagatgagagaagcgtcaagagcactgcggtgcgggtagtcgattttggatcggcaacctttgaccatgagcatcattctaccatcgtgagcacacgccattatagggccccagaggtaatcctcgaactgggctggtcacaaccctgcgacgtgtggagtattggctgtataatattcgagtattacgttggtttcacactgttccagacacacgacaacagggagcatttggcaatgatggaaaggatcctcgggccaatcccatccaggatgatacgtaagactcggaaacaaaaatacttctatagaggacgtctggattgggacgagaacacttccgccggacgttacgtcagggagaactgtaagcctctccggagatacttgacctcagaggcggaagaacaccatcagctgttcgatctgattgagtctatgctcgaatatgaacctgccaaacggctgaccctcggagaagccttgcagcatccattctttgcccgacttagagcagagccacccaataagctgtgggactccagtcgggatatcagtcggtag

SEQ ID NO: 217721 - DNA, 1500 bp, Artificial Sequence
  Description of Artificial Sequence: Synthetic coding sequence
atgccccacccccgaagataccattccagtgaacgcggatcaagaggcagctaccgcgagcattacaggtccagaaagcacaagagacgcagaagcaggtcttggtcttcatcatccgaccgtaccagaaggaggaggagagaagatagttatcatgtgagatcccggtcctcctacgatgacagatcctcggaccggcgagtgtacgaccgtaggtattgtggctcttaccggaggaacgactactcccgcgatagaggtgacgcctattacgacaccgactataggcacagttatgaataccagcgggaaaatagcagctacaggtctcagcggtcctcaagacgtaaacatagaaggagacggcgacgatctagaacatttagccgatctagttcccagcattcttcccgcagagcaaaaagcgtggaggacgacgccgaaggacatctgatctaccacgttggagattggctgcaagaacgctatgaaatcgtttctacgctgggtgagggaactttcggcagggtggtgcagtgcgtggaccaccgcagaggcggagctcgggtggcccttaaaattatcaagaatgttgaaaaatacaaagaagcagccaggctcgagataaacgtattggagaaaatcaacgaaaaggatccggataacaagaacctgtgtgtgcagatgttcgattggtttgactatcacggccacatgtgcatcagcttcgaactgttgggcttaagcacattcgattttctgaaagacaacaactacctgccatatcctatccaccaggttcggcatatggcgtttcaactctgccaagctgtgaaattccttcacgacaacaagttgacccatacagatctgaagcctgagaacatcctctttgtgaattcagactatgagctgacgtataatctagaaaagaagcgagatgagcgatcagtcaagtcaaccgcagtccgggttgtggatttcggcagtgccacgtttgaccatgaacaccattccacaatcgtttccacccgacattacagggcgcctgaagtgattctggagctcggatggtcccagccgtgcgatgtctggtccattggatgcatcatcttcgaatactacgtgggatttacactattccagacacacgataatagggagcacttggccatgatggagcggattttgggccctatcccttcacgaatgatacgcaagacccggaaacaaaaatacttttataggggcagactggactgggacgagaatacttcagcaggtcgctatgtccgagaaaactgtaaacctctgaggcgctacctgacgtcagaggccgaggaacatcaccagctgttcgacttgatcgagtccatgctagagtatgagccagcgaagcggctcacactcggagaagccctccagcaccccttttttgctcgcttacgggctgagcctccgaataagctttgggattctagcagagatatcagtaggtag

SEQ ID NO: 217722 - DNA, 1473 bp, Artificial Sequence
  Description of Artificial Sequence: Synthetic coding sequence
atgcaccactgtaaacgatatcggtccccagaacccgatccatatctgagttacagatggaagcggagaaggtcatactcccgggagcacgagggaaggcttaggtacccatcacgcagagaacccccaccccgtagaagccgctctagatcgcacgatcggctgccctaccagcggagatatagagaacggagagactcagacacctatcgctgcgaggagcggtctccctccttcggagaggactattatgggccatctaggtctcgccatcgccgacgctctagggaaaggggcccttatcggacccggaaacacgcccatcactgtcataagcgacgaactagatcatgcagctcagcatctagccgcagtcaacagtcctcaaaacgcagctctcgctccgtcgaggacgacaaagaaggccacctggtttgcaggataggtgattggctccaagagaggtacgagatcgtgggtaatcttggtgaaggtacatttggcaaggtggtcgagtgcctggaccacgctagaggaaaatcgcaggtggccctgaaaatcattagaaacgttggcaagtatcgagaggctgctcggctggaaataaatgtgctcaaaaagattaaggaaaaagacaaggaaaataaatttttgtgcgttttgatgagcgactggttcaattttcacggccatatgtgtattgcatttgagcttcttggaaagaacactttcgagtttctcaaggaaaataacttccagccttacccgctgcctcacgtgcggcacatggcgtatcaactgtgccatgcactcagattcctccacgaaaatcaactgacccatactgatctcaagcccgagaacattctgttcgtaaatagtgagtttgaaaccctctacaacgaacacaaatcatgtgaagaaaagtccgtgaagaatacctctatcagggtggccgacttcggctccgcgacttttgatcacgaacaccataccactatagtggcaacccgccattaccgcccacccgaggtcattctggaattgggttgggctcagccttgtgacgtctggagtatcggctgtatactctttgaatattatcgcggatttaccctgttccaaacacacgagaacagagaacacttagtgatgatggaaaagatccttgggccaatcccctcccatatgattcacagaacacgaaaacagaaatacttctacaagggtggtttggtgtgggacgaaaactcctccgacgggagatacgttaaagaaaactgtaagccactgaagtcatacatgctgcaggactccctcgagcacgttcagctgtttgatctcatgcgacggatgctggagttcgatccagctcagagaataactctggctgaagccctgttgcatcctttcttcgccggtctgactccagaagaaaggtcttttcacacttctcgaaacccctcccggtag

SEQ ID NO: 217723 - DNA, 459 bp, Artificial Sequence
  Description of Artificial Sequence: Synthetic coding sequence
atgcaccactgtaaacgctataggtcccctgagccagacccgtacctgtcttaccggtggaagcgcagacgtagctattcaagagagcacgaaggaaggcttagatacccatctagaagagagcctcctcctaggcggtccagatcaaggtcccatgacaggctaccctatcagagaagataccgcgagcggcgagatagtgacacatataggtgcgaagaacgcagcccttccttcggggaagactactatggtcccagtcgttcgcggcatcggaggcggtctagggagcgtgggccttacagaactcggaagcacgctcaccactgtcacaaacgtagaacgcggtcatgttcgtctgctagtagcatgcggctctggggcacatgggtaaaagctccacttgcacgctggtggagcgcatggaccatgcccgaagggtcccttcggcttccctag

SEQ ID NO: 217724 - DNA, 1404 bp, Artificial Sequence
  Description of Artificial Sequence: Synthetic coding sequence
atgcaccactgcaagaggtatagaagccctgaacctgatccctacctttcgtatcgctggaagcgtcgcagaagctacagtcgagagcacgaaggcaggctcagatacccctcgaggcgggaacctccgccaaggcgctcacgatcaaggagccatgatagacttccctaccaaaggcgatacagagagagaagagacagcgatacataccgctgtgaagaacgatccccatctttcggggaagactactatggcccttcacggtctaggcacaggaggagatctagagaacggggaccttatagaactcgcaaacacgcccatcattgtcataaacgcagaacaaggagttgctccagcgcaagctcacgctcacagcagagctcaaaacggtcttcaagatcggttgaagacgacaaggaaggtcacctggtttgtaggattggcgattggctgcaggaaaggtggaaatcccaggtggcactgaagatcatcagaaatgtggggaagtacagagaggccgctcggttagagataaacgtgttgaaaaagataaaggagaaagataaggagaataaattcctctgcgtgcttatgagcgattggttcaactttcacgggcacatgtgcatcgctttcgaactgctgggcaaaaatacgttcgaatttctcaaggagaataactttcagccgtatccattacctcatgtacggcatatggcttatcagctgtgtcatgcacttcgctttctgcacgagaaccagctgacccacacagatctgaaaccggagaacattttatttgtgaattccgagttcgagactctttacaacgaacacaaatcgtgtgaagaaaagagtgtcaagaacaccagtattcgtgtggccgactttggtagcgccacattcgaccatgagcaccacaccacaattgtggccacaagacattatcggcctcccgaggtgatcctcgaacttgggtgggcgcagccatgtgatgtatggagcattggctgcatcctttttgaatactatcggggattcacactgttccagacacacgagaacagggaacacctcgtgatgatggagaaaatcctgggtccgatcccaagccacatgattcacaggactcgcaagcaaaaatacttttacaagggcggactcgtctgggatgaaaactcgagcgacggcagatacgtgaaagagaactgtaagccactgaagagctatatgttgcaggatagtttggaacacgtccagctttttgatttaatgaggaggatgctcgaattcgatcccgctcagagaattacgctcgctgaagccctgctccaccctttctttgctggtctgacacctgaggaacgatcttttcatacttcgagaaaccccagccgctag

SEQ ID NO: 217725 - DNA, 1473 bp, Artificial Sequence
  Description of Artificial Sequence: Synthetic coding sequence
atgcatcactgcaaacggtaccgtagtccagagcccgacccatacctctcctatcggtggaagcggaggagaagctactctagggagcacgaggggagactgagatatccttctaggcgcgaacccccacccagacggagtcggtctcgttcgcatgaccggctcccttaccaaaggcgatatcgagaaagaagggactccgacacctataggtgcgaagagagaagcccatcctttggagaggattactacggaccttcgagatcgcggcatcgccgtaggagtcgggaaagaggcccttataggaccagaaagcatgcacatcattgccacaagcggagaactcggtcttgctcctccgcaagttcacgctcgcagcagagtagcaagagatcatctcggagcgtggaggacgacaaagaagggcacttggtttgccggattggggattggttgcaggaaagatacgaaatcgttggtaacctaggtgagggaaccttcggaaaagttgtcgagtgtttggaccacgcaagagggaaatcccaggttgctctcaagattataagaaatgtcgggaaatatagagaggcggcacggctggagatcaacgtcctgaagaagattaaagaaaaagacaaggaaaacaagttcctgtgcgtgctgatgtcggattggtttaacttccatgggcacatgtgtatcgcatttgagttactgggaaaaaacacatttgaatttctgaaggagaacaatttccagccgtaccctctgccacacgttagacatatggcctaccagctttgccacgcgcttagatttctgcacgagaatcaactcactcataccgatttaaaacctgaaaatatcctgttcgtgaattcagagtttgagacactgtataatgaacataagagttgtgaggaaaagtccgttaaaaacacaagcataagagtggccgacttcggaagtgctacatttgaccacgaacaccacacaacaatcgtggccacacggcattatcgcccaccagaagttatactcgagcttggctgggcccaaccatgcgatgtgtggagtattgggtgcattctctttgaatattacaggggtttcaccctcttccagactcacgaaaacagggagcatctggtcatgatggaaaagatactaggtcctatcccctcccatatgatccacaggaccaggaagcagaagtatttctataaggggggattagtgtgggatgaaaattcttccgacgggcgatacgttaaggaaaattgcaagccactcaagagctatatgctgcaggattctcttgagcacgtgcaactgttcgatctgatgcgtagaatgcttgaattcgacccggcacagagaataactctggccgaagccctgttgcaccccttcttcgctggacttaccccagaggagcgatcattccacacttcaagaaacccgagtcgttag

SEQ ID NO: 217726 - DNA, 1917 bp, Artificial Sequence
  Description of Artificial Sequence: Synthetic coding sequence
atgccggtgctctcagcacggcgtagggagcttgccgatcacgctggcagcggtcgtcggagcggccctagtccaacggccagatccggcccacacttgtcagcacttcgcgcacagccagcacgggctgcccatctttccggtcgtggcacttatgtgagacgcgatacggcagggggagggccaggccaagctcgtcctcttggcccaccaggtacgagcctactggggagaggcgcacgcaggagcggggagggctggtgcccaggagcatttgagtctggcgcaagggccgctaggccgccatcacgcgtggaacctcgtctcgctactgctgcctctagggagggcgcaggtcttcccagagctgaggtggctgccggatccgggagaggagcacggagtggcgaatggggactggcggcagcgggagcctgggagacaatgcatcattgtaaaagatacagaagccctgaaccagacccttacctttcttataggtggaagcgcaggcgctcctactcaagagagcacgagggacggctgcgatatccttctaggagggaacctcccccaagaaggagcagatccagatctcatgacagactgccttaccagagaaggtatcgagagcgacgcgattcagacacataccggtgtgaagaacggagcccctcctttggcgaggactactacggtccatcacgaagtagacaccgcagacgatccagggagcgcggaccctatcgaacccgaaagcacgcgcatcattgccataaacggaggactcggagctgctccagcgccagttctagatcacagcaatcttcaaaacggtcttcacgcagcgtggaggacgacaaggagggtcacctggtatgcagaattggcgactggttgcaggagcgctacgaaatagtggggaacctcggcgagggtacattcgggaaagttgtagaatgtcttgaccatgccagaggtaaatcccaggtggccctcaaaatcatacgcaatgtggggaagtaccgggaggctgctcggctcgagatcaatgttctcaaaaaaattaaggaaaaggataaggagaacaagttcctgtgcgtgctaatgtccgactggtttaactttcacggacacatgtgtatcgccttcgagttgctaggtaagaatacttttgagtttctaaaggaaaataactttcaaccctatcccctgccgcacgtgcggcacatggcttatcagctctgccatgccttaagattcttgcacgagaatcagctgacccatactgacctaaagccggaaaatatcctttttgtcaattcagaattcgagaccttgtataatgaacataaaagttgtgaagagaaatccgtgaagaataccagcattcgcgtggcagattttggcagtgcgacgttcgaccacgaacaccatacgacaattgtggccacgcggcattatcggccacctgaagtgatcctggaactcgggtgggcacagccctgcgatgtgtggagcattggctgcattctctttgagtactataggggattcactctattccaaacccatgagaacagggaacatctcgtgatgatggaaaaaatcctgggccctatacccagccacatgatccatagaactcggaagcaaaagtatttttataaggggggactggtatgggacgagaacagcagtgacggtcggtatgttaaagagaattgtaaacctctgaagagttacatgttgcaggacagtctggagcatgtccagttgtttgatttgatgaggaggatgcttgaattcgatcctgcccagagaattactttggcagaggctctattacacccattcttcgctggcctcacccccgaggaacggtctttccacacctcaagaaacccctcgaggtag

SEQ ID NO: 217727 - DNA, 327 bp, Artificial Sequence
  Description of Artificial Sequence: Synthetic coding sequence
atgtcactcactagctcttcatctgtgcgggtagagtggattgccgctgtgacgatcgctgccggtacggctgccataggctatctcgcatacaaaaggttctacgttaaggaccaccggaataaggcaatgataaacttacacattcagaaggacaaccccaaaattgtccatgcatttgacatggaggacctgggcgataaagcagtctactgccggtgctggcgttccaagaaatttcctttttgcgacggggctcataccaagcacaatgaagaaactggggataatgtaggccctctgataatcaagaagaaagaaacgtag

SEQ ID NO: 217728 - DNA, 408 bp, Artificial Sequence
  Description of Artificial Sequence: Synthetic coding sequence
atggtcctggaaagtgtcgcccgtatcgtaaaagtgcagctcccggcttatctaaagcgtcttcccgtgccggagtccatcactgggtttgccagactcaccgttagcgaatggctgcgattgctgcccttcctgggagtactggccctgctcggatatcttgctgttagaccctttcttcccaagaaaaaacagcagaaggactcactgatcaacttaaaaattcagaaagagaaccccaaggttgtgaacgaaataaacatagaggatctgtgtctcacgaaggctgcgtattgcaggtgttggagatcaaagacattcccagcctgcgacggaagtcacaataagcacaatgagctgactggggacaatgtagggcctctgattctgaagaaaaaggaggtctag

SEQ ID NO: 217729 - DNA, 384 bp, Artificial Sequence
  Description of Artificial Sequence: Synthetic coding sequence
atgaggggggcaggcgctatcctacggcctgctgcccgtggcgcaagggatctgaatcccaggagggacatcagctcatggctggctcagtggttccctcggacccccgcaaggtcagtggtggctctgaaaactccgattaaggtggagctagtggctgggaagacctatcgctggtgtgtatgtggccgatcaaaaaagcagccgttctgtgatgggtcccatttttttcaacgtacgggcctctctccactgaagtttaaggcccaggagactcgtatggtggccctttgtacgtgtaaggcaacacagcgccctccatactgtgatggcacgcaccggtccgagcgcgtgcagaaagcagaggtcggctccccgctctag

SEQ ID NO: 217730 - DNA, 1740 bp, Artificial Sequence
  Description of Artificial Sequence: Synthetic coding sequence
atgccctcagcttcctgcgacacactcctcgatgatattgaggacatcgtttcccaagaagatagtaaaccacaggatcgccacttcgttcggaaggatgtggttccgaaggtccgcaggagaaacacacagaaatatctccaagaggaggagaatagccctccaagtgatagcactataccgggaatacagaagatttggatcagaacatggggatgtagccacaacaatagtgacggggagtatatggccggacagctggctgcctatgggtacaaaataaccgagaatgcgagtgatgccgacctgtggctcctgaatagttgtaccgtgaaaaaccccgctgaagatcactttagaaactctattaaaaaggctcaggaggagaataagaaaatcgtcctggccggttgcgtgccccaagcccagccacgacaggactatctgaaggggctgtctatcatcggcgtacagcagatcgacagagtggttgaggtcgttgaggaaaccattaagggccactcagtccggcttctgggtcagaagaaggataacggcagaagactcggcggtgctagactggacttgcccaaaattaggaagaaccccctcatcgagatcatcagcattaacaccggctgccttaatgcttgcacttactgtaagactaagcatgctcgaggtaatctggcttcctatcccatcgacgagctcgtggatcgcgcaaagcaaagctttcaggagggggtctgcgaaatctggctgacctcagaggatactggcgcttatgggagagacattggaaccaacctacccaccctactgtggaagctcgtggaggtcatcccagagggagctatgctgcgccttggaatgacaaatccaccatacattctcgagcatcttgaggagatggcaaagatactgaatcatcccagggtttacgcgttcttacacataccggtacagtctgcatctgactcagtgctgatggaaatgaaaagagagtattgtgtggccgacttcaaacgagtggtggatttcttaaaagagaaagtccctgggataactatcgccacggacatcatctgcgggtttccaggagagaccgaccaagactttcaggaaacagtcaagctggttgaggaatacaaattcccaagtctgtttattaatcagttttatccgagaccgggtacacccgctgcaaagatggagcaggtgccagcccaggtaaaaaaacagcgtaccaaggatttgagccgagtattccatagttactctccctatgaccacaaaattggagaacgtcagcaggtacttgtcactgaggagagctttgactcaaaattttacgtggcacataaccaattttatgaacaagtgcttgtgcccaaaaatccagccttcatgggaaagatggtggaggttgacatatacgaatctggaaaacattttatgaagggacagccggtctccgatgcgaaggtctacactccttctatatctaagcccctggcaaaaggcgaagtgagcggactcacaaaggattttcgcaatggcctgggcaatcagttgtccagtggctcacacacgtctgccgcaagccagtgcgacagcgcttctagccgcatggtgctccctatgcctcgactacaccaggactgcgcgttgcgaatgagcgtgggactggcattgctggggttgttatttgcatttttcgtcaaggtttacaactag

SEQ ID NO: 217731 - DNA, 1740 bp, Artificial Sequence
  Description of Artificial Sequence: Synthetic coding sequence
atgccaagcgccagctgtgatactttgcttgatgatattgaggatatcgtgtcacaggaggactccaagccccaagacaggcacttcgtgcgaaaagacgttgtccctaaggttagacgacgtaacacgcagaagtatctgcaggaagaggagaatagtcctccatctgattccacaattcccggtatacagaaaatctggatcaggacgtggggctgctcacacaacaactccgacggtgagtacatggcgggtcagctcgccgcatatggctacaaaatcaccgagaacgccagcgacgccgatctctggctgctcaatagttgtaccgtcaagaatcctgcagaggatcacttccgcaattccattaagaaggcacaggaggaaaacaaaaagatcgttttggccggttgcgttcctcaggcccaacctcgccaagattacctgaagggactaagcataattggcgtgcagcaaatcgacagggttgtggaggtcgtcgaagagaccataaagggccactccgttcggctgcttggacaaaaaaaagacaacgggaggaggctgggaggtgcgcgtcttgacttacccaagatacggaagaaccccctgattgagattatttctatcaacaccggctgcctgaacgcctgcacatactgtaagactaaacatgctaggggcaacctagcgagctaccctatcgatgagttggttgatcgcgcaaagcagagcttccaagaaggggtatgcgagatttggctcacttccgaggataccggcgcttatggtcgagatatcgggactaacctgcccaccctcctgtggaagctggtggaagtgatccccgaaggggcaatgctacggctcggcatgacaaatccaccttacattctggaacaccttgaagagatggccaaaattctgaaccaccctcgggtgtacgcctttctccatataccggtgcagagtgccagtgactccgtgttgatggagatgaaaagagagtactgcgttgccgactttaagagggtggtggacttcctgaaggagaaggtacccggaatcactatcgcgaccgacattatctgtggtttccccggagaaacagaccaggatttccaggaaacggtgaagctggtggaggaatacaagtttccctccctctttatcaaccagttttaccccagacctgggaccccggctgctaaaatggagcaggtcccagcacaagtgaaaaagcagaggaccaaggacttgagtcgggttttccattcctactcgccttacgatcacaaaatcggcgagaggcagcaggttctagtgaccgaagaatccttcgacagcaaattctatgtggcccataatcagttctacgaacaagtgctggttcctaaaaatcccgcatttatgggaaaaatggtggaggtggacatctacgagtccggcaagcacttcatgaaaggacagcctgtatctgatgcaaaagtctatactccctctatttctaagcctttggctaaaggtgaagtgtctggtctgacgaaagacttcagaaatggcctcggaaatcagttatcttccggcagccacacttccgcagccagccaatgcgacagtgcaagttctagaatggtactgcccatgccaaggcttcatcaggactgcgctttgcgcatgagcgttggccttgccctcctggggctgttgtttgcgtttttcgtgaaggtgtataattag

SEQ ID NO: 217732 - DNA, 1467 bp, Artificial Sequence
  Description of Artificial Sequence: Synthetic coding sequence
atgctcagtagaagatatgaaggagagatccctaaaaacatctgcaaacgcaagaagaccgtgcaccaggtgacggagaacgcttctgatgctgacctgtggttgctcaacagctgcactgtgaaaaatccggcagaagaccactttcggaattctatcaagaaggcccaggaagagaacaagaaaattgtcctcgctgggtgcgttcctcaggcccagccccgtcaggactatctgaaaggtctgtcaattatcggcgttcaacagatagatcgggtcgtggaagtggtggaagagactatcaagggacactccgtgcggctcctcggccagaagaaggacaatgggaggaggctggggggagcccgtctggacctacccaagattagaaaaaacccactgatcgagattatctctatcaataccggatgcctgaacgcctgtacatattgcaagaccaaacacgcccgaggtaatttagctagctaccccattgacgagctcgtcgacagggctaaacagtcttttcaggaaggggtctgcgaaatatggttaaccagtgaggacacaggtgcctacggacgcgatatcgggactaacctgccaaccttgctgtggaagctggtggaagtcatcccagaaggcgcaatgttgcgtctgggtatgaccaaccctccgtacattttggaacacctagaagaaatggctaaaatcctaaatcacccaagggtgtatgcattcctccacatcccagtacagagtgcctccgatagtgtcctcatggagatgaagcgagaatactgcgtagcagattttaaacgtgtggtcgactttctgaaagagaaagtccccggaattaccattgcgaccgacatcatctgtggatttcccggtgagacggaccaggactttcaggagaccgttaagctggtcgaagaatataagttccccagtctgtttatcaatcagttttacccacggccaggtacccccgcagccaagatggaacaggtgcctgcccaagtgatcggcgaaagacagcaagtgctcgtgaccgaggagtcgttcgattctaagttttacgtagcacataatcagttctatgaacaggtcctggtgccaaagaaccccgcttttatgggaaaaatggtcgaggtggatatctatgaatcgggcaagcacttcatgaaagggcagccagtgtcggatgctaaagtttacaccccaagtattagcaagcccctggctaaaggggaggtgtccggcctgacgaaggatttcagaaacggcctgggaaaccagttgtcaagtggatcacataccagcgccgctagtcagtgtgattcagcatcttcccggatggtgctccccatgcccagattgcatcaggattgcgctttgcgcatgagcgtcggtctggcgctgctgggtcttctgttcgccttctttgtcaaggtgtataattag

SEQ ID NO: 217733 - DNA, 4824 bp, Artificial Sequence
  Description of Artificial Sequence: Synthetic coding sequence
atgatggatctcgtcctggaggaagatgtcaccgtgcctggcaccctaagcggatgctccggtttggtaccttccgtgccagacgacctagacggtatcaatccaaatgctgggcttggtaacgggctcctgccaaacgtgagcgaagagacagtgtcgcccacacgtgcccgaaatatgaaagacttcgaaaaccagattacggagctgaagaaggagaactttaatctcaaactgagaatctactttctggaagagagaatgcagcaagagtttcatggcccaactgagcacatttacaaaaccaatatcgagctcaaggtggaagtagagtcgctcaaaagagagctacaagaacgggagcagctgcttatcaaagcaagcaaggccgtcgaatccctagcggaggccggagggtccgagattcagagagtgaaagaggatgctagaaaaaaggtgcaacaggttgaggatctcctgaccaagcggattctgctcctggagaaggctaaggacgttaccgcagcacaagcagaactggagaaagcgttcgccggaactgagactgagaaggcccttcggctgagactggagagcaagctgtctgagatgaagaagatgcacgaaggagatttagctatggccctggtcctggacgaaaaggatagactaatcgaagaacttaaactctccctcaagtccaaggaggccctgattcaatgtctgaaggaagagaagagccagatggcatgccccgacgagaacgtgagttctggcgagcttaggggcctttgcgccgctcccagagaagagaaagagagggagaccgaagctgcccagatggagcaccagaaggagagaaactccttcgaggagcgcatccaggcattggaagaggacctccgcgagaaagaaagggaaatagccaccgagaagaaaaatagtctgaagagagacaaggctatccaaggccttacaatggcacttaagtccaaagagaagaaagtggaagagctcaatagtgaaatcgagaagctgtctgccgcttttgccaaggccagagaggctctgcaaaaggcccagacacaggaattccaaggcagcgaagactatgagactgctcttagcggcaaggaagcgctcagtgccgctctgcggtctcagaatctaaccaagtccactgagaatcacaggctgcggagatccatcaagaaaatcacgcaggagctatccgatttgcagcaagagcgagaacgtctggaaaaggatcttgaggaggcacatcgcgagaagtctaaaggagattgtaccatcagggacctccgtaatgaggtcgaaaagctacggaatgaagtaaacgagcgggagaaagccatggagaaccggtataagtcgctcctgtcggagtctaataagaagctccacaatcaggagcaagtcataaagcacctgaccgagagcactaatcagaaggacgtgcttctgcagaaatttaatgaaaaagatctggaggtgattcagcagaactgctatttgatggctgctgaggacctggaactgagaagcgaggggctcattaccgaaaagtgctcttcccagcagccccctgggtctaagaccattttttcaaaggagaaaaagcagagtagcgattacgaagagctaattcaggtgctgaaaaaggaacaggacatctatacccatttggtgaaaagccttcaggaaagtgacagcatcaacaatttgcaagccgaattgaataagatcttcgcacttaggaaacaactcgaacaggacgtcctcagctaccagaacctgcgtaaaaccctcgaagaacagattagtgagatccgccgaagggaggagtcgttttccctgtacagtgatcagacaagctacttatcgatctgcctcgaggagaataatagatttcaggtggaacatttcagccaggaggagttgaaaaagaaggtttcagacctaattcagttggtgaaggagctctataccgataaccagcatctgaaaaagaccatttttgatctgtcgtgcatgggcttccaaggaaacggtttccctgacagattagcctctactgaacagacagaggaggctaagaagagtcgcctgccgatcctgatcaaacccagccgatcattggggaatatgtacaggctgccagcaacccaggaggtcgtcacacagctgcagtcgcagattctggagctgcagggggagttaaaggagttcaaaacttgtaataagcagttacaccagaaactcatcctggcagaagctgtaatggaggggcgacctacacctgataagacgctgctgaacgcacagccacccgtgggtgcagcctatcaggattcacctggcgaacagaagggcatcaagactacgtcctccgtgtggcgcgacaaagagatggacagtgaccagcagcggagttacgaaatcgactcagaaatttgcccacctgacgatctcgccagtcttcccagttgcaaggaaaatcctgaggatgtgctcagcccaacttccgtcgccacttacctcagctctaaatcccagccaagcgccaaggtgtctgtgatgggcacagatcagtctgagagcataaatacgagtaacgaaaccgaatacctcaagcaaaaaatccacgacctcgaaactgaactagaagggtaccagaacttcatatttcagctgcaaaaacacagtcaatgttccgaggccatcatcacagttctgtgtgggaccgaaggcgcacaggacggcctaagcaagcctaagaacggctcggatggcgaggagatgacattctcatccttacaccaggtgcgttatgtaaagcacgtgaaaatcctgggtcctctggcgccagagatgattgatagtcgagtgctcgagaacctcaagcagcaactggaagagcaggaatacaagctgcagaaggaacagaacttgaacatgcagttattctcagaaatccacaatctccagaataaatttagggatctgtcgcctcccaggtatgattcgctcgtgcagtcacaggcccgtgagctgtctctccagcggcaacagataaaagatgggcatggtatctgcgtcatcagccggcagcatatgaacacaatgatcaaggcctttgaagagctcctgcaggcatctgacgtcgactactgcgtggcagaagggtttcaggaacagctgaaccagtgtgccgagttgttagaaaagcttgagaagttgttcctgaacgggaagtcagtgggcgttgagatgaacacccagaatgagcttatggaacgtattgaagaagataacctcacgtatcagcacctactgcccgaatccccagagccatctgctagccacgctctttccgattatgagacctctgaaaagagctttttctccagagaccagaagcaagacaacgagactgagaagacaagcgttatggtgaatagctttagtcaggacctccttatggagcacatccaagagattcgtaccctgcggaagagattggaagaatcgatcaaaacgaatgaaaagctgaggaagcagctcgagaggcaaggttctgaattcgtgcagggctctacttctatctttgctagtggctccgagttgcattctagcctcacctcagaaatccattttctccggaaacagaaccaagccctcaacgccatgcttattaagggctctagggataagcagaaagaaaatgataaactgagggaatctctctctagaaagaccgtatcactggaacatttgcagagggagtacgccagtgtgaaggaagaaaacgaaagattgcagaaagagggatcagagaaggaaagacacaatcaacagttgatccaggaagtgaggtgcagcgggcaggagctctcacgtgtacaggaagaggtgaagctgcggcagcaactactatcccaaaatgacaaactcctccaaagtctgagagtcgaactgaaagcctacgagaaattggacgaagagcacaggagattgcgagaagcttccggggagggatggaaaggtcaggatcccttccgtgatctgcatagcctactcatggagatccaggccctgcggctacagctcgaacgctcaatagaaacaagtagtaccctgcagtcaaggctcaaagagcagctcgcgagaggagcagagaaggcccaggaaggcgcactaactctggcagtgcaggccgtgagcatccccgaggtgcccctccagcctgataagcacgatggggataagtacccaatggaatcagacaatagcttcgacctctttgactcgtctcaggccgtcacgcctaaatcagtgtcagagaccccacccctgtcagggaatgatactgattccctgtcttgcgactccggatcctcagctactagtacaccttgtgtgagccgcctagttacaggccaccacctgtgggctagcaagaacggtaggcacgtgttagggctcattgaagactatgaagctctgctgaagcagatcagtcagggccaacgcctgcttgccgagatggatattcaaactcaagaggctccgagtagtacctctcaggagctgggaactaagggaccccaccctgctccattatcaaaattcgtgagttccgtctctacggcaaaactgacactcgaggaggcctatcggcgactaaagctcctgtggagggtgtccctgccagaggatggccagtgccccctgcattgcgaacagattggagaaatgaaggctgaggttactaagctccataaaaaattgaagaagtcctag

SEQ ID NO: 217734 - DNA, 5681 bp, Artificial Sequence
  Description of Artificial Sequence: Synthetic coding sequence
atgatggatctggtccttgaggaagacgtgactgtccctgggactctaagtgggtgcagtggcttggtgccctctgttcccgatgatctggatgggatcaaccctaatgccggactaggcaatggcctcctgccaaacgtttctgaagaaactgttagtccgacacgtgcccgtaatatgaaagacttcgaaaatcaaatcacagagctgaaaaaggaaaactttaacctaaagctgaggatttactttctcgaagagaggatgcagcaagagttccacgggccaacagagcacatttacaaaaccaatatcgagcttaaagttgaagtggagagcctcaagcgcgagttacaggaacgggagcaattgcttatcaaagcatctaaagccgtggaaagcctcgctgaggccggaggcagtgaaatccaacgagttaaggaagacgccaggaagaaggtgcaacaagtcgaggacctactgacaaaacgcatcctactcctggagaaggacgtaactgctgcgcaggcagagctggaaaaggccttcgcaggtaccgaaactgaaaaagctctgcgcctccgcttggagagtaagctgtccgagatgaaaaagatgcacgagggtgatctggcgatggcactggtgctggatgagaaggatcgcttaattgaagaactgaagctgtcattgaagtctaaagaggctttaattcagtgcttgaaggaagaaaaatcacagatggcatgtcctgacgaaaacgtttcatccggcgaacttcggggactctgtgctgctcctcgcgaagagaaggagcgagagactgaagccgcacagatggagcaccagaaggagcgtaatagcttcgaggagcgcatccaggcgttggaagaggacctgcgcgaaaaggagcgagagatcgccactgaaaagaagaattcactgaaacgcgataaggcgattcagggtttaacgatggcgttaaagagcaaagaaaagaaggtggaagaactgaacagcgagatagaaaagctcagcgccgcttttgctaaagctagggaagccttacaaaaggcccaaacccaggaattccagggatcagaggactacgaaactgctctaagcggaaaagaggctttgtctgccgctctaaggagccagaatctcacaaagagcaccgagaaccaccggctgagaagatcaatcaagaaaataacacaggagttgagcgacttacagcaggagagggagagattggaaaaggaccttgaagaggctcatagggagaagtccaagggtgattgtactatcagagacctccgcaacgaggtggaaaaattaagaaacgaggtgaatgaaagggaaaaggctatggagaaccggtataagtcactcctctctgagtctaacaaaaaactgcataaccaagagcaggtgattaagcatttgacagaaagcacaaatcaaaaggatgtcctgctgcagaaatttaacgagaaggacctcgaggtgatccagcagaactgttatttgatggctgctgaagatttagagctcaggtccgagggccttataaccgaaaagtgctcgtctcagcagccaccaggttctaaaaccatcttctccaaggagaaaaagcaatcgtcagactatgaagaacttattcaagtgctgaagaaagaacaggacatttacacacatttggtgaagtccctccaggagagcgactctatcaataacctgcaggccgaactgaacaaaatatttgccctgcggaaacagttggagcaggatgtactgtcataccagaacctccgaaagaccctggaggagcaaatttccgaaattagacggagagaggaagagagctttagcttatattccgaccagacctcatatctgtccatttgcctggaggaaaacaacaggttccaggtcgagcatttctcccaggaagagctcaaaaaaaaagtgtctgacctgattcagctagtcaaggagttgtacacagacaatcagcatctgaagaaaactatttttgacctatcctgtatgggattccaagggaatggattccctgatcggcttgcctcgaccgagcagacggagcttctggcaagcaaggaagatgaggatacaataaagatcggggaggacgatgagatcaattttctgtcagatcagcatcttcagcagtctaatgagatcatgaaggacctctccaagggcggatgcaaaaatggttacctaaggcacacggagagtaagatcagcgactgcgacggcgctcacgcaccaggctgcttagaagaaggagcctttatcaatctcttggcaccattgtttaacgagaaagcaacactgttactagagtcccggccagatctcttaaaggttgtgagggagctattgcttgggcagctattcctaactgaacaggaagtttcaggggagcacctggatgggaagaccgagaaaacaccaaaacagaagggggaactggtgcactttgtgcagactaacagttttagtaaacctcacgacgagctgaagctcagttgcgaggctcagctggtgaaagcaggggaagtgccaaaagtagggctgaaagacgccagcgttcagaccgtcgcaacggagggagacctgctgcgctttaagcacgaggccaccagagaggcctgggaggaaaagcccataaatactgcgttgtccgccgagcacagacctgaaaacctacacggtgtgcctggctggcaggcagcactgctgtctctccctggaattaccaatcgggaagccaagaagtctcgactgcctatcctaattaagccaagtaggtctctgggcaacatgtaccgactgcccgctacccaggaagtggtgacgcagctgcagagccagattctcgagttgcagggggagctgaaggaatttaaaacttgcaataagcagcttcatcaaaaattgatcttagccgaggctgtcatggaaggacggccaactcctgataagaccctgttaaatgctcagccaccggtcggggcagcctaccaagactccccgggagagcagaaggggattaagacaacaagctctgtatggagggacaaggagatggactccgaccagcaaaggtcctacgaaattgattccgagatttgcccccctgatgacttggcctcactcccctcatgcaaggaaaaccctgaggatgtgctctctcccaccagcgttgctacgtatctcagcagcaagtctcagccgagtgcaaaagtttcagtaatgggcaccgaccagtcagaatccatcaacacctctaacgaaactgagtatctgaaacagaagattcacgatctggagaccgaactcgaaggctaccagaatttcatcttccagttgcaaaagcactcccaatgctccgaagcaatcattaccgtcttgtgtgggaccgaaggcgctcaggacgggctctccaagccaaaaaacggatcagacggagaggaaatgacgttttcctccctacatcaggtgcgctatgtgaaacacgtaaaaatcctggggccactggcccctgagatgattgactctcgggtcctggagaatctcaaacaacaactggaagagcaggaatataaattgcaaaaggagcagaatcttaacatgcagctgttctctgagatccataacctccagaacaagttccgggatcttagccccccacgatatgacagcttggtccagagccaagcgagggaactcagcctgcagcggcagcaaatcaaggacggacatggcatttgcgtgatctcccgccaacacatgaacactatgataaaggcatttgaagaactgctgcaggcctccgacgtcgactactgcgtggccgaaggattccaggaacagctcaatcaatgtgcagaattactcgagaagcttgagaaactgttcctcaatggaaagagcgtgggcgttgaaatgaacacgcagaatgaactgatggaaaggatcgaagaagataacctgacataccagcacctcttaccggaaagtcctgagccatcagctagtcatgccctgtcagactacgagacctcagaaaaatctttctttagcagggaccagaaacaagacaatgaaacggagaaaactagtgtgatggtcaactcttttagccaggacctcttaatggagcacatccaggagattaggaccctgcgcaaacgcctcgaggagagtatcaaaaccaatgaaaaattacgcaagcagttagaacgtcagggctcggagtttgtgcagggctccacctcaatcttcgcttcagggagtgagctgcactcatccctgacatctgaaattcattttctgcgcaagcaaaaccaagcactaaacgccatgctgattaaagggagtagagacaagcaaaaagagaatgacaaactgagagaatctctgagtaggaaaactgtatctctggagcatcttcaacgcgagtatgcaagtgttaaagaggagaatgaacgcttacagaaggagggaagtgaaaaagaacggcacaatcagcagctcatacaagaagtccgatgttctggtcaagaattgtcccgcgtgcaggaggaagtcaagttacggcaacagttgctgagtcagaacgataagttactgcaaagtctcagggtcgagctgaaggcttacgaaaaactggatgaggagcaccgccgtctccgagaggcatctggcgaggggtggaagggccaagatcccttcagagatctccactcgctgttgatggaaattcaggccctgcggctccagttagaacgcagcatagaaacatccagcactcttcagagccggctcaaagaacagctagcgcgtggcgcagagaaagcccaggagggagcactgaccctggcggtccaagctgtctcaatccccgaggttccactccagccagacaaacacgatggcgacaaataccccatggagagcgataactcatttgatctgttcgattccagccaagcagtgacacctaagtcagtttccgagactccaccgctgtccggcaacgatacggactctctgtcttgtgacagcggtagttctgcaaccagtacaccctgcgttagcaggctggtcactggacaccatctctgggcatctaagaatgggaggcacgttctaggcctgattgaagattatgaggcacttctcaaacagatatcccaaggccagagactcctggcagagatggacattcagacccaggaagctcctagctctacttctcaggagctgggtaccaaaggccctcatcctgccccactatccaaatttgtatcttctgtctcaactgctaagcttacactggaagaggcctatcggcgactcaaactactgtggcgagtcagcctgcctgaggacggccagtgtcccttacattgcgagcagattggagagatgaaagccgaggtcactaagctccacaagaagttgtttgagcaggagaagaaattacagaatacaatgaaactgctgcagctatccaagcgacaggagaaggtgatttttgatcagctggttgtcactcacaagatactgaggaaagcccgtggcaatctggagctaaggccgggtggcgctcaccctggcacctgcagcccatccaggccaggcagtta

SEQ ID NO: 217735 - DNA, 5558 bp, Artificial Sequence
  Description of Artificial Sequence: Synthetic coding sequence
atgatggacttagtgctggaagaggacgtgacagtgccaggtactctgagtgggtgcagcggcctagtgccctctgttcctgatgatctggacggcatcaacccaaatgccggattgggtaatgggttgctgcctaacgtatctgaagagaccgtgtcccccacacgggctcggaacatgaaagacttcgagaaccaaatcaccgagctgaagaaagaaaatttcaatctcaaattgcggatctattttctggaagagcgcatgcagcaggagttccatggtcccacagaacatatctacaagactaatatcgagctcaaagtcgaagtggaatcacttaagagagagctgcaggagcgggaacagctgcttataaaagcttcaaaagcagtggaatctttagctgaggccggtgggagcgaaatccagcgggttaaggaggatgccagaaagaaagtgcagcaagtggaggatctgcttacgaagcgcatcttgctcctggaaaaggatgtgactgccgcacaagcagagctcgaaaaggccttcgccggaactgagaccgagaaggcactgcggcttcggttagaatccaagttgtctgagatgaagaaaatgcacgaaggagacttggcaatggccctggtgttggacgaaaaggatcgcctgattgaagaacttaagttgtcccttaagagcaaagaggccttgatccagtgcctcaaagaagaaaagtctcagatggcttgtccagacgagaatgtgtcctcaggcgagctgcggggtctatgcgcagccccacgtgaagaaaaggaaagagagaccgaagcagcccaaatggaacatcaaaaggaacggaattctttcgaggagcggatccaggctctggaggaagatcttagagagaaagaacgggaaatcgctactgagaagaaaaattcattaaagcgagacaaggcaattcaaggacttaccatggcgctgaagagtaaggaaaaaaaagttgaggaattaaactctgaaatcgaaaagctgtctgcggcatttgccaaggcacgggaagctctccagaaagcccaaactcaggagttccaaggatcagaggattacgaaactgctttgtccggcaaagaagcactgagcgctgccctgagaagtcagaacttaacgaagtcgaccgagaatcatcgcctgcggcgatcaatcaagaagattacccaggagttgtccgaccttcaacaggagcgggaacgtctcgaaaaggatttggaggaggctcacagggaaaaatcgaaaggggattgcactataagggatctgcgaaatgaggtcgagaagcttcgcaacgaagtgaatgagcgcgagaaggcaatggaaaatcgctataaatctcttctttccgaatctaacaaaaagctacacaatcaggagcaagtgattaaacatttgaccgaaagcaccaatcagaaagatgttttactgcagaagtttaatgaaaaagatctggaggtcatccagcagaattgttatctgatggctgcagaagatttagaacttcggtcagagggcctcataaccgaaaagtgttcttcgcaacaaccgccaggatctaagaccatttttagcaaggagaagaagcagagcagtgactacgaggaactgatccaggtactgaaaaaagagcaagatatttatacccacctggtaaaaagcctgcaggagtcagacagcattaacaatctgcaggccgagttgaacaagatctttgccctgcgcaagcaactggagcaggatgtcttgagctaccagaacctgcggaaaactctggaagagcagatcagcgagatcaggaggcgcgaggaagagtcttttagtctgtattccgatcagacatcctatctcagtatttgtttggaagagaataacagatttcaggtggaacactttagtcaggaagagctgaagaagaaagtgtcagacctgatccaactcgtgaaagaattatacacagacaatcagcaccttaagaagacaatcttcgatctgtcttgcatgggtttccagggaaatggttttcctgataggctggcgtcgacagagcaaaccgagcttcttgcaagtaaagaggacgaggacacaattaagatcggagaggacgatgagattaatttcctaagcgatcaacacctccagcagagcaatgagatcatgaaggacttatcaaagggaggatgtaagaatggatacctgcgccacactgaaagtaaaatatctgattgtgatggagcccacgcccctggttgtctcgaagaaggagccttcatcaacctgttagctcccctgttcaacgagaaggccactctgctgttggagtctaggccggacttactgaaggtcgtccgcgagctcctgctagggcaacttttcctcaccgagcaagaggttagcggggagcacctagatgggaagaccgagaaaacccccaagcagaagggcgaacttgttcattttgtgcagactaactccttctccaagcctcatgatgaactaaagttgagctgtgaggcccagttggtgaaggccggagaagtaccaaaagtcggactgaaggacgcctcagttcagaccgtggccaccgagggggacctgttgcgatttaaacatgaagccacacgggaggcctgggaggaaaaacccatcaacacggctctgtctgccgagcatagaccggaaaatctgcatggcgtgcctggttggcaggctgcattgctgagcctgccagggattactaatcgggaggctaaaaaaagcaggctcccaatcctcattaaaccaagccgctcactgggaaacatgtatagactgccagcaacacaggaagtggtgacacagctgcagtcacagatcctagagttacagggagaattgaaagaattcaagacctgcaacaagcaacttcaccagaaactgatcctcgccgaggccgtcatggaaggacgccctacaccggacaagacactgttgaacgacagcgagatctgccctcctgacgacttagcgtccctgccgagctgtaaggagaatcccgaagacgtgttaagccccacgagtgtggccacctatttaagttctaagagtcagccctctgctaaggtcagcgtgatgggtaccgatcagtccgagagcattaataccagcaatgaaaccgagtacttgaagcagaagatccatgatcttgaaaccgagttggaagggtaccagaactttatcttccagctccaaaagcattctcagtgctcagaggccattattaccgtgttatgtggaactgaaggcgctcaggacgggctgtccaagcctaaaaacggcagcgacggggaggaaatgactttttcttctctacaccaggtgcgctatgtcaagcacgtgaagatcttaggtcccctcgcccctgaaatgatcgatagcagggtgctcgagaacctcaaacaacaactagaggagcaagagtataagctgcagaaggagcaaaacctgaacatgcaactgttcagtgaaatacacaacttgcaaaacaaatttagagacctgtcccccccaaggtatgattctctggtgcaaagtcaggcccgtgaactgtctcttcagaggcagcagatcaaagacggccatggcatctgcgtgatctccagacagcacatgaatactatgatcaaggcattcgaggagctgctccaagccagtgatgtggactactgtgtcgcagaggggtttcaggaacaactgaaccagtgtgccgagctcctagagaagctggagaaactgttcctgaatggcaaatcagtgggagtcgagatgaacacccagaatgagctgatggagcgcatcgaggaagataacttgacctaccagcacctactgccagaaagccccgagcctagcgcttcgcacgctctgtccgactatgaaacaagcgaaaagagtttcttttccagagaccaaaagcaggataatgaaaccgaaaaaaccagtgtgatggtgaattcttttagccaggacctcctgatggagcacatccaggagatccgcactctcagaaaacggctggaggagtcaattaaaaccaacgagaagctgcgcaagcaactggagcgccaaggctcagagttcgtgcagggaagcaccagtatctttgcatccggtagtgaactgcacagcagcctcacatctgagatccactttctgcggaaacagaatcaggccctgaatgcaatgttgatcaagggcagtcgcgacaaacagaaagaaaacgataagctacgcgagtcgctttcgcgtaaaactgtttctttggaacacctgcaaagagagtatgcatctgtaaaggaggagaacgaaagactgcagaaggaggggtcagagaaggagaggcataaccaacagctcatccaggaggtgcgttgtagtgggcaggagctctctcgtgtgcaggaagaggtgaaactcagacagcagttactctcacagaacgataaattactgcagagcctgcgtgtagaactgaaagcctacgagaagctcgatgaagagcaccgcaggttaagggaggcatcgggagagggatggaagggccaggacccttttagggacctgcattccctcctgatggagattcaggccctgaggcttcagctggagaggtcgatagagacaagctcaactttgcagtcaaggctcaaggaacagctggccaggggtgccgaaaaagctcaagagggagcactgacactggcggtccaggcagtgtccatccccgaggtacctctccagccggacaagcatgatggcgacaagtacccaatggaatcagataacagtttcgacctttttgattcttcgcaggcagtgaccccaaaaagcgtgagcgaaactcctccactcagtggaaacgatactgattctctgagttgtgattctggcagttccgccacttccacaccttgtgtgtcccgactggttaccggacatcacctgtgggccagcaagaacgggagacatgttctgggactgatcgaagattacgaagccctgctgaaacagatctcccagggtcagcgcctcttggccgagatggacatccagactcaggaagcaccttcctccacgtcgcaagaactggggactaagggccctcatcccgcaccgctctcgaagttcgtttccagcgtaagcaccgcaaagctcacactagaggaggcttataggaggttaaaactcctgtggcgcgtgtcacttcccgaggatgggcagtgccccctccactgtgaacagatcggcgagatgaaggcagaagtgacgaagctgcacaagaaactcttcgaacaggagaagaagttgcaaaacactatgaagcttttgcagctgtcaaaaagacaggagaaggttatctttgatcaattggtcgtaacgcacaaaatccttcggaaggccagaggtaacttagagcttcgacccggaggagcccaccccggaacctgttcaccatcccgtcccggatcata

SEQ ID NO: 217736 - DNA, 5444 bp, Artificial Sequence
  Description of Artificial Sequence: Synthetic coding sequence
atgatggatctcgttttggaggaggatgtcacagtaccaggcacgctgtccgggtgctcaggtttggtaccaagcgtgcccgatgacctggacggaattaacccaaacgctggcctgggaaacggactcttgccaaacgtcagcgaagagactgtcagccctacgagggctagaaatatgaaggactttgagaaccaaatcacagagttgaaaaaggagaattttaatttaaaactaagaatttacttcctggaggagaggatgcagcaggagtttcatggtcctacggagcatatctacaaaacaaatattgaattaaaggtcgaagtagagtctttgaagcgggagctgcaggaacgggagcaactacttataaaggcaagcaaagccgtcgagtctttggccgaggctggcggatccgagatacagcgtgttaaggaagatgctagaaagaaagttcagcaggtggaggatttgttgacgaaacgtattctgctccttgagaaggatgtcaccgccgcacaggcagagttggagaaagcctttgccggaacagaaacggagaaagctctgcggctgaggctagaatccaaactgagcgagatgaagaagatgcacgaaggggacctagcaatggctctcgttctcgacgagaaagaccggctaatcgaagagctgaagcttagtctgaaaagtaaggaggctctaattcaatgtctgaaggaggaaaaaagccagatggcctgtccagacgagaacgtttcgtccggtgaacttcgcggactgtgtgccgctccgagagaagaaaaggagcgggagaccgaggctgcacagatggaacatcagaaggagcgcaattccttcgaggagcggatccaggccctagaggaggacctccgggagaaagaacgcgaaattgcgacagaaaagaagaatagcctgaagcgcgataaggctatccagggcttgaccatggccttgaagtccaaagaaaagaaggtggaggagctgaattcggaaatcgagaagttgtccgcagccttcgcaaaagctcgcgaggcactgcagaaagcccagacacaggagtttcaagggtccgaagactatgagaccgccctgagcggaaaagaagctctgtccgcagcccttcggagccagaacctgactaagagtacagaaaaccataggctgcggcgtagtatcaaaaaaatcacgcaggaactcagtgacctgcaacaggaaagggagaggctggagaaggacctcgaggaggcccatagagagaaaagcaagggcgactgtactatcagggatctccgcaatgaggtggagaaactgagaaacgaggtcaatgaaagggagaaggccatggaaaatagatataaaagcctattatcagagtccaacaaaaagctgcacaatcaggagcaggtgataaagcatctgacagagtcaaccaatcagaaggacgtcttgttgcagaagttcaatgagaaggacctggaggtcattcagcaaaactgttatctgatggccgcagaagacctagaactgaggtccgagggactaatcacagaaaagtgcagctctcaacagccaccgggtagcaagactattttctccaaggagaaaaagcaaagctcagattacgaagaactcatccaggtattgaagaaggagcaggatatctatactcacctggtcaagagtttgcaagaatctgacagcattaacaacctgcaggctgaattgaataaaatctttgccctgaggaagcagctggagcaggacgtgctttcataccagaatctcaggaagactctcgaggagcagatctccgaaattaggcggagagaagaggagagctttagcttatattcagatcagacctcatacctgtctatctgcttagaagaaaataatcgcttccaagtcgaacatttctctcaagaagaactgaaaaagaaggtgtccgatctcatccagctagtgaaggagctgtacaccgataaccagcaccttaagaagacaatttttgacttgtcttgcatgggattccaaggcaatggctttcccgacagactcgcctctaccgaacagactgagctcctcgcctccaaggaggacgaagacacgattaagattggcgaggacgacgaaattaactttcttagtgaccagcatctgcagcagagcaacgagatcatgaaagatctgagtaaaggaggatgcaaaaacggctatctcaggcacacagagtcaaagatttccgactgtgatggcgctcatgcaccgggttgcctcgaggagggtgcgtttatcaacctgttagcacccttgttcaacgagaaagctacattgttgcttgagtcgcgaccggatttgctcaaagttgtgagggaattgcttctggggcaactgtttctgacggagcaggaggtgagtggcgaacaccttgacggcaagaccgaaaagactcccaagcagaaaggcgaattggtccatttcgttcagactaattcattctcgaaaccccatgatgagttgaaactctcctgcgaggctcagctagtcaaagccggtgaagtgccaaaggtgggcctcaaagacgccagtgttcagacagtcgccactgagggcgacctcctgcgcttcaaacacgaggctaccagagaggcctgggaagaaaaaccaatcaatacagcgttatccgcagaacacaggcctgagaatctgcatggggtacccggatggcaggccgcactgcttagcctgccaggtatcacaaaccgggaagctaaaaaaagccgcctgcctattcttattaagcccagtaggtcactcggcaatatgtacaggctgcctgccactcaggaggtggtgactcagttacagagtcaaattctagaactacagggcgaactcaaggagttcaagacctgcaataagcagctgcaccaaaagctgatactggccgaggccgtcatggagggccgacccaccccagacaaaaccctgctgaatgcgcagccgcctgttggcgctgcttatcaagactcaccaggcgagcaaaaagggattaaaaccacaagttccgtttggagagacaaagagatggacagtgatcagcaaagatcttacgaaattgatagtgaaatctgtccccctgatgacctggcaagtttgccaagctgtaaggagaacccagaagatgtgctgtctccaacttctgtggccacttacctcagttccaagtctcaaccgtcggctaaggtgtcagtcatgggcacagatcagagtgaaagcatcaacacttctaatgaaacagaatatctgaagcaaaaaatccatgacctggaaacggagttggaaggctatcaaaacttcattttccagctccagaagcacagtcagtgttctgaggccatcatcacagtgctctgcggtaccgaaggcgcacaagacggcctgtctaagcccaagaacggaagcgatggagaggagatgacgttcagctcattacaccaggtccgctatgtcaagcatgtgaagatcctcggcccacttgccccagaaatgatcgacagcagagtgctagaaaatcttaaacaacagttggaggaacaggagtacaagcttcaaaaagagcagaacctgaatatgcagttgttttctgagatccataatcttcagaataaattcagggacttgtctcctcccagatacgactcattggtgcagagtcaggcaagagagttgtccttacagagacagcagattaaagacggacacggaatttgtgtgattagcaggcagcacatgaacactatgattaaggccttcgaggagctcctgcaggcttcagatgttgactactgcgttgcagagggatttcaggagcaacttaatcagtgcgccgagctcttagagaagctggaaaagttgttccttaatggcaagtcagtcggcgttgaaatgaacacacaaaatgaattaatggaaaggattgaggaggataatctgacctatcagcacttgctccctgagtcccctgaaccttctgctagtcacgcgcttagcgactacgagacatctgaaaaaagcttctttagccgtgaccagaagcaggacaacgaaactgagaagacaagcgtcatggtcaactctttcagccaggacctgctcatggagcatatacaggaaattcgcaccctccgcaaaagactcgaggaaagcattaaaaccaacgaaaaactgcggaagcagctggaaagacagggttctgaatttgtgcagggttccacctctatcttcgcctccggctctgaacttcattcttcactgaccagcgaaatacacttccttaggaaacaaaaccaggctttgaatgcaatgctcataaagggctcccgcgacaagcagaaggagaacgataagctgcgtgaatcattgagtcggaagacagtatccctggagcatctgcagcgggagtacgccagcgttaaagaagagaatgagcgcttgcaaaaagaaggcagcgagaaggagaggcataaccaacagctgattcaggaggtgcgctgtagtggccaggagcttagtcgggtccaggaagaagtgaaactgcggcagcaattactgtcccagaacgataagttgctgcagagtcttagagtagaattaaaggcttacgagaagcttgacgaagaacatcgaagactcagagatggagataagtatcctatggagtcagataattctttcgacctcttcgactccagccaggccgtgacccccaagtccgtttccgaaactccacctcttagtggaaatgatactgacagcctctcatgtgactctggctctagcgcaacatcaaccccgtgcgttagcagactggtgactggtcaccacctatgggcttcaaagaatgggcgtcatgttctgggcctgatcgaagactatgaggctctgctcaagcagatatctcagggtcagagactattagccgaaatggatattcaaacccaggaggcacctagttcaaccagccaggagctgggcactaaaggtccccatcccgctccgctctccaagtttgtaagctcagtctccactgccaaactgactctggaagaggcttaccgaagactcaaactcctgtggagggtcagcttgccagaggatgggcagtgcccattacactgcgaacagattggagaaatgaaagccgaagtgacaaagttacacaaaaaattgtttgagcaagaaaagaaactgcagaacacaatgaaacttctacagctgtccaaaagacaggaaaaggtgattttcgaccagcttgtggtgacacacaagatcctgcgaaaagctcgcggaaatctggaactgagacccggaggagcccaccctggcacatgctctccgtcacgcccaggcagcta

SEQ ID NO: 217737 - DNA, 5585 bp, Artificial Sequence
  Description of Artificial Sequence: Synthetic coding sequence
atgatggacctcgtactggaagaagacgtgaccgttccaggaactctgtcaggctgttccgggcttgtgccctctgttcccgacgatctggacggtataaaccccaacgctggtctggggaatggcctgcttcccaatgtctccgaggagaccgtgtcccctacccgagctagaaacatgaaagattttgagaatcagattacagaactgaagaaggagaacttcaatctgaagctacggatttactttctggaagaaagaatgcaacaagaattccacgggccaacagaacatatatacaaaaccaacatagagctgaaagtcgaggtggaatcactcaagcgcgagctgcaagaaagagagcagttgttgatcaaggcctccaaggctgtcgaatccctggccgaggctgggggatccgagattcagcgcgtcaaggaagacgccaggaagaaggtgcagcaggtggaagacctgctcacaaaacgaattttactgctggaaaaggatgttacagcagcccaagccgaactggagaaggccttcgcgggaaccgagactgaaaaagccctgcgtctcagactcgaatcgaagctctcggagatgaagaagatgcacgaaggcgatctcgccatggccttggttttggacgagaaagacaggctgatagaagaattgaagttatctcttaagtccaaggaggcactcattcaatgcctaaaagaggagaagtcccaaatggcttgccctgacgagaacgtttcttccggcgaattaagaggcctttgcgccgctcctcgggaagagaaagaaagagagactgaggctgcccagatggaacaccagaaggaaaggaactcctttgaggaacgcatccaagccctcgaggaagatctaagggagaaggagcgtgaaatagcaaccgagaagaaaaacagccttaaacgggataaggcaatccagggactgactatggcactcaaatccaaagaaaaaaaggtagaggaattgaattcagagatcgaaaaactgagcgctgcctttgccaaggctcgggaggcactacagaaagcccaaacacaagagttccaggggtctgaggattatgaaaccgccctgagcggaaaggaagctctgagcgcagcgctccgcagtcagaaccttaccaaatcaactgagaaccatagactgcggcgtagtatcaagaagatcacccaggagctgtctgacctccagcaagagagggagaggcttgagaaggacttggaggaagcccaccgagagaagtccaaaggggattgtaccatccgcgacctgcgaaatgaggtggagaagctcagaaatgaagtgaacgagcgcgagaaggccatggagaaccggtataagtctctgctgagtgagagcaataagaagctccacaatcaggagcaagttattaaacacctgacagagtccactaatcaaaaggacgtgcttctgcaaaagtttaacgagaaagacctggaggtgatacagcagaattgctacctcatggctgccgaagacctcgagttgaggtctgaagggctgataacagagaaatgttcctcgcagcaacccccaggatctaaaacaatttttagtaaagaaaagaagcagtcctctgattacgaggaattaatccaggtgctaaaaaaagagcaggatatctacacacatctagtaaagtcactgcaggagtccgacagtatcaacaacttacaggctgaactgaataaaatttttgcactgcggaagcagctggagcaggatgtgttatcatatcagaatttgaggaaaacactcgaggagcaaatttccgagatccggagacgcgaggaagagagttttagcctatactccgatcaaacaagctatcttagcatttgtctggaagagaacaatcgctttcaggtagaacatttcagtcaagaggagctaaaaaaaaaggtgagtgacctgattcaacttgtcaaggaactctataccgataaccagcacctgaaaaagacaatattcgatttgagctgtatgggatttcagggcaacggtttcccagatagactcgccagcacagaacagactgaaatcatgaaggacttgtctaagggaggctgtaagaatgggtacctcagacatactgagagtaagatctctgactgtgacggcgcacatgctcctggctgccttgaggagggcgcatttattaacctgctggcacccctgttcaacgagaaagccacgctgctccttgaatcccgccctgaccttttgaaagtggtgagagagctcttacttggtcagttgtttttgacagagcaggaggtctccggcgagcacctggacggaaaaacagaaaagacaccaaagcagaaaggtgagctagtgcactttgtacagaccaattctttctctaagccgcatgatgaactcaaactctcgtgtgaggcccagttagtgaaggccggtgaggtacctaaggtgggcctcaaagacgcatctgtgcaaaccgtggcgaccgaaggtgaccttctgaggttcaagcatgaagcaacacgggaagcatgggaggagaagccgatcaacacagcactcagcgccgaacaccgtcccgagaatctgcatggagtcccgggatggcaggctgcgttactctcattgccaggtataacaaatagggaggccaagaagagccggcttccgatcttgatcaagcccagtcgcagtcttggtaacatgtaccgactgcctgcaacccaagaggtcgtcacacagttgcagtcgcagatcctcgaactgcagggcgaactaaaagaattcaaaacatgcaataaacagctgcatcaaaagctgatcctggctgaggccgtgatggagggccgaccaactcctgacaagacattacttaatgcccagcccccagtgggagcagcttatcaggattctcccggagagcaaaaaggaataaagacaacctccagtgtgtggagggataaagagatggactctgaccagcagcgctcttatgaaatcgactctgagatctgcccccctgacgacctggcatcactcccctcgtgcaaagagaatcccgaagacgttctgtcccctacatccgtggcaacctatttgtcttccaaaagccagcccagcgcaaaggtatcagtcatgggaacggatcagtctgagtccatcaataccagtaatgaaactgaatacctgaaacagaagatccacgatctggagacagagcttgaggggtaccagaactttatatttcagttgcagaaacactctcagtgcagcgaagccatcatcactgtcctgtgcgggacagagggcgctcaggatggcttaagcaagcccaagaatggaagcgacggcgaagaaatgaccttctcctccctgcaccaggtgaggtatgttaagcacgtgaaaatcctaggaccacttgcacccgaaatgatcgatagcagggtcttggagaatttgaagcagcaacttgaggagcaggagtataaactgcaaaaagagcagaacttgaatatgcaactattcagcgagatccataatctacagaataagttccgggacctgtcgcctcctcgctacgatagcctcgttcagtcacaggccagggagttgagcctgcaacggcagcagataaaagatggtcacggtatttgcgtgatctcacgacaacacatgaataccatgatcaaggcctttgaagagcttctccaggcctccgatgtggattattgcgtcgctgaggggttccaagagcaattgaaccagtgcgcagaactgctggagaagctagagaaattatttctgaatgggaaatcggtcggcgtagaaatgaacacacagaacgaactgatggagagaatcgaggaagacaaccttacataccaacacttactccctgaaagccctgagcccagcgcctcacacgccctttctgattacgaaaccagcgaaaaaagttttttcagtcgggatcagaagcaagataatgaaaccgaaaagacatctgtaatggtgaattcattcagccaagatttgcttatggaacacatccaggaaatcagaacattgaggaaaagattggaggaatcaatcaagactaatgagaagctacggaagcaactggagcgccagggatccgaatttgtccaggggtccacgagcatatttgcaagtggttccgaactccacagttcactgacgtctgagatccatttcttgagaaagcagaaccaggctcttaatgctatgctaattaaggggagcagggataaacagaaagagaatgataaactgagggagtctctgagccgcaaaacagtctctctcgaacatctgcagagggagtacgccagcgtgaaggaggaaaatgagagactgcagaaggagggctccgagaaagagcgacacaatcagcagttgattcaggaggtccgatgttctgggcaggaattgtcccgcgtacaggaagaggtgaagttgcgacagcagttactctctcagaacgacaaattactgcagtcgctgagagtggaattaaaggcctacgagaagttggatgaagaacaccggaggctccgggaagcttccggggagggttggaagggccaagacccctttagggaccttcacagtctgctgatggagatccaagcactgagattacagctggagcggtccattgagacatcttcgactctccagtcccggttaaaggaacagttggcaagaggcgctgagaaagcgcaggaaggcgcactcactctggcagtccaggccgtgtccatcccggaagtgcctctgcagccggataagcacgacggcgacaaatacccaatggaatccgataattcattcgatctgtttgatagtagccaggccgtcacacctaaatcggtgtccgaaaccccccctctgagcggcaacgatactgattctctcagctgtgactccgggtcctcagccacgtccacgccatgtgtttctagacttgttacgggccatcatctctgggccagcaagaatgggcgacatgtgttgggactgatcgaagactatgaggcactactgaaacagatttcccaggggcagcgactgctagcagagatggacattcagacacaagaggcccctagttctactagtcaggaactcggtacaaaagggcctcaccctgcccctctaagtaaatttgtgagcagcgtgtccaccgccaagctgacgttggaggaagcctaccggcgtttaaagttgctttggagagtcagcctcccagaggatgggcagtgtcccctgcattgcgagcagattggcgagatgaaggcagaggtcacaaagctacacaagaaactgttcgagcaggagaaaaagttacaaaatacgatgaagttgctgcagttgtcaaagcgccaggagaaagtgatctttgaccagctcgtcgtcacacacaagatcctgaggaaggctaggggcaatctggaactacgccctggcggagcgcacccgggaacttgcagtcctagtcgcccagggagcta

SEQ ID NO: 217738 - DNA, 1521 bp, Artificial Sequence
  Description of Artificial Sequence: Synthetic coding sequence
atggaggatcatcaacacgtgcctattgacatacagacatctaagcttctggactggctcgtcgatcgtaggcactgttcgctgaaatggcagtctctggtactcaccattagagagaaaatcaacgctgccatccaggacatgccggagagtgaagaaattgcccagttactgagtggctcctacatccactactttcactgtcttcgtattctagacttactgaaaggcacggaagccagcaccaaaaacatctttgggaggtactctagccagagaatgaaggactggcaggaaatcatagcactgtatgaaaaagacaatacatacttggtagagctcagtagccttttggttcggaacgttaattatgaaattccaagtctcaaaaaacaaatagcgaaatgccagcagctgcaacaggagtactccaggaaggaagaggagtgccaggctggcgctgccgagatgagggaacagttttaccacagctgtaagcagtacggaattactggcgagaacgtacgcggagaactccttgctttggtgaaggacttgccatcacagctggccgaaatcggagctgctgctcagcagtcactaggggaggcaatagacgtgtaccaggcttccgttggatttgtgtgcgagagcccaaccgagcaggtgctgcccatgctgcgatttgtgcagaaacggggtaattctactgtctatgagtggagaactggcacagagccatccgtggtcgagagacctcacctcgaggaactcccagagcaagttgcggaagacgctatcgattggggcgacttcggtgttgaggccgttagtgagggaacggactccggcatcagcgctgaggcagccggaatcgattggggtattttccctgagtctgacagcaaagatccgggtggggatgggattgactggggcgacgacgcggtggcacttcagatcactgttctcgaggccggaacccaggctccagaaggggtggcacggggacctgacgcacttaccctcctggaatacacagagactcgcaaccagttcctggacgagctaatggagctggaaatctttttggcccaaagagcggtcgagctgagtgaagaggccgacgttcttagcgtgtcccagtttcaattggctccggcaatcctgcagggccaaacaaaagagaaaatggtcaccatggtgtctgtgttggaagacctcattgggaagctaacctctttgcagctacagcacctatttatgattctggcctccccccgttatgtcgatagagtaaccgagttcctgcagcagaaactgaagcagagccagctcctggccctgaagaaggagctcatggttcagaaacagcaggaagcattggaggagcaagccgctctcgaaccaaagttagatctgcttcttgagaagactaaggagctgcagaagctcatagaggcagacattagcaagagatattccggtcggcctgtgaacctcatgggaacttctctctag

SEQ ID NO: 217739 - DNA, 1596 bp, Artificial Sequence
  Description of Artificial Sequence: Synthetic coding sequence
atgaggaggcaatcaatgaccagcgcaacgagggacctgcatactgcgttagacggaaaagctacccagggcggaaagaaggatcatcagcacgtaccaatcgacatccagacgtccaagctgctcgactggctcgtagaccgccgacattgtagcctcaagtggcagtcattagttttaaccatccgagaaaagataaatgcggcaatacaggacatgcccgagtccgaggagatcgctcagctgttgtccggttcctatatacactatttccactgcttaaggatcctggatctcctgaagggtaccgaggcttctacaaagaatatttttggtaggtatagcagccaacgcatgaaggattggcaagagatcattgctctgtatgagaaggataacacttatctcgtggagctgtctagcctgctcgtacgcaacgtcaactatgagattcctagcctaaagaagcagatcgctaagtgccaacaacttcagcaggagtattcaaggaaagaagaggagtgtcaggcaggcgcagctgagatgcgcgaacagttctatcactcttgcaaacaatatgggattaccggggaaaacgtgcggggagagctgcttgcgttggtcaaagacctgccgtcacagttggctgaaattggagctgcggctcaacaatccctcggcgaggcgatagacgtataccaggcctcagttggctttgtgtgtgagtctcccacggagcaggtgctgccaatgctcagatttgtccagaagagagggaattccactgtgtatgagtggcgaactggcacagagccctcggtcgtggaacggccacatttagaagaactcccagaacaagtcgccgaagacgcaattgactggggagatttcggagtcgaagccgtctcagagggaacagactcaggcatttcagcagaggcggcaggtatcgattggggcatctttcccgagtctgattctaaggatcccggtggagatggaatagattggggggatgacgctgttgcactgcagataaccgtgctcgaagccggtacgcaggcgcctgaaggtgtggcaagaggtcccgacgccctaactttgcttgaatacacagagacccggaaccagttcttggatgaacttatggaattagagatcttccttgcccagagggccgtcgaacttagtgaagaggcggacgtgctgtccgtgtctcagttccagctagcccctgccatactgcaaggacagaccaaggagaagatggttacaatggtcagcgtcctagaagaccttatcggcaagctgacaagccttcagctgcagcaccttttcatgatactggcctccccccgttacgttgatagggtcaccgaattcttgcagcagaaactcaaacagagccagctactggcattaaagaaagaattaatggttcaaaagcaacaggaggctcttgaagaacaggccgctcttgagcccaaacttgacctgttacttgaaaaaacaaaagaactgcagaaactgatagaggccgacattagcaaaaggtactccggtcggccagtgaacctgatgggcaccagcctctag

SEQ ID NO: 217740 - DNA, 3864 bp, Artificial Sequence
  Description of Artificial Sequence: Synthetic coding sequence
atgcaccccgaccttggcccattatgcaccttattatacgtgaccctaacaattctttgttcatcagttagtagtgacctggcgccttacttcactagcgagcctctttcagcagtgcagaaactcggcggacctgttgttctgcactgttccgcgcaacccgtcacaacaaggattagctggttgcataacgggaagacactggatggcaatctggagcacgtaaagatccaccaagggacgcttaccattcttagtctgaacagttcactgcttggctactatcaatgcctggctaacaattccatcggcgctatcgtcagcggtccagcgacggtctctgtagcagtgttgggggacttcggcagctccaccaagcatgtgataaccgcagaggaaaagagcgcaggattcatcggatgccgcgtgcccgagagcaatcctaaggccgaggtccgttataaaatcagagggaagtggctggagcactcaactgagaattatctcatcctgccatctggcaacttgcagatccttaacgtctctctcgaagataaaggcagttacaaatgtgcagcttacaatccagtcacacaccaattgaaggtagagcctataggcaggaagctgttagtgtcccgcccaagctcagacgacgtacatatcctgcaccccactcattcacaggctctggctgtcctgtcaaggagccctgttacccttgaatgtgtagtatccggcgtgccagctccgcaagtgtactggcttaaggatggacaggacattgcacctgggagcaactggcgccgtctgtatagccacctagcaaccgactctgttgatccagcagatagtgggaactactcatgtatggctgggaataagtcaggagatgtcaagtacgtgacatatatggtcaatgtgctggagcacgctagtataagcaaaggactacaggaccagattgtgtccctgggggctacggttcatttcacctgcgatgtccacgggaaccccgctccgaactgtacctggttccacaacgctcagcccatccaccctagcgcccgacacctgaccgcgggaaacgggctgaagatctccggggttaccgtggaagacgtagggatgtaccaatgcgtcgcggacaatgggatcggattcatgcactccacaggcagactggaaattgagaacgacggtggctttaaacccgttattatcacagcccctgtgagtgcaaaggttgcggacggggactttgtgaccctgagttgtaacgcttccggtctgccagtgcccgtcatcaggtggtatgactctcacgggctcatcacctcacacccgtcccaggtcctccggtctaagtctagaaagagccagctatccagaccggaagggctcaacctagaaccagtgtattttgtgctctcgcaggcaggagcatcctcactacacatccaggccgtcacccaggagcatgccggaaaatatatctgcgaagccgcaaacgaacacggaacaacccaggcagaagcatcacttatggtggttccatttgaaaccaatactaaggccgagacagtcacacttccagacgcggcacagaatgacgacagatcaaaacgtgatgggtccgagactggactcctctcttctttcccagtcaaagttcatccaagcgccgtggaaagtgcacctgagaagaatgccagtggtatctccgtgcctgacgcaccgatcattctctcccccccacagacccatacaccagatacctataacctggtatggcgggctggaaaggatggcggactgcctatcaacgcttatttcgtcaaatacaggaagctggacgacggtgtcggcatgctgggctcatggcacactgttcgtgtgccaggatccgagaatgaactgcacctggcagagctcgaaccttcaagcttgtatgaagttctcatggtagcccgttccgcggcaggcgaagggcagccagccatgttgacgttccggacaagtaaggaaaagacagcttcctcaaaaaatacccaggcttcttcacctccagttgggatccccaagtaccctgtggtaagcgaggccgcaaacaataatttcggggtcgtgctgacagattccagcaggcactccggagtccctgaagcacccgatagacccacgatcagcacagcttctgagacatccgtttatgtgacctggattcccagggccaacggaggcagtcccataacagcattcaaagtcgaatacaaaaggatgaggacatctaattggctggtcgctgcagaagatatcccgccaagtaagttgtccgtggaagtgcgatctctcgagcctgggtcaacctacaaatttcgagtcatcgcgatcaaccactatggggaaagcttcaggtcttctgcaagccggccatatcaggttgtggggtttcctaataggttcagcagcagacccatcaccggtccgcacatcgcctacactgaggcagtgagcgacactcagatcatgcttaaatggacgtacatcccatcctcaaacaacaacacccctattcaaggcttttacatctattaccgaccgacggatagtgataacgattctgattacaagcgagatgtcgtcgagggatccaagcaatggcacatgattggtcatttgcagcccgaaacaagctacgatatcaagatgcagtgttttaatgagggtggcgagagcgagttctccaacgtgatgatttgcgagaccaaggtcaaaagagtgcctggagctagcgaatatcccgtgaaagacctcagcactcccccaaatagcctcggaagtgggggaaacgttgggccagccactagccctgctagatcttccgacatgctatacctgatcgttgggtgtgtgctgggggtgatggtccttattctaatggtgttcatcgcaatgtgtctctggaagaatcggcaacagaacaccattcagaaatacgaccctccgggatatttgtaccagggttctgatatgaacggtcagatggtggactatacgaccctctcaggggcttctcagatcaacggaaacgtccatgggggattccttaccaacgggggacttagctcgggatatagccatcttcatcacaaggttcctaatgctgtaaatggaatagtaaatggttccttaaacggcggactgtattcgggacactctaattccttgaccaggactcatgtcgattttgaacacccccaccacctagtgaacggagggggtatgtacaccgctgtaccacagatagatcctctagaatgcgtcaattgtcggaactgtaggaataataataggtgtttcacaaaaactaattcaaccttttcctctagccctcctcctgtggttccagtcgtggccccatacccacaggatggactggagatgaaacccctgtcgcacgtcaaagttccagtatgtctcacctctgcagtgcccgattgcggacagctacctgaggaaagtgtgaaggataatgtggaacctgtacccacccagagaacctgttgccaggatatcgtgaatgacgtgagttccgatggcagcgaggaccctgcggaattctcgaggggacaggagggtatgattaacctgcgaatccccgaccacctgcagctcgctaagagctgcgtttgggaaggggatagttgcgcccacagtgagactgagatcaatatagtgagctggaatgcactaatcttaccccctgtgccagagggctgtgctgaaaagacaatgtggagccctccaggcattcccctagactctccaaccgaggtgctgcagcaacctcgcgagacgtag

SEQ ID NO: 217741 - DNA, 3795 bp, Artificial Sequence
  Description of Artificial Sequence: Synthetic coding sequence
atgcaccctgacctgggaccgttatgcacgctcctgtatgtcaccctgactatcttatgtagtagtgtttcaagcgatctggctccatacttcacttctgagccactttctgcagtgcagaagctcggcggacccgtggtgcttcactgttctgcccagcctgtcacaaccagaatttcctggctccacaacggcaaaaccctcgacggaaatctggagcacgtcaagattcaccagggcactctgacgatactgagcctgaatagcagcttgctgggatactaccagtgtcttgctaataacagcataggggcaatagtgtctgggcctgccactgtctcagtggcagtgctgggcgatttcggctcatctactaagcatgttataaccgcagaagagaagagcgccggtttcattggctgtcgcgtgccagagagcaacccgaaggctgaagtgaggtacaaaatcaggggcaaatggctagaacatagtactgaaaattatcttattttgccttcaggaaatttgcagattctgaatgtgagcttagaggataagggaagctacaagtgtgctgcctataatcccgtgactcaccagcttaaagtggaacctatcgggagaaagctactggtgtctcgaccttcttccgacgacgtgcacatcctgcatccaactcacagccaggctctggctgtactttcgcggtcccctgtgactctggaatgtgtggtctcaggcgtccccgctccacaggtgtattggttaaaagacggacaggacattgctcctggctccaactggcggcgtctgtattcccacctcgcaaccgactccgtagatcctgctgactctggcaattattcttgtatggccggaaacaagtccggggacgtaaagtacgtcacgtatatggtgaacgttctggagcacgcgtctatttctaaaggtctgcaggaccagatcgtgtcccttggcgctacggttcacttcacctgcgacgtgcacggaaatccagccccaaattgtacctggtttcacaatgcccagcccatccacccttcagctcggcacctaaccgccggtaatggactgaagatcagcggtgtgactgtagaagatgtcggcatgtatcagtgcgtggcagacaacgggattggtttcatgcacagcaccggcaggcttgagattgagaatgacggaggattcaagcctgtgattattaccgcaccagtcagcgccaaggttgccgacggcgactttgtgactctcagctgtaatgctagcggcctgccggtgcccgttatccggtggtatgatagtcatgggcttatcacaagccacccgtcccaggtgcttcgttctaagtccagaaagagtcagctctctagacccgagggattaaatctggaacccgtctatttcgttctgtctcaggccggagcctcatcgctgcatattcaggccgtcacacaggagcatgccggaaagtatatttgtgaggccgctaacgaacacggcaccacccaggctgaagcctccctgatggtagttccatttgagactaatactaaggcagaaaccgtgacgctacctgacgcagcccagaacgacgaccggtccaagcgggatgggtctgaaacaggcctcctctcctcgttccctgttaaggttcaccccagtgcagtcgaatctgctcctgagaagaatgcttcaggtatcagtgtccctgatgcgccaatcatcctgagcccaccccagacccacacccctgacacctacaacctggtgtggagggccggaaaggacggcggacttccgataaacgcatactttgtgaaatatcggaagttagacgacggggtaggcatgctgggttcttggcatactgtgcgggtcccaggtagcgagaatgaactgcacctggccgagttggaaccctcttctctttatgaggtcctgatggtggcccgatctgcggctggggaagggcaaccggctatgctgacgtttaggacgtccaaagagaaaaccgcatcatccaagaacactcaggctagcagtcctcctgttggtatacccaaataccctgtggtgtcagaagcagcaaataataacttcggcgtcgtgctgacggattcgtcacggcattcaggcgttccagaggctcccgaccgacctacaatctccacggcctccgaaacctccgtgtatgtgacatggataccaagggctaatggaggatcaccaatcacagcgttcaaggtggagtataaaaggatgagaacatccaactggctcgtggcagctgaagatatccccccttccaagctttctgtggaggttaggagtctggagcctggaagtacttacaagttccgagtaattgcaatcaaccattacggagagtcgtttagaagctccgcatcacggccttaccaggtggtaggcttccccaaccgcttttccagtcggcctatcaccggtccgcacattgcgtacactgaggcagtgagcgacacccagattatgctgaagtggacttacataccgagtagcaataacaatactccaatccagggattctatatttactatcgcccaacagattctgataacgactcagactacaagcgggacgttgtggagggatccaagcagtggcatatgatcggtcacctgcagcctgagacctcttacgacattaaaatgcagtgcttcaatgagggcggtgagagcgaattttccaacgtgatgatttgtgagaccaaggtgaaaagagtccctggcgcatccgagtacccagtcaaggacctgtccacccctcccaacagcctgggttccggcggaaatgttggtcccgctacatcacccgcaagatctagtgacatgctctatctgatcgttgggtgtgtccttggcgttatggtcctgatcctgatggtatttattgctatgtgtttgtggaaaaataggcaacagaacacaatacagaagtatgacccacctggctatctttaccagggaagcgatatgaacgggcagatggtcgactacacaaccctctcgggcgctagccagattaatggcaacgtccatggcggatttctgacaaacggtgggttaagcagcggatattcacacctgcaccacaaagtgccaaacgccgtgaatggaatagtcaacggtagcttgaacggcggtttatacagcggccattcaaactctcttacaaggacccacgtggacttcgagcacccgcatcacctggtgaacggaggaggaatgtataccgcagtgcctcagatagacccacttgaatgcgttaactgtaggaattgccgcaacaacaaccgatgttttaccaaaaccaattcaaccttcagcagctcccctcccccagttgtcccagtggtggccccatatccacaggacggattggagatgaaaccactgagtcacgttaaggtacccgtgtgcttgacatccgcagtccccgactgtggtcagctgccggaagaaagcgtgaaggacaacgtggaacccgttccaacccagagaacctgctgccaggatattgtgaacgatgtctccagtgacggatccgaggacccagcagagttttcaagaggggacagctgtgcccacagcgagacggagatcaacatcgtcagctggaacgcgctcatcctcccccctgtgcccgagggctgtgccgagaagaccatgtggtcccctcctggaatcccgctggatagccccactgaagtgcttcaacagcctcgggagacatag

SEQ ID NO: 217742 - DNA, 1386 bp, Artificial Sequence
  Description of Artificial Sequence: Synthetic coding sequence
atgctggaactgcggcacaggggcagttgtccagggcctagggaagccgtctcgcctccccacagggaaggggaggcagccggaggtgaccatgagactgagagtacctccgacaaggaaaccgatatcgacgacagatatggtgacctcgattcaaggaccgattctgacatcccagagatccctcccagttctgaccgcacacccgagattctgaaaaaagcactaagtggtctgagctcccggtggaaaaattggtggatacgcggtattctcaccctcacaatgatcagccttttcttcctcatcatttatatgggatccttcatgttgatgcttctcgtcctaggaatacaggtgaaatgttttcatgaaataattacaattggttatcgggtgtatcatagctatgatctcccgtggtttcgcaccctatcatggtatttcctattatgcgtcaactacttcttctacggtgaaacagttgcagattatttcgccacatttgtgcagcgcgaggaacagctgcagtttcttatccggtaccaccgatttataagctttgccctgtacctggccggattttgcatgtttgtcctgtctttagttaagaagcactacagacttcagttctacatgtttgcttggactcacgttacactgctcattaccgttacccaatctcacttggtgatccagaatctgttcgaaggaatgatctggtttttagtccccatttcaagtgtcatatgtaacgacattaccgcctacctgttcggatttttctttgggcgaactcctcttattaaactctccccaaagaaaacatgggaaggatttataggcggatttttctccaccgtagtatttggattcatagccgcttacgtcctgagcaagtaccagtactttgtttgccccgtggaatatcgctcagacgtcaattccttcgttactgagtgtgaacccagtgagctgtttcaattgcaaacttactccttgcccccattcttaaaggccgttttgcgacaggaacgggtgagcctgtacccctttcaaatccactccattgccctaagcacatttgcttctttaatcgggccattcggtggtttctttgcgtcgggctttaaacgtgctttcaagataaaagatttcgccaatactatcccgggtcacggcggaatcatggacaggttcgactgccagtatctgatggcaaccttcgtgcatgtgtatataactagctttataagaggccctaatccctccaaagtgctacagcagcttctggtgttacagccggaacaacagcttaacatttataaaacattgaaaacacacctgatcgagaagggtatcctccagcccaccctgaaggtgtag

SEQ ID NO: 217743 - DNA, 978 bp, Artificial Sequence
  Description of Artificial Sequence: Synthetic coding sequence
atgtcccgcttgcgacatccacgcactcggtacttcctgttatgtgtcaactatttcttttacggcgagaccgtgactgactatttcttcaccctggtccagcgagaggagcctttgagaattttgagcaaataccaccggttcatcagttttactctttacctcataggattttgcatgtttgtgctatccctggtgaaaaagcattaccgactgcagttttatatgttcgggtggacacacgtgaccttactgatagtggtcacacagagccacttagtcattcataacctgttcgaaggaatgatttggttcatcgttcccatcagttgcgtgatctgcaacgacattatggcctatatgtttggattcttcttcgggagaactcccctcattaagctgtctcctaagaaaacctgggaaggatttatcgggggatttttcgcaacagtggtgtttggtcttctgctgagctacgtgatgtcgggatacaggtgttttgtatgccctgtggagtacaacaacgacactaactcatttacagtcgactgtgagccgagtgacctctttcggctgcaagagtacaacattcccggtgtgatccaatcggttattggatggaagacagtgaggatgtaccctttccagatacacagtatcgcactgtctacattcgcaagcctcataggtccgttcggaggcttctttgcctccggattcaagcgggctttcaagattaaggatttcgctaacacaatcccaggccatggtggcatcatggataggtttgattgccaatatctgatggcaacctttgtgaatgtgtacatcgcctccttcattcgcggaccaaacccgtctaagctcatacaacagttcctgactttacgtcccgaccagcaactgcacattttcaatacattgcgtagccaccttatcgacaaaggcatgctgacgtctaccacagaagacgagtag

SEQ ID NO: 217744 - DNA, 753 bp, Artificial Sequence
  Description of Artificial Sequence: Synthetic coding sequence
atgagccggcttcgccatccacggactagatggaaaaactggtgggtgaggggaattctcacactcgctatgatcgccttcttttttattatcatctaccttgggccaatggtcttgatgatcatcgtgatgtgcgtccagatcaaatgtttccatgagattatcaccatcggctacaatgtataccactcctatgatctcccctggtttcgtaccctctcatggtattttctgttgtgcgtgaactactttttttatggagaaacggtgacagactacttcttcacactggtccagagggaggagcccctgcggatactgtccaaataccaccgctttattagttttactctgtatctaatcggtttctgcatgtttgtactatcattagtgaagaaacattatcggcttcagttttatatgtttgggtggacgcacgtcactctgctgatcgtggtgactcagtctcatttagtgattcataacctctttgaggggatgatctggttcatagttcctatctcttgtgtaatatgtaacgacataatggcttatatgttcggtttcttttttgggcgaacccccttgataaagctcagcccgaaaaagacatgggagggcttcattggtgggttcttcgcaacagtcgtattcgggctcttgctctcgtacgtaatgagcgggtaccgctgtttcgtgtgtccagttgaatataataatgataccaattccttcacagtcgattgtgaatag

SEQ ID NO: 217745 - DNA, 1338 bp, Artificial Sequence
  Description of Artificial Sequence: Synthetic coding sequence
atgacggaactgagacaacgggtcgcacacgagcctgtagctcccccagaggataaggagagtgagtctgaagctaaggtggatggggagaccgcgtcagatagcgaatctcgggctgaatcggctccactccccgtgtctgcagatgacacacctgaagtgctgaatagggcactcagcaatctttctagccggtggaaaaactggtgggtccgaggaattttgactctggctatgatcgcattctttttcattatcatttatctgggacctatggtgctgatgattatcgttatgtgcgtccaaataaagtgtttccacgagattataaccatagggtacaacgtgtaccacagttacgatctgccctggttccgaacactgagttggtactttctgctctgtgtcaactacttcttctacggagaaaccgttaccgattatttcttcaccctcgtgcaacgtgaagaacctttgcgaatcctgtctaagtaccaccgctttatttctttcacactatacttaatcggcttctgtatgtttgtcctctccctggtgaagaaacattaccgcctgcagttttacatgttcgggtggacccacgtcactctccttatcgtcgtcacccagagccatcttgtaattcacaatctgtttgaggggatgatctggttcatcgtaccaattagctgcgtcatttgcaacgatattatggcttatatgttcggattttttttcgggaggacacccttgattaaactgtctcccaagaagacctgggaaggtttcatcggaggcttctttgctaccgtggtgttcggtctcctgctttcctacgtgatgtccggctaccggtgcttcgtgtgccctgtggagtataacaatgataccaatagcttcaccgtggactgcgagccttcggatctgttccgactccaggagtataacatccccggtgtgattcagtccgtgatagggtggaagacagtgcggatgtacccattccaaattcactctatcgccctctccacattcgcaagcctaattggcccattcgggggattctttgccagcggcttcaaacgagcattcaagatcaaggatttcgctaataccattcctggacacggtggcatcatggataggttcgattgccagtaccttatggccacatttgtcaatgtgtatatcgcatcgtttatccgcggacctaacccctctaaattgattcagcagtttctcacgctgaggcccgaccagcagctgcacattttcaataccctgcgctctcatctcatagataagggcatgctgaccagcacaacagaggatgagtag

SEQ ID NO: 217746 - DNA, 648 bp, Artificial Sequence
  Description of Artificial Sequence: Synthetic coding sequence
atgttcgtgctgtctttggtcaagaagcattataggctgcaattttatatgtttggatggactcatgttacactccttattgtcgtgacccagagtcacctggttatccacaacctctttgagggcatgatctggtttatcgtacccatcagctgtgtcatttgcaacgacattatggcttacatgttcggtttttttttcgggaggacccccttgatcaaactgtcccccaagaagacctgggaggggtttattggaggctttttcgctacagttgtgtttggtctcttaaagacagtgcgcatgtatccctttcaaattcactctatagctctgagtactttcgcctcactgatcgggccttttggaggtttcttcgcaagcggcttcaaaagggccttcaaaatcaaggacttcgccaacactatacccggacacggcggaatcatggacagattcgactgccagtacctgatggccacgttcgtgaacgtgtacatcgcctccttcattagaggcccaaacccgtccaagctgatccagcagttcctcaccctgagacctgaccagcagctgcacatattcaatacattacggtctcacctcatcgataaaggcatgctgacctcaaccaccgaggacgagtag

SEQ ID NO: 217747 - DNA, 3675 bp, Artificial Sequence
  Description of Artificial Sequence: Synthetic coding sequence
atggagcctctcctattaggacgaggactgatcgtatatcttatgttcttattactcaagttcagtaaggctatcgagattccatcctcagtacagcaagttcctaccataattaagcaaagtaaagttcaggtggcatttccattcgacgaatattttcagattgagtgcgaggctaagggtaaccccgaaccgacattcagctggacaaaggacgggaaccctttctactttacagatcatcgcattatcccttccaacaattctggcacattccggattcctaacgaaggacacatctcacattttcaggggaagtacagatgtttcgccagtaacaaattagggatcgctatgtctgaggaaattgagtttatcgtgccttccgtccccaaatttccgaaagagaagattgatcccctagaagtggaagagggagatcccattgtgctaccctgtaatcctcccaaagggctaccacccctgcacatatattggatgaacattgagctggagcatatcgagcaggacgagcgggtctacatgtcccagaaaggtgatttgtacttcgcaaatgtcgaggaaaaagactcacgcaatgattactgctgttttgctgccttcccacgcttgcgcacaatcgtgcagaaaatgcctatgaaactcacagtcaattctttgaagcacgccaacgacagcagtagctccacagagataggatccaaagctaactcaatcaagcagcgaaaacctaagttacttttgcccccaaccgagtccggcagcgaaagctcaattaccattctaaaaggcgagatccttctccttgagtgttttgcagaagggttgcctacccctcaagtcgactggaataagatcgggggtgatttgccgaaaggcagggaaaccaaggaaaattatgggaaaacactgaaaatcgaaaacgtctcttaccaggataaaggcaactatagatgcaccgcatccaattttctagggaccgccacgcatgatttccacgtgatcgtcgaggagccacctagatggaccaagaaaccccaaagtgccgtttacagtacgggctctaatggaatcctcttatgcgaggccgagggtgagccccagccaactattaaatggcgtgttaacggatctcccgtggataatcaccccttcgctggagatgtggtcttccctcgtgagatcagctttacgaatctccagccgaatcacacagcggtgtaccagtgcgaggcttcaaacgtccacggtacgattcttgcgaatgccaacatcgatgttgtcgacgtgcgcccactgattcaaactaaggatggggagaattacgcaaccgtggtcggttattcagcctttttacattgtgaattcttcgcatccccagaagctgttgtgtcctggcaaaaggtggaggaagtgaagccgctggagggcagacgttatcacatttacgaaaacggcaccctacagatcaaccgcactacagaagaggatgccggttcctacagctgttgggtggaaaatgccatcgggaaaaccgccgttaccgccaacctcgacatcagaaatgccaccaaacttcgggtgagccctaaaaatccacggattccaaagctgcacatgctggagctgcattgcgaaagtaagtgcgacagtcatctgaaacattcactgaagcttagttggagcaaagacggcgaggcgtttgaaatcaacggaaccgaagacggaagaatcataatcgatggcgctaatctgaccatcagtaacgtcaccttggaggatcagggcatttattgttgttccgcccatactgcattggatagtgcagccgacatcacccaagtcaccgtgctggatgtacctgaccctcccgaaaacctgcaccttagtgaacgacagaacagatctgttcgcttaacctgggaagcaggagccgatcataattcaaacatttccgaatatatcgttgaattcgagggcaacaaggaagaacctggcaggtgggaggagctgacgcgtgtgcaagggaagaaaacgactgtgatccttcctctggctccatttgtacgttatcaatttcgggtgatcgctgtcaacgaggtcgggcgttcccaaccgagccagccttccgaccatcatgagactcctcccgcagccccagaccgaaatccccagaacatccgggtgcaggctagccaaccgaaggaaatgatcatcaaatgggagccgttgaaatccatggaacagaatgggcctggattggaatacagggtaacatggaagcctcagggggctcccgtcgagtgggaggaggagaccgtgacgaaccacactctgagggtcatgacacccgcagtttacgcaccatacgacgtgaaagtacaggctattaatcagctcgggtcaggccctgaccctcagagtgttacgttatattccggtgaggattatccggacacagcccctgttattcatggtgtggacgttattaacagtactctggtcaaagtaacttggtctacagtccctaaggaccgagtgcatggacgtctaaagggctaccagataaattggtggaagaccaagtccctgctggatgggcgaactcaccctaaagaggtgaatattctacggttctcagggcagcgtaactctggcatggtgccttccctcgacgcattttcagaattccatctgaccgtcctggcctacaactctaaaggcgctgggcctgagtccgaaccttatatttttcagactcccgagggggtcccggagcaacctacattcctcaaggtcattaaagttgacaaggatacagccacattaagctggggccttcccaagaagcttaacggaaatctcaccggttatttgctccagtaccaaatcattaacgacacctatgagattggtgaactgaatgatatcaatataacaacaccttcgaagcctagctggcatctctccaatcttaacgctactacgaagtataagttctacctaagggcttgtacttctcagggttgtggaaagcccatcactgaggaaagctctaccctcggcgagggatctaaaggtattggtaagatatcaggcgtgaatctcacacagaagacacatcccattgaggtttttgaaccaggggcagaacatatagtgaggttgatgaccaagaactggggggacaatgactccattttccaggacgtgatcgagacccggggtcgggaatatgctggactgtatgacgacatttccactcagggctggttcattgggctgatgtgcgctattgccctcttgaccctgctgctcctgaccgtctgtttcgtaaaacgcaacaggggaggtaagtactcagttaaggagaaggaggacctgcacccagatcccgagatccaatctgtgaaagatgaaacattcggagagtactcggactccgatgagaaacccctgaagggcagcctgaggtcacttaatcgcgacatgcagcccaccgaatccgccgactccttggtggaatatggagagggggatcatggcctctttagcgaggacggctcctttatcggcgcttacgccggaagcaaggagaagggcagcgtggaatctaacggaagttctactgccactttccccttgcgagcctag

SEQ ID NO: 217748 - DNA, 3627 bp, Artificial Sequence
  Description of Artificial Sequence: Synthetic coding sequence
atggagccattactgttgggcagaggattaatagtgtatcttatgttcttactgcttaagtttagtaaagctatcgagatcccatcatccgtgcagcaggtgccgacaatcattaagcagtcaaaggtgcaggtggcctttccgtttgatgaatacttccaaatcgaatgcgaggcaaaggggaacccagagccaaccttcagctggactaaggatggaaatccattctacttcaccgaccaccggattatcccctccaataactccgggactttcagaatccctaacgagggccacatttcacattttcagggcaagtaccgctgctttgctagcaataagctgggcatcgcaatgagcgaagagattgagttcatcgtgccttcggttccaaagttcccgaaagaaaagatcgaccctctagaagtggaggagggagatccaattgttctcccctgtaacccacccaagggactcccaccattgcatatttattggatgaacattgaactggaacacattgaacaagatgagagagtatacatgtctcaaaaaggagacctatattttgctaacgtcgaagagaaggattcgcggaatgactactgttgctttgccgcattcccaaggctacgcactattgtgcaaaagatgcccatgaagctcacagtgaactcctccaattcaataaagcagcgcaagcccaaactcctccttccccctaccgagtcaggatcagagtccagtatcacaatcctcaagggagaaatcttactcctcgagtgttttgctgaagggcttcctacaccccaggttgactggaataagatagggggtgacctgccaaaaggccgtgaaacaaaagagaactacggaaaaacactcaagatcgagaacgtcagctaccaggataaaggaaactatagatgtactgcctctaattttttaggtaccgccactcatgactttcacgtgatcgtcgaagaaccaccacgctggaccaagaaaccacagagcgccgtgtattctactggatcgaatggaattctgctttgtgaggcagagggcgagccccaaccaactataaaatggagggttaacggctcacccgtcgataaccacccttttgccggtgacgtggtgttccccagagaaatctcctttactaatcttcaacccaatcatactgcggtttaccagtgtgaagccagcaacgtccacgggactattctggcaaatgctaatatcgacgtcgtcgatgtgcggcctctgattcagaccaaggacggagaaaactatgccacagtcgtaggatattctgcgttcctccactgtgagttttttgcaagcccagaagcagtcgtctcatggcagaaagtggaggaggtgaaacccctggagggccgtcgttatcatatttacgaaaatggcacattgcagattaatcgaactactgaggaggacgctgggtcatattcatgctgggttgaaaatgcgataggtaagactgctgtcacagcgaacctcgacatacgcaacgctaccaagcttcgggtctcgcctaagaatcctaggatccctaagctgcacatgctggaactgcactgtgaatcgaagtgtgattctcatttgaaacacagccttaaactctcatggtctaaggacggtgaagcatttgaaattaacggaaccgaagatggtaggatcattattgacggagcaaatctcaccatatctaacgttaccctcgaggatcagggtatatattgctgctcggctcacaccgctctcgacagcgcagccgacatcacacaggtcaccgtgctggacgtgccagatcctccagagaacctccacctgagcgagcggcagaacaggagtgtccggcttacttgggaggcaggcgctgatcataactccaatatttccgagtatattgttgaatttgaaggcaacaaggaggagcctggcagatgggaggagctcacacgagtgcagggaaagaagaccaccgtgattctgcccttggccccattcgtgcgatatcagtttcgagtcatcgccgtgaatgaggtggggcgatcccaacccagccagccttccgaccaccacgaaacaccaccggctgctcccgatcgtaatccacagaatatccgcgttcaggcatctcagcctaaagaaatgattattaagtgggagcctctgaagtctatggagcagaacggcccaggactggagtaccgagtcacctggaagcctcaaggagcacccgtcgaatgggaggaggaaacagtgacaaatcacacgctccgagtcatgacgccggcagtctatgccccttacgacgtcaaggtccaggccatcaatcagctggggagcggacccgacccccagtcagttaccctgtattccggagaagactaccctgacaccgcacccgtaatccacggggtggacgttataaattctactctggtgaaggtcacatggagtacagttcccaaagatagagtccacggcagactgaagggataccagatcaattggtggaagaccaagagcctgttagatgggagaacacatccaaaagaggtgaatattttgaggttctctggacagagaaattccggaatggttcccagcttggatgcctttagcgaatttcacttaacagtgctcgcgtacaattctaaaggcgcagggcctgagtcggagccatatatatttcaaaccccagaaggcgtgcccgagcaacccacgttcctgaaggtgatcaaggtagacaaagatacagccacactctcctggggcctgcccaagaaattgaacggcaatttaactgggtatctgctgcagtaccagattattaatgatacgtacgaaatcggggagcttaatgacattaacattactacaccttcaaagccttcttggcacctatcaaatctgaacgcgactacaaagtataagttctacctaagagcctgcacaagtcagggatgtggtaaacccattactgaggaaagcagcactctgggggagggcagcaagggtattggaaaaattagtggtgtaaacttaacgcagaagacgcacccaatcgaggtattcgaacctggcgcagagcatattgtccggttgatgacaaagaactggggagataacgattcaattttccaggacgtgatcgagacccggggacgagaatacgcaggactctacgacgatatcagtacccaggggtggtttattgggctcatgtgtgccattgccctccttactctgcttctcctcactgtgtgtttcgtcaagcgcaacagagggggtaagtattcagtaaaggagaaggaagatctacaccctgaccccgagattcagtccgtgaaggacgaaacctttggagaatactccgactcagatgagaagccattgaagggaagccttaggtccttgaatcgtgacatgcagcctacagaatcagccgattctctcgttgagtacggggagggggaccacgggctcttctctgaggatgggtcatttattggtgcctacgcagggagcaaagaaaagggatctgtggagtctaacggctcgtctactgcgacctttccactgcgtgcttag

SEQ ID NO: 217749 - DNA, 291 bp, Artificial Sequence
  Description of Artificial Sequence: Synthetic coding sequence
atggagcccctcctgctgggtagagggcttattgtatatttgatgttcctgttgctgaagttttcgaaggccatcgagatccccagtagtgtgcagcaagtacccacgataattaaacaatctaaggtacaggttgcctttcctttcgacgagtatttccaaatagagtgcgaagccaagggaaatcctgaacctaccttctcgtggactaaagatggaaatcctttctactttaccgaccatagaattattccttctaataatagtggaacttttcggattcctaactag

SEQ ID NO: 217750 - DNA, 201 bp, Artificial Sequence
  Description of Artificial Sequence: Synthetic coding sequence
atggaaccgctcctcctgggacgaggtctgattgtgtatctgatgttcctgcttctaaaattcagcaaggcgattgagattccatcgtctgttcaacaagtgcctacgatcataaaacagtcaaaagtgcaggttgctttcccgttcgatgagtatttccagattgagtgcgaagcgaagggcaacccagaacctacttag

SEQ ID NO: 217751 - DNA, 546 bp, Artificial Sequence
  Description of Artificial Sequence: Synthetic coding sequence
atggaacccctgttgttgggtcgaggtctcattgtatatcttatgtttctgctgctgaaattctcaaaagctatagagatcccatccagcgtccaacaggtgcctaccattatcaaacagtcaaaagtccaagtggctttcccatttgacgagtacttccagattgagtgcgaggcaaaagggaacccagaaccaaccttttcctggaccaaagacggcaaccccttttatttcacagaccaccgcatcattccctccaacaacagcggaacttttcgcatcccaaacgagggtcatatttcgcatttccaaggcaagtaccgctgctttgcgagcaacaagctgggtattgccatgtccgaggaaattgagttcatcgtgccatcagtgcctaagtttcccaaagaaaagatcgacccactggaggtcgaagaaggcgatcctattgttctgccatgcaacccgcctaagggcttacctcctttgcatatatattggatgaacatcgaactagaacatatcgaacaggacgaacgagtgtactag

SEQ ID NO: 217752 - DNA, 954 bp, Artificial Sequence
  Description of Artificial Sequence: Synthetic coding sequence
taatctgttacgctgtatagtggggaggactatccggataccgcccctgtaattcatggagtcgacgtgataaatagtaccttggttaaggtgacttggtccaccgtcccaaaagatcgcgtccatggacggctgaaaggataccagatcaactggtggaagacaaagagccttcttgacgggcgaacccacccaaaagaagtaaatattttacgcttttccggccaaagaaactctggtatggtaccctcattggatgccttcagtgagttccatctgacagtgctagcctacaacagtaagggtgcgggtcccgaatctgagccctatatcttccaaaccccggagggcgtacctgagcagcccacatttctgaaggttataaaggtagataaggatactgcaacattatcttggggcctcccgaagaagttgaatggtaacctcaccggctacctcttgcagtaccagataatcaatgatacttacgagattggagagttgaacgatattaacatcactaccccgtcaaaaccatcttggcacctaagcaacctaaacgcaactacgaagtataaattttatcttcgggcatgcacttctcaggggtgtggaaagccaattacagaggagagctcaactcttggggaaggtaaatacgcaggcctgtacgatgacatctcgacacagggatggttcatcgggctgatgtgcgctattgcgttgttaaccctgctattattgactgtgtgcttcgtgaagcggaaccgcggtggcaagtatagcgtgaaagagaaagaggatctgcacccagatcccgagatccaaagcgttaaagacgagacatttggagagtactccgacagcgatgagaagcctcttaaagggagccttcggtcattgaatagagatatgcagcccacagagtccgccgatagcttggtggaatattag

SEQ ID NO: 217753 - DNA, 258 bp, Artificial Sequence
  Description of Artificial Sequence: Synthetic coding sequence
atggaaccacttctgctcggacgtggactgatagtgtacctcatgtttcttctgctaaaattttcgaaggccatcgagatccccagctcagtgcagcaggttccgacaatcatcaaacagtcgaaagtccaggtggctttcccttttgatgaatactttcaaattgaatgcgaagccaaaggcaaccccgagccgacgtttagttggaccaaggatggcaacccgttctacttcaccgaccaccgtatcattccctag

SEQ ID NO: 217754 - DNA, 450 bp, Artificial Sequence
  Description of Artificial Sequence: Synthetic coding sequence
atggagtcgcggggtaagtcagctagttctccgaagcctgatacaaaggtcccccaggtgactacggaagcaaaggtgccacctgcagctgacggaaaggcacctcttacaaagccttctaagaaggaagcccctgccgaaaaacaacagcctcctgcagccccaaccacagcacccgcaaaaaagactagcgccaaggccgatcccgctctgttgaataaccactctaatctgaaaccagctcctaccgtgccctcctctccagatgccactcccgaaccaaaagggcctggtgacggcgcagaggaggacgaagcagcttctggaggaccgggaggcagaggaccgtggagctgcgagaactttaatcctcttctggtcgccggaggcgtggccgtcgccgctattgcactgatcctcggggtggctttccttgtgcgtaaaaagtag

SEQ ID NO: 217755 - DNA, 627 bp, Artificial Sequence
  Description of Artificial Sequence: Synthetic coding sequence
atgagcagcgaaccgcctcccccttaccccggtggacctactgctcccctgctggaggagaaatcaggagcacctccaactccaggcagatccagcccagcagtcatgcaacctccccctggcatgcctttacctccggctgatatcgggccaccaccatatgagcccccaggccacccgatgccccaacccggatttattccaccccacatgagtgcagatggcacgtatatgccccctgggttttatcctccccctggccctcatccaccaatgggttactaccctcctgggccttacactccaggtccatacccgggacccggaggacacaccgctactgtcctcgtccctagcggtgctgcaaccacagttacagtacttcagggggagattttcgagggagcaccagttcagacagtatgccctcattgtcaacaggctatcaccactaaaatttcttatgaaattggactgatgaattttgtactggggttcttctgttgtttcatggggtgtgacctggggtgctgcctgatcccctgccttatcaacgactttaaagacgtgacccacacctgtcctagctgcaaagcctacatttatacatacaagaggttgtgctag

SEQ ID NO: 217756 - DNA, 456 bp, Artificial Sequence
  Description of Artificial Sequence: Synthetic coding sequence
atggctgcaagtacctctatggtccctgtggccgtgaccgcagcagtagctcccgtactgtctattaattccgacttttcagatctacgagaaataaaaaagcaactgttgctcatagcaggcctaacgcgcgagcgcggactcctgcatagctccaagtggtccgcagagctggccttttctctgcccgctctgcccctagctgaactccagccacctcctcctatcacagaggaggatgcacaggacatggacgcctacactctggccaaagcctattttgatgttaaagagtacgatcgtgccgctcacttcctgcacggctgcaattctaagaaggcttatttcctgtacatgtactcccgatacctggtgagggcgatcttgaaatgtcattccgcattctcagagacttctatcttcagaaccaatggaaaggtcaagagcttcaagtag

SEQ ID NO: 217757 - DNA, 1794 bp, Artificial Sequence
  Description of Artificial Sequence: Synthetic coding sequence
atggccgctagtacaagcatggttcctgtggctgtgactgcggcagtggcccctgttctctctatcaattcggacttcagcgacttaagagaaatcaagaagcagctgctgcttattgctggtttgactcgagagcgagggctgctccactcttccaagtggtcagctgaactcgccttctcattgccagcattacccttggcagaactccagccacctcctcccattactgaggaagacgcacaagatatggacgcttacacacttgccaaagcctatttcgatgtcaaagagtacgaccgcgctgcacacttcctccacgggtgcaatagcaagaaggcttactttttatacatgtattcaaggtacctcagtggggagaagaaaaaagatgacgaaactgtggattctctgggcccactggaaaagggtcaggtcaaaaatgaagccctcagagagcttcgagtcgaactctccaagaaacaccaggcaagagaactggacgggtttggcctgtacctgtatggtgttgtactaaggaaactggatctagtcaaagaagcaattgatgtatttgtcgaggctactcacgtccttccccttcactggggtgcatggttggagttatgtaacctgattacagataaggagatgttgaaatttctgagcctgcccgacacgtggatgaaggaattcttcctcgcgcacatttatacagagctgcagttaattgaagaggcactgcaaaaatatcagaaccttatcgacgttggcttttcaaagtcctcatatatcgtctcgcaaattgctgtggcgtaccataacattcgggacatagacaaggctctgagcatttttaatgaacttcggaaacaagatccctataggatcgaaaacatggacaccttcagcaatctgctctacgtaagatccatgaaatccgagttgtcatatctggcacacaacctctgcgagatcgacaagtacagagtcgagacttgttgcgtcatcggcaactactacagtctgagaagtcagcacgagaaagctgctctgtattttcagcgggctcttaagctgaaccctcggtacttaggagcctggactctgatgggacatgaatatatggaaatgaaaaatacaagcgccgcaatacaggcataccgccatgccatcgaggtgaataagagggattatcgggcttggtacggattaggacaaacatacgaaatccttaagatgcccttttactgtctgtactattataggcgcgctcatcaactgaggcccaatgactcgcgtatgctggtagccctaggcgaatgctatgagaagctgaatcagcttgtggaggcaaaaaagtgctactggcgagcctacgcagtgggagatgtcgagaagatggcgttagtcaagttagctaaattacacgaacagcttaccgagtccgaacaggccgcacagtgctatatcaaatacattcaggacatctacagctgcggcgagattgtggaacatcttgaagagtctactgcattcagatatctcgcccaatactactttaaatgtaagctgtgggatgaggctagcacatgcgcccagaagtgctgcgccttcaacgacacccgtgaggaaggcaaggcccttctgcgccaaattctgcagttgcgcaaccagggtgagacccctactacagaggtccctgccccattcttcctgccagcttctctgtccgccaataatacccccactagaagagtgagccccctgaatctgagttccgtgaccccctag

SEQ ID NO: 217758 - DNA, 1575 bp, Artificial Sequence
  Description of Artificial Sequence: Synthetic coding sequence
atggagctcggcccagagcctccccataggaggagacttctctttgcttgttcacctccgccagctagtcagcccgtggttaaagccctttttggggcaagtgctgcaggcggactcagccctgttacaaatttgaccgtaactatggaccagctgcaggggctcggcagtgattacgagcagcctctggaagtgaaaaataactccaatttgcagaggatggggtcatccgagtctaccgattcaggtttttgtttggacagccccggacccctagacagcaaggagaacttggagaacccaatgcgacgcatccatagcctaccccaaaagttgctgggctgcagtccggctctgaagaggtcacactctgactctctggatcatgacatcttccagctcattgaccctgacgaaaataaggagaatgaggcgttcgaatttaaaaagccagtgagacctgtctcaaggggctgcctgcatagccacggtctacaggaaggtaaggacctgttcactcagaggcagaattctgcccctgctaggatgttgtcgagcaatgagagggactcctcagagccagggaacttcatcccactgtttaccccccagtcaccagtaaccgccactctcagtgatgaagatgacggtttcgtggatctgctggacggtgagaacctgaagaacgaagaggaaacccccagctgtatggcatcactctggactgcccctctcgttatgagaacaaccaacttagacaatagatgcaaattgtttgattctcctagtctctgctcctcctcaactcgatccgtccttaagcgcccagagagatcccaggaagagtctccccctggtagtacaaaaagacgcaaatccatgtccggtgcaagtccaaaagagagcaccaaccccgagaaagctcacgagaccctacaccaatcactcagccttgctagttcccccaaagggacaattgaaaatatactggacaatgacccgagagatcttattggcgactttagcaagggctacctgttccacaccgtcgcagggaagcatcaggatctcaaatacatctcgcctgagatcatggccagcgtgctcaatgggaaatttgctaatctgattaaagaatttgtgataatcgactgcagatatccttacgaatacgagggaggtcatataaagggggcagtcaacctgcatatggaggaggaggtggaagactttctattgaaaaagccaattgtccctaccgacgggaaacgggtcatcgtggtgttccattgtgaatttagttccgagcggggaccacgaatgtgcaggtacgtccgtgagagggataggctcgggaacgagtaccctaaactgcactatcccgagctttatgttctaaaaggaggttacaaggagttctttatgaagtgtcagagctactgtgaaccgccttcctacaggcccatgcaccatgaagactttaaagaagatctgaaaaagtttcgtacgaagtcaagaacttgggccggagagaaaagcaagagagagatgtactcgcggctgaagaaactgtag

SEQ ID NO: 217759 - DNA, 1455 bp, Artificial Sequence
  Description of Artificial Sequence: Synthetic coding sequence
atggagcttggtcctgaacctcctcaccgcaggagactgcttttcgcctgtagcccacctccagcttctcagcccgtggtgaaggctcttttcggagccagcgccgcaggcggactatcccctgttactaatctgacagtgacaatggatcaattgcaagggctcgggtctgattacgagcagcctctagaagtgaaaaacaacagcaacctccagcgaatggggagcagcgagagcacagattccgggttttgcctggattcacccggacctctcgatagtaaggaaaacctggagaatcctatgcggagaattcacagtcttcctcaaaagctgttgggctgcagccccgctctgaagcgtagtcattcagattcattggaccacgacatttttcagctgattgatccggatgagaacaaagagaacctctcctcgaacgaacgggatagcagcgagccgggaaactttatcccgctgtttaccccgcagagtcctgtaacggcaacactgagtgatgaagacgacggttttgtggacttgcttgacggggaaaacttaaagaacgaagaggaaacgcctagttgcatggccagcctgtggactgctcccctggtgatgcgcacgactaatttagacaacagatgcaagctgttcgactctccctctctgtgctctagctctacccgctcggtgctgaaaaggcccgagcggagccaggaggaaagccccccaggctctacaaaacgtcgcaagagcatgtccggcgctagccctaaggagagcactaatcctgagaaggcgcacgagacactccaccaaagcctcagtctcgcttcttcacccaaagggaccatcgaaaacatcttggacaacgaccccagagacctcatcggagactttagcaaaggatacctgtttcacactgtggcgggaaaacatcaggatctaaagtacattagcccagagatcatggcaagcgtgttgaacggcaaattcgcgaatttgattaaagagttcgtaattatcgattgtcgatacccttatgagtatgagggtggccacatcaagggcgctgtcaatcttcacatggaggaagaagtggaggattttttgctcaaaaaaccaatcgtgccaactgacggaaaacgggtgattgttgtgtttcattgcgagttcagtagtgaaaggggccctaggatgtgtaggtacgtgagggaaagggaccggctgggcaacgaatatccaaagctacactacccggagctgtacgtattgaaagggggatataaggagtttttcatgaaatgtcagagctattgcgagcccccttcttatcgccctatgcaccacgaagattttaaagaggatctgaaaaaattcagaaccaagtccaggacgtgggcaggagaaaagagtaaacgggaaatgtactctcgactcaaaaaactttag

SEQ ID NO: 217760 - DNA, 432 bp, Artificial Sequence
  Description of Artificial Sequence: Synthetic coding sequence
atggaactcgggccagaaccccctcacaggcggcgtctgctgtttgcgtgttctcctccacccgcaagccagcctgtcgtgaaggctctgtttggtgccagcgctgccggagggctatcccctgttacgaacctcacagtcaccatggatcagctgcaggggcttgggtccgactatgaacagcctttagaagtgaagaacaactcaaatttacaaagaatggggagcagcgaatccaccgactccggattctgtttggactcacctggcccactagattcaaaggaaaacctggagaaccccatgagacgaatccattctcttcctcaaaaactgctaggatgttccccggctctgaagagaagccacagtgactcactggatcacgacattttccagctgattgatccagatgagaataaagaaaattag

SEQ ID NO: 217761 - DNA, 1743 bp, Artificial Sequence
  Description of Artificial Sequence: Synthetic coding sequence
atggaggtccctcagccagagccagcaccaggaagcgccctttcacccgcaggggtctgcggcggtgcccagagacccggtcacctacccggactgctccttggcagtcacggattactggggagcccggtgagggccgctgcctcttcaccagtgaccactctgacgcagaccatgcacgatctcgcaggccttgggagtgaaaccccaaagagccaagtgggaacgctgctgttccggtctaggtctcggttgacccacctgagtctctctcggagggctagcgaaagttctctgtcctcggagtctagcgagagttccgatgcaggactctgcatggacagcccctcccctatggacccacatatggctgaacagacattcgaacaggccattcaggcggcatcccgcatcattagaaatgagcaatttgccatccgacggttccaatcaatgccagtcaggctgctgggccactcccccgtgctcagaaacatcacgaactcccaggcacccgatggaagaaggaaaagtgaagcgggaagcggggctgcctctagttccggcgaggataaggaaaacgacggtttcgtttttaaaatgccttggaagcctacccacccatcttccacacatgccttggcggaatgggcttcccgcagagaggcattcgctcaacggcctagtagcgcacccgacctgatgtgtctgtcacccgaccggaaaatggaggtggaggaactgtctcctctagccttaggcaggttttccttgacacccgctgaaggggatactgaggaggatgatggtttcgtggatatcctagagagcgatttgaaagacgatgatgcagtgcctccagggatggagtccctcatctcggcaccacttgttaaaactctggagaaagaagaggaaaaggatttagtgatgtattccaagtgtcagcgattgtttaggagtccaagtatgccatgtagtgtaatccgaccaattttgaagcggttagaaagacctcaagaccgggatacccccgtccagaataagaggagacgatccgtgacaccaccagaagaacagcaggaagccgaggaaccgaaggcgagggtgttacgctcaaaatccctgtgccacgatgagatcgagaacctgctcgacagtgatcatcgagagctgattggagattactcaaaggctttcctgttacaaacagtggatggcaaacaccaggacctaaagtatatctcgccggagacaatggtcgccttgctgactggaaaattcagtaatatagtggacaaattcgtaattgtagactgtcgctacccatacgagtacgaggggggacacatcaagacagccgtcaacttgcctctggagcgcgatgccgaaagctttctcctcaaatctcccattgccccatgcagtctcgacaaaagagtgattctgatctttcactgcgagttttcctctgaacgcggacccaggatgtgccggttcattcgggaacgggaccgtgccgttaacgactacccctccctgtactacccagaaatgtacattcttaaggggggttacaaggaattcttcccacagcacccaaacttctgtgaacctcaggattaccggcctatgaaccacgaagcgtttaaggatgagctgaagacgtttagactgaagactaggagttgggccggagagagatcgaggcgtgagttgtgttccaggctccaggaccagtag

SEQ ID NO: 217762 - DNA, 1620 bp, Artificial Sequence
  Description of Artificial Sequence: Synthetic coding sequence
atggaggttccccagccagagcctgccccaggtagcgcgctgagtcctgcgggagtatgtggtggagctcagcgacctggccacctgcccggtctgctcctcggaagtcatggcctcctagggagccccgttcgggctgcagcctcctctcccgttacaactttgactcaaacaatgcacgacttagctggcctgggcagcgagacacctaaatctcaggtcgggacccttctctttcgctctcggagtcgattgactcatctgagtctatcaaggcgtgctagcgaaagttctctgtctagcgaatctagtgagagcagcgacgcaggtttgtgcatggacagtccaagcccaatggacccgcatatggcagaacaaactttcgaacaggccattcaagctgcgtctcgcattattcgcaacgaacaatttgctatacggcgatttcagtccatgcccgacgggtttgtctttaaaatgccttggaaacctacacacccctcctcgacccacgccttggcagagtgggcttcaaggagggaggcatttgctcagcgaccgtcctcagcgccagatctcatgtgcctgagccccgatagaaagatggaagtagaagaactgtccccccttgctcttgggaggttttctttaactcccgctgaaggtgacaccgaagaggacgatggtttcgtggacattttagagagcgacctgaaagatgatgacgcagtgcctcctggcatggaaagcctcataagcgcacctttggtaaaaaccttagaaaaagaggaggagaaagacctggtgatgtacagcaagtgtcagagattgttccgttctccgtcaatgccatgtagcgttattaggcctatactgaagcgcctcgaacgcccacaggatcgggacacacccgttcagaacaagcgaagacggagcgtgacacctccggaggagcagcaggaggctgaggagcctaaagcccgagtgctgcggagcaaaagcctctgtcacgatgagatcgaaaacctgctcgacagcgatcacagagagctgattggggactattccaaggcattccttcttcagacagttgacggtaaacaccaagatctcaaatacatcagtccagaaaccatggtggcacttctaaccggcaaattcagtaacattgtcgacaaattcgtgattgtggactgcaggtacccgtatgagtatgaggggggtcacattaagaccgcggtaaatctgcccttagaacgggatgccgagtcttttttgttgaaatcacctatcgccccttgctctcttgataagcgcgtcatactcatctttcactgcgagttttcatctgaacggggacctaggatgtgtcgcttcatccgagaacgagaccgagccgtgaatgactacccatcgctctattatcccgagatgtacattctgaaaggaggctacaaggaattttttccacagcaccctaacttctgcgagccacaggattaccggccaatgaatcatgaagcctttaaggatgaattgaagacctttagactcaagacaaggagctgggccggtgaaaggtcgcggcgagagttatgtagtcgacttcaggatcagtag

SEQ ID NO: 217763 - DNA, 1551 bp, Artificial Sequence
  Description of Artificial Sequence: Synthetic coding sequence
atgcacagtgaaacccccaagtcacaggttggcacactgctctttaggtcacggagcagacttacccacttgtctctgtctcggagagcaagcgagtccagcctgagttcagagtcttctgagtcatccgacgcagggctgtgcatggattcaccgagccctatggaccctcatatggctgaacagacttttgagcaggccatccaagctgcttccagaataatcaggaacgagcagtttgctatccgcaggttccagtcaatgccagtgagactgctcgggcactcccctgtgctgcgaaatataacgaatagccaggccccagacgggagacgcaaatctgaggctggtagcggggcagcaagctcttctggagaggacaaagagaacgatggatttgtgttcaaaatgccctggaaacccactcacccaagctccacccacgccttagcggagtgggcgagtaggagagaggctttcgcccagaggccatcgagcgctcccgatttaatgtgtctttcaccagatcggaaaatggaagtggaggaattatcgcccttagccttaggcaggttcagtctgacaccagctgagggcgacactgaggaggacgatgggttcgttgacatattggagtccgaccttaaagacgatgacgcagtgccccctggaatggaatccttaatcagcgcacctctcgtgaaaaccctggagaaagaagaagagaaagatctcgtgatgtactccaagtgccaacggttgttcaggagtccatccatgccctgctctgtgatacgcccaatcctcaaacgcctggagcggccacaggatagagacactcccgtacagaacaagcgacggaggagcgtcacaccacccgaggaacagcaggaagctgaagagcctaaagcaagagtgctgcggtctaagtccctgtgccacgatgagatcgaaaatctgcttgacagtgaccatcgcgaactgatcggtgactattctaaagcatttcttcttcagaccgtagacggcaaacaccaggacttgaagtatatctctcccgaaacaatggttgccttgctaaccgggaaattctcaaacattgtggataagttcgtcatcgtggattgccggtacccctacgaatacgaaggcggacacataaagacagctgttaatcttccactcgagagggacgccgagtctttcttactcaaaagccctattgctccttgcagtcttgacaagcgagtgatcctcatcttccactgcgagttctcgtccgagcgagggcctagaatgtgccgcttcatcagagagagagatcgcgctgttaacgattacccctctctctactaccccgaaatgtacatactaaaagggggttataaggaattcttcccacagcaccccaatttctgcgagccccaggattacaggcccatgaatcatgaggcattcaaagacgaattgaaaacgtttcggctgaagacccggtcctgggctggggaacgatcccggcgagagctgtgtagtagactgcaagaccagtag

SEQ ID NO: 217764 - DNA, 1470 bp, Artificial Sequence
  Description of Artificial Sequence: Synthetic coding sequence
atgcatagcgaaacaccaaaaagccaggtcggcacacttcttttcagatccaggtcaagattgacacacctgtccttgagtcggcgtgcatcagagtccagtctgtccagcgaatctagtgaatcttccgacgccggattgtgcatggattccccaagtccaatggatccacatatggccgaacagaccttcgagcaggcaatccaggctgcttccaggattattcggaatgagcaattcgcaatccggaggttccagtccatgcccgttaggctcctcggccactcccccgttctgagaaacataacaaattcccaagctcctgacgggcgtaggaaatctgaggcgggaagcggcgctgcgagtagttctggtgaggacaaagaaaacgacggttttgtcttcaaaatgccatggaaaccaacccacccatcatcaacccacgccctggccgaatgggccagtagacgggaggccttcgcacaacgaccctctagcgccccagatctgatgtgtctatcaccggatcgaaagatggaggtcgaggaattgtcccctctggctttgggacgattctcactgacgcccgcagaaggtgatacagaagaggacgatggtttcgtggacatcttggagagcgaccttaaagatctggtcatgtacagtaagtgccagaggctgtttaggtccccaagcatgccctgttcagtgataaggccaatcctgaaacgcctcgagcgccctcaggacagggatacgccggtgcagaataagcgcaggcgctcggtcactccccctgaggagcaacaggaagccgaagaaccaaaggccagagttttgagaagcaaaagcttatgtcatgatgagatcgagaatcttctcgatagcgatcatcgtgaactgattggagattattcaaaagcttttctgctgcagactgtggacgggaaacaccaagacctcaagtatataagtcccgagaccatggtcgcattacttacaggcaagttttctaacatcgtggacaaatttgttattgtagactgcaggtacccatacgaatatgaaggcggacacatcaaaaccgctgttaacctgcctcttgaaagggacgccgaaagcttcctgctgaagtccccaattgcaccctgctcccttgataagagagtaatcctaattttccattgtgaattctcaagtgaacgcggtccgcgtatgtgccgatttatcagggagcgagatagagcagtcaacgattatccctccctttattacccggagatgtacattttgaagggcggatataaagaattcttccctcagcatccgaatttttgcgaaccgcaggactaccggccaatgaaccacgaggcctttaaggatgagctcaagacttttcggttgaaaacaaggagttgggcaggggaacggtccagacgggagttatgtagcaggttacaggatcagtag

SEQ ID NO: 217765 - DNA, 1701 bp, Artificial Sequence
  Description of Artificial Sequence: Synthetic coding sequence
atggaagtcccccagcctgagcctgccccagggtctgccctctcacccgctggcgtttgcgggggagcccaaaggcctggtcacctgcccggactgctgctaggcagccacggattgctgggttcacctgtgcgtgctgccgcttcttcccccgtgaccactcttacacaaactatgcatgatcttgccggattaggttctagatcaaggctgacccatctgagtctctctaggagggcaagtgaaagcagtctctcctccgagagttctgaaagctccgacgccggtctgtgtatggactccccgagccctatggatccccatatggctgaacaaacctttgaacaggccatacaagcagcatctaggataattcgtaacgagcagtttgctatacggagattccagtcgatgccagttcggctgcttggacactccccggtgctgcgtaacattacgaatagccaagctccagacggaagacgtaagtctgaggcaggaagcggcgctgcaagttcttcaggggaagacaaggagaatgacggatttgtgttcaagatgccttggaagcccactcacccctcttccacacatgcactcgcggagtgggccagtcggagagaggcattcgcccagcgtccatcgtccgccccagatctgatgtgccttagccccgaccgaaaaatggaggtcgaggagctgagtcctctggcactgggcagatttagccttacacctgccgaaggagacacagaggaggacgatggttttgttgacatcctggaatctgatctgaaggatgacgacgcagtgccacccggaatggaatccctgatttccgcccctctcgtcaaaaccttagagaaggaggaagagaaagatctggtgatgtactctaagtgtcaaaggctgttccgtagccccagcatgccatgcagcgtgattagacccattctgaaaagactggagcgtcctcaggacagagacacgcctgtgcagaacaagcgccgacgcagtgtaactccaccagaggagcagcaagaagcagaggagccaaaagcccgagttcttcggagcaagtctctttgccacgacgagatcgagaacctgttagattctgatcatcgagagctgattggcgattactccaaggcctttctactgcagaccgtcgacggcaagcatcaggatttaaaatacatcagccctgagacaatggttgctctgctgactgggaaattttccaatattgtggataaattcgtgatagtggactgccggtatccctacgagtacgaaggcggtcacattaagacagcagttaacttgcctcttgagagagacgctgagtccttcctgctgaagtcacccatagccccatgctctcttgacaagagggtcatactaatattccattgtgagttctcttcagaaagaggtcctagaatgtgtagatttatccgtgaacgtgacagggcagtcaacgactatccaagtctatactaccccgagatgtatatcctgaagggaggctacaaggagttttttcctcagcaccccaatttttgcgaacctcaggattaccgcccaatgaaccatgaggcttttaaggacgaactgaagacttttcgtctgaaaacgaggagttgggccggagaaagaagccgtcgcgaactctgcagtcggctgcaggaccaatag

SEQ ID NO: 217766 - DNA, 2475 bp, Artificial Sequence
  Description of Artificial Sequence: Synthetic coding sequence
atgacggtcctgcaggagccagtgcaggcagcaatctggcaggctttgaaccactacgcctacagggatgctgtgtttctcgcagagaggttgtatgctgaagtgcactcagaggaagctttatttttactcgcgacatgttactaccgctcggggaaggcttataaggcttaccggctgttgaagggacatagctgcacaactcctcagtgcaaatacctgttagctaagtgttgtgttgatttgagcaagttagctgaaggcgagcagatcctatctggcggtgtgttcaacaagcagaaaagccatgatgatattgttacagagtttggagattccgcctgtttcacccttagtctcttggggcatgtgtattgcaagactgaccgcctggctaagggaagcgagtgctaccagaaatctctgagtctcaatccgtttttgtggtctccatttgaatccctttgcgagataggcgagaaacccgacccggatcagacatttaaattcacgagccttcagaatttttctaattgtctcccgaatagttgcactactcaagttcctaaccacagtctctcacacaggcaacctgagacagtgctgacagagactccacaggataccattgagcttaatcgtcttaacctcgagtcgtccaacagcaaatatagtctgaacaccgattctagcgttagctatattgattcggcagtcatctcaccagacaccgtccccctggggaccgggacatcaattttgtcgaagcaagtccagaacaagccaaagacaggacgaagcctgcttggcggacctgccgcattgagccctttaactccttcctttggtatccttcctttggagactccctcccctggggacggtagctacctgcagaactacacaaatactccgccagtcatcgatgtccctagtaccggtgctccgtccaaaaaatcagttgctagaatcgggcagactgggacaaaaagcgtcttcagccaatctggcaatagtcgggaagtgaccccaatccttgcgcagactcaatcctcaggccctcagacctctacaaccccccaggttctgagcccaaccatcacaagtccccctaacgctctccccagacgatcctcgaggttattcacatccgatagcagtacgaccaaagagaactcgaagaaactgaagatgaaattcccgcctaagatcccaaaccgcaagacaaagtccaaaaccaataaaggaggaattacacagcctaatataaacgacagcctggagatcaccaagctcgattcctcaattatctcggaaggaaaaattagcacgattactccccagattcaagcttttaacctgcagaaggccgctgcggaagggctgatgtccctgctgcgagaaatgggtaaaggatatctggcactctgttcctacaattgcaaggaggccatcaacatattaagtcaccttccgagccaccactataacacagggtgggtattgtgccagataggtcgtgcctacttcgagttgagtgaatatatgcaagctgaacggatcttctccgaggtgcgcaggatcgagaactaccgggtcgagggtatggaaatctactctaccacactctggcacctccaaaaagatgtggcgctcagtgttctaagtaaggatctgacagatatggataaaaacagcccggaggcatggtgcgccgcaggaaactgcttcagcctccagagggaacacgatatcgcaataaagttctttcagcgggctattcaggtggatccaaattacgcgtatgcctatactttgttagggcacgagtttgttctcactgaagaacttgacaaggccctcgcctgttttaggaacgcaattagggtgaatcccagacactataatgcttggtacggtctcggcatgatctactataagcaggaaaaattcagcctggctgagatgcactttcagaaggcacttgacatcaatccgcagagttccgtgctgctctgtcacatcggtgtcgtccagcacgccttgaaaaaatccgagaaggccttagatactttgaataaggctatcgtgatagatccaaaaaaccctctgtgtaaatttcacagagctagcgtgctgtttgccaatgagaagtataagtcagcactccaggaactggaggagctcaaacagatcgtcccaaaagaatccctggtttattttctaattggaaaggtgtataaaaagctaggccagactcacctggcactcatgaacttctcttgggccatggacttggacccaaagggggcaaacaatcaaatcaaggaggccatagataagcgttaccttcctgatgacgaagaacccatcacccaggaagagcagatcatggggacggatgagtcgcaagaatcgtctatgacggatgccgacgatacccagttacacgctgccgagtctgacgagttttag

SEQ ID NO: 217767 - DNA, 2292 bp, Artificial Sequence
  Description of Artificial Sequence: Synthetic coding sequence
atggcttccactaaaccgctctgtctgcctagatgcgggtttcccagaaggactcctctgtgccgtcgattggccgaaggggaacaaatcctgtccggcggagtatttaataaacagaaaagccacgatgatatcgtaacagaattcggcgattctgcttgctttactctgtcactgctgggtcacgtctattgtaaaacagaccggttggctaaaggctctgaatgctaccagaagtcattaagcctaaacccattcctatggtctccatttgaaagcttgtgtgaaattggcgaaaagccagaccctgatcagacgttcaaattcaccagcctccagaatttttctaactgcctgcctaacagctgcaccacccaagtccccaaccatagtctgtctcaccggcaaccggagacagtgctcaccgaaaccccccaggataccatcgagctgaaccgccttaatcttgaatcatcaaatagtaaatactctctcaatacggactcatctgtctcctacatagactccgctgttatttctccagacaccgtacctctggggaccgggacgagcatcctgtccaagcaggtgcagaacaaacccaaaaccggcagatcactcttgggcggaccagcagccttgtccccattgacgccatcctttggcatattaccgcttgaaaccccctccccaggcgatggaagttatttacagaattataccaacacccccccagtgatcgatgtgcctagtaccggggcaccgtctaaaaagagtgtcgcccgtattggccagacgggaaccaagtccgtcttttctcagagtggcaatagccgggaagtcacccccattttagcccagacccaatcctcagggcctcagacaagcacaacaccccaagtgttgagccccaccatcacatcacccccaaatgctttgccaagacgctcttcaaggctatttacatctgacagctcaactaccaaggagaactctaaaaaattaaaaatgaaattcccccctaagatccctaataggaaaaccaagtcaaaaaccaataagggtggtataacccaacccaacataaatgattctctggagatcaccaagctagacagttccattatcagcgaaggtaaaatctccaccatcaccccccagatacaggcctttaacctgcagaaggccgctgctgaagggctcatgtccttgttaagggagatgggaaagggatacttggccctgtgctcctataactgtaaggaggcaatcaacatactctcacatctgccttcccaccactataatacggggtgggtgttatgtcagatcgggagggcatactttgaactctcagagtatatgcaggcagagaggatattttcagaggtgaggaggatcgagaattatcgtgttgagggtatggagatttactcaacaactctgtggcacctgcaaaaggacgtggctctgagtgtgctctccaaggacctgacagacatggataagaatagccctgaggcatggtgcgctgccggaaactgctttagtctccagagggagcacgacatcgccatcaagttctttcaacgtgctatccaggttgaccctaactacgcgtacgcctacactctcctcggtcatgagttcgtcttgaccgaagagctggataaggcactggcctgctttcggaacgcaattcgcgtgaatcctagacattataacgcgtggtatggacttgggatgatctactataagcaggagaagttttccttagccgaaatgcatttccagaaagccctggatatcaaccctcaaagttctgtgctgctatgccatattggcgttgtgcagcatgcactgaagaaaagtgagaaggccttagacacgctgaacaaggcgatcgtgattgaccctaagaacccactgtgtaagttccatagagcgagcgtgctgttcgcaaatgaaaagtataagtctgctctgcaggagttagaagaactcaagcagatcgttccaaaagaatccctggtgtactttcttatcgggaaggtgtacaagaaactgggacagacccatctcgccctgatgaacttctcgtgggctatggacctggaccctaagggtgccaataaccagataaaagaggctattgataaaaggtatctgccagatgatgaagaaccaatcactcaggaggagcagataatgggtaccgacgagtcccaagagtctagcatgacggatgctgacgacacccaacttcacgccgctgagagtgatgagttctag

SEQ ID NO: 217768 - DNA, 2472 bp, Artificial Sequence
  Description of Artificial Sequence: Synthetic coding sequence
atgacagtactgcaggagccagtacaagcggcaatttggcaagccctgaaccattatgcttatagagatgctgtgttcctagccgagcgactgtacgccgaggtgcattctgaggaggctcttttcctgttagccacttgctactatcgctccggtaaggcttataaagcgtacaggttactgaaaggacactcctgtactacaccccagtgtaaatatctgttggctaaatgctgcgtagacctgtcgaaactggctgagggagagcagattctatcaggtggggtgttcaataaacagaagtcgcacgatgacattgtgactgagttcggagatagcgcctgtttcaccctctccctgctcgggcatgtctactgcaagacagacagattagctaaaggaagtgaatgttaccaaaaatccttgtcactgaatccttttctttggagtccattcgagtcactgtgtgagatcggtgagaaacctgacccagaccaaacattcaaattcacatccttgcagaacttctcaaattgtttgcccaactcttgtactacgcaggtgccaaaccactctctgtcacatcggcagcccgagaccgtcctaacagagaccccccaggacactatcgagttgaacagactcaatctggagtcatcaaattccaagtactctctgaataccgacagcagtgtgagctatattgactcagccgtgatctcccctgacactgtgcctcttggaaccggcacgtccattctgtctaagcaagtccagaacaagcctaaaaccggacgatcactgctcggaggtcctgcggctctgtctccactgactccaagctttggaatcctgccattggaaacaccgtcaccaggggatggctcatatctgcagaactacaccaacacaccgcctgtcattgatgttcctagcaccggcgcaccatctaaaaagtccgtcgctagaataggccaaaccggcactaagagcgtttttagccaaagcgggaactcccgggaggtcaccccaattctggcgcagacccagtcctcaggccctcagactagcacaacaccacaggtgctgagccctaccatcaccagcccaccaaacgcccttccacggaggagctcgcgtctgttcacctctgatagctctacaaccaaagaaaattccaagaagctgaaaatgaagtttccaccgaagatccctaaccgtaaaacgaagagcaagactaacaagggtggcatcacccagcccaatattaatgattcattggaaattacaaagctggactcatcaatcataagcgagggaaagattagtaccataaccccccagatccaggcttttaacctgcagaaggcggctgcaggtctaatgtccctgttacgggagatggggaagggttacctggctctatgcagttataattgcaaggaagctattaacatcctgagtcacctgccttctcaccactataacacgggttgggtcctgtgccaaattggacgggcttactttgagctgtcagagtacatgcaggcagaaagaattttttccgaggtgcgacggatcgaaaactacagagtagagggaatggaaatttatagcactacactgtggcacctccagaaagacgtggcactgagcgtgctgtctaaagacttgactgatatggataaaaactccccagaggcttggtgcgctgctggcaactgtttcagtctgcagcgcgagcatgacattgccatcaagttcttccagcgagccattcaagtggacccaaattacgcttatgcctacacattgttaggtcatgagtttgtactgaccgaggaactcgacaaggccctggcatgcttccgcaacgccatacgggtgaatcctcggcactataatgcttggtatgggctgggcatgatttactacaagcaggaaaaattctctctggctgaaatgcatttccagaaggctcttgatataaacccccaaagttccgtgctgttgtgccacataggcgtggtgcagcacgctctgaaaaagtcagagaaagccctcgacaccctaaacaaagccatagttatagatccaaagaatcccctctgcaaattccaccgggcttcagtcctctttgcaaacgaaaaatacaagtctgcccttcaagagctggaggaactcaagcaaattgttccaaaagagtctcttgtgtattttctcattggcaaggtgtacaaaaagctgggccagactcaccttgctctaatgaacttttcctgggctatggatctggatccgaagggtgctaataatcagattaaagaggccattgacaaaagatacctgccggacgatgaagaacctataacccaggaggagcagattatggggactgacgagtcacaagagagctcaatgacagacgctgatgacacacagctgcacgcagccgaaagcgatgagttttag

SEQ ID NO: 217769 - DNA, 2493 bp, Artificial Sequence
  Description of Artificial Sequence: Synthetic coding sequence
atgaccgttctgcaagagcccgtacaggccgcaatttggcaggctctcaaccactacgcatatcgcgacgctgtcttcctggctgagcgcctgtatgcagaagtgcacagcgaggaggctctgttcttactggccacatgttattatagaagcgggaaagcctataaggcttatcgactcctgaaaggccattcttgtacgacccctcagtgcaaatatcttctcgccaagtgctgcgtggatctgagcaagctcgccgagggagaacagatcctttccggaggtgtgttcaataaacagaaaagccatgatgacattgtaactgagttcggagacagcgcctgtttcactctgagcttgctaggccacgtgtactgtaagactgatcgcctcgctaaaggatcagaatgctaccagaaatcgctctctttgaacccctttctgtggagcccatttgaatcactctgcgaaattggcgagaaacctgaccccgatcaaaccttcaaatttacatctttacaaaactttagcaactgtctgcccaatagctgtaccacccaggtgccgaaccatagcctcagccaccggcaaccagagacagtgctgaccgaaacacctcaggataccatagagttgaaccggctgaatcttgagtcatctaacagcaagtattctctgaacacagattcctcagtttcgtacatcgattccgcagtaataagtcctgatactgtgcccctgggcaccggcaccagcattctgtcaaagcaggtgcagaacaaacctaagactggtcgatccttgctcggcggaccagcagctctaagcccgctcacaccgtcgtttggaatcctgccccttgaaaccccatctcccggagacggaagctatttacaaaactacaccaatacccccccagtcatcgacgtgccctcaaccggagcaccatctaaaaaaaccttcagagtcttgcagtcagtggccagaattggacagaccggaactaaatccgttttctctcagtctgggaactcccgtgaggtgacacccatcctggcccagacccagtcttccgggccacagacctccactaccccacaggtgttgtctcctacaatcacgtcacccccaaatgcactgccacgcagatccagtcgactgtttacctctgactcctccaccacaaaagagaactcaaagaagttgaaaatgaaatttcctcctaagatcccgaacagaaaaactaaaagtaaaaccaataaagggggaatcacacagccgaatataaatgactccctggagatcacgaagctcgacagttccatcatcagcgagggcaagatctcgacaatcactcctcagatccaggccttcaatcttcagaaggcagctgccgagggtcttatgagcctattgcgggagatgggtaaggggtatctggcactgtgctcctacaattgtaaagaggccattaatatcctgtcccacctcccgagccaccactacaacaccgggtgggttctttgtcagattggccgagcctatttcgaactgagtgaatacatgcaggccgagagaatatttagtgaagttcgcagaattgagaattaccgagtcgaaggcatggaaatttacagcaccaccctgtggcacctgcaaaaggacgtggcactatccgtgctttccaaagacctgacagatatggacaagaacagtccagaagcctggtgtgccgctggcaactgtttttctttgcaacgagaacacgacattgctataaaattctttcaaagagcgatccaggtggacccgaattatgcatacgcctacaccctgctgggacatgaatttgtgttgactgaggaactggataaggccctcgcctgctttaggaatgccattcgcgtcaatccgaggcactacaacgcatggtacggactagggatgatttactacaagcaggaaaagttcagcctagctgagatgcattttcaaaaagctctggatatcaatccccagtcctccgttcttctctgtcacattggggttgtacagcacgcacttaagaagagcgaaaaagccttggacacactaaacaaggctatcgtcatcgatcccaaaaacccactgtgtaagttccatcgagcatccgtactttttgccaatgaaaaatataaatctgcacttcaagagctggaggaactgaaacaaatcgtcccgaaagaaagcctggtgtacttcctcatcggtaaagtctataagaagcttgggcagacacaccttgccctgatgaacttcagttgggccatggacttggaccctaagggggctaacaatcagatcaaagaggctattgacaaaagatatctgcccgacgatgaagaacccattacgcaggaggaacaaatcatggggacagatgagagccaggagtctagcatgacggatgctgatgatacacagctacatgccgctgagtccgatgagttttag

SEQ ID NO: 217770 - DNA, 1740 bp, Artificial Sequence
  Description of Artificial Sequence: Synthetic coding sequence
atgagcgccgctatagctgccctcgctgcttcctacggatcaggatctggatcagagtccgatagcgattctgagtctagccgttgccccctgccagccgctgactccttaatgcatttaaccaagtccccaagcagtaagccatcccttgcagtggctgtggactctgcgccagaggtggctgtcaaggaggacctggaaaccggtgtccatcttgatccagctgtcaaggaagtgcagtataatcctacctatgaaactatgttcgctcccgagtttggtccagaaaacccttttcgcactcaacagatggcagccccaaggaatatgctcagtggttatgcagagcccgctcacattaacgacttcatgttcgagcaacagcgccgaacatttgctacctatggctatgcgctggatccgtccttggataatcatcaggtatccgcaaagtacatcggcagtgtagaagaggccgagaaaaatcagggattgacagtattcgaaaccgggcaaaagaagactgagaagcgcaagaagttcaaggagaatgacgcatctaacatcgacggcttcctcggtccatgggctaaatacgtcgacgagaaagatgtagctaaacctagtgaagaagagcagaaagagctagatgaaatcaccgcaaagcggcaaaagaaaggcaagcaggaagaggaaaagcccggagaggagaagacaattctacatgttaaagagatgtacgactatcagggcaggtcttatctccatatacctcaggatgtgggagtcaatctgcgcagtacgatgcctccggagaaatgctatcttcccaagaaacagattcacgtatggtcgggacacactaagggtgtttcagccgtgaggttatttcccctctccggccacttgttgctgtcctgtagtatggattgcaagattaaactgtgggaggtctatggcgaacgacgttgcctacgaacgtttatcgggcattccaaagccgtcagggatatttgcttcaacacagccggaactcagttcctatccgccgcttatgataggtacttaaagttgtgggacacagaaaccggccagtgcattagcaggttcacgaacagaaaagttccttactgtgttaagtttaaccccgatgaggacaaacagaacctcttcgttgccggaatgtctgacaaaaaaatcgtgcagtgggacataagatcgggcgagatcgtccaagagtacgaccgccatttgggagccgtgaataccatcgtgttcgtggacgaaaaccgtaggttcgtgagcacaagcgacgacaagtcactgcgggtgtgggagtgggatatccctgttgacttcaaatacatcgcggagcctagtatgcactctatgccggcagtcaccttgtcacccaatggcaagtggctggcatgtcaaagcatggacaaccaaattctcatcttcggcgcacaaaatcgttttcgattgaataagaaaaagatttttaaaggtcacatggtggctggttatgcttgccaggtggatttttcccctgatatgtcttacgtgatcagtggagacggtaatggtaaacttaacatttgggattggaagacaaccaaactgtacagtagatttaaagcccatgacaaagtttgcatcggcgctgtgtggcaccctcacgagacgagtaaggtgataacctgtggatgggacggccttattaaactttgggattag

SEQ ID NO: 217771 - DNA, 1620 bp, Artificial Sequence
  Description of Artificial Sequence: Synthetic coding sequence
atgtcagccgctatcgcagccctagccgcaagttacggttccggttctggatccgagtcagattccgattcagaatctagcagatgtcccttgccggctgcagacagtctgatgcacctgaccaaaagcccttctagtaagccgtctctcgctgtagcagtggacagcgctccagaagttgcagtgaaggaggatctggaaactggggtccatttagatcccgcagtgaaggaggtgcagtataaccccacttacgagactatgttcgcccctgagtttggcccagaaaacccatttcgcacccagcagatggccgcacctcgcaacatgctaagcggttatgccgagcccgcacatattaatgatttcatgtttgaacagcagcggcgtacgttcgcaacttacggatatgctttggacccatcactcgataaccaccaagtctccgccaagtatatcggaagcgtagaggaggcggaaaagaaccagggcctcaccgtgtttgagacgggccagaaaaagaccgagaaacgcaaaaagtttaaagagaacgacgcgagtaacatcgatggcttccttggtccatgggccaaatatgttgatgaaaaagatgtggctaagccttcagaggaggaacaaaaggagcttgacgaaataacggccaagcgccagaagaagggaaagcaggaggaagagaaacccggagaggaaaaaacaatcctccacgtcaaagagatgtacgattaccaaggtcgcagttatctccacatcccgcaagacgtgggcgtgaacctacggtccaccatgcctccagagaaatgttacttaccaaaaaagcaaatccatgtttggagcggccatacaaaaggggttagtgccgtgagactatttcccctctctgggcatctgctgctgagctgcagcatggactgcaagatcaaactttgggaagtttatggtgaaaggagatgccttcgtactttcatcggccactcaaaagctgtccgcgacatttgttttaacacggcaggaactcagttcttgtccgccgcttatgaccggtatctgaagctgtgggataccgagaccggacaatgcatctctcgcttcaccaacaggaaggtgccttattgtgtcaaattcaaccctgacgaggacaagcaaaacctcttcgtggctggtatgagtgataagaagatagtgcagtgggatatcaggagcggagaaatcgtacaggagtatgaccggcacctgggcgcagtgaacactattgtgttcgttgacgaaaacaggcgcttcgtgtccacttcggatgacaaaagcctgcgagtatgggaatgggacatcccagtcgattttaaatatatcgccgagcctagtatgcattccatgcctgccgtaactctgagccctaacgggaagtggttggcttgtcagagcatggacaaccaaatcctgatttttggcgcacagaatcggttcaggctcaataaaaaaaaaatatttaaaggtcatatggtggccggatacgcttgtcaggttgatttctctccggacatgcgcgtcccacagtcctttcagaaccttaaggaagtcactgctggccctcaagaaggctag

SEQ ID NO: 217772 - DNA, 1740 bp, Artificial Sequence
  Description of Artificial Sequence: Synthetic coding sequence
atgtcagctgctatagcagcactcgcagcatcctacggatctggatccgggtcagagagtgattcagattcggagtcgagtcgctgccctcttccagccgcagactctttgatgcatctgactaaatccccatcctctaaaccgtcattggccgtggccgtcgacagcgctcctgaggtcgctgtaaaagaggacctggagaccggggtccacctggatccagccgtgaaagaagttcaatataatcccacatacgagaccatgttcgcccctgagtttggccctgaaaatcctttccgtacccagcagatggcagctcctcgcaatatgctaagtgggtatgctgagcccgcacatattaatgacttcatgtttgagcagcagcgccgtacctttgcaacttacgggtatgctttggacccatccctggataatcaccaggttagtgctaaatatattggctccgtcgaagaagctgaaaaaaaccaggggctcaccgtatttgagacaggacagaagaaaacagagaaacgaaaaaaatttaaggagaacgatgcatccaatatcgatggatttcttggtccgtgggccaaatacgttgacgaaaaggacgttgccaaaccgtccgaagaagagcagaaggagctggatgagataaccgcaaagcgacagaagaaggggaaacaggaagaggagaagcctggggaggagaagaccatcctccacgtcaaggagatgtatgactaccagggccgatcatacctccacatccctcaggatgtcggcgtgaatctgagatctaccatgcccccagaaaagtgttacctgcctaaaaagcagattcatgtttggtccggccataccaaaggcgtcagtgcagtgcggcttttcccgttgagtggtcatctgcttctgtcctgctccatggattgtaaaatcaaactctgggaggtctatggcgagagaagatgccttagaacttttattggacacagtaaggctgtccgggacatctgtttcaatacagccggaacacagttcttaagcgcagcatacgaccgatatctcaagctttgggacactgagacagggcagtgtatatccaggttcacaaaccgcaaggtcccctactgtgtcaagtttaatccagatgaagacaagcagaatttattcgtggccggaatgagcgacaaaaagattgtccagtgggatattaggtccggcgaaattgtgcaagagtacgatcggcacctgggtgccgtcaataccatcgtgtttgtggacgagaaccgcaggttcgtttctacaagtgatgataagagcctgcgcgtgtgggagtgggatattcccgttgacttcaaatacatcgcagaaccatccatgcactcaatgcccgcagtcacactgtcccccaatggcaagtggctggcttgccagtcgatggataatcaaatcttgatcttcggcgcacaaaatagatttcggcttaacaaaaaaaagatttttaaagggcatatggttgctggctacgcttgccaagttgatttctcacctgatatgagttatgtgatcagtggtgacggtaacggtaagctcaatatctgggattggaagacaaccaaactctacagcaggtttaaagcacatgataaggtttgtataggggcagtctggcatcctcacgaaacatccaaagtaatcacctgcggatgggacggccttataaagttgtgggactag

SEQ ID NO: 217773 - DNA, 1620 bp, Artificial Sequence
  Description of Artificial Sequence: Synthetic coding sequence
atgagcgccgctattgctgcccttgcagcgagttacggtagtggctctgggtctgagagcgacagcgactccgagtcttcccggtgtcctctaccggctgccgattctctcatgcatctcacaaaatctccatcctccaaaccttccctggcagtggcagttgatagcgcccctgaagttgccgtgaaggaagacctggaaacaggagtccatttggacccggcagtaaaggaagtgcagtataaccctacctacgaaacaatgttcgctccagaattcggtcctgaaaacccatttaggacacagcagatggctgcacctagaaacatgctgagcggctacgccgagcccgcacatatcaatgacttcatgttcgagcaacagagacgcaccttcgctacctatggctacgcacttgatccttctctggataaccaccaggtaagcgctaaatatatcggaagcgtggaggaggcagaaaagaaccagggcctcacagttttcgaaactggacaaaaaaagacagagaagagaaagaagttcaaggagaacgatgcatcgaacattgacggttttctgggaccgtgggctaaatacgttgatgagaaggatgtggccaagccatctgaggaggagcagaaggagctggatgaaattacggccaaacggcagaaaaaaggcaaacaggaggaagaaaaacctggtgaggaaaaaacaatacttcacgtaaaagagatgtacgactaccagggacggagctacctccatatccctcaggacgtgggggtgaatttaagaagtacaatgccgcctgagaaatgttatctcccaaagaaacagatccacgtctggtcaggacatactaaaggtgtcagtgccgtgagactgttcccgctgagtggccatcttctgctttcctgtagcatggactgcaaaatcaaactctgggaggtctatggggagagacggtgtttacggacatttattgggcattctaaagccgtaagagatatttgctttaataccgccggaacacagtttctcagcgcggcttacgatcggtacctgaaactgtgggatactgaaaccggtcagtgcatcagtcgctttacgaatagaaaggttccctactgcgtcaagttcaatcctgacgaggacaagcagaatctgttcgtggccggtatgagtgacaagaaaattgtgcagtgggacataagaagtggggagattgtccaggagtacgaccggcacctcggcgctgtgaacaccatcgtctttgtagatgaaaataggcggttcgtgagcacatccgacgacaaatcccttcgtgtttgggagtgggacatccccgtcgacttcaagtatatcgcagaaccctctatgcattccatgcccgcagttactttgagtcctaatggtaaatggcttgcgtgccagtcaatggacaaccagatcctcatcttcggagcacaaaaccgtttccggctgaataagaaaaagatattcaaaggccacatggtcgcgggatacgcatgtcaggtcgacttctcaccggatatgcgagtgccacagtcttttcagaacttaaaagaagtgacagctggcccacaggaaggctag

SEQ ID NO: 217774 - DNA, 378 bp, Artificial Sequence
  Description of Artificial Sequence: Synthetic coding sequence
tgaaatatgctatccggctatgctgagcctgcccatatcaacgatttcatgttcgagcagcagcggcgaactttcgccacctatgggtacgcccttgaccccagtctggacaatcaccaggtgagcgccaagtatattggctctgttgaagaggctgaaaagaatcagggactcactgtttttgagacagggcagaaaaagacagagaagcgcaagaaattcaaagaaaacgacgccagcaatattgacggctttcttggtccgtgggccaagtacgtggacgagaaagacgtcgccaaacccagcgaggtgtctttcgatgtcttcaattgccaattcaggtatacactatatttatacgaaggataccttcattag

SEQ ID NO: 217775 - DNA, 495 bp, Artificial Sequence
  Description of Artificial Sequence: Synthetic coding sequence
atgtcagccgctatcgcagcactggccgcttcctacgggtccggctcgggctcggaaagcgacagcgactcagagtcttccagatgtccgctccctgccgctgacagtctgatgcacctcacaaagagtccctcctccaaaccatccttagcagttgcagtggactcagctcctgaggtggctgtaaaggaggatctagaaaccggcgtgcacctcgatccagcagtgaaagaggtgcagtacaacccgacatatgagactatgtttgcccctgaatttggcccagaaaatcctttccgcactcagcagatggcggctcctcggaatatgctgtcagggtatgccgaacctgcccatatcaacgattttatgttcgaacagcagagaagaaccttcgccacttatgggtatgcgctggaccccagccttgataaccaccaagtctcggccaagtacatcggctccgtggaggaggccgaaaagattaaggtctag

SEQ ID NO: 217776 - DNA, 213 bp, Artificial Sequence
  Description of Artificial Sequence: Synthetic coding sequence
atggcagccccacgaaatatgcttagtgggtacgccgaacctgctcatattaatgattttatgttcgagcagcagcggaggacattcgctacttacggctacgctttggatccgtccctcgataatcaccaggtctccgccaagtacatcggctccgtcgaggaggccgagaaaaatcagggtcttactgtgtttgaaacagggcagaagtag

SEQ ID NO: 217777 - DNA, 1305 bp, Artificial Sequence
  Description of Artificial Sequence: Synthetic coding sequence
atgagtatccttaagattcacgcaagagagatcttcgattcaagaggcaatccgaccgtggaggtagatttgttcaccagcaaaggattgtttagggccgctgtcccatctggggcttccactggcatttatgaagcccttgagcttcgtgacaacgataagacccgttatatgggtaaaggtgttagcaaggctgtcgaacacattaacaagaccattgcaccggcattagtcagcaaaaaactcaatgtgaccgagcaagaaaaaattgataagctcatgattgagatggacggtaccgagaacaagtcaaaattcggtgccaatgcaatcctgggcgtcagccttgcggtatgcaaagccggagctgtcgaaaaaggagtgcccctgtataggcatattgcagaccttgcgggaaatagtgaagtcatcttgccagttccggcattcaatgtgattaacgggggatcacatgcaggaaacaagctagccatgcaggagttcatgatccttccagtcggcgcagccaacttccgcgaggctatgagaataggcgcagaagtctaccataatcttaagaatgtcattaaggaaaaatatggcaaagatgccactaatgtgggagatgaaggagggttcgcaccgaatattttagaaaacaaggaaggactcgagctgctgaagaccgcaattggtaaagccggatatacggataaagtggtgataggcatggacgtggcagcctccgagtttttcaggtctggcaaatacgacctggatttcaaaagccctgacgatccctcccgctatatctccccagatcagctcgcagacctttacaagagctttattaaagattatcccgtagtttcgatcgaggaccccttcgatcaggatgactggggggcttggcagaaatttaccgctagtgcaggaatccaagttgttggggacgatctaaccgtaaccaatcccaaaagaatcgccaaggcagtcaatgagaagtcatgcaactgtctactcctgaaagtgaatcaaattggatcagtgaccgaatccctgcaggcctgcaaattggcccaggccaacggctggggggtcatggtctctcaccggagtggggaaaccgaagatacttttattgctgacctggtggtgggattgtgtactggccagattaagacaggcgctccatgcagatctgagagactggcaaagtacaatcagcttctacggattgaagaagaattagggtctaaggcaaagtttgccggtaggaactttagaaatcctttagcaaaatag

SEQ ID NO: 217778 - DNA, 360 bp, Artificial Sequence
  Description of Artificial Sequence: Synthetic coding sequence
atgcgtaagactgccagcagttgcccggcatcactgacttgcgattgctatgccaccgacaaggtgtgttccatctgcctgtctagacgacagcaggttgccccacgagcaggcacacccggatttagagctcccgaggtgttgactaagtgtcctaaccagacaaccgggaagtccattttgtgcagcaaggaagtgcctgcacaggatctgcggaagctgtgcgagagattacgaggcatggacagctctacacccaagttgaccagcgacatccagggacacgcatcgcaccaacctgctattagtgagaagaccgaccacaaagccagctgcctggtgcagaccccccctggttag

SEQ ID NO: 217779 - DNA, 474 bp, Artificial Sequence
  Description of Artificial Sequence: Synthetic coding sequence
atggaggcatccttgggaatacaaatggacgaacctatggctttcagcccccagcgggacaggttccaggccgaagggagtctgaagaagaacgagcagaatttcaagctagccggagtcaagaaggacatcgaaaaactctatgaagcagttccccagttatctaacgttttcaagatcgaggacaagatcggggagggaacttttagctcagtgtatctggccacagcacagcttcaggtggggcctgaagaaaaaattgctctcaaacacttgataccaacaagccatccgattcggatcgctgccgaattgcaatgcctaacagtagcgggaggacaagacaacgtgatgggggtgaaatactgcttccggaagaacgatcatgtcgtaatcgctatgccctatctggagcatgaatcctttttggatatccttaactcgctgtcttttcaagaggtgagggagtactag

SEQ ID NO: 217780 - DNA, 1725 bp, Artificial Sequence
  Description of Artificial Sequence: Synthetic coding sequence
atggaagcgagcttggggatacaaatggacgaaccgatggctttttctccacagagggaccgctttcaggccgaggggagcctcaagaagaatgagcagaattttaagcttgccggagtcaaaaaggatatcgaaaagctctacgaggcagtccctcaactgtctaacgtctttaaaattgaggacaaaatcggggagggaacattttcttctgtctacctggcgacagcacaactgcaagtgggaccagaagagaaaattgccctgaaacatctcataccaacctcacacccaattagaattgccgcagaactgcagtgcctcacggtcgctggaggccaggataacgttatgggggtgaagtattgctttcgtaaaaacgatcatgtagtcattgccatgccctatctcgagcatgagagcttcttagatatcctcaactcccttagctttcaggaggtgcgcgagtatatgctcaatttgtttaaggccctaaagagaatccatcagttcggcattgtccatcgcgatgtcaaaccctccaactttctttacaatagacgacttaaaaaatatgccttggtggacttcggcttggctcagggcacccacgacaccaaaattgaattgcttaagttcgtgcaaagtgaggcacagcaggaaagatgctctcaaaataagagccacatcatcactggaaataagatacctctctccggccctgtacctaaagagttggaccaacagtccaccaccaaagccagcgtgaagaggccatacacaaacgcccagattcaaataaagcagggtaaagatggaaaggaaggctccgtgggattgagcgttcagcgttctgtgttcggtgagcggaactttaacattcacagttctattagccacgaatctcccgcagtgaagttgatgaaacagtccaagactgtggacgtgctgtctcgtaagcttgcgaccaaaaaaaaggccatctcaacaaaggtgatgaactctgccgtgatgcggaagacggcctcatcttgtccggcttccctcacatgcgactgctatgccacagacaaggtatgtagcatttgtctatccagacgtcaacaggtggccccaagagccggaacaccaggctttagagcccctgaggttctaaccaagtgtcccaaccagactaccgctatcgatatgtggtctgctggtgtgatttttctaagtctgcttagcgggagatatcctttctacaaagcctctgacgatctgaccgctctagcacagattatgacaatccgaggctccagagagactattcaggctgccaaaacgtttgggaaatccatcctgtgttccaaagaggttcccgctcaggacctgcgcaagctctgtgaacgcctacggggtatggatagttccactcccaagctcacttcagacatacaaggccatgcttctcatcagcccgcaatttccgaaaagacggaccacaaggcctcctgtctggtgcagacgcctcctgggcagtattcaggcaactcgtttaagaaaggtgattccaattcctgcgagcattgtttcgacgaatataataccaacttagaaggctggaacgaggtccccgatgaagcatacgacttgcttgacaagctgctggacctgaatcccgcaagccgcatcaccgctgaagaagccctgcttcatccgttcttcaaggatatgagcctctag

SEQ ID NO: 217781 - DNA, 1641 bp, Artificial Sequence
  Description of Artificial Sequence: Synthetic coding sequence
atggaggcctcgctgggtattcaaatggacgagccaatggcattttctccccaaagagacaggttccaggctgagggttctttaaaaaagaacgagcaaaatttcaaactggctggcaccttcagcagtgtctacttagcaacagcacagttgcaagtgggcccagaagagaagattgcgcttaagcaccttattcctacctctcacccaatccggatagccgcagaattgcagtgcttgactgtcgcaggcggacaggacaatgtgatgggtgtcaagtactgtttccgtaagaatgatcatgtggtcatagctatgccatatctggaacacgagagtttcttggacattctcaactcgctgtctttccaggaagtgcgagagtatatgcttaatctgtttaaagctctgaaaagaattcaccaattcggaatcgttcaccgggacgtgaagccctcaaatttcctgtataatcgcaggctgaaaaaatacgccctggttgactttggcctggctcagggcacacacgacactaagatcgaattactcaagtttgtccagtccgaagcgcaacaggaacgctgtagtcagaataaatcccatatcataacagggaataagattcccctgtctggaccagtgcccaaggagttggatcagcagtccaccaccaaagccagcgtgaaacgaccctacactaatgcacagatccagatcaagcagggtaaggatggaaaagaaggcagcgtgggactgagcgtgcagaggagcgttttcggagaaaggaactttaacattcactcctctatatcacacgagagccccgctgtgaaactcatgaagcaaagcaagactgtcgatgtcctgtctaggaagctggcaaccaaaaaaaaagcgatctccactaaggtcatgaatagcgccgtaatgaggaaaacagcctcgtcctgcccagcttcacttacctgcgactgttatgcgaccgataaggtttgctccatttgcctctcgagacgtcaacaggtggcccctagggctggtaccccgggttttcgggctccagaagttctcaccaaatgtcccaaccagaccaccgcaatagatatgtggtctgcgggtgtcattttcctttccctgctctccggcaggtaccccttctacaaagccagtgatgacctgacggctcttgcccagatcatgactatcagagggagccgcgagaccatacaagctgctaagacctttggcaaatctattctgtgttccaaggaggtacccgcacaggatttgcggaaactgtgcgagcgccttcggggaatggattcttcaactcctaaactgacctcagacattcagggccatgcaagtcatcagcccgctatctctgaaaaaaccgaccacaaagcgagctgcctagttcagacacccccaggccagtactctggcaactcattcaagaagggcgattccaactcctgcgagcactgcttcgatgagtacaatacaaacttagagggttggaatgaggttccggatgaagcatacgaccttctcgataaactcctcgacctcaatcccgcatctcgaattaccgctgaggaggccctgttacacccattttttaaagacatgtccctgtag

SEQ ID NO: 217782 - DNA, 3453 bp, Artificial Sequence
  Description of Artificial Sequence: Synthetic coding sequence
atggcacagtttggaggtcagaaaaacccgccatgggcgacccagttcactgccacagctgtcagtcagcccgctgccctgggtgtgcaacagccgagcttgcttggagcctccccaaccatctacactcagcagaccgcactggcagctgccggtttgactacgcagacccccgctaactaccaacttacccagacagcggctctgcagcagcaggccgctgcggcagcagctgccctacagcagcaatacagtcagccccagcaagcactgtattcagtccagcagcaattacagcagccgcagcaaacattgttaactcaaccagcagtggcactcccgacgtctctgagcctttccaccccacagcctactgcacagattacggtcagctatcctacaccacggtcctcccagcaacagacgcagccccagaagcagcgtgtgttcacaggggtggtcactaagctccacgacaccttcggcttcgtggacgaagacgtgttctttcaattgtcggccgtgaaagggaagacacctcaagtcggggatcgggtgctcgtggaagctacgtataatcctaacatgccttttaaatggaacgctcagcggatacagacattgccgaaccagaatcagtctcagacacaaccgctccttaagactcctcctgccgtgctgcagcctatagccccacagaccacgttcggtgttcagacccagccacagcctcagtctctcctgcaggcacagatctcagctgcctccataacaccccttcttcaaacccagcctcagcccctgctgcaacaaccacagcagaaagcaggactgctccagcccccagttcgaattgtctctcagccacagccagcacggaggctagatccaccaagtagattctctggtagaaacgatcgcggagaccaggtgcccaacaggaaggatgataggtccagggaacgcgagcgagagcgccgtagaagtcgggagcgttccccacagcgtaagaggagccgcgaaaggtcccctagaagagagagggaacgcagtccacgcagagttcggagagtggtcccacgctacacagttcagttctccaagttctccctggactgtccttcttgcgacatgatggaactccgacggagataccagaatctgtacattccctccgacttttttgatgctcaatttacctgggtggatgccttcccactctcccggccattccaactgggcaactattgcaatttctacgtgatgcacagggaggtggagagcctggagaagaatatggctatcctggatccccctgatgctgaccatctgtattcagccaaggtcatgcttatggcttctccgagcatggaggacctctatcacaaatcgtgcgcccttgctgaggacccccaggagctgagggatggctttcagcatcccgcaaggctggtgaagtttctggtcgggatgaaggggaaagacgaggctatggccatcgggggacactggtccccatcactggacggcccagatcccgagaaagatccatcggtgctgatcaagacggccataaggtgctgtaaagctctgactggtatcgacttgtctgtctgtacgcagtggtacaggtttgcagagattaggtatcatcgaccagaagagacgcataagggcagaacagtgccggctcacgtggaaaccgtcgtcctcttctttccggatgtgtggcactgtttgccaactagaagtgaatgggaaacactttctcgcggttataaacagcaattggtggagaagctccagggcgaacggaaggaggcagatggcgaacaggatgaggaagagaaagacgacggggaagcaaaagaaatctccacgccaactcactggtccaagttggaccccaaaacgatgaaggtcaacgatctgcgcaaggaactcgagagtagggccctgtcgagcaaggggctgaagagccagctgattgccagactgaccaagcagctcaaggttgaggaacagaaggaagaacagaaggaattggaaaagtcagagaaagaagaagatgaagacgatgataggaagtccgaggatgataaggaggaagaggaaagaaagaggcaggaagaaatcgagcggcaacggagagaacggagatacatactccctgatgagcccgctatcattgtacatccgaactgggccgcaaagagcgggaagtttgattgtagcatcatgagtctatccgtgctactggattatcggctggaagataataaggagcactctttcgaagtgtcactctttgccgagctttttaatgagatgctccagcgagactttggagtcagaatctacaagtccttgcttagcctgcctgaaaaggaagacaagaaagaaaaagacaaaaaatccaaaaaagacgagcgtaaagacaagaaggaagaaagggacgatgagaccgacgaacctaagcccaagcgacggaagagcggcgatgacaaagataagaaggaagacagagatgagagaaagaaagaggacaagcgcaaggacgactccaaagacgacgatgaaaccgaggaggacaataaccaggacgagtacgatcccatggaggcagaggaggccgaggacgaggaggacgatcgtgacgaagaagagatgacaaaacgggatgacaaacgcgatattaaccgctattgcaaggagagacccagtaaggacaaggaaaaggagaagacccagatgattaccattaaccgggacctcctgatggcattcgtgtatttcgaccagagccattgcggttacctgctggagaaagaccttgaggagattctatacactctcggcctccacctgtcacgggctcaggtgaaaaagctcctgaataaggtcgtgctcagagaaagctgcttctatcgcaaactgaccgatacatcaaaggatgaggagaatcacgaggagtccgaaagcttgcaggaagatatgctgggcaataggttgctgctgccgaccccaaccgtcaagcaggagtccaaagacgtagaggaaaatgtggggctaattgtgtataacggtgcaatggttgacgtaggctcactcttgcagaagttggaaaaaagcgagaaagtgcgtgccgaggtggaacaaaaacttcagctgcttgaggagaagaccgatgaggacgaaaagacaatacttaatctcgaaaactccaacaaatccctgagtggcgaactacgcgaggtgaagaaggacctttctcaactgcaagaaaacctcaaaatcagcgagaatatgaacctgcagtttgaaaatcagatgaataaaacaatccgaaatcttagcactgtgatggatgaaatacacactgtgctgaaaaaggacaatgtcaagaacgaggacaaggatcagaaatcaaaggagaatggggcatccgtatag

SEQ ID NO: 217783 - DNA, 3408 bp, Artificial Sequence
  Description of Artificial Sequence: Synthetic coding sequence
atggcgcagttcggaggacagaagaaccctccgtgggccacacagtttactgctaccgctgtcagccagcctgccgcattaggggtgcagcagcccagcttattgggagcttccccaacaatatacacacagcagaccgccctggccgctgccggtctcactacccaaacccctgccaactaccaactgacacagaccgcagcactgcaacaacaggccgctgctgccgcagccgcactgcagcaactgcaacagccccagcaaactctgctgacccagcccgcagtcgccctgccgacatcactctccttgtccacacctcagccaactgcccagataaccgtgtcctatccaacaccgagatcttcgcagcagcaaactcagcctcagaagcaacgagtctttacaggcgtggttacaaagctgcatgatacctttggttttgtggatgaagatgtgttttttcaactgtcggcagtcaagggcaaaaccccccaggttggggacagagtattagtcgaggccacatacaaccccaacatgcccttcaagtggaacgcacagcgtatacaaacccttcctaaccagaaccagtcacaaactcagccccttctcaaaacgcctcccgctgtactccaaccgatcgccccacagacaacattcggggtccagactcagccgcagcctcagtcgctgttgcaggctcaaatctctgctgcctcaatcaccccactgcttcaaactcagccgcagcctttgctgcagcagccgcagcaaaaggccggattactccagccccctgtgcgcatcgtgtcccagccccagcccgctcgaagactagatcccccatctcggttttccggcagaaacgatcgaggagaccaggtcccaaataggaaggacgatcggagccgcgagcgcgaaagggagagacggaggtctagggagcgcagcccccagcgcaaacgaagcagagaaagaagtccacggagagagagagagagaagccccaggagagtcagaagagttgtacctcgctatacggttcagttctccaagttctccctcgactgcccatcctgtgatatgatggagctacgcagaaggtatcagaatctctacatcccttccgacttttttgacgcccagttcacttgggtggatgccttcccactgtccaggccttttcagttaggaaattactgtaacttttatgtcatgcacagagaagtagagagcttggaaaaaaatatggctatcctggaccctcccgatgccgaccacctttattctgccaaagtgatgttgatggcaagcccatccatggaggatctgtaccataagtcctgtgcccttgccgaagatccccaggaattgcgggatggttttcagcaccctgcacgtttggtgaagttcctcgtgggtatgaaaggaaaagatgaagcaatggctatcggcggacattggtctcctagcttagacgggccagaccccgaaaaggaccccagcgtgcttatcaagacggccattagatgttgcaaggcgctcaccggcattgacctctccgtttgcacccaatggtatcggttcgcagagataagataccatcggcctgaggaaacccacaaaggtcgaacagtgcctgctcacgtggagactgtggtactcttctttccagacgtctggcattgcctccccacacgctccgaatgggaaacactgagtaggggctacaagcaacagcttgtcgagaaattgcagggcgaaagaaaagaagccgatggcgaacaggatgaggaggaaaaggatgatggggaggccaaggaaatctcaacaccaacgcattggagtaaactggatcctaagacaatgaaggtgaatgaccttcggaaggaactggaaagccgggcactctccagcaagggcctaaaatcccagctgatagccagactgactaaacagcttaaggtggaggagcagaaggaggaacaaaaagagctggaaaaatccgagaaggaggaggatgaagacgacgaccgaaagagcgaagatgataaggaggaagaggaaaggaaaagacaggaggaaatcgaacgccagcgcagggagcgcaggtatatcctacccgatgagcccgctataattgttcacccaaactgggcggctaaatcagggaagttcgattgtagtattatgtccctgagcgtgttgctcgattatagactggaggataataaggagcattcttttgaggtctccctgtttgccgaactctttaacgaaatgcttcagcgggatttcggagtgagaatatataagtctctgctgagtctgcccgagaaggaggataaaaaagagaaagataaaaaaagtaagaaggatgagcggaaggataagaaagaggagcgcgacgacgaaaccgatgagccgaagcccaaaagacgcaagtccggtgacgacaaggacaaaaaggaggacagggatgagagaaagaaggaggataagagaaaagatgatagcaaggacgacgacgagacggaggaggacaataatcaggatgaatatgaccctatggaggccgaggaggccgaagatgaggaagatgacagggacgaggaggagatgaccaaacgtgatgacaagcgcgacatcaaccgctactgtaaagagagaccctccaaggataaggaaaaggagaaaacacagatgattacgataaacagggacctcttgatggctttcgtatactttgaccaatctcactgtggataccttctggagaaagacctcgaggaaattttatatacgttaggcctccatctgtctcgcgcacaggtcaagaaactgctcaacaaagtggtattacgcgagagttgcttctatcggaagctgactgatacttccaaggacgaggagaatcatgaggaaagtgaatccttgcaggaagacatgttgggcaaccggttgctgttgccaactcctaccgtgaaacaagagagcaaggatgttgaggaaaatgtaggtttgatcgtgtataatggggctatggtcgatgttgggtcgttgttgcaaaaactggagaaaagcgagaaagtgcgcgctgaggtcgaacaaaaactgcaactgctcgaggagaagaccgatgaggacgaaaaaactattcttaatctagagaatagcaataagtccctcagcggcgaactccgtgaggtgaaaaaggacctatctcagctgcaggagaacctgaagatcagtgagaacatgaaccttcagtttgagaatcagatgaacaagactattaggaatcttagtaccgtaatggacgagatacacaccgtgctcaaaaaagataacgtgaaaaacgaggataaggaccagaaaagcaaggaaaacggtgcctcggtgtag

SEQ ID NO: 217784 - DNA, 360 bp, Artificial Sequence
  Description of Artificial Sequence: Synthetic coding sequence
atggcacagttcggcggtcagaaaaatccaccgtgggcaactcagttcactgccacagctgtgagtcaacccgctgcactaggcgttcagcagccctccctgctaggggcttctccgaccatttacacgcaacagacggcactggctgctgctggactgacaacccaaactccagccaattaccagcttactcagactgccgctctgcagcagcaggccgctgctgctgcggcagctctgcagcaacagtactctcagccccagcaggcgttatactctgtgcagcaacagctccagcagccccagcagacgctgctgacccagcctgctgtggccttgcccacatcgctgtccctctag

SEQ ID NO: 217785 - DNA, 516 bp, Artificial Sequence
  Description of Artificial Sequence: Synthetic coding sequence
atggctcagtttgggggtcaaaagaatcccccttgggctactcagtttaccgccaccgcagtgtctcagcccgcagctctcggtgtgcagcagccatctctcctcggagccagccctaccatttatacccagcagacagccctggccgcagcagggcttacaacacagacgcccgcaaattaccaactgactcagaccgctgccctacagcagcaagctgctgctgctgcggcagccttgcagcagcagtactcacagcctcagcaggcattatactctgtgcagcagcagcttcagcagccccagcagactctcctgacccagcccgctgtcgcccttccaacaagtctgtcactttctacacctcagccaactgctcagataacagtttcctatcccacgccaagaagctcacagcagcagacacagccgcagaagcagcgggtgtttaccggagtggttacgaaactgcacgacaccttcggctttgtggacgaagacgtgtttttccaatag

SEQ ID NO: 217786 - DNA, 3132 bp, Artificial Sequence
  Description of Artificial Sequence: Synthetic coding sequence
atggctcaattcggtggccaaaagaaccctccctgggcaacacagtttaccgccacggccgtcagccagcctgccgctctgggagtccaacagccctcccttctcggggctagtcctactatctacacccaacagactgctcttgcagcagctggcctgacaacccaaacgccagccaactatcagctgacacagacagccgcactgcagcagcaggctgccgcagccgctgccgctctgcagcaactccagcagccccaacagactttgctcacccagcccgcagtcgcgctgccaacaagtttgtcgctgagtacgccccaacctactgctcaaatcaccgtgagttaccctacaccgcgatcaagtcagcagcagactcagccccagaaacagagagtgtttaccggagtggtgactaagttacacgatacatttgggttcgtcgacgaggacgttttttttcagctttccgctgtcaagggcaaaacccctcaggtcggagatcgggtactggtcgaagcaacctacaaccctaatatgccattcaagtggaacgcacaaaggatccagaccctgcccaatcagaatcagtctcagacgcagcctctgctgaaaacccctccagcggtcctacagccgattgctccccagactaccttcggcgtacagacacaaccacagcctcagtccctgctccaggctcagatctctgcagctagtattaccccgctgcttcagacgcaaccccagccactgttgcagcagcctcagcagaaggccggtctgctgcagcctcctgtgagaatcgtctcccaaccgcagcctgctcgtagactcgatccaccgagtagattctcaggaagaaacgatagaggtgatcaggtccctaatcgcaaagacgaccgatcaagagagcgggagcgggaacggaggcgctcccgcgagaggagtccgcaaaggaagcgcagcagggaacggagccctcggagagaaagagagcgctctccccgtagggtccgacgcgttgtacccagatacactgtgcaattcagtaagttctcgttggattgtccatcatgcgatatgatggaattgaggcgcagataccagaatctttacatcccatccgatttcttcgacgcacagtttacctgggtggatgccttccccctgtctagacctttccaacttgggaactactgcaatttctatgtcatgcacagggaagtggagtccctcgaaaaaaatatggcgattctggatccacctgatgccgatcatctttattcagccaaggttatgcttatggcctcaccaagcatggaagacctgtaccacaagtcttgtgctctagccgaagatccgcaggaacttcgagatggcttccagcatcccgctcgacttgttaagttcctcgtggggatgaaaggtaaggatgaggccatggctattggcggacactggtcgccatccttggatgggccagatcctgagaaggatccatccgtgttgatcaagacagcgattagatgttgtaaagctctcactggcatcgatctgtcggtgtgcacgcaatggtatcggtttgccgagattaggtaccatcggcctgaagaaacacacaaggggagaacagtacccgctcatgttgagacagttgtgctgttttttccggatgtttggcactgcttaccaactcgcagcgaatgggagaccctgagtagaggctacaaacagcagctggttgaaaagctgcaaggcgagcgcaaggaggccgacggcgagcaggatgaggaggaaaaggacgacggtgaagcaaaggagatctcaaccccgacccactggtctaagctcgatcctaagacgatgaaagtcaacgatctacggaaagagctcgagtccagggccctatctagcaaaggactaaagtcccagttgatcgcgagactcactaaacagcttaaggtagaagaacaaaaagaagagcaaaaagaattggaaaagtctgagaaagaagaggacgaagatgatgacagaaagagcgaggacgacaaagaagaggaggagcgtaaacgtcaggaggagatagagagacaacggagagaacggcgatacatcctccccgatgagcccgcaattatcgtccaccctaactgggccgctaagtccggtaaattcgattgttccatcatgtctctgagtgtcctcttagattaccgcctcgaggacaacaaagagcacagttttgaggtgtccctatttgcagagctgtttaatgagatgctacagagggacttcggggtgcggatttataagagtcttctatccctccccgagaaggaggataagaaggaaaaagacaagaagagtaagaaagatgagaggaaggataagaaagaggaacgcgacgacgaaacggatgagccaaagcccaagcgacgtaagtctggtgacgataaggacaaaaaagaggacagagatgagcggaaaaaagaagacaaaagaaaggacgatagtaaagacgacgacgagacagaagaggataataaccaagatgagtacgacccaatggaagctgaagaggccgaagatgaagaagacgatcgagatgaggaggagatgacgaagcgagacgataaacgggatataaatcgctattgcaaagagcggccttcaaaagataaagagaaagaaaaaacccagatgatcacgattaaccgtgatctgcttatggctttcgtctacttcgaccagtcccactgcggatatctcttggagaaggatctagaggaaattttatatactctcggacttcacctctccagggctcaggtcaaaaagctgttaaacaaggttgttttacgtgagtcctgtttctacaggaaactgactgacacatctaaggatgaggaaaatcacgaagagagcgaatccctccaagaagacatgttgggtaacagattactgctccccacgcccactgtaaaacaggaatctaaagacgtcgaagagaacgtgggcctcatagtatacaacggcgctatggtcgacgtggggtccctactccaaaaactcgaaaagtctgagaaagtgagagccgaggtggaacagaaactccagttgctgtag

SEQ ID NO: 217787 - DNA, 726 bp, Artificial Sequence
  Description of Artificial Sequence: Synthetic coding sequence
atgtttgcacgtggactaaaacggaagtgcgtggggcatgaagaagatgttgagggcgcactggcgggtctcaagacagtgagctcctattctctgcaaaggcagtctttactggacatgtccctagtcaagttgcagctctgccatatgctggtggaacctaacctttgccgtagcgtgctgattgctaacacggtgaggcaaatccaggaagagatgactcaggacggaacctggagaacagtcgcaccgcaggccgcagaaagagcccctctagatcgactcgtctcaactgagattctatgtagagccgcatgggggcaggaaggggctcatcccgcacctggactgggcgatggccatacacagggccctgtgagcgacctttgccctgtgacctctgctcaggctccacgtcatctccaaagcagcgcctgggagatggacggcccacgtgaaaaccgaggaagctttcacaagagcttggatcagatcttcgaaaccctcgaaacaaagaatccttcatgtatggaagagttgttctctgacgttgattcaccttactacgaccttgacacagtgttgactggaatgatgggcggagccaggccagggccttgcgagggcctcgaggggctcgccccagctacccccggacccagctctagttgcaagagtgacctcggagaactggaccacgttgtggagatacttgttgaaacctag

SEQ ID NO: 217788 - DNA, 726 bp, Artificial Sequence
  Description of Artificial Sequence: Synthetic coding sequence
atgtttgccagagggctcaagcggaaatgcgtggggcacgaggaggacgtcgagggcgctctcgctggactaaaaaccgtcagctcctactccttacagagacagtccctgctggacatgtctcttgtgaagctgcagctgtgccacatgctggtggagccaaatttatgtagatctgtgctcattgccaacacggtaagacagatccaggaagagatgacccaggacgggacctggaggacggtcgccccacaggcggcagagagagcccctttagaccgtctggttagtaccgagattctttgccgagctgcctggggccaagaaggagctcaccctgccccaggactcggagatggtcatactcagggcccagtgagtgacttgtgccccgtgacctctgcccaggcccctcgacatctacagtctagtgcttgggaaatggacggtcctagggaaaatcggggttcctttcacaaatctctcgaccaaatcttcgaaaccctcgagactaagaatccttcttgcatggaagagttgtttagcgacgtcgacagcccttattatgatttggataccgtgttaacaggtatgatggggggagccaggcctgggccatgcgaaggactggagggcttggcccctgctaccccagggccaagctcttcatgtaaaagtgatttgggcgaattagatcacgtggtagagattctcgtggagacctag

SEQ ID NO: 217789 - DNA, 759 bp, Artificial Sequence
  Description of Artificial Sequence: Synthetic coding sequence
atgtcaggaagacgaactcgctcaggcggagccgcacagcggagcgggcctcgcgcaccgtcccctactaagccattaagaagatcccagaggaagtctgggtctgaactgccgtctatactgccagagatttggcctaaaactcctagcgccgctgctgtgaggaaaccgatcgtccttaagagaattgtggctcacgccgtggaggtccccgcagtgcagtcacccagacgctcaccacgcatttcctttttccttgagaaagagaatgaacctcccggaagggaattaaccaaggaagatttattcaagacgcattccgttccagccacaccaacatcgactcccgtgcctaaccctgaagccgaaagttcttctaaagagggagagctcgacgcccgtgatctggaaatgagtaagaaggtcagaaggtcttattcacgactcgagactttaggctcggcttctacctctacacccggaagacgctcctgttttggatttgagggattgctgggcgctgaagatttgtctggcgtgtccccagttgtctgcagtaaactgacagaggtgccaagggtctgcgccaagccctgggcccctgacatgactttgccgggtattagtcctcctccggaaaagcaaaaaaggaagaagaaaaagatgcccgagatactcaagacagaactggacgaatgggccgctgcgatgaacgctgagttcgaggccgcagaacaattcgacttgttggttgagtag

SEQ ID NO: 217790 - DNA, 216 bp, Artificial Sequence
  Description of Artificial Sequence: Synthetic coding sequence
caattcctggatcaggaagactggggtccccagcggacttccaaggaaataagacagctccagaacgactgcatgagactacgagagtctctcaataccacacaagttcacaacctggcactgggggaaaagctgcagaacttacctaccctgttgtacaaatccctgaaggaaggagctcaagccattcaggaggaggctcaggccatccagtag

SEQ ID NO: 217791 - DNA, 1353 bp, Artificial Sequence
  Description of Artificial Sequence: Synthetic coding sequence
atggacgcaagaagggtgccccaaaaggacctcagagtcaaaaagaaccttaagaagttccgttacgtgaagttgataagtatggaaacctcgtcgtcctctgatgacagttgtgattcgttcgcttctgataactttgctaatacgaagccaaaatttcgtagtgacatcagcgaggagctggccaacgtcttctacgaagactccgataatgagagtttctgcgggtttagtgagtcggaggtgcaagatgttctcgaccattgtggatttcttcaaaagccaaggcccgacgtgaccaatgagctcgcgggtatctttcacgcggacagcgacgacgagagcttttgcggttttagtgagtcagagatacaggatgggatgagactgcagtccgtgcgtgagggctgcagaacacggtcacagtgtaggcacagcgggccactccgcgttgcaatgaaattccctgccagatcaaccaggggtgccaccaataagaaggccgagagccgccaaccttctgaaaatagcgttactgactcgaacagtgactccgaagatgaatcaggcatgaactttctcgaaaagagggccctcaacatcaaacagaacaaagcaatgctagctaagctgatgtccgagctcgaatcgtttccaggcagcttccggggacggcatcctctccccggtagcgacagccagagccggagaccacgacgcaggacttttcccggtgttgcatctcggaggaatccggaacggagggccagacccctgaccagaagcaggagccggattttagggtcgctggacgctcttcccatggaagaagaagaagaagaggataaatatatgctcgtcagaaagcgtaaaaccgtagatgggtacatgaatgaggatgacctgcctcgctctcgacggtcgaggtccagcgtgactttacctcatattatccgtcccgtggaagagattacagaagaggagcttgagaacgtatgtagcaatagtcgggagaagatctataaccgcagcctgggctccacctgccatcagtgtcgccaaaaaaccatcgatactaagactaactgtaggaatcctgactgttggggggtccgcggacagttttgcgggccatgtctgagaaacaggtatggagaagaggtcagagacgcgctgctggaccctaactggcattgtcccccttgtcgcggaatatgtaattgttcattttgccgacaacgggacggcagatgtgctacaggagttctggtctaccttgcgaagtatcacggtttcgggaatgtccatgcttaccttaagtctctgaaacaggagttcgagatgcaagcttag

SEQ ID NO: 217792 - DNA, 1116 bp, Artificial Sequence
  Description of Artificial Sequence: Synthetic coding sequence
atggatgccagaagggtccctcagaaggacctgcgcgttaagaagaacctgaagaagttccggtatgtgaagcttatatccatggagacaagtagctcatcagacgattcctgcgacagttttgcatcagataactttgccaacacccgtctccaaagcgtgcgggaagggtgtcggacgcggagtcagtgcaggcattccggcccactgcgcgttgccatgaaatttcctgccaggtcaaccagaggcgctacaaacaagaaggcagaatcccgccagccatctgaaaactcagtgaccgactccaacagtgacagtgaggatgagtcgggaatgaacttcctcgagaagcgtgcactcaacatcaagcaaaataaggccatgctcgccaaactaatgtccgagctggaatcatttcctggctcatttagagggaggcatcctctgcccggttccgacagccagagtagacgccctcggagacggaccttcccaggcgttgcctcccgtcgcaaccccgagaggcgggctcgtcccctaaccagatcccggtctcgcattttaggaagccttgacgcgttgcctatggaagaggaggaggaggaggataagtacatgttggtacgcaagagaaagacggttgacggctatatgaatgaggacgatctgccccgaagtcgtagatctcggtcttccgtcactctgcctcacatcattcggcctgtggaggaaataacagaagaagaactggaaaacgtgtgtagtaatagtagagagaaaatatataatcgctctttgggctccacatgccatcagtgccggcagaaaactattgacacaaagactaactgtagaaaccctgattgctggggtgtccggggtcagttctgcggtccttgtctaaggaatcggtatggggaggaggtccgtgatgcacttctggacccaaattggcattgtccgccatgccgcggaatttgtaactgctcattctgcagacagcgcgatgggcgttgtgccaccggcgtgctggtgtacctggcaaagtatcacggttttggaaacgtccatgcctacttaaaatctctcaagcaggagttcgagatgcaagcctag

SEQ ID NO: 217793 - DNA, 966 bp, Artificial Sequence
  Description of Artificial Sequence: Synthetic coding sequence
atggatgcgcgtagggtgccacaaaaggatcttagagtgaaaaaaaatttgaaaaagttccggtacgtcaagctgatttcaatggagacatccagctcctccgacgactcctgtgattcttttgccagtgacaatttcgccaatactcgattgcaatcggtgcgcgagggatgtcgcacccgctctcaatgtaggcatagcgggccactgcgtgtcgcaatgaagtttcccgcacgtagtacaagaggagcaacaaataagaaagcagaatcacggcagccctcagagaatagcgtaactgactccaatagtgactctgaagatgagtccggcatgaacttcctggagaaacgggcacttaacatcaaacaaaataaagccatgctagccaagttaatgtctgagctcgagagtttcccgggaagttttcggggtagacatcctctacccggaagcgacagccaaagtagacggccaagaagacgcacctttcccggtgtggcaagtcgacgtaatcccgaaagacgcgctcggcctctgacacgctcccgttcacgcatcctaggcagcctagacgctcttcctatggaagaggaggaggaggaagacaagtatatgctggtgcggaagagaaaaactgtggatggctacatgaacgaagatgatctaccaagaagccgtcgatcccgaagctcagtaaccctgccgcatattatacggccagtcgaagaaatcaccgaggaagagttggaaaacgtgtgcagtaattcaagagagaaaatctataaccggtctctgaattggcactgccccccttgcagagggatctgtaattgtagtttttgccgccagcgcgacggccgatgcgctaccggcgtgctggtctacctagccaagtaccatggctttggcaacgtgcatgcttaccttaagtctctcaaacaagaatttgagatgcaggcatag

SEQ ID NO: 217794 - DNA, 1263 bp, Artificial Sequence
  Description of Artificial Sequence: Synthetic coding sequence
atggaaaccttgtctagtgaggaatcgtgcgattcatttgattctttagaatcaggcaaacaacaggatgtgaggtttcacagtaaatactttactgaggagctcagacgcatattcatcgaggataccgactccgagactgaggattttgccggtttcacacaatcggacctaaatgggaaaactaatcctgaggtgatggtagtggaaagcgatctttccgatgatgggaaagcatctcttgtgtcagaagaagaggaggacgaggaggaagataaggcgaccccgcgaagaagtcggagccgcagatcctccatcggcctaagggtggcctttcagtttccaactaaaaagttagccaacaagccagacaaaaatagcagttccgaacagttattttcctcggcaagactgcagaatgagaagaaaacaatcctggagagaaagaaagactgtagacaagtgattcagcgggaagacagcacctctgaatccgaagacgattcaagagatgaaagccaggaaagctctgacgccctgctgaaaagaactatgaatattaaggaaaacaaagctatgttagcccaactgcttgcagaactgaattctatgcccgatttttttccagtaagaacccctacgagtgcttctcgtaaaaagactgtccgccgtgcttttagtgaaggccagatcacccggaggatgaatcctacacgatccgccagacccccagaaaaattcgctctggaaaactttaccgtgtctgccgctaaattcgctgaagaattctatagcttcagaaggcgcaagacaattggaggcaagtgccgcgaatatcggagacggcaccgcatctcaagctttcgccctgtggaagatatcacggaggaagatctcgagaatgtggcaatcaccgtccgcgacaaaatttatgataaggttctgggcaatacttgtcatcagtgcagacagaagaccatcgatacaaaaacagtgtgccgcaaccagggctgttgcggcgttagaggccagttctgcggtccctgtttgcgcaatagatacggagaggatgtcaggtcagctctcttggaccctgattgggtgtgtcccccttgccgtggcatctgtaattgcagttattgtcggaagagggacgggagatgtgcgacgggcatcctcatccacctggccaaattctatgggtacgacaacgtcaaggaatatttagaaagtctacagaaggaattggtcgaagacaattag

SEQ ID NO: 217795 - DNA, 1227 bp, Artificial Sequence
  Description of Artificial Sequence: Synthetic coding sequence
atggagttggcaacccgctatcagattcctaaggaagtggctgacatttttaatgccccaagcgacgatgaagagttcgtcggatttagagacgacgtcccaatggaaaccctgtcatcagaagaatcttgtgattccttcgattcccttgaatctggcaagcaagtcgtcgagtccgatctatcagacgacggaaaagcaagtcttgttagcgaggaagaagaggacgaggaggaggacaaagccacccccaggcggagtaggtcccggagaagtagcataggcttgcgggttgctttccagtttcccactaagaagctggcgaacaagcccgataagaatagctctagcgagcaactcttctcgtctgcacgtctgcaaaatgaaaaaaaaaccatcctcgagcgaaaaaaagattgcagacaggttattcagagggaagatagcacctccgaaagcgaagacgacagcagagacgagtctcaggagtcgtcagacgctttgctaaagaggacaatgaatatcaaagaaaacaaggcgatgctggcccaacttctggcggagctgaatagtatgcctgactttttcccggtgcgcacgcccaccagtgcttcaaggaaaaaaaccgttagacgcgcatttagcgagggtcagattacacggcgtatgaatcccacacggagcgccagacccccagagaaattcgccctggagaactttacagtctccgccgctaaattcgccgaagaattctattcttttcgacgacggaagacaataggcggtaagtgtagggaatacaggcggagacatcggattagttcctttcgccctgttgaggacataacagaagaggatctggaaaacgtcgccataacagtgcgggacaagatctatgacaaggttctgggaaacacatgccaccaatgcagacagaagactattgatactaaaacagtatgtaggaaccaaggttgttgcggtgtgcggggacagttttgcggcccatgcttaagaaaccgatacggcgaggatgtgagaagtgcgctactcgatcctgattgggtgtgccccccatgtcgcggaatctgcaactgttcttactgcagaaagcgggatggcaggtgtgccaccggaatactaattcacctggctaagttttacggatacgacaacgtcaaggagtatcttgagagccttcaaaaagaactcgtagaggacaattag

SEQ ID NO: 217796 - DNA, 1365 bp, Artificial Sequence
  Description of Artificial Sequence: Synthetic coding sequence
atggagctggccacccgctatcagatccctaaagaggtggctgatatctttaatgcaccttccgacgatgaggaatttgtgggttttcgcgatgacgtgcccatggagaccttgtcctctgaagagtcctgcgacagtttcgacagcctcgaaagtggcaaacagcaagacgtgcgattccactccaagtatttcaccgaagaacttaggcggatttttattgaagacacagactccgagactgaagattttgcgggattcacccagagcgacctgaatggtaagaccaacccagaggtcatggtggtggaaagcgacctgagcgatgatgggaaggcatctttagtttctgaggaagaggaggacgaggaagaagataaagccacccctcgcaggagccgtagcagaagaagctccattggactccgagtggccttccagtttcctacaaagaaattggcaaacaaaccagataagaactcctcgtcagagcagctattctcatccgcaaggctgcagaacgaaaaaaagactattttggaaaggaaaaaggattgcagacaggtgattcagcgcgaagacagcacttcagagtctgaggatgactctagggacgagtcacaagaatccagtgatgcactcctcaaacgcacgatgaatattaaggaaaacaaagccatgttagcccagttgctggcagaactaaattcgatgcccgatttttttccagtgcgtacccctaccagcgcgagtaggaaaaaaactgtgcgtcgcgcattctccgagggacaaattactcgacggatgaatcctacaagaagtgctcggcctccggagaaattcgccctcgaaaactttactgtttccgccgctaagtttgctgaggagttctatagttttcgaagaaggaagactatagggggaaaatgccgcgagtatagaagacgccatcgtatcagcagctttcggccagtcgaagacattacagaggaggatttggagaatgtagccatcactgtccgagataagatttatgacaaggtcttaggaaatacctgccatcagtgtaggcagaagactatcgataccaaaactgtttgcagaaatcaggggtgctgcggggtgaggggccaattctgcgggccttgcctgcgcaacaggtacggggaggacgtaaggtcagcgctgctcgatcctgactgggtgtgccccccatgccgcggtatctgcaactgctcatactgccggaaaagagatggtaggtgtgccaccggaatccttatccacctggcaaaattttacgggtacgataatgtgaaggaatacctcgaatctctgcagaaagagctggtcgaggacaattag

SEQ ID NO: 217797 - DNA, 291 bp, Artificial Sequence
  Description of Artificial Sequence: Synthetic coding sequence
atggaaaccctgagttctgaagagtcctgcgacagcttcgattccctagaaagtgggaagcagcaggacgtgcgctttcattccaagtatttcaccgaggagctccgccgaatttttatagaagacaccgacagcgagacggaagatttcgccggtttcactcagtcagacttaaatggaaaaacaaatcccgaggtgatggttgtcgagtctgatttgtccgacgacggcaaggcatccttggtctccgaggaggaagaggacgaggaggaggacaaagccacaccctag

SEQ ID NO: 217798 - DNA, 843 bp, Artificial Sequence
  Description of Artificial Sequence: Synthetic coding sequence
atggcacctcgtaaaggttctagcagagttgcaaaaaccaattccctgaggcgacggaaattagcatcgttcctgaaagactttgaccgggaagtcgaaatcagaattaagcagatcgagtctgatcggcagaaccttttgaaagaggtcgataacttgtacaacatcgaaatcttgcgcttgcccaaagcgctgagggagatgaactggctggactactttgctctcggaggaaataaacaggccctggaagaagcggcaactgctgatcttgatatcaccgagatcaacaagctcaccgccgaagccatacaaacccctctaaagagtgccaaaacacgcaaagtgatccaggtggatgaaatgatagtcgaagaggaggaggaggaggaaaatgaaaggaagaatctccagacagccagggtcaagcgatgtcctccatcgaaaaagcggacacagtctatccaggggaaaggcaaaggcaaaaggagttctcgtgccaatactgtgaccccggctgtcggcagactcgaggtctccatggtcaagcccactcccggattgacacccagattcgatagccgggttttcaagactcccggtttgcgcacacctgccgctggcgagaggatctataatattagcggaaacggaagccccctcgctgacagtaaggaaatctttctgaccgtccccgtgggcggaggagaaagcttaagactgctcgcctcagatctccaacgtcacagcatagcccaattagaccctgaagccctaggaaacattaagaaactgtcaaatagattggcacaaatttgttcaagcattagaactcacaagtag

SEQ ID NO: 217799 - DNA, 843 bp, Artificial Sequence
  Description of Artificial Sequence: Synthetic coding sequence
atggctcccaggaagggaagtagtcgcgtagcaaaaaccaacagtctgcgacggaggaaactggcctcttttctaaaggactttgaccgagaggttgagatacggatcaaacaaattgaaagcgaccgccaaaacttgttgaaggaggttgacaatctttacaatatcgagattctgcgactccccaaagccttgcgtgaaatgaattggctggattacttcgctctgggagggaacaagcaggcacttgaagaggctgccaccgccgatcttgatataacagaaataaacaagctaaccgcagaggccatccagacccccctgaaatcagccaaaacaaggaaggtgatacaggtggacgagatgattgtggaggaggaggaggaagaagagaacgagcgaaagaacctgcagacggcccgtgtaaaaaggtgccccccatccaagaaacggactcagtcaattcaagggaaggggaaaggcaagcgctcgtcaagagcaaatacagtgacaccggcagtgggtcgcctggaggtttccatggttaaacccacacccggacttaccccgagatttgactccagggtgtttaaaacacctggcttgcggacgccagccgctggggaaagaatatacaatattagtggaaacggttcgccattggctgattctaaagaaatttttctgacggtaccagtgggcggaggtgagagcttgagactgctcgcgtctgacctgcagcgacacagcattgcccagctagatcctgaagcactgggaaatatcaagaaactcagtaacaggttggcccaaatatgttcttccatcagaacgcacaaatag

SEQ ID NO: 217800 - DNA, 414 bp, Artificial Sequence
  Description of Artificial Sequence: Synthetic coding sequence
atgcctaacttcgcgggaacctggaagatgaggtcgtcagagaatttcgacgaactgctgaaagccctgggagttaatgcaatgctgcgaaaggtcgcagtggcagccgcttctaaacctcacgtggaaatccgccaggatggagatcagttttacatcaaaacgtcaacaaccgtaaggactaccgagatcaacttcaaagtcggggaggggttcgaagaagagaccgtggacggcaggaaatgtagatctctggctacctgggaaaacgagaataaaatccattgcacacagaccctgctggagggcgacggccctaagacctactggacccgcgaactggctaatgatgagctgattctgactttcggcgcagatgacgtcgtgtgtaccagaatttatgtgcgtgagtag

SEQ ID NO: 217801 - DNA, 249 bp, Artificial Sequence
  Description of Artificial Sequence: Synthetic coding sequence
atgcctaatttttctggtaattggaagatcatcagaagtgagaatttcgaagaactgctcaaggtgctcggggtgaacgtcatgctacgaaagattgctgtcgcagccgcttctaagccagcagtggagattaagcaggagggtgataccttctacatcaaaactagtactaccgttcggacaaccgagattaactttaaggtgggagaggagttcgaagagcagaccgttgatggcagaccctgttag

SEQ ID NO: 217802 - DNA, 417 bp, Artificial Sequence
  Description of Artificial Sequence: Synthetic coding sequence
atgcccaactttagcggcaactggaagataattagatcggagaatttcgaagagctcctgaaggtactgggagtcaatgtcatgctacggaaaatcgcggtggcagccgcttcgaagccggctgtagagattaagcaggagggcgacaccttctacattaagacttccacaaccgtccggaccacagagatcaactttaaagttggcgaggagtttgaagaacaaacagtcgatggccgtccttgcaagagtctggtaaagtgggagtcggagaacaagatggtgtgcgaacagaagctgctgaagggggagggtcccaagacttcctggactagggaactaaccaatgatggggagctgatccttaccatgaccgccgacgacgtggtctgcacacgcgtatatgtgagggaatag

SEQ ID NO: 217803 - DNA, 417 bp, Artificial Sequence
  Description of Artificial Sequence: Synthetic coding sequence
atgcccaatttctcaggaaactggaagatcatacggtccgaaaacttcgaggaattactcaaggtgctcggagtcaatgtgatgctccgcaagattgctgtagccgcagcctccaagcctgctgtcgagatcaagcaggagggtgacacgttctatattaagacatccacaactgtccgtacgaccgagatcaatttcaaagtgggcgaggagttcgaagaacagacggtagacggaaggccctgtaagagcctcgtgaagtgggagtctgagaataagatggtttgcgagcagaagttactgaaaggggaagggcctaagaccagctggacccgagagctgacgaacgacggggagctgatcctcacaatgactgcagatgacgtggtgtgcacccgagtgtatgttcgggaatag

SEQ ID NO: 217804 - DNA, 744 bp, Artificial Sequence
  Description of Artificial Sequence: Synthetic coding sequence
atgggaacttccagcactgactcacaacaagccggtcacagaaggtgttctaccagcaataccagtgcagaaaatctgacatgcctaagcctccctggtagccctgggaagacagctcctcttcctggtcccgctcaggctggagctggccagcccctgccaaaaggatgtgccgcagttaaagccgaagtgggaattcctgccccacacacttcccaggaagtacgcatccacatccgtaggctgctcagctgggccgctccgggagcctgcggccttcggagcacgccttgtgctctcccacaagctcttcctcaggccagaccttgtccaggtcggtggttctttcctggttgctctctgccgacgggcggtgctcagaccatcttgagtttgtggacatggcgccactttttgaattgggcccttcagcagagggaggagaattccggccgtgcacgtagagtaccccctgtccctaggactgctccagtatctaagggagagggatcccaccccccacaaaatagcaacggcgagaaagtaaaaacaattactcctgatgtcgggttgcatcagtctctgacaagcgaccccacggtggctgtcttacgagccaaacgggcacccgaggcgcatccccctagaagctgctccgggtcgcttaccgctagggtctgccacatgggagtgtgccagggtcagggcgacacagaggatgggagaatgactctcatggggtag

SEQ ID NO: 217805 - DNA, 744 bp, Artificial Sequence
  Description of Artificial Sequence: Synthetic coding sequence
atgggtacttctagcactgacagccagcaggccggtcaccggcgatgtagcacatcaaatacctcagctgagaatttgacctgtctgagcctgccaggcagccccggaaagacagctcctcttccaggccctgcccaggccggagctgggcagcctctgcctaagggttgcgctgccgtgaaggccgaggttgggattcctgctcctcacactagccaggaagtaagaatccacatcaggcggctattaagctgggcagcccctggcgcttgtggcctgcggtctaccccttgcgctttgccccaggccttaccacaagcgagaccatgccccggaagatggttcttcccaggatgcagcttgcctacaggtggcgcacagacaatcctcagtttatggacctggagacacttccttaattgggcattacagcagagggaagagaatagtggcagagccaggagggtgcctccagtccctcgcactgcacccgtgtccaagggagaggggtcccacccaccccaaaactctaatggagaaaaggtgaaaaccatcacaccagatgtgggcttgcaccaatccttaacctccgacccaaccgttgccgtgcttagggctaagcgcgctcccgaagctcacccacctcgttcttgtagtggatcattgaccgcaagagtgtgccacatgggcgtgtgtcagggacagggcgatactgaggacggccgaatgaccctgatgggttag

SEQ ID NO: 217806 - DNA, 4218 bp, Artificial Sequence
  Description of Artificial Sequence: Synthetic coding sequence
atggcagccagaagcccacccagcccacacccttcgcctccagcaaggcagcttgggccaaggagtcccagagtgggcaggggagccgaagttcacgctatgcgctccgaggcatccggtttcgccggagcagccagggaggtggtcgctgacgagtccgacaagatttgggtgggagaggaggggagcggcggaagaaggggaccaggtggagccgcacccgctcacgcgcctctgttgtcagccccaatgggtagccgacggctcgagggcatatcagtggaagaggcaatggtgacacggacccagttgctggaggaggagttgtccagcctcaaggaggagcttgcactatgccaggccgacaaagaattcgtctggtccctgtggaagagattacaagttactaatcccgaccttacacaggtagttagtttagtggtggagagggaaaaacagaagagtgaggccaaggatcggaaggtcctggagattcttcaggtgaaggatgctaagattcaggagttcgaacagcgcgaatctgtcctgaaacaggagataaatgacctcgttaagcggaaaattgccgtggacgaggaaaacgccttcctccgcaaagagttctctgacttggaaaagaagtttaaagataagagccaggaaataaaagacacgaaggagtgtgttcaaaacaaggaagaacaaaacagactcgtcataaaaaatctagaggaagaaaacaagaagctcagcacccgctgtaccgacctgcttaatgacctcgaaaagttgagaaagcaggaggctcacctgcgaaaagaaaaatacagtactgacgccaagataaagactttcgaggacaacctgatcgaagccagaaaggaggtggaagtgtctcagtctaaatacaatgccctgagtcttcagctcagcaacaaacaaacagaactgatccagaaagacatggacatcactcttgtcagacaggagttgcaagagttgcaaaacctgtacaagcaaaattccacacataccgcgcagcaggctgagctgatccaacaattacaagtgctcaatatggacacccaaaaagtacttagaaaccaagaagacgtgcacacagcagagtcgatctcctaccagaagttgtataatgagctgcacatctgcttcgaaaccactaagtccaacgaggccatgctcagacagtcggtgactaacctgcaggatcagctgcttcagaaggaacaggaaaatgctaaactgaaagagaaacttcaggaatcgcagggagcgccactgcctttgccccaagaatccgacccggattactcagcccaggtgccacaccggcctagcctctccagccttgaaacattgatggttagtcagaagtctgaaatcgagtacctgcaggagaaactgaagattgccaacgaaaagctgtccgagaatatcagcgccaataaagggttttctcggaagagtatcatgaccagcgcagagggtaagcacaaagagccaccagtcaaaagatcaaggtctctgtctccgaaatctagttttacggactctgaggagctgcaaaagctcagaaaggcagaaaggaaaatcgagaacttagaaaaagccctccaactgaaatcacaggagaacgacgaactgagggatgcccatgaaaagcgcaaggagcgcctgcaaatgctgcagacaaattaccgggcagtgaaggaacagctgaagcagtgggaagaagggtccggcatgacagagatacggaagatcaagcgcgcagatccacagcagctcaggcaagaggacagtgacgcagtgtggaacgagttagcatacttcaagcgcgagaaccaagagctcatgatccagaaaatgaacctggaagaggaactggacgaactcaaggtgcacatctccatcgacaaagccgctattcaagaactgaaccggtgtgtcgctgagagaagagaggagcagctttttcgcagcggagaagacgacgaggtgaaacggagtacaccagagaagaacgggaaggagatgctggaacagaccctgcaaaaagtgaccgagctagagaatcgcctgaagagtttcgagaagcgttcccgcaagctcaaggagggaaataagaagctgatgaaggagaacgactttttaaagagtctgttaaagcaacagcaagaggatactgaaacccgcgagaaggagctggagcagatcattaaggggtccaaggacgttgagaaggagaacacagaacttcaggtgaaaatttctgaactggaaacagaggtgactagtctgcgccgacaggtcgctgaggcgaatgcattacggaatgagaatgaggagctaattaatcctatggaaaaaagtcatcagtctgcagaccgtgccaagtctgaaatggcaaccatgaaggttaggtcgggtcgctacgattgcaagactacaatgacaaaagtcaagttcaaggctgctaagaagaattgtagtgtggggcgacatcatacagtgctgaaccattccatcaaagtgatgtccaacgtgtttgaaaacctgtcaaaggacggctgggaagatgtcagtgagagtagctctgatagcgaggcgcaaacaagccagactctcggtaccatcatcgtggaaacgtctcagaaaatcagccccacagaggacggaaaagaccaaaaggagagcgacccgaccgaagacagccaaactcaaggaaaggaaatcgttcaaacctatttaaacatcgatggcaagactcccaaggactattttcacgataagaatgcaaaaaagcctacctttcaaaaaaagaattgcaagatgcagaagagctctcacacggctgtaccaacgcgagtcaatcgggagaaatataagaatattactgctcagaaaagctcttccaatattatcttgttaagagagaggatcatatctctccaacagcagaactcagtgttgcagaatgccaaaaagacagctgagctctcagtaaaagagtacaaggaggtgaatgaaaaactcctccatcaacagcaagtaagcgaccagaggttccagacttcgaggcagacaatcaaaaaactgaatctagacctggctggcctgcgaaaggagaaagaggacctcttaaagaaactggagtccagttccgagattacctccttggctgaagagaacagtcaggtaacattcccaagaatccaggtgacatcgctgtcaccttctcggtcaatggacctggagatgaagcagctgcagtacaagctcaagaatgccaccaatgaactcacaaaacagtcgagtaatgtgaaaaccctcaagtttgagctgttggccaaggaggaacatatcaaagaaatgcacgaaaagatctctcggatggaaagggacataacaatgaaaagacacctcatcgaggatctgaaattcaggcagaaagtcaatcttgagtctaataaatcttttagcgagatgttgcaaaacttggataagaaggttaaaacactgaccgaagagtgcagcaacaagaaagtatccatcgactctttaaagcaaaggctgaatgtggccgtgaaagagaagtcccagtacgagcagatgtatcagaaaagcaaagaagaactcgaaaaaaaagatctaaaactgacgcttttggtgtctaggatctctgagacggagtctgccatggcagagatcgagaccgccgcaagcaaacaactgcaggagttggccttacagagcgaacaggttctggaaggagcacagaagaccctcctactggctaatgagaaggtagaggaattcacaactttcgttaaagcgcttgcaaaagaactgcaaaacgatgtccatgtggtgaggcgccagatcagggagctgaaaaaaatgaagaagaatcgcgatgcttgtaagacctcaacacataaggctcagacattggccgcttctatcttgaacatctccaggtcagatctcgaagaaattctcgacacagaggatcaagtcgagatcgaaaagacaaaaattgacgcagaaaacgacaaggagtggatgctctatattcagaaactcttggagggtcaatctctcgccctgtctccaagattaaagtgtaatggagccattgtggcacaccagaacctgcggctgccagattcttcctcctcagccagcgcctcttag

SEQ ID NO: 217807 - DNA, 1176 bp, Artificial Sequence
  Description of Artificial Sequence: Synthetic coding sequence
atggctgcgagatctcccccttccccccatcctagtcctcccgcaagacagcttgggcctcgctctccgagagtcgggagaggcgctgaagtgcacgctatgaggtccgaggcaagcggtttcgcgggagctgctagagaggtagtagccgatgaatctgataagatctgggtaggcgaggaggggagcggcggtcgcaggggcccaggcggtgcagctcctgctcacgcccctctgctgtctgcccctatggggagtcgcaggctggaaggcattagcgttgaagaggcaatggtgactcgcacgcagctgctggaagaggagctctcttccttaaaagaggaactagcactgtgccaagccgacaaagaattcgtgtggtcactgtggaagagactgcaggtgacaaaccctgatctcacccaggtggtgagtctggtcgtggagagggagaagcaaaaatccgaagcaaaggataggaaggtcctggagattctacaggtgaaagatgctaaaattcaggagttcgagcagagggagagcgtcctgaaacaggagattaacgatctggtcaagagaaagattgccgtagacgaagagaatgcttttctcaggaaagaattcagcgacttagagaaaaaatttaaggataaatcccaggagataaaagatactaaagagtgcgtgcagaataaagaagagcagaaccggctcgtgatcaaaaacttggaagaagagaacaaaaagttgtcaactaggtgtactgatctcctcaacgatctggagaagttgcggaagcaggaggcccatctgcgaaaggagaagtactcgacagacgcaaagattaaaacattcgaggacaaccttattgaggctagaaaagaggtcgaggtgtctcagtctaaatataacgcgctctcattgcagctctctaataagcaaactgagctcatacagaaagatatggatatcactctggtgcgcaaagaattgcaggagctgcagaatttatataagcaaaattctacccataccgctcagcaagccgagcttattcagcaactgcaggtgctgaatatggacacccagaaagtgttgcgcaatcaggaagatgttcacaccgcagaatctatctcctatcagaaagtctgtttttacagcgtgatcaagatgtag

SEQ ID NO: 217808 - DNA, 4221 bp, Artificial Sequence
  Description of Artificial Sequence: Synthetic coding sequence
atggcagccaggagccccccatcaccccatcctagtccgcctgcccgacagctaggtcccagatctccacgggtcggaagaggagccgaggtccacgctatgcggtctgaagccagcggattcgcgggagctgcacgggaagtcgtggccgatgaatctgacaagatatgggttggcgaggaggggtctggtggcaggcgcggtccaggaggggcagctccagcccatgcgcctctgctctctgcccctatgggatcccggcgactcgagggaatttctgttgaagaagccatggtgacccggacccagttgttggaagaggagcttagcagccttaaggaggaactcgccctatgccaggccgataaggagtttgtgtggtccctctggaagagacttcaggtcacaaaccccgatttgacgcaagtggtaagcctggttgtggagcgggaaaagcagaagtctgaagctaaagatcgtaaggtgctggaaattctgcaagttaaggacgctaaaatccaggagttcgaacagcgggagagtgtgctgaagcaggagataaatgatctagttaaacgcaagattgctgtggacgaggagaacgcctttctaaggaaggagttcagcgacctggaaaagaaattcaaagataaatcacaggagattaaggatacaaaagaatgtgtccaaaataaagaggagcagaatagactcgtgatcaaaaaccttgaggaagagaataaaaagctgtcaaccaggtgtacggatctgcttaacgatctggagaaattgcgcaaacaggaggcccacttacgcaaggagaaatactccactgacgctaaaatcaaaaccttcgaagataacctgattgaagccagaaaggaagtcgaagtgtctcagtctaagtataacgcccttagtctgcagcttagcaacaagcagacagagctgatccagaaagacatggacattaccctggtaagaaaagagctgcaagagctccaaaatctctataagcagaattctacccacaccgcccaacaggcagagcttatccagcagctccaggtactaaatatggacactcagaaggtgctgcggaatcaggaggacgtgcacaccgcagaaagcatcagttatcagaagctgtacaacgagctccatatctgcttcgaaactacaaagtcaaacgaggcgatgctgagacagagcgtaactaatttgcaggaccagcttttgcaaaaggaacaggaaaacgccaaactgaaggaaaagctccaggagagccagggtgctccgctgccactcccccaggaaagtgatccagactactccgcccaggtaccccaccggccatccctttccagcctggagacactcatggtttctcagaagagcgagattgaatacctgcaggaaaaattgaagattgctaacgaaaagctatctgagaatatttcggccaataaggggtttagccgaaaatcaatcatgactagtgctgaaggaaagcacaaggagcccccagttaagcgtagccgctctctgtcccctaagtcgtcttttactgacagtgaagagctgcaaaagctccgcaaagctgaaaggaagatcgaaaatctggaaaaagctctgcagctgaagagccaggagaacgatgagctgagggatgcccatgagaagagaaaagaaagattacagatgcttcaaaccaattaccgggctgtgaaggaacagctgaaacagtgggaagaaggtagcggaatgacagagatccggaaaattaagcgcgctgacccccagcagcttaggcaggaggatagtgatgcggtctggaacgagctggcctactttaagagggaaaaccaggagctgatgatacagaaaatgaatcttgaagaggagttagacgaactcaaagtccacatctccattgacaaggctgcgatccaggagctgaatcggtgcgtggcagagcgaagagaggagcagcttttccggtccggagaggatgatgaagtgaagaggtcaactccagaaaaaaatggcaaagagatgctggaacagacactccagaaggtgactgaactggagaatcgtctcaagtcatttgagaagagatccaggaagctcaaagaaggtaataaaaagctcatgaaagagaatgacttcctgaagtctttgctaaagcaacaacaggaagatacggagaccagagagaaagaactggagcagatcattaaaggaagtaaagatgtagaaaaagagaatactgagcttcaggtgaagatctcagaactggagactgaagtcacatcattaagaagacaggttgctgaggctaatgcactcagaaacgaaaacgaggaactgataaatcccatggaaaaatcccatcagagtgctgaccgggctaaaagcgagatggctaccatgaaagtgcgatcagggaggtacgactgtaagacaaccatgacgaaggttaaatttaaggctgcaaaaaagaactgtagcgttgggagacatcacaccgtgcttaaccactctattaaggttatgagtaatgtgttcgagaatctatcaaaagatgggtgggaagatgtctccgaatcatcctctgattccgaagcacagaccagccagactctgggaacaattattgtggaaacgagtcaaaaaatttcaccgactgaggatggaaaggaccaaaaggagtccgatccgacagaggattcgcaaacacagggaaaagaaatcgtacaaacttatctgaacatcgacgggaagaccccgaaggattattttcacgacaaaaacgccaagaagcccacatttcaaaagaagaattgcaagatgcagaaaagctcccataccgctgtgcccacccgggtgaatcgcgaaaagtataagaatatcaccgcacagaaatcctcctctaacattatcctgttgcgcgagcggattatatctctgcagcagcagaattcagtgttgcagaacgcaaaaaaaacggccgagctgagcgtaaaagaatataaagaagtcaatgaaaagctgctgcaccagcaacaagtgtctgatcaacggttccagacctctcggcagactataaaaaaacttaatttggaccttgccggactaaggaaggaaaaggaggacttattgaagaaactagaaagcagcagcgagattacctctctcgctgaggagaatagccaagtgacatttcctcgtatacaggtgaccagcctgtcccctagcaggagcatggacctagagatgaaacagcttcagtacaagctgaaaaatgctacaaacgaacttacaaagcagtcaagtaacgtgaaaacactgaagtttgagctcctcgcaaaagaagaacacatcaaggagatgcatgagaagataagtagaatggaaagagatatcaccatgaaaaggcacctgatcgaggacttgaagtttcggcaaaaggtgaacctggagtctaacaaaagcttctctgaaatgctccagaatttggacaagaaggttaaaacactaactgaggaatgcagtaataagaaagtgagcatcgactccttgaagcagcgattaaatgtggccgttaaggagaagtctcagtacgaacagatgtatcagaaatctaaagaagagttggagaagaaggatctgaagttgaccctccttgtgagtagaattagcgaaactgagagcgcaatggcggagattgaaaccgccgcaagcaagcaactgcaagaattagccctgcaatccgagcaagtgctggaaggagcccagaaaacacttctgctagctaacgagaaggtagaagagttcactacatttgttaaggccctggcaaaagagctgcagaatgatgtccacgtcgtgcgtcgccagattagggaactgaaaaaaatgaagaaaaatcgtgacgcttgtaaaacatcgacccataaggcgcaaactttagcggctagcattctgaatatctcaaggagcgacctggaagaaatactggacaccgaggaccaggtagagattgagaaaacaaagatcgacgcagaaaacgataaggagtggatgttatatattcagaaattactcgaagggcagctgcccttcgcatcttatctgcttgaagctgtccttgagaaaattaatgagaagaagaagctagtcgagggctacttcacaattatgaaggatattaggtag

SEQ ID NO: 217809 - DNA, 4221 bp, Artificial Sequence
  Description of Artificial Sequence: Synthetic coding sequence
atggctgcgcgaagcccgccaagtcctcacccgagtcccccagcaagacagctcggccctaggtctccccgagttgggaggggggcagaagtgcatgcgatgagatccgaggcttccggattcgcgggtgccgcacgagaagtagtagccgacgaaagcgacaagatctgggtgggagaagagggatccggaggaaggcgtggacccggaggagctgccccagcacacgcccctcttctgagtgcacccatgggctcacgtcgcctggagggcatctccgtagaggaggcaatggtaacccgcactcagttacttgaggaagaactgtcatctttaaaagaggagctggccctctgccaggccgataaggagtttgtttggtcactgtggaaacggttacaagtgaccaatccagacctgacccaagtcgtgtctctcgttgtcgagcgcgagaagcagaaatccgaagcaaaagatcgaaaggtgctggaaattctccaagtgaaagacgctaagatccaagagttcgagcagagagagagcgtgctcaagcaggaaattaacgacctcgtgaagaggaaaattgctgtggacgaggaaaatgcctttttgcggaaagagtttagcgatctggaaaagaagtttaaggacaagtcccaggaaataaaagacacaaaagagtgcgttcagaataaagaagagcagaacaggctggttataaagaacctggaggaagagaataagaaactcagcacacgttgtacagacctgttgaatgatctcgaaaaattgcgcaagcaggaagctcacctgagaaaagagaagtactcgacggacgctaaaatcaaaactttcgaagacaacttgatagaggctagaaaggaggtggaggtgtctcaaagcaaatataatgctttaagcctgcaactgtccaacaagcaaaccgagcttattcagaaagatatggacattacactagtgcgccaagagctgcaggagctgcagaatctgtacaagcaaaactcgactcacaccgcccagcaagctgaactgatacagcagctgcaagtgttaaacatggacacacagaaagtgctgcgcaaccaggaggatgtccacactgctgaatctatatcttaccagaagttatataatgagttgcacatctgttttgaaacaaccaagagcaatgaggcgatgctcaggcagtctgttaccaacctgcaggatcaactactgcagaaggagcaagagaatgccaagctcaaggagaaactgcaggaatcgcaaggagctcccctgccactccctcaggaaagcgatcccgattacagcgcccaggttcctcaccgcccttctttgtctagcttagaaacgctcatggtgtcacagaagtcagagatcgagtaccttcaagaaaagctcaagatagcaaatgaaaaactaagcgagaatatctccgccaacaaaggcttctctagaaagagcattatgacttcggccgaagggaagcacaaggagccacccgtcaagcgcagccggtctctctcaccgaagagctcttttactgattcggaagagctacaaaaactgcgcaaggctgagcgaaagatagagaacctggaaaaggctctgcagcttaagagccaagagaacgatgaactgcgcgacgcacatgaaaaacgtaaagagcgactccaaatgcttcagacaaactatcgtgcagtgaaggagcagcttaaacagtgggaggagggaagcggcatgacagaaatccgcaaaatcaaaagagcggacccccagcagctccggcaggaggattctgatgctgtttggaatgagctcgcctattttaagcgggagaaccaggagctcatgatccaaaagatgaatctcgaggaagaactcgacgagctgaaggttcacatcagcatcgataaggctgccatacaagaactgaatcggtgtgtggctgagcggcgagaggagcagctgttcaggtccggggaggatgatgaagtgaaacgctctaccccagagaagaacggaaaggaaatgttggaacagaccctgcagaaggtcacagagctagaaaatagacttaagagtttcgagaaacgctccagaaaactgaaggaaggcaacaaaaagctcatgaaggagaacgactttcttaaatccctcttgaaacaacagcaggaggacaccgagactcgggaaaaggagcttgaacaaattatcaaggggagtaaagacgtagagaaggagaatacggagctgcaagtgaagatctcagagctggaaacggaggtgacctccttgcgcagacaagtcgcggaagcaaacgcactgcgcaatgagaacgaggagctgatcaaccccatggagaagtcccatcagagcgcggatcgcgcaaaatcagaaatggcaaccatgaaagtgaggagcggcagatacgactgcaagaccacaatgactaaagtgaagtttaaagccgctaaaaagaattgttctgtggggagacaccacacggtcctgaatcatagcattaaggtaatgtcaaatgtcttcgagaatctgtccaaagacggttgggaggacgtcagtgaatcctccagcgatagtgaagcgcagactagccagactctgggcacaattatcgttgaaacctctcagaagatttctcctacggaagacggaaaggatcagaaggaatctgatcccactgaagatagccagacgcagggaaaggaaatcgtgcagacgtacctgaatattgatggtaaaacgcccaaagactactttcacgataaaaatgcaaaaaagcctacatttcagaaaaagaattgtaagatgcagaagtcttcccatacagccgttcccacccgggtgaaccgcgagaaatacaagaatatcaccgcgcagaaatcaagttctaatataatactactccgggagcgcatcatatccctgcaacagcagaacagtgtcctgcagaatgccaaaaagacagccgagttgagcgtgaaggaatataaggaagtgaatgaaaagttattgcatcagcagcaggtttcagatcagagatttcagacatcccgtcagacaataaaaaagttgaatctcgatctggcgggtttgaggaaggagaaggaagacctgctcaaaaaactggaatcgagttctgagatcacttctttggccgaggagaactctcaggtgacattcccaagaattcaagtgacatcattgtcccccagtcgcagcatggatcttgagatgaagcagctccagtacaagttgaagaatgccaccaatgagctcaccaagcaaagctccaacgtgaagaccctgaaatttgagctgttagcaaaggaggagcatattaaagagatgcacgaaaaaatctcccggatggagagagatattactatgaaacgccacctcatagaggacctcaagttcaggcagaaggtgaatctggagagcaataaaagcttctcggagatgctgcagaatctggacaagaaggttaagactctgacggaggaatgtagcaataaaaaagtttcgatcgactcgctgaagcaaagactgaacgttgctgtgaaggaaaagtcgcagtacgagcagatgtatcagaaatccaaagaggaactggagaagaaagatctaaagttgacactgcttgtgagccggatctctgaaacagagtcagccatggctgagatagaaacagcagcctctaaacagctccaggagctggctcttcagtcagaacaggtgctcgagggcgcacagaagacactgctattggctaatgagaaggtagaggaattcactacttttgtcaaggcattagccaaggagctacagaacgacgtccacgtcgtccggcgacaaatccgggaactgaagaaaatgaaaaaaaaccgagacgcctgtaaaacatctacgcataaggcacagactctggctgcctccatcttgaacattagtcggtctgacttagaggaaatcttagacaccgaggaccaggtggaaatagagaaaacaaagattgacgcagagaacgataaagagtggatgctctacatacagaaactgctggaaggacaattaccttttgcatcttatctcttggaagcagtgcttgagaagatcaacgaaaagaagaaactcgtggaaggatattttactataatgaaggacattcgctag

SEQ ID NO: 217810 - DNA, 519 bp, Artificial Sequence
  Description of Artificial Sequence: Synthetic coding sequence
atggcctcaggcttcaagaagccttccgcagccagcaccggacagaagcgaaaggttgcccctaagcctgagctgaccgaggaccagaagcaggaggttagagaagccttcgatctgtttgacgtggacggcagtgggacaattgacgccaaagagctgaaagtggccatgagagctctcggtttcgaacctcgtaaggaggaaatgaagaagatgatttctgaggtcgatcgcgaggggaccggaaagatcagtttcaatgacttcctcgccgttatgacccagaagatgtctgagaaggatactaaagaagaaatcctaaaggcatttcgtcttttcgacgatgacgaaacgggaaagatcagtttcaagaatctgaaacgggttgccaatgaactgggcgagaacctgaccgatgaggaattgcaggaaatgatcgatgaagcagaccgtgatggggacggcgaagttaatgaggaggagtttttgaggatcatgaaaaaaacttctctctattag

SEQ ID NO: 217811 - DNA, 519 bp, Artificial Sequence
  Description of Artificial Sequence: Synthetic coding sequence
atggcctcaaatttcaaaaaagctaatatggcctctagctcacagaggaagcgtatgtctcctaaacccgagctgacagaggaacagaaacaagaaatcagggaagctttcgacctttttgatgcggatggaactggcaccatcgacgtgaaggaactgaaagttgctatgagggcattgggctttgagcctaaaaaggaggagattaagaaaatgatctctgaaatagacaaagaaggaaccggaaaaatgaactttggggactttctaacagtgatgacccagaaaatgagcgaaaaagatactaaagaagagattctgaaagcgttcaaactgtttgatgacgatgagacagggaagatttccttcaagaatctcaaacgggtcgccaaagagttgggagaaaatctgaccgacgaggaactgcaggaaatgatcgatgaggctgacagagacggtgacggggaggtaagtgaacaggagtttctccgcattatgaaaaagacttcgctgtactag

SEQ ID NO: 217812 - DNA, 378 bp, Artificial Sequence
  Description of Artificial Sequence: Synthetic coding sequence
atggccatgcaggccgcaaagcgcgcaaacataaggctgcctccggaggtcaatcgaatactttacatcaggaacctcccctacaagatcaccgccgaagagatgtacgatatcttcgggaagtatgggcctattcgacaaattagagtgggcaatacaccagagaccaggggaaccgcgtacgtggtgtacgaagacatattcgatgcaaagaacgcctgcgaccacctcagcggcttcaacgtgtgcaatcggtacctggtggtgctgtattacaatgccaaccgagctttccagaagatggacacgaaaaaaaaggaggaacagctgaagcttctgaaagaaaagtatggaattaacacagacccgcctaaatag

SEQ ID NO: 217813 - DNA, 423 bp, Artificial Sequence
  Description of Artificial Sequence: Synthetic coding sequence
atgggtcctcgcagaagatccagaaagccagaagctccccgtcggagaagtccaagcccaacccccacgcccggaccttcccgccgaggaccttctctgggtgcatccagtcatcaacactctcgccgtcgtcagggttggctcaaagagattcgtaaactgcagaaatccacccacctattaattaggaagcttccatttagtcgcttagcgcgagagatctgtgtgaaattcaccagaggggttgacttcaactggcaggctcaagccctgcttgccttgcaggaagccgcagaagccttcctggtgcacctcttcgaagacgcttacctcctgactctgcacgctggtagggtaactttgttccctaaagatgttcaactagcaaggcgtattcgaggactggaagaggggctgggatag

SEQ ID NO: 217814 - DNA, 1800 bp, Artificial Sequence
  Description of Artificial Sequence: Synthetic coding sequence
atgggccctaaacggcgacagcttacttttcgcgaaaagagccggataatccaagaggtggaggagaaccccgatctgaggaagggagagatcgctcggagatttaatatccccccaagtaccctgagtaccatcctgaagaataagcgggcaattttagcatccgagcggaaatacggggtcgcgtctacatgcaggaaaactaacaagctcagcccttatgataaacttgaaggcctgcttatcgcctggtttcagcagatcagagccgcaggtctgcccgtaaaaggcatcatcctgaaagagaaagcactgcgaatagctgaagaactcggtatggatgatttcacagcctcaaatggctggctggaccgctttagaaggcgacatggcgtggtgtcttgttccggggttgctcgggcacgtgctagaaacgctgcccctcgcactccagctgcacctgccagccctgctgccgtcccttccgagggatcaggcggaagtactactggatggcgagccagagaggagcagccgccaagcgtggccgaaggatatgcatctcaggacgttttttccgccaccgagacctccttatggtacgactttttgcctgaccaggccgcaggcttgtgcggaggagacggcagaccgagacaagccacacagcgcctctcggtactgctgtgtgccaatgcagacggatccgagaagttgccgccactggtagcaggcaagtccgcgaagcctcgggcaggacaagcgggtctgccctgtgactatacagcaaacagcaaagggggtgtcaccacacaggctctagcgaagtatttgaaagccctggatacaaggatggccgctgagagcaggcgggtcctacttcttgcagggaggctggcagctcaaagcttggatacgtcggggttacgacacgtgcagctggctttctttccccctggaacagtgcacccactcgagagaggcgtggtgcagcaggtgaaggggcactaccgacaggccatgctgctgaaagctatggccgctttagaggggcaggaccccagcgggcttcagcttggcttaactgaggcactgcatttcgtggccgcagcatggcaggctgtcgaaccaagcgacattgccgcttgtttccgggaggctggatttggcggaggtccaaacgcaactatcactacaagcctcaagtctgaaggtgaagaagaggaggaggaagaagaggaggaggaggaagaagagggcgagggcgaagaagaggaggaggaaggcgaggaagaagaagaggagggaggggaaggagaggagctgggcgaagaagaagaagtagaagaggaaggggacgttgatagcgatgaggaggaggaggaagacgaagagtcaagttctgaaggtctcgaggcggaggactgggcacagggcgtggtggaggccggaggctccttcggcgcttacggggctcaggaggaagctcagtgtccaacccttcatttcctggaaggcggagaagactcggattctgacagtgaagaagaggatgatgaagaggaggatgacgaagatgaagatgacgacgatgacgaggaagatggggacgaagtgcccgttccatctttcggcgaggcaatggcctactttgctatggtgaagcgctatctaacaagctttccgattgacgaccgcgtccagagtcacattttacatctggaacatgatctcgtacatgttacgcgcaaaaaccatgcaaggcaagcaggagtgagagggctgggccaccagtcgtag

SEQ ID NO: 217815 - DNA, 417 bp, Artificial Sequence
  Description of Artificial Sequence: Synthetic coding sequence
gaggatgaagaaagctcttccgaaggcctcgaagcagaagactgggcccagggcgtcgtagaagcagggggatcttttggcgcatacggcgcacaagaagaggcccagtgtccaacactgcatttcctggagggcggagaggattcagatagtgacagtgaggaggaggatgacgaggaggaggatgacgaggatgaagatgacgacgacgacgaagaggacggagacgaagttcccgtgcctagctttggcgaggcgatggcatactttgccatggttaaaaggtacttaactagctttcctattgacgacagggtgcaatctcacatcttgcatctggagcacgatctggtacacgtaacacggaagaatcacgccagacaggccggagtgcgcggactgggccatcagtcctag

SEQ ID NO: 217816 - DNA, 2832 bp, Artificial Sequence
  Description of Artificial Sequence: Synthetic coding sequence
atggctgctagtggactcgatcatctgaagaatggctaccggagacgcttctgtcggccttcccgagccagggatatcaacactgaacagggccagaacgtcctcgaaattctccaggactgttttgaggaaaaatctttagctaacgacttctccaccaacagcactaagtccgtgcccaattccactcgcaaaattaaggatacatgcatccagtccccctcaaaggagtgccagaaaagccacccaaagagtgtccccgtgtcttcgaagaagaaggaggcatccctccagttcgtagtcgagccctctgaggccactaaccgctctgtgcaagcccacgaagtgcaccaaaagatcctagccacagacgttagctccaaaaatacccccgatagcaaaaaaattagctctcgaaacattaatgaccatcactcagaagctgacgaggagttttacctatctgtcggctcacctagcgtcctcctcgatgctaagaccagcgtgtctcagaatgtcattccaagctcagcccagaagcgggagacctatacctttgagaattctgtcaacatgctgccctcttccaccgaagtgagtgtgaaaactaagaaacgcctgaatttcgacgacaaagttatgctgaagaagatcgagatagacaataaagtgtctgatgaggaggacaagaccagcgagggacaggaaagaaaacctagtggaagctctcagaatagaattagggacagtgaatatgagattcaacgccaggccaaaaaatctttcagcacacttttcctggagacagtgaaaaggaagtctgagtcgtcacccattgtgaggcatgccgcaacagcaccccctcatagttgcccacccgatgacaccaagttaatcgaggacgagttcattattgatgaaagcgaccaatcttttgcgtctcgaagttggatcaccatacccagaaaagccggaagtttaaaacagcgtaccatatcgcccgctgagagtactgcactcctccagggcaggaagagtcgggagaagcatcataatattctccctaaaacactggccaatgataaacactcccataagccacatcccgtggagacttcacagcccagcgacaagacagttctggatacttcttacgctttaattggagaaacagttaacaattatagatcaaccaaatatgagatgtacagtaagaatgccgaaaagcccagtcgttccaagagaacaatcaaacagaagcaacgcaggaagttcatggcgaagccagcagaggagcaattggacgtgggtcagagcaaagacgaaaatatccacacatcgcacattactcaggatgagtttcagcgtaattccgatcgcaatatggaagaacacgaggagatgggtaacgactgtgtgtccaagaagcagatgccacccgtcggcagcaagaaatctagcacacggaaagacaaagaagaatccaagaagaaaaggttcagctctgaaagtaaaaataagttggtccctgaggaagtgacttctactgtgacgaaatccaggcgtatttcccggagacctagcgattggtgggtggtcaaaagtgaagagtctcctgtatattcaaatagcagcgtccgaaacgagctgcctatgcatcataattcatcaaggaaaagcacaaaaaaaactaatcagtccagcaaaaacatcaggaagaagacaatcccactgaaaaggcaaaagacagctacaaaaggcaatcagcgggttcagaagtttctgaatgccgaaggcagcggagggatagttgggcacgacgagatctcccgatgctccctaagtgagcctctggaatctgatgaggccgacttggccaagaaaaaaaaccttgactgctccagaagcactcgttcctcaaagaatgaggataacatcatgactgcccagaacgtacccctgaagcctcaaacctccggatatacctgtaacatccccacggagagcaatctcgactccggagagcacaaaacaagcgtcctggaagagtcggggcctagccggttgaataataattatctcatgagcggtaaaaacgatgtggatgacgaagaagtgcacggaagctccgatgattctaagcagtcaaaagtgattcctaagaacaggatccatcacaagctggtgttgcctagcaacacgcccaacgtacgccgtaccaaaaggacaagactgaaacctcttgagtactggagaggcgagcgaatcgattatcagggtcgaccaagcggcggttttgttataagtggcgtgctcagcccggacacaattagcagtaaacgcaaagccaaagaaaacatcggaaaggtgaacaaaaaatctaacaaaaagaggatctgtctggataacgatgagagaaagaccaatttgatggttaatctggggattccactaggtgaccctctgcaacctacacgcgtaaaagacccagagacaagagaaattatccttatggacctggtgagacctcaggatacctatcaatttttcgtaaagcacggcgaactcaaggtatataagacactggacaccccctttttctccactgggaaacttattctgggcccacaagaagaaaaaggtaaacagcacgtgggccaggatattctggtcttttatgtcaattttggtgatttgctctgtaccctgcacgaaactccgtatatactgtctacaggcgatagtttctacgtcccttctggtaactattacaacatcaagaacctccgaaacgaggagagcgtgcttctgtttacccagatcaaacgctag

SEQ ID NO: 217817 - DNA, 8106 bp, Artificial Sequence
  Description of Artificial Sequence: Synthetic coding sequence
atggcagaggagggcgcagtggctgtgtgcgtgcgcgtaagaccactgaacagtcgtgaggagagtctgggtgagacagcacaggtgtattggaagaccgacaataacgttatctaccaagtggacgggtcaaagagttttaattttgatagggtcttccacgggaacgagactaccaagaacgtgtacgaagaaatagctgctccgatcatcgacagcgccatacagggttacaacggcaccattttcgcctacgggcagactgcctcaggaaagacatatacaatgatgggcagtgaggaccacctgggggtgattccgagagcaattcatgatattttccagaagataaagaaattccccgaccgtgagttcctgctccgggtttcatacatggagatatataacgagacaattacagatttgttatgtggtacacaaaagatgaagccactgataattagggaagacgtgaacaggaacgtgtacgttgctgatctgactgaagaagtcgtctacacatcagagatggcgctgaagtggatcaccaaaggagagaagagtaggcactacggggagacaaaaatgaatcagaggagttctcggtctcacaccatcttcagaatgatactcgagagccgcgagaaaggagagccatcgaattgtgagggatcggtgaaggtcagccaccttaacctggtggacctggccggttcagagcgcgctgcccaaactggggctgcaggggtgaggctcaaagagggatgtaacatcaacagatccctgttcatactggggcaggtgattaaaaagctgtctgatggccaagtgggaggctttattaattatcgggattcaaaactcactaggatcctccagaactccctcgggggtaatgcgaaaacacgcatcatctgcactataactcccgtgagctttgacgagacactgactgccttgcagtttgctagtaccgctaagtacatgaagaacacaccatatgtaaacgaggtttcaaccgatgaagcccttctcaaaaggtatcgcaaagagattatggatttgaaaaagcagctagaagaggtgtcccttgaaacacgggcacaggccatggaaaaggatcagctggcccaattgctggaggaaaaggatctgctacagaaagtacagaacgagaagattgagaacctgacccggatgcttgtcacaagtagctctctgactctgcagcaagagttgaaagcaaagcgcaaacgcagagtgacatggtgtctgggaaagatcaataagatgaaaaattcaaactatgcggaccaattcaatatcccgactaacattactaccaagacacataagctgagtattaatctgctgagggagattgatgaatcagtttgttcggaaagcgatgtgttttcgaacaccttggacactctcagtgaaatcgaatggaaccctgccactaaactgctgaaccaagagaacattgagtccgagttaaattctctacgcgcagattacgacaacctagtgctcgattacgagcagttgagaaccgaaaaggaagagatggagctgaagcttaaggagaagaatgacctagacgagttcgaagccctcgaacgaaaaacgaagaaagaccaagaaatgcagctgatccatgagatcagtaacctgaaaaatctggtgaaacatgctgaggtatacaaccaagatctagaaaatgagctctcaagtaaagtggagctactgagagagaaggaagatcagattaagaaacttcaggagtacatcgacagtcaaaagctggagaatatcaagatggatctgtcttactctttggaatccattgaggatcctaagcagatgaagcagactttatttgatgccgagacggtcgcacttgatgcaaagagagagagtgccttcttgagaagcgagaacctagagctgaaagaaaagatgaaagagctcgccacaacatacaaacagatggaaaatgatattcagctgtaccagagccagcttgaagcaaaaaagaaaatgcaagttgaccttgagaaagaattgcaatccgcatttaatgaaattactaagctgacatcactcattgacggcaaggtgccgaaagacctcctgtgtaacctggaacttgagggcaagattactgacctgcaaaaggaattgaataaagaagtggaggagaacgaagccctccgggaagaagtcatcctgctcagcgagctgaaatccctcccttctgaggtggaaagactccgcaaagaaatccaggacaaaagtgaggagttgcatatcataacaagcgaaaaggataaactcttctctgaggtggtgcataaagagtcacgagttcagggactgctcgaggagattgggaaaacgaaagatgatctcgcaacgacccagtccaactacaaaagcacagaccaggagttccagaatttcaagacactccacatggatttcgaacaaaagtacaagatggtcttggaggagaacgaacgtatgaatcaggagatcgtgaatttatctaaagaggcccagaagtttgactctagtcttggggctcttaagacagaactctcgtacaagacacaagaacttcaagaaaaaaccagggaggtgcaggagcggttgaacgaaatggaacagttgaaagagcaacttgagaacagggattctaccctccagactgttgaacgggagaagacactgattactgagaaattgcaacagaccttggaggaagtcaagactctgacgcaggagaaggacgatctgaagcaactacaagagtccctgcagatcgaacgcgaccagctgaagagcgatatccatgataccgtgaatatgaatatcgatactcaggagcaactgcgaaatgctctggagtcgctcaagcagcaccaggagaccatcaatacccttaagtccaaaatatccgaagaggtgagtcgtaatctccatatggaggaaaacaccggcgagactaaagacgaattccagcagaaaatggtgggaattgacaagaagcaagatctcgaggcaaagaacacacagactctgacagccgatgtgaaggacaatgaaatcattgaacagcagcggaaaatattttctctcatacaggagaagaacgaacttcagcagatgctggaaagcgtcattgctgaaaaggaacagctcaaaactgacttgaaagaaaatattgaaatgacaattgagaatcaggaagagctgcggctgttaggcgatgagctgaagaaacaacaggagattgtggcgcaggagaaaaaccacgctatcaagaaagagggggaactttctagaacttgtgatcgcctcgcagaagtggaagaaaagctaaaagagaaatctcagcaactccaggagaagcaacagcagttgttaaatgtgcaggaagagatgtccgagatgcagaaaaagatcaatgaaatcgaaaatttaaagaatgagctcaaaaacaaggagctgactctggagcacatggagacagagagactcgaactagcccaaaaactcaatgaaaactatgaggaagtgaagagcattaccaaagagagaaaagttctgaaggagttacagaagtccttcgagactgagcgggaccacctcagagggtatatccgtgaaattgaggccaccggcctgcaaactaaagaggagctgaagattgctcacattcacctaaaagaacaccaagaaacaattgatgagctgcgaaggtcagtcagcgagaaaaccgcgcagatcataaacacgcaagatctcgagaagtctcatactaaacttcaggaggaaatcccagtgctgcacgaagagcaggagctgctgcctaacgttaaggaagtttctgagacacaggagaccatgaacgagctggagttacttaccgagcaaagtaccaccaaagacagcaccacactggcgagaattgaaatggaaaggctaaggcttaatgaaaagtttcaggagtctcaggaggaaatcaaatcacttaccaaggagcgtgataatttaaagacaattaaggaggcgctggaggtcaaacacgatcagctcaaagagcacatacgagaaaccctcgctaagattcaagagtcccaatctaagcaggaacagtccctgaatatgaaagagaaggacaacgagaccactaagatcgtgtcagagatggaacaatttaagccaaaagactccgcgttgctgaggatcgagatcgaaatgctgggcctgagtaagcgcctgcaggaatcccacgacgagatgaagagcgtggcaaaggaaaaagatgatcttcagaggctacaagaagtcctccagtctgagagcgaccaactgaaggagaacattaaggagatagtagctaagcatctggagaccgaagaggagctgaaggtcgcccattgttgcttaaaggaacaagaggagacaataaatgaattgcgagtgaatctatctgaaaaggaaactgagattagtacaatacagaagcagctagaagcgataaacgacaagctccagaataagattcaggaaatctacgagaaggaggagcaatttaatattaaacagatcagtgaagtgcaagaaaaggtcaatgagttgaaacaatttaaagagcatcggaaggctaaagactctgccctgcaatccattgaatcaaaaatgcttgagctgacaaacagacttcaagagagccaggaggagatccagattatgatcaaagagaaggaggaaatgaagcgcgtgcaggaggccctgcagattgagagggatcagctgaaggagaataccaaggagatcgtggctaagatgaaggaatcccaggaaaaggagtaccagtttcttaagatgaccgcggtcaatgagacccaggagaagatgtgcgaaattgagcacctgaaagagcagttcgagactcaaaagttgaaccttgagaacatcgaaacagaaaatataaggctaacccagattcttcacgagaatctggaagaaatgagaagcgtgacgaaggagagagacgatttacggtcagtggaggagacactgaaagtagagagagatcagctcaaggagaatttgcgcgaaacgatcacccgcgacctggaaaaacaggaagagttgaaaattgttcatatgcatctcaaggagcaccaagagacaattgacaagttgagaggaattgtatcggaaaagactaatgagatcagcaacatgcaaaaggacctggagcattccaatgacgctctcaaagcccaggatctaaagatccaagaagaactaagaatcgcacacatgcatctgaaggagcagcaggagacgatcgacaaactgagagggattgtttcagaaaagaccgataagctgtctaacatgcaaaaggatctcgaaaacagtaatgccaagctgcaggagaaaatccaggaactcaaggcgaatgagcatcagctgatcactctcaagaaggacgttaacgaaacacagaaaaaggtttccgagatggagcagctgaagaagcagattaaagatcagtctctcacactgagtaaacttgagatcgagaacttaaaccttgcccagaaactccacgagaacctggaggaaatgaaatctgtgatgaaggaaagagataatctaaggagggtggaggagactctgaagctggagcgtgatcagctcaaagagagcttgcaggagactaaggcgcgagacctcgagatccagcaggaactgaaaactgccaggatgctctcgaaagagcataaggagaccgtcgacaagctccgcgaaaagatttcagagaagaccatccaaatcagtgacattcagaaggatctagataagagcaaggatgagctccaaaagaaaatccaggagctacagaagaaggagctccagctgctgagggtgaaggaggatgtgaacatgagccataaaaaaattaatgaaatggagcaacttaagaaacagtttgaagcccagaatctgagcatgcagtctgtgcggatggacaactttcagctgacaaaaaaacttcatgagagcttggaggagatccggatcgtggcaaaagaacgagacgagctgcgtcggattaaggagagtcttaagatggaacgcgaccagtttatcgcaactctacgggagatgatcgcccgagatcgccaaaatcatcaggtgaagcccgaaaagagattgttgtccgacggacagcaacaccttaccgagtctttgcgcgagaaatgttctagaatcaaggaacttctcaagcggtactccgaaatggacgaccattacgaatgtttgaatcgattaagtctagacttagagaaggaaattgaatttcagaaggagctgtctatgagagtgaaggcgaatctgagtttgccctatctgcagacgaagcacatcgagaagctgttcactgccaaccagcgctgcagcatggaattccatagaatcatgaagaagctgaagtatgtgttgagctacgtgactaagatcaaagaggaacagcatgaatcaatcaacaaattcgagatggacttcattgacgaggtcgaaaagcagaaggagctgctaattaagatccagcatctgcagcaggactgcgacgtgccctcaagggaacttagagaccttaagctgaaccagaacatggacctgcatatcgaggaaatactgaaggatttttctgagtccgaattcccttcaattaagaccgagtttcagcaggtcctcagtaatcggaaggagatgacacaattcttggaggagtggctgaacacacgattcgatattgaaaagcttaaaaacggaatccagaaagaaaacgacaggatttgtcaggttaacaatttctttaataaccgcatcatcgccataatgaacgagtctacagagtttgaggaacgatctgccaccatcagtaaagaatgggaacaagatttgaaatctttgaaggagaaaaacgagaagttatttaagaactatcagacattgaaaacctcccttgcctcaggggcacaggtaaaccccaccacccaggacaacaaaaatccgcatgtcacttctagggctacccaactgaccacggaaaagatccgggaacttgagaattctctgcacgaagccaaggaatctgctatgcacaaggagtctaaaataattaaaatgcagaaagagctggaagtaacaaacgatataatcgccaaattgcaggcaaaagtgcacgaaagtaacaagtgcctggaaaaaacgaaggagacaattcaggttctacaggataaagtcgccttaggggctaagccttataaagaggagattgaagacctaaagatgaaactggtgaaaattgatctggagaagatgaaaaacgcgaaagaattcgaaaaggagattagcgcaaccaaggctacggttgaataccagaaggaggttatcagactgctgagggagaatctgaggcgatctcagcaggctcaggatacctccgttattagcgagcacaccgatcctcagccatcgaacaagcctctgacatgtgggggaggttccggcatcgtacaaaacaccaaggccctgattctcaagagcgagcacatccggctggaaaaggagatctctaaactgaaacagcagaacgagcagttgattaaacagaaaaatgaactcttaagtaataatcagcacctgtccaacgaagtcaaaacttggaaggaacgaacactgaaacgagaagcgcacaagcaggtgacatgcgagaatagtcctaaaagtccaaaggtgacagggacggcctctaagaaaaagcagataactcctagccagtgtaaagagcgtaacctccaggatcctgtgcccaaggagagccccaagtcatgctttttcgactcgcgttcgaagagcttgccatctccacaccctgttcgatattttgataacagcagtctgggactctgccccgaggtgcagaatgcaggtgccgaaagcgttgattcacagcccggtccttggcatgcctcaagcggcaaagacgttcccgagtgtaaaacgcagtac

SEQ ID NO: 217818 - DNA, 7742 bp, Artificial Sequence
  Description of Artificial Sequence: Synthetic coding sequence
atggccgaagagggagccgtagctgtctgcgtgcgagtcagaccgttaaactctagggaggagtcgctgggagagacagctcaagtgtattggaagacagacaataatgtgatctatcaagtggatggttctaagtccttcaatttcgacagagtgtttcacgggaacgaaacaacgaaaaacgtgtacgaggagatagcagccccaattatcgactccgccatccagggatacaatggcacaatctttgcctatggccagaccgcaagcggaaaaacctatacaatgatggggagcgaggaccatcttggtgtgatcccaagggcgattcatgacattttccaaaaaattaaaaaattccccgatagggaatttctactgcgggtgagctatatggagatctataatgagactatcaccgatttactctgtggcacccagaagatgaaaccgctgatcatcagggaggacgtgaacaggaacgtgtacgttgccgatctaacagaagaagtcgtgtacacatctgaaatggccctgaagtggataaccaaaggagaaaagtcgcgccactacggcgagacgaagatgaaccagcgaagctcgagaagccacacaatttttcggatgatacttgagagccgcgaaaagggggaacctagcaactgcgaggggtctgtgaaagtttctcacctgaatctggtggatcttgctggctccgaacgagctgcccaaacaggagcagcgggagtccgactgaaagagggctgtaacattaatagaagtttgtttatcctcggccaggtgataaaaaaactctctgacggccaggtgggagggtttattaactaccgggattccaagttgacacgcatcttgcaaaactcgctaggcggtaatgctaaaacccgaatcatttgtactattacccccgtctccttcgacgagaccctgaccgctttgcaatttgcatccacagccaagtacatgaaaaatacaccttatgtgaacgaggtctcaacagatgaagcattattgaaaagatatcggaaagaaatcatggacctcaagaaacagctagaagaggtttcgttggagaccagagcccaagccatggagaaagaccaactggcgcagctcttagaggagaaggaccttcttcagaaggtgcagaacgaaaaaatcgaaaatttaaccagaatgttggtcacttcgtccagtctcacactgcagcaggagctgaaggcaaagcgtaagcgccgagtgacctggtgcctggggaagatcaacaaaatgaaaaattctaactatgcagatcagttcaacatcccaaccaatatcacgaccaagacacataagttatccataaatctgctcagggaaatagatgagtccgtgtgctcagaatcagacgtcttcagcaacacactagataccctgtccgagatagagtggaaccctgcaaccaagttactgaaccaggagaacatagagtctgaattaaactccctgcgagccgattacgacaacttagtcctcgattacgagcagctgcggactgagaaggaagaaatggaactcaagctgaaggaaaagaatgacctggacgagtttgaagccctagaacgaaaaacgaagaaagaccaggagaatgagctctcgagcaaagtggaactgctgcgagagaaagaggaccaaatcaaaaaattacaagaatatatagattcccaaaaattggagaacatcaagatggacctgagctactcactggaatcaattgaagatcctaaacagatgaaacaaacgctgttcgatgccgagacggtggcactggacgccaaacgtgaatctgcattcctgagaagcgagaacctggagctcaaagagaagatgaaggagctggctaccacctacaaacagatggaaaatgacatacagctgtaccagagccagttggaggcaaaaaaaaagatgcaggtggatttggagaaggaattgcagtctgccttcaacgagataacaaaactaactagcttgattgacggtaaagtgccaaaagatctgctgtgtaatcttgaactagaaggcaagatcacagatctccaaaaggaactgaacaaagaggtggaggaaaacgaggcactgagggaggaagtcatattgttgagtgagctgaagagcctgccctccgaggtggagcgcctccggaaagagatccaggataaatcagaggaactccacatcatcacatctgaaaaggacaaacttttcagcgaggtggtgcacaaagagagccgagtccagggtttgctagaagaaatcggaaaaactaaggacgacctggcaacaacccagagcaactataagtcgaccgatcaggaattccaaaatttcaaaactctgcatatggactttgaacaaaagtataagatggtgctcgaggagaacgaaagaatgaaccaagaaattgtaaacttgtctaaggaggcccagaaatttgattcatccctcggcgcactgaagactgagttgagctacaaaacccaggagctacaggagaaaacacgggaggtccaggagcggctgaacgagatggagcagctcaaggagcagctcgaaaaccgcgatagtaccctgcagaccgtggaaagggagaaaaccctgatcactgagaaactccagcaaaccctagaggaggtgaagacgttgacccaggaaaaggacgaccttaagcagctgcaagaatctcttcagattgaacgtgatcaacttaaatccgacatccacgataccgtgaatatgaacatcgatacacaggaacagcttagaaatgccctcgagtcacttaagcaacatcaggagaccatcaacacactgaagtcaaagatcagcgaagaggtttctagaaatctgcatatggaagagaatacaggagagaccaaggatgagtttcagcagaaaatggtggggatcgacaaaaagcaagatctggaggcgaagaatacacagacactcacagctgatgtgaaagataatgaaatcatcgaacaacagcgcaaaatcttttctctcattcaggagaaaaacgaacttcagcaaatgctggaatctgtgattgctgaaaaggagcaactcaaaacggaccttaaggagaatattgagatgaccattgaaaatcaggaggagcttaggctgctaggtgatgagctgaagaagcagcaagaaattgtggcccaggaaaaaaatcacgctattaaaaaagagggcgaactgtcacggacatgcgacagactggccgaagttgaagagaaactcaaggagaaatctcagcagctccaggaaaagcaacagcagctactgaacgttcaagaggagatgagtgaaatgcaaaaaaagatcaatgagatagagaacttaaaaaacgagctaaagaacaaggaactgactctggagcacatggagacggagcggctggaactggcacagaaacttaatgagaactatgaggaggtgaagagtatcactaaggagaggaaggtgcttaaggagctccagaagtccttcgaaaccgagcgggatcatttgaggggatatattagggagattgaagccactgggctgcaaaccaaagaagagctgaaaattgcccatatccacttaaaagaacatcaggaaaccatcgatgagcttcgcagatcagtttccgagaaaacagcacagatcataaatacccaggacctggaaaagagtcataccaagctgcaagaagaaatccccgtacttcacgaggaacaggagctcctgccaaatgtcaaggaggtttccgaaacacaggaaacaatgaacgagcttgagctgttgaccgaacagtctaccacaaaggactctactacgttagcgagaatcgaaatggagcgactgagactgaacgaaaagttccaggaatctcaggaagagatcaagagtttaacaaaggaaagagataaccttaagactatcaaagaagccctagaagtcaagcacgaccagttaaaggaacatatacgcgagaccctagccaagattcaggaatcccagtctaaacaggaacagtcgcttaacatgaaggaaaaggataacgaaactacaaaaatagtcagcgagatggaacagtttaaacctaaggattcagccctgcttcgtatcgaaattgagatgttgggtctgagcaagcgtctccaggaatcccatgatgaaatgaagtccgttgcaaaggagaaggacgatttgcagagactgcaggaagtactgcagtcagaaagcgatcagctgaaggagaacattaaagaaatagtcgcaaaacacctggaaaccgaagaagagcttaaggtcgcacattgttgtctcaaagaacaagaggagactatcaacgagttacgcgtaaacctgtcagagaaagagaccgaaatttccacaatccaaaagcagctggaagccattaatgacaagcttcagaacaagatacaagagatttatgaaaaggaagaacagttcaacatcaagcagatttctgaagtgcaagagaaagttaacgaactgaaacagttcaaagaacatcgtaaggcaaaggattccgctctacaatccatcgagagtaagatgctcgagttgaccaatcgcttacaggagagccaggaggagattcagatcatgataaaagagaaagaggaaatgaagcgagttcaggaggctttacagattgagagggatcaactgaaagagaacaccaaagaaattgtcgccaagatgaaagaaagccaggagaaagagtatcaattcttaaagatgacagcggtcaatgaaacgcaagaaaagatgtgcgaaattgaacacctgaaagaacagtttgaaacccagaagctcaacctggagaacattgagaccgagaacatccggttgacccaaattctgcatgaaaatctggaagagatgcgatctgtcaccaaagagagagacgatcttaggtctgtagaggaaactctgaaggttgagcgggatcaactcaaagagaacctgagagagactattacaagggacctggaaaagcaggaggagctgaagatcgttcacatgcatctgaaagagcatcaggagacgatcgataaactcagggggattgtttctgagaagaccaacgaaatcagtaatatgcagaaggatttggagcacagcaacgatgctttaaaagctcaggatcttaaaatccaggaagagttaagaatcgctcatatgcacctaaaggaacaacaagaaacgatcgataagctccggggaatcgtgagtgaaaagacagataagctgtcaaacatgcagaaggaccttgagaacagcaacgcaaaactccaggaaaagatccaagagttaaaggcgaacgagcaccagctgataacactaaaaaaggatgtcaatgaaactcagaagaaagttagtgagatggagcagttaaaaaagcagataaaggatcagtccctgacactatcaaaactggaaatagagaacttgaatttagcacaaaaactgcatgaaaacctggaagagatgaagagcgtaatgaaggaacgcgacaaccttcgccgagtcgaggaaactctcaaacttgaacgggaccaactcaaagagagtttgcaggagacaaaggcaagggatctcgaaattcagcaagagctgaagacggccagaatgttgagcaaggagcataaagagacggtggacaaactcagagagaaaatatctgaaaaaacaattcagataagtgacattcagaaggacctggacaaatccaaggatgagctccagaaaaagcaggatagacagaatcatcaggtgaagcccgaaaaacgacttctctccgatggtcagcaacacctgactgaatctttgcgtgagaaatgcagcaggattaaggaactcctaaagcggtactcagagatggatgaccactatgagtgcctcaacagactgtctctggatctcgaaaaggagatagagtttcagaaggagttgagtatgagagtcaaggccaacctgagtctcccttatctgcagactaagcacatcgagaagctgtttacggccaaccagcgctgctctatggaatttcaccgcatcatgaagaaattgaaatatgtgcttagttatgtgactaaaataaaggaggagcagcacgagtccataaacaagttcgagatggacttcatcgatgaggtggagaagcaaaaagaattgttaattaagatccagcatctgcagcaggattgtgacgtgccttcgcgcgaactacgtgatctgaaattgaatcagaatatggaccttcatatcgaggaaatcctgaaagatttctctgaatctgagtttccgtcaataaaaactgagttccagcaggtgttgagtaaccggaaggagatgactcagttcctggaagaatggctaaacacaaggttcgatatcgaaaaactgaagaacggcatccaaaaagagaatgatcgcatctgtcaggtgaacaatttttttaacaataggattatcgccatcatgaatgaatctactgagttcgaagagagatccgcaacgatcagcaaagagtgggaacaggatctgaagtccttgaaagaaaagaacgagaagctgtttaagaactaccagactctaaaaaccagtctcgcctcaggcgctcaggtcaatcctactacacaagacaacaagaatccacatgtgacaagtagggcgacacagttgacaacagaaaagatccgggagttagagaacagtctgcacgaagcaaaagagtctgccatgcacaaggagagcaagatcattaagatgcagaaggagctagaagtgaccaacgatattatcgccaagctgcaagctaaggtgcatgagtccaataagtgccttgagaagaccaaagagacgatccaggtgttgcaggacaaagttgcgcttggagctaaaccttataaagaggagatcgaagatttaaagatgaagctagtgaagatcgatttggagaaaatgaagaacgccaaggagttcgaaaaggagattagtgcgaccaaggcgactgtcgaataccagaaagaagtcattaggctgctgcgtgagaacctcaggaggtcccagcaagctcaggataccagcgtgatctctgaacacacagacccccagccatccaacaagccactgacgtgcgggggtggctccggtattgtccagaatactaaagctctgatcctgaaaagcgagcacatcagactcgaaaaggagatttcaaagctgaagcagcagaacgaacagctcattaaacaaaagaatgaactgctgagcaataatcagcacctgtccaatgaggtgaagacatggaaagaaagaacactaaaacgggaggcgcacaagcaggtcacctgtgagaacagtcctaaaagcccgaaggttacagggacagcaagtaaaaaaaagcagattactccaagtcaatgcaaagagcggaacctgcaggaccccgtacccaaagagagccccaaatcttgttttttcgattctcgaagcaaatctttaccaagcccccaccccgtccgctacttcgataactctagtctgggcctgtgcccagaggtgcagaatgccggtgctgaatccgtagatagccagcccggtccttggcacgcttcttcaggaaaggacgtgcccgaatgcaagactcagta

SEQ ID NO: 217819 - DNA, 7037 bp, Artificial Sequence
  Description of Artificial Sequence: Synthetic coding sequence
atggctgaggagggcgcagttgcagtgtgcgttagggtccgaccacttaattctcgcgaagaatcgcttggagagaccgctcaggtgtactggaaaaccgataataacgtgatctatcaggtagacggatccaagagcttcaactttgatcgcgtttttcacggaaacgaaaccaccaagaatgtctatgaagagatcgctgctcctatcatcgactccgccatccaaggctataatgggactatcttcgcatatggtcagaccgcttcgggaaaaacttacacaatgatgggctctgaggaccatctcggagtaattcctagagccatccacgacatcttccagaaaattaaaaaattccccgaccgggagtttctgctgagagtgtcatacatggagatctataatgagaccatcacagacctactgtgcggaacgcagaagatgaagcctctgatcatccgggaggatgtgaatcggaacgtctacgttgctgatctgacagaggaagtagtttatacttcagagatggctttgaagtggatcaccaagggggagaaatccaggcactatggggagaccaagatgaaccaacggagctcaaggagccacacaatctttagaatgatactcgaaagcagggagaagggggagccttccaactgcgagggctcagttaaggtgtcccatcttaatctggtggatttggcagggagcgaaagagctgcccagaccggggcagctggcgtgcgattgaaggagggctgcaatattaaccgatctctcttcatactaggtcaggtgatcaagaagctgagcgacggccaagttggcggtttcattaattacagagactctaagctgacccggatccttcagaattcgctgggcggaaatgcgaaaacacggattatttgcaccattactccagttagctttgacgagacactgaccgctctgcagtttgccagcaccgctaaatacatgaaaaacaccccctatgtgaacgaggtatctacggatgaagcgctccttaagagatatcgcaaagaaatcatggacttgaagaagcagctggaggaagtgagtctagaaacacgggcacaagcaatggagaaggatcaactcgcccagttgctggaggagaaagatctcttgcagaaggtgcagaacgaaaaaattgagaacctgacaagaatgctggtgacctcctcatctttgaccttacaacaggagttaaaagcaaagcgaaagaggcgcgtgacctggtgtctgggcaagattaataagatgaagaactcaaattatgccgatcagtttaatattcccacaaatataacaacaaaaactcataagctctctataaacctgctgagagagatagatgagtcagtatgttctgagagcgacgttttttctaacacccttgacacactatccgaaatcgaatggaatccagcgaccaagctcttgaatcaggaaaacatcgagtccgagctaaacagtttgcgagcagattatgacaatctggttctggattacgagcagctccgtactgagaaggaagagatggagttgaaactgaaagaaaaaaacgacttagatgagtttgaggcattagagagaaagactaaaaaagaccaggagatgcaacttattcacgaaatttcaaatctgaaaaacttggtgaaacacgcagaggtgtacaatcaggatctcgagaatgagctgtcatcgaaagttgagctgctgcgagagaaggaagaccagattaagaagcttcaggaatatatagattcccagaagttggagaatatcaaaatggaccttagctattccttggagagcattgaggatcctaagcagatgaaacagacgctgttcgacgccgagacggtcgctctagatgctaaacgggagtctgcgttcttaaggagtgagaatctggaattgaaagagaagatgaaggaactcgctaccacatacaagcagatggagaatgacatccagctttatcagagccaactcgaggccaaaaagaagatgcaagtggatctggagaaggagctgcagtctgcttttaacgagattacaaagctcacaagtctcatcgacggtaaggtcccaaaagatcttttatgcaaccttgagttggaaggcaagattactgatcttcaaaaggagttaaacaaagaggttgaagagaacgaggccctgcgtgaggaggtcatccttctgtcagaacttaagtcgcttccatcagaggtggagcgcctgaggaaagaaatccaagacaaatccgaagaactacatattatcacaagcgagaaggataagctgtttagtgaggtcgtccacaaggagtcccgcgtgcagggtttactcgaagagatagggaagactaaggacgatctggcaaccacgcagagtaattacaagtctacagatcaggagttccagaacttcaaaacactgcacatggattttgagcagaagtacaagatggtgttggaggagaacgagcgaatgaatcaggagattgtcaacctgagtaaggaagcccaaaaattcgactcttccctgggcgcactgaaaaccgagttgagctacaagactcaagagctccaggagaaaactcgtgaagtgcaggagcggctcaatgagatggaacagctgaaggagcagctggaaaaccgtgactcgaccctgcagaccgtagaaagagagaaaacactgattactgaaaagctacagcagaccctggaggaagtcaagaccctcactcaagagaaggacgatctgaaacagttgcaggagagcttgcagattgagagggaccagttgaaaagcgacatacacgataccgtgaacatgaatattgacacacaggaacagctgcgcaatgcattagagtcccttaagcagcatcaggagaccattaacactctgaaatcaaaaatctccgaagaggtctcccgcaatcttcatatggaggagaatacaggcgagacaaaagatgagtttcagcaaaagatggtgggaattgacaagaaacaagatctggaggctaaaaacacacagacacttacggccgatgtaaaggataacgagataattgagcagcagaggaagattttcagcctgatccaagagaagaatgagctgcaacagatgctggaatccgtcatcgcagagaaggagcagcttaagactgatctgaaggaaaacattgaaatgaccatcgagaatcaagaggaactgcggctactcggagacgaactgaagaagcaacaagagatcgtggcccaagagaagaatcacgccatcaagaaggagggagaactctcacgaacctgcgacagactggctgaggtagaggaaaagttgaaagagaaatctcaacagttgcaggagaagcagcagcagctgctgaacgtgcaagaggaaatgagcgagatgcaaaagaagatcaacgagatcgagaatctaaagaacgagttaaagaataaggaacttactctggaacatatggagacggaacggctagagctggctcaaaaactgaacgaaaattacgaggaggtgaaaagcatcacaaaggagcggaaagtgctgaaggagctgcagaaaagttttgagactgaaagggatcatttgcggggttatataagagagattgaggctaccgggctccagacgaaagaagagctcaaaattgcccacatccatcttaaggagcaccaggaaactattgacgaactccggagatctgtgtccgaaaagacagcccagattattaatacgcaagatctcgagaaatcccacactaagttgcaggaagagatccccgttctccatgaagagcaggaacttctacccaatgtaaaggaagtgagcgaaacccaggaaacaatgaatgagttagagctgctgacagaacaatcaacaaccaaggattctacaacattggccagaattgaaatggagagactgcgactcaatgaaaaattccaggagtcgcaggaggagattaaatctctcaccaaagagcgcgataatctcaagaccataaaagaggccctcgaagtgaaacatgatcagctcaaagaacatattcgcgaaacgttggccaagattcaagagagtcagtccaagcaggagcagtccctgaatatgaaagagaaggataacgagacaaccaagattgtgagtgaaatggagcagtttaagcctaaagactctgcactgctgaggattgagatcgaaatgcttgggttgagtaaacgcctgcaggagtcacacgatgaaatgaagtcagttgctaaagagaaggacgatcttcagcgcctgcaggaagtcctccagtctgaatctgatcagttgaaagagaacattaaagagattgtcgcaaaacacctggaaactgaggaggagttaaaggtagcacattgttgtcttaaggagcaggaagagacaattaatgaactcagggtcaatctgtctgaaaaggaaaccgagatcagcaccatccagaaacagctagaggccatcaatgacaagttgcagaacaaaatccaagaaatatacgagaaggaagagcagttcaacattaaacaaattagcgaagttcaagagaaggttaatgaactgaaacagtttaaggagcaccggaaggcaaaagattccgctttgcaatctatcgagtccaagatgctggagctgactaatcgactccaggaatctcaggaggaaattcagatcatgatcaaggaaaaggaggagatgaagagagtgcaggaggccttacaaatcgaaagagaccagctgaaggagaacactaaggaaatcgtagctaaaatgaaagaaagccaagaaaaggagtaccagttcctgaaaatgaccgccgtgaacgaaactcaggaaaaaatgtgtgagattgaacatctgaaggagcaattcgagacacaaaagttgaatcttgagaatatcgagactgagaatattcggctcacccagatcctccatgaaaacctagaggaaatgcgcagcgttacaaaagaacgtgatgacctgcgatccgttgaggagacccttaaagtggagcgcgaccagcttaaggaaaacctcagggagacaatcactcgggatctggagaaacaggaggaattaaagattgtgcacatgcacctgaaagagcaccaggagacaatcgacaagttgcgcggtattgtctctgagaagacaaatgaaatctcaaacatgcaaaaagacttagagcattcaaacgatgcgctaaaagctcaagacctaaagattcaagaggagctgcgcattgcgcacatgcatctcaaggagcagcaagagaccatcgacaaactccgtgggattgtttccgaaaaaaccgacaagctgtctaacatgcaaaaggacctggaaaacagcaatgcaaagctgcaggaaaagatccaggagctgaaagccaacgagcaccagctgatcacattgaaaaaggacgttaatgaaacacaaaaaaaggtcagcgagatggaacagctgaagaaacaaatcaaagaccaatctctgaccctatctaagctcgaaattgaaaacctgaacctggctcagaagttacacgagaacttagaagaaatgaaatccgtaatgaaagagagggataacctgcgcagggttgaggaaaccctgaaactagaacgggaccagctcaaagagtccttacaagaaacaaaagccagagacctggagatacaacaagaattaaaaactgccaggatgctgtcaaaagaacacaaagaaaccgtggacaagttgagggagaaaatttctgagaagaccattcaaattagcgacatccaaaaagacttggataaatccaaggacgaactacagaagaaaatccaggaactgcaaaaaaaggagcttcaactgctgcgggtgaaggaggacgtgaacatgagtcacaaaaagatcaatgagatggaacaactcaagaagcagtttgaggcgcagaatttgtcaatgcagtccgtacgcatggataattttcagctgacaaaaaagctccatgagtccctggaggaaattagaatcgtggccaaggagagggatgaactgcggcgaatcaaagaatctctcaaaatggagagagatcagttcattgccactctccgcgagatgattgctcgagaccggcagaaccatcaggtcaaaccagagaagaggctgttgagcgacggccagcaacatttgaccgaatccctccgtgagaagtgctctcggatcaaagaactcctcaagcggtacagcgagatggacgatcattacgaatgtctgaaccggctttccctggatctcgaaaaagagattgagtttcaccggatcatgaaaaaactcaaatacgtgctatcctatgttaccaaaattaaggaagagcagcacgagtcaattaataagttcgagatggatttcatcgatgaagttgaaaagcagaaggaacttcttatcaaaattcagcatctccagcaggactgcgacgtaccttccagggaattgcgcgacctgaagctcaaccaaaacatggacctccatatagaagaaatcctgaaagattttagcgagtcagaatttccatccattaagactgagtttcaacaagtgctgtcaaacagaaaggagatgacgcagtttctggaagagtggctcaacacccgtttcgacatcgaaaagttaaagaatggtattcaaaaggaaaacgatagaatttgccaggttaacaatttttttaacaaccggatcatcgcaattatgaatgaatctactgagttcgaagaacgaagtgccaccatcagcaaggaatgggagcaggatcttaagagtctgaaggaaaagaatgaaaagctgttcaaaaattatcagactctcaagacctcactggcttcaggcgcacaggtgaatcctactacccaggataacaagaaccctcacgtgacaagcagagcaacccagttgactaccgagta

SEQ ID NO: 217820 - DNA, 9344 bp, Artificial Sequence
  Description of Artificial Sequence: Synthetic coding sequence
atgtcctgggctctggaggaatggaaggagggtctccccacgcgagccctgcaaaaaatccaggagctagaggggcagctcgataaactgaagaaggaaaaacagcagaggcagtttcagctggattctctggaggccgcattacagaaacagaagcagaaagtggaaaacgagaagacagaagggacgaaccttaaaagagaaaaccaaaggctgatggaaatctgcgagagtctagaaaaaactaagcaaaaaattagccacgagctccaggtgaaggagtcacaagtaaactttcaggaagggcagctgaactcgggcaagaagcagattgagaagctggagcaggagctaaaaaggtgtaaatccgagctagaacgtagtcaacaggccgctcagtcagcggacgtgtcactgaacccatgcaataccccccagaaaatttttactacgccgttaaccccatcccagtattattccggcagcaaatatgaggatctcaaggagaagtataataaggaggtggaagaacgcaaaagactcgaggcagaagtaaaggccctccaagccaagaaggctagccaaacacttccacaagccaccatgaaccatcgggacatagcacggcatcaagcatcctcaagtgttttcagctggcagcaggaaaagacccctagccatctttcatccaatagccaacgcaccccaattaggcgggatttctccgccagctatttcagtggtgagcaggaggtcaccccctctcggagtactttacagatcggaaagagggatgctaactcatccttttttgacaacagcagttccccccacctgctggatcagctgaaagcccaaaatcaggaactgcgaaacaaaatcaacgagttagagctgagactgcaggggcatgaaaaagagatgaaaggtcaggtgaacaagttccaggagctgcaactccaacttgaaaaagccaaagtggaattaattgaaaaggagaaagttcttaataagtgccgcgacgaactcgtcaggacaaccgctcagtatgaccaggccagtacaaaatatacagccttggagcagaaactgaaaaagttgacagaggacctctcctgccagcgccagaatgctgagtccgcgagatgttccttagagcagaaaattaaggagaaggagaaagagtttcaggaagagctgtcacgccagcaacgaagtttccagactttagatcaggagtgcatccaaatgaaggcacgtctgacacaggagctgcagcaagcaaagaacatgcacaatgtgctacaagccgaactggataagctgaccagcgtgaagcagcagctggagaacaacttagaggagtttaagcagaagttgtgcagagctgaacaagcctttcaggcgtcccagattaaggaaaatgaattaagaaggtcaatggaagaaatgaagaaggagaacaatctgctgaaatctcactccgagcagaaagcacgggaagtctgtcacttagaagcagagttaaaaaacatcaaacagtgtctgaatcagtcgcagaactttgccgaggagatgaaggccaaaaatacttctcaggagacgatgctgcgcgatcttcaggaaaagataaaccagcaggaaaactccctgaccctggaaaagttgaagctcgccgtggccgacctagagaagcagagggactgttcccaagacctgcttaaaaagagggagcaccatatagagcagctgaatgacaagctgagcaaaacagagaaggagtccaaggccctcctgtcagccctggagttgaagaagaaagagtatgaggaattaaaggaggagaaaacccttttttcttgttggaagagtgaaaacgagaaattattaacacaaatggaatccgagaaggagaatctgcaatccaagataaatcacctcgaaacttgcctgaagacccaacagataaagagtcacgagtataatgagcgagtgcgaaccttggaaatggatcgggagaatctgagtgttgagatccggaatctccataacgtgttggactcgaaatcggtggaagtggagactcagaagctcgcctacatggagctacaacagaaggccgaattcagcgatcaaaaacaccaaaaagagatcgagaatatgtgccttaaaactagccagctgactggacaagtggaggacttggaacacaaactgcagctactcagtaacgaaatcatggacaaggatagatgttatcaggacctgcatgccgagtatgagtcactgagggatcttctcaaaagcaaagatgctagcctggtgactaatgaggatcatcagcggtcactactcgcgttcgaccagcagccagccatgcatcactcctttgcaaacataatcggagagcagggctccatgccttcagaacggtccgagtgccgccttgaagctgatcagagcccgaaaaattctgctattcttcagaaccgcgttgacagcttggagttcagcctcgaaagccagaaacagatgaactccgatctgcaaaagcagtgcgaagagcttgtccagatcaaaggcgagatcgaagagaacctcatgaaggccgaacagatgcatcaaagctttgtggccgaaacttctcagagaatctcgaaactgcaggaggacacctcagctcaccagaatgtcgtggccgagaccctcagtgctctcgagaataaagagaaagaattacagttgctcaacgataaggtggagaccgagcaggcagagatccaagagctgaagaagtctaatcatcttctcgaggactcattgaaggagctgcagcttctgagtgaaacattgtctctggaaaaaaaggagatgagctccataattagtctgaacaagcgcgagatcgaagaacttacccaagaaaacggcacactcaaggaaataaacgcgtccctcaatcaggaaaaaatgaatcttatccagaagtcagagtcctttgcaaactacatcgacgagcgcgaaaaatctatctctgaactgtctgaccagtacaagcaggaaaaattgatcctattacagaggtgtgaggagacgggaaacgcttatgaggacctgtcacagaaatataaggcagcccaggagaagaattcaaagctggagtgcctactcaacgaatgtacctctttgtgcgagaatcgtaagaatgaacttgagcagctaaaagaagcttttgcgaaggagcatcaggagtttcttaccaagcttgcattcgctgaggagcgcaaccagaacttaatgctggagctcgagacggtccagcaggccttgaggtctgagatgacagataatcaaaacaactctaaaagcgaggccggaggactgaaacaggaaatcatgacattgaaggaggaacaaaacaaaatgcagaaggaagtgaatgatttactccaagagaatgagcaacttatgaaagtgatgaagacaaagcacgagtgtcagaacctggaaagcgagccgattcggaattcggtgaaagaaagagagtctgaacggaaccagtgcaacttcaagccccaaatggacctggaggttaaagagataagcctggactcttataatgcccagctggtgcaattggaggcgatgctgagaaacaaggaactcaagctgcaggagtcagaaaaggaaaaggaatgcttgcagcacgagctgcagacaatccggggagacttggagaccagcaacctgcaggatatgcagtcacaggagatctcaggccttaaggactgtgaaatcgatgcagaagaaaaatatatcagcggaccgcacgaactcagcacatctcagaacgataatgcacacctgcagtgttcactgcagaccacaatgaataagctgaatgagctagaaaagatctgcgaaatccttcaggccgagaagtacgagctggtgaccgagctcaacgatagtcgatccgagtgcataactgcaaccagaaaaatggcggaagaagtcggcaaactgctcaatgaagtcaagatcctgaacgatgacagcgggctgcttcacggtgagctagtggaggacataccaggcggagagttcggggagcagcctaacgagcagcacccagtcagtttggctcctctggacgaatcgaactcctatgagcaccttacgcttagcgataaggaggttcagatgcactttgctgagctccaagagaagttccttagtctgcagtctgaacacaagatcctgcatgaccagcactgtcaaatgagctcgaaaatgtcagaactacaaacctacgtggattcactcaaggctgagaatctggtgctaagtaccaacctgcgcaactttcaaggagacctggtgaaggaaatgcagcttggccttgaagaggggctggtgccaagtctgagcagctcatgtgtgcccgattcttccagcctgtctagtcttggcgattcttctttttacagagcgttacttgagcagacaggagacatgtcgttgctctccaaccttgagggggcagtcagcgcgaaccagtgctccgtggatgaggtattttgttcttctctgcaggaggagaacttgacacgcaaggagacacctagtgctcccgctaagggggttgaagagctggaatcgttgtgcgaagtctatagacagtctttggaaaagttagaggagaagatggaaagtcaaggaattatgaaaaataaggagatacaagagctggagcagcttctctctagcgagcgacaagaactggactgcctccggaaacagtacctgtccgaaaacgaacagtggcagcaaaaactgacttctgtcacactggaaatggagtcgaaactagccgcagaaaaaaagcagaccgagcagctgagcctcgaactggaagtagctagacttcaactgcagggactggatctttctagccgctctttgttgggcatagacacagaggacgcgattcagggccgaaatgagagctgtgacatttccaaggagcacacttctgagacgaccgagagaacacccaaacatgacgtgcatcagatctgcgacaaagacgcacagcaagatctcaatctggatatcgagaaaatcaccgaaactggcgcagtgaagcctaccggagaatgtagtggagagcagtctccagatacaaactatgaacctccgggagaggataaaacacagggctcaagtgagtgcatctccgaactgtccttttcaggccctaacgcgcttgtgcctatggacttccttgggaaccaggaggatatccataacttgcagttaagagtcaaggagacctctaatgaaaatctgaggttactacatgtgatcgaggacagggatcgcaaagtcgagtccctgctgaatgagatgaaggagctcgattccaaactccacctgcaggaagtccagttgatgactaagatcgaggcctgcatcgaattggagaagatagtcggtgagttgaaaaaggagaattcagatctgtcggagaagctcgagtactttagttgtgaccatcaagagcttctgcaacgtgtggaaaccagtgaaggtctcaacagcgatctggaaatgcacgccgataagagttccagggaggacatcggcgacaatgtggctaaagtaaacgattcctggaaggagaggttcctagacgtggaaaacgaactttctcgaatcaggtctgagaaggcatctatagaacatgaagccctgtatcttgaggccgatcttgaagtggtgcagactgagaagttgtgccttgaaaaggataacgagaataagcagaaagtgattgtgtgtctggaagaggagctctcagtggtgactagcgagcgcaaccaactcaggggcgagctggatacaatgtcaaagaagactacagcccttgatcagctttcagaaaagatgaaagagaaaactcaagagctggaaagccaccagtccgaatgtctccattgcatccaagtggctgaggccgaggtaaaagaaaagaccgagctcctacagaccctaagcagtgatgtgtcagagctgttaaaggacaaaacacacctccaagagaagctccaaagcctggagaaagacagccaagctctgagcctcacaaaatgcgagctggaaaatcagatagctcagctgaataaggagaaggaattactggttaaagagagtgagtcgttacaggccaggctgagcgaatccgattacgagaaactaaatgtgtcgaaagcactggaagctgctctcgtggagaaaggtgaattcgccctaagactaagcagcacccaagaggaggtccaccaactccgcaggggtatagagaaacttagggtcagaatcgaagccgacgagaagaaacagctgcacatcgccgaaaagttgaaagaacgggaacgagagaacgactcactcaaagataaggtggagaacctggagcgcgaactccagatgtccgaggagaaccaggaactagtgatactcgacgcagaaaactcaaaggcagaagtggaaactttgaaaactcagatcgaagaaatggcaaggtctctaaaagtgttcgagctggacctggtcacactgcgcagtgaaaaagagaatctgaccaaacagatccaggaaaaacagggccaattgtccgagctggacaagctgctgagctccttcaaatcactactggaagaaaaggaacaggccgagatacagatcaaagaagaatccaagactgccgtagaaatgctgcagaaccaattgaaggagctgaatgaagctgtcgcagcactctgtggtgatcaagaaatcatgaaggctaccgaacagtcactggacccccctattgaagaagagcaccagttgcgaaattcaatcgaaaaattacgtgctaggctggaggcggacgagaagaaacagctttgcgtgctgcagcaattgaaagagtcggagcaccacgctgatctcctgaagggacgagttgaaaacctggagcgtgagttagaaattgctaggactaatcaggaacacgccgcattggaggcagagaactccaaaggcgaggttgaaactctaaaagcaaaaatcgagggaatgacccagagtttacggggactggagctagatgtggtcacaatcaggtcagagaaggagaatctgactaacgagctccagaaggagcaggaacgcattagtgagctagagataatcaattcgtcgttcgaaaatatcctgcaggagaaggaacaggagaaggtgcaaatgaaggagaagagcagcacagcgatggaaatgctgcagacccaattgaaggagctgaatgaaagggtcgctgcactccacaatgaccaggaggcttgcaaggcgaaggaacagaatcttagctctcaggtagagtgtcttgaattagagaaggctcagctgctccagggcctcgacgaggcgaagaacaattacattgtgctgcaatctagtgttaacggtcttatacaagaagttgaggacggaaagcagaagctggaaaaaaaggacgaagaaatctctcgcctcaaaaaccaaatccaggatcaagagcagctggtgtccaagctctcccaggtagagggagagcaccaactttggaaagagcagaaccttgaactgcgcaacctgaccgttgagctggagcagaaaatccaggtgctgcagagcaaaaacgcttcattacaggacaccctggaagttcttcaatcgtcctataaaaacctcgagaatgagctggagctcactaaaatggacaaaatgagctttgtggagaaggtcaacaaaatgactgccaaggagactgagctgcaacgcgaaatgcacgaaatggctcagaagaccgccgagctgcaggaggaactgtccggcgagaagaaccgattagcaggggaactacagttgctgctcgaggagatcaaaagcagcaaggaccaactgaaagagctgacgttagagaacagtgagctgaaaaagagtctggattgcatgcacaaagatcaagtggagaaagagggtaaggtgcgggaggagatagctgagtaccagttacgcctgcacgaggctgagaaaaagcaccaagctctgctgttggacacaaataagcagtacgaggtagaaattcagacatatagagagaagctcaccagcaaagaggaatgtctgtctagccaaaaattagaaatcgacctgctgaagtcatctaaggaggagctgaataattctctgaaagcaaccacacagattctggaggagctgaagaagaccaagatggataacctaaaatacgtgaaccaactaaagaaggagaatgaacgtgcccagggaaaaatgaaacttctgatcaagtcgtgcaagcagctagaagaggagaaagagatcctgcaaaaggaattgtctcagttacaggcagcccaggaaaaacagaagacaggcaccgtaatggataccaaagtggatgaactcactaccgaaataaaagagctcaaagaaactctggaagaaaagacaaaagaggccgatgaatatctggataaatactgcagccttctaatctctcatgaaaagttggaaaaagccaaagagatgttagagacacaggttgcccatttatgtagccaacagagcaaacaggacagtcgcggttcacccctgctgggcccagttgtgccagggccaagccctatcccgagcgtcaccgagaagagactgagtagcggccagaacaaagcttcaggtaaacggcagcggagttctgggatctgggagaacggacgcggacccacacctgcgaccccggaaagcttcagcaagaagtccaagaaagcagtcatgtcaggaattcaccccgctgaagataccgagggcactgaatttgagcccgagggcttaccagaggtggtaaagaaaggctttgccgacattccgaccggtaagacctccccctacatcttgcggagaactaccatggctacgcgcacatcaccacggctcgctgcccagaaactggccctaagccctctttcactgggtaaggagaacttggccgagtcgtccaaacccaccgccggaggctcacgatcgcaaaaagtgaaagtcgcacaacggtccccggtggattcaggaaccattctaagggagcctacaacaaagagtgttcccgtgaacaaccttccggagaggtctcccaccgacagtcccagggaaggcctgagagtgaagcgtggaagactggtgcccagcccaaaagcgggactggaaagcaatggcagtgaaaattgtaaggtccagta

SEQ ID NO: 217821 - DNA, 528 bp, Artificial Sequence
  Description of Artificial Sequence: Synthetic coding sequence
ctcatgattaaaggccgaaaggggaaagtgaataagatgacagcaaaggagacggaactccagagagaaatgcacgagatggcgcagaaaaccgcggagctccaggaggagctctccggagagaagaacagattagccggtgaattgcagttgctgttagaagaaattaaaagctctaaggaccaactgaaagaactgactctggaaaacagcgagctcaaaaaatccctggattgtatgcataaggaccaggtcgaaaaagagggaaaggttagggaagaaatcgccgaatatcagcttcgcctgcatgaagccgagaagaagcaccaggcattgctccttgacacaaacaagcagtacgaagtcgagatccagacgtacagagagaagctgacctccaaggaggagtgtttatcctcacagaaactcgagatcgatctgctgaaaagctccaaagaggagttaaataactctctgaaagcaacgacccaaatattggaagagctgaaaaagaccaaggaaaattag

SEQ ID NO: 217822 - DNA, 4017 bp, Artificial Sequence
  Description of Artificial Sequence: Synthetic coding sequence
atgtttttgatgcccacttctagtgagctgaactccgggcagaactttcttacccaatggatgaccaatccatcaagagccggagtgattcttaataggggattcccaatacttgaagctgacaaggagaaacgtgccgcagttgatatctcgacatcctttcctattaagggcacccatttttcagattcctttagcttcatcaatgaggaggattctttactcgaggagcagaaactggaaagcaacaacccctacaagcctcagtctgataagagtgaaactcacacagctttcccttgcattaaaaagggtccacaagtggctgcctgtcattccgcacctggacaccaggaggagaacaaaaacgactttattccagatttggcctcagagtttaaggaaggagcttacaaggacccattatttaaaaagcttgaacaactgaaggaggttcagcagaaaaaacaggaacaattaaagcggcagcaactggagcagctgcagaggctaatggaagagcaggagaaactcctcaccatggtcagtggccagtgtacgctgcccggtcttagcctgttgccagacgatcaaagccagaagcataggtcacccggtaatacaaccaccggagagcgggcaacatgttgtttcccatcttacgtgtaccctgatccaacccaggaagagacctaccccagcaacatcctctctcacgaacagagcaatttttgtcgcaccgcacatggcgactttgtgctgactagtaaacgggcttcccctaacctgttttcagaagcccaataccaggaggccccagtggaaaagaacaatctgaaggaagaaaaccggaatcaccccaccggagagtctattctctgttgggagaaagtgaccgaacagatccaggaggctaacgacaagaaccttcagaaacacgacgattcctcagaggtggccaatatcgaagaacggcctattaaagccgctatcggagaacggaagcagaccttcgaggattacctggaagaacaaatccagctggaggaacaggagctgaagcaaaagcagttgaaggaggccgaggggccactgccgatcaaagccaagcccaagcagcccttcctgaaaaggggggaaggcctcgcaagattcactaacgctaaaagtaagttccagaagggtaaggaaagtaagctggttaccaaccaatccacgtcagaggaccagcccctttttaagatggatcgacagcaactgcagcgcaagactgcccttaaaaacaaggagctttgcgcagacaacccaattttaaaaaaagatagcaaagccagaaccaaatccggctctgttacactgtcacagaagccaaagatgctgaagtgctcgaatcgtaagtccttatctcctagcggccttaagatacagactggaaagaagtgcgacggccagtttcgtgaccaaataaagttcgaaaacaaggtcacttccaacaataaagagaacgtcaccgagtgccccaagccgtgcgatactggctgtacggggtggaataaaactcaggggaaagaccgcctgccattgagcactggccctgcttcccggctagccgcaaaaagtccaatccgcgagaccatgaaggaaagtgagtctagtttggatgtgtctctccagaagaagcttgagacgtgggagcgggaaaaagagaaggaaaatctggaactggacgagtttctgttcctcgaacaggcagcggacgagatcagtttttcctctaattcttccttcgttctgaagatattggaacgtgatcagcagatttgtaaaggccacagaatgagctcgacccccgtcaaagcagtccctcagaaaacaaaccctgcggaccccatttcccattgtaatcgcagcgaagatctcgaccatactgcacgtgaaaaggagagcgagtgcgaagtcgcgcctaaacagctgcactctctgtcttctgctgatgaattgcgagagcagccctgcaagatccgaaaggcagtgcagaagagtactagtgaaaaccagactgaatggaatgctagagacgatgaaggagttcccaattctgattcctcaaccgacagcgaggagcagctggacgttacaattaagccttcaaccgaagaccgagaacgaggaatctcatcccgcgaggatagcccacaagtgtgtgatgataaaggaccctttaaagacaccagaacacaggaagataaaaggagagacgtcgacctggacttgtcagataaagattattcctctgacgagtcaatcatggaaagtataaaacacaaagtgagtgagcccagcaggtctagctctctttccctctcgaaaatggacttcgacgatgagcgaacatggactgacctcgaagagaacctatgtaaccacgatgtggtcctgggaaacgagagcacctacggcaccccacaaacgtgttatccaaacaatgagatcggcatattagataagaccatcaaacgcaaaatcgctcctgtaaaacggggagaggacctgtcaaagagtagaaggagccggtcgcctcccactagtgagttgatgatgaaattctttcccagtctgaagccaaagcctaagagtgattcacatctggggaacgagctgaaacttaatatctcacaggatcagcccccaggtgataacgccaggtcacaagtactgagggagaagattatagaactggagacggaaatcgaaaagttcaaggccgaaaatgcatctttagcgaaactgcgcatcgagcgggagagcgcactcgagaaactcagaaaggagattgcggattttgagcagcaaaaggcgaaggagctggctaggatcgaggagtttaaaaaggaagaaatgcgcaaacttcagaaagagcgcaaggtgttcgaaaagtacacgaccgcagccaggacttttcccgataagaaggaacgggaggagatccagactttaaagcagcagatcgcagatctcagggaagatttaaagcgcaaagaaactaagtggtccagcacccattccagactgcgctcccagatccagatgttggtgcgcgagaatactgacctccgagaagaaattaaggttatggagagatttaggcttgacgcatggaaaagagcagaggccatagagagcagcctggaagtggagaagaaagacaagctcgcaaacacctcggtcagattccagaatagccagatatccagcgggactcaggtcgagaagtacaagaaaaactaccttcccatgcaaggaaatcccccaagaaggtccaagagcgcccctcctcgggatctgggaaacctggataagggccaggcagcctcccctcgggagcccctggagccactcaatttcccagaccctgaatacaaggaggaggaagaagaccaagatatacagggagaaatcagccaccccgatggcaaagtggagaaagtttacaagaacggttgccgagtcatactcttccccaacggaactcgcaaggaagtcagtgcagacgggaagacaataacggtaacctttttcaatggcgatgtcaaacaggtcatgccggatcagcgcgtgatttattactatgccgctgcccagaccacgcacaccacttaccctgagggcttggaagtcttgcatttttccagcggtcaaatcgagaaacactatccagacggacgcaaagaaattacttttccagatcaaacagttaagaatctgttccccgatggccaggaggaaagtatttttccggacggcaccatagtgcgggtccagagagacgggaataagctgattgagtttaataatggacaacgtgaactacacacagcccagtttaagcgaagggaatatccagacggaacagtgaagaccgtttacgcaaatggacaccaagagacgaagtaccgctctggacgaataagagttaaggacaaggaaggcaacgttttaatggacactgagttgtag

SEQ ID NO: 217823 - DNA, 3411 bp, Artificial Sequence
  Description of Artificial Sequence: Synthetic coding sequence
atgtttctgatgcccaccagctccgagctgaatagcggccaaaacttcctgacccaatggatgaccaacccttctagagccggtgtcatcttaaatcgaggcttcccaattctcgaggccgacaaagagaagagggccgctgtggacattagtacttcttttccaattaagggcactcatttttccgacagcttctcctttatcaatgaggaggactccctgctggaagaacagaaactggaatcaaacaacccgtataaaccacagtctgataagagcgaaacacacaccgcgttcccctgtattaagaagggtccacaggtcgcggcttgtcattccgctccaggccaccaggaagaaaacaaaaacgatttcattcccgatttggcaagtgaattcaaggagggagcatacaaggacccgctgttcaaaaaactcgaacaacttaaggaggtccagcagaaaaaacaggaacagctcaagcggcagcagctggaacagctgcaacgcctgatggaagagcaagaaaagttactgacaatggtgtccggacaatgcaccctcccaggcttgagtctcctacccgatgaccagtcccagaaacacaggagtcccggaaatactacaaccggcgagcgggcaacttgctgctttccctcctacgtgtaccctgatccaacccaggaggagacatatccatctaatatcttatcccacgaacaaagtaatttctgccgtacagcccacggtgattttgtcttgacctctaaacgcgcaagcccaaacctgttttcagaggcccaataccaggaagcacccgtagagaagaataacctcaaagaggaaaatagaaaccatccaacaggtgagagtatcctgtgctgggaaaaagttactgaacaaatacaggaggcaaatgacaaaaacttacaaaaacatgatgactcaagcgaagttgcgaacatagaggagaggcctatcaaggcagctataggcgaacgaaagcagactttcgaagactatttagaagaacaaatccaactggaagaacaggaactgaagcagaagcagcttaaggaagcagaaggccctctgcctattaaagccaaaccaaagcagccctttctgaagcgcggtgaaggcctcgcgcgatttaccaacgctaagtctaagtttcagaagggtaaagaatccaaactggtgaccaatcaaagtacatcagaggaccagcccctgtttaagatggatcgacagcaactgcagagaaagacggcattgaagaataaagagttatgcgcagataaccccattttaaagaaagacagcaaagcgcgtacaaaatctgggtccgtcaccttaagccagaaacctaaaatgctgaaatgctccaaccgtaagtcactgtcaccctcaggccttaagatacagacaggcaaaaaatgcgatggtcagttcagagaccagataaagttcgagaacaaagtgacttcaaataacaaggagaatgtcactgagtgtccaaaaccctgcgatacaggttgtacaggttggaacaagactcagggaaaagacaggctgccactgtctactggacctgcttcccgtctggcagccaagtcaccgatccgggagaccatgaaggaatcagagtcttctctggatgtctctttacagaagaagctcgaaacctgggagagggaaaaagagaaagaaaacctggaactggacgaattcctattcctcgaacaggctgccgacgagatctcttttagcagcaatagttcttttgtgctgaaaattttggagcgcgaccagcaaatatgtaaaggacacagaatgtcatcaacccctgtgaaggctgtgccccagaaaaccaacccggctgatccaatttcacactgcaatagatccgaggatctcgatcacaccgcgagagaaaaagagagtgagtgcgaagtagctccgaaacagctgcactctcttagcagtgccgacgagttgcgagagcagccctgcaaaattagaaaagctgttcagaaatcaacttctgaaaaccagacagaatggaacgccagggatgatgaaggcgtgcccaacagcgacagctccactgactcggaagagcagctggacgtcacgatcaaaccgtccactgaggatcgagagaggggaatctcaagcagagaggatagtccccaggtgtgcgatgacaaagggcctttcaaggacacgcgcactcaggaagacaagcggagggacgtggatcttgacctgtccgacaaagactactcctccgacgaaagtatcatggagtctatcaagcacaaagtcagtgaaccgagtaggtcatccagccttagtctatcgaagatggatttcgatgacgagcgcacatggacagacctagaagaaaatttgtgcaatcatgacgtcgttctgggcaatgaaagcacatacggcactcctcagacatgctatccaaacaacgaaatcgggatacttgataagactattaagcggaagatagcccctgttaaacgtggtgaggatctaagcaagtcaaggcggagccgctctccccctacatccgagttgatgatgaaattcttcccttccctgaagccaaaaccgaaaagcgacagccacctgggcaatgaactgaagttgaatatatcacaggatcaacctccaggggacaacgcaaggtctcaagttttgagggaaaaaattatcgagctggagacagaaatagagaagtttaaggccgagaatgcttccctggccaaactaagaattgaacgagagtctgcgctagaaaagctaagaaaggagatcgctgattttgagcaacaaaaagccaaggaactggctcggatcgaggagttcaaaaaagaagaaatgagaaaacttcagaaagagcgaaaggtattcgaaaagtacaccaccgccgctaggacctttccagacaagaaggagcgggaagagatccagacgctaaagcaacagattgcagatttgagagaagacttaaagagaaaggaaaccaagtggagcagtactcactctcgattacggtcgcagatccaaatgctggtccgcgaaaatacggatctgagagaagaaatcaaggtcatggagagattccggctggatgcttggaagcgggcagaggctatagagtccagcctggaagtggaaaaaaaggacaagttggccaacacatctgttaggttccagaattcacagatctcttccggaacccaggtggaaaaatataagaagaactacttgcctatgcagggaaccgcgcaacctccacacacaccatcaagcttgttggctgatcatttacctccactctcatcttttagacctttttctaggaatattcagttgtgttacaccttctag

SEQ ID NO: 217824 - DNA, 3261 bp, Artificial Sequence
  Description of Artificial Sequence: Synthetic coding sequence
atgtttctgatgcctacctctagcgagcttaattcaggccaaaacttcctgacacagtggatgactaacccctctcgagctggcgtgatactgaaccgtgggttcccaatactggaggcagacaaagaaaagcgggctgccgttgatatctccacatcattccccatcaaagggacacatttcagcgattccttttccttcatcaacgaagaggactctcttcttgaggagcaaaaattagaatctaataacccctataagcctcagtccgacaagtcagaaacacataccgccttcccctgcataaagaagggaccgcaggtagccgcatgccattccgcgccaggccaccaggaggaaaataagaatgatttcatacctgaccttgccagtgagtttaaagaaggagcttataaggatcctctgtttaaaaagcttgaacagctcaaggaagtgcagcaaaagaaacaggaacaactcaaacgacaacagcttgagcagctccaacggctgatggaagagcaggaaaaactcttgaccatggtgtctggccagtgcactctccccggtctttcccttctgcctgatgaccaatcccagaagcataggagccctggcaatacgaccaccggggaaagagccacatgctgctttccttcttatgtttacccagaccccacccaagaagaaacctatccctcaaacattctttcgcacgagcaatccaatttctgcagaaccgcccacggcgactttgtgctgaccagcaagagagcctcccctaatctcttcagtgaagcccagtatcaggaagcacccgtggagaaaaacaatctcaaagaagaaaacaggaaccaccccaccggagagtctatattatgttgggagaaggtaacagagcagatccaggaggcaaacgacaagaacttgcaaaagcacgatgattcgagtgaagtggccaatatcgaggaacgtccaattaaggccgcaatcggtgagagaaagcagacattcgaggactacctggaagagcaaattcagctggaggagcaagagctgaagcagaagcaactgaaagaagccgaggggccacttccgatcaaggctaaacctaagcagccattcctgaaacgcggagaaggcctagccaggtttaccaatgccaaaagcaagttccaaaaaggtaaagaatctaaattggtcacgaaccagtctacaagtgaggaccagcctctatttaagatggaccgacagcagctgcagcgtaaaacagcgcttaagaataaagagctgtgcgccgataatcccatactgaaaaaagactccaaggctcgaaccaagagcggttcagtgaccctgtctcagaagcctaaaatgttgaagtgctccaaccgtaagtcactgtcaccctccgggttgaaaattcaaacaggaaagaagtgtgacgggcaattcagggatcagatcaaattcgagaataaagtaaccagcaataacaaagaaaacgtgacggaatgccctaagccatgcgacaccggctgcactgggtggaataaaacccaggggaaagatcgactgcccctcagtacaggccctgctagcaggctcgcagctaagtctccaattcgcgagactatgaaggagagcgaatctagtttagacgtgagtctgcagaaaaagctggaaacttgggaacgggaaaaagagaaagagaacctagagctggatgagtttttgttcctcgaacaggcagcggatgaaatctccttctcctccaatagctcatttgtgttaaaaattctggagcgtgatcagcaaatttgcaaaggccaccgaatgagttctactccggttaaggccgtgccccaaaagactaacccagccgaccctatcagccactgtaatcgcagcgaagatctggatcacacagcccgagagaaggaaagcgaatgcgaagtggcgccaaaacagctgcactcactgtcaagcgccgacgagcttcgtgaacagccctgtaaaatccggaaggccgttcaaaaaagtacatctgagaaccagacggagtggaacgcgagggacgacgaaggcgtgccgaactccgacagttctaccgatagcgaagagcaactggacgtcacgatcaagcccagcacagaggaccgagagcgcggtatttcatctagagaggattctccacaggtctgtgacgacaaaggcccttttaaagacacacgaacgcaagaggataaaagaagagacgtggacttggatttgagcgataaagattacagttccgacgagtcaattatggagagcatcaagcacaaggtgtccgaaccgtcccgctcctccagcctgtccctctctaagatggactttgacgatgagagaacttggactgacctggaggagaatctttgtaaccacgacgtggttctcggcaacgaatccacctatggtaccccccagacctgctaccccaataatgagattggtatcttggataagacgattaaacgcaaaattgccccagtcaagcggggagaagatctgtccaagtctcgaagaagccggtcacctcccacttcggaactgatgatgaagtttttcccatccttaaagccaaaacctaagtcagacagccatctggggaacgagctcaagctgaacatctcgcaggaccagcccccaggagacaatgcgaggtctcaggtcctgcgcgaaaagataattgaattggaaaccgagatcgagaagtttaaggccgagaatgcctcactcgcaaagctaaggatcgaacgggagtccgctctggagaaattgcggaaagaaatcgcagatttcgagcagcaaaaggccaaagaactggcacgaatcgaggagtttaaaaaggaggagatgcgcaagctgcagaaggaacgcaaagtttttgagaaatatactacagcagcccgtacttttcccgacaaaaaggagagagaagagatccagacattgaaacagcagatcgctgacctgcgtgaggacctgaaaaggaaggagactaaatggtcttccacgcacagccggctgcgaagccagatccagatgttagtgcgagaaaatacagacctccgcgaggaaatcaaagtgatggagcgattcaggctagacgcttggaaaagggccgaagccatagagtcgtctttagaagtggaaaagaaagacaagttagctgctattcatctggaagatccatcactgcaccttctggttatttag

SEQ ID NO: 217825 - DNA, 1035 bp, Artificial Sequence
  Description of Artificial Sequence: Synthetic coding sequence
atggatagttactctgctccagaaagcaccccatctgcttctagtcgccctgaggattacttcataggggcaactccattacagaagagattagagtctgtgcgcaagcaatcaagttttattctgaccccaccacggagaaaaattccccagtgctctcagctccaagaggacgtggatcctcagaaggtggcttttctgcttcacaagcagtggacattgtacagcctaacccctttgtataagttcagctacagtaacctcaaggagtattcacgtctgctgaatgcatttattgtggccgagaaacaaaaagggttagccgttgaggtgggggaagactttaatataaaggtgatcttttccaccctactcggtatgaaaggtacccagcgagaccccgaagcttttctggttcagatcgtgtccaaatcccagctgccaagtgagaatcgggagggtaaagttctgtggactggttggttttgctgcgtcttcggagactcgctgcttgagacggtgtcagaggatttcacctgtcttcctttatttctggccaacggcgctgaaagcaatacagcaatcatagggacgtggttccagaaaacctttgattgctattttagcccattggccataaacgcgtttaacctgtcttggatggcagcgatgtggacagcctgcaagatggaccactacgtagctaccaccgagttcctttggagcgtgccctgctctccacagagtttagatatttcttttgctatccatcccgaggacgccaaggcactgtgggactccgtacacaaaacgcctggcgaggtcacacaggaggaagtggatctgttcatggattgcctctatagccacttccaccgacacttcaagattcacctatccgctacccgtctggtgagagttagtacaagcgtggccagcgcgcacacagacggcaaaataaagattctgtgccacaaatacttgattggcgtgctcgcatatctgaccgaactggctatcttccagatcgaatag

SEQ ID NO: 217826 - DNA, 1173 bp, Artificial Sequence
  Description of Artificial Sequence: Synthetic coding sequence
atggattcctattctgcccctgagtctactcctagtgccagtagccggccagaggattattttattggcgcaacccccttgcagaagcggctggaatcggtaagaaagcagtcgtccttcatcctgacccccccaagaaggaagatcccccagtgttcacaactccaagaagacgttgatccccagaaggtggctttcctgctgcataagcagtggactttgtatagcctgaccccactgtacaagttcagttattctaatctaaaagagtatagtagactccttaacgcctttattgtcgctgaaaaacaaaagggcctcgccgtggaagtcggagaggacttcaacattaaggtgatcttctccacgttgctggggatgaaggggacccaaagagatccggaagcttttctcgtgcaggggctgattctgtcaccacggctggagtacagcggaacgattctcgtggattgcaacctctgtctgctcggcagttccgatccttctacactggccttccaggtcgcaggaacagccggtgcctgtcatcacacgcgcatcgttagcaagagtcaattgccatctgagaaccgggaaggaaaagtgttatggaccggctggttttgctgtgtgttcggcgattctttgttagagacagtgtcagaagacttcacttgtctcccactgttcctcgcaaacggcgcagagtcaaatactgccatcataggcacctggtttcagaagacattcgattgttatttctcaccgctcgccattaacgcatttaatttgtcctggatggcagcaatgtggaccgcctgcaagatggatcattatgtcgcaactacggaatttctatggagtgtcccttgctccccccagtcattggatatctcatttgcaatccacccggaagatgctaaggcgctgtgggactctgtgcacaaaacccctggcgaggttactcaggaggaagttgacctctttatggattgcctatactcccactttcacaggcacttcaagatccacctctccgccacacggctcgtccgggtgagtacatccgttgccagtgcacacactgatggaaaaatcaaaatcctgtgccataaatatctgatcggcgttctggcttatttaacagagctggccatatttcagattgaatag

SEQ ID NO: 217827 - DNA, 1035 bp, Artificial Sequence
  Description of Artificial Sequence: Synthetic coding sequence
atggactcctatagtgccccagaatctacaccttccgcctccagtagacctgaggactacttcatcggggctacccccttacagaagaggttagagtcggttagaaaacaaagctcatttatcctgactccacctagaagaaagataccccagtgttctcaactgcaggaggacgttgacccacagaaggtggcatttctgcttcataaacagtggaccctttatagtttaacccccctttataaattcagctacagcaacctcaaagaatatagccggctgctgaatgcctttatcgtggctgagaaacaaaaagggctagccgtggaggtaggcgaagacttcaacatcaaggtgatttttagcacactgctggggatgaaagggacgcaaagggaccctgaagctttccttgttcagatagtttccaaatcacagctgccctccgagaatcgcgaaggaaaggtcctatggactgggtggttttgctgtgtatttggcgactcattactcgagaccgtaagtgaagacttcacatgcctgcctttgtttctagccaatggagctgaatccaacactgctattatcggaacctggttccagaagacgttcgactgttatttttcccctctcgctatcaacgcattcaacttaagctggatggccgctatgtggacagcctgcaagatggatcattatgtggctaccactgagtttctgtggtcagtgccttgtagcccacagagccttgacatcagctttgcaattcatcccgaggacgcgaaagcgttgtgggattcagtgcataaaacacctggagaagtcacccaggaagaggtggacttgtttatggattgcctgtattcgcactttcaccgacatttcaagattcatttgtctgccactaggctcgtgagagtgtccaccagcgtggccagtgcacacaccgacggaaagattaaaatcctgtgtcacaagtacctgatcggggtgttggcctacctgacagagctcgccatcttccagattgaatag

SEQ ID NO: 217828 - DNA, 615 bp, Artificial Sequence
  Description of Artificial Sequence: Synthetic coding sequence
atggacgagactgtggctgagtttataaaaaggaccatactcaagattcctatgaatgagctaaccactatcttgaaagcatgggacttcctttcggaaaatcagctgcaaaccgtgaactttaggcaacgaaaggaatccgtcgtccaacacttgatccacctctgtgaggaaaaacgtgcttctataagcgacgcagcccttttagatattatctacatgcagttccatcagcaccagaaggtctgggaagtgttccaaatgtccaaagggcctggcgaggacgtggacctgtttgatatgaaacagtttaaaaactcctttaaaaaaatcctccagcgagctttgaaaaatgtgactgtgtctttccgtgaaacggaagagaacgctgtgtggatcagaattgcatggggtacccagtatacaaagccaaatcagtacaagcccacctacgtggtgtattacagccagaccccgtacgccttcacatcttctagtatgttgcgaaggaataccccactcctcggacaggaactggaggctaccggcaagatttacctacggcaggaagagatcattttagatattactgagatgaaaaaggcatgtaattag

SEQ ID NO: 217829 - DNA, 1020 bp, Artificial Sequence
  Description of Artificial Sequence: Synthetic coding sequence
atggatgaaaccgtggccgagttcataaagcgcaccatcctgaagatacctatgaacgagctcaccaccatcctaaaggcatgggacttcctttccgaaaaccaactgcagaccgtaaacttccgccagaggaaagagtcagtcgtgcagcacctcatacatctgtgcgaagagaagcgcgcaagcatctcagacgctgcactgctcgacattatatacatgcagtttcatcaacatcagaaggtgtgggaagtcttccaaatgtctaaggggcctggagaggacgtggacctcttcgatatgaagcagttcaagaattctttcaagaagatcctgcagcgcgcactcaagaatgtgactgtatccttccgtgaaacagaagaaaatgctgtgtggattcgcattgcttgggggactcagtacactaaacctaatcaatacaaacctacttatgttgtgtattactcccagactccctatgcatttaccagcagcagtatgctgagacgcaacacacccctgctgggccaggccttgaccatagcttcaaagcaccatcagattgttaaaatggacctccgttctaggtacctggatagtctgaaagccattgttttcaaacaatataatcagacatttgagactcataactcaacaaccccacttcaagagagatcgctggggctggatattaacatggactcgcgaatcattcacgagaatatcgtggaaaaggagagagtgcagagaattactcaggagaccttcggcgactatccccagccccaactggagttcgcccaatataagttggagacaaagttcaagtccggacttaacggcagtatactcgcggaacgcgaggagccgctgagatgcctaatcaagttcagttctccccatctgctggaagcgctgaaaagtttggctccagcaggaattgccgacgccccactgtcccccctactgacctgtattccaaataagcggatgaattactttaagattcgggacaaatag

SEQ ID NO: 217830 - DNA, 918 bp, Artificial Sequence
  Description of Artificial Sequence: Synthetic coding sequence
atggacgagactgtagccgagttcatcaagcgaacaattctcaagattccaatgaacgagttgactactatcttaaaggcctgggactttctgagcgagaaccagcttcagacagtcaatttcaggcagcgcaaagaaagtgtggtgcagcacctgatccacctctgtgaggagaagagggcctcgatcagtgatgccgctctgctggatattatctatatgcagttccatcagcatcaaaaggtctgggaggtgttccaaatgagtaaaggcccaggtgaggatgtcgacctctttgacatgaagcagtttaaaaactctttcaagaagatcctgcagcgagccctaaagaacgtcaccgtatcattccgtgagactgaagagaacgccgtttggatccggatagcatggggcactcagtacactaaacccaaccaatacaagcccacctacgtggtgtactattcacagactccttatgccttcacctcaagctctatgcttaggcgcaacacacctcttctgggtcagactttcgagactcataattccacaaccccgctccaggaacgcagcctggggctggatataaacatggattctaggatcattcatgagaacatcgtcgagaaggagagagtccagagaataactcaagagaccttcggagactatccccaaccccagctggagttcgcccagtataagttagaaaccaaatttaagagcggcctcaacggctcaattttagctgaacgagaagagcctcttagatgtctcatcaagttcagcagtcctcatttgcttgaagcgttaaagtctctggccccagcgggaattgctgacgctccactgagccctttgctgacttgcattccaaataagcggatgaattacttcaaaatccgggataagtag

SEQ ID NO: 217831 - DNA, 960 bp, Artificial Sequence
  Description of Artificial Sequence: Synthetic coding sequence
atggatgagaccgtagcagagttcattaagcggacaatcctcaagattccaatgaatgagctgactactatcttgaaagcttgggatttcctttccgagaatcaactccagaccgtgaacttccggcagcgcaaggagtccgtagtgcagcatttaattcatctgtgtgaggagaagagagcctcaatcagcgacgcagccctcctggacattatatgtgaagacgtggatctgttcgatatgaaacaattcaaaaactcttttaaaaagatcctgcagcgtgcactgaagaacgtgaccgtgtcattcagagagactgaggaaaatgctgtgtggatccggatcgcctgggggacccagtacacgaaaccgaatcaatacaagcctacttacgtggtctattatagccagactccgtatgcatttacctcctcaagcatgttacggaggaacacccctctgttggggcaggctctaaccattgcatctaaacatcatcaaatcgttaagatggacctgagatcacggtacctggattcactgaaagcgatcgtcttcaagcagtacaatcagacgttcgaaacccataactctaccactccactccaggagcggagcctcggtctggatattaatatggatagtcgcattattcatgaaaatattgtcgaaaaagaacgggtccagcgtatcactcaagaaacttttggcgattacccccaaccccaacttgaattcgcccagtataagctggaaacaaagttcaagtccggacttaacggtagcatactggccgagcgggaggaacctctgcgctgtctcataaagttctcatcaccacacctacttgaagcactcaaatcactggctcctgccggaattgctgacgcgccactatccccactgctgacctgtatcccaaataaaagaatgaattatttcaagatcagagacaaatag

SEQ ID NO: 217832 - DNA, 1062 bp, Artificial Sequence
  Description of Artificial Sequence: Synthetic coding sequence
atggacgagacagtcgccgagtttattaagaggaccattcttaagattccaatgaatgagttgacgactattcttaaggcctgggatttcttaagtgaaaatcaactgcaaactgtgaattttcggcagcggaaggagagtgttgtccagcaccttatacacctgtgcgaagagaagcgggcaagcatctctgatgcagcacttcttgacatcatctacatgcagtttcaccagcaccaaaaagtgtgggaagtcttccaaatgtccaagggacctggggaagacgtggacctgttcgatatgaagcaattcaagaatagttttaagaaaatcctgcagagggccctaaagaatgtcaccgttagctttcgggagaccgaagagaacgctgtctggatccgcattgcttgggggacccagtatactaagcccaatcagtacaaacccacttatgtcgtctattactcccaaaccccctacgccttcacctcatcctctatgctgcgtcgtaacacacccctgctggggcaggcccttactattgcaagcaagcatcatcaaatagtaaaaatggatctccgttcgcgctacctagactctctgaaggccatcgttttcaaacagtataatcagacttttgagacacacaacagtaccacccccctccaagagcgcagtcttggcctggatattaatatggattcccgaattattcatgagaatatcgtcgagaaagagagagtccagaggatcacacaggagactttcggggattacccgcaaccccagcttgagtttgcccagtacaaactcgagacaaagtttaaatcggggctgaacggcagtattctggccgagagagaggaaccattacgctgcctgatcaagttctccagcccccatttgctggaggcactaaaaagcctggcgcctgccgctctggtgtgtcgaatccagaagctgctttgttattcaggcagtcacagccagggcactcaagatccatccagctggcagaaggatctgtatttactgtttgtacccctatatccgcgatgttag

SEQ ID NO: 217833 - DNA, 903 bp, Artificial Sequence
  Description of Artificial Sequence: Synthetic coding sequence
atggagcaagcaaatcccctgagacccgacggggagagcaaggggggagtgctggcccacctggagcggctggagacccaggtgagccgatcgcgaaagcagtcggaggaactgcagtctgtgcaggctcaagaaggagccctgggtaccaaaattcataaactgcgtagattgcgtgacgagctccgcgctgtagtgaggcacaggagagcctctgtgaaagcatgtattgcaaatgtagagccaaaccagactgtggagatcaacgagcaggaagccctggaggagaaactggaaaacgtgaaggctatactgcaggcttatcactttacaggtctttcaggcaagcttaccagtaggggggtgtgcgtgtgcatttctactgctttcgagggaaaccttcttgatagttactttgttgatctcgttatccagaagcctctgaggatccaccatcatagcgttccagtttttattccgctggaagaaatcgcagccaagtacctgcagaccaatattcagcacttcctcttctcattgtgcgaatatctgaatgcgtactctggacgcaagtaccaagccgatcgcctccagagcgacttcgctgctttactgacaggccctctacagaggaacccactgtgtaatcttttgagtttcacctataaactcgaccccggaggacaatcatttccattctgtgctcgacttttatataaggatctgacagcaaccctgcccacagacgttactgttacatgtcagggagttgaagtgctcagcacaagctgggaggagcagcgggcatctcacgaaactttgttttgcaccaagcctctccatcaggttttcgccagtttcactaggaaaggcgaaaagcttgacatgagcctggtatcctag

SEQ ID NO: 217834 - DNA, 903 bp, Artificial Sequence
  Description of Artificial Sequence: Synthetic coding sequence
atggaacaggcaaatcccctacggcctgatggagagagtaaaggcggagttttggcgcacttggagcggctcgagacccaggtctctcgatcccgaaaacagtccgaagaattacagagtgttcaggcacaagagggagctctggggactaaaatccacaagctcagacggctccgtgatgagctacgcgcagttgtgcgccaccggagagctagcgttaaggcttgcatcgctaatgtggaaccgaatcaaactgttgaaatcaacgaacaggaagctcttgaggagaaactggaaaatgtgaaagcgatcctacaagcttaccatttcaccggactcagcggaaaattaacttctcgcggtgtttgcgtgtgcatctcaaccgccttcgaaggcaacctgctggacagttacttcgtggaccttgtgatccagaaaccgttgcggatacatcatcactcggtgcctgtctttattcctcttgaggagatcgcagcaaagtacttgcagacaaatatacagcacttcctgttctccttatgtgaatacctgaatgcgtatagtggcaggaagtaccaggccgataggcttcaatccgatttcgccgcactgcttactggcccacttcaacgaaaccctctgtgcaatttactttcattcacctacaagctggatccgggaggccagtcttttccgttttgcgcgaggctgttgtataaagacctgacggccacgcttccgaccgatgtgaccgtgacctgtcaaggggtcgaggttctaagtacttcttgggaggagcagcgggcatctcacgaaacactgttttgtactaaaccactgcaccaggtgttcgccagtttcacacgtaaaggcgagaagctagacatgagcctggtgagttag

SEQ ID NO: 217835 - DNA, 885 bp, Artificial Sequence
  Description of Artificial Sequence: Synthetic coding sequence
atggccggaattttggctagtggcctgggagtgcttgcccacctggaacgcctggagacccaagtctccagatctcgcaagcagagcgaagagctccagtctgtgcaagctcaggaaggggctctggggactaaaattcacaagctaagacggttgagagatgagctgcgggcagtagttagacatcgacgagcaagcgtcaaagcttgcatagctaatgtcgagccaaaccaaacagtcgagatcaacgaacaagaggccctggaagaaaagctcgaaaacgtcaaggctattttacaagcttaccactttaccggcctatccggaaaattaacttctaggggagtgtgcgtgtgcatcagcacggcatttgaaggcaacctgctcgacagctacttcgtggatctggtgattcagaagccactgagaattcatcaccactctgtgcctgtcttcattcccttggaagagatcgcagccaaatacctgcaaactaatatccagcactttctgttctccctgtgtgaatatcttaatgcctacagcggcagaaagtatcaagctgaccgcttgcagtccgacttcgcagccctgttaaccggcccacttcagcggaatccgctgtgtaacttgctaagctttacttataagcttgacccaggtggccagtcttttcctttttgtgcacgactactgtacaaagatctgacggccacacttcctactgacgttaccgtaacgtgtcagggagtggaggttctgagcacatcttgggaggaacagcgagccagccacgagaccttgttctgtaccaaacctctgcaccaggtcttcgccagtttcaccagaaaaggcgagaaactggatatgtctttggtatcttag

SEQ ID NO: 217836 - DNA, 309 bp, Artificial Sequence
  Description of Artificial Sequence: Synthetic coding sequence
atgcaggagaagtatcctgatgcagtgtatttgagcgaaggcccatctagttgttctatgggcataaggagcgcaagtagaccagggtttgagctcgtgattgtgtggaggatacagatagacgaggatggaaaagtgttccccaaacttgatctactgacgaaggtgccacagagggccctggaactggacaagaaccgcgctatcgagaccgcacccctgagttttcgaacactggtggggctgctgggcatcgaggccgctctggagagcttgatcaaatccctgtgtgcagaagagaacaactag

SEQ ID NO: 217837 - DNA, 348 bp, Artificial Sequence
  Description of Artificial Sequence: Synthetic coding sequence
atggaagccccaagctggtctgtgctgcagcggagtggagatgaagagaagtaccccgacgcagtgtacctgtccgagggtccaagctcctgttcaatgggaatccgttcagcttcgaggcccggatttgaactggtcatagtctggcgcattcaaatagacgaggatgggaaggttttcccaaaactggatctgctaactaaagtgcctcaacgagctctggagctggacaaaaatcgggctatcgagactgctcccctgtcatttcgcaccctagtgggcttgctgggcatagaggctgcattggaaagcttaattaagtctttatgtgccgaggaaaacaactag

SEQ ID NO: 217838 - DNA, 867 bp, Artificial Sequence
  Description of Artificial Sequence: Synthetic coding sequence
atggacgcagagctcgcagaggtaagggcactgcaggctgagattgctgctcttagaagggcctgtgaagaccctccggctccatgggaagagaaatctcgggtccaaaagagctttcaggctatccaccagttcaacctggagggctggaaaagtagcaaggaccttaagaatcagcttggccatttggagagtgagttgagctttctgagtactctcactggcattaacattcgtaaccatagtaagcaaactgaggaccttacctctaccgagatgaccgaaaagtctattcggaaggtgctacaacgccacaggttatctggcaattgccatatggttactttccagttagagttccagatcctggagatccagaacaaggagcggcttagttcagccgtaaccgatctgaacataattatggagccgactgaatgttccgaactgagtgaattcgtctcaagagcagaggagcggaaggatttatttatgtttttcaggagccttcactttttcgttgagtggttcgagtaccgcaaaagaacatttaagcacctgaaggagaagtatcctgatgctgtatatcttagcgaaggcccttctagctgcagtatgggtattagatccgcttcccgaccagggttcgaactggtgattgtttggcgcattcaaattgacgaggacggcaaggtctttcccaagctagatctcctgactaaggtgccacagcgagcattagagctggacaagaaccgggcaattgaaacagccccattaagctttcgcaccctagtaggtctgctggggatcgaagctgccctggagtccctgatcaaaagcttatgcgctgaggaaaataattag

SEQ ID NO: 217839 - DNA, 744 bp, Artificial Sequence
  Description of Artificial Sequence: Synthetic coding sequence
aagagagcgggacgttccgacagttgcgcagccggaccagccgctgtcagcaacgcgccttggacacagtcctggcaaaggtgcgcaccgtgcaaactccggtcccggccatgtggagaaagagttcggacccacagaagacccggaaaaaggtccccagaatcctcgatcagaaaggtgctccaaagacaccgtctgagcggtaactgtcacatggtgacattccagctggagtttcagattctcgaaatccagaataaagagagactgagttcagctgttaccgatctcaacataatcatggagcccactgaatgtagtgaactctcggagttcgtctcacgggctgaggagagaaaggatctgttcatgttctttcgaagcctgcacttctttgtggaatggttcgagtaccgtaagaggacgttcaagcatctgaaggaaaagtacccagacgctgtctacctttccgagggtccgtcatcctgctccatgggaatccggagtgcatcccggcctggctttgagctggtcattgtctggcggatccagattgacgaggacggtaaggtattccctaagctggaccttctcactaaggtgccccagcgggctctggaactggataaaaacagggccatagagacagccccactctcattcagaaccctggtcgggcttcttggcatcgaggccgctctcgagtcactgattaaatctttatgcgcagaagagaacaactag

SEQ ID NO: 217840 - DNA, 807 bp, Artificial Sequence
  Description of Artificial Sequence: Synthetic coding sequence
atgtcaggaaaggctaatgcctctaagaaaaatgcacagcagttgaaacgcaaccccaagaggaagaaagataatgaggaggtggttctcagtgaaaacaaagtgcggaacactgtgaaaaagaacaaaaaccacctcaaggacctatctagcgagggacagactaagcacaccaatctgaaacacgggaagactgctgcttcaaagcgcaagacgtggcagccgctcagtaaatccacccgggaccacctgcaaactatgatggagtcagttattatgacgattctgagtaacagcatcaaggaaaaagaagaaatccagtaccatctcaattttctgaagaaacggttgctccagcagtgtgaaaccctcaaagttccaccgaagaagatggaggatctgaccaacgtgtcaagcctgctaaatatggagcgtgctcgcgataaagcaaatgaggaaggattggctctcctccaagaggagattgacaaaatggtggagactacagagctcatgaccggcaacatccagagcctcaaaaacaagatccagatcctggcaagcgaggtggaggaggaagaggagcgcgttaaacagatgcaccaaatcaacagctctggggtgttgagcctgcctgaattgagccagaagaccttaaaggcccctaccttacaaaaggaaatcctggctctcattcccaaccagaacgccctcctcaaagatcttgacattctgcataatagctcacaaatgaaatcaatgagcacttttatagaggaggcttacaaaaaactcgatgcaagctag

SEQ ID NO: 217841 - DNA, 807 bp, Artificial Sequence
  Description of Artificial Sequence: Synthetic coding sequence
atgagcgggaaagccaacgcttcaaaaaagaatgcccaacaactgaaaaggaatccaaaacggaagaaagacaatgaggaggttgtgctttctgaaaataaggtgcgcaacactgtaaaaaaaaacaagaaccatctgaaggatctatccagtgagggtcagacgaagcacacaaacctaaaacacgggaaaactgctgcttcgaaaaggaagacctggcaaccattgagtaagagtacacgtgaccaccttcagacgatgatggaatcagtgatcatgactattctgtctaacagtataaaggaaaaagaagaaatccagtatcacctgaatttccttaaaaagcggctcctccagcagtgcgagacgttgaaagttccaccaaagaagatggaggatctgaccaatgttagtagcttactgaacatggaacgcgcacgtgacaaggccaacgaggagggcctagctctcctgcaggaagagatcgacaagatggtggagaccacagaactgatgacagggaacattcagtcactgaagaacaagatccagatactggcatcggaggtcgaggaggaggaagaacgcgtaaagcaaatgcatcagataaattcttccggggttttgtcactgcctgagctttctcaaaaaacactcaaggcccctaccctccagaaggaaatcctagctctaatacccaaccaaaacgctctgctgaaggatttggacatcttgcacaacagttcacagatgaagagcatgtctacttttatagaggaagcttacaagaagctcgacgcctcatag

SEQ ID NO: 217842 - DNA, 384 bp, Artificial Sequence
  Description of Artificial Sequence: Synthetic coding sequence
atgggcgacaaacccatctgggaacagatcggcagctcttttatccaacactactaccaattatttgataacgatcgtacacagctgggtgccatctacatagacgctagctgcctgacgtgggagggccagcagttccagggaaaggctgctatcgtagagaagctttcatccttgccttttcagaagatacagcactccataaccgcccaggatcatcagcccacgcccgactcttgtattatttcaatggtggtcggtcagctcaaggcagacgaagatccaatcatgggcttccaccagatgttcctgctgaagaatatcaacgatgcatgggtctgcactaacgacatgttcagattagcgcttcacaatttcggttag

SEQ ID NO: 217843 - DNA, 786 bp, Artificial Sequence
  Description of Artificial Sequence: Synthetic coding sequence
atgtcttggtgttgtttgtggctctgcctttcttcggttgggagaacgggctccgccggtccaagtctccccttcagcgaactgtgttcactgggtctgctccgactgcgaccggtgttcagccccctccatagcggcccaggtaaaccagcccagttcctggcaggcgaggccgaggaagtgaatgccttcgcattagggtttctttccactagctctggagtatccggggaggacgaagtcgaaccacttcatgatggagtagaggaagcggagaagaagatggaggaggagggagtttcagtgagcgagatggaagcaacgggggctcagggcccttctcgagtggaggaagcggaaggacatactgaggttacggaagccgagggaagccagggtactgcagaagccgatggccctggcgcatcctccggggatgaggatgcgtctggcagggcagcctcaccagagtcagcgagttccactcccgaaagcctacaggcccgacgccaccaccaatttctggaacctgccccagctcctggagccgcagtgctgtcaagcgagcctgcagaaccccttctcgtgcgccaccccccaaggccacggaccacagggccaaggccccgtcaggatccccacaaagctgggttatcacactacgtgaagctttttagcttttatgccaaaatgccaatggagaggaaggctctcgagatggtggaaaaatgtatttttgtaatgatttggaggtatctgctgctaatgctggccgctcgtctatag

SEQ ID NO: 217844 - DNA, 1686 bp, Artificial Sequence
  Description of Artificial Sequence: Synthetic coding sequence
atggccgaccataacccagactcagacagcacccctcgaactcttctgaggagagtactggacactgcggatccgaggacccccagacggccaaggagcgcaagagccggagcccgaagagcactgctagaaacagcctcccccaggaagctctctggccagactcgcaccatagccaggggcaggtcccatggagccagaagtgtcggcaggagtgcgcatatccaggcctccggtcatctggaagaacagacgcccaggactctcctgaagaatattttgttgacagctcccgagagttccattctgatgcccgagagcgtagtgaagcctgtacccgctcctcaggcagtgcaaccctcccgacaggagtcttcctgtggttcccttgaactccagctgcccgagctggaacctccaaccacactggctcctgggttgttagcccctggcagacggaagcagcgcctgagattatccgtgttccagcagggagtggatcagggcctaagcctttcgcaggagcctcagggtaacgccgatgcatcctcactgactcgatcactcaatctgaccttcgcaactccattacaaccacagagtgttcagcggcctggtcttgcacgtcgaccacccgcacggagggcagttgatgttggtgcctttctgcgcgacttacgggacacaagtctggccccacctaatattgttcttgaggatactcagccttttagccagcctatggtgggttctccgaatgtgtaccacagtctcccttgtaccccgcataccggagccgaggacgccgagcaggccgctgggcgaaagacacagtcctctggcccaggcctgcagaagaacagcccgggtaagcccgcacagttcctggctggtgaagctgaagaagtaaacgcattcgctctgggattcctgtctacctcgtctggagtcagtggcgaggacgaagtggagcctctccacgatggcgtagaggaggcagaaaaaaagatggaggaagagggggtctccgtctctgagatggaggctactggagcacaaggaccgtctagagtggaggaggccgagggacacaccgaagtgactgaggcggaaggaagtcagggtactgcagaggcagacgggcctggtgcaagttcaggggacgaggatgcttctggcagggccgcttcacctgagtcagcctctagtacgcccgagagcctgcaagccagacggcatcatcagtttctcgaaccagccccagctcctggcgctgccgtcctgtcctcagaaccggctgaaccattgctcgtccggcatccgcctaggccgagaactaccggccctcgcccacgccaggacccccataaagccggtctgagtcattatgttaaactcttctcattctacgcaaagatgccgatggaaagaaaggctctcgaaatggttgaaaaatgtctggacaaatacttccagcacctgtgtgatgatttggaggtctttgcagcacatgccggaagaaagactgtgaaacctgaagacctggagctgctaatgaggcgccaagggctagtgacagaccaggtctccctgcatgtcttagtagagaggcatctccccctggagtatcggcaattgctcatcccttgtgcatatagcggcaattctgtttttcctgctcaatag

SEQ ID NO: 217845 - DNA, 447 bp, Artificial Sequence
  Description of Artificial Sequence: Synthetic coding sequence
atgcccgaatctgtcgtcaagccagtaccggcaccacaggcggttcaaccaagtagacaagaaagctcatgcgggagtttggaactgcagcttcccgagctagaacctcccacaacactcgccccaggacttctcgcccctgggagacgcaagcaacggctccgcttaagtgttttccagcaaggagtcgaccaaggactttcactctctcaggaaccccagggcaacgccgatgcctcatctttgacccgctccctaaacctgactttcgctaccccactgcagccgcagagcgtccagagaccgggtttggcccgacgtccgcctgcgagacgcgcagtggacgtcggggcattcctgagagatctgcgcgatacgtcgcttgcacccccaagcaaagtcggcttttccccggctggcctttggggcaaattgtctcctttgtag

SEQ ID NO: 217846 - DNA, 1686 bp, Artificial Sequence
  Description of Artificial Sequence: Synthetic coding sequence
atggccgaccacaatccagattcggattcaacaccacgcacactcttgaggagagtgttagacaccgccgatcctcggactcctaggcggccacgctcagcccgtgctggtgcaagaagggcactgctagaaactgcatctccccgtaaactgtccggacaaacccggaccatcgctcgaggcagatcccacggggcacggagcgttggcagaagcgctcatattcaggcttctgggcatctagaagaacagacccctcgtacgttactgaaaaacatcctgctgactgctccggaatccagtatcttgatgccggaatcggtcgtaaagcccgtccccgcacctcaggccgtgcagccgtcacgccaggagtctagttgcggcagcttggagcttcaactgcctgagttggagcctcctacaaccctggccccaggcctgttagccccaggtcggagaaagcagcgactacgtctctctgttttccagcagggcgtggaccagggactgtccctaagtcaggagccccaaggcaatgcggatgccagctcacttaccaggtcgttaaacctgactttcgcaacacctctgcagccccagtccgtccagagacccggattggccaggcgccctcccgctcggagagctgtggatgtcggggctttcctgcgggatctccgagatacatcactggcaccccctaatatcgtacttgaagacacccagcctttctctcagcctatggtaggaagtccaaatgtataccatagcctgccctgcaccccacataccggcgcagaggacgctgagcaggctgcgggtcgtaagacacagtcctctggcccaggactgcagaaaaactctccaggcaagccggctcagtttctggctggtgaagcggaggaagtcaatgcctttgcactcggattcctttccacctcatcaggcgtgtctggggaagacgaagtggaacctctgcacgacggagtagaggaggctgaaaaaaagatggaagaggagggagtgagcgtttccgagatggaggcgaccggggctcaagggccaagcagagtagaggaggctgagggacacactgaggtaactgaagcagaggggagccaagggaccgcagaggctgacggtcccggagcatcctcaggagatgaggacgcttccggaagggcggctagtcctgagtccgcctcttccactccagagtccctgcaggcccgtagacaccatcagtttttggagccagccccagctccgggagccgcagtgctgtcatccgaaccggctgaacctctgctggtacgtcaccctcccaggccgaggacaacaggacctagaccacgacaagacccccataaggctggtctgagtcattacgtgaaactcttttccttctacgctaagatgcccatggaacgaaaggcacttgagatggtggaaaagtgcttggacaaatattttcaacacctgtgtgacgatttagaagtatttgctgcacatgccggaagaaaaaccgttaaaccagaagatctggaactgctcatgcgacggcagggcttggtgactgaccaagtatccctgcacgtgctggtggaaaggcacttacctctagagtacaggcagctactgattccctgcgcgtatagtggcaacagcgtattcccagctcagtag

SEQ ID NO: 217847 - DNA, 819 bp, Artificial Sequence
  Description of Artificial Sequence: Synthetic coding sequence
atgagacgtagccgcagctccgccgcagcaaaactccgcggacagaagaggtctggagcgagtgctgcaccagctgcctctgctgcagccgctctcgcccctagtgccacaagaacaagacgatccgcgtctcaggcgggatcgaagtcccaggccgtggagaaacctccttctgaaaagcctagactcagacgtagctcaccacgggcacaagaagaagggcctggcgaaccgccacctcccgagctggccctgctaccaccaccacccccacccccaccgacccctgccacccctacctcgtcagcatctaaccttgacctgggtgaacaacgggaacgctgggaaaccttccagaagcggcagaaactgacctctgagggggcagccaaactgctgctggacacattcgagtaccagggacttgtgaagcataccggtggatgtcattgtggtgccgtgcggtttgaggtttgggcgtccgccgatctgcacatctttgattgcaattgctcaatctgcaagaaaaagcagaaccggcatttcatcgttcccgcatccagattcaagctgctgaagggagcggagcatatcactacgtataccttcaatacgcataaggctcagcacacgttttgcaaaaggtgtggagtgcaatccttttacacccccaggtccaatcccggaggatttggcattgcgcctcactgcttggacgaaggcaccgtccgatccatggtcacggaagagtttaacggctcagattgggaaaaggcaatgaaggaacacaagacaataaagaacatgtctaaggaatag

SEQ ID NO: 217848 - DNA, 2961 bp, Artificial Sequence
  Description of Artificial Sequence: Synthetic coding sequence
atggttagtaagagtgatcagcttctgattgtggtatctatattagaaggcaggcacttccctaagaggcccaaacacatgctggttgtcgaagcgaagttcgatggagagcagttagccactgatccagtggatcataccgatcagcctgagtttgccacggagctagcctgggagatcgataggaaagcactgcaccagcaccgtctccaacggacaccgataaagttacagtgtttcgccctggatcccgtgacctccgccaaagaaacaataggatatatcgttttggacctgaggacagcccaagaaaccaagcaagcaccaaagtggtatcaattactttccaataagtataccaagttcaagagtgaaatccagatcagtatcgctctggagactgacacgaagccgccagtggatagctttaaggccaaaggcgcacccccacgagacgggaaggtgccagccatcctggccggtctggatcctcgcgatatcgtggcagtactgaatgaagaaggaggataccatcagatcggccctgctgagtattgtacagattcctttataatgagcgttacaatcgccttcgccactcaactggagcagctgatcccctgcactatgaagctcccagaacggcagcctgagttctttttctactatagcctgctcgggaatgatgtgaccaacgaacccttcaatgatttaattaatccaaattttgaaccggagcgggcaagcgtgagaatccggtctagtgtggagatcctgcgagtatatctagccttgcagtcgaaactgcagatacatttgtgctgcggcgaccaatccctggggtccacagagattcccctgactggtctcctgaagaaaggttctacagaaatcaaccagcatcctgttactgttgaaggtgcctttactctggatcccccaaaccgcgcaaaacagaaactggccccaatacccgtcgaattagcccctacagttggcgttagcgtagctctccagcgggaaggcatcgacagtcagagcttaatcgaactgaaaacccagaatgagcacgagcctgagcactccaagaagaaagtactcacccccattaaagaaaagacactcactgggcctaagtctcctacagtctcaccagtgcctagccacaaccaatcaccacctacaaaagacgacgccacggagagtgaggtggaatcacttcagtatgataaggatacaaagccaaatccgaaggcctctagtagtgtccctgcctctctggcccagctggtgaccacctctaatgctagcgaggtcgccagcggccaaaagatcgccgtcccagctacctctcatcatttctgcttctccatcgatctccgttcgattcatgcgctagaaatcggttttccgataaactgcatcctgagatacagctatcctttttttggtagcgcagccccaatcatgacgaatcccccagtagaggtgagaaagaatatggaagtgttcttgcctcagtcgtattgcgccttcgacttcgcgacaatgccgcaccagttacaagatacctttctgcgcatcccactccttgttgaactgtggcacaaagacaagatgtccaaggatctgctgctcggcattgccagaattcaactgtctaacatcctgtcctccgagaagacacgttttctggggtctaacggtgagcagtgttggaggcaaacatactccgagagtgttccagtaatagctgcccaggggagtaataaccgaattgctgacttaagttacacggttaccctggaggactatggacttgtgaagatgcgagaaattttcatcagtgatagttcacaaggagtgtccgccgtgcagcaaaaaccatcgtccctccctccagccccttgccccagcgagattcaaaccgagcctcgcgaaacgctggaatataaagcagcactcgaacttgagatgtggaaggaaatgcaagaggatatcttcgaaaatcagttgaagcagaaggagctcgcacatatgcaggcgctggctgaggagtggaaaaaaagagatagagagagagagtctcttgtgaagaaaaaggttgccgaatacaccatccttgagggtaagcttcaaaagaccctgattgacctcgaaaagagagagcagcaacttgcctcagtcgagagtgaactgcagcgggagaagaaggaacttcaaagtgaaaggcagcgcaatctgcaggagttgcaggacagtatcaggcgagctaaggaagattgtatacaccaggtcgaactcgagagactgaagatcaaacagctggaagaggacaagcatcgactgcagcagcagctgaacgatgccgaaaacaagtacaagatactggaaaaagagttccagcagttcaaagatcagcaaaacaacaagcctgagatccgcctccagagcgagataaacctcctgaccctcgagaaggtggaactggagagaaagcttgaaagcgcaaccaagtccaagctgcactataagcagcaatgggggcgtgccctgaaggaactagccagactaaagcagagagagcaggagtcacaaatggcacggttgaagaaacagcaagaagaactggagcaaatgcgactgaggtatctggcggcagaagagaaagacactgtaaaaaccgagagacaggagctccttgatatcagaaacgagcttaatcgactccgacagcaggaacagaagcagtatcaggacagtactgagattgcttctggcaaaaaagacggccctcacgggtctgtgctagaggaaggcctggatgattatctgactagactgatcgaggaaagggacactctgatgagaactggcgtgtacaatcacgaagaccggataatcagtgaattggatcgtcagatccgcgaaatcctcgctaaatcaaacgcttcaaattag

SEQ ID NO: 217849 - DNA, 2883 bp, Artificial Sequence
  Description of Artificial Sequence: Synthetic coding sequence
atgctggtagtggaggcgaagtttgacggagagcagttagccactgatcctgttgatcacaccgatcagccagagtttgcgaccgagctggcgtgggagatcgatcgcaaggcgctgcatcagcatcggcttcaaaggactcccatcaagctgcagtgtttcgctctggatccagtgacatctgcgaaagaaacaatcggctatatcgttctggatctgcgaacagcacaagaaacaaagcaggctcccaaatggtaccagctgctgagcaataagtacacaaagtttaagtccgagattcagatctcaatagcccttgagacagacactaaaccacctgtggatagtttcaaggccaaaggagcgcctcccagagacggtaaagtacccgctatccttgctggactcgaccccagggatatcgtcgctgtcctgaacgaagaagggggttaccaccagataggccctgccgagtactgtactgatagcttcatcatgtccgtgactatcgccttcgcaactcagctcgaacagcttattccctgcacgatgaaattgccagaaagacagccagaattctttttctactattctctgctaggcaacgacgtgacaaatgaacccttcaatgatctgatcaatccaaacttcgaacccgaaagagctagcgtgagaatcaggagtagcgtcgagatcttacgcgtgtacttagccctgcagtccaaacttcagatccacctgtgctgcggcgaccagtccttggggtctaccgagattcccctgacaggattattgaaaaaggggtcaactgaaattaatcaacaccccgtcaccgtagaaggtgccttcactctcgacccccctaatagagctaagcagaaattagccccaatcccagtggagctggcccctaccgtgggcgtttctgtagcccttcagcgggagggcattgacagccagtctctaatcgagttgaagactcaaaatgaacacgaacccgaacattctaagaagaaagtcctgacccctatcaaagaaaaaacactgacaggccctaagtccccaacagtgagtccagtccccagccacaatcagagtcctcctactaaagacgatgcaactgagtccgaagttgagtccttgcaatatgacaaggacactaaaccaaaccccaaggccagctcttcagtacctgcgtcgttggcccagcttgtgacgacttcaaacgccagcgaggtagcttccggacagaagatagccgtgcccgctaccagtcatcatttttgttttagcatagatctgaggtccatccacgctttggaaatcggattccccataaactgcattttacgctactcctatccttttttcggcagtgcagcaccaatcatgaccaatcccccagtagaggtgaggaagaacatggaggtcttcctgccacaatcgtactgtgccttcgacttcgccaccatgccccaccaactccaggatacattcctgagaatcccactgttggtggagttgtggcataaggacaaaatgagtaaggacctgctgctcgggatcgcacgaatccaactgtccaatattctctcatccgagaaaacaaggtttttaggttcgaatggcgagcagtgttggcgccaaacctacagcgaaagcgtgcccgtgatcgcagcacaagggtctaacaatcgaattgccgatttgtcttatactgtaaccttagaggactatggactggtgaaaatgagggagatcttcataagcgacagctcccagggagtctccgcggtccagcagaaaccgtctagcctgcccccagccccttgcccatctgagatccagaccgaaccgcgagagactttagagtacaaggctgcccttgaactagagatgtggaaggagatgcaggaagacatatttgagaaccagctgaagcagaaggaactcgcacacatgcaagccctggccgaggagtggaagaagcgggatcgagagcgggaaagtcttgtgaagaaaaaagtcgcagagtacaccatactggagggaaagcttcagaagacactgatagacctggagaagcgcgagcagcagcttgcctccgtggaatcggagctgcagagggagaaaaaagagttacagtctgaacgccaacggaaccttcaagaactccaagactcaattaggcgggctaaagaagattgcattcatcaggtggaattagagcgactgaagatcaaacagctggaagaagataaacatagactgcagcagcagctcaatgacgcagaaaataaatataaaatcttagagaaagagtttcagcagttcaaagatcagcagaataacaagccggagatccggctgcaatcagagattaacctcctgaccctcgagaaagtggaacttgaaaggaagctcgagtccgcaaccaaatccaagctgcattataaacagcagtggggcagagccctcaaagagttagctcgactgaaacagcgtgagcaggaatcccagatggccagactcaaaaagcagcaggaggaactggaacaaatgcgcttgcgctacctggcggctgaggagaaagacaccgtgaagacggagaggcaggaactcttggatatacgcaacgaactgaaccggttgagacaacaggaacagaagcagtaccaggattctacagaaatcgccagcggaaaaaaagatgggcctcacggcagcgttctagaagaaggactggatgattaccttacccggttaatcgaagagcgcgacaccctgatgcgcaccggagtttacaatcacgaggaccgaataatctcagagctggaccggcagattagagaaattctggccaagtcgaacgcttcgaactag

SEQ ID NO: 217850 - DNA, 2961 bp, Artificial Sequence
  Description of Artificial Sequence: Synthetic coding sequence
atggtgtctaagagtgaccagctcttgattgttgtctcaatcctcgagggaaggcattttcccaagcggccaaagcacatgctcgtcgtcgaagcaaaatttgacggggaacagttagccactgatcctgtggaccacaccgatcagcccgaattcgctacagagctagcgtgggaaatcgatcgcaaagccctgcaccaacaccggctgcagcgcacccctatcaagttgcaatgttttgctttggacccggtgacgtcagctaaagagacaatcgggtatatcgtcctggatctacggaccgcacaggaaactaagcaggctccaaaatggtatcaactgctcagcaacaagtatacaaagttcaaaagcgagattcagataagcatcgctttggagacagatacgaaacccccagtggactcctttaaggccaagggcgcacctccccgtgatggcaaggtccctgcgatcctggctggactcgacccccgagacatcgtggccgtgttaaatgaggaaggaggataccaccagattggccctgccgaatattgtaccgactcttttataatgtccgtgacgattgctttcgccactcagcttgagcagctcatcccgtgcactatgaaactgcctgagcgtcaaccagagttcttcttttactattccctgctgggaaacgacgtcacgaacgaaccattcaacgatctcatcaatccaaacttcgagcccgagcgggctagcgtgagaatacggtcatccgtagagattctgcgagtttatctggccctccagtcaaagctgcagatccacctgtgctgtggagatcaaagcctgggctcaacagaaattccgttaaccgggcttctgaagaagggtagtaccgagattaatcagcatcctgtgacagtggagggtgcttttacacttgaccccccaaaccgcgcaaagcaaaaactcgctccaatcccggtcgaactcgcaccgaccgtgggggtgtctgtagctctgcagcgcgaggggatcgatagccagtccctcattgaacttaagacccaaaacgaacacgaaccagagcacagcaagaaaaaggtgctgactcccatcaaggaaaaaactctgacaggcccaaaaagccctaccgtgtcgccagtaccctcccataatcaatcaccaccgactaaagatgacgctaccgagtctgaggttgagagtctgcaatacgacaaagataccaagccgaacccgaaagcatcctcttcggtaccagcaagcctggcccagctcgtgacaacgtccaacgccagcgaggtcgcatcgggacagaagatcgctgttcccgctaccagccatcacttctgtttctcaattgacctcagatctatccacgcccttgaaatcgggtttccaataaactgtatcctccgatactcttatcccttcttcgggagtgctgcaccaatcatgacgaaccctcccgtggaggtgaggaaaaacatggaagtctttctgccccagtcttactgcgccttcgactttgcgactatgccacaccagctgcaggatacttttctccgcattcctctgctagtagaactgtggcacaaggacaaaatgtctaaagacctgctgcttggcatagccagaatccagctgtccaatatcctgtcaagtgagaagacccgctttctgggatccaacggcgagcagtgttggagacagacctattcagagtccgtgccagttattgctgcccagggcagcaacaatcgcattgcagacttgagttataccgttacactggaagactatggtctggtgaaaatgcgggagatatttatcagtgactctagtcaaggtgtttctgccgtgcaacagaagccctcttccctcccgccagctccatgtccatccgaaatacagacagaacctcgggaaacccttgagtacaaggccgcattggagcttgaaatgtggaaggaaatgcaggaggacattttcgaaaaccaactgaagcagaaagaactggcccatatgcaggccctagctgaagagtggaagaagagggatagggagagagagtccctcgtgaagaaaaaggtggcagagtacacaatcctcgagggcaagcttcagaagacactgatcgatctggaaaaacgcgagcagcagcttgctagcgtggaaagcgagcttcagagagaaaagaaggaacttcagtctgaacgccagcggaatctacaggaactgcaggattctattcgaagggccaaagaagactgcattcaccaggtcgagctggagaggctgaagataaaacaattggaagaagacaagcaccggctgcagcagcagttgaatgatgctgaaaacaagtacaagatactcgaaaaagagttccaacaatttaaagatcagcagaacaataaacccgaaattcggttacagagcgaaattaaccttttgacattagaaaaagtcgagctggaacgcaagctggaatcggccacaaagagtaaactgcattacaagcagcagtggggcagagctttgaaggaacttgcacggttgaagcaacgagagcaagagagtcaaatggctcgtctcaagaagcagcaggaagagctggaacagatgcgattaaggtatctggctgcagaggaaaaggacacggtgaagaccgaaaggcaggagttgctggacatcagaaatgagctgaacaggctgagacagcaggaacagaagcagtatcaagactctacagagatcgcttcaggcaagaaagacggccctcatggatcagtcctggaggaaggtctggatgactacctgactcgccttatcgaagaacgtgatacgctgatgcgcactggtgtgtataaccacgaggaccgtatcattagtgagctggacagacagattagagagatcctggccaagtccaacgcctctaattag

SEQ ID NO: 217851 - DNA, 1143 bp, Artificial Sequence
  Description of Artificial Sequence: Synthetic coding sequence
atggtgagtaaatcagatcaattgctcatcgtcgtgagcatcttagagggcagacatttcccaaagcgcccaaaacatatgctggtcgtggaagctaaattcgatggcgagcagctggccactgacccggttgatcatacagaccaaccggagtttgccacagaactcgcttgggagatcgatagaaaggccttacatcagcaccggctccagcgtaccccaattaaactacagtgctttgccctagatccagtgacctcagccaaagaaactatagggtacatcgtgctagacctgaggactgctcaggagactaaacaggcgccaaagtggtatcagttgttaagcaacaaatacactaagttcaagtccgaaatccagatttcgatagcgctggaaaccgacaccaaaccacctgtggattcttttaaggcaaagggcgctcctccaagggacggaaaggtgcctgccatactggccggactagacccccgtgatatcgttgcggtcctcaacgaagagggcggttaccaccagattggccctgccgagtactgcacagactcatttatcatgagtgttacaatcgcctttgctacccaactcgagcaactgatcccatgcacaatgaagctgccagagcgtcaacccgaattctttttttattattcactgctaggaaacgatgttaccaatgagcctttcaatgatctcatcaatcctaattttgagcccgaaagggccagcgtaagaatccggtcatctgtagagattctccgggtgtacctggcccttcagagcaagctgcaaattcacctgtgttgcggcgaccagtccctgggtagcactgagatcccgctcaccggactgttgaaaaaagggtctaccgagatcaatcagcaccccgtgaccgtggagggcgctttcacactggatcctcccaacagagcaaagcagaagctcgctccaatcccggtggaactggctcctactgtgggcgtgagcgttgcgttgcagagggaagggatcgactcccaagacgccttctggtattcagctttggacataatatttcctttatttatatttttattcctggtactggacgccattaggaagtttgccaactatgaagagaaatag

SEQ ID NO: 217852 - DNA, 3828 bp, Artificial Sequence
  Description of Artificial Sequence: Synthetic coding sequence
atgtccctagactttggaagcgtggccctcccagtgcaaaacgaagacgaagagtatgacgaggaggactacgaacgcgaaaaggagttacaacagcttctgacagatcttcctcacgatatgctggatgatgacctcagttcccctgagttgcagtactcagattgcagcgaagatgggaccgacgggcagccccaccatcctgaacagcttgaaatgagctggaatgagcaaatgctccccaagagccaatcagttaatggcccaagctgtcaaggtctagaaccttacaacaaggtgacgtataaaccatatcagagcagcgcccagaataacggttctccggcacaggaaatcacagggagtgatacctttgaaggcctccagcagcaattcctaggggcaaatgaaaactccgccgagaacatgcagattatacagcttcaggtgctgaacaaggctaaagaacggcagctggaaaacctgatcgagaagcttaacgaatctgagagacagataagatatcttaaccaccagttagtcatcatcaaagacgagaaagatggactgaccctttcgctccgggagagccagaagctgtttcagaatggcaaggagagggagatccagctggaagcccagattaaagctttggagactcagatccaggccctcaaagtgaacgaagagcagatgatcaagaagtctagaacgactgagatggcattagaaagcttgaagcagcaactcgtcgacctgcatcatagcgagagcctccagcgggcacgagagcaacacgagagtatcgtcatgggtctcaccaaaaaatacgaagagcaggtgctgtccttacaaaaaaacttggacgcgactgtcaccgcgcttaaggagcaggaggatatctgttcccgcctcaaagaccacgtaaaacaacttgagcgtaatcaggaagctattaagctggagaagacggaaatcattaacaagctgacacgtagccttgaggaatcccagaaacaatgcgctcatctgctacagtcgggcagcgtgcaggaggtcgctcagctgcagtttcaactgcagcaggcccaaaaggctcacgccatgtcagcaaacatgaataaagccttacaggaagaactgaccgagttgaaagacgagatttctctgtacgagagcgccgctaagctgggcatccaccccagtgactccgagggggaactcaacattgagctgacggagtcatatgttgacttagggattaagaaggtgaactggaagaaaagcaaggtgacatccatcgtacaggaagaagaccctaatgaagagctgtccaaagatgagttcatacttaaactcaaagcggaagtgcagagattgctgggaagcaactctatgaaacggcatctcgtttcccagctccagaacgacctgaaggactgccacaagaagatagaggacctgcatcaagtcaagaaggacgaaaaaagcattgaggttgaaactaagactgacacctcagagaaacctaaaaaccaattgtggcctgagagttccacatcagacgttgttagggacgacatcctgcttcttaagaatgagattcaagtcttgcaacagcagaatcaagaactgaaagaaaccgagggtaagctgcggaataccaatcaagatctgtgcaaccaaatgagacagatggttcaagatttcgaccacgataaacaagaagccgtggaccgttgtgagcgaacatatcagcaacatcacgaggctatgaagacacagatcagggaatccttgttggcaaagcacgctctagagaaacagcagctgttcgaagcatacgagcgcacccacctgcagctgagaagcgaattggacaaattgaacaaggaagtgacggccgtgcaggaatgctacctcgaagtttgccgcgagaaggataatcttgaactgacactgagaaaaacaacagagaaagagcagcagacgcaggaaaagattaaggaaaagttgatacaacaactcgagaaggagtggcagagcaaactggaccagaccattaaagctatgaagaagaagacacttgattgcgggtctcaaaccgaccaggtgaccacaagcgatgtgatctccaagaaagagatggccattatgatcgaggagcaaaagtgtacaatccagcagaacctggagcaggagaaggacattgcgatcaaaggcgcaatgaaaaagttggagatcgagctagagctgaaacactgtgagaacattactaagcaggtggaaatcgccgtacaaaatgcccatcagagatggctcggggaacttcccgagttagccgaatatcaggcactggtgaaggccgaacagaaaaagtgggaagaacagcacgaggtatccgtcaacaaaagaatctcctttgcagtgtctgaggccaaagagaaatggaagtcggagctggagaatatgcgaaagaacatactccccggtaaggagctagaggaaaagatccacagtttacagaaagaactcgagttgaagaacgaagaagtgccggtggtgattcgagcggaactggccaaggctcggagcgaatggaacaaggagaaacaggaggaaatccaccggattcaggagcaaaatgaacaagattatagacagttcttggacgatcacaggaacaagataaatgaggtgctcgcggctgccaaagaggacttcatgaagcaaaaaactgaactgctgctgcagaaagagaccgaacttcagacctgcctggaccaatcccgtcgggagtggaccatgcaggaggccaaaaggatccagctggagatctatcagtatgaggaggacatacttactgtcctgggcgtgctgctttctgatacacagaaagaacatatctcggactccgaggacaagcagctgctggagattatgtctacctgtagcagcaaatggatgagcgtacagtatttcgagaagctgaaagggtgcatccaaaaggcctttcaggacacattacccttactggttgagaatgcagatcccgaatggaaaaagcgcaatatggctgagctgagtaaggattcagccagccaggggaccggccagggagaccctgggccagccgctgggcatcacgcccagccattagccttgcaggccaccgaagccgaagccgacaagaagaaagtactcgagattaaggatctgtgctgcgggcactgcttccaggagctcgaaaaggccaaacaggaatgtcaggacctgaaaggaaaattggaaaaatgttgcaggcacctgcagcatctcgagaggaaacacaaagctgtagtggaaaagatcggcgaagaaaacaacaaggtggtggaggaactcattgaggagaataacgatatgaaaaataagctggaggagctccagactctttgcaaaacacctcccagaagcctgagtgcaggggctatcgagaatgcttgtctgccttgcagtggcggagcgttagaggagctgagaggccagtacattaaggcagtgaaaaagataaagtgcgacatgcttcggtacatccaagagtctaaagagagagcagccgaaatggtcaaggccgaggtcttgcgcgagcgccaagaaaccgccagaaagatgaggaagtattatctgatttgcctgcagcagattttgcaggatgatggcaaagagggggctgaaaagaaaataatgaacgccgctagcaagctcgctactatggccaagctcctcgagacaccaatcagctcaaagtcccaaagcaagactacccagtccggcatgtccaagtag

SEQ ID NO: 217853 - DNA, 5132 bp, Artificial Sequence
  Description of Artificial Sequence: Synthetic coding sequence
atgagtctcgactttggatcagttgccctaccagtgcagaacgaggacgaggagtacgacgaggaggactatgagcgcgagaaggaattgcagcaattgctcacagatctgccccacgacatgctggacgacgatttatcttcccccgagctgcagtattccgactgctctgaagacggtaccgacggacagccccatcatcctgagcaattagagatgtcttggaatgagcagatgttgcctaagagccagagcgttaatgggtataatgagatccagtccctgtacgcaggcgagaaatgtggcaacgtttgggaggaaaacaggtccaaaaccgaagataggcaccccgtctaccatcccgaagagggaggagacgaagggggtagtgggtactctccaccctccaagtgcgaacagactgacctataccacttgccggaaaactttcgtccatatactaatggccagaagcaggagtttaacaaccaagctacaaatgtgattaagttttccgacccacagtggaatcacttccaggggccttcgtgtcagggattagaaccatacaacaaggtgacgtacaagccgtatcagagttcagcgcagaataacggctccccggctcaggagataaccgggtctgacacattcgaggggctgcaacagcaattcttgggcgcaaacgagaactcggccgaaaatatgcaaattatacagttgcaagtactgaataaagctaaggaacggcagttggaaaacctgattgaaaaactcaatgagtccgaaaggcaaatcagatatctaaatcatcagctcgtgatcattaaagatgaaaaagacgggttaacgctgtcacttagggagagccaaaaactcttccagaacggcaaggaaagagagatccagctcgaagcacagataaaggcgcttgagacccagatccaggctctcaaagttaatgaagagcagatgattaaaaagtcccgcacgacagagatggctctggagtccttgaagcaacagctcgtggacctgcatcacagcgagagtctccagcgggcaagagagcagcacgaatccattgtgatgggcctgaccaagaagtacgaggagcaggtactgtcgcttcagaagaatctggacgcaacggttactgccctgaaggagcaggaagatatatgtagtcggctaaaggaccatgttaagcaattggagaggaatcaggaagccatcaaactggagaagacggaaatcattaacaaactcactcggagcctggaggagagccaaaagcagtgtgcccacttgctgcagtccgggtctgttcaggaggttgcccaattgcagttccagctccaacaagcacagaaagctcacgccatgagcgccaacatgaataaggccttgcaggaagaactcaccgagctcaaggacgagatctcactctacgagtccgctgccaagttgggcattcacccctccgattctgagggcgaactgaacatagaactgaccgagagctacgtggacctgggaattaaaaaagttaattggaagaaaagtaaagtgacaagtattgttcaggaagaagatccaaatgaggagctgtctaaggatgaatttatactaaaactcaaagctgaagtgcagcggttactgggctccaacagcatgaaaaggcatctagtgtcccaacttcagaacgatctaaaggactgccacaagaaaatcgaggacctgcatcaggtgaaaaaagatgaaaaaagcatcgaggtagagaccaagaccgatacctccgaaaagcctaaaaaccagctatggcccgaaagctccacaagcgatgtggtgcgagacgacatcctgttgcttaaaaatgagatccaagtgctccaacagcaaaaccaggaactgaaagagacagagggaaaattgagaaataccaaccaagacctttgtaaccagatgcggcagatggtacaagacttcgaccacgacaaacaggaggcagtagatagatgcgagagaacctaccaacagcaccatgaggcaatgaaaacacagatccgagagagtctgcttgccaaacatgccctggaaaaacagcagctgttcgaagcttacgagaggacgcacctgcagctgcggtctgaactggataaactgaataaagaggtgactgcagtgcaagaatgctatttagaggtttgtcgggagaaggataatctcgaattgaccctcagaaagacgactgagaaggagcaacagacacaggaaaaaattaaagagaagctaatacaacagctggaaaaggaatggcagagcaagctagaccagacaattaaagcaatgaagaagaagaccctggattgcggctcccagaccgaccaggttacaaccagcgacgttatctccaagaaggaaatggcgatcatgatagaggagcagaagtgcacaatccagcagaacctcgaacaggagaaggacatcgccatcaagggcgcaatgaagaaactggagatcgaactggagctcaagcattgcgaaaacatcacaaagcaagtcgagatcgctgtccaaaacgcccaccagcggtggcttggcgagctgccggagcttgccgagtaccaagccctggtgaaggccgagcaaaagaaatgggaggaacagcacgaggtttcagttaataagcgtatttccttcgccgtgtctgaggcaaaggagaaatggaaatccgaattggagaatatgcggaagaacattctccccggaaaggagctcgaggaaaagattcacagtcttcagaaagaactggagctgaaaaatgaggaggttccagtcgtgattagggccgagctcgcgaaggcgagatcagaatggaataaagaaaagcaggaggagatccatagaatccaggagcagaacgaacaggactaccgtcagttcctggacgatcaccgaaataagataaatgaggtccttgccgctgcaaaggaagattttatgaagcaaaagaccgagttgctcctgcaaaaagaaacggagctgcagacatgcctggatcaatctcgcagagaatggaccatgcaggaagccaagaggatccagctcgaaatctaccagtatgaggaagatattctgaccgtccttggggtgctgctgagtgacacgcaaaaagaacacatctcggatagcgaggacaaacagctgctggaaatcatgtccacatgctcgagcaaatggatgagcgtccagtactttgagaaattaaaaggttgcatccagaaggctttccaggacactctacctcttctcgtagagaatgcagatccggaatggaagaaaaggaacatggcagagctatccaaagacagcgcttctcaaggaaccggtcagggcgaccctggaccagcagcgggtcaccatgcccaacccctggctctgcaggctaccgaagccgaagcagacaagaaaaaggtcttagaaattaaagacctgtgctgcggccactgctttcaggagcttgagaaagccaaacaggagtgccaggacttgaagggcaagctggagaaatgctgccgtcacttgcagcacctggaacggaagcacaaagctgtggtcgagaagattggggaggagaacaataaagtagtggaggagctgattgaggagaacaatgacatgaaaaacaagctagaggagctccaaaccctgtgcaagacaccacccaggtcattatctgccggagcgatcgagaacgcatgccttccgtgctccggaggagccctcgaagagctgaggggtcaatatatcaaagcggtcaagaagatcaagtgcgatatgctacgttatatccaggagtccaaagaaagggctgccgagatggtcaaggccgaagtcttaagagagaggcaagaaacagctcgcaagatgcggaagtactacctaatctgtctacaacagattctgcaggacgacggcaaagagggtgccgagaagaagattatgaatgccgcatcaaaattggccacaatggcgaagctcctagagacccccatcagtagcaaatcacagagcaaaaccacccaatctgctctgcctttgacatccgaaatgctcattgctgtgaaaaaatcaaaaagaaacgatgttaatcaaaagatcccttgctgtatcgaatctaagtccaactccgttaatacaatcacacgcacactgtgcgagcaggcgcctaagcggagagctgcctgtaatcttcagcgcctgctggaaaattccgaacatcagtccatcaagcacgtcggttctaaggaaactcacctggagtttcagttcggcgatggctcctgtaaacatctgaactccttgccacgcaatgtttcccccgaattcgtcccttgtgaaggggaggggggttttgggctgcacaagaaaaaagacctactgtctgacaacggatcagaatctctgccacactcagctgcctacccctttcttgggaccctggggaataagccaagcccaaggtgtaccccgggacctagtgaatccgggtgtatgcatattaccttcagagattcaaacgaacggctgggcttgaaggtgtataaatgcaaccctcttatggagagcgagaacgctgcctcggaaaaatcacaaggactcgatgtccaggagcctcctgtaaaggatggcggtgatctctccgactgcctgggatggccttcatcatctgccaccctgtcattcgatagtcgagaggccagcttcgtgcacggccgtccccagggaacactcgagattccctcggagagcgtaaagtcgaagcagtttagccccagcgggtacttgagcgataccgaggaaagcaacatgatttgtcagacaatgaaatgtcagcggtatcagactccgtacctctccgaagagaccacctacctggagcctggcaaaattagtgtgaattgcggacacccttccaggcataaggctgaccgtctgaaatcagacttcaagaagttgagctctactctcccatcctctgtctgccagcagccaagtcggaagttaattgtcccccttagctcccaacaggacagcggctttgactctccgtttgtgaacttggacta

SEQ ID NO: 217854 - DNA, 4965 bp, Artificial Sequence
  Description of Artificial Sequence: Synthetic coding sequence
atgtctctggacttcggttccgtcgctctaccagtgcagaacgaggatgaagaatatgatgaggaagattacgaacgggagaaagaactccagcagctcctgaccgatctgcctcatgatatgctggacgacgacttgtccagccccgagcttcagtatagcgattgcagcgaggacggcacggacgggcaaccccaccatccggagcagttagaaatgagttggaatgaacagatgctgcccaagtctcaatccgtgaacggctacaacgaaatacagagcctctatgctggagagaaatgcggcaatgtatgggaagagaacagaagtaagacagaagaccgacatccggtgtatcaccccgaggaaggaggcgatgagggaggatcaggttactctcccccatcaaagtgcgaacagactgacctgtatcaccttcccgagaacttccggccttatacaaacggccagaaacaggaatttaacaaccaggccactaacgtcatcaagttctcggacccccaatggaatcattttcagggcccatcatgccagggacttgagccttacaataaggtcacctataagccctaccaatctagcgcccagaacaatgggagtccggctcaagaaatcaccggctcagatacttttgaggggctccagcagcaatttctgggcgctaatgagaactctgcagaaaatatgcagataatccaactgcaggtcctgaataaggcaaaagagcgacagctggagaaccttatcgaaaagctgaacgaaagcgagaggcagattagatatctgaatcaccagctagtgatcattaaagatgagaaggacggattaaccctgtcattgcgggagagtcaaaaattgttccagaatggaaaagagcgagagattcagttggaagctcagattaaggcacttgagacacagatccaagccttaaaggtgaatgaagagcagatgatcaagaaatcacgcacaacggaaatggccttggagagcctgaaacaacaactggtcgaccttcatcactccgagtcgttgcagcgtgcccgtgagcaacacgaaagtatcgtgatgggcctcacaaagaagtatgaggaacaagtcctttccctgcagaaaaatctggacgctacagtgacagcgctgaaagaacaggaagacatctgctctcggctgaaggaccatgttaaacagcttgagcgaaaccaagaggcaatcaaactagagaaaacggagattattaacaaactcacaaggagcctggaagagtcccaaaagcagtgcgcccatctcttgcagagtggaagcgtgcaggaggttgcccagttgcagtttcaactacaacaagctcaaaaggcccatgcaatgagtgccaatatgaacaaggcgctccaggaggagttgactgagctgaaggacgagattagtttgtatgagtctgctgcaaagctcgggattcacccatctgactccgaaggcgagctcaatatcgagctgaccgagtcctacgtggacctcggtataaagaaggtcaactggaaaaagtcaaaggtcacatccattgtgcaagaagaggacccaaacgaagagctatcaaaggatgaattcattctcaagctcaaggccgaggtgcaaagactcctgggatcaaattctatgaaacgccatctggtgagtcagcttcaaaatgatttgaaggattgccacaagaagatcgaagacttacaccaggtgaagaaggatgagaagtcaatcgaagtcgagaccaagacggatacttcagagaaacccaagaaccaactctggccggaaagctctacgtcagacgtcgtgagagatgatattctactgcttaagaatgagattcaggtgttacagcagcagaaccaggagctaaaagaaactgagggaaagctccgcaacactaatcaggatctgtgtaaccagatgcggcaaatggtgcaggacttcgaccacgacaagcaggaggcggtcgaccggtgtgagagaacataccagcaacaccacgaggccatgaaaacgcagatcagggagagtctgcttgccaagcacgcgcttgaaaaacagcaactgttcgaggcatacgaaaggacacacctccagctgaggagcgagctcgataagctgaataaggaagtaactgccgtacaggaatgctatctggaggtctgtagagagaaggacaacctagagctgaccctgcgaaagactacagaaaaagaacagcagacgcaggagaaaataaaggagaagctcattcaacaactggagaaggaatggcagtcaaaacttgatcaaaccatcaaagccatgaagaagaagaccctggattgcggatcacagactgatcaggttactacttcagacgtgattagcaagaaggagatggccatcatgatcgaagagcagaaatgcaccattcagcagaatctggagcaagagaaggacattgctatcaaaggggctatgaaaaagctggagatcgagctggaactgaaacactgcgagaacatcaccaaacaagtggagattgcagtgcagaatgcccatcagcggtggctgggcgagttgcctgaactcgccgaatatcaggctctggttaaagcggagcaaaagaagtgggaggagcagcacgaggtgagcgtgaacaagcggatcagctttgcagtgtccgaagcgaaggagaaatggaaaagcgagttggaaaacatgagaaagaatatactgcctggaaaggagctcgaagaaaaaatccactctttacagaaagaattagaactcaagaatgaggaagtacccgttgtgataagagctgagctcgctaaagcacggtctgagtggaacaaggaaaagcaagaagagattcacaggatccaggagcaaaatgaacaagattatcgccagttcctggatgatcaccggaataaaatcaacgaggtgctggctgctgccaaagaagactttatgaaacagaaaactgagctgctgctccagaaagagaccgagctacagacctgcctggaccaaagcagacgggagtggacaatgcaggaagccaagcggatccagctggaaatctaccagtatgaagaagatatattaacagtgctcggcgtcctgctcagtgacacacagaaagaacacatctccgattctgaagataagcagttgctggagattatgagcacatgctcatccaagtggatgtcagtgcaatactttgagaaactgaaaggatgcatccagaaggcatttcaggacacgcttcccctgctcgtcgagaatgcagatccagaatggaaaaaaaggaacatggccgagctcagcaaggatagtgcttctcagggcacgggtcagggagatccagggccagcagccggacatcacgctcagccactggcgctgcaggccactgaagctgaggccgaagaaaacaataaagttgttgaggaacttatcgaggagaataacgacatgaagaacaaactggaggagttgcagacattatgcaagacccccccacgttccctgtccgccggagcaatcgagaacgcttgtcttccatgcagcgggggagctctcgaagagttgaggggccaatacattaaggcagtcaaaaaaataaagtgtgacatgttaagatacattcaagaatctaaggaacgcgcagccgagatggtgaaagctgaggtgctgcgtgagcgacaggaaaccgccaggaaaatgcgtaagtattacctgatttgtctccagcagattctgcaagacgacggcaaggagggggctgagaaaaagattatgaacgcagccagcaaactggccaccatggcgaaactgctggaaaccccaatttcctctaagagccaatcaaaaacaacacaatctgccttgcctctgacctcagagatgcttatcgccgtgaagaaatctaaacgaaacgacgtgaatcagaagatcccctgttgcatcgaatctaagagcaactcggtgaacacgattaccaggacgctgtgcgaacaggccccaaaacggcgagcagcctgcaacctgcagcgcctgctggagaattcagaacaccagagtataaagcacgtgggttcaaaagaaacacatttggagtttcagttcggcgatgggagctgtaaacatctgaactcccttcccagaaacgtgtctccagagttcgtgccttgtgagggggaggggggattcggactccataaaaaaaaggatcttttatccgataatggtagtgagtcgctgccccatagcgccgcatatcccttcttgggcacactgggcaataaaccaagtcctcgctgcacacccggtcctagcgagagcggctgtatgcacattacttttcgtgattctaacgagcgcctgggattaaaggtgtacaagtgtaatccactcatggaaagtgagaacgccgctagtgagaaaagtcaaggcttagacgtgcaggaaccgcctgtcaaggatggaggagatttatcagattgcttggggtggccatcatcatctgccactctttcgtttgactctcgtgaggcgtcttttgtgcacggccgtccccaggggaccctggaaatcccatctgagtcagtgaaaagcaaacagttcagccccagcgggtacctgtccgatacggaagaaagcaatatgatttgccagacgatgaaatgtcagcggtatcaaactccttatctgtcagaggagacaacctatctggaacctgggaaaatatcggtgaactgcggccatccctcccgccacaaagccgatcggctgaaatctgatttcaagaagttatcctccactctgcctagttcagtgtgccagcagcctagtcggaagctgatcgtgcctttgtcgtcacagcaggattcggggttcgactccccatttgtgaacctggactag

SEQ ID NO: 217855 - DNA, 1779 bp, Artificial Sequence
  Description of Artificial Sequence: Synthetic coding sequence
atgtcactcgatttcggctcagtcgctctcccagtgcagaatgaggatgaggagtacgacgaagaggactacgaaagagagaaggagctacaacagcttcttacagatctgccacacgacatgctggacgacgatctgtctagcccagagcttcagtactccgattgcagtgaggacgggaccgatgggcagccacatcatcctgaacagttggagatgtcctggaatgagcaaatgctcccaaagagccagtctgtgaatggctataatgagattcagtccctgtatgccggagagaagtgcggaaatgtttgggaagaaaatcgaagtaaaacagaagaccgacatcccgtctatcatcctgaggagggcggtgacgaagggggtagtgggtatagcccaccttccaagtgtgagcaaacagatctctaccacctcccggaaaactttcggccatacacaaacggccagaaacaggaattcaataaccaggccactaacgttatcaagtttagtgaccctcagtggaatcattttcagggcccaagctgccagggactcgagccctacaataaagtcacttacaagccatatcagtctagcgcccagaataatgggagccctgcccaggagatcaccggtagcgatacctttgaaggcctgcagcaacaattcctcggagccaatgagaacagtgcagaaaacatgcagatcattcaactacaggtgctgaataaggcaaaggagcggcagctagaaaatctcatagagaaactgaacgaatcagagaggcagattaggtacctcaaccatcagttagttattatcaaggatgagaaggatgggctgacactgtcattacgggaatcccaaaagctctttcagaacggcaaagagagagaaattcagctggaagcccagatcaaagcactggaaactcagattcaggctctgaaggtgaacgaggaacagatgatcaagaaatctaggaccaccgagatggcactagaatccctgaagcaacagcttgtggatttgcaccacagcgagtctctgcagagagctagggaacaacatgagtcaatcgttatggggctcacaaagaagtacgaggaacaagtcctgtccctgcagaaaaacctcgacgcgactgtaacagcactcaaagagcaggaggacatctgtagcaggctcaaagaccacgtgaaacagttagaaaggaaccaagaagcaatcaaactggagaagactgaaataatcaataagttgactagaagcctggaggaatcgcagaaacaatgcgcccaccttcttcagtcaggcagcgtgcaggaagtagcacagctgcagtttcagctccagcaggcccagaaagcccatgctatgtctgccaatatgaacaaggcactgcaggaggagcttactgagctgaaggacgagatcagcctctacgagtcagccgcaaaactgggcatccatccctccgacagcgagggagagctgaacattgagctgacagagagttatgtggacctaggcatcaagaaggtgaactggaaaaagagtaaggtgaccagcatagtccaggaagaggaccctaacgaggagctcagcaaggatgagttcatcttaaagctgaaagctgaagtacagcgcctcctggggtctaatagcatgaagaggcatcttgttagtcaattgcagaacgacctcaaggattgccataagaagattgaagatctgcatcaggtgaaaaagaaaaaaaaaaaaaagaagtag

SEQ ID NO: 217856 - DNA, 207 bp, Artificial Sequence
  Description of Artificial Sequence: Synthetic coding sequence
atgagcctggatttcgggtccgtagcactgccggtgcagaacgaggacgaggaatacgacgaagaagattatgagagggaaaaggagctacaacagctccttaccgacttaccacatgatatgctggacgatgatcttagtagccccgagctgcagtactctgactgttccgaagacgggacagatggacaacctcatcacccttag

SEQ ID NO: 217857 - DNA, 4755 bp, Artificial Sequence
  Description of Artificial Sequence: Synthetic coding sequence
atgagtcttacctcgtggttcctcgtgtccagtggcggtacgcgtcacagactccccagggagatgatttttgttggacgcgacgattgcgagctgatgctccagtctcgttccgtggacaagcagcacgctgtcattaactacgacgcatcaaccgatgaacatctggtaaaggatctggggtcactgaacggcaccttcgtgaacgatgtaaggattcctgaacagacttacatcacactgaaattagaagataagctgagatttggatatgatacaaacttgttcacagttgtccagggagaaatgcgagtcccagaagaggccctcaaacatgagaagttcacaatccaactgcaactcagccagaagagctcggaaagcgaattatctaaaagtgccagcgcaaagagtatagactcgaaggttgcagatgctgccacggaggtgcagcacaaaaccactgaggcgttgaagtccgaggagaaggccatggacataagcgccatgccaaggggcactccgctctacgggcagccaagctggtggggcgacgatgaggtggatgagaaaagagccttcaaaactaatggaaaacccgaagaaaagaaccatgaagccggtacaagcggttgcggtatcgacgccaagcaggttgaggagcagagtgctgccgctaacgaggaggtactgtttccattctgccgggagccgtcctactttgagatccctaccaaagaattccagcaacctagtcagatcaccgaaagcactatccacgagatcccaacaaaagacactccaagcagccacatcactggggcagggcatgcctcctttaccatcgaattcgatgatagcactcccggaaaggtgacaataagagaccatgtaaccaaatttactagcgatcagcgccataaatccaagaaaagcagcccaggcacgcaggacctgctggggattcagacaggaatgatggctccagagaacaaggtcgcggattggctggcccaaaacaatcccccacagatgctgtgggagcgcacagaggaggatagcaaaagtatcaagtctgatgtgccagtgtacctgaagagactcaaagggaacaagcatgatgacggtacccagagcgattctgaaaacgcaggagcccatcggcgttgcagcaagcgcgctacgctggaggaacacctgagacgtcaccatagtgagcacaaaaaacttcagaaggttcaggctaccgagaaacaccaagatcaggcagtaacctccagcgcgcatcaccgcggaggacatggagtaccccatggcaaactacttaagcaaaagtctgaagaaccctcagtttcaatccctttcctccaaacggccctgctccgctccagcgggtccctcgggcatagaccatcacaggaaatggataagatgttgaaaaatcaggccacctctgccacgtctgagaaggataacgatgacgaccagtcggacaagggaacatatactattgagctcgaaaatcctaactccgaagaggtagaagccaggaagatgatagataaggtgtttggggtggacgataaccaagattataatcggcctgtaattaacgagaagcacaaagatctgatcaaagactgggcgctctcatccgctgccgcagtcatggaggagcgtaaaccattaacaacatcaggctttcaccactccgaagaaggtacgtcctcttccggctctaaaagatgggtcagccaatgggcctctctggccgcaaatcacacccggcacgaccaggaagaacgcatcatggagttttcagcacccctgcctctggaaaatgaaaccgagatcagtgaaagtggcatgaccgtgaggtccacaggaagcgcgacttctttagcttcgcagggcgagcgtcgcagaaggacgctgccccaactgcctaatgaagaaaaatcgctggagtcacatcgggctaaggtagttacccaacgctctgagatcggcgagaaacaagatacagagctccaggagaaagaaacccctacccaggtatatcaaaaagacaagcaagacgccgataggccgctctctaaaatgaaccgtgcagtgaatggggagacactaaaaactgggggagacaacaaaaccctcctgcacctcggaagtagcgctcctgggaaagagaaatctgaaacggacaaggaaactagtctggtgaaacagactctggccaagctgcagcagcaggagcagagagaagaagcacagtggaccccaacaaaactttcctccaagaacgttagtgggcagaccgacaagtgccgggaagagacctttaagcaggaaagccaacctcctgaaaaaaactcaggccatagcacttcaaagggtgacagggtcgctcaaagcgagtccaagagacgcaaagccgaggagatcctgaagtcacagacccccaagggcggtgacaagaaggaatcctctaaatcgctggtccggcagggcagctttaccatagaaaagccatcccctaacattcctattgaattgatcccccacataaataagcagaccagcagtactcccagctccctggcattaacgagcgcctctcggatcagggagcgcagcgaatcactggatcccgattcttccatggataccactctgatcctcaaggatacagaggccgtcatggcattcttggaggccaagctccgtgaagataacaaaactgacgaaggacctgatacgcccagctataatcgagacaattctataagtccggagtcagatgttgacaccgcctccaccatctcccttgtgactggcgaaaccgagcgcaaaagtactcagaagcgtaaaagcttcaccagtctgtacaaggaccgatgttctactggcagcccttctaaggacgtgaccaagtcatcatcatcgggggcacgagagaaaatggagaaaaaaactaagagccgctcaaccgacgtggggtcacgggctgacggcagaaaatttgtacagtcttccgggagaatcaggcaaccatcggttgacctgacagatgatgaccaaacaagtagtgtaccccactccgctataagcgatatcatgtcctcagatcaggaaacatactcatgcaagcctcacgggaggactccgcttacttctgccgacgaacatgtacattctaagctggagggtagtaaggtcacaaaaagtaagacttcccctgtagttagtgggtcaagcagcaagagtaccacgttgcctcggcctcggccaaccaggaccagcttactgagacgggcacgcctgggtgaagcctcagattcagagctggcagatgctgataaggctagcgtggcgagtgaggtgagcactacatcctctacctccaagcccccaactggcaggcgtaatatctcaaggatcgacttactcgcccaaccgagacgtaccaggcttggctccctgagtgccagatccgacagcgaggcaacgatttcacgctcaagtgcctcaagtcggacagctgaggccatcatacggagcggagcacggctggttccaagcgacaaattctccccacgaattcgcgctaacagtattagtagactgtctgacagcaaggttaagtccatgacctctgcacacggttctgcatcggtgaattcaagatggaggcggttccccactgactacgcctctacctctgaggacgaatttggctcgaataggaactccccgaagcatacgaggctaaggactagccccgcactgaagactactagactgcagtccgccggatcagcaatgcccaccagtagcagctttaagcaccggattaaagaacaagaggactacattcgcgactggactgctcaccgagaggaaattgccagaatcagccaggacttagccctgattgcgcgtgagataaacgacgtggcaggagagatcgactctgtgaccagctctggcaccgcgccatcaactacagttagtaccgctgctaccactccgggatctgccattgatactagagaggaacttgttgacagggtttttgatgaatctctgaattttcgtaagataccccctctggtccactccaaaacgccagagggaaacaatggccgaagcggtgatccacgaccccaggccgctgaacctcctgaccacctgactatcacacgtagaagaacatggtccagggacgaggttatgggcgataacctactcttaagtagcgttttccagttctcaaagaaaatccggcagtccatcgataaaacagctggcaaaatccggatccttttcaaggataaggatcgtaattgggacgacatcgaaagcaaactgcgcgctgagtccgaggtgccaatcgtaaaaactagcagcatggagatcagcagcattttgcaagaactgaagagagtagagaaacagctccaggcaatcaacgccatgatagatcctgacggaacgttggaggctctgaacaacatgggctttcccagcgcaatgttaccgagtccaccgaagcagaaatcatcgcccgtgaacaaccaccactctccagggcagactccaactcttggtcagccagaggctagggccctccaccctgctgctgtcagtgcagcagccgaattcgagaacgcagagtctgaagctgatttttctattcacttcaaccgctttaatcccgatggcgaagaagaggatgtcaccgtacaggaatag

SEQ ID NO: 217858 - DNA, 4383 bp, Artificial Sequence
  Description of Artificial Sequence: Synthetic coding sequence
atgtccctgacctcctggttccttgtgtcctctggcggtacaaggcaccgtctgccacgggagatgattttcgtgggtcgcgatgattgcgagctcatgcttcaaagtcgctcagtggacaagcagcatgcagtcattaattacgatgcatccaccgacgagcatctggttaaggacctcggaagcctcaatggaaccttcgtgaatgacgtgagaatcccggagcagacctacataactttgaaactcgaagacaagttgcggttcggctacgatactaatcttttcactgtcgtgcagggagagatgagggtgcccgaagaggctctcaagcatgaaaaattcaccatacaattacaattgtcccagaaatcatccgagagtgaattgagtaagtcggcgagtgcaaagtccattgatagtaaagttgctgatgctgccacagaggtacaacacaagacaacggaagcccttaagagtgaagaaaaggcaatggacatttccgcaatgccccgaggaactcctttgtacgggcaaccgtcctggtggggagacgacgaagtggatgaaaaacgggcattcaaaaccaatggtaaacccgaagagaaaaaccacgaagctggcacgtcaggctgtggcatcgacgccaaacaggtggaagagcaaagcgccgctgcaaatgaggaagtcctctttcctttctgcagggaaccctcgtactttgagattcccacaaaagaatttcaacagccatcacaaatcacggagagcacaatacacgaaatcccaacaaaagacaccccatcctctcatatcaccggagccggacacgcatcattcacgattgaatttgacgactcgacgccaggtaaagtgaccatcagagaccacgtgactaagttcaccagcgaccaacgacacaagtctaaaaagagctcgcctggaacacaggacctcctcgggatccaaacaggcatgatggcgcctgaaaataaggtagcagactggctggcgcaaaacaatcctccccagatgctctgggagaggacagaagaggactctaaatctataaagtccgacgtgccagtctacctaaagagactgaagggcaacaaacatgacgatggtactcagtctgactccgagaatgcgggtgcccatcgtcgctgctccaagcgtgcgaccttggaagagcacttacgaagacaccattctgaacacaagaaactgcagaaagtgcaggccactgaaaaacaccaggatcaggctgtggttttcggcgttgacgataaccaggattacaatcggccagtaattaatgaaaagcataaagacctgatcaaagattgggctctctcatcggcggctgcagtcatggaggaacgaaagcctctcaccacttctggcttccatcattcagaggaggggacctcttcatcgggatcaaagcgctgggtgtcacagtgggcaagtctcgctgccaaccacacacgccacgaccaggaagagcgcatcatggaattttctgcgccactcccattagagaatgaaaccgaaatctctgagagcggcatgaccgttcgaagcactgggagcgccacctcactagcctctcagggtgagcgtaggcgaaggactctacctcagctgccgaatgaggagaagtccctggagtctcacagagcaaaggtagtcacacagcggtccgaaatcggcgagaagcaggacacggaactgcaggaaaaggagacgccaacgcaagtgtaccagaaagataagcaggatgctgataggcccctgtcgaagatgaatcgggctgtaaatggcgagactctcaaaacaggaggcgacaacaaaaccttattgcacttgggatcctccgccccaggtaaggaaaagtcagaaacagataaagagacctccttggtgaagcagacgttggcgaagctccagcaacaagagcagagggaggaggcacagtggacccccactaaactgtccagcaaaaatgtcagtggacagaccgataagtgtcgagaggaaactttcaaacaggagagccagcctcccgagaaaaatagcgggcactccacttctaagggcgaccgggtggcccagagcgaatctaagaggcgcaaggctgaggagattctcaagtctcagacccccaagggcggagacaaaaaggaaagttctaagagccttgttagacaagggtccttcacaatagagaaaccaagtcccaacatcccaatcgaactgatcccccacatcaataagcagacctcatccacccccagttcactggcgttaacttccgcctctagaatcagagagagatcagagtctctagaccccgactcatccatggacaccaccctcatacttaaagacaccgaggccgtcatggctttcctcgaagcgaaattacgagaagataacaagaccgatgaaggccctgacactccctcctataatcgtgacaatagtatatcacccgaatccgatgttgatactgcctctactatttctctggtaaccggcgagaccgagcggaaatctacacagaaaaggaaaagttttacttctctgtataaagatcggtgtagcacaggctcaccgtcaaaggacgtgacaaagtcaagcagctcaggcgcaagggaaaaaatggaaaagaagaccaaatccaggagtaccgatgttggctcgagggcagacggtaggaaatttgtccagtcctctggaaggatacggcagcctagtgtggacctgacggatgacgatcagacatcaagtgtccctcacagtgcaatctccgatataatgtctagcgaccaggaaacttatagctgcaagccgcatgggaggacaccactcacctccgctgacgagcacgtgcatagcaagctggaggggtcaaaggtcacaaagtcaaaaacctccccagtagtaagcggatctagttcaaagtctaccacattgccccgacccaggcctacccgcacctccctgctcagacgggctagactcggagaggcctcagactccgagctagcagatgcagataaggcctctgtggcaagcgaggtatccactacaagtagcacatccaagcccccaactggcaggagaaatatctcacgcatcgatctcctagctcaaccgaggaggacaaggctgggaagcttgtccgctcggtccgactctgaagccacaatttctaggtctagcgcttctagcaggaccgctgaggcaatcattcgctcaggagcgagattagttcctagcgacaaattctcccccaggatccgggcaaattctatcagcaggctctccgatagcaaagtgaaatccatgacttcagcccatggatccgctagcgctctgaaaaccacaagactccagagcgctggcagtgccatgccgacctcctcctcttttaaacacaggataaaggagcaggaagactatatccgggattggaccgcccatagggaggagattgcaagaatctcacaggatctggctctgatagcccgagaaatcaatgatgtcgccggagagatagactcagtcacttcaagcggcactgccccttccaccacagtgagcactgcggctactactccaggctctgcgatcgatacgcgcgaggaggtgggagacctccacggcgagatgcataagctagttgatagggtcttcgatgagtctctcaattttcggaaaattccacccctggttcacagcaagacaccggagggtaataacgggaggtcaggggacccacgccctcaagcggctgaacctcctgatcacctgacaatcacacggaggaggacatggagcagagacgaagtcatgggcgataacctgctactttctagtgtcttccagttttctaagaaaatccgtcagagcattgataaaaccgccggaaagatccggatcttatttaaggataaagataggaactgggacgacattgagagtaaactaagagccgagtcggaggtgccgatcgtgaagaccagttcaatggagattagctccattctccaggagcttaaacgagtagagaagcagttacaggcgatcaacgccatgattgacccggatgggacactcgaggcgctgaataatatgggcttcccttcagccatgctgccatcaccaccaaaacagaagagcagtcccgtgaataatcaccatagccccggacagactcccacccttggccagcccgaagccagggccctccaccccgctgccgtgtctgccgctgctgagttcgagaacgcggagtcagaggcagacttcagcatacactttaatagatttaacccagacggcgaagaggaggacgtgacagtgcaagagtag

SEQ ID NO: 217859 - DNA, 4461 bp, Artificial Sequence
  Description of Artificial Sequence: Synthetic coding sequence
atgtccctgacaagctggtttctggtatccagtggcggaactagacacagattaccacgggagatgatttttgttggcagagacgactgcgagttgatgcttcagagtcgctctgtggacaaacagcatgctgtcatcaactatgacgcttctaccgatgagcacttggtgaaggacctcggctccctgaatgggacattcgtcaacgacgtgcgtatccctgagcaaacgtatattacactgaagttggaggacaagctgcgttttgggtacgatactaatctgtttactgtggttcaaggggagatgcgggttcctgaggaggccctgaaacatgagaagttcaccattcagctgcagttatctcagaaatcgtcagaaagcgaacttagtaagtcagcctccgccaaaagcattgatagcaaggtcgcagacgccgctaccgaagtgcagcacaaaacaaccgaggccctgaagtccgaagagaaggccatggatatttctgccatgcctagaggtacacctctctatggccagcccagctggtggggcgacgacgaggttgacgaaaagagagcctttaaaactaacggaaagcccgaggaaaaaaaccacgaggcgggtacttccggatgtggaatagacgctaagcaagtggaagaacaatctgctgctgctaatgaggaggtcctcttcccattctgcagagagccctcttactttgaaatacctactaaagagtttcagcaaccctcccaaataactgaaagcacaatccacgagattcccaccaaagatacccccagcagtcacatcactggcgcaggacacgcatcttttacaattgagtttgacgactccaccccaggcaaggtgaccatacgagatcatgtgaccaaatttacaagtgaccagagacacaaatccaagaagagctcccctggtactcaggacctgcttgggattcagactggtatgatggctcctgaaaataaagtggctgactggctggcccagaacaaccctccacagatgttatgggaaaggacagaagaggatagcaagtctatcaagtccgatgtgcccgtgtatctgaaaaggctgaaaggcaataagcacgatgacggcacgcagagcgactctgagaatgcaggcgctcatagaaggtgtagcaagcgcgctactctcgaagagcatcttcgcaggcaccacagcgagcacaaaaaactccagaaggtgcaagctaccgaaaaacaccaagatcaagcagtggtgtttggcgtggatgacaatcaggactataaccgacctgtgatcaacgaaaaacacaaggaccttattaaggactgggcactctcctccgcggctgcagtgatggaggagagaaagcccttaacaacctccggcttccaccactcggaagagggcacctcttcctccggaagtaagagatgggtgtcacagtgggcatcgctggccgcaaatcatacgcggcacgatcaagaagagagaattatggagttcagtgccccacttcctctagagaacgagaccgagatatctgagagtgggatgacagtgcggtccacgggaagcgccacaagtctggcatcccagggcgaacgacggcgacggacgttgcctcagctacctaacgaggagaaatccctggaatcccacagggctaaagtcgtgacacaaaggtccgaaattggggaaaaacaggataccgagctgcaggagaaagaaacccccacccaagtctatcagaaggataagcaagatgcagacagacccctttcaaagatgaatcgggctgtgaatggagagacccttaagacaggaggggacaataagacactgctgcatctgggcagctctgcacctggaaaggagaaatccgagacagacaaggagaccagtctcgtgaagcagacactcgcgaaactgcagcagcaggagcaacgcgaggaagcccagtggacccccaccaagttatctagcaagaatgtcagtggacagacagacaagtgtcgcgaggaaacatttaagcaagagtctcaaccaccggagaaaaatagcggccattcaacaagtaagggggaccgggtggcccagtccgaaagcaaacgcaggaaagctgaagagattttaaaaagccagacccccaaaggcggagataaaaaggaaagttctaagagcctggttaggcagggcagttttactatagaaaagcctagcccaaacatccccatcgagcttattcctcacatcaacaagcagacatcctcgacaccatccagcctggctctaacgagtgcctcacggatcagggagaggagcgagagcctggacccggattccagcatggatacaactcttattcttaaggatacagaggccgtcatggcctttcttgaggccaaattgcgcgaggacaacaaaacagacgagggacctgacacgcctagttacaaccgggacaactcaatctctcccgaatcggacgtggacacggcatctacaatctctctggtcacaggcgagactgagagaaaatcgactcagaagagaaagagttttaccagcctgtataaggacaggtgcagtactggatcgccatccaaagacgtgacaaagtcctcctcatccggagcacgcgaaaaaatggaaaagaaaaccaaaagtcggtcaactgatgtgggttcacgcgcagacggcaggaaatttgtgcagtcctctggccgaattcggcagccgagcgttgatctgactgacgacgatcagacttctagcgtcccccatagtgccatttctgatattatgtcgagtgaccaggaaacctactcatgcaagccacatggcagaactcctctgacaagtgctgacgagcacgtccacagtaagctcgaagggagtaaggtgactaagtccaaaactagccctgtggtcagtggttcttcatctaaaagtactactctgccgagaccgcgtccgaccagaacttccctgttgcggagagctcggcttggcgaggctagcgattctgagctggcagacgccgataaggcaagcgtggcctcagaagtctcgactacctcatcaaccagtaaacctccgaccggaaggagaaacatcagcagaattgaccttctggctcaaccaagaaggacacgacttggttctctgtcggctcggagcgatagtgaggcaaccataagccgctcgtcagcaagctccagaacagccgaagccataatccgctctggggcaaggctggtcccaagtgacaagttcagtcccagaatcagagcgaattcaatctcaaggctttcagattctaaggtgaagtcgatgacaagtgcgcacggttccgccagtgttaactccagatggcgtcgattccccacagattacgctagcacaagtgaagatgagtttggatctaatcgcaactccccaaagcatactagactgagaacaagccctgctctgaaaactaccaggttacaaagtgctgggtcagccatgcctacctcctcctcatttaaacatcgtattaaggagcaagaagactacatcagagactggacagcacaccgggaggaaattgctaggatcagtcaggatctggccctgatcgccagggagataaacgacgtggccggtgagattgactcagtcacctcctcgggcacagcaccctccactaccgttagcacggcagcaacgactccaggtagcgccatcgatacccgcgaggaacttgtcgaccgtgtttttgacgagagtctgaattttcggaagattccccctctagtgcacagtaagacaccggagggcaataatgggaggtcaggagacccgcgacctcaggccgctgagccccctgaccaccttaccattacccggagacgcacatggtctagggacgaggtgatgggagataacctccttctgagttccgtatttcagtttagtaagaaaatccgccagtccatcgacaagacagccggaaagataagaatactcttcaaagacaaagacagaaactgggacgatattgagagtaaactgagggccgaatcagaggtacccatagttaagacttcctcgatggagatttcttctatcctccaggagctaaaacgcgttgagaaacaactgcaagcgatcaacgccatgattgacccagatggcactctggaggctttaaataatatgggttttccttctgctatgctcccttctcctcctaagcagaagtcaagccctgtgaataaccatcacagcccaggccagacacctactcttgggcagcctgaggccagagcgctgcatccagcagctgtctctgccgcagctgagtttgaaaatgctgaatctgaagctgacttttccatccactttaaccgttttaatccagatggggaggaggaggacgtgacggtgcaggagtag

SEQ ID NO: 217860 - DNA, 1239 bp, Artificial Sequence
  Description of Artificial Sequence: Synthetic coding sequence
atgcgagtgcccgaggaggccctgaaacatgagaaatttacgatccaactgcaactgtcgcagaaatccagcgagtccgaactctctaagagtgcttctgcgaaaagcatcgactccaaggtcgcagatgctgccaccgaagttcagcataagacaaccgaggccttgaaatccgaagaaaaagccatggatatcagtgcgatgccaaggggcactcccctctatggacaaccttcctggtggggtgatgatgaggtggacgaaaaaagggccttcaaaactaacggtaagccagaagaaaagaaccacgaggcaggtacaagtgggtgtggtatcgacgccaagcaagttgaggaacagtcggccgctgctaacgaggaagtactgtttcccttctgccgcgagccttcctactttgaaatcccaactaaggagtttcagcaacctagccagataactgagtcaacaattcatgagattcctaccaaagacactccctcttctcatatcacgggagctggccatgccagtttcacaattgagtttgacgactctacccccggaaaggtgactatacgagaccatgtcacgaaattcacctccgaccagcgacacaagagcaaaaaatcatcacctggaacccaggacttactcgggatacagacaggcatgatggctcctgagaataaagttgctgattggctagctcagaacaatccaccccaaatgctgtgggagcggactgaggaagattccaagagcatcaagtcagacgtgccagtttacttgaagcgcctgaaagggaacaaacatgatgatggcacccagtccgactcagagaatgccggagctcacaggaggtgcagtaagcgggcaactctggaggagcatctcagacggcatcacagtgagcataagaaacttcaaaaagtccaggccacggaaaaacaccaagaccaggccgtgacttccagtgcacaccacaggggaggacacggggttccccacgggaaactgcttaaacaaaagtcagaagagccctctgtgtccatcccttttctgcagactgcccttctccggtcaagtggctctctcggccacagaccttcacaggagatggataagatgttgaaaaatcaggcagactgtggatctgtcgccttttgcgggtttatgatctttaagctgaatctcatgattactccctttccctttatcgatctgttctcattcttctag

SEQ ID NO: 217861 - DNA, 402 bp, Artificial Sequence
  Description of Artificial Sequence: Synthetic coding sequence
atgtcacttacctcctggtttcttgtgtcctctggcggtacccggcatcggctgccacgcgagatgattttcgtgggtagggatgactgcgaattgatgctgcagagtcggtctgtcgataaacagcacgccgtgataaattacgacgccagcaccgatgagcatctcgtgaaggacctcggatccctgaatggcacttttgttaacgatgtccgcatccctgagcagacctacattacgctgaagttggaagacaagttgaggtttggctatgacacaaaccttttcacagtcgtgcagggcgaaatgagagtaccagaagaggccttaaaacacgaaaagtttacaattcagcttcaattgtctcagaagtccagtgaatctgagctcagcaagagctag

SEQ ID NO: 217862 - DNA, 267 bp, Artificial Sequence
  Description of Artificial Sequence: Synthetic coding sequence
atgtctctcactagctggtttttggtcagctcagggggtacgaggcacaggctgccaagagagatgatctttgtggggagggacgactgtgaactaatgctgcaatcaagaagcgtggacaaacagcacgcagttatcaactacgacgctagcactgatgaacaccttgtcaaggacctcggttccctgaatggtaccttcgtcaacgacgttcgtatccccgagcagacctatattacacttaaactcgaggacaagctccgctag

SEQ ID NO: 217863 - DNA, 336 bp, Artificial Sequence
  Description of Artificial Sequence: Synthetic coding sequence
atgagcctcacatcctggttcctcgtgagctcaggaggaacaagacaccgtcttcccagagaaatgattttcgtaggtagagatgactgcgaactgatgctgcagagccggtctgtggacaagcagcatgctgtgattaattacgatgcctcaaccgacgaacacctggtcaaggacctggggtcccttaatgggacttttgtcaacgacgtcagaattcctgagcaaacgtacataacattgaagctggaagataaactcagattcggatacgataccaacctgtttacagtggtccagggcgagatgagagttcccgaggaggccctaaaatag

SEQ ID NO: 217864 - DNA, 1407 bp, Artificial Sequence
  Description of Artificial Sequence: Synthetic coding sequence
atgagctcggaccaggagacttatagttgtaaaccacacggcagaactccgcttacttcagctgatgagcacgtgcactcaaagctggaggggagcaaggtcacaaaatctaagacctcaccagtggtgagtggctctagttcaaaatctaccacccttcctagaccacgcccaacccgcactagtctgttaaggagagctcgccttggcgaggcttccgattctgaactcgcggatgctgacaaggcctcagtggcctctgaggtttccactacatcatcgacaagcaaacctccaaccggcaggcggaacatatcccgcattgacttgctcgctcagccaagaagaacacgactcgggtctctcagcgcccgttcagactctgaggccaccatttcaagaagctcagcctcttcccgcactgcggaagcaattatccgcagcggagctcgcctggtgccgtccgataagttctctcctcgcattcgggctaacagtatttcccgactctcagatagtaaggttaaaagtatgaccagcgcccacggcagcgctagcgctctcaagacaacgcgcctgcagagcgcagggtcagcaatgcctacctcatccagttttaaacacagaataaaagagcaggaggattatatccgtgattggaccgcccatcgagaggaaattgctcggatctcccaggatcttgcattaattgccagggaaatcaacgatgtcgccggagagattgactccgtcactagctctggcacggctcctagtactaccgtgtcgacggcagctaccactcccggtagcgccattgatactcgggaagaggtaggggatttgcacggggaaatgcataagctggtagaccgtgtctttgacgagtcgctcaactttcgcaagatcccccctctcgtgcactccaagacacctgagggcaataacggcaggtctggggaccctaggccacaggcagccgaaccccctgatcatcttacgatcacccgcagacgaacctggtcacgagatgaggttatgggggacaatctcctgctctcttcggtcttccagttcagtaaaaagatacgacagtcgatcgataagacagcagggaaaattagaattttgtttaaagataaagatcgtaactgggacgatatcgaatctaagttgcgcgcagaatcggaggtgcctattgttaagacctcatctatggagatcagctccatcctgcaggagctcaaacgtgtcgagaaacagctgcaggcaatcaacgcaatgattgaccccgacgggacccttgaagctctcaacaatatggggttccccagtgctatgctcccatctccccctaaacagaaatcctcccccgtgaataatcaccattcgcccgctatgctgtag

SEQ ID NO: 217865 - DNA, 7160 bp, Artificial Sequence
  Description of Artificial Sequence: Synthetic coding sequence
atggagacccgttcccccggtctgaataatatgaagccgcagagcctgcagctcgtacttgaggaacaggtcctagcactccaacagcaaatggctgaaaaccaagcggctagctggcggaaactgaaaaacagtcaagaagcgcagcagcgccaagcaacactcgttcgaaaactgcaagccaaggtactacagtatcggagctggtgtcaggagctcgaaaaaagactggaggctacgggcggacctatcccacagcggtgggagaatgttgaagagccaaatctggatgagctcctggtccggctggaagaagaacagcagaggtgtgaaagcctggccgaggtgaacacccaacttcgactgcacatggagaaagctgatgtcgtgaataaggctctgcgcgaagatgtggaaaaattgacagtcgattggagtagggccagagacgagctcatgcggaaagagagccagtggcaaatggagcaggagttctttaagggatatctcaaaggggaacatggaagacttctctctttgtggagggaggttgtcacatttcggaggcactttctggaaatgaagtctgctacagatcgcgatctgatggaactgaaagcagaacacgtacggttgagcggaagcttgctgacctgttgcctgcggctcaccgtgggtgcccagtctcgcgaaccgaacggctcaggcagaatggacggccgagagcccgctcaattattgctcttactagccaagacccaggagctcgaaaaagaagcacatgagcgttctcaggaactgatccaactgaagtctcagggtgacctcgagaaggcggagctgcaggatagggttaccgagctctctgcgctgctgactcagagccagaagcagaatgaggactatgagaagatgatcaaggctcttcgcgaaacagtcgagatcctggagacaaaccacacagagctgatggagcacgaggcttctctctcccgaaatgcgcaggaagagaagctgtctctgcagcaggtaatcaaggacatcactcaggtcatggtcgaggaaggcgacaacatcgcccagggctccgggcatgaaaacagtctggagctggactcgtcgatcttttctcagttcgattaccaggacgccgacaaagcactcaccctggttcggagcgtgctgactcgcagaaggcaggctgtgcaagacctaagacaacagctggcagggtgtcaggaggctgttaatttgctgcagcagcagcacgatcagtgggaggaggagggaaaggcactgaggcaacgactccagaagcttaccggcgaaagggataccctagctggacagacggtggaccttcagggcgaggtggattcacttagcaaagagagagaactgctgcagaaagcaagagaggagctccggcaacagcttgaggtgctcgagcaagaagcatggaggctgcgtagagtgaacgtggaacttcagcttcaaggagacagcgcgcaggggcagaaagaggaacagcaagaggagctgcacctggccgtccgggaaagggaaagactgcaggagatgttgatgggactggaggcgaagcagagcgaatctttgagcgagctaataacactgcgagaggccttggagtcctcacatctggagggcgagctcctaagacaggagcagacggaggtgactgcggctctcgcgagggcggagcagtcgatcgccgagctgtcctctagtgaaaatacactgaaaactgaagtcgcagatcttcgggcagctgcagtgaagctctctgccctcaacgaagcactggctctcgacaaggtgggactgaaccaacagctgctgcagttagaagaggaaaaccagtcagtgtgttctcggatggaagctgccgagcaagctagaaatgcattacaggtagatctggcggaagccgagaaacgcagagaagctctctgggaaaagaacacccacttagaagcacagctccagaaggccgaggaggccggagccgaactccaagcagacctgcgggacatccaagaagagaaggaggagatacagaagaaattaagcgaatcaagacatcagcaggaagctgctaccacacaactagaacagctccaccaagaggcaaagcggcaggaggaggtcctggcacgggcagttcaggaaaaggaagccctggtcagagaaaaggcagccttggaagtcaggctgcaggctgtggagagggataggcaggacctggccgaacagcttcagggactcagctcggctaaggaactccttgagagttctctgtttgaagcccagcagcaaaactcggtcatcgaggttaccaagggccaattagaggtgcaaatccagaccgtcacccaagcaaaggaggttatccaaggcgaggtgagatgtctcaagctcgaactggatacagaaaggagtcaagcagaacaagagagagatgcagccgcacgccagttggcacaggccgagcaagaagggaaaacggcccttgagcaacagaaagctgctcacgagaaagaagtgaaccagctccgcgaaaagtggatgcaactcgaaacagagaaagagagggttagtctcctcgaaactctccttcagacccaaaaggagctggcggatgcgagccagcaacttgaacgcttgcgtcaggacatgaaggtgcagaaactgaaagagcaggaaactaccggaatcctgcagacccaactgcaggaggctcagagggaattgaaggaagccgcaagacagcatcgggacgacttggcagccctccaggaagagtctagctccctgcttcaggacaaaatggatctgcaaaagcaggtggaggacttaaaatctcagctggtggcccaggatgacagtcagagactggtcgagcaggaagtgcaggagaagctgcgagaaacacaagagtacaacagaattcaaaaggaactcgaacgcgagaaggccagtctcaccctgagtctcatggagaaggaacagcgcctgctagtgctccaggaagcggacagtatacgccagcaggaactctccgcgttacgtcaagacatgcaggaagcacagggggagcaaaaggagctcagtgctcagatggagctgctgaggcaagaagtgaaagaaaaagaagcagacttcttagctcaggaagcacagctgcttgaggagctggaggcgagccatattacggaacaacagctgagagcttcgttgtgggcccaggaggccaaggccgcacagctgcagctgaggttacggtctactgagagccaactcgaagctctcgctgctgaacagcaacccggaaatcaagctcaggctcaagctcagctggccagcctgtattctgctctgcaacaggcactgggttctgtgtgcgaaagtcggccagaattgtctggcggaggtgacagcgctccatctgtttggggcctggagccggaccagaatggcgctagatcgttgtttaaacgcggtccattgctgactgctctctccgcagaggcagttgccagcgcactccataagctgcatcaggatctctggaagacacaacagactcgtgatgtgctcagagaccaggttcagaagcttgaggaacggctcacggacaccgaggcagagaaatctcaggttcacaccgaactgcaagatctccaaagacagctgtcgcagaatcaagaggaaaaaagtaaatgggaaggaaagcagaactcactagagagtgaactgatggaactgcacgaaactatggcgtctctgcagagtcgccttcgcagagccgagcttcagcgaatggaagctcagggcgaacgtgaactcctccaggcagcaaaggagaacctgaccgcacaggtcgagcacctgcaagccgctgtagtggaagctagggctcaggccagcgccgcaggcatccttgaagaagacctcaggaccgctcggagtgcactgaaattgaagaacgaggaggtggaatcagaacgagagagggcccaggcactgcaggagcaaggtgagttaaaagtggcgcaggggaaagccctccaggaaaacctcgcacttctgacacagaccctagccgagagagaggaagaggtggagacactgagaggacagattcaagaacttgagaaacagcgggaaatgcaaaaagctgctctcgaactgctgtctctggatctgaagaagcggaaccaggaggtggacctgcaacaggaacagatccaggagctcgagaagtgcagaagtgttcttgagcacctccctatggcggtgcaagagcgggagcaaaagcttactgttcagagggaacagatcagggaattggagaaggatcgggagacccagcggaatgtcctcgagcaccaactgctggaactggagaaaaaggaccaaatgattgaatcacagcggggtcaggtgcaggacctgaaaaagcaactcgtcaccctcgagtgtctggccctggagctggaggagaaccatcataaaatggaatgtcagcaaaagctgataaaggaactcgagggccaaagggaaactcagcgcgtggctttgacacacctgacactcgatcttgaggagaggagccaggagttacaggcacagtcatctcagattcatgacctagaatcgcattctaccgtcctggcgagagagttgcaggaacgggatcaggaggtgaagtcccagagggaacagatagaagagctccagcggcaaaaggagcatcttacccaagacctcgaacggagagatcaggagcttatgctgcagaaagaacggattcaggtgttagaggatcagcgcacacggcagacaaagattcttgaagaggatctagagcaaattaagttgtccctgagggaacgcggtcgtgaattgactacacagaggcaactcatgcaggaacgagctgaagagggaaaaggccctagcaaggcacagcgcggttcccttgagcatatgaagctaattcttcgggacaaagagaaggaggttgagtgtcagcaggagcacatccatgaattgcaggaactcaaagatcagctcgagcagcagttgcagggactacaccgaaaggtgggcgagacaagcctgttgctcagccagagggaacaggaaattgtagtcctccagcagcaactgcaggaggctagagagcagggggagctcaaggagcagtctctgcagtcccagcttgatgaagcacagagagcactggcgcagagggaccaggaactggaggctcttcaacaggaacaacagcaagcccaagggcaggaagagagagttaaagagaaagcagatgccctacagggagctctcgaacaggcccacatgactcttaaggaacgccatggggagcttcaagatcataaagagcaggccaggaggctcgaggaagaactggctgtggaggggcgacgagtgcaggctctcgaggaggtcctaggtgacttgcgcgctgaaagtcgcgagcaagagaaagccctccttgctctgcagcagcaatgtgccgaacaggctcaggagcacgaggttgaaaccagagccctgcaggatagttggctgcaggcccaggctgtattgaaagagcgcgatcaagaactggaggccctacgggcagagtctcagtcgagccgccatcaggaagaagcagcacgggcaagggcagaggctctccaggaagccctgggaaaggcccacgcagctctgcagggcaaagagcagcacctcctggagcaggccgagctttcccgtagccttgaggccagtaccgctacattgcaggctagcttggatgcctgccaggcccattctagacagttagaagaggctctgcggattcaagagggagaaatccaagatcaggatctccgctatcaggaggatgttcaacagctgcagcaggccctcgcgcaaagagatgaggagttgcgacatcagcaggagcgggagcaactgttggaaaaatctttggctcagcgggttcaggaaaatatgattcaggaaaagcaaaacttgggccaggaaagagaggaggaagaaatccgtggcctgcatcagagcgtcagagaactccagctcaccctcgcgcagaaggaacaggaaatcctggagcttagagaaacgcaacaacggaataatttggaagccctgccgcactcccataagacttcacccatggaagagcagtcactgaagctcgactctttggagcctaggctgcagcgcgagcttgaacgtctacaggctgcactgcgccagacagaagctagggagattgaatggcgcgagaaagctcaggatctggctttatctcttgcccagaccaaagccagcgtctcatccctgcaggaagtggccatgttcctgcaggcttctgttctggagagagactctgagcagcaacggcttcaggatgagctcgagctcacgagaagagctttggagaaagaacgcttgcactctccaggcgctacatccactgccgaacttgggtcaaggggtgagcagggtgtacagctgggcgaggtctccggagtcgaggctgaaccttcccctgatggaatggagaagcagagctggagacagcgcctggaacacttgcaacaggctgttgcccgactggagatcgacaggtctaggctgcagagacacaacgtccagctccgtagcacactcgagcaagtggaacgggagaggcggaagttaaagagggaggctatgcgtgcagcccaagccggatcgttggaaatttcgaaagccactgcctcctctcccactcaacaagacggtcgaggacagaaaaatagcgatgccaaatgcgttgccgaactgcagaaggaggtggttcttttgcaggcccagttgacacttgaaaggaaacagaagcaggactatatcactagatccgctcaaacctcccgagagttggccggacttcaccactcgctgagccattcactactggccgttgcacaggccccagaggctaccgttctggaggccgaaacaaggcgattggacgaatcactgacgcagagtctgacttccccaggacccgtcttgctgcaccctagtccctcaaccacccaggctgcctctaggta

SEQ ID NO: 217866 - DNA, 1020 bp, Artificial Sequence
  Description of Artificial Sequence: Synthetic coding sequence
atggagaccagaagcccgggactcaacaacatgaaaccccagagcttacagcttgtcctcgaggagcaggtcctagctctccagcagcaaatggccgagaatcaggctgccagttggagaaagctgaagaattcccaagaagcgcaacagcgccaggcgaccctggttaggaagctccaggctaaggtacttcagtaccgtagttggtgtcaggagctggagaaacggctggaagctactgggggaccaataccacagcggtgggaaaacgtggaggaacccaatctggatgagctgctggtccgattggaggaggagcagcagagatgtgaatctctggccgaggtgaacacgcagcttcggctgcatatggaaaaagccgatgtcgtgaataaggccctgagagaggatgtcgagaaacttacggtggactggtcccgcgcacgggacgaattaatgcggaaagaaagccaatggcagatggagcaagaatttttcaagggttatctcaaaggggaacacgggaggctgcttagtttatggcgcgaggtggtcactttccgaagacacttcctggaaatgaaaagtgccaccgaccgagatctgatggaattgaaggcagagcacgtgaggctgtcaggttcgctgcttacctgctgtctgcggttaaccgtgggtgcccagtcaagagaacctaacggatcaggacggatggacggccgagagcccgcacaactcctcttgctcctggcgaagacccaagagctagagaaagaggcccacgagcgcagccaggaactgatccagctgaaatcccagggtgatctggagaaagcagaactccaggacagagtgacagagctgtctgctttattgacccagtcacagaagcagaatgaagattacgagaaaatgattaaagccctcagggagacggttgagatcttggtccatgaccctctcctgtggaagggcgtcggccgaggactggtgggatccctttgtttcatggaccggtag

SEQ ID NO: 217867 - DNA, 7328 bp, Artificial Sequence
  Description of Artificial Sequence: Synthetic coding sequence
atggaaaccagaagtcccggattgaacaacatgaaacctcagtcactgcaactggtgctcgaagagcaggtgttggccctgcagcaacagatggcagaaaaccaggccgcatcatggcgcaaactgaagaactcccaggaggcccagcagcgccaggctacgcttgtgcggaaattgcaggccaaagtgttgcaataccggagctggtgccaagagctggaaaagcgccttgaggcaacaggtgggcctataccccagcggtgggagaacgtggaagaacccaatttagacgaattactagtgagactggaagaggaacagcaaagatgtgaatcgctcgctgaagtgaatacgcagcttcgcttacacatggagaaggctgacgtcgtcaataaggcattgcgggaagatgttgaaaagctgactgtggactggtcccgagctcgggacgagctgatgcggaaagagagccagtggcaaatggagcaggagttttttaagggataccttaagggggagcatggaagactcttgtccctttggagagaagtggtgacctttcgtaggcactttctagagatgaaatctgcaaccgatcgagacctgatggaacttaaagcggaacacgttcggctgagcgggtctctcctcacttgttgcctgcgcctcactgtgggcgctcagtctagagaaccaaatggtagtggtcgtatggatgggcgagagcctgcccaacttctcttactcttagctaaaacacaggagctggagaaagaggcacatgagcgctcccaggagcttatccaattaaagagtcaaggagatctggaaaaggcggaacttcaagatagggtgacagagctatccgctttgctgactcagagccaaaagcagaacgaggattatgagaaaatgatcaaagcactccgggagactgtcgaaattctcgagacaaatcacactgagctcatggagcatgaggccagcttaagccggaatgcacaggaggaaaaactgagtctacaacaggtaatcaaggatatcacccaggtgatggtagaggaaggtgataacattgcacaagggagcggccatgagaactcacttgagttagattcatcaatcttttcgcaattcgattaccaggacgccgataaagccctgactttggtgagatctgtcctgacacggaggagacaggccgtccaggatttgaggcagcaattggctgggtgccaagaagccgttaacctgctccaacaacagcacgaccagtgggaggaagagggaaaagccctgaggcaacgcctccagaagcttacaggtgagcgggataccctggctggccagacagtggatttacaaggggaggtggatagtctctcaaaggagagagaattgttgcaaaaggccagggaagagctgcgccagcagctggaggtgctagagcaggaagcctggagattgcggagggtgaacgtggaattgcaactacaaggcgactcggcccaggggcagaaagaggagcagcaggaggagcttcatctggccgtgagggagcgcgagagactccaggagatgttgatggggctggaagcgaagcagtctgaaagtctttcggagttgattacactgcgagaggccctcgaatcgagtcatctggaaggagagctgctccggcaagaacagaccgaggtcacagctgccttggctagagccgaacagtccattgccgagttgtcttcttcagagaacacattgaaaactgaggtggccgatctgcgggcagcagctgtgaagctttctgcattaaacgaagctttggcattggacaaggttggtctcaaccagcaactgttacagctggaggaagagaatcagagcgtctgttctaggatggaagcggctgagcaagcacgtaatgccctccaggtcgacttagccgaagctgaaaagaggcgtgaagccttgtgggagaagaacacacacctagaggcacagctgcagaaggccgaggaagccggtgccgagctgcaggcagacctcagagacatccaggaggagaaggaagagattcaaaagaagctctccgagagccgccaccagcaagaagccgctacaacgcaattggaacaactccaccaggaggctaaacgacaggaagaggtactggctcgggcagtgcaagagaaagaagccctcgtgcgtgaaaaggctgccttggaagtaaggttacaggcagtggagagggatagacaggacctcgcagaacagttgcaaggactgtcttccgcaaaagaactcctcgagtctagcctgttcgaagcccaacagcagaactctgtcatcgaggtcactaaagggcaactcgaagtgcagattcagaccgtgacccaagccaaggaagttatacagggggaagttaggtgcttaaaacttgaattagatacagagcgcagccaggcggagcaggagcgggatgctgccgcacgccagctcgcccaggccgagcaggaaggaaagaccgccctggaacaacaaaaagccgcacacgagaaggaggtcaaccagttaagggagaaatgggagaaggagcggtcatggcaccagcaggaactggccaaggcgctcgagagccttgagagggaaaagatggagcttgaaatgagacttaaggagcaacagaccgagatggaggccatccaggctcagcgggaggaggagcgcactcaggccgaatccgccctgtgccagatgcagctggagactgaaaaggagcgagtgtcactgctcgagactcttttacagacccagaaggagctggcagatgcttctcagcagctcgagcgattacgccaagacatgaaagtccagaagcttaaagagcaggaaacgaccggcatcctacagacacagttgcaggaggcccagcgcgagctgaaagaggccgcacggcagcacagagatgacctcgcggctctgcaggaggaatcaagctctctcttacaggataagatggatctgcagaagcaggtggaggacttgaaaagccagcttgtggcacaggatgactcccagcgtctcgtcgagcaggaagtccaggagaaattacgcgaaacccaggaatacaacagaattcagaaggaactcgaacgcgagaaagcctctctaactttaagcctgatggaaaaagagcaaagacttctcgttctgcaggaggcagatagcatacggcaacaggagctgagcgcccttagacaggacatgcaggaggcgcagggtgaacagaaagagctgtctgctcagatggagctcctcaggcaggaagtgaaagaaaaggaagcggatttcctagcccaagaggcgcagctcctggaagaattggaggctagtcacataaccgagcagcagcttcgagctagcttgtgggcccaggaggcgaaagctgcacagctccagctgcgccttcggtcgaccgaatcccagcttgaagctttggctgctgagcagcagcccggaaatcaggcgcaggcacaggcgcagctggcatctctgtatagcgctcttcagcaggccctggggtcggtgtgcgagtcccggccagagctgagcggcggtggtgactcagctccttcggtgtggggcctcgaacccgatcaaaacggtgctcggtccctcttcaagcggggaccattactgaccgcattatctgccgaagccgtcgcctccgctctgcataaattacaccaggacctatggaagacacaacagaccagggacgtccttagggatcaagtgcagaaactggaagaaagattgacagatacggaggccgagaaatctcaggtgcacaccgagcttcaggatttacaaagacagctgagtcagaatcaggaggagaagagtaagtgggagggcaaacaaaacagtctggagtccgaactgatggagctgcacgagactatggcttcactccagagtcgcctccgaagggccgagcttcaacggatggaagctcagggagaacgtgagctcctccaggcagcaaaggaaaacctgactgctcaggtggagcacctacaggccgctgtggtcgaggctagagcacaagcatcggccgcaggcatcctggaggaagacctccgtaccgcacgttccgccctgaagctgaaaaacgaagaagttgaatccgagagagagagggcacaggcattacaggagcagggagaactaaaggtggcccaggggaaggccctgcaagagaacttggcactattgacgcagacactcgctgaacgcgaagaagaggtggagacgctgcgtggccagattcaagagctagagaaacagagggagatgcaaaaagccgctctggaactgctgtccttggacctcaaaaagcgtaaccaggaagtcgaccttcagcaggagcagatccaagaattggagaagtgcaggagcgtgttggagcacctgcctatggcagtacaagagcgagaacaaaaactgactgtgcagcgagagcagattagagagctggaaaaagaccgagaaactcagcgaaatgttctagaacatcagctgctggagttagaaaagaaagatcagatgatcgagagccagagggggcaggtccaggatctgaagaaacagctagtcacccttgaatgtcttgcattagaacttgaagagaatcatcacaaaatggagtgccagcaaaagcttatcaaggagctcgagggtcaacgcgaaacacaaagagtggctcttactcacctgacgctggatctagaggagcgtagtcaagagttacaggctcaatccagccagattcacgatctcgagtcccactctaccgtgctcgcacgtgagttgcaggaaagggaccaggaggttaaatcacagagggaacagattgaggagctgcagaggcagaaagagcatctcactcaggacctagaacggagggaccaagagctcatgctgcagaaagaaaggatacaggtcttggaagaccagaggactaggcaaacaaaaattctagaggaagatctagagcagatcaaactgtccctccgggaaagaggtcgggagctgacaacccagcggcagctgatgcaggaacgtgctgaggagggaaagggaccatcaaaagcacagcgaggttcgctggagcacatgaaattgattctgcgggacaaggaaaaggaggtagaatgtcagcaggagcatatccacgaactgcaggagttgaaggaccagctcgaacagcagttgcaggggctccaccggaaggtgggggaaactagcctattactcagccagagagagcaggaaatcgtggtccttcagcagcagctgcaagaggcacgagagcaaggcgagctcaaggaacagagcctccaatcgcagctggatgaagcacagagggctctggcccagcgtgaccaggaattagaggcactgcaacaagagcaacagcaggcccagggccaagaagaacgcgtgaaggaaaaagccgacgcactgcagggcgcactggagcaggcccatatgactcttaaggagcgccatggagaactccaggaccataaagaacaggccagaaggttggaagaggagctcgctgtggaaggtcggagggttcaagcccttgaagaggttctgggagacctacgcgcagagtcacgcgaacaggaaaaagctcttttggccctgcaacagcagtgcgctgaacaggctcaggagcatgaggtagagactcgggctctccaggactcctggctacaggctcaggccgtgttgaaagaaagagaccaggaactggaagccctgagagcagagtctcagagtagccggcatcaggaggaagccgcacgggctagggcagaggctctccaagaagctctgggaaaggcccacgccgcactccaggggaaggaacaacatctgctggagcaggcagaactgagccggagtctggaggcttctaccgccacactgcaggctagcctcgacgcctgtcaagctcacagccggcagctggaagaagcattacgcattcaggaaggtgaaatccaagatcaggatctccgctatcaggaagatgtccagcagttgcaacaggctctcgcgcagcgagatgaagagttaaggcaccagcaagaacgagaacaactgttagaaaagtccctcgcccagcgcgtgcaggagaacatgattcaagagaaacaaaacctcggccaggagcgggaggaagaggaaattcgaggcctccatcagagtgttcgggagctgcaactgacgcttgcccaaaaggaacaggagatccttgagctcagggagactcagcagcgtaataacctggaggccctgcctcactcccacaagacctctcctatggaagagcagtcgctgaagttggatagccttgagcccagactccagagagaattggaacggctacaggctgccctgaggcagacagaagccagggagatcgagtggagagagaaagcccaggaccttgccctatctctagcgcagactaaggcctcggtctcctcactccaggaagtagcaatgtttctacaggccagtgtgctcgagcgggattcagaacagcagcggctccaggatgagctggaactgacacggagagctctcgaaaaagaaaggttgcatagccctggtgcaacgtccaccgctgaactgggaagccggggagagcagggagtgcaattgggtgaagtttctggagtggaggctgagccgagccctgatggaatggaaaagcaatcatggagacagaggctggagcacctccagcaggctgtggcgaggctggagattgacagatccaggctgcagcggcataatgttcagttgcgctccaccctggaacaggtcgagcgcgagcgcaggaagttaaagagggaggccatgagggccgctcaggctggttctctggaaatttctaaagcaaccgcttctagtcccacccagcaggatggacggggacaaaaaaactcagatgctaaatgcgtggctgaactgcaaaaagaagtagtcctgttgcaggcacagctaactctcgagcgcaagcagaaacaagactacattactagaagcgcacaaacttccagagagcttgcaggtctgcaccactctctgtctcactctctgctagctgtagcacaagccccagaagctacagtcttggaggcggagaccaggcggctagatgagtctcttacgcagtccttgacatcacctggccctgtgttactgcacccgtcaccttccacaacgcaggcggcatcccgata

SEQ ID NO: 217868 - DNA, 345 bp, Artificial Sequence
  Description of Artificial Sequence: Synthetic coding sequence
atggaaacgagatctcctggcctgaataacatgaaacctcagagcctccagctggtgctggaagaacaagttttggctcttcaacaacagatggcagagaaccaggccgctagttggagaaaattgaagaactcccaagaagcccagcagcggcaagccacactcgtgcgcaagctgcaggccaaggtcctgcagtaccggtcttggtgtcaggagctcgaaaagagattggaagccactgggggaccaatccctcaacggtgggagaatgtagaggagccaaacctcgatgaattgctggtgagattggaggaggagcaacagcgatgtgaaagcttagcgtag

SEQ ID NO: 217869 - DNA, 2055 bp, Artificial Sequence
  Description of Artificial Sequence: Synthetic coding sequence
atggaaacccggtcccctggcctgaacaatatgaagccacagtcactgcagctggtcctggaggagcaggtgctagccctccagcagcaaatggccgagaaccaggcagccagctggagaaaactcaagaattcccaggaggcccagcaaagacaggcaaccctggtcaggaaacttcaagctaaggtgttgcagtatcggagctggtgtcaggagctggaaaagcggcttgaagcaacaggcggtcccataccacaaaggtgggaaaacgtggaggagcccaaccttgatgaactgctcgtgcgcttggaagaggaacaacagaggtgtgagtcacttgctgaagtaaacacgcaactcagactccatatggagaaagccgacgtagtcaacaaggcccttagagaggacgttgagaaactcaccgtagactggtcccgcgctagggatgagcttatgcgtaaggagtcacaatggcagatggagcaagaatttttcaagggctacctgaaaggggaacatggcaggctgcttagtttgtggagggaggtcgtcacgtttcgaaggcattttctcgagatgaaatcagcgaccgacagggacctcatggaactgaaggcagaacacgtgaggctttctgggtcattactgacttgctgtttgcggctcacagtcggagctcagagccgggagccaaacggctccggtcgcatggatggacgcgagccagctcagcttcttcttttactagcaaagacccaggaactcgagaaggaagcacatgaacgatcacaagagttgattcagctgaaaagccagggcgatctggagaaggccgaactccaggaccgtgtgaccgagttgtcagcactgttgacacaatctcaaaagcagaacgaggactatgagaagatgatcaaggcgcttcgggagacagttgagatccttaccaaccacaccgaattgatggagcacgaagcctccctgagccggaatgcccaagaagaaaagctctcactccagcaggtgattaaagacatcacccaggtgatggtagaggaaggcgataacattgcacaggggtccggacatgagaattccctggaactggattcctctatcttctcacagttcgactaccaggacgccgataaagctttaacactcgtacgttccgttctcacacggcgtcgacaagcagtccaagatctgcgccaacagctggcgggttgccaagaggctgttaatcttttgcagcaacaacatgaccagtgggaagaggaaggaaaagctctgaggcaaaggctgcaaaagctaacaggcgaacgtgacactctcgcgggtcagacagtcgatctgcagggagaagtggactctctgagtaaagaacgggagctgcttcaaaaagctcgcgaagagctgcgacagcaactcgaggtccttgaacaagaggcctggaggctgcggagggtgaatgtggagctgcaactgcagggcgacagcgctcagggccagaaagaggagcagcaagaggaacttcacttagcagtgcgcgagcgcgagaggctacaagaaatgctgatgggactcgaggcaaagcagagcgagtctttgtctgagcttatcaccctgcgcgaggctttagagtccagtcacctggagggcgagcttctgcgccaggagcagacagaggtcaccgcggcactcgccagggccgagcagagcatcgcagagctgtcatcctccgaaaacacgctcaaaacagaggtggccgacttgcgagcagcagctgtgaaattgtcagcccttaacgaggcactggcgctggataaagtcggactcaaccagcagctactgcaactggaagaagaaaatcagagcgtgtgttcccgaatggaggctgcagaacaggccagaaacgccctgcaggttgatctagcagaagcagaaaagagaagggaagctttatgggagaaaaatacacatctggaggcacaactgcaaaaggctgaggaggctggcgctgagcttcaagccgacctcagagacatctag

SEQ ID NO: 217870 - DNA, 495 bp, Artificial Sequence
  Description of Artificial Sequence: Synthetic coding sequence
atggaaactcgatcacccggattgaataacatgaagccacagtcattgcaactcgtgctagaggagcaagtgctggcgctgcagcagcaaatggcggagaaccaggccgcaagctggaggaagctcaaaaactctcaagaagctcagcagaggcaggccacccttgtgcgcaagctccaggccaaggtcctgcagtataggagttggtgtcaagagcttgaaaaacgactcgaagctacagggggaccaatcccgcagcgatgggagaatgtggaggagccaaacctcgacgagctcctggttcggctagaggaagagcagcaaaggtgtgaatctttggcagaagtgaacacccagctgaggttacacatggaaaaggctgacgtagtaaacaaggcccttagggaggacgtcgaaaaactgaccgtggactggagcagggcgagggatgaactgatgagaaaagaaagccagtggcagatggaacaggaatag

SEQ ID NO: 217871 - DNA, 1617 bp, Artificial Sequence
  Description of Artificial Sequence: Synthetic coding sequence
atggaaacacggagcccagggctcaacaacatgaaaccccaaagcctgcagctggtgctggaggaacaggttctcgccctacaacaacagatggccgagaaccaggccgcttcctggaggaaactcaagaactctcaagaggcccagcagcggcaggccaccctcgtgaggaagttgcaggcaaaagtcttacaataccgcagctggtgccaggagttggagaagaggctggaagcaaccggcggacctatcccacagcggtgggagaatgtggaggagcccaacctggatgagctactggtacgacttgaggaagagcaacagagatgcgagtccctggcagaagtgaacacccaacttagacttcacatggaaaaggccgacgttgttaacaaagctctcagggaggacgtcgagaagctcacagtcgattggagtcgtgccagagatgaactgatgcgcaaggagagtcagtggcaaatggaacaggaattttttaagggctacctcaagggggagcatgggcgtcttctgagcctttggcgggaggtcgtgacttttcgcagacatttcctggagatgaaatctgctacagatcgcgatctgatggaactcaaagcagagcatgtgagattgtcagggtctctgctgacctgctgcctgcgattaacagtgggcgctcaatcccgagaacctaacggctctggaagaatggatggtcgggagcctgcccagctgctgcttctgcttgctaagactcaagagttggagaaggaagctcatgagcgctcacaggagctcatccagctaaagtctcagggggatctggaaaaggccgagctccaggacagagtgactgagttgtcagcactgctgacacagtctcagaaacaaaatgaggactacgagaagatgatcaaagccctgagagaaaccgtggagatcttagagacgaatcacactgagctgatggagcatgaggccagcctttctcgcaatgcccaggaagaaaagctgagcttgcagcaagtgattaaagacattactcaggtgatggtcgaggagggcgacaacatcgcccagggatccggtcacgaaaattcccttgaattggacagcagtatcttctctcagttcgattaccaggatgctgataaggctctgaccctggtacgcagtgttctaactcgaagaaggcaagcagtccaggacctccgccaacagctggcaggctgtcaagaggctgtgaatctgttgcagcaacagcacgatcagtgggaagaagagggcaaggccctgaggcagcggctgcagaagttgactggcgaaagagatacactcgcaggacaaacagtggatctccagggcgaggtggacagtctttcgaaggaacgcgaactgctgcagaaggcccgagaagagttgcgacaacaactcgaagttcttgagcaggaggcatggcgtttgcgaagagtgaatgtggagcttcaactgcagggcgattccgctcagggacagaaggaggaacagcaggaggagctccacctggccgttagagagagggagaggctgcaatcgtcccagcttcagagctgccgagttttaaagaccccttag

SEQ ID NO: 217872 - DNA, 7445 bp, Artificial Sequence
  Description of Artificial Sequence: Synthetic coding sequence
atgccgcctaatattaactggaaggagattatgaaggtggaccccgatgatctcccaagacaggaagaactcgccgataatttactcatctctctttcaaaagtggaggtgaatgaactcaaaagtgagaagcaggaaaatgtgatccatctatttagaattactcagtccttgatgaagatgaaggctcaagaagtggagttagcgctggaagaggttgaaaaggccggtgaggagcaggcaaagttcgagaaccagcttaaaaccaaagttatgaaacttgaaaatgaactggaaatggctcagcagtctgctggagggcgtgacacaagattcctgagaaatgagatctgccagctagagaaacaactcgagcaaaaagaccgggaattagaggacatggagaaggagctcgagaaagagaaaaaagtcaatgagcagctagccttacggaacgaggaagcagaaaatgaaaactccaagctgcgccgtgagaacaaacgactcaagaagaagaatgagcaactctgccaagacattattgactatcaaaagcagattgactcacagaaagaaaccttgctgtcacgcagaggtgaggatagtgactaccggtcacaactatcaaagaaaaactatgagctgatccagtacctggacgaaattcagacccttacggaggcaaacgagaagattgaagttcagaatcaggaaatgagaaaaaatctggaagagagtgtacaggagatggagaaaatgaccgatgagtacaacaggatgaaagctattgtgcaccaaactgataatgtgatcgatcagctaaagaaagagaatgaccactatcagctccaggtgcaggaactcacagacctacttaaatcaaagaacgaggaggacgatccgatcatggtggcagtgaatgcaaaagtcgaggagtggaaacttattctctcatcaaaagatgacgagattatcgagtatcaacagatgctgcacaatttaagggagaagctcaagaatgcccagctggatgccgataagtccaatgtgatggccttgcagcaggggattcaggaaagagactcccagattaagatgctaactgagcaggtcgaacagtacaccaaggagatggagaaaaacacctgcattatagaggacctgaaaaatgaactccagcgtaataagggcgcaagtaccttatcccagcagacccatatgaagatccagagtactctagacatcctgaaagagaagacaaaagaggccgaaagaaccgccgagctggctgaggctgacgcaagagagaaggacaaagagctggtcgaggccttgaaaaggctgaaggactatgagagcggtgtttacggcctggaggatgcagttgtggagataaagaactgtaagaaccaaatcaaaatcagagacagagaaattgagatcttgaccaaagagataaacaaactggaattgaaaatctccgacttcctggacgaaaacgaggccttgcgtgaaagagtgggattagagccaaagaccatgattgatctcaccgagttccggaacagtaaacatcttaagcagcaacagtaccgcgcagagaatcagattctgttgaaggaagcatcgatcgaaagtctagaggaggaacgcctcgacctaaagaaaaaaatccgacagatggctcaggaaaggggaaagagaagcgctacatcaggtttgaccacggaggacctaaacctgactgagaatatttcccaaggcgatagaatatctgaacggaagctagacctgctgtctttaaaaaacatgtctgaagctcagagcaagaatgaattcctgtcaagagaactcatcgagaaagagcgcgatttggaacgttccaggacagtgatcgccaagttccagaacaagcttaaagaactcgttgaggaaaataagcagctggaggagggtatgaaagagatcttacaggcaattaaggagatgcagaaggaccccgacgtcaagggcggagaaacatccttgataatccctagcttggagcggctcgtcaacgcgatcgagagcaagaacgcagagggcattttcgatgcttccctgcatctgaaagcgcaggtcgatcaactcactggacgcaatgaggaacttaggcaggaactgcgcgagagccggaaggaggctattaactacagccaacaacttgctaaagcgaacttgaagatcgaccatcttgaaaaagagacatctctgttgaggcagtcagaaggatcaaatgtggtgtttaaagggatcgatctgcccgacggaatcgccccaagcagcgcatctattataaacagtcaaaatgaatacttgatccacctccttcaggagctggagaacaaagagaagaagttaaagaatttggaggactctttggaggactataatcgaaagtttgccgttattcggcaccagcagagcctcctgtacaaggaatacttgtcagaaaaggagacctggaagaccgaatcaaagactataaaggaagaaaaacgcaagctggaggaccaggtgcagcaagatgccattaaggtcaaggagtacaataacctgctgaatgccttgcagatggattccgacgagatgaagaagatactggctgaaaactctcggaagattaccgtgctgcaagtcaatgagaagtctctaatccgacaatacaccaccctcgttgagctggagagacagttgcggaaggaaaacgagaaacagaagaacgagctcttatctatggaagctgaggtttgtgagaaaatcggttgtctgcaacggtttaaggagatggctatctttaagattgcagctttacaaaaggtggtggacaacagcgtgtcactatctgaactcgaacttgctaacaagcagtacaatgagctcactgccaaatatagagatattcttcagaaggataatatgctcgtgcagcggacgtctaaccttgagcatcttgaatgcgagaacatctctctaaaggagcaagtagaaagtatcaataaggaactggagatcaccaaagaaaagctccatacaattgaacaggcctgggagcaagaaaccaagctgggcaacgagagcagcatggataaggcaaaaaaatctattaccaactctgacattgtctccatctctaaaaagatcaccatgctagagatgaaagagctcaatgaacgacagagagctgaacattgtcaaaaaatgtacgaacacctgagaacaagtctcaaacagatggaagagagaaattttgaactggaaaccaaatttgccgagcttacaaagatcaacttggatgcgcagaaggttgaacagatgctccgtgacgaactggccgattccgtgtccaaagcagtgagcgatgccgatagacagagaatcctggagctggaaaaaaatgaaatggagctgaaggttgaggttagcaagctccgcgagatcagcgacattgccagacgtcaggttgagattttaaacgcacaacagcaatcacgtgataaggaggtcgaaagtctgcggatgcagttgttagactaccaggcgcagagtgatgagaaatcgcttattgcaaaactgcaccaacacaacgtcagcctgcagctgagtgaagcaacagctctggggaaactagaaagcataaccagtaagttgcagaagatggaggcatacaacctgagattagaacagaagctagacgagaaggaacaggccttgtattatgcacggcttgagggcagaaatagggcaaagcatctacgtcaaacgatccagtccctgcgccgacagtttagtggagctctgccccttgctcagcaggagaagttcagcaagaccatgatccaactgcagaatgacaaactgaagattatgcaggaaatgaaaaattcacagcaggagcaccgcaacatggaaaacaaaactcttgaaatggaattgaagctgaaggggctagaggaactgatctccactctgaaggataccaagggagctcagaaagtgattaactggcacatgaagatcgaggaactgaggctccaggaactgaaactcaatcgggagctcgtgaaagacaaggaggaaattaagtatcttaataacattatcagtgaatacgagcggaccattagctctctagaagaagaaatcgtgcagcagaataagtttcacgaggagaggcagatggcctgggatcagcgcgaggtagatttagagcggcaactggatatttttgacagacaacagaacgagatactcaacgccgcacaaaagttcgaggaagccaccggatcgatcccagatccctctctgccacttcctaaccagttggagattgccctccgcaagattaaagagaatatccggatcatattggaaacacgggctacttgtaaatcactggaagagaaactcaaggagaaagagagtgctctgcgattagccgagcaaaacattctatctcgcgacaaagtgataaatgaactgagactaagactgccggcaactgccgagcgcgaaaagctaattgccgagttgggcagaaaggaaatggaaccaaaaagccaccataccctcaaaatcgcccaccaaacaatcgccaacatgcaggcacgccttaatcagaaggaggaggttctcaaaaagtatcaacggctgctggaaaaggcaagggaggaacagcgcgaaattgtgaaaaaacatgaggaggaccttcacattctgcatcaccggctggagcttcaggctgacagttccctcaataaatttaaacagaccgcgtgggaccttatgaaacaaagccctacgcctgtgcccaccaataagcacttcatcaggctggctgaaatggagcagaccgtggccgaacaggacgattcgctcagcagcttgttagtaaaattaaagaaagtttcccaggatctggagcgacagagagagatcaccgagcttaaagtgaaggaattcgagaacattaagctccagctgcaggaaaaccatgaggatgaggtgaaaaaggtgaaagctgaagtcgaggatctaaaatatttattagaccaatcccagaaggaatctcagtgtctgaaaagcgagctgcaggctcaaaaagaggctaactctagggccccaactacaactatgcgcaatctggtggagcggctgaagtctcaactcgcgttgaaagagaagcagcagaaggcattgagcagggcgctgctcgagctgagagcagagatgacagcggctgccgaagaacggatcatctcagctacctcccagaaggaagcacacctgaatgttcagcaaatagtcgatcgccataccagagaacttaagacacaggtagaggatcttaacgagaacctactcaaactcaaagaggctttaaagacatcaaagaatcgcgagaatagtctcaccgataacctcaacgacctgaataatgaactgcagaaaaagcagaaagcttacaataaaatcttgcgggaaaaagaggagatcgatcaggagaacgatgaactgaaacgccagatcaagcgcctgacttccggactgcaggggaaaccacttacagacaacaaacaaagcttgatagaggaattgcaaagaaaagtcaaaaagttagaaaatcagttagaagggaaagtcgaggaggtggatttgaagccgatgaaagagaagaacgcaaaggaggagcttatcagatgggaagaagggaagaaatggcaggccaaaatcgaaggaatccgtaacaagctgaaggaaaaagaaggcgaggtttttacactcacgaaacagctcaataccttgaaagacctctttgctaaagccgacaaggaaaaactaacattgcagaggaaactcaagacaactgggatgacagtggatcaggtgcttggcatccgggctctcgagtctgagaaggaacttgaagagctcaaaaaacgcaatctcgacctggagaatgacatcctctacatgagggcccatcaagcactgcccagagattctgtcgtagaggatctccatttgcaaaaccggtacttacaggaaaaactgcatgccttggagaagcagttctcaaaggatacgtattccaaaccctctatctcaggaatagaatcagacgatcattgtcagagagagcaggaactccaaaaggaaaacctgaagctctcatcagaaaacatagaactgaagttccagctggagcaggccaataaggatctgcccagactgaaaaaccaggttagggacctcaaagaaatgtgtgagtttctaaagaaggaaaaagccgaagtccagcgcaagctgggacatgtgcgtggcagcgggagatcagggaagaccattcctgagctggagaaaactatagggcttatgaagaaggttgttgagaaggtacaacgggagaacgaacagctcaagaaagcttctggcatacttacatctgaaaagatggctaacatcgaacaggaaaacgaaaagctgaaggctgagctggagaagctcaaggcgcatttgggccatcagcttagtatgcactacgaatcaaagacaaagggcaccgagaagatcattgccgagaatgaaagactgcgaaaagagctgaaaaaagaaacagatgctgcagaaaagctgagaattgcaaaaaacaacttagaaattcttaatgagaaaatgacagtacagcttgaagagacaggcaagcgtctgcagttcgctgaatcacggggtccccagctggagggcgctgacagcaaaagctggaaatcgatagtcgtcaccagaatgtacgagaccaaattgaaggaactggaaaccgacatcgcgaaaaaaaatcagtcaataactgatctaaaacagttggttaaagaagctacggagcgagagcagaaggtgaacaagtacaatgaggacctggagcagcagataaagattctgaagcacgtccccgaaggggctgagactgaacagggtctgaagagagagttgcaagtgctgcggttggctaaccatcaattggataaagaaaaagctgagttaattcatcagattgaagctaacaaagaccagtcaggcgctgagagcacaatcccagacgctgatcagctcaaggaaaagattaaagatctggagactcagttgaaaatgtccgatttggagaagcagcacctaaaggaggaaattaaaaaattgaagaaagagcttgaaaattttgaccccagcttcttcgaggagattgaagacctcaaatacaactacaaggaggaggtgaagaaaaacattttgttagaggaaaaggtcaaaaagttgtccgagcagttgggagtcgagctcacaagccccgtggcagcaagcgaggagttcgaagacgaagaagagagtcccgtgaactttcctatctacta

SEQ ID NO: 217873 - DNA, 4620 bp, Artificial Sequence
  Description of Artificial Sequence: Synthetic coding sequence
atggccatctttaagatcgctgccctgcagaaagtcgtggacaactcagtgtctctttccgagctggaactcgccaacaagcagtacaatgagctgactgctaagtatagggacatcctccagaaggataacatgctggtgcagcgtacatcaaatttggaacacctggaatgtgaaaacatctcactcaaagagcaagtggagtcgattaacaaggagctagagatcaccaaggagaaactgcatactattgaacaagcttgggagcaggagaccaaattagggaacgaatcttctatggacaaagcaaagaaaagcattaccaattctgatattgttagcatttctaaaaaaattaccatgctggagatgaaagaactgaacgagcgtcagagagcagagcattgtcagaaaatgtatgagcacttgagaacgtcactgaagcaaatggaagagagaaatttcgagctggaaaccaagttcgccgagctgacaaaaatcaatcttgacgcacaaaaggtggaacagatgctgcgggatgagctggccgactctgtcagtaaggctgtttcagatgccgaccgccagagaatcctggagttggagaaaaatgaaatggaactcaaggtggaagtgtccaaacttagggagataagcgacatcgcgcgtaggcaggtggaaatcctgaacgcccaacagcagagccgggataaagaggtggagtccctccggatgcagctcctggactatcaagcacagtcagatgaaaaatccctgatagccaagttacaccagcataatgtgagtcttcagctatccgaggcaactgcgctgggaaagctcgagagtataaccagtaagctgcaaaaaatggaagcttacaacctacgcttggaacagaagctcgacgaaaaggaacaggccctttattacgctagactggaaggtcggaacagggccaagcacctgaggcaaaccattcagtccctgcgcaggcaattctcaggcgctcttccccttgcccagcaggaaaagttctccaagactatgattcaactgcagaacgacaagctgaagatcatgcaggaaatgaagaattcacagcaggaacacagaaatatggaaaacaagaccctggaaatggagctgaagctcaaggggttggaggaacttattagcacactcaaagataccaaaggcgctcagaaggtgatcaactggcatatgaagatagaggagctgcggctccaggaattaaagctgaatagggagctggtgaaggacaaagaagagatcaaatacctaaacaatatcatctcagaatatgaaagaaccatatcctcattagaagaggagattgttcagcaaaataaatttcacgaggaaaggcagatggcctgggaccagcgggaggtggatctggaaaggcaactggacatttttgatcgacaacagaatgaaatcctgaacgcagcccaaaaattcgaggaggccaccggtagcatcccagatcccagtctgcccttacccaatcaactcgagattgcacttcgtaagatcaaggaaaatattcgcattatcctggagacccgtgctacatgcaagtctctggaggaaaaactaaaagaaaaggagtcagcattgaggttggctgaacagaatatcttgtcaagggacaaggttattaacgaactgagactgcgcctcccagccacagcggaacgcgaaaaactgatcgctgagttaggaaggaaggagatggaacccaagtcacatcacacacttaagatcgctcatcagactatagccaacatgcaggcacgcctgaaccagaaggaggaagtgctgaaaaagtatcagcggctcctggagaaagcgagagaggagcagagggaaatcgtgaagaaacacgaggaggatcttcacatactccaccatcgactcgagctacaggccgatagctcactcaacaagtttaagcaaactgcctgggacctcatgaagcaaagcccaactccagtgccgacgaataagcacttcatccggctggctgaaatggagcagaccgtcgccgagcaggatgactctctgagcagcttgctagtgaaactgaaaaaggtttcccaggacctagagcgacagagagagatcactgaactcaaggtgaaagagtttgaaaacatcaaactgcaacttcaggaaaatcacgaggacgaggttaagaaggttaaggcagaggtggaggacttgaaatacctgttggatcaaagccagaaggaaagtcagtgcctcaaatccgaattacaggctcagaaggaagcaaactcaagagcccctaccaccactatgagaaacctcgtggaaagacttaaaagtcagttagccttaaaggagaagcagcagaaagcattaagtagggctctcctggaattgcgcgcagagatgacagccgctgccgaggaaaggataatctctgccactagtcaaaaggaagcccatctaaacgtgcagcagatagtggaccggcatactcgggaactgaagacacaggtcgaggatttgaatgaaaacctgttgaaactgaaggaggcattaaagacttcaaaaaacagggagaattctctgaccgacaacttgaatgacttgaacaacgaattacaaaagaagcagaaagcttacaataagatcctgagagagaaggaagagattgaccaagaaaacgatgagctgaaaagacagattaaacgcctcacatccggcctccagggcaaacccctgaccgacaataagcaaagcttgatcgaggagctccagcggaaggtgaaaaagctcgagaatcaactggagggtaaggtggaggaggtcgatctgaaaccaatgaaagaaaaaaatgcaaaagaagagctcatccgttgggaagagggaaagaaatggcaggccaagattgaaggaatcagaaacaaactaaaagaaaaggagggcgaggtgttcaccctcaccaaacaacttaacacccttaaagatctgtttgcaaaagccgacaaggaaaaactgacactgcagcgcaaactgaagaccacagggatgaccgtggaccaggttctaggaattcgcgctttggaaagcgaaaaagaactcgaggagttgaaaaaacggaacttggaccttgagaacgacatattgtatatgagagcacatcaggccctcccacgcgactcagtcgttgaggaccttcacctccagaacaggtacctgcaggaaaagctgcacgctttggaaaagcagttttcaaaggacacatactctaaaccatccataagcggcatcgaatccgacgatcactgccagcgcgaacaagaactgcagaaagaaaatctgaaactatcatctgagaatatcgagttgaaatttcaacttgagcaggccaacaaagacttacctcggcttaagaaccaagtgcgcgacctcaaagagatgtgcgaattccttaaaaaggagaaggccgaagtgcagagaaagctagggcacgtccggggttcaggaaggagtggcaaaactatacccgaacttgagaagacaataggcctcatgaaaaaggtcgtcgagaaggttcagagggagaatgagcagctaaaaaaagcatccggaattttgaccagtgaaaaaatggctaacattgagcaggagaacgagaagctcaaggctgagctggaaaagctgaaggctcacctgggacatcagttgtctatgcactacgagagtaagactaaagggacggaaaagatcatcgcagagaacgaacggttgaggaaagaactgaagaaagagacggatgctgcagaaaaactgcgcattgccaagaacaatctggaaatcctaaacgaaaagatgacggtgcagttggaagagacaggaaagcgtctgcagtttgcagaatccagagggcctcaactggaaggggctgatagtaaaagctggaaatctattgtggttaccaggatgtacgagaccaaactgaaggaactggaaacagacattgccaagaagaatcaatcaattactgatttgaagcagctcgttaaggaagcaaccgagcgtgagcaaaaggtgaacaagtataacgaagatctggagcagcagattaagatcctgaaacacgtgcccgaaggggctgaaactgagcagggcctgaaacgggagcttcaggttctccgacttgccaaccatcagctcgataaagagaaggcagagttgatacaccagatcgaggcgaataaagaccagtctggagcagagtccacgatccccgatgccgaccagctcaaagagaagataaaggacctcgaaactcagctgaagatgagcgacctagagaagcaacacctgaaagaggaaattaagaagctgaaaaaagaattagaaaacttcgatccctcatttttcgaggagattgaagatttaaagtacaattataaggaggaggttaaaaaaaacatccttctggaggaaaaggtaaagaagttgagcgagcagctgggagttgagttaacatctcccgtggccgcatcagaagaatttgaagatgaagaggagtctcctgtcaatttccccatctattag

SEQ ID NO: 217874 - DNA, 2415 bp, Artificial Sequence
  Description of Artificial Sequence: Synthetic coding sequence
atgcctcccaatataaactggaaagagatcatgaaagtggaccctgacgaccttcccaggcaagaagagttggccgacaatctgcttatttccctctccaaggttgaggtgaatgaactcaagtccgagaagcaagaaaacgtgattcacctcttccgcattactcaaagcctgatgaaaatgaaggcacaggaagtggaattggcgctggaggaagttgagaaagcgggtgaagagcaggctaaatttgaaaatcagctgaagacaaaggttatgaaactggaaaatgagctggaaatggctcaacagagcgcaggcggacgagacaccagatttctccgcaacgaaatctgccagcttgagaagcagctagaacagaaggaccgggaactggaagatatggaaaaagaactcgaaaaagaaaaaaaagttaacgaacagctggctctcagaaacgaagaggccgaaaatgagaactccaagcttagaagggaaaataaaaggctgaagaagaagaacgaacagctctgtcaggacattattgattatcagaaacagatcgattctcagaaggaaactttgctctcaagaagaggcgaagatagcgattacaggtcccaactgagcaagaaaaactacgaactgattcagtacttagacgagatccaaacattaacagaggctaacgagaagatagaggtccagaaccaggagatgagaaaaaacctggaagagtcagtgcaagagatggaaaagatgactgacgagtataacagaatgaaggctatcgtccatcagacagataatgttatcgatcagttgaaaaaggaaaatgaccattatcagttgcaggtgcaagagctcacagacctgctaaaatcgaagaacgaagaagacgatccgatcatggttgctgtcaatgccaaggtggaggagtggaagttgatcctcagctccaaagacgacgaaattattgagtatcaacagatgcttcacaacctgagagaaaaactgaagaatgctcagctcgacgcggataagagtaatgtgatggcactgcagcaaggtatacaggaacgggacagtcagatcaaaatgctcacagagcaggtggagcaatatacgaaagaaatggaaaaaaacacctgtatcatcgaagacttaaaaaacgagctccagcgtaacaaaggagccagtactctctcacaacagactcatatgaagattcagagtaccctcgacattctcaaggagaagacaaaggaggcagagagaaccgccgaactggcagaggctgatgccagagagaaagacaaagagttggttgaagctctgaagagactaaaggactacgaatctggtgtctacggactggaggatgccgtggtagaaattaagaattgtaaaaaccaaattaaaatcagggaccgggagattgaaatcctgactaaggagatcaacaagctagagctgaaaattagcgacttcctggacgagaacgaggccctgagggagcgtgtgggcctagaacccaaaacaatgatcgatctgaccgagtttaggaacagcaaacatctgaaacagcagcaatacagggccgagaatcagatcctcctgaaggagattgaaagtctggaggaggagaggctcgatcttaagaaaaaaattcgacagatggcccaagaacgaggaaaacggtccgcaacaagcggacttacaaccgaagacctcaacctaacagagaacatttcacaaggggacagaatctcagaacggaaactggaccttctctcgctcaaaaacatgtccgaagctcaaagcaagaatgagttcctgagccgtgagctaattgagaaggaacgagatctggaacgcagtcgcacagtaatcgccaaattccagaacaagctgaaagaactcgtagaggaaaataaacagctggaggagggaatgaaagagatcctgcaggctattaaagaaatgcagaaggaccccgatgtaaagggcggagaaacctcacttatcattcctagcctcgaaagattagtgaatgcaatcgagtccaagaacgcagagggaatctttgacgccagcctgcacctcaaagcacaggtggaccagctgacaggccgtaacgaggagctaagacaggaactgagggaatcccgcaaagaggcgataaactattctcagcagctggcgaaagcgaacctgaagattgatcatttggaaaaagaaacctccctgctgaggcaatctgaaggatccaacgtggtatttaagggaatcgacctgcctgatggtattgcgccttcaagcgccagtatcattaactcccagaatgagtatcttattcacctgctgcaggaactggaaaacaaagagaaagtcaaggaattcaggcgcttctcctag

SEQ ID NO: 217875 - DNA, 1650 bp, Artificial Sequence
  Description of Artificial Sequence: Synthetic coding sequence
aagatggctcaacaatctgccggtggcagagacactcggttccttaggaacgaaatatgtcagctggaaaaacagctggagcagaaggacagagagttggaggatatggagaaagaactggagaaggagaagaaggtaaacgagcagctagcgttgcgcaatgaagaggcggaaaatgaaaactctaagctgcggagggagaataagagattgaagaagaagaacgagcagctctgtcaggacatcatcgactatcagaagcagattgactcacagaaagagaccctgctgagtagaaggggcgaagactcagattatcggagccagctctctaagaagaattacgagttgatccagtacttagatgagattcagactcttacggaagcgaatgaaaagatcgaggttcagaatcaagaaatgagaaagaacttggaggagagtgtacaggagatggaaaagatgactgatgaatataaccggatgaaggcaatagtgcaccaaacagacaatgttatcgatcagctcaaaaaggaaaacgaccattatcagttgcaggtacaggagcttaccgacctgcttaagagcaagaacgaagaagatgacccgattatggtggccgtgaacgccaaggtggaagaatggaagcttatactgagctctaaggatgacgagataattgagtaccagcagatgctccacaacctcagggaaaagctgaagaatgcacagctggacgccgacaaaagcaatgtgatggccctccagcagggcatccaggaacgtgactcccagattaagatgctgacagagcaggtcgagcaatataccaaagaaatggaaaaaaatacgtgtattatagaagatttgaaaaacgagctccagcgtaataagggagcctccaccctcagccaacagactcacatgaagattcagagcaccctggacatcctaaaagagaagacaaaagaggcggagcgcactgcagagctcgctgaagctgacgctcgtgagaaggacaaagagctcgtcgaggcactaaagagactgaaggactatgaatctggggtgtacggccttgaggatgcggtcgtggagattaaaaactgtaaaaaccaaatcaagatcagagacagggagatcgagatcctgacaaaggaaattaacaaactggaactaaagatatcagattttctcgatgagaatgaagctctgagggaaagagttggacttgaacccaagaccatgattgatcttaccgagttccgaaattccaagcacctgaaacagcagcagtatcgtgcagagaatcagatcctgctcaaggagatcgagtccctggaggaagaaaggctggacctgaaaaagaagatacgacagatggcacaggagaggggcaaacgttcggcgacttccgggctcaccacggaggatcttaacctcacagaaaatatttcccagggagatcggatttccgaaagaaagctggacttgctgagcctaaagaacatgtcggaggcacagagtaaaaacgaattcctctcacgcgaattgattgagaaggagagggatctggagcggtctcgcaccgtgatcgccaagttccagaataaatgctaccgaataaaggaatgtaggcgaaacctctag

SEQ ID NO: 217876 - DNA, 4620 bp, Artificial Sequence
  Description of Artificial Sequence: Synthetic coding sequence
atggcaatctttaaaatcgccgctctccaaaaggttgtggacaactctgtatctctctctgagctggagttggctaataagcagtacaacgaactcaccgcgaagtaccgggatattctacagaaagataatatgctagtgcaacggacaagtaatctcgagcatcttgagtgtgagaatatctccttgaaggaacaagtggagtccataaataaggagctcgagatcacaaaagagaagctgcacactatcgagcaggcttgggagcaggagacaaaattgggcaacgagtccagtatggataaggctaagaagagcattactaactcagacatcgtgagcatatcaaagaagattaccatgctcgagatgaaagagctgaacgagcgccagcgagcagaacactgccagaagatgtacgagcatctccgcacctccctgaaacaaatggaggagcgaaatttcgaactggaaacaaagttcgcagagttgaccaagatcaacctagatgcccagaaggtggaacagatgctgagggatgagctcgccgactctgtgtccaaagccgtttccgatgccgatcggcagcggattttagagctggagaaaaatgagatggagctgaaagtggaggtttccaagttgcgtgaaatttctgacatagctaggaggcaagtagaaattctgaacgcccaacaacagagtcgcgataaggaagtggaatctctgcggatgcagcttcttgattatcaggcacagagcgacgagaaatccctcattgccaagctacaccagcataatgtatccttgcagctgtccgaagctactgcactcgggaagttagaaagtatcacgtccaaacttcagaagatggaagcttataatctaaggcttgaacaaaagctggacgagaaggagcaggccctgtattatgcaagactggaaggtagaaatcgggcaaagcacctcagacaaacaattcagtccctaagaaggcagttcagcggcgcactaccacttgcccagcaagagaaattcagcaaaaccatgatccaattgcagaacgacaaactgaaaatcatgcaagaaatgaagaactcccagcaagagcatcgtaacatggaaaataagactctcgagatggagctcaagctgaaagggttggaggaactcatctcaactttgaaagataccaaaggagctcagaaagtcattaactggcatatgaagatagaggagctgagattgcaggagttgaagctgaatcgggaattggtgaaagacaaggaggagataaaatacctcaacaacatcattagcgagtacgagagaacgattagcagtcttgaggaggaaatcgttcagcagaataagtttcacgaggagcggcagatggcttgggaccagagagaggttgacctcgagcggcagctggacatctttgacagacagcagaacgagatccttaatgctgcccagaagtttgaagaggctacagggagcattcctgacccttctctgcctttgcctaaccagcttgaaattgccctgagaaagataaaagagaatattcggattatcctggagacccgggcaacttgtaaaagcctcgaagaaaagctcaaggagaaggagtctgctctgcgtctggctgagcagaacatcctgtcgcgggacaaagtgattaacgagttgcgactgcggctcccggctaccgccgagagagaaaagctgatcgccgaactcggcaggaaggagatggagcccaagtcccatcatactctgaaaattgcccaccagactatcgctaacatgcaggcaaggctcaaccagaaagaggaagtgcttaaaaagtatcagaggctcctcgaaaaagcacgggaagagcagcgcgaaattgtgaagaaacatgaggaagatttgcacatcctacaccatcgacttgagctccaggctgactcttcccttaacaagttcaagcaaaccgcttgggatctgatgaaacaatcgcctacccctgtacctacaaacaaacattttatccgactcgccgaaatggagcagaccgtggctgaacaggacgacagcctgtcctctttgttagtgaaactgaagaaggtttcacaagacctggaacggcagagggagatcacggagctgaaagtcaaagagtttgaaaatatcaaattgcagctgcaagagaaccatgaagatgaggttaagaaggtgaaggctgaagtggaagatctgaaatacctgttagatcaaagccaaaaggaatcacagtgtctgaagtccgaactacaggcacaaaaggaggcaaacagccgcgctccaacaacaacaatgagaaacctggtggagcggctgaagtcccagctagctctcaaggagaagcagcagaaagctctgtctcgcgctcttctggagctgcgggcagaaatgacagcggcagctgaagaaaggatcatctccgcaactagtcaaaaggaagcacatcttaatgtgcagcagatcgtggataggcataccagagagcttaaaacgcaggttgaggacctgaacgagaacctgctcaagcttaaagaggccctgaagacgtctaagaatagagaaaacagccttactgacaacttgaacgacctaaacaacgagctgcagaaaaaacagaaggcttacaataagattctgcgggagaaggaagaaattgatcaggaaaatgacgaactgaagcggcagatcaagagactgacctccgggctgcagggtaagcctctgaccgacaacaaacagagtctgatagaagagctacagcggaaggtgaagaaactggaaaatcagctggagggcaaggtggaagaagtggacctgaagccgatgaaggaaaagaatgccaaggaggagctgatacgatgggaagaaggcaagaagtggcaagccaagattgagggcatacgcaacaaactcaaagagaaggaaggagaagtattcacccttaccaagcagctgaacactctcaaagacctttttgctaaagcggataaagaaaaactgacccttcagcggaagttaaaaactaccgggatgactgtagatcaggtattaggcattcgtgccctggaaagtgagaaggagctcgaagaactgaaaaagaggaatctggatctggagaacgatatattgtatatgagggcccatcaagccctgcctagagactccgtcgtcgaggatctccatttgcaaaacaggtatcttcaggagaaattgcatgccctcgaaaagcagttttccaaagacacgtacagcaaaccatctatatcaggtattgaatcagacgaccactgccagagggagcaggaactgcagaaggaaaatcttaaactctctagcgagaatattgaactgaaattccagttagagcaggcgaacaaagatttacccaggctaaagaatcaagttcgagacctgaaggaaatgtgcgagttccttaagaaggagaaggcggaagttcagagaaaattaggccacgtgcgtggctctggcaggtcagggaaaaccattccggagctggaaaaaacgattggcctgatgaagaaggtggttgagaaggttcagcgcgaaaacgaacagctaaaaaaggcctcgggcattctgactagtgaaaaaatggctaatatcgagcaggaaaacgaaaaactgaaggcggagctggaaaaactcaaggcacaccttggccatcaactcagtatgcattacgagtccaagactaagggcaccgagaagatcatcgccgagaacgagagactgagaaaggaacttaaaaaagaaacagatgccgctgaaaaactgagaatcgctaagaacaatctagaaattctcaacgagaagatgaccgttcaactggaggaaacgggcaagcgactgcaattcgccgaaagtcggggtccccagctcgagggcgctgatagcaaatcctggaaatcaatagtagtgaccaggatgtatgagactaagctgaaagaattggaaactgacatcgcgaagaagaaccagagtataaccgatttgaagcaattagtaaaggaggcaactgaaagagagcaaaaggtgaataagtataacgaggatttagagcagcaaattaagattctaaagcacgtcccggagggtgccgagacggaacaggggttgaaacgcgagctgcaagttctccggctggctaaccaccaattggataaagaaaaggccgagctgattcatcagatcgaggccaacaaggaccagagcggcgcagagtctaccatcccggatgctgaccaactcaaggagaaaattaaagacctggaaacacagttaaaaatgtcagatcttgagaaacaacacctgaaggaggagattaaaaagcttaagaaagaactggagaattttgacccttcattctttgaggaaatcgaagaccttaagtataactataaagaagaggttaaaaaaaacatcttgttggaagaaaaagtaaaaaaactgtccgaacaactcggggtggaactgacttctcctgtcgcggcaagtgaagaattcgaagatgaggaagagtccccggttaactttccaatctactag

SEQ ID NO: 217877 - DNA, 7439 bp, Artificial Sequence
  Description of Artificial Sequence: Synthetic coding sequence
atgccgcctaacattaactggaaagagattatgaaggtcgatccggacgacctgcctagacaggaggagctggccgataacttgcttatctctctctccaaggtggaggtcaacgagctcaaaagcgaaaagcaggaaaacgtgattcacttgttccggatcacacaaagccttatgaaaatgaaggcccaagaagttgagctcgccttggaagaagtggagaaagcgggtgaagagcaggctaaattcgaaaaccaactcaagactaaagttatgaaactcgaaaatgaactggaaatggctcaacaatctgccggaggaagggatacccggttcttacgtaatgagatatgccagttggagaagcagctcgagcagaaggatcgtgaactcgaagatatggaaaaagagttggaaaaggaaaaaaaggttaacgaacaattagcgttacgtaatgaggaggccgagaatgagaactcaaaactgagaagagaaaacaagcgcttgaaaaagaaaaatgagcagctctgtcaggatattatagactaccagaaacagatcgatagtcagaaggaaaccctgttaagccggagaggcgaagatagcgactatcgatcacagctgtcaaaaaaaaattatgagttaatccaatatctcgacgagatccagacattgacagaagccaatgaaaagatagaggtgcagaatcaagagatgaggaaaaatctcgaggagagtgttcaggaaatggagaagatgaccgacgagtataataggatgaaggcaattgtccaccagaccgataatgtaatcgaccaactcaaaaaggaaaacgatcattatcagctccaagtccaggagctgaccgaccttctgaagtcaaagaatgaagaggacgaccccattatggtggccgtgaacgctaaggttgaagagtggaagctcatactttcaagtaaagatgatgaaataattgaataccagcagatgctccataatctgcgagagaagttgaaaaacgcacagctagatgcagataagagcaacgtcatggctctgcagcaggggattcaagaaagagactcccagataaaaatgctaacagagcaggtcgaacaatacaccaaggaaatggaaaaaaatacatgtattattgaggatttaaaaaatgagctgcaacgcaacaaaggagcctctaccttaagtcagcagacacatatgaaaattcagagcactttagatatcctcaaagagaagaccaaagaggcagagaggacagccgagctcgccgaagctgacgctagggaaaaagataaggagcttgtggaggccttaaaaagattaaaagactacgaatcaggggtgtatgggctggaggacgcagtggtcgagattaagaactgcaaaaaccagataaagatacgtgaccgggagatagaaattctcactaaagaaataaataaactggagttgaaaatctctgatttcctggatgagaatgaagccttacgcgaaagagtgggcctcgagccaaagaccatgattgatctgaccgaatttagaaacagcaaacatctcaagcaacagcagtatcgtgcagagaaccaaattcttttaaaagagattgagagtctcgaggaagagcgattggatctcaaaaaaaagattagacagatggcccaagagcgcggtaaacggtccgccacaagcggcctcaccactgaggacctcaacctgacagaaaacatcagtcaaggggacagaatttctgagcgtaagttagacctgctctccctgaaaaatatgtccgaagcccagtcaaagaacgagttccttagtcgtgaactgattgaaaaggaacgagacctcgaaaggtcgcgtaccgtgattgccaaatttcagaataagctcaaagagctcgtggaagagaacaagcagctggaagagggtatgaaagagattctgcaagcaatcaaggagatgcagaaagacccagacgtgaaagggggtgaaacttcactcatcatcccgagtcttgaacgtctcgttaacgcaattgagtccaaaaatgcggagggtatcttcgacgcctcgttgcacttgaaggctcaggtagatcaactcacgggcagaaatgaggaactgcgccaggagctgagagaaagcaggaaggaggccataaattatagtcaacaactggccaaagcaaatttgaagatcgaccatttagaaaaggagacatctctactgcgtcaatctgaaggttcgaacgtggtctttaaggggatagacctccccgatggaatcgccccatcttcagcctcaatcatcaacagtcagaatgaatatcttatccacctgctacaggagctggagaacaaggagaaaaaactaaagaatctcgaggactctttagaagattacaaccgcaaattcgccgtcatcaggcaccaacagtccttactgtataaggaatatctgtctgagaaagagacgtggaaaacagaaagcaaaaccattaaggaggagaaaaggaaacttgaagatcaggtccagcaggacgcaatcaaggtgaaggagtacaacaacctcctcaatgcactgcaaatggactcggacgagatgaagaaaatcctcgccgagaactctcggaaaatcactgtgcttcaagtaaacgagaaatctcttatccggcagtacaccacactggttgagctcgagcgtcaacttagaaaggaaaacgagaaacagaagaacgagctgttgagcatggaggctgaggtatgcgagaaaatcggttgtctccagaggtttaaagagatggcaatctttaaaattgccgcattgcaaaaagtggtggataattccgtgagtctttcggagctggaactggctaacaaacaatataatgagcttaccgcgaaataccgggatatcctacagaaggataacatgcttgtccagcgcacgagcaatttggagcatctcgagtgtgagaacattagtctgaaagaacaggtcgagtcaattaataaagaactcgaaataacaaaagaaaaactgcacaccattgagcaagcatgggaacaggagacgaaattggggaatgaatcaagtatggataaagccaagaaatctataacaaactccgacatcgtgtcaatttccaagaaaatcacgatgctggagatgaaggaactgaacgagaggcaaagggcagaacactgccaaaagatgtacgaacacctgcggacttcgctgaaacagatggaagagcggaacttcgaacttgaaactaaattcgctgagctcacaaaaatcaacttggatgcccaaaaagtggagcagatgctgcgtgacgagttggcggactctgtctctaaagccgtgagcgacgccgatcgacagaggattctagagctggagaaaaacgagatggaactgaaagtggaggtatcaaagctgagagagatctctgatatagccaggcggcaggtggaaatcttaaacgcacagcagcagagtcgggacaaagaggtcgagagcctgcgcatgcagctactggattatcaggctcagtccgacgaaaaatcgcttatagcaaagctgcaccagcacaatgtgagccttcaactaagtgaggccacagccctcggaaagcttgagtccattacaagcaagttgcagaagatggaggcatacaacctgcgcctggagcagaaacttgatgagaaagagcaggctctgtactatgcaaggcttgaggggagaaatagagccaaacatctccggcagaccatccaaagtctaaggaggcaattctctggagccttaccacttgctcagcaagaaaagttttccaagactatgatccagctacagaatgataaactgaagatcatgcaggaaatgaaaaacagtcagcaggaacatagaaacatggaaaacaagacgttggagatggagcttaagctcaagggacttgaagagcttatctccaccttgaaggataccaaaggtgcacagaaggtaattaattggcatatgaaaatcgaggagctcagattgcaagaactgaaattgaaccgggagctcgtgaaagacaaggaagaaataaaatacctgaacaacattatctctgaatacgaacgcactattagtagcctggaagaagagatcgtacagcagaacaaattccatgaggaacggcagatggcctgggatcaacgcgaagtagacctggaaagacagttggatatctttgaccggcaacaaaatgagatcctaaacgccgctcaaaagtttgaggaggccacagggagtatacccgacccgtctctaccactgcccaatcagctggaaatcgccctccggaaaattaaggagaacatccggattatcctggagactagagcaacctgtaaatctctggaggagaaattgaaggaaaaggaaagcgccctgcgcctcgccgaacagaacatcttgagccgggacaaagtcattaacgagctccgcttgcggctgcccgcaaccgctgagcgtgagaagctcatagccgaactcggacgtaaggagatggagcctaagtcccatcataccctcaagattgcacaccagacaatcgctaacatgcaggcgaggttaaatcaaaaggaggaagtacttaaaaagtatcaacggctgttggaaaaggccagagaggagcagagggagatagtcaaaaagcacgaggaggacctacacatcctgcatcatcgtttagaacttcaggccgactcctcactcaataagtttaaacaaactgcatgggatctgatgaagcaatcccccacccccgtaccaaccaacaagcatttcattagactcgcggaaatggaacaaacagtcgccgagcaggacgacagtctgtcatcccttttggtgaaactcaagaaagtgagtcaggatctagagcgtcagagagagatcactgagcttaaggttaaggaatttgagaacatcaaactgcagctgcaagagaatcatgaagacgaggtcaaaaaggttaaagctgaggtggaagacttgaagtaccttctggatcaaagtcagaaggagtcacagtgtttaaagagtgaactacaagcgcagaaggaggccaatagcagagctccgacaacaaccatgcgtaacctggttgagaggctgaagtcacaacttgctttaaaagagaagcagcaaaaagccctcagcagggccctgctggaattgcgcgcagaaatgaccgccgctgccgaggaacggataatttctgccacttcgcagaaagaggcacacttaaatgtgcagcaaatagttgaccggcacacccgtgaattgaaaactcaagtagaggatctcaatgagaacctgctcaagctgaaggaggccctgaagaccagcaaaaacagggagaatagcctgaccgacaatctgaatgacctgaataacgaactacagaagaaacaaaaagcctacaacaagattttaagagagaaagaggagatcgaccaggagaacgacgagcttaagagacagattaaacgcctgacttcgggcctgcagggtaaacctcttaccgataacaagcaaagcctgattgaagaactccagcgcaaagtaaaaaaacttgagaatcagctggagggaaaggttgaagaagtggatcttaagccaatgaaagagaaaaacgccaaggaggagctgatacggtgggaggaaggaaaaaaatggcaggccaagattgagggtatccgtaataaactgaaagagaaagagggggaggtctttacactgactaagcaacttaataccctcaaagacctgttcgccaaggcagataaggagaagctgacccttcagcggaagctgaaaaccacaggtatgacagtcgaccaagttctgggcattcgagccctggagagcgagaaagaacttgaggaattgaaaaagaggaacctggacctcgagaacgacatcctgtacatgcgggctcatcaagccctgcccagggactccgttgtggaggacctgcatctgcagaaccgttatcttcaggaaaaactccacgcacttgagaaacagtttagcaaagatacttactctaagccgtccatcagcggaatagaatccgatgaccattgtcagagagagcaagaactgcagaaggagaacctgaagctcagctcagaaaacatagaactcaagtttcagctggagcaggcaaataaagatctgcccaggctgaaaaaccaggtgcgggaccttaaggagatgtgcgaatttctcaagaaagagaaagcagaagtccagcggaaattgggccacgtacgcggttccggccgaagtggtaagaccataccagaactggagaagacgatcggactgatgaagaaagtggtggagaaggtgcagcgggagaacgagcagttgaagaaggcgagcgggattctgaccagcgagaaaatggccaatattgagcaggaaaacgagaaactgaaagctgagctggagaaattgaaggcccatctgggccatcagctgtccatgcactacgaatctaagactaagggaacggagaagatcatcgccgagaacgaacggctaagaaaagagctgaagaaggaaaccgacgctgcagaaaaactgaggatagcaaagaacaatctcgagatcttgaatgagaaaatgaccgtacaactggaggagacaggcaaacgccttcagttcgccgaatcccgaggacctcaactggaaggtgcggacagtaagtcctggaaaagcatagttgtgacccgcatgtacgaaaccaagctcaaggaactcgaaacagatatcgcaaagaaaaaccagagcattactgacctcaaacagctggtgaaagaggctactgagagggagcagaaagtgaacaagtataacgaggacttagagcagcagatcaaaatcctgaagcatgtcccggaaggagcagagaccgagcagggcttgaaaagggagctgcaggtcctgaggttggccaaccaccagcttgataaggagaaagctgagctgattcaccaaattgaggccaacaaggaccagtctggggcagagtcaactattcctgacgcagaccagcttaaagaaaagatcaaagatttggaaacacagctaaagatgagcgacttggaaaagcaacaccttaaagaggaaataaaaaagctgaagaaggaactggagaatttcgatcctagcttctttgaggaaatcgaggacttgaaatataattataaggaagaggtgaagaagaacattctgctcgaggagaaggtcaagaagctcagcgagcaactaggggtcgagctaaccagccccgtggcagccagtgaggaatttgaagacgaagaggagtctcccgtaaatttcccaatatacta

SEQ ID NO: 217878 - DNA, 1512 bp, Artificial Sequence
  Description of Artificial Sequence: Synthetic coding sequence
atggaggaacatggggtgacacaaacagagcacatggcaacgatagaggcacatgctgtggctcagcaggttcagcaggtgcacgttgctacctatacggaacacagcatgctgagtgcggacgaggatagcccttcctcaccagaagataccagctacgacgactccgacatccttaattccacagctgcagacgaggtcactgcacatctggctgctgcagggccagtggggatggccgcagctgccgctgttgccaccggcaagaaaaggaaaagacctcatgtattcgagtccaatccctccatcaggaaaaggcagcagacccgcctgctacgcaaactaagagccactctcgatgagtacactacacgggtgggacagcaggccattgtgctgtgtatctcccctagcaagcccaacccggttttcaaggtgttcggcgctgccccactggaaaacgttgttagaaagtacaaatcgatgattcttgaggatttggagtctgccctcgccgagcacgcaccagcccctcaggaagtgaacagtgaattaccacccctgactatcgacggcattccagtgagtgtagacaaaatgacccaagcacagctaagagccttcatccccgagatgctgaagtacagtactggcaggggaaagcctggctggggaaaggagagttgcaaacctatatggtggcccgaggacatcccttgggccaacgttcgatctgacgtgcgtactgaagaacagaaacagcgggtgtcgtggacccaggcacttagaaccattgtaaaaaactgctacaaacagcatgggagagaagacctgctgtacgcgtttgaagaccagcaaactcagacgcaggccacagcgactcactcgatcgcccatcttgtgcccagccaaaccgtggttcaaacgttttcaaatccagacggaaccgtctccctgattcaggtgggtaccggggctacagtggcaacccttgccgatgcctcagaactaccaactacagtaacagtggctcaggtcaattattcagctgtggcagacggtgaggttgagcaaaactgggccaccctgcaggggggagaaatgaccatccagacaacacaggcaagtgaagctactcaggccgtcgccagcttagccgaggcagctgtggccgcttcccaagaaatgcagcagggggcaaccgtgactatggccctcaactctgaggccgcagcccatgccgttgccactctcgcagaagctactctccagggcggtgggcaaatagtgttgagcggagagactgcagcagcagtcggagcgcttactggagtccaagacgcgaacggcctagtgcagatcccggttagcatgtatcaaacagtcgtgaccagccttgcccaaggcaatggtcctgtgcaagtggcaatggctcccgttacaacccgcatttccgactccgccgtgaccatggatggccaggctgttgaggtggtaacattggagcagtag

SEQ ID NO: 217879 - DNA, 906 bp, Artificial Sequence
  Description of Artificial Sequence: Synthetic coding sequence
atgagcctccgtcggcacatcggaaacccggagtacctgatgaaacggatcccgcagaatccccgataccagcatataaaaagtcggctcgataccggtaatagcatgacaaaatatactgagaagctggaggagataaaaaaaaattatcgctataaaaaagatgagctgtttaaacgcctcaaggtcacaacttttgcccagcttatcatccaagtggcgtctctttccgatcaaaccctcgaggtgactgccgaggaaattcagagactggaggacaatgattcagccgcatctgatccggacgctgagaccactgcgaggactaatgggaaaggaaaccccggtgagcaaagcccaagcccagaacaatttatcaacaatgccggtgccggtgactctagtcgctctactctccagagtgttatctccggtgtgggtgaattggacctggacaaaggacccgtgaagaaggccgaaccacacacgaaagacaaaccttaccccgattgtcctttcctattgcttgacgtccgggatagagactcataccagcagtgccacatcgtgggcgcatattcctaccctattgccactctgtcccgtaccatgaatccatactctaacgatatcctggaatacaaaaatgcccacggtaagattatcatactgtacgacgatgacgaacgcttagccagccaggcagctaccaccatgtgtgagcgcggtttcgagaacctcttcatgctctccgggggtaggctgaatcaggccaacagtagcggcagggagtcaaaggtgcccggagccagatctgctcagaacctgccaggaggcggacccgcatcgcattcgaacccgaggagtctctcatcagggcacctacagggaaaaccatggaaatag

SEQ ID NO: 217880 - DNA, 165 bp, Artificial Sequence
  Description of Artificial Sequence: Synthetic coding sequence
atgagtctccggcgacatattggcaaccccgagtatctcatgaagcggatacctcagaaccctaggtaccaacacatcaaaagcaggttggacactggggcttgtgtgtaccttacatcttctcctgctttgcccgattgtgcaatgaatggcttgtgcttctag

SEQ ID NO: 217881 - DNA, 858 bp, Artificial Sequence
  Description of Artificial Sequence: Synthetic coding sequence
atgagcctaagacgacacatcgggaacccagagtaccttatgaagagaatacctcaaaaccccagatatcagcacattaagtcccgcctggacactgattaccgatacaagaaggatgaattgttcaagagacttaaggttacgacctttgcgcagttaatcattcaggtggcctctctgagcgaccaaaccttagaggtcacagccgaggagattcagcgcctggaagacaatgacagtgcggcaagcgaccccgatgctgagacaaccgcgcgaacaaacgggaaagggaaccccggagagcagtccccgtctcctgagcagttcatcaacaacgcaggcgctggcgattcatcccgaagcacactgcagtctgtgatttcaggggtgggtgagctggacctcgacaagggccctgtgaaaaaggctgaaccacacaccaaggacaagccataccctgattgcccattcctgctccttgacgtgcgggacagagactcctaccaacaatgtcacattgttggagcctactcttatccaattgctacccttagccgcacaatgaacccgtacagcaatgacattcttgaatacaaaaacgctcatggaaaaatcattatcctctacgatgacgatgaacggcttgccagccaggctgctaccaccatgtgcgagagagggtttgaaaacctgtttatgcttagcggtggcaggctcaaccaagccaactcttcaggcagggaatccaaggtacctggagctcgttctgcacagaaccttcctggcggtggacctgccagccactcaaacccaaggtctctgtcttctggacacctgcaaggtaagccatggaagtag

SEQ ID NO: 217882 - DNA, 1200 bp, Artificial Sequence
  Description of Artificial Sequence: Synthetic coding sequence
atgtcctccaggagcactaaagacctgataaagtccaagtggggcagcaagccatctaattccaaaagtgagactaccctggagaagctgaagggggagatcgctcacctgaagactagcgtagatgagatcacttcgggaaagggcaaactgaccgataaagagcgtcacaggttgctggagaagatcagggtgctggaagctgaaaaggagaagaatgcataccagctgacagagaaagataaggagattcagaggctgcgtgatcagctgaaggctcggtattctactacaaccctgctggaacagctcgaggagactaccagggagggcgaacggagagaacaggtccttaaggcactgagtgaagagaaggacgtgctgaaacagcaacttagcgcggcaaccagcaggatcgccgaactggaaagcaaaactaacaccctgcgcctgtcacagactgttgcccctaactgttttaattccagcatcaataacatacacgagatggaaattcagctgaaggatgcgttggaaaagaaccaacaatggctcgtctacgatcaacagagggaggtttacgtgaaagggttactagccaagatttttgaactggagaagaagactgaaacagccgcacatagcctcccacagcagacaaagaaaccggagtctgaaggatacctccaagaggaaaagcaaaagtgttataatgacctgctggcatccgcaaagaaggatctagaagtggagagacagaccattactcagctctctttcgagctttcagaattccgcaggaagtatgaagagacacagaaggaggtgcataacctgaatcagttgctctactctcaacgtcgcgcagacgtccagcatctcgaggatgacaggcacaagactgagaagatccaaaagttgagggaagagaacgatattgctcgcggtaagctggaagaggaaaagaaacggagcgaagagctgttgagtcaggttcaattcctgtacaccagcctgctcaagcaacaagaggaacaaactcgagtggccctgctggaacagcagatgcaagcctgtaccctggattttgaaaacgagaagctcgaccgtcagcacgtgcagcatcagctgcacgtgattctgaaggaactgaggaaggccaggaataatactgtcgggatactggataccaagagttag

SEQ ID NO: 217883 - DNA, 1395 bp, Artificial Sequence
  Description of Artificial Sequence: Synthetic coding sequence
atgagtagtcgatccactaaagatctgattaagtctaaatggggatcgaagccttcaaattcaaagtctgaaactactttggagaagttaaaaggcgagattgctcacctgaagacatccgtggacgaaatcacatctggcaagggaaagttaaccgataaagagaggcatcgtcttctggaaaagatccgggttctcgaagccgaaaaagagaagaatgcctaccagttaactgaaaaagacaaagagattcaacggctgcgggaccagcttaaggcccgatactcaacaaccacactgctggaacagttggaggagactactcgggaaggcgaacggagagagcaagtcctaaaggccctcagcgaggaaaaagacgtgctgaaacagcaactgtcagccgctacctccaggattgccgaactagagagtaaaaccaacactctacgccttagccagactgtagcccctaactgcttcaacagtagtatcaacaacattcacgagatggaaatccagctgaaagacgccctggagaaaaaccagcagtggctagtctacgatcagcagagggaggtgtacgtgaaggggttgttggccaagatattcgaactggaaaagaagactgagaccgccgctcacagcctcccccagcagactaaaaagccagagagcgagggatacctgcaggaggaaaagcagaagtgctacaacgatcttctagcctcggccaaaaaagacctggaggtcgaacgccagaccataactcagctatcttttgaactctccgagttccgcaggaagtacgaagagacgcagaaggaagtgcataaccttaatcaactgctctacagccagcgcagagccgatgtccaacacctggaggacgaccgacacaaaaccgaaaagatccagaagctaagagaagagaacgacattgccagaggcaaacttgaagaggagaagaaaagaagcgaagagctattaagccaggtccaattcctctatacaagcctcctgaaacagcaggaagagcaaacacgggtcgctctactggagcagcagatgcaggcctgtactttggacttcgagaatgagaaactagaccgacaacatgtgcagcaccagctgcatgtgattctcaaggagctgcggaaagcaaggaatcagattacacagttagagtctctcaaacagcttcacgaatttgcaataacagagccactggtgaccttccagggagaaactgagaacagagagaaagttgccgcttcaccgaagagccctaccgccgcacttaatgaatcgctagtcgagtgtcctaagtgcaatatccaataccctgcgactgagcacagggatttgttggttcacgtcgagtactgttccaaatag

SEQ ID NO: 217884 - DNA, 627 bp, Artificial Sequence
  Description of Artificial Sequence: Synthetic coding sequence
taatcttctatcaataatatccacgagatggagattcagttgaaagacgcccttgaaaagaaccagcagtggctggtctacgatcagcagagggaggtgtacgttaaggggctgctggccaaaatctttgagctggagaagaaaactgagacggctgcccacagtcttccccagcagaccaagaagccagaaagcgagggttacctgcaagaagagaaacagaaatgctacaacgacctgctcgcctccgcgaagaaagacctggaggtcgaacgtcagactatcacacaactcagctttgaacttagcgaattccggagaaagtatgaagagacccaaaaagaagtgcataacttgaatcagctactttatagccagcgaagagcagatgtccaacacctagaagacgatcgacataagacagaaaagatacaaaagctcagggaggaaaacgatatcgcccgtggaaaactggaggaggaaaagaagcggtccgaagagctgctgtctcaagtgcagttcctgtatacctctctgctgaagcagcaggaggagcagactcgagtggcacttcttgaacagcaagtgctgatcagagtggcctcgaagtttaacagcgcatgttag

SEQ ID NO: 217885 - DNA, 1425 bp, Artificial Sequence
  Description of Artificial Sequence: Synthetic coding sequence
atggcggctgcttcggtgtccgccgcttccggtagtcacctgtcgaactcgttcgcagagcctagcagaagcaacggttctatggtgagacacagttcctccccctacgtagtgtatcctagtgataagccatttctgaattcagatctccgtcgcagccctagcaagcctactctcgcttacccagagtctaatagccgagcaattttcagtgccttgaaaaacttgcaagataagattaggcgcctggagctcgagcgcatccaggccgaggagtcagtgaaaaccctgagcagagaaactatcgagtataagaaagtgctggatgaacagattcaggagcgtgagaactctaagaatgaagaatccaaacataaccaggagctgacctcgcaactcttagcggctgaaaataagtgcaacctgctcgaaaagcagctggaatatatgcgcaatatgattaaacatgccgaaatggagcgaaccagtgtgcttgagaaacaagtttcactcgagagagagcgtcagcatgaccagacacacgttcaaagccaactggagaaactcgaccttttggaacaggaatacaacaagctcactacaatgcaggctctggccgaaaagaagatgcaggagctggaggcgaagctccacgaagaagaacaggagcgcaagcgaatgcaggcaaaagccgcagagctccagaccggactggaaacgaatcgcctaatttttgaagataaagccaccccctgcgtacctaatgccagaaggataaagaagaaaaaaagcaagccacccgaaaaatctacctctccctcccatgcagtagttgcaaacgtgcagttagttcttcacctgatgaagcagcacagtaaggccctctgcaatgaccgggtaataaatagcataccactggctaagcaagtgtcatcaagaggcggaaaaagtaaaaaactctccgtcaccccacctagttcaaacgggatcaacgaagaactgtccgaggttttgcaaacactgcaagacgaatttgggcagatgtcctttgaccatcagcagttagcaaaactcatccaggagtcccccacagtggaactgaaggataagctggagtgcgagctggaagccctagttggcaggatggaagccaaggccaatcagattaccaaggtgcggaaatatcaggcccagttggagaaacagaaacttgaaaaacagaaaaaagagctaaaggctactaagaagacactggacgaggagcggaatagctcctccaggtccggtatcactgggactacaaataagaaggattttatgaagttacgacctggcgagaagaggagaaaaaatcttcagctactgaaggatatgcagagtatacagaatagccttcagtcttcatcgctctgttgggattactag

SEQ ID NO: 217886 - DNA, 1503 bp, Artificial Sequence
  Description of Artificial Sequence: Synthetic coding sequence
atggctgccgcatcagtgagcgccgcaagtggctctcacctcagcaactcatttgccgagccgagtcgctcaaacggaagcatggtcaggcattcaagctctccctacgtggtgtacccgtcagataaacctttcctcaacagcgatttacgacgctccccctccaagcccacactggcatatccagagtctaatagtcgcgcaatcttttctgcccttaaaaacctgcaagacaagattaggcgccttgagttagaaagaatccaagccgaggaatcggtcaaaacgcttagtcgcgagactatcgaatataaaaaggtcttggacgaacagatccaggaacgggaaaacagcaagaatgaggaatcaaaacacaatcaggagctgacatcgcaactgctggcagccgagaacaagtgtaacttgctcgaaaagcaactcgaatacatgcgtaacatgatcaaacatgctgagatggaacggactagcgtgctcgagaagcaggtttccctcgaacgtgagagacagcatgaccagacgcacgtgcagtcacagttggagaaactcgatttgctggaacaagaatacaataagctcacaactatgcaggcactggccgaaaaaaagatgcaggagctggaagctaaactgcatgaagaggaacaggaaaggaagcgcatgcaagctaaggcggcagaactgcagaccggccttgagaccaacaggctgattttcgaggacaaggctacaccctgcgtcccaaacgccaggcggattaagaaaaagaagtccaaaccccctgagaaaaaaagctctcggaactactttggagcacaacctcattacaggctgtgccttggcgacatgccctttgtcgccggaaagtccacttcacctagccacgcagtggtggccaatgtgcagttagtcttgcacttaatgaaacagcactcgaaagctctctgtaacgatagggttatcaactccatacctctggcaaagcaggtgtcaagtaggggcggtaaaagcaagaagctctctgtgaccccccctagctccaacgggattaacgaggagctgtctgaggtgctgcagaccttgcaggatgaattcggtcagatgtcattcgaccatcaacaattggccaagcttatacaggagagtccaaccgttgagctaaaagataaactagaatgcgagttagaggccctggtcggacgcatggaggctaaagcaaaccagatcaccaaagtcaggaagtaccaggcgcagctggaaaagcagaagctcgagaagcagaagaaagaactgaaagcaactaaaaagaccctggatgaggagaggaactctagttccaggagcgggattaccggcactacaaacaaaaaagactttatgaaactgcggcctggggagaagcgcaggaagaacctgcagcttctgaaggatatgcagtcaatccaaaatagtctgcagagttcctccttgtgctgggattattag

SEQ ID NO: 217887 - DNA, 813 bp, Artificial Sequence
  Description of Artificial Sequence: Synthetic coding sequence
atggccgctgcgagcgtctcggcagcgtccggtagtcatctgtctaattctttcgccgagccttcccgaagcaacggcagcatggtgcgtcattcatcgtccccatacgtagtttacccttcagacaaaccattcttgaatagcgatctgcgcagatctccctctaaacccaccttggcataccctgagagcaactccagagcgatcttcagcgcactcaagaacttacaagataagatccgaaggttagagctggagcgaatccaggccgaggaaagtgtgaagaccctgtccagagaaacaattgaatataagaaagtgctcgatgagcagatccaagaaagggagaatagtaagaacgaagaatctaaacataaccaagagttgacatctcagctacttgcggctgagaacaagtgtaacctcctagaaaagcaattggagtacatgcggaacatgatcaaacacgccgagatggaacgaacatcggtgctggaaaaacaggtctccctggaacgggaaagacagcatgatcagactcacgtgcagagccagctggagaaactcgacctgcttgagcaagagtacaataagctgactaccatgcaggcattggccgaaaaaaaaatgcaagaactggaagccaagcttcatgaagaagagcaggagcgaaagcgcatgcaggcaaaggccgctgaactgcaaacgggactcgaaaccaatagactgatctttgaagataaggctactccctgtgtgcctaatgctaggaggattaaaaagaagaaatcaaagccgcctgagaaggtttag

SEQ ID NO: 217888 - DNA, 1476 bp, Artificial Sequence
  Description of Artificial Sequence: Synthetic coding sequence
atgttaacccgtatcgacaattcgttcgctgagccctcgcggtctaacggctctatggtccgacactcttcttctccctatgtggtttacccctccgataagccttttctcaacagcgacctaagacgaagcccgtcaaagcccacactggcctatcccgagtctaactctagggcaatctttagcgcgcttaagaacctgcaagacaagatccggaggctggaactggaacgcatccaggcagaggaatctgtgaagactttatcacgagagaccattgagtacaagaaggtgcttgacgaacaaatccaggagagagaaaattccaaaaacgaggagtccaaacataatcaagaactgaccagccagctgcttgctgccgagaataaatgtaacctccttgagaaacaactcgaatatatgcgtaacatgataaagcatgccgagatggagcgaacctccgtactggaaaaacaagtgtctctagagagggaacggcagcacgaccaaacccatgtacagtcacagttagaaaaactggacctgttggagcaggaatacaataagctgacaacaatgcaggccctagccgagaagaagatgcaggagctggaagcaaagcttcatgaagaggagcaggagagaaagcgcatgcaagccaaagccgctgaactccagaccggcctcgaaactaacagactaatctttgaagacaaagcaacgccgtgtgtgcccaacgcaagacgcataaaaaagaagaaaagcaagccgccagaaaagaagagtagcaggaattattttggagcccaaccccattaccgcctgtgcctcggcgacatgccattcgtggccggtaagtccacatctccaagccatgcagtggtcgctaacgtgcaactggtactgcatctgatgaaacaacatagcaaagctctctgtaacgaccgcgtgattaattccatacctctggctaagcaagtgtcgtcccggggtggaaagagtaaaaagttgtccgtgacacccccaagtagcaatggaattaacgaggaattgtcggaggtgctgcagaccctgcaagacgaatttggtcaaatgtctttcgaccatcagcagttggccaaactcatccaagagagtcccaccgtcgaactcaaagacaagctggaatgtgaactggaagcgcttgtagggaggatggaggccaaagcgaatcagatcacgaaggtgaggaagtaccaagcacagttggaaaaacagaaactagaaaagcagaaaaaagagttgaaagccaccaagaagacactggatgaagagcgcaacagcagcagtcggagtggtatcaccggaactactaacaagaaggatttcatgaaactccgaccaggggagaagaggcgcaagaatctgcagctgttgaaagatatgcagtcgatccagaatagcctgcagtcgagctcactctgctgggattattag

SEQ ID NO: 217889 - DNA, 1794 bp, Artificial Sequence
  Description of Artificial Sequence: Synthetic coding sequence
atgtttcccgtggcccctaagcctcaggattctagccaacctagtgaccgtctgatgaccgagaagcagcaagaggaggcagagtgggaatccatcaatgtcctccttatgatgcatggacttaaacccctgagtctggtgaagcgaacagacctgaaggatcttattatctttgacaaacagagttcccagcgaatgaggcagaacctcaagctgttggtggaagagacctcgtgccagcaaaacatgatccaggaactgattgagaccaaccagcagctgagaaatgagctgcagttagaacagtctagagccgctaaccaggagcagagagccaacgacctggagcagatcatggaatcagtgaagtcaaagataggagagctggaagatgagagccttagccgagcctgccaccaacagaacaagatcaaggaccttcagaaggagcagaagactctccaggtcaaatgtcagcactacaagaagaagagaactgaacaggaagagaccattgcttccctccagatggaagtatgtcggctgaagaaggaggaggaggatcggattgttacccaaaaccgcgtttttgcttacctctgtaagcgcgttccacacaccgtgctggatcgtcagctgctgtgcctgatagactactatgaatccaagattcggaagattcatacacagagacagtacaaagaggacgaatctcagtcagaggaggagaatgattacaggaatctcgacgcaagccccacatataagggactgctgatgtccctccagaaccagttgaaggaaagtaaaagcaaaatagatgcattgtctagtgaaaagcttaatctccagaaggacctcgagacacggcctactcagcatgaattgcgtttgtacaagcagcaggtgaaaaagctggaaaaagctctcaaaaaaaacgtcaagcttcaggaattaatcaaccacaaaaaggcagaggatacagagaaaaaagacgagccctccaagtacaaccagcagcaggctctaatagatcagcggtactttcaggtgctctgttctatcaactccattatccataaccctcgggcacctgtgataatctacaaacagaccaagggaggagtccaaaattttaataaagaccttgtccaggattgtggtttcgagcatcttgtgcctgttattgagatgtgggccgaccaactcacgtccttaaaagacctatataagtccctcaaaacactgagcgcggaactcgtaccatggctgaacctcaagaagcaagacgagaatgaggggataaaggtcgaggatttgctgttcatcgttgacacaatgctagaggaggtcgaaaataaagagaaagatagcaacatgccacatttccagaccctgcaggcaattgtgagtcattttcagaagctattcgatgtcccatctctcaacggcgtgtaccccagaatgaacgaggtttataccaggcttggcgagatgaataatgccgtgaggaacctgcaggagctgttagagttggactccagtagtagcctctgcgtccttgtctccaccgtcggcaagctgtgccggctgatcaatgaggacgtaaacgagcaggtgatgcaggtgctgggccctgaagacctgcagtccattatatataagctcgaagagcacgaagagttcttccctgccttccaagcgtttaccaatgacctgctcgagattcttgagatcgatgatctggatgcaattgtgcctgccgttaaaaagctgaaagtcttgtcttactag

SEQ ID NO: 217890 - DNA, 639 bp, Artificial Sequence
  Description of Artificial Sequence: Synthetic coding sequence
atgttccccgtggcgccaaagccacaagacagcagccaaccttcggatcgtctgatgaccgagaagcaacaggaggaggccgaatgggagagtatcaatgtgctgcttatgatgcatggcctgaaacccttgtccctggtgaaaaggactgatctcaaggatctgatcatctttgataagcagtctagccaaaggatgagacaaaatctaaagctgctggttgaggaaacaagctgccagcagaatatgatccaggagttgatcgaaacgaaccagcaactaaggaatgagctgcagttggagcagagtagagctgccaaccaagagcagcgcgcaaacgacctcgaacagatcatggaatctgtcaagagcaagatcggagagttggaggatgagtcccttagtcgagcgtgtcatcaacaaaacaagattaaggacttacaaaaggaacagaagacccttcaggtgaagtgtcagcactacaagaaaaagaggaccgagcaagaggagactatagcctcgctgcaaatggaggtctgcagactcaaaaaggaggaggaggaccgaatcgtcacgcagaatcgagtgttcgcatacctctgcaagcgagttccgcatacagtccttgataggcaatag

SEQ ID NO: 217891 - DNA, 351 bp, Artificial Sequence
  Description of Artificial Sequence: Synthetic coding sequence
atgttccctgtggcccctaagccccaagacagctcgcagccatctgataggttgatgaccgagaaacagcaggaagaagccgaatgggagagcatcaatgtgcttctaatgatgcacggattgaaaccactgagcctggtcaagcgcaccgatctgaaagatttgattattttcgacaaacagtccagccagagaatgcgccagaacctcaaactgctggtggaagaaacaagttgtcagcagaacatgatccaagaactgattgaaaccaatcagcaactgcgtaacgagctgcaactggagcaatcacgcgctgcaaaccaggagcagagagcgaatgacctggaatag

SEQ ID NO: 217892 - DNA, 1665 bp, Artificial Sequence
  Description of Artificial Sequence: Synthetic coding sequence
atgtttcccgtggcaccaaagcctcaagattcaagtcaacctagcgacagactcatgaccgagaaacagcaggaagaggctgaatgggagtctatcaacgtgttactcatgatgcatgggttgaagccactatcactagtcaaacgtaccgacttgaaagacctgatcatcttcgataaacaaagcagccagaggatgcggcagaacctaaaactactggttgaagaaacatcatgccagcagaatatgatacaggagcttatcgagacaaatcagcagctccggaacgagctgcagctagagcagtctagagcagccaaccaggagcagcgcgcaaatgatttagaacaaatcatggaatccgtgaaaagcaaaataggggagttggaagatgagtcattgagtcgagcatgccaccagcagaacaagataaaagacctccaaaaagagcaaaagaccttacaagttaagtgtcagcactataagaagaagagaacagaacaggaggaaacaattgctagcctgcaaatggaggtctgccggctgaagaaggaagaagaggataggatcgtgacccaaaaccgcgtcttcgcatacttgtgtaaacgggtgccccacaccgtcctggaccgacagctgctctgtctgattgattactacgagtccaaaatcaggaagattcacacacagcgtcagtacaaagaggatgagtcccagtctgaggaagagaacgattatcgcaatcttgacgcatcgccaacatataaaggtctgctgatgagtctgcagaatcagctgaaggagtccaagtccaaaattgatgccttatcatcagagaagctgaacctgcagaaagatttggaaacacgtccaacacagcacgagcttcgtctgtacaagcagcaggttaagaagcttgaaaaagctcttaagaaaaacgttaagttgcaggaactgatcaaccacaagaaggccgaggacactgagaagaaagatgaacctagcaaatataatcagcagcaggccctcatcgaccagcggtattttcaagtgttgtgttctattaactctattattcacaaccctcgagctccagtcataatctacaagcaaacgaaaggtggcgttcaaaattttaacaaggacttggtccaagactgcggcttcgagcacctagtccctgtaattgagatgtgggccgaccagctgacgtcgttaaaagatttgtacaagtctcttaagactcttagcgctgagcttgttccttggttgaatctgaagaagcaagatgagaacgagggcattaaagtcgaagacctccttttcatcgttgatactatgctggaggaggtggaaaacaaggaaaaagactcaaatatgccccactttcagacgctgcaagccatcgtgtcccacttccaaaaactgttcgatgtgccttcactgaacggcgtgtacccacgaatgaacgaggtctacactagacttggtgaaatgaataacgctgttcggaacctgcaagagctgctcgaactggactcttcaagtagtctgtgtgtcttggttagtacagtcggaaagctctgccggttaatcaacgaggacgttaatgaacaggtgatgcaggtcttgggcccagaagatctccagaggtatctgttctag

SEQ ID NO: 217893 - DNA, 1794 bp, Artificial Sequence
  Description of Artificial Sequence: Synthetic coding sequence
atgtttccagtggcccctaaacctcaggatagcagtcagccatccgataggctcatgacagaaaagcaacaagaagaagccgaatgggaaagtatcaatgtgcttctgatgatgcacggcttgaaaccgctgtccctcgttaagaggacagacctgaaggatctcataattttcgataagcagagctcccaaagaatgcgccagaatcttaagttgctcgtcgaggaaactagttgccaacagaacatgattcaggagctaatcgaaaccaaccaacaacttcgtaatgaactgcagctagagcagtcgcgggctgccaaccaggaacagcgcgcaaacgacttagagcaaattatggagtccgtaaaatccaagattggcgaattggaagatgaaagcctgtcacgggcttgccaccagcagaacaagatcaaagacctgcagaaagagcagaagaccctccaggtgaagtgtcagcattataaaaagaaacggacggagcaggaagagactatcgccagtctgcaaatggaggtctgtaggctgaaaaaggaagaggaggataggattgtcactcagaacagagttttcgcttacctgtgcaaacgagttccccatactgtgttggaccggcagctgctttgtctgattgactactatgagagtaaaatccggaagattcacacacagcgccagtacaaagaagatgagtctcagtcagaagaggaaaatgactaccgtaacctggatgccagcccaacctataaaggactgctgatgagcctgcagaaccagctgaaggaaagcaaaagcaagattgacgccctgtctagtgagaaattgaatctccagaaagatcttgagacacggccaacacagcatgagctgaggctgtataaacagcaggtgaagaaactcgaaaaagcactgaaaaagaatgtgaagctgcaggagctgataaatcataaaaaagccgaggacaccgagaagaaagacgaaccttcaaaatataaccaacagcaggccctcattgatcaacgctattttcaggtgctttgttcaataaacagcatcattcataacccccgagccccagtcattatttataagcagactaagggcggtgtgcagaacttcaataaggatctcgttcaagactgcgggttcgagcacctggtgcctgtcatcgagatgtgggccgatcagcttaccagcctcaaagatctctacaagagccttaaaactctttcagccgagttggtaccttggcttaacttaaagaaacaggacgaaaatgagggcatcaaggtggaggatctactctttatcgtcgacacgatgctagaagaagtggaaaacaaggagaaagattccaacatgcctcactttcagactctccaagcaatcgtctcccacttccagaagctgttcgatgtgccatctctgaatggtgtgtacccccgaatgaacgaggtgtatacgcgactgggggaaatgaacaacgcagtgcgtaatctgcaggagcttttggaactcgactcctccagctcattgtgcgtgttagtttccaccgtgggaaagctgtgcagactgatcaatgaggacgtgaacgagcaggtgatgcaggtactgggtcctgaggaccttcagtcaataatttacaaactcgaagagcacgaagagttcttcccggcttttcaggcctttacaaacgacttgctagaaattttagaaatcgacgacctcgacgctattgtgcccgctgtgaagaagctaaaagttctcagctattag

SEQ ID NO: 217894 - DNA, 72 bp, Artificial Sequence
  Description of Artificial Sequence: Synthetic coding sequence
atgttcccagtcgctcccaaaccacaggatagtagccagccatcggaccgccttatgacggaaaaacagtag

SEQ ID NO: 217895 - DNA, 1734 bp, Artificial Sequence
  Description of Artificial Sequence: Synthetic coding sequence
atgactgagcaggaggaagcggaatgggaatccattaacgtgcttctaatgatgcatggattgaagccactatccctagtgaaaaggacagacctgaaggatctgatcatctttgataagcagagctctcagagaatgcgccagaatctgaaattattggtggaagagactagctgtcaacagaacatgattcaggaactcattgagacgaatcagcaactcaggaatgagcttcagctagagcaatctcgcgcagctaaccaggagcagcgggcaaatgacctcgagcagattatggaaagcgtgaagtcaaagatcggtgaactcgaggacgagagcctgtctagagcatgtcaccagcaaaacaaaattaaggatctgcagaaggagcagaagaccctccaggttaagtgtcaacactacaagaaaaaaaggaccgagcaagaggaaacaatcgccagcctgcaaatggaggtgtgccgccttaagaaagaggaggaggacagaatcgtaacccaaaatagagtttttgcatatctgtgcaagagagtccctcataccgttttggatagacagctactgtgcttgattgactattacgagtcgaagattaggaagatccacacccagaggcaatacaaggaagatgagtctcagagcgaagaagagaatgattatcgaaacttagacgcctcaccaacgtacaagggactgctcatgagcctacagaaccaattgaaggagtctaagtccaagatcgacgccctttcctctgagaagctcaatctgcagaaggatctggaaaccagacccacccaacatgaacttaggttgtataagcagcaggtgaaaaaactggaaaaagcgctaaaaaaaaatgttaagctacaagagttgatcaaccataaaaaggccgaggatacagagaagaaggatgagccttcaaaatacaatcaacagcaagccctgatagatcagcggtatttccaggtgctttgctcaattaattctatcatccataatcccagagctccagtcataatctataagcaaacaaaaggcggagtgcagaactttaacaaggaccttgttcaggattgcggcttcgagcatctcgtgcctgttatagaaatgtgggcggaccaactgactagtttaaaagacttgtacaagagcctgaagacactgtctgctgagctggtgccttggctcaacctcaaaaagcaagatgagaatgagggaatcaaggtcgaagatttactgttcattgtggatactatgcttgaggaggtcgagaacaaagaaaaagattccaacatgccccatttccagaccctgcaagccatcgtaagccactttcagaagctgtttgacgtgcctagtctgaatggagtgtatccgcgtatgaacgaagtttatacgcgcctgggagagatgaacaacgccgtgcgcaatctgcaagagctactcgagctcgactcatcgagtagcttatgcgttctggtgtctaccgtgggtaagttatgcaggctgattaatgaggacgtgaatgaacaagtgatgcaagtactcgggccagaggacctgcagtctatcatctacaaattggaagagcacgaagagtttttccctgcttttcaagcctttacaaacgatttactcgaaattctagagattgatgacctcgacgccatcgtgcctgcagtgaagaagctgaaggtactgtcatactag

SEQ ID NO: 217896 - DNA, 3666 bp, Artificial Sequence
  Description of Artificial Sequence: Synthetic coding sequence
atgctttttccactgcaagttgccgctgtgaccagctcagttcgggacgaccccttagaacattgcgtgagccccaggactagagccaggtcccctgagatctgcaagatggccgacaatctggacgagtttatcgaggagcagaaggcccgactagcggaagataaggcagagctggaaagcgatccaccctacatggagatgaaaggcaagctgtctgctaagctcagtgaaaacagcaaaatcttaatatctatggctaaggagaatataccgccaaacagtcagcagactcggggaagtctagggattgactacggcttgagtctccctctgggagaagactatgagcgcaagaagcacaaactgaaagaggagctgcgccaggactacagacggtatttgacccaggagcggctgaaacttgagcggaacaaagagtacaatcaatttttgcgtgggaaagaagaaagcagtgaaaaattccgacaggttgaaaagtccacggagcccaagagccagcgtaacaagaagccaattggccaggtaaagcccgacctgacctcacaaatccagacctcatgcgaaaatagcgaggggccacgcaaagacgtactgaccccatcggaggcgtatgaagaactgcttaaccagcggaggctcgaggaagaccgttatcgccaactcgacgatgagatcgaattgcgcaataggcggattatcaagaaggctaacgaggaggtgggtatcagcaatttgaaacatcagcggttcgcgtctaaggccggtatccccgaccgaagatttcaccggtttaacgaggacagagtgttcgaccgcaggtatcaccggccagatcaggaccccgaggtgtcggaggaaatggatgagcgcttcaggtatgagtccgactttgataggagactctctagagtgtacactaacgatagaatgcataggaataagagggggaatatgccacctatggagcatgacggggatgttatcgaacagtctaacattcgcattagttccgccgagaataaatctgctcccgataatgagactagcaaaagtgccaatcaagatacttgttctccattcgctggcatgttgtttggtggggaggaccgcgaattaattcagcgtcggaaggagaagtataggctcgagctgctggagcagatggcagaacagcagagaaataagcggagagagaaggacctggaacttagagtggccgcttccggagctcaggacccagagaaaagcccagaccgtttgaaacaattcagcgtggcgcctcgacattttgaggaaatgataccccctgagcgcccacggattgctttccaaactcccctgccacccctctccgctccctccgtgcctccaattccctctgtccacccagtaccatcacagaacgaagaccttagaagtggtttaagcagcgctcttggcgagatggttagccctagaattgctcccctgccccctcctccattgcttcctccgctcgctaccaactatcgcactccttacgacgatgcttattacttctacgggtcacggaacacatttgacccgtccctggcgtactatggttctggtatgatgggggttcagcctgctgcttacgtgtctgctcctgttactcaccagttggcacaacccgtagtgaatactgttggtcagaatgagttaaaaattacatccgatcaggtaatcaactcggggcttatcttcgaagacaaacccaagccttcaaagcagtcactccagtcttatcaggaagcgctgcaacagcagattcgggagcgggaagaacgaaggaagaaggagcgagaggaaaaagaggaatatgaagcaaagcttgaggcagagatgcgcacctataacccttggggaaagggcggagggggagccccactgcgggatgctaaagggaacctcattacagatctcaaccgaatgcataggcagaatattgatgcctaccataatcctgacgccaggacttatgaggataaaagggctgttgttagtttggacccgaatctggccacttcgaatgccgaaaacctggaggacgctgctaacaagagctcagggcatatgcagacacaatcatcacctttcgcacggggtaacgtgttcggcgaaccccctacagagcttcagatcaagcaacaggagctgtataaaaatttcctgagattccagatcgaagagaaaaagcagcgggaagaggcagagcgggaacgacttagaatcgctgaagagaaggaagagcgcagactggcagagcagcgggctcgtattcagcaggaatatgaggaagaacaggaaaaaaaacgagagaaggaggaagagcaacgtttaaaaaacgaagaacatattagactagcagaagagcgtcaaaaggaggccgagcgcaagaagaaagaagaggaagagaagtacaacttacagttgcagcattattgcgagcgcgataacctcattggggaggaaacgaaacacatgagacagccatcccccattgttccggcattgcagaataaaattgcttcaaagcttcagaggccaccgtcagtggattctatcatcagatccttcatccacgagagcagtatgagtcgggcacagtctcccccagtaccggctagaaaaaatcagctgcgcgcagaagaggagaaaaaaaacgtcatcatggagctgtctgaaatgcgcaagcagctgaggtcggaggagagacggttgcaagaacgccttttgcatatggactccgatgacgaaatccccattaggaagaaagagcgcaatccgatggacatttttgatatggccaggcatcggcttcaggcaccagtccgcaggcagagtcccaaaggcctggacgctgctacgttccagaacgtgcacgatttcaatgaattgaaggatcgggactcagagacccgagtggatctgaaattcatgtatctcgatcccccaagagatcatcataccctggaaatccagcagcaggccctcctgcgagagcagcagaagcgcctgaaccgtattaagatgcaagagggcgcaaaggtggacttggacgccatcccaagcgccaaggtgagagaacagcgcatgccaagagacgacacctctgacttcctgaagaatagcctactggagtccgactccgctttcattggggcatacggcgagacttacccggctatagaagacgacgtgctcccaccgccttctcaactcccttcagccagagagaggcgtcgtaacaaatggaagggactagatatagatagctctcgtccaaacgtcgccccagatggattgtccctcaagagcatttccagcgtcaacgttgatgagctgcgcgtcaggaacgaggaacggatgagaaggcttaacgagtttcacaacaagccgattaataccgatgacgagagctccctcgtggatcccgacgatattatgaagcatatcggagatgatggcagcaactcggtggcaacagagccctggctaagacctggtacctccgaaactctcaagcgctttatggctgagcagttgaaccaagagcaacaacagattcccggtaagcctggcacctttacatggcagggcctcagtactgcccatggctag

SEQ ID NO: 217897 - DNA, 3771 bp, Artificial Sequence
  Description of Artificial Sequence: Synthetic coding sequence
atgctcttcccacttcaggtggccgcagttacctcttctgtgcgcgacgacccgctagaacactgtgtcagccccaggacccgcgctagaagccccgagatttgcaagatggccgataacctggatgaattcattgaagaacaaaaagctcggcttgccgaggataaagccgagctcgaatctgacccaccctatatggagatgaagggtaagctgtccgccaaactgagtgagaatagtaaaatccttatctccatggccaaagagaacatcccaccaaattcccaacaaaccagaggcagcctgggcattgattacggactgtccctgcccctaggggaggactatgaaaggaaaaaacacaaactgaaggaagagctgagacaggactacagaagatatctgacacaaaaagtatttagcggaacgtcgaaaaagaattttctaagcaccagtgagaccgatccgtccacgctcggcgttagcttacctattggagagcgcctgagcgcgaaggagcgcctcaaacttgagcgaaacaaggaatacaaccagtttctgcgcggtaaggaggagtcctctgagaagtttcgtcaagtcgaaaagtctaccgagcccaaatctcaacggaataagaagcccataggacaagtgaagccagatctcacatcacaaatacaaacctcctgcgagaatagtgaaggtccacggaaggacgtgctgacaccaagcgaagcttacgaggagctgctgaaccagcggagactggaggaagaccgctacagacaactggatgatgaaatagaactacgaaatagacgaattatcaaaaaagcaaacgaagaagtcggaattagtaaccttaaacatcagcgcttcgccagcaaggccggtattcccgatcgacgctttcacagattcaatgaagaccgtgtctttgaccggaggtaccacaggcccgatcaagaccctgaggtgtctgaggaaatggatgaaaggtttcgctatgagagtgatttcgacaggcggctctcacgtgtgtacacaaacgaccgcatgcatcgcaataagaggggaaacatgcctcctatggagcatgacggcgacgtcatagaacagtccaatatacgcatcagctcagcagaaaacaaatccgcaccagacaatgaaacctccaagtcagctaatcaggatacgtgtagcccgtttgctgggatgttgtttggcggagaggatcgtgaactcattcagcggagaaaggagaagtatcgcttggaattactcgaacagatggcagagcagcagcgcaataagcgcagagaaaaagatctagagttgcgcgtcgccgcaagtggggctcaggaccctgagaaaagcccagacaggttgaaacagttcagcgtggccccacgccacttcgaggaaatgattcctcccgagcggcctagaatcgcttttcagacaccactgccacccctgagcgccccttctgtgccccctattcccagtgtgcatcccgtcccttctcagaacgaggacctgcggagtggactttccagcgctctcggggaaatggtgtctccccgtatagctccccttccccctcctcccctgttaccaccactggccactaactaccgcaccccgtatgacgacgcttactacttttacggtagccgcaatacctttgacccctcactggcgtactatggctccggtatgatgggtgtgcagcctgccgcttacgtatccgctccagtaacacatcaactggctcaacctgtcgttaacaccgtgggacagaacgagctcaagattacgagcgatcaggtgatcaactctggcctgatctttgaagacaagccaaagccaagtaagcagagtctccagagttaccaggaggccctgcagcagcagattcgcgagcgcgaggagcgaaggaaaaaagagcgcgaggagaaggaggagtatgaagctaagttggaagccgaaatgcgaacatacaacccttggggcaaaggtgggggaggcgcacctctaagggatgcaaaagggaacctcatcactgacctgaatcgaatgcaccggcagaatattgacgcgtaccataatcctgatgcaagaacctacgaagataaaagggcagtcgtgagtttggacccaaatctggccacctccaatgccgagaacctggaggacgccgctaacaaaagcagtgggcacatgcaaacgcagtcctctccatttgcacgtgggaatgtcttcggcgaaccacccaccgagctgcagattaaacagcaagaactctacaagaactttctaaggttccagatcgaggaaaaaaaacaaagagaggaggccgaaagagagagactaaggatcgctgaagagaaggaggagcgtaggctggcagaacagcgggcacgaatacagcaagaatatgaagaggagcaggaaaaaaaacgcgagaaagaggaagagcagcgcttgaagaacgaagagcacattagactggccgaagagcggcagaaagaggcagagcggaaaaagaaagaagaagaggagaagtataatctgcaactgcaacattattgtgagagagacaacctgattggcgaagaaaccaaacacatgcgacaaccctctccaattgtgccagctctgcagaacaaaatcgcttctaaattacagcgtccaccctctgttgactccatcatccgttccttcattcatgagagctctatgagtagggcgcaatcacccccagtccctgctcgcaagaaccagctgcgggcagaggaggaaaagaaaaatgttatcatggaactgtctgagatgcgaaaacagcttcgctctgaagagcggagacttcaggaacgtctgttgcatatggatagtgacgatgagattccaatcaggaaaaaggaaagaaatccaatggatatctttgacatggcaaggcatcggctccaggctccagtccgaagacagagtccaaagggcctagatgccgcaaccttccagaatgttcacgattttaacgagctgaaagacagggacagcgaaacccgggtggacctaaagtttatgtaccttgacccgccacgagatcaccacacactcgagatacagcaacaggcgctgctgcgcgaacagcagaagcggttaaatcggatcaaaatgcaagaaggggcaaaagtggatctcgacgcaatcccttcagctaaggtgagagagcaaagaatgccgagggatgacacttccgactttctgaagaacagtctgctggaatccgactctgcattcatcggcgcttatggagagacttatccggctatcgaggacgatgtgctgccaccaccatcccagttgccctcagctcgcgaaagaaggcgaaacaagtggaaaggcctcgatatcgatagcagcaggcctaacgtcgccccagatgggttgagcctgaagagcattagttccgtgaacgtggacgaactgcgcgtgcgtaacgaagaaagaatgagaaggttgaatgagttccataataagcctattaacacggatgatgagtcctcccttgtggaccccgacgacatcatgaagcatattggcgatgatggttcaaacagcgtagctaccgaaccctggttgcggcctggcacctctgaaaccctgaagaggttcatggctgagcagttaaatcaggagcaacagcaaatccccggaaagccgggaacttttacttggcagggactctctaccgctcatggatag

SEQ ID NO: 217898 - DNA, 2631 bp, Artificial Sequence
  Description of Artificial Sequence: Synthetic coding sequence
atggacgaacgttttcggtatgagagtgattttgaccgtagactgagtagagtctacacgaacgatcgcatgcatagaaataagcgcggaaatatgccaccgatggaacatgacggcgacgtaatcgaacaaagcaatatacgcatcagctccgctgagaacaagtccgccccagataacgagaccagcaaaagcgccaatcaggacacctgtagcccttttgctggaatgcttttcggaggcgaggacagggaactgattcagcgcagaaaagaaaaatacaggctggagctgctggaacagatggccgagcagcagcggaataaaaggagagagaaggacctcgaattacgggttgccgcttccggggctcaagaccctgagaagtcccccgaccgactcaaacagttcagtgtcgctcccaggcattttgaagagatgatcccccctgaacggcctagaattgctttccaaaccccactgcctcccctctctgccccaagcgttccacctattccttccgtccatcccgtgccatctcagaacgaagatctccggtccggattatcctctgccctgggggagatggtgtctcctcggatcgctccccttcccccaccacccctcctaccccctctggctacaaactaccgaaccccttatgacgatgcctattacttctacggctccaggaatacttttgacccatctcttgcatattatggtagcggaatgatgggagtgcagccggctgcctatgtgtcagcaccagtcacgcaccagctggctcaaccagttgtgaatactgtcggccagaatgaactgaagatcacttccgatcaggtgataaacagcggtctcatttttgaagacaaacccaagcccagcaagcaatcccttcagtcatatcaggaagccttgcagcagcagatcagagagcgggaagagcgcaggaagaaggagcgggaggaaaaggaggaatacgaggcgaagttagaagccgaaatgagaacctataatccctggggtaaaggaggaggcggagctccgctgagagatgcgaaaggtaacctgatttctcacatgcagacacagtcatccccttttgccagagggaatgtcttcggcgaaccccctactgagctgcaaattaagcagcaggaactatacaagaactttctgaggttccagattgaggaaaaaaagcagcgagaagaagccgagagagaacggttaaggatcgctgaagaaaaagaagaaaggaggcttgcggagcagcgcgctcggattcagcaggagtatgaggaagaacaggagaagaagcgcgagaaggaggaagagcagaggcttaaaaacgaagagcacatacgtctggcagaggagcggcaaaaagaggcagagaggaaaaagaaagaagaggaagagaagtacaaccttcaactgcagcactattgcgagcgagacaacttaattggtgaggaaaccaaacatatgcgacagccatccccaattgtccccgctctccagaacaaaatcgcctctaaactccaacgcccacctagtgttgatagcatcataagatcattcatccatgaaagctctatgtccagagctcagtctcctcccgttccagcccgaaagaatcagttgcgggcagaggaagagaaaaaaaacgtgattatggagttatcagaaatgaggaagcagcttcggtctgaggaacgaaggcttcaggaacgtctgctacatatggattcagacgatgagatccctatccggaaaaaagaacgtaatcctatggacattttcgatatggccaggcaccgcttgcaggcacccgtccgtaggcaatctcctaaaggactagacgctgccacttttcagaatgtgcacgatttcaatgaactgaaggatcgggatagcgagacacgggttgatttaaaatttatgtacctggatccaccacgagatcaccacactctcgagattcaacaacaggccctgctgagggaacaacagaagcgcctgaaccgaattaaaatgcaggaaggtgccaaggtcgatctggacgctataccctcagcgaaggtgagggagcagcgcatgccgcgagacgatactagcgatttcctgaagaacagcttgcttgagtcagactctgcctttataggagcctacggggagacataccctgccatcgaggacgatgtactgccgcctcccagccagctcccatcagccagagagcgtagaagaaacaaatggaaggggttagatatagactccagcaggccaaatgtggcgccagatgggctgtcgctgaagtctatcagttcagtgaacgtggacgaactgcgggtcaggaacgaggaaagaatgagacgactgaatgagttccataataaacccataaataccgatgacgagtcttccctggtcgatcccgacgatattatgaagcatatcggcgacgacgggagcaatagtgtggccactgaaccgtggctgaggccaggcacatctgagacactgaagagatttatggcagagcaactcaaccaggaacagcagcagattccaggtaagccgggtacattcacgtggcagggattatccacggcacacgggtag

SEQ ID NO: 217899 - DNA, 2631 bp, Artificial Sequence
  Description of Artificial Sequence: Synthetic coding sequence
atggacgagcgattccgctatgagagcgacttcgatcgccgattgtctcgggtgtacacaaatgacagaatgcaccgcaacaagcgagggaacatgcctcccatggagcacgatggcgacgtgatcgaacagtccaatatacgtatcagcagcgccgagaacaagtccgctcccgacaatgaaacgtcaaagagtgccaaccaggacacatgctccccattcgcaggcatgttgtttgggggagaggaccgggagctcatacaacgccgtaaggagaagtaccggctcgagttgctggagcaaatggcagaacagcagaggaacaagcgccgtgagaaggatctggagcttagggtggcagcgagcggcgctcaggaccctgaaaagtcccctgatcggttaaagcaattttccgtggcccctcggcattttgaagaaatgatccctccagagcgccctcgcatcgcatttcagactcctctgccgcctctgtcagccccatctgtccccccaattccttccgtgcaccctgtgccaagccaaaatgaggacctgcgtagtggcctgagctcagcactgggcgaaatggtgagccctcgcatcgcgccactcccaccccctcctttgttacctcctctggccactaactatcgaacgccctacgatgatgcatactatttttacggtagcaggaacacattcgatccaagcttagcttactatggctccggaatgatgggagttcaacccgctgcctatgttagcgctcctgtgacccaccaattagcacaaccagtcgttaacactgttggacaaaacgaactgaaaataactagtgaccaggtgattaatagtgggctgattttcgaggacaagcctaaaccatccaaacaatcccttcagagctaccaagaggctctgcaacagcagatccgagaaagggaagaacggcgaaaaaaagaaagagaggaaaaagaggaatacgaagctaagttagaggctgaaatgagaacttataatccttggggaaaagggggaggcggagcgccactgcgggacgctaaaggtaacttaataagtcacatgcagacacagagcagcccttttgccagagggaatgttttcggagaaccaccaacagagctccaaatcaaacagcaggaactctacaaaaatttcctccgttttcagatcgaggaaaagaagcaaagagaggaggctgagcgcgagcgtctccgcatcgccgaggaaaaagaggagagaagacttgccgagcaacgcgctcgtattcaacaggagtacgaagaggagcaggagaaaaaaagagagaaggaggaggagcaacgcttgaaaaacgaggaacacataagactggcggaggagcggcaaaaggaagccgagaggaagaagaaagaggaggaagagaaatataatcttcagctgcagcactattgcgagagagacaatctcatcggagaggagacaaagcatatgagacagccttccccaatcgtgccagccctgcagaacaaaattgccagcaaactacagcgtccaccttccgtggatagcatcattagatcgtttattcatgaaagctctatgagcagggcgcaatctcccccagtccctgctcgcaaaaatcagctgcgggcagaggaggagaaaaagaatgttataatggaactatccgaaatgcgcaaacaactccggtctgaggaacggcgtctgcaggagcgtctccttcatatggatagcgatgatgagatccctataaggaaaaaggaacgcaatcccatggatatttttgacatggcacgccacaggttgcaggccccagttaggcgtcagagcccaaaagggctcgatgcagccacattccagaatgtgcatgacttcaatgagctgaaggatcgtgattctgaaacacgtgtcgatcttaagttcatgtacctcgacccgccacgtgaccaccacacactggagattcagcagcaggcactcctacgggaacagcagaaacgcttgaacagaatcaaaatgcaagagggcgctaaggtggatttggacgccatcccctccgctaaagtgagggaacaacgcatgcctcgggacgatacttcagattttctgaagaactctcttttagaatcggacagtgccttcatcggggcttatggcgaaacgtatccagcgattgaggacgacgtgttacccccacccagtcagctccctagcgcccgagagagacggcgaaacaagtggaaggggctggacattgactcttccaggcctaatgtggctccagacggcctatccctaaaatccatcagctctgtgaacgtcgatgaactccgcgtcaggaacgaggagaggatgcggagactgaatgagtttcataataaaccaattaataccgatgatgaatcctccctagttgaccccgacgacatcatgaagcatattggagacgacggcagtaatagtgtcgctactgagccttggctaaggccaggcaccagcgaaactctcaaacgctttatggcagagcagctcaaccaagagcagcagcagatccctggaaaaccaggtaccttcacctggcagggcctgtctacggcgcacggctag

SEQ ID NO: 217900 - DNA, 1677 bp, Artificial Sequence
  Description of Artificial Sequence: Synthetic coding sequence
atgccgtggaggcgtcgcaggaaccgggtgtctgcactggagggaggaagggaagaggaagctccaccagaagccgctgcggtccctcctgccctgttgaccagtcctcagcagaccgaagcagctgccgaacgaatcttgctccgaggaatattcgagattggcagagattcatgtgacgtcgtattgtccgagcgggctctccgatggcgaccgattcagcccgagcggcctgccggtgactcaaaatacgatctcctgtgtaaagaggaattcatagagctgaaggatatcttctctgtgaaacttaagaggcggtgcagcgtcaagcagcagcgttctggcaccctgcttgggattactttgtttatttgcctcaagaaggaacagaataagctgaaaaattccacgttagacctcatcaacctgtccgaggatcattgtgatatctggtttcgacagtttaagaaaattcttgccggttttcctaaccggccaaaatcactgaagattcttttgaacccacaaagtcataaaaaagaggctacacaggtgtactacgaaaaagtggaaccattacttaaacttgccggtataaaaaccgacgtcactattatggaatatgagggtcacgccctgtctttgctgaaggagtgcgagttacagggcttcgatggtgggcaccgcaaaccacttttcgctattcactggagcgtccagcgtcttttcacaggtatgcaaactctcgaaccttctgtcgtctgcgttggcggtgatggatctgcatcagaggtggcccacgcattactcctcagagcccagaaaaacgcgggaatggaaacagatcgcattctcactccagttcgagcccaactccccctgggcctgataccagccggatctactaacgtgttagcacacagcttgcacggggtgccacacgtcattaccgccacgctgcacatcattatgggccacgtccagctggtcgacgtctgcaccttctcgactgcgggaaaactcctgaggttcggttttagtgcaatgttcggctttggtgggagaactctcgcactggcagagaaataccgctggatgagtcccaatcagcggagagattttgccgtggtcaaagctctagccaaattgaaagcggaagactgtgagatttcattcttgccattcaatagtagtgacgacgtacaggagcgaagagcccagggctctcctaagtccgattgtaatgaccagtggcagatgatccagggccaattcctcaatgtgtcaataatggcgattccgtgtctttgctctgtcgcaccgagggggttggcccctaataccagacttaataacggatcaatggccctgattatcgctagaaatacctcccgccctgaatttatcaagcatctgaaacgttatgcatccgtcaagaatcagtttaactttccgtttgtcgagacttatactgtagaagaggtgaaagtgcacccaaggaacaatacaggtggctataatcctgaagaggaagaggacgagacagcatcggagaactgtttcccatggaacgtcgatggagacctaatggaagttgccagcgaagttcacattagactccaccctagactcatctccctctatggcggaagcatggaggaaatgatcccgaaatag

SEQ ID NO: 217901 - DNA, 1260 bp, Artificial Sequence
  Description of Artificial Sequence: Synthetic coding sequence
atgccttggcgacggcgacgaaatagggtttcagccttggaggggggacgcgaggaagaggcacctcccgaggccgcagctgtccctccggctttgctcacatccccgcagcaaaccgaggccgcagccgagcggattctccttcgcggtatcttcgagatcggcagggactcatgtgacgtagtgctgtcagaacgggctctgcgctggcgaccaatccagcctgaacggccagccggtgactcaaaatatgacctgctgtgcaaagaagaattcatcgaactgaaagatatctttagtgtgaaattaaagcgcaggtgcagtgtgaagcagcagcggtcaggtacactgctcggtattacgttgttcatctgcctcaagaaggaacagaataaactgaagaactctacactagatctcatcaatttgagcgaagatcactgtgacatttggttccgtcagttcaagaagatactggccggatccacaaacgtgctcgcacacagtcttcacggcgtcccacacgtgatcacggccaccctgcacataataatggggcacgtgcaattggtcgacgtttgcaccttttccaccgccggtaagctgctgcgcttcggattctctgccatgttcggttttggagggagaacactggcccttgcggaaaagtaccggtggatgagtccaaaccaacgtcgggattttgccgtggtgaaagctcttgcaaagcttaaagctgaagactgcgagatttccttcctgccttttaattctagcgacgatgtgcaggagcgccgagcacagggcagccctaaatctgattgtaacgatcagtggcagatgatccagggtcagttcttgaacgtgtcaattatggccattccttgtctctgtagcgtggcccctcggggtctggcccctaatacaaggttaaacaacggctcaatggccctcatcattgcccgaaacactagcaggcccgaattcataaagcacctgaagcgctacgctagcgttaagaaccagttcaatttcccctttgtagagacgtacacagttgaggaagtaaaagtgcaccctcgcaataacactgggggatataaccccgaagaagaggaggatgagacagcaagcgaaaactgcttcccttggaacgtggacggtgatctaatggaagtcgcttctgaagtgcatattcgtttacaccctcggctgatttccctatacggcggatcaatggaagaaatgatacccaaatag

SEQ ID NO: 217902 - DNA, 1392 bp, Artificial Sequence
  Description of Artificial Sequence: Synthetic coding sequence
atgccatggcgcagaagacgcaatagagtgagcgcgctggaaggagggagggaggaggaggcccctcccgaagctgctgctgtcccacccgcactccttactagtccccaacagaccgaagctgcggctgagaggatcttgctccgaggcatttttgaaattggacgggactcctgtgatgttgttctctccgaaagagcactgcgctggcgcccaatccagccggaacggcctgctggtgactctaagtacgacttgctgtgtaaagaggagttcatcgagctcaaggacattttcagcgtgaagctgaagagacgctgtagcgtaaagcagcagagaagcggaaccctgctcggaattacactgttcatatgtctcaagaaggagcaaaacaagttgaagaattccaccctggacctgataaacctgtccgaagatcactgtgacatttggttcaggcagtttaaaaagatcctagccggattcccaaatcgtcccaagtctctcaagatcttgctgaatccgcaaagccacaaaaaggaagccactcaggtttactatgagaaagtggaacctctgttgaaactcgctggcattaaaaccgatgtaactagaagcacaaatgtgcttgcacatagcctgcacggcgttccccatgtcatcaccgccacattgcacatcattatgggacacgtgcaattggtagacgtctgcacattctcaacggccggaaagttactgagattcggcttcagcgctatgtttggcttcggtggccgaactctggcccttgcagagaaatataggtggatgagcccgaaccaaaggcgggattttgctgttgtgaaggcactcgcaaagctgaaagcagaagattgcgagatctccttcctaccatttaatagtagtgatgacgttcaggaacggagagcccaagggtcccccaagtctgactgcaatgaccagtggcaaatgatacaggggcaattcctgaacgtgtccattatggctatcccctgtctgtgctctgtcgcccctcgcggacttgcccctaacacccgattgaataatggctccatggcgcttatcattgcaagaaatacttcacgccctgagtttatcaagcatctcaaacgctatgcttctgtgaagaatcagttcaattttcccttcgttgagacttatactgtggaagaagtcaaggttcatcccagaaataataccggaggatacaatcctgaggaagaagaagatgagaccgcgtcagagaactgctttccttggaacgttgatggagatctcatggaggtggcatctgaagtccacattcgtctgcaccccagattgatatcgctgtatggaggtagcatggaagagatgatacccaagtag

SEQ ID NO: 217903 - DNA, 1599 bp, Artificial Sequence
  Description of Artificial Sequence: Synthetic coding sequence
atgccgtggcgtcgcaggaggaaccgcgtgtccgctctggagggagggagggaggaggaagctcccccagaggcagccgcagtgccccctgccctcctgacttccccccagcaaaccgaggctgctgccgagcggatcctcctgagaggcatcttcgaaatcggtcgcgattcttgtgacgtagtcctgtccgagagggctctcagatggcgtcccattcagcctgagcggccagccggagactcaaagtatgatctcttgtgcaaggaggagttcatcgaacttaaagacattttcagcgtaaagctgaaaaggcgctgtagtgtaaagcaacagcgcagcggaactctactcgggatcactttgttcatttgcctgaagaaagagcaaaataagctaaagaactccacgttggacttaatcaacctgtctgaggatcactgcgatatttggttcaggcagtttaagaagatcctcgccggattcccaaaccgcccaaaaagcctaaaaatcctactgaatccccagagtcacaaaaaagaagccactcaggtttactacgaaaaagttgaaccactgttgaagctcgccggaattaagactgatgtcaccattatggagtatgagggccacgctctcagtctactcaaagaatgcgaactgcaggggtttgacggcgtggtctgtgtaggaggcgacggttctgccagtgaagtggcccacgccctcctgttaagagctcagaagaacgccggtatggagacagatcgcatcctgaccccggtacgggcacaactacctctcggcctgattccggctggatccacaaatgtgcttgcccactcactccatggcgtacctcacgtgatcacagccaccctgcatataatcatgggccacgtgcagttggtggatgtgtgcacgttcagcacggcagggaagctgcttaggtttggcttcagtgcaatgtttggattcgggggtcggactctggcgctggctgagaaatatagatggatgagccccaaccagagacgagactttgctgttgttaaggcactggccaagctgaaagcggaggattgcgagatctcctttttacccttcaactcctccgatgacgtccaggagcgcagggcccagggttctcccaagtccgactgtaatgaccagtggcagatgatccagggtcagtttctcaacgtgagtattatggccataccctgtttatgtagcgtggccccacgtggccttgcccctaatacacgcttaaataacgggtctatggccctcataattgcccgaaatacttctcgacccgagtttataaaacatctcaaaagatacgccagtgtcaaaaatcagttcaacttcccctttgtggaaacctacacagttgaggaagtgaaggtgcaccctcggaataacacaggaggatataacccggaggaggaggaggatgaaaccgcttctgaaaactgctttccttggaacgttgatggtgacttgatggaagtggcctctgaagttcacatacgtctgcaccccaggctgatttctctatacggaggctccatggaggaaatgattccaaaatag

SEQ ID NO: 217904 - DNA, 1545 bp, Artificial Sequence
  Description of Artificial Sequence: Synthetic coding sequence
atgccttggcgccgtagacggaatcgggtaagtgctctcgagggcggacgcgaggaggaggcccctcccgaggctgccgcagtgcctcccgctctgcttaccagtcctcagcagactgaagctgccgcagagcggatcctgctgaggggcatatttgaaatagggagggactcatgcgacgtggtgctgtccgagagggctctgcggtggcgccctatccagcccgaacggcctgcaggggatagcaagtacgatctactgtgtaaagaagagttcatcgagctgaaggacattttctcagtgaaacttaaaagacgttgttctgtgaaacagcagagatctggcaccttgctcggaataacactatttatatgcctaaagaaggaacagaacaagcttaaaaacagcacgcttgatctcattaatctatcagaggaccactgtgatatctggtttaggcagttcaaaaagattctggcagtaatggagtacgagggccatgctctctctctcctgaaggaatgtgaactgcaggggttcgatggcggacatcgaaagccactgttcgcaatccactggtctgtccagagactgttcaccggaatgcaaactctggagcccagcgtggtctgtgtaggaggagacgggtctgctagcgaagtggcgcacgccctcctgctgcgtgcacagaaaaacgccggtatggagaccgatagaatcctgacacccgtgagagctcagctgccactggggttgatccctgccggatctacaaatgtgctggcccactcactgcacggagttccccatgtaatcacggcaacacttcatatcattatgggccatgtgcagttggtggacgtgtgcaccttctcaaccgccggtaaattactgagattcggattctctgccatgttcggcttcgggggaaggacactagccctggctgaaaagtaccggtggatgtcccccaatcagcgcagagatttcgccgtggtgaaagcactggcaaagcttaaggccgaagattgcgagatcagtttcttgccattcaatagttcggacgacgttcaggaacgcagggcccaggggagtcctaagagcgattgcaacgatcagtggcagatgatacagggacagttcttaaatgtctctatcatggcaatcccttgtctatgtagcgtcgcacctagggggctggcaccaaataccagattaaacaacggctccatggcactgattatcgcccgaaatactagccgcccagaatttattaaacacctcaagcggtacgcatcagtaaagaaccagttcaattttcccttcgttgaaacttacacagttgaagaagtgaaagtgcacccaaggaacaacactggcggatacaacccagaagaggaggaagatgagaccgcctcagagaattgtttcccgtggaacgtagacggagatctaatggaagtcgccagtgaagttcatataagactgcacccgagacttatttcgctgtacggagggagtatggaggaaatgataccaaagtag

SEQ ID NO: 217905 - DNA, 804 bp, Artificial Sequence
  Description of Artificial Sequence: Synthetic coding sequence
atgcatctactgcttttccagctactcgtcttattgcccttgggcaaaacaacacggcaccaggacggccgacagaaccagtcgtctttatctccggtgctgttaccccgtaatcagcgagaacttcctacggggaaccatgaggaagccgaagaaaaaccagatctgttcgtagcagtcccccaccttgtggctacatcgcctgcaggcgaagggcagcggcagagagagaagatgctgtcaaggtttggacggttctggaagaagcctgagagggaaatgcacccaagtagagattcagactccgagccatttcctccagggacacagagcctaattcagcctattgatggcatgaagatggaaaagtccccactgcgggaagaagctaagaagttctggcatcactttatgttcaggaaaacacctgccagccagggcgtgatcctgccgatcaaaagccacgaggtgcattgggaaacctgtagaacggttccattctcacagaccatcacacacgaaggctgcgaaaaagtggtcgtccagaataatctgtgcttcggcaaatgcgggagtgtgcatttcccgggagctgcccagcacagtcacaccagctgttcgcattgcttacccgctaaattcaccaccatgcacctcccattgaactgcaccgaactgagctctgttattaaggttgtgatgctagtggaggaatgtcaatgtaaggtgaaaacagaacatgaggacggacacatcctgcacgcaggatcccaggattcctttattcccggagttagcgcatag

SEQ ID NO: 217906 - DNA, 789 bp, Artificial Sequence
  Description of Artificial Sequence: Synthetic coding sequence
atggcatggttggaagatgtggacttcttagaggacgtgcccctgttggaggacattccattgttagaagatgtccctttgctggaggacgtgccactcctagaagatacttccaggctcgaagacattaacctgatggaggacatggcgttactggaggacgtggatctgctggaagataccgactttctggaggacctcgacttctctgaagccatggacttgcgcgaagataaagacttcctggaagatatggacagcctagaggatatggccctgctggaagatgtcgatctactggaagacacagactttttggaggatcccgatttcttggaagctatcgatctgcgggaggacaaggacttccttgaggatatggatagcctcgaggacttggaggcaatagggaggtgtggtttttccggcaggcacgggttttttggcaggcgcaggttctcaggccgacctaaactttcaggtagactgggccttcttgggcgacggggattttccgggagattaggaggttactggaaaacatggattttctggaagacctggattttctggaaaacttggatcttccggaagacttacatcgggtggaagacctggatattttccgggcgatgcgggcttactggaaggccaggattcggaggtcgaagaaggtttttctggaaaactctgacagactggaagacttggatcagtttctggaaaactctcattgactggaaaacttggatctcattttggaagactctgattgactggaagatctag

SEQ ID NO: 217907 - DNA, 1365 bp, Artificial Sequence
  Description of Artificial Sequence: Synthetic coding sequence
atgctcgctgaaaatttagtggaggagtttgaaatgaaggaagacgaaccgtggtacgaccaccaggatttacagcaagatctgcagcttgctgctgagctcgggaagaccctgctggatagaaatacagaattagaagacagtgtgcaacagatgtacaccacgaaccaggagcagctgcaggaaatcgaatatctaaccaaacaggtagagctgcttcgacagatgaatgagcagcacgcaaaagtgtatgagcagttggacgtgactgcaagagaactcgaggaaaccaatcaaaagctcgtggccgatagcaaagcttctcaacagaaaatcctctctcttacagaaactattgaatgcttacagactaacatcgatcatctgcagtcacaagtagaggaactgaaatcgtcgggacaggggcgaaggtcccccggaaagtgtgatcaggagaaaccagccccttcttttgcttgtttgaaagagctgtacgacttgcgccagcactttgtgtacgatcacgtctttgcagaaaaaatcaccagcctacagggacagccctccccagacgaggaagaaaatgaacacttgaagaaaactgttacaatgctgcaggcccaactctccctggaaaggcagaagagggtgacaatggaagaagagtatggcctggttctgaaggagaattctgagctcgaacagcagctgggcgcaactggcgcttatagagcgagggcactggagcttgaagctgaagtggcagagatgcgccagatgctgcaaagcgaacaccctttcgtgaacggtgtcgaaaagttagtgcctgacagcctatacgtcccgttcaaagagccaagccagtctctcctcgaagaaatgttcctgacagttcctgagagccatcggaagccccttaaacgatcctcctcggagacgattctcagtagcctggccggtagcgacatagtcaagggccatgaggagacgtgtatccggagggccaaagctgtcaaacagagagggatcagtctgctccacgaggtggacacacagtattctgccttgaaagtgaagtatgaggagcttttgaaaaagtgccaggaagagcaggattcattgtctcacaaggctgtgcagacatcgcgcgctgccgctaaggatctgaccggggtgaacgcgcaatctgaacctgttgcttcgggctgggagttggcctccgtgaacccagaacccgtgtcttcccccactaccccaccggaatacaaggctctgtttaaagaaatcttttcatgtatcaaaaaaactaagcaagagatcgatgagcagcgaaccaaatatcggtctctctcatcacattcttag

SEQ ID NO: 217908 - DNA, 618 bp, Artificial Sequence
  Description of Artificial Sequence: Synthetic coding sequence
atgctcggtgcaaaaccacactggcttcccggtccgctgcactcccccggactcccactcgtactcgtgcttttggccctcggagccggatgggctcaggagggctctgaacctgtactgctggaaggggagtgtctcgtggtgtgcgaacccggaagggcagcagccggtggccctggcggagctgctctgggagaggccccaccaggcagagtcgcattcgccgcagtcaggtcacaccatcacgagcctgccggagagaccggcaatggaaccagcggggctatatattttgatcaggtactggtgaacgaaggcggtgggtttgacagagcaagtggctccttcgtagcccctgtgcgcggtgtctacagttttcgattccatgttgtcaaggtatacaaccgccagaccgtccaggtgagcttgatgctaaatacctggcccgtgatctccgcctttgcaaacgaccctgacgtgacaagagaggctgccacctccagcgtgctgctaccacttgaccccggagatcgcgtatctcttcgcttgaggaggggaaatctgctcggaggctggaaatactcaagcttctccgggttccttatcttccccctgtag

SEQ ID NO: 217909 - DNA, 990 bp, Artificial Sequence
  Description of Artificial Sequence: Synthetic coding sequence
atgattctgatgaagatgggcttctctggtattgtcgtgcaccaagagtcagtctgcgcgacttacgggagtgggttaagctccacatgtatcgtagacgtgggcgatcagaagaccagcgtgtgctgcgtggaagacggcgtgtcgcaccgtaacacgaggatcttctcttggaatcaggacatctctgggctgcaggaccatgagtttcagattcgccaccccgattctcctgccctgttgtaccagttcaggttgggagatgagaagctgcaggcccctatggcactcttctatcccgcaacattcggtatcgtgggccagaagatgaccactctccaacatcgaagtcaaggcgatcctgaagatccacacgatgagcattacctgctggccacacagtctaaacaagaacaatctgcaaaggcaacagctgatcgcaagagtgccagcaaacccattgggtttgagggcgatctcagaggtcaatccagcgatctgccagaacgccttcactcacaagaagtggacctgggctctgcacagggagacggactgatggctgggaacgatagcgaggaggcacttactgcattgatgtcaaggaaaacagcgatctcactgttcgaaggcaaagcattgggcctggataaagctatactgcactcaattgactgttgtagcagtgacgatacaaagaagaaaatgtatagcagcattctcgtggttggaggagggctcatgtttcataaagctcaggaattcctgcagcatcgcattttgaacaaaatgccacccagctttcgtagaattattgagaatgttgatgttatcaccaggccaaaagatatggatcccagactgatagcttggaagggaggtgccgttctggcctgccttgataccacacaggaactctggatttatcagcgcgagtggcagcgcttcggcgtccggatgctgcgcgagagagccgctttcgtatggtag

SEQ ID NO: 217910 - DNA, 1131 bp, Artificial Sequence
  Description of Artificial Sequence: Synthetic coding sequence
atggaggaatttcatgggcgtaccctccacgacgacgacagttgtcaggtcataccagtcctgccacaagtgatgatgatcttgatcccgggacaaactctgcctttgcaactgttccatccgcaggaagtgtccatggtcagaaacctcatacaaaaggacagaacattcgctgtgctcgcttacagcaacgtccaagaacgggaagcacaatttggcaccacagcagaaatctatgcgtatcgtgaggaacaggatttcggaatcgagattgtgaaggtcaaagctattggcaggcagcgattcaaggttctagaactgcgaactcagtccgatggtattcaacaggccaaggtgcagatcttgcccgaatgtgtactcccctcaacaatgtcggctgtgcagcttgaatcgctgaataaatgccagattttcccatctaagcctgtgagtcgtgaggaccaatgttcttataagtggtggcaaaagtaccaaaaacggaaattccactgtgcgaacctgacatcctggcccaggtggctttattccctgtatgatgccgaaacgctgatggacagaataaagaagcaactgcgtgagtgggatgaaaacctgaaagatgatagtcttcccagcaatttctcctatagagtggctgcttgcctgcctatcgatgacgtgcttagaattcagctccttaaaattggtagcgcgatccagagactccgatgcgagcttgatatcatgaacaaatgtacctcactctgctgcaagcaatgccaggagactgaaattaccacaaagaatgagatcttcagtctctctctctgtggaccaatggcagcgtatgtgaacccacatgggtacgttcatgagacgctaactgtgtacaaagcttgcaacctgaacctgataggtaggcctagcacggagcacagctggttccccggttacgcttggacagtggctcaatgtaaaatttgtgcctcacacatcggatggaagtttactgccactaaaaaggatatgtccccacagaaattctggggcttgactagaagcgccctgcttcctacaatcccagacactgaagatgagatcagtccggataaggtcatcctgtgcctctag

SEQ ID NO: 217911 - DNA, 1326 bp, Artificial Sequence
  Description of Artificial Sequence: Synthetic coding sequence
atggccggagaaggcgaccaacaggacgccgctcataatatgggcaatcatctaccactgctgcccgagtccgaagaggaagacgagatggaggtcgaagaccaggactcaaaggaggcaaagaagccaaacattatcaattttgatacttcactgcccaccagccatacatatctgggagctgacatggaggagttccacggcagaaccctccacgacgatgatagctgtcaggtaatacccgtgctcccacaggtgatgatgatcctgatacccggtcagactctgccactgcagctgtttcacccccaggaagtttccatggtccgcaacctgatccagaaggaccgcacttttgccgtactggcatattccaacgtccaggaaagagaagctcaattcggcactacggcagaaatctatgcttatagggaagaacaggattttggcatcgaaatcgttaaggtgaaggcgatcggacgtcagcgattcaaggtgctcgaactcagaacccagtccgatggcattcagcaggcaaaggtgcaaattctgccagaatgcgtgcttccctcaaccatgtctgctgtgcagctcgagtcactgaataagtgtcagatcttccccagcaagcctgtttcgcgagaggaccagtgctcgtataagtggtggcagaagtaccaaaagaggaaattccactgtgctaatcttacctcctggcccaggtggctgtatagcctctacgacgctgagactctaatggacagaatcaaaaagcaactaagagagtgggatgagaatctcaaggacgacagcctgccctccaatcctattgatttttcttaccgggtggcagcctgcctacccatcgatgacgttcttaggatccaactgctcaaaatcgggagcgctatacagaggctgagatgtgagctggacattatgaacaaatgcactagcctgtgttgcaagcagtgtcaggagactgaaattacaacaaagaacgagatctttagcctgtcattgtgcggcccaatggcagcctacgttaacccacatggctacgttcacgaaacgctcactgtatataaggcctgtaacctgaatttgatcggaaggccaagcacagagcactcctggttcccgggatatgcttggaccgtagcccaatgtaaaatctgtgcaagccatataggatggaagttcaccgctaccaaaaaggatatgagtccccagaaattttggggattgacaaggagtgccttactgccaacaatccctgatactgaagacgagataagccctgacaaagtgatactttgcttgtag

SEQ ID NO: 217912 - DNA, 1335 bp, Artificial Sequence
  Description of Artificial Sequence: Synthetic coding sequence
atggaggaggagggcaagaagggtaagaagcccggaatcgtgagcccattcaagcgcgtttttttgaaaggggaaaaatcccgcgacaaaaaggcacacgaaaaagttacggagcggaggccactgcatacggtggttctctcactgcccgagagggtcgagcccgatcggttattgtccgattacattgaaaaggaagtgaagtacttgggacagctcacctccatacctggctacctcaacccctcctccagaactgaaatccttcacttcattgacaacgcgaaacgggctcaccagctgcctgggcacctcacccaggaacatgatgcagtactctcccttagcgcttataatgttaagctggcctggcgcgacggggaagatataatcctccgggtaccaattcacgatatcgcggcagtgtcttatgtcagggatgacgctgctcacctcgtcgtcctcaagacagctcaagaccccggaatctccccctcccaatcgttgtgtgccgaatcttccaggggtttgagtgctgggagcctgtcagagtcggccgtgggacccgtagaagcttgctgtctggtgatcctcgctgcggagtctaaagtcgcggctgaggaactgtgttgtttactcggccaggtgttccaggtggtgtacacagagtcgactatcgatttcctggatcgcgctattttcgacggcgcttctactccaactcatcaccttagcctgcactccgatgatagtagcacaaaggtggatatcaaggagacatatgaagtcgaggcttcaacattttgcttccccgagtcagttgatgtaggcggtgcgtcaccacattctaagacaattagtgaatcagaactgtctgcttctgccaccgaactcttgcaagattacatgttaaccctgcgcacaaagctgagctcccaggagatccagcaatttgcagcgttactgcatgagtacaggaatggggctagcattcacgagttctgtatcaatctcagacagctatatggggacagccgaaagttcctgctccttgggcttcggccattcattcctgaaaaagactctcagcatttcgagaactttctggaaacaattggcgtgaaggatggcaggggtataattacagactcctttggcaggcaccgcagggctctgtcaacaactagctcatccacaaccaacgggaatcgcgctaccgggagctccgacgaccgcagtgccccaagcgaaggtgacgagtgggacaggatgatctctgatatatccagcgatattgaagctctgggctgctctatggatcaagacagcgcctag

SEQ ID NO: 217913 - DNA, 1398 bp, Artificial Sequence
  Description of Artificial Sequence: Synthetic coding sequence
atgcatagctcctgtcggcaacgtaggaaccagaacctgtcaaaagaaatacctcaaactgaattccataccggctactccatggagaatgaaccagggattgtgtctccattcaagagggttttcctgaaaggtgagaagagccgcgataaaaaagcgcatgagaaggtgaccgaacgcaggccccttcataccgttgtactcagcctgccagagcgcgtggagcccgacagactcttaagtgattacatcgaaaaggaagtgaaatatcttggtcagttgacatccattcctggataccttaacccttcaagccgtacagagattctgcatttcattgataatgctaagcgtgcccatcagctaccgggtcacctgactcaggagcacgacgctgtgctgtctctgagtgcctacaatgtcaaactcgcgtggcgcgatggcgaagacatcattctgagagttccaatacatgatattgctgcagtgagttatgtcagagacgacgctgcccacctggttgtgttaaagacggcacaggacccaggaattagtccgtctcagtctctctgtgcagagtcctcgcgcggactgtcggcaggatcgctcagtgagagtgcagtcggccctgtcgaggcttgttgccttgtgatcctcgcggctgaaagtaaagtcgccgctgaggagctgtgttgcctcctcggtcaggtgtttcaggtcgtgtataccgagtcaacgatcgactttcttgatagagccatcttcgacggggcaagcacccccacacatcatttgagcctgcactcggacgacagctctactaaagtggatattaaagagacctacgaagttgaggcgtccacattctgttttccagagtcggtggacgtggggggagcctctccccactccaaaacaatttctgaatccgagttaagcgcctcagctacggagctcctgcaagattacatgctcaccctgaggacaaagctctctagccaggagattcagcagtttgccgctctgctgcatgagtaccgaaatggggcttccattcacgagttttgtataaatttgagacaactttatggggactctcgcaagttcctgctccttggactgcgtccatttatacctgaaaaagattcccagcactttgaaaacttcttagagaccatcggggtcaaggacggcagggggatcatcacggatagtttcgggaggcaccggagagcactcagcaccaccagttctagtaccaccaatggcaatcgcgcaacgggttcctcagatgatagaagcgcacctagtgagggtgacgagtgggacagaatgatatctgatatctcttccgacattgaggccctggggtgcagcatggatcaggattctgcgtag

SEQ ID NO: 217914 - DNA, 1317 bp, Artificial Sequence
  Description of Artificial Sequence: Synthetic coding sequence
atggaaaacgaaccagggatagtctcaccttttaaacgtgttttcctcaaaggagaaaagtcccgggacaagaaggctcacgagaaggtaaccgagcgcaggccactccatacagtggtgctgtcacttccagagcgcgttgagccagatcggcttctgagtgattacatcgagaaggaggtcaaatacttaggtcaactgaccagtatcccaggctatctcaacccatcgagtcgaaccgagatactgcactttatagataacgcaaaacgcgcacatcagctacctggacatttgacgcaggaacacgatgccgttctgagtctgtccgcttacaatgtaaaactcgcctggcgcgacggagaagatatcatcttgcgggtgccaatccacgatatagcagcagttagctatgttcgcgacgatgccgcacatctagttgttttgaagacagcgcaggaccccggtatttcgcctagtcagtcactttgtgcagaaagtagcagaggactctcagcaggcagtttgagtgagtctgcagtgggacctgtggaggcttgctgtcttgtaatactcgctgccgaatctaaggtcgcagccgaagaattgtgctgcctgctcggccaggtgttccaagtggtatacacagaaagcaccatcgactttttagatagggcgatttttgatggagcgagcactccgacacaccatctgtccctacacagtgacgactccagtaccaaagtcgacattaaagagacttacgaagttgaagcttctactttctgttttcccgagagtgtggacgttgggggagcttcgccgcatagtaaaactatcagtgagagcgaactgagcgcctccgccaccgagctgctgcaggattacatgttgacgctccgcaccaagctttccagtcaagagatccaacagtttgctgcactgctgcacgagtaccgaaacggtgcgtccatccatgagttctgtattaatctgagacaactgtacggcgactcacggaaattcctcctccttgggcttaggccgtttattcccgaaaaggacagccagcattttgagaactttctagaaactattggagtgaaggacgggaggggcatcatcactgactcatttggcagacacagaagggcactcagtacaacatcgtcttcgaccacgaatggcaatagggcgacaggaagttcggacgacaggtccgctccgtccgagggagacgagtgggaccggatgatctccgacatctcatccgatatcgaggcactaggatgctccatggaccaggattcggcttag

SEQ ID NO: 217915 - DNA, 1161 bp, Artificial Sequence
  Description of Artificial Sequence: Synthetic coding sequence
atggaagaagaaggaaaaaaggggaagaagtacctggggcaattgacaagcattcctggatatttgaatccatctagccggacggaaatcctgcatttcattgataacgcaaagcgagcccatcagctcccgggacatctcactcaagaacacgacgccgtgctgagcctgagcgcctacaacgtcaagctggcatggcgggacggagaggacatcattctgagagtgccaatccatgacatcgcagctgtgagctacgtgagggatgacgcagcgcatctggtggtgcttaaaaccgctcaagaccccggaatctcaccaagtcaatccctgtgcgccgagtcttctcggggactttcagccggatccttatccgagtcagctgttggccctgtcgaggcttgttgtctcgttatcctggctgctgaaagtaaagtcgccgcagaagaactttgttgcctgctggggcaggtcttccaagtggtctataccgagtctacaattgactttctggatcgcgctatctttgatggagcaagcacgccaacccaccatctgtctctgcactccgatgacagctcgactaaagttgacatcaaagagacctatgaagttgaggccagcaccttctgttttccagagtctgtggatgtcgggggagcttccccccactctaagacaatctctgaatcagagctgagcgcatccgccaccgagttgcttcaagactacatgctcacactaaggacaaagctgtcatcccaggaaatccagcaattcgccgcactgctgcacgaataccggaacggcgcatcaattcacgagttttgcatcaatctgcgacagctatacggggactcacgcaagttcttgctcctagggctgagacccttcatacccgagaaagactctcagcatttcgagaacttcctagaaacaatcggggtaaaagacgggaggggaatcatcaccgattccttcgggagacatcgtcgagccctttctactaccagctccagtacaacgaacgggaatagggctactgggagttcagacgatagaagtgccccttccgaaggtgatgaatgggataggatgatcagtgacatcagtagtgacatcgaagctctcggctgctccatggatcaggattctgcctag

SEQ ID NO: 217916 - DNA, 216 bp, Artificial Sequence
  Description of Artificial Sequence: Synthetic coding sequence
atggaggaagagggcaaaaagggcaaaaaacccggtatcgtgtcacccttcaaaagggtcttcttgaagggagagaagagtcgtgataagaaagcccacgagaaggtcactgaaaggcgccctttacatacggtagtgctctctctccctgaaagggttgaaccggataggctgttgtcggactacatagaaaaggaagttaagggcagccattag

SEQ ID NO: 217917 - DNA, 1062 bp, Artificial Sequence
  Description of Artificial Sequence: Synthetic coding sequence
atggaggaagaagggaagaaaggaaaaaagccaggcattgtgagcccctttaagagggtgttcctcaagggggaaaaatcccgggacaagaaggctcatgaaaaagtgactgagagacgtccactgcacactgtcgtcttaagcttgcccgagcgtgtagagcccgaccgcctgctgtcagattacatcgagaaggaggtaaaatacctgggccagctgacaagcatacctggatatctgaatccatcctccagaacagagatactgcactttattgataatgccaaacgagcgcaccagcttccaggccatctcacccaggaacatgatgccgtactcagcctctctgcctacaacgtcaaattagcctggcgagatggagaagatatcattctccgcgtccccattcatgacatagcagccgtctcatacgttcgcgatgacgcggcacatctagtagtgctgaagactgacgattctagtacaaaggttgacattaaagagacttacgaagtcgaagcctcaaccttctgctttcctgagtcagtcgatgtgggaggtgctagtccacatagcaaaaccatctctgagtccgagctgagcgcttccgccaccgagttgctgcaggactacatgttgacacttaggacaaagctgtcaagccaggagatccagcagttcgccgctttgctccacgaataccgcaacggagcgtctatacacgagttctgcatcaatctaaggcagttgtatggcgacagtagaaagttcctgttgctgggcctgcggcctttcatacctgaaaaagattcacagcactttgagaacttcttggagactatcggagtcaaggacgggcgaggtattattactgactccttcggacggcatcgacgggctctgagcacgacctcttcaagcaccacaaatgggaatcgggcaactggtagctctgacgatagaagcgctccctctgaaggagacgaatgggatcgaatgatctctgatatttcctccgacatcgaagcgttgggctgctcgatggatcaggactccgcatag

SEQ ID NO: 217918 - DNA, 1224 bp, Artificial Sequence
  Description of Artificial Sequence: Synthetic coding sequence
atgcgaagaaatctgcggctgggaccatccagcggggcagacgcccagggacagggagccccacgtcccggactggccgctccccgaatgttattacctcctgcctcgcaggcaagcagggggtcaggaagcactggttgcagtttgatggctcaggaagtcgacacagcccagggggctgaaatgaggcgaggcgctggagctgcacggggtcgcgctagctggtgttgggctctggccctcttgtggttagccgtcgtacctggatggtcaagggttagcggaatccccagcaggcgtcactggccagtaccctataagagattcgattttcggccaaaacctgatccatattgtcaggcaaagtacaccttttgcccgactggaagtcccatccccgtcatggaaggcgacgatgatatagaggtttttaggttgcaggctccagtatgggaatttaagtatggcgatcttctcggtcacttgaagattatgcatgatgccatcggcttccgatccactcttaccggtaaaaattatactatggagtggtatgagctatttcagctgggaaattgcaccttccctcatttgcggcctgagatggacgccccattttggtgcaatcagggcgcagcttgttttttcgaggggattgatgatgtacattggaaggaaaatggtactcttgtgcaggttgcgaccatctctggtaacatgttcaaccagatggccaaatgggttaagcaggacaacgagaccgggatctattacgagacctggaacgttaaggcttcacctgagaagggagctgaaacatggtttgactcgtacgactgcagtaagtttgtgctcaggactttcaataagttggctgaatttggagctgagttcaagaacattgagaccaattatacccgaattttcctttattctggagaaccaacatacctcggaaatgagaccagcgtcttcggacccactgggaacaagactctgggcttggcaataaagcgattttactacccattcaagccccaccttcctaccaaggaattcctcctgagtctactgcaaatctttgatgctgtgattgtacacaagcaattttaccttttctacaactttgagtactggttcctccccatgaaatttccgtttattaaaatcacatacgaggagattccactccctattagaaataagacactcagcggactgtag

SEQ ID NO: 217919 - DNA, 822 bp, Artificial Sequence
  Description of Artificial Sequence: Synthetic coding sequence
atggagggagatgatgacatcgaggtctttagacttcaggctcctgtctgggagtttaagtatggcgatctcctcggccacctgaagatcatgcatgacgccattggattccgctctacactcacaggcaagaactacacgatggaatggtacgaactgttccaactgggtaactgtacctttccccacctcagaccggagatggacgcaccattctggtgtaatcagggcgcagcctgtttcttcgagggaattgacgatgtgcattggaaggaaaatggaaccctcgtgcaagtggctacaatatctggcaatatgtttaaccagatggccaaatgggtaaaacaggataatgaaaccggcatttattacgaaacatggaacgtcaaggcgtcacctgaaaagggcgctgaaacatggtttgacagttacgactgctctaaattcgtgctacggactttcaacaagcttgctgagttcggcgctgaattcaaaaacattgagactaattacactcgcatctttctgtactcaggagagccgacctatctgggaaacgagacaagcgtgtttggacccactggcaataagactctgggactagccattaagcgattttattatcctttcaagccccatctgcccaccaaggaattcctcttgagcttactccagatttttgatgcagtaatcgtgcataaacagttctacctgttctataactttgaatactggtttctgcccatgaagttcccttttatcaaaattacatatgaggagattccactccccatccgcaacaaaacactgtccggactttag

SEQ ID NO: 217920 - DNA, 1077 bp, Artificial Sequence
  Description of Artificial Sequence: Synthetic coding sequence
atggcgcaggaggtggataccgcacaaggagctgaaatgcgcagaggtgcaggagcggcacgcggacgagcgtcatggtgttgggctctggcgttgttgtggcttgcagtggtccctggatggtcccgggtcagtgggattccatctcggcgtcattggcccgtgccttataaacgatttgattttagaccaaaacccgacccatactgccaggccaaatatacattttgtccaacgggctcacccatccccgtgatggaaggggatgacgacatcgaagtgttccgacttcaggcccctgtatgggagttcaaatatggagatctgttgggccatttgaaaatcatgcacgatgcaattggcttccgatccacactgacaggtaaaaactataccatggaatggtatgaactctttcagctcggcaactgtacattccctcacctccgtcccgaaatggatgcccctttctggtgcaatcagggagccgcttgcttttttgagggaattgatgacgttcactggaaagaaaacgggactttagttcaagtggccacaatttccgggaatatgttcaatcagatggccaagtgggtgaaacaggacaacgaaactgggatctactacgagacttggaacgtcaaggcctccccggagaagggggctgaaacatggtttgactcctatgactgttctaagtttgtgctgcgcacctttaataaattggctgagttcggagccgaattcaaaaatatcgaaacaaattacacgcgcatttttttgtatagcggcgaacctacctacctcggtaacgaaacatcggtgttcggccctactggcaataaaacacttggactggccattaaaagattctactacccctttaaaccacacttacctacgaaagaatttctcctgagccttctgcagattttcgatgctgttattgtgcataagcagttctacctgttttataactttgaatactggtttctgcctatgaaattcccatttatcaagatcacgtatgaggaaatccccttgcccattcggaacaagacactgtcggggctttag

SEQ ID NO: 217921 - DNA, 936 bp, Artificial Sequence
  Description of Artificial Sequence: Synthetic coding sequence
atggaagcaacgcgaagaagacagcatttgggtgctacgggtgggcctggggctcaactgggcgcatccttcctgcaagccagacacggctctgtatcagccgacgaggctgcgagaaccgcaccattccacttggacttatggttctattttactttgcagaattgggtactggacttcggacggccaatcgcgatgctcgtcttccctctggagtggttccctctcaataagccttccgttggcgactatttccatatggcatataacgtaatcactcccttcttgctgcttaaattgatcgagcgttctcctaggaccctccccaggtccatcacgtatgtatcaatcataatcttcataatgggggcttctatccatttggttggcgatagtgtgaatcatagactcctgttttccggttatcagcaccaccttagcgtcagagaaaaccccatcattaaaaatcttaagcctgagactctgatcgatagcttcgagctgctctattactatgacgagtacttgggacactgcatgtggtacattccattcttccttatcctttttatgtatttctctggctgttttaccgcctctaaagcagagagcttaattcccggacctgccctccttctggttgcacctagcggtctgtactattggtacttggtgactgagggccagatcttcatcctgtttattttcacttttttcgcaatgctggcgctagtgctccatcagaagaggaagaggctctttttggattccaacggtttgttcctgttttcttcctttgcgctgactttgctgttggtggccttgtgggttgcttggctgtggaatgaccctgtgctccgaaaaaagtaccccggtgtcatttacgtcccagagccttgggcattctacacccttcacgtgtccagtcgccactag

SEQ ID NO: 217922 - DNA, 549 bp, Artificial Sequence
  Description of Artificial Sequence: Synthetic coding sequence
atgcgtctgccagcccgattacctagcacctccacatcggggtccaccagccactgccggacgggattctggaccctgggcgtcccccttccttgttggtactcgctgtccagtggtttccatagtacctctcccgttttgggcaccactagtacctggcctaccactagcagtcggcctttctcatgttccagcggatgctttactgcaagcaaagcagaatcactgatacccggacctgccctactgctggtggccccttccggcctgtactattggtacctagttaccgaaggccagatcttcattctctttattttcaccttttttgctatgttagctttggtgctacatcagaagaggaagcgcctgtttctcgactctaatggactgtttctgttttcctcattcgcactcacactgctgcttgttgccctgtgggtggcgtggctttggaatgatcccgtgctcaggaagaagtaccctggtgttatatatgtgccagagccttgggcattctacacactgcatgtgtccagtcggcattag

SEQ ID NO: 217923 - DNA, 1032 bp, Artificial Sequence
  Description of Artificial Sequence: Synthetic coding sequence
atggcagcagtggcaggcaaggagagacgcgctcgcggtaggcccagacctgagactttaggggcaatcccacgcagagagggcggtgaagcaggtctgtcccgggcattcaagccgcttgcccaagcacccctgagctgtgaaacttcattacgaaagcttaagtttaagggcaagaaacacggatcggtttccgctgatgaggccgctaggactgccccatttcatctcgacttatggttctatttcacactgcagaattgggtgctcgactttgggcgtcctattgccatgctagtgttccctttagagtggtttccactgaacaagccaagtgttggcgattacttccacatggcgtacaacgtgatcactcccttcctcctgcttaaactgatagagcgctcccccagaacactgcccagatcgattacttacgtttccatcatcatttttattatgggcgctagcatccatttggtgggggactcagttaatcaccgtctattatttagcggataccaacatcacctgtcagtgagagagaacccaattatcaagaatcttaagcctgaaacccttatcgacagcttcgaactcctctattattacgacgagtacctgggacattgcatgtggtacattccattttttttaattttgtttatgtatttctctggctgctttactgcttccaaggctgagtctctcatacctggacctgcacttctgctcgtggctccctcaggattatattactggtatctggtgacagaaggccaaatctttatcttattcatattcacttttttcgcaatgctggccctcgtcctgcaccagaaacgcaagcgtctgttcctggactctaacgggctgttcttattctcatcatttgcgttgacgctcctcctggtggccttatgggtggcttggttgtggaatgacccggtccttaggaagaagtatcctggggtcatctacgtcccagaaccttgggcattctacactttgcatgttagttctcggcattag

SEQ ID NO: 217924 - DNA, 861 bp, Artificial Sequence
  Description of Artificial Sequence: Synthetic coding sequence
atgaacccggcttcagatgggggtacttccgagtcaatctttgatctggactacgctagttggggcatacgaagcactctcatggttgccggttttgtgttctatctgggagtcttcgtagtctgccaccagctgtccagctccttgaacgccacctaccggtcactagttgccagggagaaggtcttttgggacctcgccgctactcgggcagttttcggagttcagtcaaccgccgctggactgtgggcactgctgggcgatccggttctgcacgcagacaaagcccgaggccaacagaattggtgctggttccacataactacagctaccggttttttttgcttcgaaaacgtcgctgtgcacctttctaacctaatcttcaggactttcgatctgtttcttgtgatccaccacctctttgcctttcttgggttcctggggtgccttgtaaatctgcaagccggtcactatctggccatgaccacgctcttgctggagatgagcacccccttcacttgtgtgagctggatgcttcttaaagccggatggagcgagagtctcttttggaaattaaaccagtggttgatgattcatatgttccattgtagaatggtgctgacctaccacatgtggtgggtctgcttctggcattgggatggtcttgtatcttccctgtacctccctcatctgactctatttcttgtcggcctggctttgctgactctgattattaatccttattggactcacaaaaaaacacagcaattgctaaatccagtggactggaattttgcccagccagaggctaagtccaggcctgaaggaaatggccagctcctgcggaaaaaacgaccctag

SEQ ID NO: 217925 - DNA, 1065 bp, Artificial Sequence
  Description of Artificial Sequence: Synthetic coding sequence
atgtatagagagtgggtggtcgtaaatgtattcatgatgttgtacgtgcagttggtccaggggtcctccaacgagcacggccctgtgaaacgctcatctcagtctaccctagaacggagtgagcagcagatcagagccgcatcctcactggaggagctgctccgcatcactcactctgaagattggaaactttggcgctgccgcctgagactgaagtcattcacctctatggacagccgctctgcctcccaccgatctacaaggttcgccgcaaccttttacgacatcgagacactaaaggtgattgacgaggagtggcagcggacacagtgtagtccacgagagacctgtgtggaagtagcttctgagctcggcaaatcaacaaacaccttctttaaacccccttgcgtgaatgtgttcagatgcggagggtgttgcaacgaagagtccctaatctgtatgaacaccagcacctcttacatctctaagcagctttttgagattagtgtacccctgacttccgtgccagagctagtacctgtgaaggtcgctaaccataccggttgcaagtgcctgccaactgcccctcggcacccttactcgatcatcaggaggtcaattcagataccggaggaggatagatgttcacatagcaagaaattgtgccccatagatatgttgtgggacagcaataagtgcaaatgtgtcttgcaggaagaaaaccctctggcaggaaccgaagatcacagccaccttcaggagccagctctttgtggtccacatatgatgtttgacgaagacaggtgtgaatgcgtgtgcaagacaccttgccctaaagacctcatacaacacccaaaaaactgtagctgtttcgagtgtaaagaaagccttgaaacttgctgtcaaaaacataaattatttcatcccgacacgtgctcttgtgaggaccggtgtccatttcacacgagaccctgcgcaagtgggaaaaccgcctgtgccaagcattgtcgcttccccaaagagaagcgggcagcgcaaggccctcactcgagaaaaaacccctag

SEQ ID NO: 217926 - DNA, 504 bp, Artificial Sequence
  Description of Artificial Sequence: Synthetic coding sequence
atggaaagattcgttgtgacagctccgccagcacgtaaccgctctaaaaccgctttatacgtgactccgttggatcgcgtgacggagtttgggggtgaattacacgaagacggtggcaaactcttctgtaccagttgcaatgtggtacttaaccatgtgcgcaaaagcgcaatctctgaccatctgaaatccaagacacataccaaaagaaaagccgagttcgaagaacaaaacgtgagaaaaaaacaaagaccacttactgcttcattgcaatgcaacagtacagcccaaactgaaaaggtcagcgttattcaggatttcgttaagatgtgtctggaggccaatattccccttgaaaaagcagaccacccagccgtcagagcctttctcagtcgtcatgtcaagaatggtggaagcattccaaagagtgatcagctgcggagagcatatctccctgatggatacgagaacgaaaaccagctgctcaactcccaggattgctag

SEQ ID NO: 217927 - DNA, 504 bp, Artificial Sequence
  Description of Artificial Sequence: Synthetic coding sequence
atggaaagattcgtcgtaaccgcaccgcctgccagaaatcgttctaaaacagccctttacgtgacccccctcgatagggtgaccgaattcgggggagagttgcacgaggatggcggtaaactcttctgtacctcttgcaacgtggtgctgaaccacgtgcgcaaatctgctatctctgatcatctcaaatccaaaacacacaccaaacgcaaggccgagttcgaagagcagaacgtgcgcaaaaagcaaaggccgttgactgcctccttgcagtgcaacagcacagcccagactgagaaagtttcagtcatacaggactttgtgaagatgtgcctggaggcgaatataccactcgagaaggctgaccacccagcagtcagagcctttttgagtaggcacgtgaaaaacgggggttcaatccccaaatctgatcagctccgacgcgcataccttcccgacggatatgagaacgagaatcaacttctgaatagccaagattgctag

SEQ ID NO: 217928 - DNA, 504 bp, Artificial Sequence
  Description of Artificial Sequence: Synthetic coding sequence
atggaaaggtttgttgtgacagctccacccgcacgaaataggtccaaaaccgcactgtatgtcactcccctcgacagagtcaccgaattcggtggggagctgcatgaagacggcggaaagctgttttgtacaagctgtaatgtagtgctgaaccacgtgcgcaaatcagccatcagcgaccacctcaaaagtaaaacccataccaagcgaaaggcggagttcgaagagcagaatgtgcgcaagaagcagagacctcttacggcctccctgcagtgcaatagtacagcgcaaactgaaaaggtgagtgtgattcaggacttcgtgaaaatgtgtctggaagcgaatatcccgttggaaaaagcagatcacccagccgtgagggcttttttgagtcgtcacgttaagaacggaggcagtatccccaaaagcgaccagttacgccgagcctatctccccgatgggtatgagaatgaaaatcagttactgaattcacaggattgctag

SEQ ID NO: 217929 - DNA, 321 bp, Artificial Sequence
  Description of Artificial Sequence: Synthetic coding sequence
atggagcgctttgtagtgacagcccctccagcaaggaacaggtccaagaccgccttgtacgtgaccccactggatagagtcacagaatttggcggagagttgcatgaagatggcggtaaactattctgcacttcatgtaatgttgtcttaaatcatgtacgcaaaagcgcgatttcagatcacttaaaatccaagacccacactaagaggaaagctgaattcgaagagcagaacgtccgcaagaagcagcgacccctgaccgctagcctgcagtgtaattccactgcacaaaccgagaaggttagtgtgatccaggattag

SEQ ID NO: 217930 - DNA, 504 bp, Artificial Sequence
  Description of Artificial Sequence: Synthetic coding sequence
atggagcgttttgtggtgaccgcccctccagccaggaaccgatctaagactgccctgtacgttaccccactggatcgagtaactgagttcggcggtgagctccatgaggatggaggtaagctgttttgcacgtcgtgtaacgtcgtgctgaaccacgtgaggaagtccgccataagtgaccacctaaaaagcaagacacacaccaaacggaaagctgaattcgaggaacagaatgtgcggaagaagcaacgacccctgaccgcttcactgcagtgcaactctaccgcccagactgagaaggtatccgtgatccaggatttcgtgaaaatgtgcctggaggcgaacatacctctcgagaaggccgaccatccagcggtgcgcgcatttttgtcaagacacgtgaagaacggcggatcaattcctaaatctgatcaactgaggagggcctatctcccagacggctacgagaacgaaaaccaacttctgaactctcaggactgttag

SEQ ID NO: 217931 - DNA, 1608 bp, Artificial Sequence
  Description of Artificial Sequence: Synthetic coding sequence
atggcaagtctgagtctggctcctgtgaatatatttaaggcaggcgctgacgaggagagggcggaaaccgcacgactgacctctttcatcggggctattgctataggcgacctggtgaaaagtactctgggccctaaggggatggataagatactgctgtcatccggtcgggatgccagcctgatggtaacaaacgacggggctaccattttaaaaaatatcggcgtcgacaaccccgcagcgaaggtgctagtcgacatgagtcgggtgcaagacgatgaagtcggggacggcaccaccagcgtgaccgtgctagcggctgagctcctgcgagaggcggagtctttgatagccaagaagatccacccacagacgattatcgctggatggcgcgaggcaaccaaggccgcacgggaggcacttctgtccagcgccgtggaccacggctctgatgaggtcaagttcagacaagatctaatgaacatcgccggaaccactctgagcagcaagttgcttacacaccacaaggatcactttacgaaacttgccgtggaggctgtgctcaggcttaagggctctgggaacctcgaggccatccacatcatcaaaaaactgggaggttctttagctgactcttacctggacgagggatttcttctggacaagaagataggtgtcaatcagccaaagagaatcgaaaacgctaagatcctgatagccaacacaggtatggacactgataagataaaaatattcggttctcgcgtccgtgtggacagtaccgcaaaggtggccgaaattgagcacgccgagaaagagaaaatgaaagagaaagtggagcggattctcaagcatggcattaattgctttatcaatcgccagttgatctacaactatccggaacagttgttcggcgctgctggagtgatggctatcgagcacgccgacttcgctggcgtggagaggctggccctggttactggcggtgaaatcgctagtacatttgaccatcctgaactcgtgaaattgggttcttgtaaacttatcgaagaggtgatgatcggagaagataaactgatccatttttctggcgtggccctgggcgaggcgtgcaccattgtgctccggggagctactcagcagatccttgacgaagccgagcgcagtcttcacgatgctctgtgtgtgttagcacaaacggtcaaggacagtagaaccgtgtatggcggaggctgctccgagatgctgatggctcacgctgtgactcagcttgccaatcgaacccctggaaaggaagccgttgccatggaatcgtacgctaaagctctgagaatgcttccaactatcatcgctgataatgccggatacgacagtgccgatctggtggcccagctgagggccgctcatagcgaagggaatactacggccggtctcgatatgagggaggggaccattggagacatggctattttaggtattacagagtccttccaggttaaacgccaagttctccttagtgccgctgaagctgcggaagtgatcctccgagtggataacataatcaaggccgctcccaggaaaagggtccccgaccaccacccatgttag

SEQ ID NO: 217932 - DNA, 1467 bp, Artificial Sequence
  Description of Artificial Sequence: Synthetic coding sequence
atggacaaaatattgttatcctccggacgggatgcttcactcatggtgaccaatgacggggcaacaattctgaagaacatcggtgtcgataaccccgctgccaaggtactcgtagatatgagccgagtgcaggacgatgaggttggagacggtaccacctctgtgaccgtcctcgccgcagaactgttgagagaagcagagtccctcatagctaagaaaatccacccacagaccatcatcgctggttggagggaagcaacgaaggccgcacgagaggcccttctgtcctccgcggtggaccatggcagtgatgaggtgaagttccggcaagacttgatgaacattgccggaactacactgagctctaaattactcacgcaccacaaagatcactttaccaagctggctgtcgaggccgtgctgagactgaagggatcgggtaacctggaggctattcacatcatcaaaaaactgggcggatccttagctgacagctacttggacgaggggtttcttttggacaaaaaaatcggcgtaaatcagcctaagaggatcgagaatgcaaaaatcctgatcgctaacactggaatggatacagacaaaatcaaaatctttggttctcgtgtgagggtagatagcacagccaaggtcgcagaaatagaacacgctgaaaaagaaaaaatgaaagaaaaggtggagagaatactgaagcacgggatcaactgctttatcaacagacagttaatttataactaccccgagcagttattcggcgctgcaggagttatggcaatagagcatgccgatttcgcaggggtagaacgactggccctagtcacaggtggagaaatcgcatccacattcgatcacccagagttggtaaaattggggtcttgcaagcttatcgaggaggtgatgatcggggaggataaactgatacacttctccggggtggcccttggggaggcttgcaccatcgttcttcgcggtgcaacccagcaaatccttgatgaggccgagcggtctctgcatgatgctctgtgtgtgctggcacagactgttaaggacagcaggaccgtgtacggtggcggttgttcagagatgctcatggctcatgctgtgacacaactcgctaataggacccccggaaaagaggctgttgctatggaatcttacgcaaaggcgctgcgcatgctgcccactattatcgccgacaatgcaggatacgactccgccgatctcgtggcccaactgcgggctgcccactcagaaggaaacactactgcaggattggatatgagagagggaaccatcggtgacatggctatcttgggaattacggagagcttccaagtcaagagacaggtacttctcagtgcagccgaagccgctgaggtgattttacgcgtcgacaacatcataaaagctgcccctcggaagcgcgtgcccgaccaccatccttgttag

SEQ ID NO: 217933 - DNA, 1638 bp, Artificial Sequence
  Description of Artificial Sequence: Synthetic coding sequence
atgatgggtcacaggcctgtcctggttttatcccagaatacaaagcgagagtcaggtaggaaagtgcaaagcgggaacattaatgccgcaaagactatcgcggatattattcgcacatgccttggcccaaaatcaatgatgaagatgctgcttgatcctatgggcggaattgtgatgacgaacgatggcaacgctattttgagagagatccaagtgcaacacccagcagcgaagagtatgatcgaaattagcagaactcaggatgaggaagtcggtgatggtactacttctgtcattatcctggccggagagatgctcagcgtggcagagcacttcctggaacagcagatgcatccaacggtcgtgatctccgcctaccggaaggcacttgacgatatgatttcaaccctgaagaagataagcattcccgttgatatttcagattccgacatgatgctgaatatcatcaacagctcaataacgaccaaggccatctcaaggtggtcctccctagcatgcaatatagcgctcgacgccgtgaaaatggtgcagtttgaagagaatgggcgtaaagagatcgacattaaaaaatatgcaagagtcgagaagatccccggtggaatcatcgaggatagctgtgttcttcgtggcgtaatgattaacaaagatgtgacacacccccgtatgaggcggtatatcaagaaccctagaattgtccttttggacagctctttggagtacaagaagggcgagtcacagacggacattgaaattacccgcgaggaggattttaccaggatactgcagatggaggaggagtatattcagcaactgtgcgaggacatcatccagctcaaaccggacgttgtgatcaccgagaaaggtatatccgatctggcgcagcattatctcatgagagccaatattacagcaatcaggcgtgtccggaagaccgataacaataggattgcaagggcatgcggagccagaatcgtttccaggccggaagagttgagagaggacgacgttggcacaggagctgggttattagagatcaaaaagatcggggatgagtattttactttcatcaccgattgcaaggatccgaaagcttgcacaattttgctcaggggggcatccaaggaaatcctgtccgaggtcgaacggaatctgcaagacgctatgcaggtttgcagaaacgtcctcctcgatcctcagctcgtccccggaggaggggcttctgagatggccgtcgcgcatgccctgaccgaaaagtcgaaggccatgacaggcgtggaacagtggccttatcgcgctgtcgcacaggctttggaggtcattccacgcactcttatccaaaactgtggagccagcacgatccgactgttgactagcctccgggctaagcatactcaagagaactgtgaaacctggggcgtaaacggcgaaaccgggaccttggtcgacatgaaagaattggggatctgggaaccactggccgtgaaactgcagacatataagactgcagtggaaacagccgtgctgctcctcagaattgatgatatcgtgagtggacataaaaaaaagggagacgaccagtctcgacaaggaggcgcacccgatgccggtcaggagtag

SEQ ID NO: 217934 - DNA, 1524 bp, Artificial Sequence
  Description of Artificial Sequence: Synthetic coding sequence
atgatgggccaccgacccgtactggtgctatctcagaacacaaagcgggagtctggaaggaaggtgcaaagcggtaacattaatgccgcaaaaattcaagttcagcaccctgcagccaaaagcatgatcgagatttctcggacacaggatgaggaggttggcgatgggacaaccagcgtgattatcctggcaggagagatgctgtccgttgccgaacacttcctggaacaacaaatgcatcccacagtggttattagtgcctaccgaaaggccttggacgacatgataagcacactcaagaaaatatccatccccgttgatatttccgacagcgatatgatgctcaacatcatcaacagttcgatcaccacaaaggcaatctccaggtggtcctccctggcatgtaatattgccctggatgccgtcaagatggtacaatttgaggagaatggacggaaagagatcgacatcaaaaaatatgccagagtggagaagataccagggggaattattgaggactcttgtgttctgcggggtgtcatgattaacaaggatgtcacccacccacgcatgagacgctacattaagaacccacgcattgtgcttctggattcctcactggagtacaagaagggggaatcccagacagacattgagattacaagagaggaggattttacgaggattctacagatggaggaggagtacatccaacagctctgtgaggatattatacagctgaagccagacgtcgtgatcaccgagaagggtatcagcgatcttgctcaacattacctgatgcgggctaacatcactgctatcaggagggtgcgcaagaccgacaataaccggatcgctcgtgcctgcggagcccgaatcgtgtcaagacctgaggagctgcgggaagacgatgtggggaccggggctggactgctagagataaagaagataggagacgagtactttacctttatcaccgattgcaaagaccccaaggcctgcactatactgctgcgcggtgcctctaaagagatactctcggaagtggaacgtaatttgcaggatgcaatgcaagtgtgccgaaacgtgctcctggatccccagctggtaccaggcggaggggctagtgagatggctgttgctcacgctctgacagagaagtccaaggccatgacaggcgtggaacagtggccttaccgggcagttgctcaggcgttggaagttattcctcggacccttatccagaactgcggcgcaagcaccatcaggctactgacatccctgcgcgcaaagcatacgcaggagaactgcgagacctggggtgtaaatggcgagactggtacgctggttgacatgaaagaactaggcatctgggaacccttggctgttaagttacaaacttataaaaccgccgtcgagaccgcagtgctcctgctgagaatcgacgacatcgtcagcgggcataagaaaaagggagatgaccagtcacggcagggaggtgcacctgatgccggacaggagtag

SEQ ID NO: 217935 - DNA, 1503 bp, Artificial Sequence
  Description of Artificial Sequence: Synthetic coding sequence
atgatgaaaatgctcctcgatcctatgggaggcatcgttatgacaaatgacggaaacgcaatcctgcgcgagatacaggtacagcaccccgctgcaaaatctatgatcgagatctcacgaactcaggatgaagaagttggagacggaaccacttctgtaatcatactggctggcgagatgctgtcagtggcagagcatttcctggagcaacagatgcaccctacagttgtgataagtgcatacaggaaggcactagacgatatgatctctactctaaagaagatatctattccagtggacatatcagactctgatatgatgctgaacataattaacagcagtatcacaactaaggcgatatccagatggagcagcctggcctgtaatatcgctctcgacgccgtgaagatggtccaatttgaagaaaacggtaggaaggaaatagatatcaagaagtacgcacgggttgagaaaatcccaggcggtataattgaggactcgtgtgtgctgcgcggtgtcatgatcaacaaggacgtgacccaccccagaatgaggcgctatataaagaatccgcgaattgtcctgttggattcatccttggaatacaaaaaaggggagtcgcaaacagacattgaaatcacaagggaggaggacttcacccgcatcctgcagatggaggaagagtacatccagcaactgtgcgaggacatcatccagctgaaacccgacgtagttataactgagaaaggtatatctgacttggcacagcactatctgatgcgcgctaacattaccgcaatccgcagagtgcgcaagacagacaataacagaatcgcacgcgcttgtggcgcacggatcgtcagcaggccagaagaactgagagaagatgatgtgggcacaggggctgggttgctcgagatcaaaaaaatcggggacgagtatttcacttttattactgactgtaaggatcctaaagcctgtaccatccttctacgtggcgcttcaaaggagatcctttcagaggtagagcgaaacctccaggatgctatgcaggtatgtagaaatgtccttctggatccccagttggtacccggtggcggtgctagcgaaatggccgttgcccatgctttaacagagaaatccaaagccatgacaggggtggaacagtggccctatcgggctgtggcacaagctctcgaagtcataccgaggacacttatccagaattgcggggcatctacaattcgcttgctgacaagcctacgagccaagcatacgcaagagaattgtgagacctggggcgtcaacggggaaaccggaacactcgtggatatgaaggagctgggtatttgggaaccattggcagtgaagctacagacctacaagaccgctgttgaaaccgcagtgctcctgctgcggatagatgacattgtgtccggacacaaaaaaaaaggagatgatcagagccgacagggcggagcccctgatgctggtcaggagtag

SEQ ID NO: 217936 - DNA, 831 bp, Artificial Sequence
  Description of Artificial Sequence: Synthetic coding sequence
atgtatgagggagatctggaaggccagagcatgaactggacttccgaagagggtcgcggagatatcattaggtccggtaccaacatcgacagagcatggcaatgtcagaacacaaagagggagtcaggacggaaggtgcagagcggaaacattaacgccgctaagacaatcgccgacatcattcggacatgtctgggacccaagagtatgatgaagatgctgcttgaccccatggggggtatcgtcatgaccaatgatggtaacgccattctgcgcgagatccaggtccagcatccagcagccaaatcaatgatcgagatcagccggactcaagacgaagaagttggagacgggactacctctgtcattatcctcgccggtgaaatgctctccgtcgccgaacatttcttggagcagcagatgcaccctacagtggtgatatcagcctatcggaaagctctggacgacatgatttcgaccctgaagaaaatttccattccagtggacataagtgactcagacatgatgttgaatattattaatagctccataacaactaaagccatcagcagatggtcctcccttgcctgtaatattgctctggatgccgttaaaatggtgcaatttgaggagaacggccgaaaggagatagatatcaagaaatatgcgagagtggaaaaaatacccggtggcatcatcgaagacagctgcgtgctgagaggcgtaatgataaacaaagatgttactcaccctcgcatgcgccgatatattaagaatccacggattgtcctgcttgattcatctctagagtataagaaaggggaaagttag

SEQ ID NO: 217937 - DNA, 486 bp, Artificial Sequence
  Description of Artificial Sequence: Synthetic coding sequence
atgatgggtcataggcccgtgttggttctgagccagaatacgaagcgtgaatccggcagaaaggtgcagtcaggtaatattaatgcggctaagaccattgcagatataattcgcacttgcctagggccaaaatctatgatgaaaatgctcctagacccaatggggggaattgttatgaccaacgatggaaatgccatcctgagggagattcaagttcagcatccggctgccaagtcaatgatagaaatttcccgcacacaggacgaagaggtaggcgacggcactacttccgttatcattttagagagccactccgtgaccatgctggaatgcggtggagccatactggcacactgtaatctatgtctgccagctggggagatgctgagtgttgcagaacacttccttgagcagcaaatgcacccaacagtggtgataagcgcctatcggaaagctctggacgacatgatttcgacccttaaatag

SEQ ID NO: 217938 - DNA, 567 bp, Artificial Sequence
  Description of Artificial Sequence: Synthetic coding sequence
atgtacgagggagacctggaggggcagtcaatgaattggacatctgaggagggaaggggagatatcatccggtccggcacaaatatcgatcgggcatggcagtgtcaaaacacaaaaagggagtccggtaggaaggttcagtcaggcaatatcaatgctgctaaaatccaggtccaacacccggcagccaaatcaatgatcgaaatatctcggacacaggacgaggaggtaggcgatgggaccaccagcgttattatcctggccggagaaatgcttagtgtcgccgaacattttttggagcagcagatgcaccccaccgtcgtgatatctgcttaccggaaggctctcgatgatatgattagcacactgaagaagatctcaatcccggtagatatctccgactccgatatgatgctgaacattatcaactctagtatcaccaccaaggccatcagcaggtggagctctctggcctgtaacatagcccttgatgctgttaaaatggtacaattcgaagagaacggacgtaaggagatcgacattaagaagtatgctcgcgtggagtag

SEQ ID NO: 217939 - DNA, 1503 bp, Artificial Sequence
  Description of Artificial Sequence: Synthetic coding sequence
atgatgaagatgttattagacccaatgggcggaattgtgatgaccaatgatgggaacgcaattctccgggagatccaggtacagcatcctgccgcaaagtccatgattgagatctcacgaacacaggatgaggaggtaggtgatggtacaacgagcgtcataatcctggccggtgagatgttgtctgtagctgaacatttcctggaacaacagatgcacccaaccgtggtgatatctgcttatagaaaggctcttgatgatatgatctccaccctcaagaagataagtatccccgtggacatttccgactccgacatgatgttgaatatcattaactcttcaattacgactaaggcaatttccaggtggtcatcactagcctgcaacattgcattggatgctgttaagatggtgcaattcgaggaaaacggcagaaaagagattgacatcaaaaagtacgccagggtggaaaaaatccccggtggcattatcgaagactcctgcgtccttagaggtgttatgattaacaaggatgtaacccacccaagaatgcgaagatacataaagaacccacgcattgtcctccttgacagcagcctcgaatataaaaagggagaatcacagactgatattgaaatcactcgcgaggaagatttcaccaggattcttcagatggaggaagagtatatacagcagctgtgtgaagacatcatccaactcaagccggatgtcgtgattacagagaaaggcattagcgacctcgctcagcactacctgatgagggctaatattacagcaatccgaagggtgagaaaaaccgacaacaacaggattgcccgagcctgtggtgcgcgaatcgttagccggccagaagaactgagggaggacgacgtcgggacaggagcaggactcctggaaataaaaaaaataggcgatgagtatttcacttttatcaccgactgcaaggatcctaaagcctgtaccattttattacggggtgctagcaaagagatcctttcagaggtcgaacgcaatcttcaggacgctatgcaggtctgtagaaatgtgcttctggaccctcagttggttcctgggggaggggctagtgaaatggcagttgctcacgccttgacggaaaagtcaaaggcaatgacgggcgtcgaacaatggccctatcgcgcagttgcccaggccctggaggtgatcccacgaacattgatccagaattgcggcgcaagtacgatcaggctcctaacctctttgcgggcaaagcacacccaggaaaattgcgaaacttggggcgtgaatggagagaccggcaccctggtggatatgaaagaattaggcatttgggaacctctggctgtcaagctgcaaacctataaaacagcagtggaaacggctgtactcctcctgaggatagacgatatagtgtcaggacacaaaaagaaaggtgacgatcaatcacgtcaaggtggagcaccggatgccggacaggagtag

SEQ ID NO: 217940 - DNA, 1620 bp, Artificial Sequence
  Description of Artificial Sequence: Synthetic coding sequence
atgccagagaatgtggcccctcgctcgggggctaccgcaggtgccgcaggcggtcgcggaaagggagcataccaggacagagacaagcctgcacagatccggttctctaacatctccgcagctaaggccgtggccgacgctatccgtacgagcttaggacccaagggcatggacaaaatgattcaggatggtaagggagacgtcaccataactaacgacggagccaccatcctgaagcagatgcaggtgctgcatcccgctgcgagaatgctcgtagagctgagcaaggcacaggacattgaggccggagatggcactaccagcgtggtaatcatcgctgggtccctgttggactcatgcaccaaactgctccagaagggtatccatccaacaattatcagcgagagctttcagaaggcactggagaaggggattgagattttgactgacatgagtaggccagtcgagttaagcgatcgggagactctgctaaactccgcaactacaagtctcaatagcaaagtggtgtctcagtacagctccctgctcagtcccatgtcagtaaacgcagtgatgaaggtgatcgaccctgctaccgccacgtcagttgatctcagggatatcaaaattgtcaagaagctgggaggcactatagacgattgtgaactggtggagggccttgtcttaacacagaaagtctctaattctgggatcactagagtggaaaaggcgaagatcggcttaattcagttctgcctgagcgctcctaagacagatatggataaccagattgtggtctctgattacgcacagatggatagagtcctcagagaggagagagcttacatcctgaatctagtgaagcaaattaaaaaaacaggatgcaatgtgcttctgatacagaagtcgatattgagggatgcacttagtgacctggcactacatttcctgaacaaaatgaagattatggtcattaaagatatagaaagagaggatatcgagttcatatgcaaaactattgggacaaagccagttgcccacattgaccagtttactgcagacatgctgggctccgccgagttagctgaggaagtaaacctgaatggaagcggcaaattgctcaagattaccgggtgcgcatctcctggcaaaaccgtgacaatcgtggtccgcggaagtaacaaacttgttatcgaggaggctgaaaggagtatccacgacgccctctgcgtaatccggtgcctcgtcaaaaagcgcgctctaattgccggaggcggtgcgccagagatcgagctcgccctcagactgacagaatatagccggaccctcagcgggatggagagctattgcgtgagagcatttgccgacgcaatggaagtcattccttcaaccttagccgagaacgccggactgaatcccatttcaaccgtaaccgagcttcgtaataggcatgcccaaggagaaaagaccgccggtatcaatgtccggaaagggggaatctctaatattcttgaggaactggtcgtgcagcctctcctggtctctgtgtccgcactgactttagcaaccgaaaccgtgagatcaatactcaagatagatgatgtcgttaatacccggtag

SEQ ID NO: 217941 - DNA, 1452 bp, Artificial Sequence
  Description of Artificial Sequence: Synthetic coding sequence
atggataagatgattcaggacggtaagggcgacgttactattactaatgacggagcaacaatactgaagcagatgcaggtgttacatccagcagccagaatgctcgtcgagctgagtaaggcccaggatattgaagccggtgatggaaccaccagcgtcgtgattattgccggtagtctgttggatagctgtacaaaactgctgcagaaaggtattcatcccacgatcatcagtgaaagcttccagaaggccctcgagaaggggatagagatactcaccgacatgagtagacctgtggaactttctgaccgcgagactctcttgaattccgcgaccacctcccttaatagcaaggtcgtcagccagtatagttctctactttcacccatgtccgtgaatgcagttatgaaagttatagacccagcaacagctacctccgtggatcttagagatatcaaaatcgtcaagaaacttgggggaaccatagatgattgtgaactggttgaaggtcttgtgttgacccagaaagtgtcaaactccggaattaccagagtcgagaaggctaagattggactcatccagttctgcttgagcgcccctaagacggacatggataatcagattgttgtgagcgattatgctcaaatggaccgggtcctgcgggaggagagggcgtatattctgaacctggtgaaacagatcaaaaagaccggatgcaacgtgctgttaatccaaaaatccattttgcgcgacgcactttctgaccttgccctgcatttcttgaataaaatgaagatcatggtaattaaggacatcgagagagaagatatcgagttcatttgtaagactatcgggaccaaacccgtcgcgcacatcgatcagtttacagcagacatgctgggcagtgcagagctcgcggaagaggtgaacctaaatggatcaggaaaactccttaaaataacagggtgtgcatctcccggaaagaccgttacaatcgtggtacgagggtccaataagctggtcatcgaggaggccgagcggtccatacatgacgctttgtgcgttatcagatgtttagtgaagaagcgagccctcattgctggaggaggagcacctgagatagaactcgcccttcgcttgaccgaatactcccggacattgtcaggcatggagtcctactgtgtaagggctttcgcggatgccatggaagtaatcccaagtaccctcgccgagaatgccggtctgaatccaatcagcaccgtaactgagctgcggaaccgccacgcacagggggaaaagactgctgggattaacgtcagaaagggtgggatcagcaacatcttagaggagttagtggtccagcccttgctggtaagtgtctcagctcttactctagccacagaaactgtgcggtccatcctcaagatcgatgacgttgtgaacacgaggtag

SEQ ID NO: 217942 - DNA, 1530 bp, Artificial Sequence
  Description of Artificial Sequence: Synthetic coding sequence
atgcccgaaaatgtcgctccacggtctggagcaactgcaggggcagccggagggagaggaaaaggggcatatcaggatcgagacaagcccgctcagataaggttctcaaatatctctgctgccaaggcagtggccgacgcaattcgcacttcattaggccctaagggaatggataaaatgctggtggagctaagcaaagcacaggacatcgaagctggagatggtaccacatccgtggtcattatcgcagggagccttttggattcttgcaccaaactgttgcagaaaggaattcatcctacaataattagcgaaagcttccagaaggccctggaaaaaggtattgagattcttacggacatgagccggcctgtcgagctgagcgatcgcgagacgctacttaacagtgcgaccacttctttgaactctaaagtcgtgtcccagtactccagcttattgagccccatgtctgtcaatgccgttatgaaggtgatcgaccctgctacagccacttccgtagacttaagagacattaaaatcgtgaaaaaactcggcggtacaatcgacgactgcgaactggtggaagggctggtgcttacacaaaaggtctcgaactcagggattactcgcgtcgagaaagcgaagatcgggttgattcaattctgcctttcagcacccaagaccgacatggataaccagattgttgttagtgattatgcacagatggatcgggtccttcgagaggagcgagcttacattctgaacttggttaagcagattaagaaaaccggatgcaatgttctgctcatccagaagagcatactccgcgatgccttatccgacttggccctacatttccttaacaaaatgaaaataatggtaattaaagatatagaacgtgaggacatagaatttatttgcaagactatcggaactaaacctgttgcccacatcgatcagtttactgccgatatgttgggctccgcggaactggcagaagaagtcaacctgaacggctccggtaagttactaaagattaccggatgcgcaagtcccggtaaaacagtgacgattgtcgtgcggggatctaataaattggtgatcgaggaagccgaaaggtccattcacgacgcattatgtgttatcagatgcctggtgaaaaagcgcgctttgatcgcgggtggcggagctcctgagattgaactggcgctgcgacttacggagtactctagaaccctttcaggtatggagtcctattgtgtccgagccttcgccgatgctatggaggtcatacccagcaccctcgccgaaaacgccggtcttaatcctatcagcacagtcaccgaactgcggaatcggcacgcccaaggtgagaagacggcagggattaatgttagaaagggtggcatttctaacatcctggaagagctcgttgtgcagcctctgttagtgagtgtcagtgccctgacactggccaccgaaacagttcggagcatactaaaaattgatgacgtcgtcaacaccaggtag

SEQ ID NO: 217943 - DNA, 1170 bp, Artificial Sequence
  Description of Artificial Sequence: Synthetic coding sequence
atgtctcgacccgtcgaattgagcgatcgcgagacactgttgaacagtgccacaacatcgctgaactccaaggtggtgtcacaatacagttcattgctgtcgcctatgagcgtgaatgctgtgatgaaggtgatcgatccagcaactgcgacctccgtcgatctgagggacattaagatcgtgaaaaaactcggagggaccatcgatgattgtgagctagtcgaaggtttggttctgacccagaaggtgtctaattcaggaatcactagagtggagaaggccaaaattgggctgatccaattctgcctgtctgccccaaaaaccgacatggacaaccaaatcgtggtgagcgactacgctcagatggatagggtcttgagagaggaaagggcgtacatattgaacctagtgaagcagataaagaagaccggctgtaacgttctgctcatccagaaatcaattctacgcgacgccttgtctgatctcgccctacacttcctgaacaaaatgaagatcatggtaataaaagatattgaacgcgaggacatcgagtttatctgcaaaaccatcggaaccaaacccgtggcacatatcgaccagttcactgcggatatgctgggctctgctgaactggcggaggaagtgaatctcaatggatcagggaaactgctgaaaatcaccggctgtgcgtctcctgggaagacagttaccatagtagtgcgaggcagtaataagctggtgatagaagaggctgaaaggtccatccacgacgcactgtgcgtgattcgctgcctcgtcaagaagagagccctgatcgccggagggggagcaccggagattgaactcgccctaagacttaccgaatactctcgtaccctgagcggtatggagtcttactgtgttcgagcatttgctgacgccatggaggtcattccctcaactctggccgaaaacgcaggcctcaaccccatctcgacagtcaccgaactgaggaacagacacgctcagggagaaaagactgccggaattaatgtgcgcaaagggggtatcagcaacatcctggaagagctggttgtgcagcctctgctggtcagcgtgtccgccttaacgctggccaccgaaaccgtgcgctctatcctgaagattgacgacgtggtgaacactcgatag

SEQ ID NO: 217944 - DNA, 1626 bp, Artificial Sequence
  Description of Artificial Sequence: Synthetic coding sequence
atggccagcatggggaccctcgcatttgatgagtacgggaggccatttctcatcatcaaagatcaggacagaaagtctcggctgatgggactcgaagccctgaaatcacacataatggccgcaaaagctgtggcaaatacgatgaggacatctcttgggcctaatggattagacaagatgatggtcgataaagatggtgatgtgacggtcacaaatgacggcgcaaccatcctcagcatgatggacgtcgaccaccagatcgccaaactgatggttgaattgtcaaaatctcaagatgacgagatcggggacgggacgacaggcgtagtagtgttggctggcgctctgctcgaagaagccgagcaattgttagatcgcggaatacacccaatcaggattgccgatggctacgaacaggccgctagggttgctatagagcacctggacaaaataagcgactcagtgttagtagatatcaaggacacagagcctctgattcaaactgcaaagactaccctgggctcgaaagtagtgaattcttgccacaggcagatggctgagattgccgtgaacgccgtgcttacagtagctgatatggagagaagagatgtggacttcgagctgattaaagtggaaggcaaggtaggaggacgattagaagatacaaagcttattaagggagtcatagttgacaaggatttcagccatccccagatgcccaagaaggtggaagatgcgaaaattgctatcctaacttgtcctttcgagccacccaagccgaagacaaagcataagctggatgtgaccagcgtggaggactataaggcactgcagaaatatgagaaggagaagtttgaagagatgatccaacaaataaaggagacaggtgctaaccttgctatttgtcagtggggatttgatgatgaggctaaccacctactactccagaacaatcttcccgctgtgcgatgggtgggcggaccagagatagagctgatcgccatagcaaccggagggagaatagtgcccaggttttccgagcttactgctgagaagctcggattcgctgggctggtgcaagagattagcttcggaactactaaggacaagatgctagtgatagaacagtgcaaaaactcaagagcagtaactattttcatcagaggagggaataagatgatcatagaggaggctaagagaagccttcatgatgcgctgtgtgttattcggaacctgatacgggacaatagagttgtctacggcggtggtgcagccgaaataagctgcgcactggcagtgagtcaagaggccgataagtgtcctacactcgagcagtacgcaatgagagctttcgccgatgccctggaggtcatcccaatggcactgtcagaaaatagcggcatgaacccgatccagactatgacggaagtgcgagccaggcaggtgaaggaaatgaacccagccctcggcatcgactgcctccataaagggactaacgacatgaaacaacagcacgtcatagagacacttatcggtaaaaagcagcagattagcctggccacacagatggtgcggatgattcttaaaatcgatgatatacgcaaacctggtgagagtgaagaatag

SEQ ID NO: 217945 - DNA, 1545 bp, Artificial Sequence
  Description of Artificial Sequence: Synthetic coding sequence
atggcctctatggggaccttggcgtttgacgaatatgggaggcccttcctgatcatcaaagaccaagaccggaagtctcggctgatgggtctggaggccctgaaatcccacataatggcagcaaaggccgtcgccaacaccatgaggaccagtctcggccctaacggactggacaagatgatggtcgataaggacggtgatgtcacagtcacaaacgatgagataggggatggcacgactggcgtcgtggttctcgctggggcactactggaagaagccgagcagctgctcgataggggtatccacccgatccgcatagccgacggctacgagcaagccgctcgtgtcgcaatcgagcatcttgataagatcagcgactctgttctcgtagatattaaagataccgaaccactcatccagaccgccaagacaactctgggttccaaggtcgttaattcttgtcacaggcagatggccgaaatcgccgtcaatgccgtcctcaccgtggctgacatggaaagaagggacgtcgacttcgaattaatcaaggtagaaggaaaagtggggggaagactagaggatacaaaactgatcaagggtgtgatcgtggataaagatttctctcatcctcagatgcccaagaaggtggaggacgccaaaattgccatccttacttgcccatttgagcccccaaagcctaaaactaaacataagttagacgtcacctcggtggaagactataaggcactgcagaagtacgagaaggagaagttcgaagagatgatccaacagataaaggaaaccggcgcaaacctggctatttgtcagtggggattcgacgacgaggccaaccacctgctgttgcagaacaatttaccagccgtgcgatgggtcggcggaccagagattgagctgatcgctatcgccacaggcggtaggatcgtacccaggtttagcgaactcactgctgagaagctgggctttgcaggtttggtgcaggaaattagctttgggaccactaaagacaagatgttggtcattgagcagtgcaagaacagcagagcggttactatattcattcggggaggcaacaaaatgatcatcgaagaagctaaaaggagcctccacgatgctttgtgtgtgatccgcaacctgatcagagataacagggtggtgtacgggggtggagccgctgagatatcatgcgctctggccgtgagccaagaggccgataagtgtcctaccctggaacagtatgcaatgcgcgcattcgctgatgcccttgaggtcattccaatggcgttatctgagaattctggcatgaacccgatacagactatgacagaggttagagcacgccaagtgaaggagatgaatcctgcgcttggaatcgactgcctccataagggaactaacgatatgaaacaacagcatgtgatcgaaacgctaattggaaaaaaacagcagatttcgctggcaactcaaatggtgcgaatgatcttgaaaatagatgatatacgcaagcctggcgaatcagaggaatag

SEQ ID NO: 217946 - DNA, 1563 bp, Artificial Sequence
  Description of Artificial Sequence: Synthetic coding sequence
atgaactcttcactgggcccaaccattgagaaactgtcagtatcccacatcatggctgccaaggcggtggcaaatacaatgaggacaagcttggggcctaacggcctggacaagatgatggtagataaagacggggacgtcacagtgacaaatgacggtgcaacaatacttagcatgatggatgtggaccaccagatcgccaagcttatggttgaactgtcaaaatctcaggacgacgaaatcggagatgggaccacgggggtggtggttctcgcaggcgctctcctcgaggaagccgaacagctactggatcgcggaattcaccctatcagaatcgctgacggctatgagcaagcagcgagggtcgccatcgagcatctggacaagatatctgatagcgtcttggtcgatatcaaggatactgagcccttgatccaaactgcaaaaactactctgggctcaaaggtggtaaacagctgtcaccgacagatggcagaaattgccgttaacgcagtcctgacagtggccgatatggaacgacgggatgtcgattttgagctgattaaggtggaagggaaggttggcggtaggcttgaagataccaagctcataaaaggtgtgattgtggataaagacttctcccatcctcagatgcctaagaaagtcgaggacgccaagattgctatcttgacctgccccttcgagccgccaaagcccaagacaaaacacaagctggatgtcacaagcgtcgaagactacaaggccctccaaaaatatgagaaggaaaagttcgaggagatgattcagcaaattaaagagacaggcgctaatttggcaatttgtcagtggggcttcgatgacgaggcgaaccatcttctgttgcagaataatcttcctgcagtccgctgggtggggggaccagagatcgagctcatcgccatcgcaacagggggaaggatagtccctagattttcagaactcaccgccgaaaagctgggctttgccggactggttcaagagatttcattcggcactacaaaagacaaaatgctggtgatcgaacagtgtaagaacagtagagcggtgaccatcttcatcagaggagggaacaagatgattatcgaggaggctaagcgatcacttcacgacgccctttgcgtgattaggaacctgatcagggataacagagttgtgtatggcggtggggctgctgagatctcctgcgcccttgccgtgtcacaggaggctgataagtgccccacgctggaacaatatgctatgagggccttcgcggacgcactggaagtgatacctatggctctatcagaaaactctggtatgaatcccatccagacaatgacagaggtcagggcaagacaagtcaaagaaatgaatcccgctctaggcattgattgtctccacaagggcactaacgatatgaagcaacagcacgtgattgagactttaattggcaagaagcagcagatttcgctggcgacccagatggtcaggatgatattgaagatcgatgacatccggaaacccggtgagtcagaggagtag

SEQ ID NO: 217947 - DNA, 1347 bp, Artificial Sequence
  Description of Artificial Sequence: Synthetic coding sequence
atggctgccaaagctgtcgcgaacaccatgcgtacctcactgggacccaacgtcctggccggagccctgctggaggaggctgagcagcttttggatcggggaatccatccaatcagaatcgccgatggttatgagcaggccgctagggtagccatcgaacacctcgacaagatttctgattcagttttagttgatattaaagataccgaacccctaattcagactgccaaaaccacactcggaagtaaggtggtcaacagctgtcaccggcagatggccgagatagcggtgaacgcagtgttgaccgtagccgatatggagcgcagggacgtggattttgagctgatcaaagtcgagggaaaagtggggggtcgacttgaggacactaaactgatcaagggagtcatcgtggataaagacttctcacatcctcagatgcccaaaaaggttgaagatgccaaaattgcaattctcacgtgccctttcgagcctcccaagccaaaaacaaagcataaactggatgtcacctctgtcgaagattacaaagctctccagaagtatgagaaagagaaattcgaagaaatgattcagcagatcaaggaaacaggcgcaaacctggctatttgtcaatgggggtttgacgacgaagcaaaccacctcctgctccagaataatctgccagcagttcggtgggtaggtggccctgagattgagctgatcgctatagctaccggcggtagaatcgttcccagattttcagaacttaccgcagagaagctcggattcgctggcttggttcaagagatctcatttggtaccacaaaagataagatgctggttattgaacagtgcaagaacagcagagccgttaccatattcatccggggtggaaacaaaatgattatagaggaggccaagcgctcattgcacgatgccttatgtgtgattcgtaacctgatacgagataatcgggtggtgtatggcggaggcgcagccgagatttcgtgtgctttggcagttagccaagaggccgacaagtgtccaacgctggagcagtacgccatgcgggcttttgctgatgcgctagaagtgatccctatggctctaagtgagaacagcggcatgaatccgatacagactatgacagaagtaagggctagacaagtgaaagagatgaatcctgcgttgggaattgactgtctacacaaaggcacgaatgacatgaagcagcagcatgtgatagagactctgattgggaagaaacagcagatttcgcttgctacccaaatggtgaggatgatccttaaaatcgatgatatcaggaaacctggtgagtctgaggaatag

SEQ ID NO: 217948 - DNA, 1461 bp, Artificial Sequence
  Description of Artificial Sequence: Synthetic coding sequence
atggcttcgatgggcaccctggcctttgatgagtacggcagacccttcttgataattaaagatcaggacagaaagagtcggcttatgggcctagaagcgctgaagtcccatatcatggcagccaaggctgttgctaataccatgaggacgtctctggggcctaacgtactggccggagccttactcgaagaggcggagcagctccttgatcggggaatccaccctatcaggattgccgatggatatgaacaagccgctagggtggcaatagaacatcttgacaagatttctgactcggtattagtggatataaaggacaccgaaccactgattcagacagcaaagaccaccctgggttctaaggtggttaactcttgccaccgccaaatggccgaaatcgctgtgaacgccgttctgaccgtggcagatatggagagacgagatgtagacttcgagttgattaaggtggaaggaaaggtaggaggtagactggaggatactaagctgataaaaggagtgattgtggacaaggacttttcccacccacagatgcccaaaaaggtggaggacgctaaaattgccattctgacatgtccctttgagccgcctaagcctaagaccaaacacaagttggacgttacctccgtggaagattacaaagccctccagaagtacgagaaagagaaattcgaagagatgattcaacaaatcaaagaaaccggggctaatctggcaatttgtcagtggggatttgatgacgaggccaatcatctgctgctccagaataacctgcccgcagttcggtgggtaggaggccctgagattgagttaattgccatcgccactggaggaaggatcgttccaagattttctgaactgaccgcagagaagctcggatttgctggcctagtccaggaaattagcttcggaacgacgaaagacaaaatgctggtcattgagcagtgcaaaaatagcagggccgtgaccatctttattaggggtggcaataagatgattatcgaggaggcgaaacgctccttacatgacgccttatgcgtcatacgaaatctgattcgggacaaccgagtggtatacggaggcggtgcagctgaaatcagctgcgcactagctgtatcccaggaggctgataaatgtccaacgttagagcagtacgccatgagagctttcgctgacgccctggaggtgattccgatggccctatcagagaattcgggcatgaacccaattcagactatgaccgaggtccgcgcaagacaggtgaaggaaatgaaccctgcgttagggattgactgcctccacaagggcactaatgacatgaagcagcagcacgtgattgaaactctgattggcaagaagcaacagatttccttagccacacagatggtccggatgattctgaagattgacgatatcagaaagcccggagagtccgaggagtag

SEQ ID NO: 217949 - DNA, 1512 bp, Artificial Sequence
  Description of Artificial Sequence: Synthetic coding sequence
atggctgccaaagccgttgctaatactatgcggactagcctgggcccaaatgggctggacaagatgatggttgataaagacggggatgtgacagtgaccaacgatggtgccactattctctccatgatggacgtggatcaccagatcgccaagctgatggtcgaactgtctaaatctcaggatgatgagataggcgatgggaccacaggcgttgtggtgctggccggtgctctactggaggaggctgaacagctcctcgacaggggaattcaccccattcgtatcgccgatggctacgagcaggctgcccgtgtggcaatcgaacacttggacaaaataagcgattccgtgttggttgacatcaaggataccgaaccattaatccaaacggcaaaaaccaccctgggatctaaggtggttaactcgtgccatcgccaaatggcagagatcgccgtgaacgctgtactgactgtcgcagacatggaaagacgcgatgtcgactttgagctgattaaggttgaggggaaggtcggcggaaggctggaggacacaaagctgatcaaaggcgtgattgtggataaagatttttcacatccccagatgccaaaaaaagtcgaagatgcaaaaatagccattctgacttgcccctttgagccaccgaaaccgaaaacaaagcataagctcgacgtgacaagcgtggaagactacaaggcacttcagaaatatgaaaaggagaaatttgaagagatgatccaacagattaaagagactggcgctaacctggctatttgtcagtgggggttcgacgatgaggccaatcacctgctcttacagaacaatctcccagcagtaagatgggtcggaggacccgaaattgagttgattgccatagcaactggtggcagaatagtgccccgtttctccgagctgacagcagaaaaacttgggtttgcagggttggtgcaagaaatatcttttggcacaaccaaagacaaaatgctggtaattgaacaatgcaaaaacagtcgagcggtgactatctttattcgaggcggaaacaaaatgatcatcgaagaagccaaacggagtctgcatgatgctctgtgcgttatacggaacctgattagagataatcgcgtcgtgtacggcggtggtgcggcagagatttcctgtgccctagctgtatcccaagaggctgacaagtgcccaacgctcgagcaatatgctatgagggcgttcgccgatgccctggaggtcatacctatggccctatcagagaactccggtatgaatcctattcagactatgacagaggtgcgagcacgtcaagtcaaagagatgaaccctgctttgggtatcgattgccttcacaagggcacgaatgacatgaaacaacagcacgtaatcgagacactgatcggaaaaaaacaacagatatccctcgctacgcagatggtccgcatgattctcaagattgacgatattcgtaaaccgggtgaatctgaggagtag

SEQ ID NO: 217950 - DNA, 1593 bp, Artificial Sequence
  Description of Artificial Sequence: Synthetic coding sequence
atggccgctatcaaggccgtcaatagcaaggccgaggttgctagagcgcgtgccgcactcgctgttaatatatgcgctgctcggggactgcaggatgtactccggaccaaccttggcccaaagggtaccatgaagatgctggtgtctggggctggagatattaaacttaccaaggacggtaacgtgttgttggacgaaatgcaaattcagcaccccacagcttctcttatcgccaaagttgccaccgcccaggatgatgttacgggagacggcacgaccagcaacgttttgattatcggggagttactaaagcaggctgatttatatatatctgagggcctccacccacgcattatagcggaaggctttgaagcggcaaagattaaggccctggaggtcctggaggaggtgaaggtgaccaaggaaatgaagcggaaaatcctcctggacgtcgcgaggacttctttgcaaactaaagtccacgccgagttggccgacgtgctgaccgaagtcgtggtcgatagcgttcttgctgtgcggaggcctggctatccgattgatctcttcatggtggaaattatggagatgaagcataagctcggcacagacacaaagttgatccagggtctcgttttggatcacggagcgcgacacccagacatgaaaaagagagtcgaggatgcatttatcctaatctgtaatgtgtccctggaatatgaaaagacagaagtgaactcaggctttttctacaagactgccgaggaaaaagaaaagctggtaaaggccgaacgcaaatttatcgaggaccgcgtgcagaagattattgaccttaaagacaaagtgtgcgcccagtccaacaaaggctttgtcgttatcaaccaaaaaggaatagatcccttttccctagactcgctggcaaagcacgggatcgttgctcttaggcgtgccaagcggagaaacatggaaaggctatcattggcctgtggcggaatggccgtcaattccttcgaggatctcactgttgattgccttggccacgcaggcctcgtgtacgaatacaccctgggcgaggagaagttcacattcatcgaagagtgcgtcaacccctgcagcgtgaccctgctggtcaaaggccctaataaacacaccctgacgcaggtgaaggacgctattcgggatggattgcgcgctataaagaacgccattgaggacggttgtatggttcctggggctggggctatcgaggtagctatggccgaggcactagtgacctataagaacagcatcaagggacgggcacgcctgggagtccaggcgtttgccgacgccctgctgatcatcccaaaagtgctggcccaaaacgctgggtatgatccgcaggagacactggtgaaggtgcaagcggagcatgtggagtctaagcaactggtgggagtggatttgaacacgggcgagccaatggtcgccgctgacgccggtgtgtgggataattattgcgtaaagaagcagctcctacactcctgcactgtgatagccaccaatatcctcttagtcgatgaaataatgagggcagggatgtcctccttgaagtag

SEQ ID NO: 217951 - DNA, 1482 bp, Artificial Sequence
  Description of Artificial Sequence: Synthetic coding sequence
atggctgcaatcaaagctgtcaattctaaggctgaggtcgctagagccagagcagccctggctgtcaatatctgcgccgcacggggtttacaggatgtgttgagaacaaatttgggccctaaaggcacgatgaagatgcttgtgtcaggcgctggagatatcaaactgaccaaagacggtaacgtactgctggatgagatgcagatccagcatccaaccgcaagcctcatcgctaaggttgccactgcgcaggatgacgtcacaggggatggcaccactagtaacgtcttgattattggcgagctgctgaagcaagccgatctctacattagcgagggtctccaccccaggatcattgcagaaggcttcgaggcggcaaagatcaaggctctcgaggtcctcgaggaggtgaaggtcacaaaagaaatgaagagaaagattctgttggatgtggcgcgaacctcacttcaaacaaaggtacacgcggaactcgctgatgtgctcaccgaagttgtggtagattctgtcctcgcggtgaggcggccaggctacccgatcgatctgtttatggtggaaattatggagatgaaacataaactggggaccgatacgaaggaggtaaattctggttttttctataaaaccgctgaagaaaaagagaaactggtgaaagctgaacgtaagtttatagaggacagggtgcagaagatcatcgacctaaaagacaaggtctgtgcccagagcaataaaggatttgtcgtaatcaatcagaagggtatcgaccccttttccctggattcactggcaaagcacggaatcgtcgcactccgtagagctaagcggaggaatatggagcgactgtccctggcctgtggcggaatggccgtgaactccttcgaggaccttactgtggactgcttaggccacgctgggctcgtttacgagtacacccttggggaagagaaattcacctttatcgaagaatgtgtgaacccctgctcagttactttactagtgaaaggcccaaacaagcacacactgacacaggtgaaggacgctatccgggatggcttgcgtgcgatcaaaaatgcgattgaggacgggtgcatggtacctggtgccggtgctattgaagtcgctatggcagaggcactggtgacttacaagaactcaatcaaggggagggcacggctgggcgtgcaggcctttgccgatgcactactcattattcccaaggtattggcacaaaatgcaggctacgatccacaggagacactcgtgaaggtccaggcagaacacgtggaaagcaagcagctggtaggagtcgacctgaacacgggggaacccatggtggctgccgacgcaggcgtgtgggataactactgtgttaagaagcaactactccactcttgtacagtgatcgctactaatatccttctggtcgacgaaatcatgcgcgcaggaatgagtagcctgaagtag

SEQ ID NO: 217952 - DNA, 1458 bp, Artificial Sequence
  Description of Artificial Sequence: Synthetic coding sequence
atggcagcgataaaagccgtgaactctaaagccgaggttgcccgagccagggccgctcttgcagtaaacatatgcgctgctagaggactgcaggacgtgctgcgaacaaacctgggtcccaagggaacaatgaagatgctggtgtccggagctggggacatcaaactgactaaggacggcaacgtgttgttagatgaaatgggacttcaccctagaattatcgcagaagggtttgaggccgctaaaattaaagcccttgaagtccttgaggaagtgaaggtgacgaaagagatgaagcgaaagatacttctggacgttgctaggacatccctgcagactaaggtacatgccgaactggctgacgtgctgacagaggtggtcgtagactcggtgctcgcagttcgacgacctggttatcccattgatctttttatggtggagataatggaaatgaaacacaagctaggcacagataccaagctgattcaagggctcgtcctcgatcacggtgcacgacacccggacatgaaaaagcgtgtcgaagacgcttttattcttatatgtaacgtgtcactcgagtacgagaaaaccgaggtcaacagtgggtttttctataagactgctgaggagaaagagaaattggtgaaggctgagcgcaaattcatagaagaccgcgtgcagaagattatcgatttgaaggacaaggtctgcgcacaaagcaacaagggctttgtagtgatcaatcagaaaggcattgaccccttctccctcgattcactggctaagcacggtatcgttgccctgagaagggccaaaaggcgtaacatggaacggttgagtctggcttgtggtgggatggctgttaactcttttgaggacctgacggtggactgcctggggcacgctggattggtgtacgagtacaccctcggggaggagaagttcacatttattgaggagtgtgtcaacccgtgtagcgtgactctgcttgtcaaaggccctaataaacatacattgactcaggtcaaggatgcgattcgcgacgggttaagggctattaaaaatgcaattgaagacggttgcatggttcctggagcaggagccatcgaagtggccatggcagaagctcttgtaacatataagaacagcatcaaaggcagagcgcgtttgggagtacaggcatttgccgacgctctgcttatcatccccaaagtgcttgcacagaatgcagggtatgaccctcaggagactttggtgaaagtccaagccgagcacgttgaaagcaagcagctcgtgggagtcgacctcaatactggcgaacccatggtggctgcagacgcgggagtctgggacaactattgcgtaaaaaagcagctgctccactcgtgtactgtcattgctacaaatattttacttgtcgacgagatcatgcgcgcaggaatgtcctctctgaagtag

SEQ ID NO: 217953 - DNA, 966 bp, Artificial Sequence
  Description of Artificial Sequence: Synthetic coding sequence
atgaaacccggattctcaccacgtggtgggggtttcggtgggagaggcggatttggcgatagaggaggaagaggaggtcgtgggggattcggcggaggcaggggccgtggtggaggcttcaggggtagaggacgtggaggaggtggcggtgggggaggaggcggaggtggagggagaggtggcggagggttccacagcggtggaaacagaggcagaggccgaggcggaaaaagggggaatcaaagcggaaaaaacgtcatggttgaaccacatcggcacgaaggcgtctttatctgtaggggaaaagaagacgccttagtgactaaaaacctggtccccggagaaagcgtgtatggagagaaacgcgtgagtatcagtgagggagacgataagatagagtaccgggcttggaaccccttccggtccaagcttgcagctgccatactcggcggtgtagatcaaatacacataaagcctggagccaaggtcttatatctaggcgcagcctctggtactaccgtcagccatgtctcggatatagtcggcccagacgggctggtgtatgccgtggaattttcccatcggagcggtagagatctgattaacctggcaaagaagcgaactaacattatccctgtgattgaggatgcacggcaccctcataaatacaggatgttgatcgctatggtcgacgtgattttcgcagacgtggcccagcccgaccagacaagaatcgtggcactcaatgcgcacacattccttagaaatgggggtcactttgttatatcaatcaaagcgaattgtatcgactcaaccgcttctgccgaggcagtcttcgcatccgaagtgaaaaaaatgcagcaggagaacatgaagcctcaggagcagctgacgctcgagccctatgaacgggatcacgctgtggtcgtgggcgtttatagacctccccctaaagtcaaaaactag

SEQ ID NO: 217954 - DNA, 723 bp, Artificial Sequence
  Description of Artificial Sequence: Synthetic coding sequence
atggatgtccatggggaagccgctggcgaagcaggacaggaaggcggagaagggctacaaggtggggctggtcaatctgaggagggcccttccgccgaaaaatgtcgggtttgcccttgtgtgtgccgggagaggcacccccaggaggagagaagatgcgaactggcgagtgatggagttcctagaaggcgaagtggcctgcaaggagcggattcgtgcgactacgagggaggggaccaggaatacggaccaggagaccagagccccggtcagggcccagagcaccatggcccagccgagggactgttatccgatggccaagtgcgcgcagcaggagctgaaccaggaagaccttacatcggagatggcggattacacgagctgggccatcatcctgaccacgccgctggggctgggggacagccgcaccacgctgacaggagaggggagtggcccggaggggcagggcctgcccagccggcagctaggggacggttgtgtcggggtagggagctgtgtgcccagcctggcggacccgctgttaccgaggttggcagactcgaggaattagcggttccgagacgctgcgcaccgcctcttcctcgggacgtactggaggggtcgtgccccctccctaccgctagctgcctgtgtgccgatccagctggtttgagacccgctgcaacgctgcgcttgtctcctgcgagaccagcatggccttag

SEQ ID NO: 217955 - DNA, 591 bp, Artificial Sequence
  Description of Artificial Sequence: Synthetic coding sequence
atggacgataccctgtttcaactgaaattcaccgctaaacaattggaaaaactggcgaagaaggccgagaaagattccaaggcagagcaggctaaagtgaagaaggctctactgcagaagaacgtagaatgcgccagagtctacgctgaaaacgcaattaggaagaagaacgagggtgtcaattggctcaggatggcctctcgcgtcgatgctgtggctagcaaggtgcaaacagccgtgacgatgaaaggcgtcaccaagaatatggctcaggtgaccaaggcactggacaaagccttatctaccatggatttgcaaaaagtatccagcgtcatggatagatttgagcagcaggttcaaaatctggacgtgcataccagcgtgatggaagacagtatgtcctccgctactaccctcactaccccacaggagcaggtagacagcctgatcatgcagatcgctgaggagaacgggctggaggtccttgatcagttgagtcaacttcccgaaggagcctctgccgttggtgaaagttctgtcagatcgcaggaagaccagttgtccagacggctcgccgcattgcgaaattag

SEQ ID NO: 217956 - DNA, 600 bp, Artificial Sequence
  Description of Artificial Sequence: Synthetic coding sequence
atgtctaacatggaaaagcacttgttcaacttgaaattcgctgctaaggagctatcaagatcagccaagaagtgcgacaaagaggaaaaggccgaaaaagcgaaaatcaaaaaggccattcagaaagggaacatggaagttgcccgtattcacgcagaaaacgcaattagacagaagaaccaagcagtcaattttctgcgcatgagtgcacgagtggatgccgttgcggcacgggtgcagactgctgtaactatgggcaaagtgaccaagtcaatggcaggtgtggtcaaaagtatggacgcaaccctgaaaactatgaatttggagaaaatatccgcattaatggataagttcgagcaccagtttgagacactcgacgtacagacccagcagatggaggacacaatgagctctaccacaaccctcactaccccacaaaaccaagtcgacatgctattacaggagatggctgacgaggctggattggatcttaatatggagctccctcagggccagactggtagcgtgggcacttctgtggcaagcgctgaacaggacgagctttcccagagactggccagactgcgagatcaggtctag

SEQ ID NO: 217957 - DNA, 669 bp, Artificial Sequence
  Description of Artificial Sequence: Synthetic coding sequence
atggatcttctttttggcaggcgaaagacacccgaggaactgctccggcagaaccaacgcgctttgaacagagccatgcgggagctggacagagagcgccagaaactggagacgcaagaaaaaaagatcatagccgacataaaaaaaatggccaaacagggacagatggacgccgttaggatcatggccaaggacctggtccgaaccaggcgttacgttcgcaaattcgtgttgatgagggcaaacatccaggcagtctccctgaagattcaaacactgaaatccaataactcgatggcccaggctatgaagggggtgaccaaggccatgggaacgatgaatcggcagctgaagctcccacagattcagaagattatgatggagtttgagcggcaggccgaaatcatggatatgaaagaggaaatgatgaatgacgctattgacgacgcgatgggagatgaggaggatgaggaggagtcagatgctgttgtttcacaggtgctcgacgaactgggtctgagtctgactgacgagctgagcaatcttcctagcaccggaggctctctgtcagtagcagccggaggcaaaaaagcagaagccgctgcctccgccctagcggacgctgatgcagacctggaagagcggctcaagaacttacgcagggactag

SEQ ID NO: 217958 - DNA, 669 bp, Artificial Sequence
  Description of Artificial Sequence: Synthetic coding sequence
atggacctgctcttcggccgtcgaaaaacaccggaagaacttttgcgccaaaaccagcgagcccttaatcgcgctatgcgcgagctcgaccgtgaacggcagaaactagagacacaagagaaaaagatcattgctgatatcaagaagatggccaaacagggccagatggacgcagtgcgcattatggctaaggacctagtcaggactcgaagatacgttaggaaattcgtgttaatgcgagcaaatatccaggctgtgtccctaaagattcagacgctgaagagcaataattccatggcgcaggccatgaaaggggtgaccaaagcgatgggcactatgaaccggcaattgaagttaccccagatacaaaaaataatgatggagttcgaacgacaggcagagattatggacatgaaggaagagatgatgaatgacgcaatagacgatgctatgggagacgaggaagacgaggaggagtctgacgctgtagtgagtcaggtcctggatgagctcggactctctctgacagatgagctgtctaacctgcctagcacgggaggcagcttgagtgtcgccgcaggcggtaaaaaagccgaggctgcagccagtgccttggctgatgcagacgcagacctggaagaaaggctaaaaaatctacgcagagattag

SEQ ID NO: 217959 - DNA, 642 bp, Artificial Sequence
  Description of Artificial Sequence: Synthetic coding sequence
atggccagcctgttcaaaaaaaagacggtggacgacgtgatcaaagaacagaaccgggaactgcgtggcactcaacgcgctattatcagggatcgcgctgcactagaaaagcaagagaagcagttagaactggagatcaaaaaaatggccaaaatcggcaacaaagaggcctgtaaagttttagccaagcagttggtgcatttgagaaaacagaaaacacggacgtttgcagtcagctccaaggtgaccagtatgagtacccagacgaaggtgatgaatagtcagatgaaaatggctggggctatgtctacaaccgcaaaaaccatgcaggctgtcaacaagaagatggacccacagaagacattgcaaactatgcagaattttcaaaaagaaaatatgaaaatggagatgactgaggagatgattaacgatactctagacgacatattcgacggtagtgatgacgaggaagagagtcaggatattgtgaaccaggtcctggatgaaattggaattgagatctcagggaaaatggccaaagcgccaagtgccgctagaagtctgccaagcgcaagcacttcaaaagcgacgatctccgatgaggaaattgagagacagttgaaggccctgggtgtcgactag

SEQ ID NO: 217960 - DNA, 519 bp, Artificial Sequence
  Description of Artificial Sequence: Synthetic coding sequence
atggagttggaaatcaaaaagatggccaagattggtaataaagaagcctgcaaggtcctcgccaagcagctcgtgcacctccgaaagcaaaaaaccaggaccttcgcagtgtcctcgaaggtgacctccatgagtacgcaaactaaagtcatgaactcccaaatgaaaatggccggagccatgtccaccaccgcgaaaaccatgcaggcggttaataagaaaatggacccgcagaagaccttgcagaccatgcaaaactttcagaaggagaacatgaaaatggagatgaccgaagaaatgatcaatgacactctggacgatatcttcgacgggtccgacgatgaagaagaatctcaggatattgtcaatcaggtactggacgaaattgggattgagatctctgggaaaatggcaaaggcaccaagcgcagctcggagtctgccaagcgcgagtacttccaaagctaccataagcgacgaggagatcgagcgacagcttaaggctctgggggtggattag

SEQ ID NO: 217961 - DNA, 669 bp, Artificial Sequence
  Description of Artificial Sequence: Synthetic coding sequence
atggggttgtttggcaagacccaggaaaagccacctaaggagctggtcaacgaatggtccctcaagatcagaaaggaaatgagagtagtggatagacagattagggatattcagcgcgaggaggagaaggtgaagcgctcggttaaggacgccgctaagaagggccaaaaggacgtctgcatcgttctggctaaagagatgatccgctcacgcaaggctgtgtcgaaactttacgcctctaaggcccatatgaactctgtgttgatgggcatgaaaaaccagctagccgtcttacgagtggccggttcactccagaagtccaccgaggttatgaaagctatgcaatccttagtgaagattccagagattcaagcaaccatgcgtgagctgagtaaggagatgatgaaagctggcatcatcgaggaaatgctggaagacactttcgagtcaatggacgaccaggaagaaatggaagaagaggcagagatggaaatcgacaggatactgtttgagattactgctggcgcactgggtaaagcccctagtaaagtcaccgatgccttgcctgagcctgagccacctggagcaatggctgcatcggaggatgaagaggaggaagaggaggcactggaagcgatgcagagtcgactggcaaccctacgctcatag

SEQ ID NO: 217962 - DNA, 471 bp, Artificial Sequence
  Description of Artificial Sequence: Synthetic coding sequence
atgatcaggtcacggaaagccgtctccaaactctatgccagcaaagcccatatgaacagtgtgttaatgggtatgaagaaccagttagcagtcctgagagtggcaggcagtctccagaaatccacagaagttatgaaagccatgcaatccctggtgaaaataccggaaattcaggctactatgagggaactcagtaaggaaatgatgaaagccggaatcatagaggagatgctagaagatacttttgagagtatggatgatcaggaggaaatggaggaggaggccgaaatggaaattgaccgaatcttatttgaaattacggcaggggcactcggaaaagcacccagtaaagttacagacgctctccccgaaccagaacctcctggagccatggcggcttcagaagatgaggaggaagaagaagaggccctcgaagccatgcagagccgcctggccacgctgagatcctag

SEQ ID NO: 217963 - DNA, 756 bp, Artificial Sequence
  Description of Artificial Sequence: Synthetic coding sequence
atggagggcgaactttattctgcactgaaggaagaggaagcctccgagagcgtttccagcaccaactttagcggcgaaatgcatttctatgaactggttgaagatacaaaggatggcatttggctggtgcaggtaaatgagtggtcactgaaaataaggaaggagatgcgggtggtggaccggcagattcgagatattcagagagaggaagagaaggtgaaacgctcagttaaggacgctgccaaaaaaggacagaaagatgtttgtatcgtgctcgccaaagagatgattagatcacgcaaggcggtaagcaagctgtacgccagtaaagcacacatgaattcagtcctgatggggatgaaaaaccagctggcagtactgagggtcgccggatctcttcagaagtccacggaggttatgaaggccatgcagtctctggtgaagattcccgagatccaggccaccatgagggaactgtctaaggaaatgatgaaagccggaatcatcgaggagatgcttgaagacacattcgagtcaatggatgaccaggaggagatggaagaggaagccgagatggaaatcgaccggatacttttcgaaattactgccggtgccctcggcaaggcacctagcaaagttactgacgcactccccgaacccgagccccctggcgcaatggcagcgtctgaggacgaagaggaggaagaggaggcactggaggccatgcagtcccggctggctaccctcaggtcttag

SEQ ID NO: 217964 - DNA, 549 bp, Artificial Sequence
  Description of Artificial Sequence: Synthetic coding sequence
atgggcctattcgggaaaacacaagaaaagcctccgaaggagctggtgaatgagtggagcctcaagatccgtaaggagatgcgcgtcgtggatcgccaaattcgggatattcagcgtgaagaggagaaggtgaagcgctcggttaaggatgctgcgaagaaagggcagaaagatgtatgtatcgtactggcgaaagaaatgatccgctcgcggaaggccatgcagtccctcgttaagattcctgaaattcaggcaacaatgagggagttgtcaaaggagatgatgaaggccggtatcatcgaggaaatgctcgaggacacatttgagtccatggacgatcaagaagagatggaggaagaggcagagatggaaatcgaccgcatcctgtttgagattacagcgggtgctctaggcaaggcaccttccaaggtgacagatgcccttccagaacccgagcctcccggagccatggcagcatccgaagacgaggaggaagaggaggaggctttagaggcaatgcagtccagactcgctaccctgcgctcttag

SEQ ID NO: 217965 - DNA, 798 bp, Artificial Sequence
  Description of Artificial Sequence: Synthetic coding sequence
atgtccaggcgcagaccagaggatggcctggggaaagccggaccctgcgttatgaggcaccatcccccaaggtctaaagccgaagtttggagaaccctgcgaggaggagggggtcgaggcgagcttgccatgagtggactgggtaggctgtttgggaaggggaagaaggaaaaggggccaacacccgaggaggccatccagaagcttaaagaaaccgaaaagattctcattaagaaacaggaatttctcgagcagaaaattcaacaagagctacagactgccaagaagtatgggaccaaaaacaagagggctgctcttcaagctttgagacggaagaaacggtttgaacagcagctcgcccagacagacggcaccctgtctacgcttgagttccagcgtgaggcgattgaaaacgctacaactaacgcagaggtattaaggaccatggagctcgccgcacagtccatgaagaaggcctaccaggatatggacatagacaaagtcgacgagctgatgacagacattacagaacagcaggaggtggcacagcagatcagcgatgctatctctcgccctatgggcttcggtgacgacgttgatgaggacgagctgttagaagaactcgaagaactcgagcaggaagagctggcccaggagttgctgaacgtgggagacaaggaagaggagccttcggtgaagctcccttctgttcctagcacacatctcccagccggacccgcaccaaaggtcgacgaggacgaggaggcgttaaaacaacttgccgagtgggtttcttag

SEQ ID NO: 217966 - DNA, 378 bp, Artificial Sequence
  Description of Artificial Sequence: Synthetic coding sequence
atggccggaccttctctggcctgttgtctcttgggcctgcttgccctgacttctgcttgttatatccagaactgccccctgggcggaaagagggccgctcctgatttggacgtccggaagtgcctgccctgtgggccaggaggtaagggaaggtgctttggcccaaatatatgttgtgccgaggagcttgggtgtttcgtaggtacagccgaggccctgcgctgccaggaggaaaattacttacctagcccctgccagagtgggcagaaagcctgtggcagtggtggccgatgtgccgtcctggggctctgctgttctccggatggttgtcatgctgatccagcctgcgacgcagaggcgacatttagccagagatag

SEQ ID NO: 217967 - DNA, 831 bp, Artificial Sequence
  Description of Artificial Sequence: Synthetic coding sequence
atggctccaccccctgcccctctgcttgcccctcgccctggggagactcgaccaggctgtaggaagccaggaactgtctcatttgcagatgttgccgtatacttttcacccgaagagtggggctgcctgagaccagcacagcgcgctctctatagggacgtaatgcaggagacatatggccatttaggggcacttgggtttcctggcccaaagcctgcactgatttcatggatggaacaagagtccgaagcttggagtccggcagctcaagaccccgaaaaaggcgaaagactaggaggagctcggaggggtgatgtgcccaatcgtaaggaagaggagccagaagaagtgccaagggctaagggtcctagaaaagcacccgtgaaggaatccccggaggtgctagtggagaggaatcccgaccccgcaatcagtgtggctcctgctagggcacagccccctaaaaatgcagcctgggaccccacgaccggcgcacaacctccagcccctattccttcaatggacgctcaggccggtcagaggcgccatgtctgcaccgactgtggcagaagatttacctaccccagcctgttggtaagtcatcgcagaatgcacagcggagaaagaccatttccctgtcccgagtgtggaatgaggtttaaaagaaaattcgccgtggaggctcaccagtggatccatcggagctgttccggtggaaggcgcggacgacgccctggcatccgtgcagtaccacgcgcaccagtgcgcggagatcgcgacccgccagtcttgtttcgccactatcctgatatttttgaggaatgcggatag

SEQ ID NO: 217968 - DNA, 516 bp, Artificial Sequence
  Description of Artificial Sequence: Synthetic coding sequence
atgaatcgactatttggcaaagccaagcccaaagcccctcctcctagtctcacggactgcattggaacagtggattctcgcgcagagagcattgataagaagatcagcaggcttgacgccgaactggtcaaatacaaagatcagatcaaaaaaatgagagagggtcctgctaagaacatggtgaaacagaaggcattacgtgtactgaagcaaaagcggatgtatgagcagcagcgggataatctggcgcagcaaagcttcaacatggagcaagccaactacactattcagtccctgaaggacactaaaacgacagtagatgcaatgaaactgggcgtgaaagagatgaaaaaggcttacaagcaggtgaagatcgatcagattgaggatctgcaggatcagttggaggatatgatggaggatgccaacgagatccaggaagctctgtcccgcagttacggtaccccagaacttgatgaagacgaccttgaagccggttggagctctggaggatag

SEQ ID NO: 217969 - DNA, 606 bp, Artificial Sequence
  Description of Artificial Sequence: Synthetic coding sequence
atgggcaacctcttcggcaggaagaagcagagccgcgtgaccgagcaagataaagccatcctccagctgaagcaacagcgcgataaattgcggcaataccaaaaacgcattgcccagcaactggaaagagaaagagctctcgccaggcagctgttgcgcgacggccgaaaagagagggcaaagctacttctgaagaagaaacggtaccaggagcagctgctggacagaacagagaatcagatctcctctttggaggccatggttcagtcaattgaattcacccaaattgaaatgaaggttatggaagggcttcagtttgggaatgaatgtttgaataaaatgcaccaggtgatgagcatcgaagaagttgagcgtatcctggatgagacgcaggaggccgtcgagtatcagcgccaaatcgacgaattgctcgccggaagttttacccaggaggacgaagatgccatcttggaagagctttccgccatcacccaggagcagattgaactgccagaggtgccatctgagcctctgcctgaaaagatccccgagaacgtacctgtaaaggcccgacccaggcaggccgagttggtcgcagccagctag

SEQ ID NO: 217970 - DNA, 1362 bp, Artificial Sequence
  Description of Artificial Sequence: Synthetic coding sequence
atgtggtctcccgagagggaggccgaggctcctgccggaggagacccagccggtttacttcctccggagtgggaagaagacgaggagcggatgagctttctgttctccgctttcaagcgcagcagggaggttaactccaccgactgggactcaaaaatggggttttgggcacccctcgtgctgtcccactcacgaaggcagggtgtggtgcgtcttcgtctccgagacctccaggaggctttccagagaaaaggctccgtacctcttggcttagccaccgtactccaggatctgctccgcagaggcgagcttcagcgcgaaagtgactttatggcgtccgtggactcttcctggattagctggggggtgggggtttttctgttgaaaccactgaagtggacactcagtaacatgcttggcgacaacaaggtacctgcggaggaagttctggttgcagtcgagttgctaaaggaaaaggccgaggaagtgtacaggctgtatcagaatagtccactgtcaagtcatccagtggtcgcgcttagcgaacttagcaccctgtgcgcgaatagctgtcccgacgaaagaaccttttaccttgtgttgctccagcttcagaaggaaaagcgcgtcactgtactcgagcagaatggcgaaaagattgtcaagtttgccagagggccaagggctaaggtgtcacccgtgaacgatgttgacgttggcgtgtatcagctgatgcaatcagagcagctattgtcccggaaagtcgagagcctgtctcaagaggcagaaaggtgtaaagaagaagcaagaagggcctgcagagcaggcaaaaagcaactggccctgcgaagtctgaaggccaaacaaaggactgagaaaaggatagaggccctacacgctaaactcgatacagtgcagggtattttggataggatttacgcttcacagaccgaccagatggtgttcaacgcctatcaggccggagtgggagccctgaagctcagtatgaaggacgtcacagtcgagaaggcagaatcactggtcgatcaaatccaggagctttgtgatacacaggatgaggtatcccagaccctggcgggtggggtcaccaacggactggacttcgacagtgaggaactggaaaaggaactagacatcctgctacaggacactaccaaggagcctctggatcttcctgacaaccctaggaatagacacttcacaaacagtgtacctaaccctcgaatcagtgacgcagaactggaagctgagctcgagaaactttctttaagcgagggcggtctggttccttcctctaagtcccctaaaaggcagttagagcccactctgaaacccttgtag

SEQ ID NO: 217971 - DNA, 1362 bp, Artificial Sequence
  Description of Artificial Sequence: Synthetic coding sequence
atgtggagtcccgagcgcgaggccgaagcgcctgcagggggagaccccgctggtctcctgccacctgaatgggaggaggatgaggaaagaatgtcatttctgtttagcgcctttaagcggtctagagaagtgaattcaactgactgggacagtaagatgggcttctgggcgcctctggtactctcacatagcagacggcagggcgtggtgaggctgaggctgcgagacttgcaggaggctttccagcgaaaaggatctgtgcccctcggtctggctacagttcttcaagatctactgagacggggagaattgcagcgggagtctgatttcatggcttcagtagactcgtcctggatctcgtggggagtaggcgtgtttctgctaaagcctttaaaatggacgctcagtaatatgttgggcgataataaagtgcctgccgaggaggtgctagtcgccgtcgagctgctgaaggagaaggccgaagaggtgtacaggttgtatcagaacagcccactgtccagccacccggtggttgccctctcggagttgtctacgctgtgcgccaactcttgtccagacgagcgaacattttatctggtgctgctccagttgcagaaggaaaagcgcgtcaccgttttagaacagaatggggaaaagatcgtgaaatttgctaggggacccagggcaaaggtgagccccgttaacgacgtggacgtgggagtctaccagctcatgcagtctgagcagctgctgagtagaaaggtcgagagtctgtcacaggaggctgagagatgcaaagaggaggccaggcgtgcatgccgagcaggcaagaagcagctcgcacttaggtcccttaaggccaagcagagaacagagaaaaggattgaggcgttacacgcaaagctggatactgtgcagggcatccttgatcgcatctatgcctctcagacagaccagatggtattcaatgcataccaggccggagtgggggctctgaagctttccatgaaagacgtcactgtcgaaaaggctgagtccctcgtagaccagattcaagaactttgcgatactcaggatgaagtaagtcagacacttgccggaggtgtcacaaatggtcttgattttgactctgaagagttagagaaagaactggacattttactccaagacaccaccaaggagcctctcgaccttccagacaaccctagaaacaggcactttaccaactccgttcctaatcccagaatcagcgatgccgagttagaagcggagcttgaaaagttgagcctttctgagggcggactggtgccttcttctaaaagtccgaagagacagctagagcctactctgaagcccctatag

SEQ ID NO: 217972 - DNA, 1992 bp, Artificial Sequence
  Description of Artificial Sequence: Synthetic coding sequence
atggagaggcctgaagaaggcaagcaatcacccccaccacaaccgtggggccgtttgctgcggctcggtgccgaggagggcgaaccacacgtcttgcttcgcaagcgcgaatggactatcgggagacgacgtggttgcgatttgagcttcccctccaacaaactggtatcaggcgatcattgcagaatcgtagtggatgagaagtccggacaagtgaccctggaggatacgtcgacctctggcaccgtgataaacaaactcaaggttgtaaaaaaacagacatgcccacttcagaccggcgacgtaatatatttggtttaccgcaaaaatgagcccgagcataatgtggcttacctttatgagtctctgagcgaaaaacaagggatgacccaggagtcttttgaggccaacaaagagaacgtatttcacggcacgaaggatacatccggcgcaggagctggcagaggcgcagacccacgtgtccccccaagtagtccggcaactcaggtgtgcttcgaggaaccgcaacccagtactagcacatcggatctgtttcccaccgctagcgcaagctcaacggagcctagccctgctggtcgagagaggtcttcgtcctgcggctcaggtggcggtggcatttcacccaaaggctcaggcccatccgttgccagcgacgaggttagcagtttcgcctctgctctgcctgatagaaaaacagcaagtttctcttccttggaacctcaggaccaggaggatctagagcccgtgaagaagaagatgcgtggagacggagatctggacctgaatggccagctgctcgtggctcaaccacgtcggaacgctcagaccgtccatgaagacgtaagggccgctgcaggcaagcctgataaaatggaagaaacccttacttgcatcatttgtcaggacctcctccatgactgcgtctccttgcaaccttgcatgcacacattttgcgctgcctgctactccggctggatggagcgttcttcactgtgcccaacctgtagatgtccagtggagaggatctgcaagaaccatatccttaataacctagtagaggcctatctcatccagcatcctggaaattcccgcagtgaggaggacgtacagagtatggatgcacgcaataagataacgcaggatatgcttcagccaaaagtgcggaggtctttctctgatgaagagggctcatctgaagatctgctggagctgtccgacgtggattccgagtcaagcgatatatcccagccgtacgtcgtgtgcagacagtgtcccgaatatcggagacaggcagcccagcccccacattgtccggctcccgagggagaacctggggctccacaggctctgggggacgctccttccacctcagtgtccttgactactgttcaggactacgtttgcccattacagggaagccatgccttgtgcacttgctgcttccaaccgatgccagaccgccgagccgagcgagagcaggatcctcgggtcgcacctcagcagtgcgccgtctgccttcagccattttgtcacctatactgggggtgtacgaggaccggttgttatgggtgtctggccccattctgtgaactgaatctgggggataagtgcctggacggtgttctgaacaataactcgtacgagagcgatatactcaagaattatttggcaacccgtggcctaacatggaagaacatgcttaccgaatccctggtggcgttgcagaggggtgtttttcttctctcagattacagggtgactggggatacggtgctatgttattgctgcggcctccgctccttcagagagctcacgtatcaatatcggcagaatatcccggcatctgagctgcccgtcgccgtgacctctcgccctgattgttactggggcaggaactgccgcacgcaggtgaaagcccatcacgcaatgaagttcaatcacatttgtgaacagaccagatttaagaactag

SEQ ID NO: 217973 - DNA, 1872 bp, Artificial Sequence
  Description of Artificial Sequence: Synthetic coding sequence
atggagcggccagaagaggggaaacagagtcctccaccccaaccctggggcagactcctgagactgggggctgaggagggagaaccccatgtccttcttcgtaagagggagtggacaatcggcagaagaagaggctgcgacttgtcattcccctccaacaagctggtcagcggcgaccactgtaggatcgtggtggacgaaaagagcgggcaggtcacactcgaggacacatccacttccggcacagtcattaataaactgaaagtggttaagaaacagacatgtcccctgcagaccggagacgtcatttatttagtctatcggaagaatgaaccggagcacaacgttgcttacctgtatgagtctctgagcgaaaaacaagggatgacccaggaatcttttgagatggtgccctgttgcgttgctcaggctggactcaagctcctcggcagctcagacccccctacactggctagtcagtctatcgtcatcaccgggtccggcggaggcggtattagtcccaagggttccgggcctagcgttgcatccgatgaggtgagtagcttcgcatccgcgctacctgataggaagaccgcttctttctcaagcctcgagccccaggaccaggaagatttggagccagtcaagaagaagatgcggggagacggagatctagacctgaacggtcagttacttgttgcgcagccccgaagaaacgcccagacggtacacgaggatgtgagagcagcagctgggaaacctgacaagatggaggaaaccctaacatgcattatctgtcaggatttgctccatgactgtgtgagtctccagccatgcatgcacaccttctgtgccgcatgttattctggatggatggagcggtccagtctctgccctacctgtcggtgcccagttgagagaatttgcaagaatcacatactaaacaatctggttgaagcttatctgattcagcacccggataaatcacggtcagaggaggacgtgcagtctatggacgctaggaacaaaattacgcaggacatgctgcagccaaaggtcagacgttctttctctgacgaagaggggtccagcgaggatttgctggagcttagtgacgtcgactcggaaagcagcgacattagccagccttacgttgtgtgccgacagtgtccggagtaccggagacaggcggctcagccaccacattgcccggctcccgagggagaacctggtgcaccccaagccttgggcgatgccccaagcacatccgttagcctgacaactgccgtgcaggattatgtatgccctttacagggaagtcatgccctgtgtacttgttgctttcagccaatgcccgatagaagagctgaacgtgagcaggaccctcgcgtggctccacagcagtgtgcagtctgcctgcaaccattctgtcacctttattggggatgtaccaggacaggatgctacgggtgcctagcacctttttgcgagttgaatttaggagacaagtgtctggacggcgtcctaaacaataatagttacgagagcgacattctgaagaattatctggctacaaggggactgacctggaagaatatgcttacagagtcactggtggcgctgcagcggggagttttcctcttgtcagattaccgggtgacaggagataccgtgttatgctattgctgcgggttgcgctcctttcgggaactcacgtatcagtataggcagaacattccagcctccgagttgcctgtggccgttactagccgccctgactgctattgggggagaaattgccgaactcaagttaaagcacaccatgcaatgaaatttaatcacatctgcgagcagacgcgttttaagaactag

SEQ ID NO: 217974 - DNA, 1995 bp, Artificial Sequence
  Description of Artificial Sequence: Synthetic coding sequence
atggagcgcccagaggaaggaaaacaaagtcctccaccgcagccatggggacgactgctgagactcggtgccgaggagggtgaaccccatgtcctcctccggaaacgggaatggactatcggaaggcgccgaggctgcgacctgtcttttccgtctaacaagctagtgtctggggatcactgcagaattgtcgttgatgaaaagtcagggcaggtcacattggaggatacttcaaccagtgggaccgtgattaataagctcaaagtggtgaaaaaacagacatgtccgctgcagactggcgacgtgatttacctcgtatataggaagaatgaaccggagcacaacgtggcctacctatacgagagtctgagcgagaaacaggggatgacccaagaaagttttgaagccaacaaggaaaatgtgtttcacgggactaaggataccagcggagccggtgccggtcgcggagcggaccctcgtgtgcccccaagctcacctgccacacaggtgtgctttgaagaacctcagccttcaacctcgacctctgacctgttcccaacagcatctgcttcttcaactgagccctcccccgctggcagggagcgctcaagtagttgtgggagtgggggaggcggaatttctccaaaggggagtggaccctcagtggcctccgacgaggtatcctcttttgcatccgcactcccagacaggaaaaccgccagtttttcttcactggaaccacaagaccaagaggacctggagccagtgaaaaagaagatgagaggggacggcgatcttgatctgaatgggcagctgctggtggcacagcctcgccgaaacgcacaaaccgtgcatgaagacgttcgagctgcggcaggcaagcccgacaagatggaagagactcttacctgtattatctgccaggacctgttgcatgactgcgtgtcattgcagccttgcatgcacaccttttgcgcggcttgttattcaggatggatggagcgctctagcttgtgtccaacttgtagatgtcccgtcgagcgaatctgcaaaaaccatattctgaacaatcttgtcgaggcatatttaatacagcatccagacaaatcccggtccgaagaagacgtgcaaagcatggatgccagaaacaagatcacgcaggacatgctgcagccaaaagtgaggaggagcttctcggacgaagagggctcatccgaagacctgctggagctatctgatgttgactccgagtcttccgatattagccaaccctacgttgtttgccgccagtgccctgagtatcgcaggcaggccgctcagccacctcactgccctgctcctgaaggcgagccgggagcgcctcaggccttaggtgatgcccctagtacttcagtgtcgcttacaacagctgtccaggattatgtttgcccgttgcaggggtctcacgctctgtgtacctgttgtttccagcccatgcccgaccgccgtgccgaacgggagcaagatcccagggtagccccacagcagtgtgcagtgtgtttgcaaccgttctgtcacctgtactggggctgcacccggaccggatgttacggctgcctggctccgttttgtgagctgaacctgggagacaaatgtctggacggcgtgctgaataataatagctacgaatccgacattcttaaaaattacctcgcaacccgaggccttacttggaaaaacatgcttacagagtcgcttgtcgccctgcagaggggagtttttctgctatctgactatcgagtgaccggcgacacggtgctttgctactgttgtggccttcgttcattcagggaactaacataccagtaccgccagaatattcccgcatccgagttgccggtggccgtgacaagtagaccagattgctactgggggagaaattgccgaactcaggtgaaggcacatcatgctatgaagttcaaccacatctgcgaacagactcgctttaaaaattag

SEQ ID NO: 217975 - DNA, 1959 bp, Artificial Sequence
  Description of Artificial Sequence: Synthetic coding sequence
atggaaaggccggaggagggaaaacaaagtccccctccccaaccctgggggaggctactccgccttggtgccgaggagggagaacctcacgtgctgctgcgcaaacgagagtggaccatcggacgcaggcgcggatgcgaccttagcttcccgtccaataaattggtttctggcgatcactgtcgcatcgtagtggacgaaaaatctggccaggtgactcttgaggatacctctacctccgggacggtcatcaacaagctcaaagtcgtcaaaaaacagacctgccctttgcagactggcgacgtgatttacctcgtatatagaaaaaatgagcccgagcacaacgtggcctatttgtacgagagcttgtccgagaagcagggaatgacccaggaatcgtttgatacttctggcgcaggcgctgggaggggagccgacccgagggtgccaccgtcttcccctgccacccaggtatgtttcgaggagcctcagccgtctacatctacctccgatctcttcccaaccgcttccgcatcttctaccgagccttctcctgcgggtcgggagcggtccagtagttgcggatctggtggtggaggcatctctcccaaaggctccggcccaagcgtcgcttccgacgaagtctcctcctttgctagcgcactgcctgaccgtaaaacggctagcttcagcagtttggagccacaggaccaggaagacttagagccggtgaaaaaaaagatgagaggagacggagatctcgatttgaatggacagctgttggtggcacagcctaggcgaaacgctcagaccgttcatgaggatgttagggccgctgctggaaagcctgataagatggaggaaacgctgacatgtataatttgccaagatctattgcacgactgtgtaagcctgcaaccatgtatgcatactttctgcgctgcatgctactcaggttggatggaacggagctcgttgtgtcctacatgtagatgtccagtcgagcgaatctgtaaaaaccacatcctgaacaacctggtcgaggcgtatctgatccagcatcctgataagtcccgctccgaagaggatgtacagtcgatggatgcgaggaataaaataacccaggatatgctccaaccaaaagtcaggcgtagcttcagtgacgaggaggggagcagtgaggacttgctggaattatcggatgtagactctgaaagctcagacattagccagccatatgtggtgtgtcgccaatgcccagaatatcgcaggcaggcggcacagccgcctcactgccccgcaccagagggcgagcctggggctccacaggccctcggagatgctcctagtacgagcgtgtcgcttaccacagccgtgcaggattatgtctgtcctttgcagggatcgcatgctctgtgtacctgttgctttcagccaatgcccgacaggcgggctgaaagggagcaagacccacgtgtcgctcctcagcagtgtgccgtgtgtctgcaacctttctgtcacctctattgggggtgcacacggaccggctgttatggatgtctggcacccttctgcgaactcaatctgggggataagtgtctggacggggtgctaaacaataattcatacgaatcagacatcctgaagaattacctggcaactagagggctcacttggaaaaatatgctgacagagagtcttgtggcacttcagcggggagtgtttttacttagcgattacagggtcactggggacactgttctgtgctattgttgtggactcagaagtttcagggagcttacctatcagtatcgccagaatatcccggcatctgagctgcctgttgccgtaacgtcacgtcccgactgctattggggcaggaactgccggacccaggtgaaggcccatcacgcaatgaaattcaaccacatttgcgagcagacacgcttcaagaattag

SEQ ID NO: 217976 - DNA, 672 bp, Artificial Sequence
  Description of Artificial Sequence: Synthetic coding sequence
atggaaaggcccgaggaaggaaagcagtcacctccacctcaaccatggggtaggctgcttaggcttggcgcagaggaaggcgaacctcatgtgctgctaaggaagcgggaatggactattgggcgacgccgaggctgtgatctctccttccccagcaacaaacttgtgagtggcgaccactgcagaatcgtggtggatgaaaaatccggtcaagtgactttggaggacaccagtactagcggcactgttatcaacaaactgaaggttgttaaaaagcaaacatgcccattgcagacaggcgacgtcatctatctcgtgtaccgtaaaaacgagccagagcacaatgttgcatacctctacgaatccttatccgagaaacagggcatgacacaggagtcatttgatacttccggtgccggagcaggcagaggcgctgaccccagagtgccaccgtcgtcacctgccactcaggtatgtttcgaggagccacagcccagtacaagtacatcagacctgttccctactgcatccgcatcatcgacagaaccgtcacccgctggcagggaacggtctagttcttgtggctcgggaggtgggggaatcagcccaaaagggagtgggccaagcgtcgcctcagatgaggtgagttccttcgccagtgccttgccctag

SEQ ID NO: 217977 - DNA, 1050 bp, Artificial Sequence
  Description of Artificial Sequence: Synthetic coding sequence
atgactcaagaatcatttggctctggtggtggaggcatatcacccaaaggttccggtccatctgtagctagcgatgaggttagctcatttgccagcgctctccccgacagaaagacagcatccttctcatcacttgagcctcaagatcaggaagacctggaaccagtcaagaaaaagatgaggggcgacggggacttagatttaaatgggcagttgctggtggcgcagcctcgccgaaatgcccagacagttcatgaggatgtccgagccgctgcgggaaagccagataaaatggaggaaaccctgacttgtatcatctgtcaggatcttctgcacgactgcgtctctttgcagccttgtatgcacacattttgtgcggcttgctacagtggctggatggaaaggagcagcttgtgcccgacttgtaggtgccccgtagaacgcatctgtaagaaccacatactgaacaatttggtggaggcctacctgatacagcacccggacaagtcgcgcagtgaagaagatgtacagtctatggacgctcgaaacaagatcacacaggatatgttgcagccaaaagtgcgccgatctttcagcgacgaagaaggcagtagcgaggacctcttggagctcagcgatgtggattccgagagctctgatatttcgcaaccatacgtggtctgtaggcaatgccctgaatatcgtaggcaagctgcgcaacccccacattgccccgctcctgagggtgaacccggtgccccacaggcgctcggggatgctcccagtacctccgtgagcctgacgaccgctgtgcaggactatgtgtgtcccttgcagggtagccacgctctgtgcacttgctgctttcagccaatgcctgaccggcgtgcagaacgtgagcaagatccgcgtgtagcccctcaacagtgtgccgtgtgccttcagccattttgtcacctttactggggatgtactagaaccggctgttacgggtgccttgctcctttctgtgtgagcgggagacaatgcttccctgccacaagtctctag

SEQ ID NO: 217978 - DNA, 1719 bp, Artificial Sequence
  Description of Artificial Sequence: Synthetic coding sequence
atggagaggcccgaggagggcaaacaatcacctccacctcagccctggggaagactgttacgactgggcgctgaggagggagagccgcatgtcctgctacggaaacgcgagtggactataggcaggcgacggggttgcgacctatccttccctagtaataaattggtgtcgggtgatcattgcagaatcgtcgttgatgaaaagtctggtcaagtcacactcgaggatacaagcacctccggcaccgtgattaataaactgaaagtggtgaagaaacagacgtgcccattgcaaactggagacgtgatatatctggtttatcgtaagaatgaaccagaacatagatctgggggtggtggcatttcaccgaagggctccgggccaagcgtggccagcgacgaggtgtcctcctttgcttcggcactccccgaccgaaagaccgcttcttttagttcattagagcctcaggaccaagaagacctcgaacctgtcaaaaagaagatgagaggcgacggagatctagatctcaacggccagctcctggtggcccagccacgcaggaatgcccaaaccgtccatgaggacgtccgtgccgctgctggcaagcccgacaaaatggaggaaaccctgacctgcatcatttgtcaggaccttttacacgactgtgtgagcctccagccatgtatgcacacgttttgcgccgcatgctactctggctggatggagcgctcttcattgtgtcctacatgcaggtgtcccgtggagaggatttgcaaaaatcatatattaaataatctcgtcgaagcataccttatccagcatcccgataaaagccgatcagaggaagatgtccaaagcatggatgctcggaataagataactcaggatatgctgcagcctaaagtgaggagaagcttcagtgatgaggaaggctcatccgaggacctgctggaacttagcgacgtggactcagaaagcagcgacatatcccagccatacgttgtctgtcgtcaatgccccgagtaccgcagacaggccgcacaaccaccccattgccctgctcctgaaggcgagccaggcgcacctcaggcgctcggtgacgctcctagtacttccgtttctcttacgactgccgtgcaagactatgtgtgcccgctgcagggcagtcatgcgctctgcacctgttgtttccagcccatgccagatcgccgtgccgagagggagcaggacccgagggtggctcctcagcagtgcgccgtatgcttgcagccgttttgtcacctgtactggggatgtacccgtacaggctgttatgggtgcctagcccctttctgcgaactgaatctcggcgacaagtgcctcgacggagttctgaataataatagttacgaaagcgacattctaaagaactacctagccactcggggattgacctggaaaaacatgttaactgaaagcctcgtcgccctgcagaggggcgtgtttctgcttagcgactaccgcgtcactggagatactgttttgtgttactgctgtggattgcgatccttccgggagctgacctaccagtatcggcagaatatcccagcttctgaactgcccgtggctgtcacaagtagaccggattgttactgggggcgaaactgcagaacccaggtgaaggctcatcatgcgatgaagtttaaccatatatgtgaacagacaaggtttaagaactag

SEQ ID NO: 217979 - DNA, 345 bp, Artificial Sequence
  Description of Artificial Sequence: Synthetic coding sequence
atgaggctgctgattctagctcttctgggtatctgtagtttgacagcctacatcgtggaaggagtgggctcagaagtttctgataagcgtacttgtgtttctctgaccacccagaggctgcccgtctcacggattaaaacatacaccatcacggaagggtcactgcgggctgtgattttcataactaagcgtgggctgaaggtgtgtgcagacccgcaggctacatgggtgcgagacgttgtgagaagcatggatcgcaaaagcaatacacgcaataacatgatacagacaaagcccactggaacccagcagagtaccaataccgcagttactttaactggctag

SEQ ID NO: 217980 - DNA, 345 bp, Artificial Sequence
  Description of Artificial Sequence: Synthetic coding sequence
atgcgcctcttaatcctggccctgcttggcatctgctcattgacagcctatattgtcgaaggggtgggctcagaggtgtctcacaggcgtacgtgcgtaagtcttacaactcagcggcttcctgtatccaggatcaaaacctacacaattacagagggaagtctgcgggctgtaatatttattacaaagcgcggtctgaaggtgtgcgccgaccctcaagcgacttgggttcgtgacgttgtccgatctatggatcgtaagtcgaacactcggaataatatgatccagactaagccaacaggtacgcagcaaagcactaatacagcagtaaccctgacaggatag

SEQ ID NO: 217981 - DNA, 1002 bp, Artificial Sequence
  Description of Artificial Sequence: Synthetic coding sequence
atggaatctagcgggaatccagaaagcactacctttttctactatgacttacagtcgcagccgtgcgaaaatcaggcctgggtgttcgctactctggccacgaccgtcttatactgcttagtctttctcctttccctagttgggaactcacttgtcctgtgggtattagtgaaatatgagagccttgagtcattgactaatatctttattctcaatctgtgcctgagtgacctggtcttcgcctgcctgcttcctgtgtggatttcgccttaccactggggatgggtgctgggagacttcctgtgcaaactgcttaatatgattttcagcattagtctctatagttccatattttttcttaccattatgaccatccaccgctaccttagcgtagtgtcccccttaagtaccttgagagttcctacactgcggtgccgtgttctggtgacgatggccgtttgggtcgcttcaatcctgtctagcatcttagataccattttccacaaagtcctgagctctggttgtgactactccgaattgacctggtacctcacaagcgtgtatcagcacaatctgttttttctgttgagtctggggataattctcttctgttatgtagaaatcctgaggacattgtttcggtcaaggtcaaaaagacgtcaccgcacagtgaaactcatcttcgcaatcgtggtcgcttatttcctttcctggggtccttataattttaccttgttcctacaaaccctgtttcgcacccaaatcatcaggtcatgtgaagctaagcagcagctggaatatgccttgctgatctgcaggaatctggctttctctcattgttgcttcaaccccgttctttatgtttttgtgggagtgaaatttagaacacatctaaaacacgtgctgcgacagttttggttttgccgtctccaagctccatcacccgcttcaatcccccactccccgggagctttcgcctacgagggcgcttctttttactag

SEQ ID NO: 217982 - DNA, 111 bp, Artificial Sequence
  Description of Artificial Sequence: Synthetic coding sequence
atggagagcagcggaaatcctgagtctacaacatttttttattatgatctgcagtcccagccatgcgagaaccaggcttgggtgtttgccacattggctacaaccgtgtag

SEQ ID NO: 217983 - DNA, 1002 bp, Artificial Sequence
  Description of Artificial Sequence: Synthetic coding sequence
atggagtcatctggaaacccagagtctacaacattcttctattacgatcttcaaagccagccctgtgagaatcaggcatgggtgtttgctactctggcaaccacagtgctgtactgtctggtgttcttgctgtccttggtggggaattccctggtcttgtgggtactggtcaaatatgagagcttagagagtctcactaacatcttcatacttaatctttgcctgagtgacctggtgttcgcatgcctcctgcctgtgtggatctcaccctaccattgggggtgggtcctcggcgactttctctgtaagctgctgaatatgattttcagtattagcctctactccagcatcttcttcctgactataatgaccatccaccgttacctgtctgtggtgtcaccgctgtctacattaagagtgcccacgctccggtgccgagttcttgtaacaatggccgtctgggtggcaagcatcctgtcaagcatcttagatactatcttccataaggtcttgagtagcggctgcgactacagcgagttgacctggtacttgacaagcgtgtaccaacacaacctcttctttcttctttctcttggcatcatattattctgctacgtcgagatcctccggaccctgtttcggtccagatctaagcgcaggcaccggacagtgaagctgatcttcgctatagtcgtggcttactttctgagttggggaccttataatttcaccctgtttctgcagactctgttccgtactcagatcatccggtcatgtgaggccaaacaacagctcgagtacgcactgctgatctgtcgtaacctggccttcagccattgctgtttcaaccccgtgctgtacgtgttcgtcggggtaaagttcaggactcatctgaagcacgtgttgaggcagttctggttctgtagactgcaggcgcctagtcccgcatcaattcctcacagccccggtgcctttgcctatgagggagcatctttctattag

SEQ ID NO: 217984 - DNA, 300 bp, Artificial Sequence
  Description of Artificial Sequence: Synthetic coding sequence
atgaaggtgagtgccgcacttttatgtctgttgctgatggctgccaccttcagtccacaagggctcgcgcagcccgactctgtatcgatcccaatcacttgttgtttcaatgtcattaatcgaaagatcccaattcagcggctagagtcatataccaggatcactaatatccaatgcccaaaggaagccgtcatatttaagaccaaacgaggaaaggaggtgtgcgccgaccctaaagagaggtgggttcgggacagtatgaagcacctggaccaaatttttcagaatttgaaaccctag

SEQ ID NO: 217985 - DNA, 291 bp, Artificial Sequence
  Description of Artificial Sequence: Synthetic coding sequence
atgcagatcatcaccactgctctcgtctgccttttgttggcaggaatgtggcctgaagacgttgatagtaaaagtatgcaggtaccattcagtcggtgctgttttagctttgccgagcaggagatccctctcagggcgattctctgctatagaaatacatcttctatctgctccaacgaggggctcatatttaagctcaagagagggaaagaagcttgcgcactcgacacagtgggatgggtacaacgccatcggaagatgctccgacattgcccaagcaagcgcaaatag

SEQ ID NO: 217986 - DNA, 282 bp, Artificial Sequence
  Description of Artificial Sequence: Synthetic coding sequence
atgaagataagtgtcgcagcaatccctttttttctgcttatcacaatcgccctaggaacaaaaacagaatccagttcgcgcggaccatatcatcctagcgagtgctgttttacctacacaacgtataagatcccgcgtcaacgcattatggactactacgagaccaattcccaatgctcaaaacccggtatcgttttcatcacaaaaaggggacacagtgtctgtaccaacccatcagataagtgggtgcaggactatattaaggacatgaaggaaaactag

SEQ ID NO: 217987 - DNA, 330 bp, Artificial Sequence
  Description of Artificial Sequence: Synthetic coding sequence
atgaagatcagcgtggcagccatccccttttttctgctgattaccattgcccttggtactaaaactgagagttccagccaaacaggcggaaagcctaaggtcgtgaaaatacaattaaagctcgtagggggtccctatcatcctagcgagtgttgtttcacgtacactacatacaagatccctaggcaacggattatggactattatgagactaactcccagtgtagtaaacccggaattgtatttatcacaaagaggggtcatagcgtctgcaccaacccttccgataagtgggtccaagactatatcaaggacatgaaagagaattag

SEQ ID NO: 217988 - DNA, 330 bp, Artificial Sequence
  Description of Artificial Sequence: Synthetic coding sequence
atgaagatatcagtcgccgctatccccttcttccttttgataacgatcgctctgggtaccaagacagaatctagcagtcagacaggtggaaagcctaaggtcgttaaaatccaattgaaactcgtcgggggaccctaccacccttcggaatgctgcttcacgtacaccacctacaaaatccctagacagagaattatggactactatgaaacaaattcacaatgctctaagccaggtatcgtgtttatcacgaagaggggtcactccgtgtgtaccaatccctccgataagtgggtgcaggactacatcaaggatatgaaggaaaattag

SEQ ID NO: 217989 - DNA, 342 bp, Artificial Sequence
  Description of Artificial Sequence: Synthetic coding sequence
atgaaggtgagcgtcgccgctctctcttgtttgatgctcgttgcagttttgggttcccaggcccaattcattaatgacgcggaaaccgagttaatgatgtcaaaattaccactggaaaacccagtcgtgctgaactcgttccattttgctgccgattgttgcacgagctacattagtcagtctatcccctgttctctgatgaaatcctacttcgaaactagctcagagtgcagcaagccaggagtgatcttcctgaccaaaaaaggaagacaggtctgcgcaaaaccttccgggcctggggtgcaggattgtatgaaaaagctgaagccatacagcatttag

SEQ ID NO: 217990 - DNA, 186 bp, Artificial Sequence
  Description of Artificial Sequence: Synthetic coding sequence
taatgtacctcatatatatctcaaagcattccatgttctctgatgaaatcttactttgagacttcttctgagtgtagcaagcccggagtcatcttcctgaccaaaaagggacgtcaagtctgcgcgaagccaagcggtccgggagttcaggattgcatgaaaaagctgaaaccctactctatatag

SEQ ID NO: 217991 - DNA, 342 bp, Artificial Sequence
  Description of Artificial Sequence: Synthetic coding sequence
atgaaagtttctgtagcagccctttcatgcctaatgctagtagccgtcctgggcagtcaggcacagttcattaatgacgccgagaccgagctcatgatgagcaagctgccccttgaaaaccctgtcgtgctgaacagcttccactttgccgctgactgttgcacgagctacatctcacagagtattccatgctccctgatgaagagctacttcgagaccagctctgagtgctccaagcccggagtgatatttctaacaaagaaaggcagacaagtgtgtgcaaagccctccggacctggagtccaggattgcatgaagaaactcaagccatattcaatttag

SEQ ID NO: 217992 - DNA, 342 bp, Artificial Sequence
  Description of Artificial Sequence: Synthetic coding sequence
atgaaagtctcagtggccgcactttcttgcctgatgctcgtcgcagtgctcggatcgcaagctcagttcatcaatgacgcggagactgagcttatgatgtcaaagcttccgctggagaacccagtggtgctgaatagttttcacttcgccgctgattgctgtacgagctatatcagtcagtctattccctgctctcttatgaaatcatatttcgaaacctcctccgaatgctctaaaccaggggtaattttcttaaccaagaaaggtagacaagtgtgcgctaaaccttccggaccaggagtgcaggattgcatgaaaaaacttaagccttattctatctag

SEQ ID NO: 217993 - DNA, 363 bp, Artificial Sequence
  Description of Artificial Sequence: Synthetic coding sequence
atgaaggtctcggaagcagcgttatctttgcttgtcttaattctgataatcacctcggctagtcggtcccagcccaaagtgcctgagtgggtgaacactccaagcacatgttgtctgaagtactacgaaaaagtcctcccacgcagactcgtggtgggttacagaaaagccctcaattgtcacctgcccgctattatctttgttacaaaacgaaatcgggaagtgtgcacaaatcctaacgacgattgggtgcaagagtacatcaaagatcctaacctcccactgttgccgactaggaatctgtcaaccgtgaagatcatcacagctaaaaatggacagccacagctgctgaacagccagtag

SEQ ID NO: 217994 - DNA, 1188 bp, Artificial Sequence
  Description of Artificial Sequence: Synthetic coding sequence
atggcctggcgccatctgaagaaaagagcccaggatgccgttattattcttggaggcggaggcctccttttcgcttcttatctgatggcgaccggtgatgaaagattttatgctgagcaccttatgccgacattgcaggggctgcttgatcccgaatctgctcacagactggccgttcgcttcacctcgctaggcctgctgccccgtgcacggttccaggacagtgatatgctggaggtgcgagtgctcggccacaaatttcgcaacccggtggggattgctgctggcttcgacaaacacggcgaagcagtggacggcctttacaagatggggttcggctttgtggagatcgggagcgtcacccccaagccacaggagggaaatcccagaccccgtgtgtttcggttaccagaagaccaggctgtcatcaataggtatggctttaacagccacggactgtccgtggttgaacaccgcctgagagctcggcagcaaaagcaggccaaactcactgaagacgggttgcctttaggcgtaaatctcggaaaaaataagacaagtgtagacgccgcagaggattacgccgagggagtcagagttctggggccactcgccgattacctggttgtaaacgtgtcatcaccaaacacggcaggcctacggtccctgcagggtaaagcagagctgcggagactgctgaccaaggttcttcaggagcgcgacggactgcgccgagtgcacagacccgctgtgctggtcaagattgcacctgacctgacctcgcaggacaaagaagacatcgcgagcgtcgttaaggagcttggcatagatggactgattgttacgaatactacagtttctcggccagcagggctccaaggggcactacgtagcgaaaccggcggtttgagtgggaagcccctgcgcgatttaagcacccagacgattcgcgaaatgtatgcactgacgcaagggcgtgtgcccatcatcggtgtaggcggtgtcagcagtgggcaagacgctttggagaagatccgggctggcgcaagcctcgttcagctgtatactgccctgacgttttggggtccccctgtcgtaggcaaggtgaaaagggagttagaagcactcctgaaggagcagggcttcggcggagtgacggacgcaatcggcgcagaccatcggaggtag

SEQ ID NO: 217995 - DNA, 270 bp, Artificial Sequence
  Description of Artificial Sequence: Synthetic coding sequence
atgaaaggattagccgcagcccttctcgtgctcgtctgcaccatggccctttgctcctgcgcccaagttgggactaacaaagagctctgttgtttggtgtatacgtcttggcaaataccccagaagtttattgtcgactattctgagacatcacctcaatgccctaagcctggagtgatattactcactaaacgtggcaggcagatctgcgcagatcccaataaaaagtgggtccagaaatacatctctgatttaaaactcaacgcctag

SEQ ID NO: 217996 - DNA, 297 bp, Artificial Sequence
  Description of Artificial Sequence: Synthetic coding sequence
atggcactgcttttagccctgagtctgctggtgctttggacatcccccgcacccacactgagcgggacaaatgacgctgaggactgttgcctctccgttacccagaagcctataccgggatacattgttaggaactttcattacctgttgatcaaggatggctgccgggtgccagccgtcgtcttcactaccctgcggggaagacagctgtgcgcccctccagaccagccatgggtggagagaatcatacagcggcttcaacgtacgtcagctaagatgaaaaggcggtctagctag

SEQ ID NO: 217997 - DNA, 315 bp, Artificial Sequence
  Description of Artificial Sequence: Synthetic coding sequence
atggctctactcctggccctgtctctcctggtgctgtggacctcccccgcacctaccttgtcaggaaccaatgatgcggaggattgctgcctgagcgtcactcagaagccgattcctggctatattgtccgcaactttcattatctgttaattaaggatgggtgtagggtgccggcagtggtgttcacgaccttgaggggccgacagctgtgcgcaccaccagaccagccctgggttgagcgaatcattcagcgactccaacgtacctccgccaaggcttctctcgctctgccaggccctgtcagcagcctgtag

SEQ ID NO: 217998 - DNA, 291 bp, Artificial Sequence
  Description of Artificial Sequence: Synthetic coding sequence
atgtgttgtaccaagagtctgcttctggcagcgctgatgtccgttctcttactgcacctctgtggcgaaagcgaagcggcaagtaactttgattgctgtttggggtacactgacaggatcctccatcctaaatttatcgtcggttttactcgccaactggctaacgagggctgtgacattaacgctattattttccataccaaaaagaaactctctgtatgtgccaaccccaagcagacatgggtcaagtatatagtgcgcttattgagcaagaaagtcaaaaatatgtag

SEQ ID NO: 217999 - DNA, 288 bp, Artificial Sequence
  Description of Artificial Sequence: Synthetic coding sequence
atgtgctgcacaaagagtttactactagcagcgctgatgagcgtactgctcctgcatctttgtggcgaaagtgaggccagtaacttcgactgttgcctggggtacaccgaccgcatcctgcatcctaagttcatcgtcggcttcacaagacagttggcaaatgaggggtgcgacattaacgccattatctttcacaccaagaagaaactgtctgtttgcgccaaccctaagcagacgtgggtaaagtatattgttcgcctgttatctaagaaggtgaaaaatatgtag

SEQ ID NO: 218000 - DNA, 405 bp, Artificial Sequence
  Description of Artificial Sequence: Synthetic coding sequence
atggctcagtcgctcgcactgagcctcctcatactggtgctggccttcgggattccacggacacaagggtctgacgggggagcccaagactgctgtttgaagtattcccagcgcaagatccctgcaaaggtggtgcgctcctatcgaaagcaggaacccagcctgggctgcagtatccccgcaatcctgttcctcccacgtaaacggagtcaggcagaattgtgtgccgatcctaaggaactttgggtacagcagctgatgcagcatctggacaagacgccatcacctcagaaacccgctcagggctgcagaaaggaccggggagcttcaaaaaccgggaaaaaaggcaagggctcaaaaggctgcaagcggaccgagcgttctcagacacctaaaggtccatag

SEQ ID NO: 218001 - DNA, 375 bp, Artificial Sequence
  Description of Artificial Sequence: Synthetic coding sequence
atggcacagtcgcttgctctgagcctgctaatattagtgttggcttttgggattccacggacacagggatccgacggcggtgcccaggactgctgccttaaatattcccagcggaaaattcccgctaaggtggtgcggtcgtaccggaaacaagaaccaagccttgggtgcagtatccctgcgattcttttcctgccaagaaagaggtcccaggcagagctgtgtgccgaccccaaagagctgtgggttcagcaacttatgcagcatctcgacaaaacaccttcccctcaaaagcctgcccagggctgtcggaaagaccgaggggctagtaaaaccggtaaaaaagggaagggatcaaaaggatgcaagaggtag

SEQ ID NO: 218002 - DNA, 549 bp, Artificial Sequence
  Description of Artificial Sequence: Synthetic coding sequence
atggctgagttcccttctaaagtgtcaacccgtacgtcaagcccagcacagggggcagaggcctccgttagcgccctaagacctgaccttggttttgttagatcacggttaggcgcactaatgctgctccagctggtgcttggacttctggtctgggcccttatagcggataccccgtatcacctgtacccagcttatggatgggtgatgtttgttgcggtatttctgtggctggtgacaatcgtgttattcaatttatacctctttcagctgcatatgaagctgtacatggtcccatggcccctggttctgatgatctttaatatctcggctacagtgctctatatcaccgcattcatcgcttgcagcgctgccgtggacttgacaagcctgaggggaacgcgcccttacaaccagcgggctgcagcatccttttttgcatgtctggtgatgatagcctatggcgtaagtgcttttttcagctaccaggcctggagaggcgttggtagcaatgccgctacgtcccagatggctggtgggtatgcttag

SEQ ID NO: 218003 - DNA, 414 bp, Artificial Sequence
  Description of Artificial Sequence: Synthetic coding sequence
atgaaagtgagtgtggccgcactctcttgtcttatgctggttaccgctttgggatcgcaggctcgcgtaactaaggacgccgagactgagtttatgatgtcaaagcttccactcgaaaaccctgttctcctagacatgttgtggcggaggaaaataggcccacagatgaccctgagtcatgcggcaggctttcacgccacttctgcggattgctgcatcagctatacacctcgatcaattccatgcagccttctcgagtcatactttgagacaaatagcgaatgctctaaaccaggcgtgatctttttaacgaagaaggggcgtcggttttgtgcaaatccttctgataaacaggtacaggtatgtgttcgaatgctgaaactcgatacaagaattaaaaccagaaaaaactag

SEQ ID NO: 218004 - DNA, 363 bp, Artificial Sequence
  Description of Artificial Sequence: Synthetic coding sequence
atgaaagtcagtgtagccgctctgagctgcctcatgctggtaacagccttaggatctcaggctagggtcactaaggacgccgaaaccgaattcatgatgtccaagctgcccttggagaaccctgtcctcctcgataggtttcatgccacaagtgccgattgctgcatatcttacacgccacgatctatcccctgctccctgcttgagtcctacttcgagacgaactcagaatgctcaaaacctggggttattttcctgacgaagaagggccgacgcttctgcgcaaaccctagtgataagcaggtgcaggtctgtgtcaggatgctgaagctggacacgaggatcaagacccggaagaactag

SEQ ID NO: 218005 - DNA, 2862 bp, Artificial Sequence
  Description of Artificial Sequence: Synthetic coding sequence
atggaagaacaggggcactccgaaatggaaatcattccttccgagtctcatccccacatccaactgctgaaatccaacagggagctgctggtgacccacatcagaaacacacaatgtctcgttgataacctcctcaaaaatgactatttttctgccgaagacgctgagatagtgtgtgcgtgtcccacacagccagacaaggttcgcaagattcttgacctcgtgcaaagtaaaggagaggaagtctctgagttttttttatacctacttcagcagctcgccgacgcatacgttgacttacggccatggctcctggaaattggatttagtcctagtctgctgactcagtctaaggtggtggtaaataccgatccggtgtccagatatactcagcaactccggcatcacctggggagggatagtaaattcgtcctatgctatgcccagaaggaggaacttctcctcgaggagatctacatggatactatcatggagctggtaggcttttccaatgaatctctgggctccctgaacagcctagcatgtctgctggaccatacaactggcatccttaatgagcagggtgagactattttcatcctgggggacgctggagttgggaagagtatgctgctgcagaggcttcagtctctgtgggccaccggcagacttgatgccggagttaagtttttttttcactttaggtgtcgcatgttcagttgctttaaggagagtgaccgattgtgtttacaagatctgctatttaagcattactgctaccctgagcgagatccggaagaggtgttcgcttttttgttgcgcttcccccacgttgctctgttcacatttgacggacttgacgaactgcattccgatctggatctcagcagggtgccggattcgagttgcccctgggagcccgctcaccctctagtgctgctggctaatctgctttccgggaagctgcttaaaggagctagcaagctcctgactgctagaacaggcatagaggtgccaagacagttcctgaggaagaaggtcctgctgcgtgggttctcaccttcacacctacgcgcttatgccagacggatgtttccagagagagctctgcaggaccgtctgctctcacaactcgaggctaaccctaatttgtgttccctctgtagcgttcccctcttctgctggattatttttagatgctttcagcacttccgtgccgcttttgaagggtcgccccagctacccgattgcacgatgaccctgaccgacgtgtttctgcttgtcactgaagtgcacctcaacaggatgcagccgtccagcctggtgcagcgcaacacacgcagcccagtggagaccctgcacgccggtagggataccctttgttccctggggcaagttgcgcacagaggcatggagaaatcacttttcgtgttcacacaagaagaggtgcaggcctcaggactccaggaaagggacatgcagctgggattcctgagggcactacccgagttggggccaggcggagaccagcaaagctacgagtttttccatctgactctccaggcatttttcaccgcgtttttccttgtgctagatgacagagtgggtactcaggagctgcttcgctttttccaggagtggatgccccctgcaggagctgccactacatcctgctatcctcctttcctgccttttcagtgtctccaggggtcgggacctgctcgcgaggacctctttaagaataaagaccacttccagtttaccaatttattcctctgcggactgctgtctaaggccaaacagaaattactaagacacctggtgccagccgcagccctgaggagaaagcgcaaggcgttgtgggcgcacctgttcagctcactgcgcggataccttaaatccctgcctcgggttcaggtcgagtcgttcaaccaggtgcaggctatgcctacatttatatggatgttgagatgtatctacgaaacacagtctcaaaaggtgggacagcttgctgccagggggatttgtgccaactatctcaagttgacatactgtaatgcctgtagcgccgactgctctgccctgagttttgttctgcaccactttcccaaacgactggctctagaccttgataacaacaatttaaatgactacggcgtccgggagctacagccatgctttagcaggctcactgttctgcgcctgtccgtgaaccaaatcaccgacggcggagtcaaagtgctgtcggaagagcttaccaaatacaagatagtaacctacctcggattgtataacaatcaaatcacagatgtgggagcgagatacgtgaccaagatcctggacgaatgcaagggtctgacacaccttaagcttgggaagaataagattacatctgaaggaggcaaatatcttgctctcgctgttaaaaactcaaaatccatctccgaggtggggatgtggggcaaccaggtgggtgacgaaggggcaaaagccttcgccgaagctctgcgcaaccatcccagtctgactaccctcagcctggcttccaacggcatctcgaccgaagggggaaaaagcctggccagggcactacaacagaacacatccctcgagattctctggctgactcagaatgaactgaacgatgaagtcgctgagagtttggctgagatgctgaaggtgaatcagacactgaaacacctgtggttaatccagaaccagattaccgcgaagggcaccgctcagttggccgacgcgcttcagtctaatactgggattacagaaatttgtcttaatgggaatttaatcaaaccagaggaagcgaaggtatatgaagacgaaaagcggataatttgtttctag

SEQ ID NO: 218006 - DNA, 360 bp, Artificial Sequence
  Description of Artificial Sequence: Synthetic coding sequence
atggctggcctcatgactattgtgaccagcctgctgtttctaggagtgtgcgcacaccacataatacccactggaagtgtggtcataccgtcaccctgttgcatgttcttcgtctccaagcgcatccccgaaaacagggtcgtgtcgtaccagctgtcaagtaggtccacatgccttaaggcaggtgtgatttttaccacgaaaaagggacaacagttttgcggggaccccaagcaggaatgggtccagaggtacatgaaaaacctggatgctaagcaaaagaaggcttctccaagagctcgggctgtggccgtgaagggaccggttcagagatatcctggtaatcaaacgacctgttag

SEQ ID NO: 218007 - DNA, 450 bp, Artificial Sequence
  Description of Artificial Sequence: Synthetic coding sequence
atgaatctatggctcctggcatgcctggtggccggattcctgggagcctgggcgcctgctgttcacactcagggcgtgtttgaagattgctgcctcgcctaccactatcccatcggttgggccgtcttgcgcagggcctggacttatcgtattcaggaggtgagcgggtcctgcaatctgccagccgctatcttctacttgcccaagaggcaccgaaaagtctgcggaaaccccaagtcccgcgaggttcagcgcgctatgaagctcctggacgccaggaacaaggttttcgccaagttgcatcacaatactcaaacatttcagggtcctcatgcagtcaagaaattgtcgtccggcaactccaagctttcgtccagcaaattttccaaccccatcagcagcagcaagcgtaacgtgtctctgctcatatctgcaaacagcggcctttag

SEQ ID NO: 218008 - DNA, 255 bp, Artificial Sequence
  Description of Artificial Sequence: Synthetic coding sequence
atgaatctgtggctcctcgcgtgtttggtagccggttttctgggggcatgggccccagcagtccatacccagggtgttttcgaggattgctgtcttgcttatcactatcctatcggttgggctgttctgcgcagggcctggacatataggatccaggaggtatccggaagctgcaatctccctgcagccataagacctagttgttgtaaggaagtggaattctggaaactacaggtcatcattgttcaggtatag

SEQ ID NO: 218009 - DNA, 453 bp, Artificial Sequence
  Description of Artificial Sequence: Synthetic coding sequence
atgaacctttggctcttggcttgtctggtggcagggttcctgggtgcatgggcaccagctgtgcatacacaaggagtgtttgaggactgctgccttgcctatcactacccaattgggtgggccgtgctcagaagagcttggacctaccggattcaggaagtgtccggctcttgcaatctacctgccgctatattttacctgcctaagcgccacagaaaagtatgcggcaacccaaaatctagggaagtccaacgcgctatgaagctcctggatgcaagaaacaaggttttcgcaaagttgcaccacaatactcagacttttcaagccggacctcacgctgtgaaaaagttgtcatctggtaatagcaaattgtctagctccaagttttcaaatcccattagcagcagcaagaggaatgtatcattgcttatttccgccaatagtggcctgtag

SEQ ID NO: 218010 - DNA, 285 bp, Artificial Sequence
  Description of Artificial Sequence: Synthetic coding sequence
atgatgggtctgagtctggcaagcgctgtgctattggcatcattactgagtttgcatctcgggacagctacgagggggtctgatatttctaagacttgttgcttccagtattcacacaagcctctcccctggacatgggtccgtagttacgagttcactagtaactcgtgttctcagagagcggtgattttcaccacgaagcggggaaagaaagtgtgtacccacccacgcaaaaaatgggtccagaagtatatctctctcctcaagacgcccaaacagctctag

SEQ ID NO: 218011 - DNA, 285 bp, Artificial Sequence
  Description of Artificial Sequence: Synthetic coding sequence
atgatgggtctgtccctggcgtccgcagtactcctggcgagtttactgagtttgcaccttggcactgctaccagaggatcggatatctcaaaaacttgttgctttcagtatagccacaaaccgctgccatggacatgggttcggagctatgagtttacctctaattcgtgtagccagagagcagtcatttttacaacaaagagggggaagaaagtatgcacacatcccaggaaaaagtgggttcaaaagtacatctccctgctgaaaacccccaaacagctatag

SEQ ID NO: 218012 - DNA, 339 bp, Artificial Sequence
  Description of Artificial Sequence: Synthetic coding sequence
atgaaagggcctccaaccttctgctccttgctgctgctctccctgctgctgagtcctgatccaaccgccgctttcctgctgccaccatcaactgcctgttgcacacagctgtatcgaaaacctcttagcgataaactactgcgtaaagtgatccaggtcgagctgcaggaggccgacggagattgccacctgcaagctttcgttttgcatttggcccagagatccatctgcatccatccccagaaccccagtctctctcagtggttcgagcatcaggaaagaaaactgcacggcactcttcccaagctgaacttcgggatgcttaggaagatgggatag

SEQ ID NO: 218013 - DNA, 384 bp, Artificial Sequence
  Description of Artificial Sequence: Synthetic coding sequence
atgcagcagaggggtctggccatagttgctctggcagtgtgtgctgcactccatgcctcagaggctattctgcctattgcctcgagctgctgtaccgaggtgtctcaccatatttcacggagactcctggaaagagtcaatatgtgtagaattcaaagggccgacggtgactgtgatctggctgctgttattctgcatgtaaaacgacgaaggatatgcgttagcccccacaatcacaccgtgaaacagtggatgaaggtgcaggcagctaaaaaaaatggtaaaggaaacgtgtgtcacagaaaaaaacaccatgggaagaggaatagcaacagggcccatcagggaaagcacgagacctatgggcataagaccccctactag

SEQ ID NO: 218014 - DNA, 384 bp, Artificial Sequence
  Description of Artificial Sequence: Synthetic coding sequence
atgcaacagcgtggtctcgccatcgttgcccttgccgtgtgcgcggcactgcatgcatcggaggcgattctgcctatagcttcaagttgttgtacagaagtgtcacatcatattagccggaggttgctggagagggtgaacatgtgccgtatccagcgcgctgacggagattgcgatctagccgcagtcattctgcacgtgaaacggagaagaatatgtgtgtcaccccacaaccacactgtcaagcagtggatgaaagtgcaggcagccaagaagaatgggaaaggcaatgtgtgccaccggaagaaacaccacggtaaaaggaactcaaaccgcgcacatcagggaaaacacgaaacttatggccacaagacaccttactag

SEQ ID NO: 218015 - DNA, 243 bp, Artificial Sequence
  Description of Artificial Sequence: Synthetic coding sequence
atgtgccggatccagcgcgctgatggcgactgcgatctggcagctgtgattctgcacgttaaaaggcggcgaatttgtgtcagcccccacaatcacactgtaaaacagtggatgaaggtgcaggccgcaaagaaaaacggaaaagggaacgtgtgtcacaggaagaagcaccatgggaagcggaactccaatagagctcaccagggaaagcacgagacctacggacacaagaccccctactag

SEQ ID NO: 218016 - DNA, 354 bp, Artificial Sequence
  Description of Artificial Sequence: Synthetic coding sequence
atgcaacaaagggggctggccattgtcgctctggcagtatgcgctgccttgcacgcatccgaggccattctccctatcgcatcttcctgttgcactgaggtgtcacaccatatcagccgacggctgctggaaagagtaaatatgtgccgaattcagcgtgccgatggcgactgcgacctggcagcagtgatgctggaatgttccgatatgatttcagctcattacaacctgcacttgcccggaagtaatgacagtccaaccagcgccttccaggtcgccggaattaccgccttcatgtccagcgccgaggaatccgtatcagcgagaacaacgatactccttagctctggctag

SEQ ID NO: 218017 - DNA, 282 bp, Artificial Sequence
  Description of Artificial Sequence: Synthetic coding sequence
atgcaggtttctactgcagcgttggccgtcctgctgtgcaccatggccctgtgcaaccaggttttgtccgcccctctggcggcagacacaccgacagcttgttgctttagttacacctctagacagataccccagaattttatcgccgactactttgagacatccagccagtgttcaaaacctagcgtaatctttctgaccaaaagagggcgacaagtgtgcgccgatcccagcgaagagtgggtccagaagtatgtgagcgaccttgaactgagcgcctag

SEQ ID NO: 218018 - DNA, 159 bp, Artificial Sequence
  Description of Artificial Sequence: Synthetic coding sequence
atgcaggtgagtaccgctgccctcgctgtccttctatgtactatggctttgtgtaatcaagtgttgagtgccccactctccaggccccgtgaggccggtcggagcgtacttacgcctgtccgatccgggtcaaggaatacctccgtgacatggagctag

SEQ ID NO: 218019 - DNA, 144 bp, Artificial Sequence
  Description of Artificial Sequence: Synthetic coding sequence
atgcaggtttctactgccgctctcgccgtgctcctctgcacgatggcgctctgtaatcaggttttatctgctcctcaggcagggagatcagtattaactcctgttcggagtgggtcccgaaacacctccgttacatggagctag

SEQ ID NO: 218020 - DNA, 279 bp, Artificial Sequence
  Description of Artificial Sequence: Synthetic coding sequence
atgaagctgtgcgtgactgtgttgtcacttctcatgctggtcgctgcattctgcagtccagccctctccgcccctatgggtagtgacccacctaccgcttgttgctttagttacaccgcacgtaagctgccacgcaattttgtggtggactactatgagacgagcagcctctgtagccagcctgcagtggtgttccagacaaaacgatccaaacaggtgtgtgctgacccaagcgagtcctgggtccaggaatatgtgtatgaccttgagttgaactag

SEQ ID NO: 218021 - DNA, 159 bp, Artificial Sequence
  Description of Artificial Sequence: Synthetic coding sequence
atgaaactgtgtgtgacggtactgtccctgcttatgctggtcgccgcattttgttctccggctctcagcgctcccaacagcaaaccaaaggaagcttccaagtcagtgcttatacctgtgaacccgggtagtcgttcaacgtgtatgacttggaactag

SEQ ID NO: 218022 - DNA, 159 bp, Artificial Sequence
  Description of Artificial Sequence: Synthetic coding sequence
atgaagctgtgcgtgacggtcctgagccttttagtcctcgtggccgcattctgcagtttggccctcagcgctcctaattctaaacctaaggaggcctcaaaatctgcccttaccccggtgtctccgggttcacgctccacctgcatgacttggaattag

SEQ ID NO: 218023 - DNA, 207 bp, Artificial Sequence
  Description of Artificial Sequence: Synthetic coding sequence
atgaaattgtgtgttacagtgctgagcctccttgtgttggttgccgctttctgctctctagccctctcagcccctacaaagagctctgaatggaaactgcagggggtttgtttccagtgttgcagcagaaaggacccaatccaccagtcatgtcccacctggaccatggttcggcagaggaagatgcctacgaccgggaagggatag

SEQ ID NO: 218024 - DNA, 261 bp, Artificial Sequence
  Description of Artificial Sequence: Synthetic coding sequence
atgaaattgtgtgtgaccgtgctctcgctccttgtgctggtagctgccttttgcagtctggcccttagcgctccaatggggagcgatccgccaactgcatgctgcttctcctacacagcgagaaagctgcccagaaacttcgtggtagactattacgagacctcctctctgtgtagtcagcccgctgtggtagccgctccacacggcccatggtctggaagggggaggtgccttccgcaggccagagataaagctagatag

SEQ ID NO: 218025 - DNA, 279 bp, Artificial Sequence
  Description of Artificial Sequence: Synthetic coding sequence
atgaagctttgcgttaccgtgctctcgctgttagtcctggttgccgctttctgcagtctggctctctccgctcctatggggtccgacccccctaccgcatgctgtttcagttacactgccaggaagctgccacgtaacttcgttgttgactactacgagacctcctccctttgttcacaacccgcagtcgtctttcaaaccaaaagaggtaaacaggtctgtgcagaccctagtgagagttgggttcaggaatacgtatacgatcttgaactcaactag

SEQ ID NO: 218026 - DNA, 300 bp, Artificial Sequence
  Description of Artificial Sequence: Synthetic coding sequence
atgaaagtgagtgcggcactgctgtgcctgctcctgatcgctgctacatttattccccagggtctcgcacaacccgacgccattaacgctcccgtgacatgctgttataattttaccaatcgcaagatcagcgtccagagactcgcaagttataggaggattacaagttctaaatgccctaaggaggccgtgatttttaagaccatcgtggccaaggaaatctgtgccgacccaaaacaaaaatgggtgcaagacagcatggaccacctggacaaacagacacagacacccaagacatag

SEQ ID NO: 218027 - DNA, 330 bp, Artificial Sequence
  Description of Artificial Sequence: Synthetic coding sequence
atgctgaaactcacccctttgccaagtaaaatgaaagtgagcgctgccctgctttgtctcctgcttatggccgctactttctcgccacaaggactcgcccaaccagatagcgtttccatacctattacatgttgctttaacgtgatcaatcgcaagattccgatacagagactggaatcctacacacggattactaacatacagtgcccgaaagaggctgtgatattcaagaccaagcggggaaaggaggtatgcgccgaccccaaagagcgatgggtcagggacagtatgaagcacctggaccaaatcttccagaatctgaagccctag

SEQ ID NO: 218028 - DNA, 1068 bp, Artificial Sequence
  Description of Artificial Sequence: Synthetic coding sequence
atggaaactccaaatacaaccgaagactacgatacgaccaccgagtttgattatggagatgccacaccttgtcagaaagtcaatgagcgtgccttcggcgcacagctcctaccacctttatattctctggtatttgttatcggtttggttgggaatatcctcgtagtgttagtgctcgtgcagtataaaaggctgaaaaatatgacctcaatctatctcttgaatcttgccatttctgatttacttttcctgttcacacttccgttctggattgactataagctcaaggacgactgggtatttggtgatgcgatgtgtaagattttatcgggattttactatactggactgtactcggaaatctttttcattattctccttacaatcgatcggtacctggccattgtccacgcagtgtttgcactccgggctaggaccgtgacatttggcgtgatcacatccataattatatgggctctagccattctggcctccatgcctgggttatattttagcaagacccaatgggaattcactcaccacacctgcagtcttcacttcccacacgaatcgctgagagaatggaaactattccaggcgctgaaactcaatctgttcggattggtattgcctctcctggtcatgatcatttgttacaccggaataataaaaatccttctgaggcgcccaaacgagaagaagagtaaggcagtccgactgatctttgttatcatgataatattctttttgttctggaccccctacaatctcactattctcattagcgtctttcaggactttctgtttacgcacgaatgcgaacagtcgaggcacctggacctcgccgtccaggtaaccgaggtcatcgcgtatacccattgctgcgtcaatcccgttatttacgcgttcgtcggtgagcggttccgcaagtaccttagacagctgttccatcgcagagtggccgtccacttggtcaagtggctgccattcttgtcagttgacaggctggagcgcgtttcctcaacatcaccttccacaggtgaacacgaactgagcgcaggtttctag

SEQ ID NO: 218029 - DNA, 1089 bp, Artificial Sequence
  Description of Artificial Sequence: Synthetic coding sequence
atgggcactgaggccaccgagcaagtgtcctggggacactactctggggacgaggaagatgcctatagcgccgaacccctgcccgagctgtgctacaaggcagacgtgcaggctttctcacgggcatttcagccctctgtcagcctgacagttgctgctctgggactggccggaaatggtctcgttctggccacccaccttgccgctaggagggcagccaggtcgccaactagcgcgcacctccttcagttagctttggccgatcttttgctcgcgcttactctgcctttcgccgcagcaggcgctctgcagggttggtcactggggtcagctacatgccggaccatctcggggctgtattcggcgagtttccacgctgggttcctttttctagcgtgcatttctgcagatcgatacgtcgcgattgcccgtgctctcccggcaggtccgaggccttccacgcctggtcgtgctcatctagtgtccgtcattgtatggctgctaagtcttctcctggcactgcccgctctcctgttcagtcaagatggccagagggagggacagcgtcggtgtagactgatctttccggagggtctgacccagactgttaagggagcctcagctgtcgcccaggtggccctcggcttcgcactcccactcggggtgatggtggcgtgctacgctttacttggtcgcacactgttagcagcacggggacccgaacggcgtcgtgccctcagagtcgtggttgcgctggtggcggcattcgtcgtacttcagctcccgtattcgctggccctgctcctcgacacagctgacctgcttgcagctcgtgagcgaagctgtccggcttctaaaagaaaagatgtcgctttgttagtcacatcgggactcgctctggcccgatgcggcttgaaccccgtgctctacgcttttcttgggctgagatttaggcaagacctgaggcgactgctccggggagggtcttgccctagcggcccacagcccagacggggatgcccgcgtagacccagattatctagctgttccgcacctaccgagactcacagtctctcctgggacaactag

SEQ ID NO: 218030 - DNA, 1125 bp, Artificial Sequence
  Description of Artificial Sequence: Synthetic coding sequence
atgctgtcaacaagccggtccaggtttattcgcaacaccaacgagtcaggagaagaggtaaccacgttctttgactatgattacggagccccttgccataagttcgacgttaagcaaattggcgcacaactgctgccaccattgtatagcttggtgtttatctttgggttcgtaggaaatatgctcgttgtgctgatcctgatcaattgcaagaaactgaagtgtctgaccgacatctaccttctcaacctagcaattagcgaccttcttttcctgattacactacctttgtgggcacactccgccgctaatgaatgggtgtttgggaatgccatgtgcaaactgttcactggtctgtatcacatcgggtacttcggcggtatcttctttattatcctgctgactatcgataggtacctggccatagtccatgcagtctttgctttaaaagccagaacagtaacattcggtgtggtcacctccgtgataacgtggctagtggccgttttcgcctctgttcccggtattatcttcacaaagtgtcagaaagaggattctgtgtacgtgtgcggtccatacttcccaagaggatggaacaatttccacactatcatgagaaacatcctgggcttggtccttccactgctcataatggtcatctgttattccggtatcctaaagacactactgcgctgcaggaatgagaagaaacggcaccgagcagtcagggtgattttcacaattatgatagtttatttcctgttttggaccccctataacattgttatcttgctgaacacattccaggagttcttcggcctcagcaattgcgagagcactagccagctagatcaggccacacaggtcacagaaactctgggaatgactcactgttgcatcaatcccatcatatacgcttttgttggagagaagttcaggtccctgtttcatattgctctcgggtgccgaatcgcgcctcttcagaaacctgtgtgtggcggacccggtgttcgcccaggcaagaacgtcaaagttacaacgcaaggcctactcgacggcagggggaagggcaaatctattggaagagccccagaagctagcctacaagataaggagggcgcttag

SEQ ID NO: 218031 - DNA, 1125 bp, Artificial Sequence
  Description of Artificial Sequence: Synthetic coding sequence
atgctcagtacttcaagatccaggttcattcgaaatactaatgagtcaggggaggaggttacaactttcttcgattacgactatggcgcaccatgccataagttcgatgtcaagcagattggggctcagcttctgcctccgctgtacagtctagtgtttattttcggatttgtaggtaatatgttggtggtgctgatcctaattaactgcaagaagcttaagtgcctcactgacatctatctcttaaacctggccatctcggatcttctgtttctgataacacttccactctgggctcactctgctgcaaacgagtgggtgtttggcaacgcgatgtgtaaactgttcactggtctgtatcatatcggctacttcgggggaatctttttcatcatcctgctgacaattgaccgctatctggcaatagttcatgctgtattcgcgctcaaggctagaacggtgacttttggggtcgtcactagcgttatcacttggctggttgctgtatttgcatcagttcctggcatcattttcacaaagtgtcaaaaagaagatagcgtctacgtgtgtggaccgtatttccctcggggatggaacaacttccataccattatgagaaacatactcggacttgtgcttcctcttctgatcatggtaatttgttactccggcatcctgaaaaccctgctccgctgccgtaacgagaagaaaagacacagagccgtacgcgtaatctttactatcatgattgtttattttctgttttggactccctacaatatcgtaatcctgctgaatacttttcaagagtttttcggactctctaactgcgagagtacttctcagctggatcaggcaacccaggtgacggaaactctcgggatgactcattgctgtataaaccccattatctatgcattcgtcggcgaaaagttccgctcactgttccatatcgccctgggatgccggatcgcacctctgcagaaaccagtgtgtggcggtccaggcgtacgcccagggaaaaatgtcaaagtcacaactcagggactcttggacggaagggggaagggtaagagcatcggcagggcacctgaagcatcactgcaggataaagaaggtgcgtag

SEQ ID NO: 218032 - DNA, 366 bp, Artificial Sequence
  Description of Artificial Sequence: Synthetic coding sequence
atgctgtctactagccggtcgcgctttattaggaataccaacgagtcaggtgaggaggtgacaacctttttcgactacgactatggtgccccatgccacaagttcgatgtcaagcagataggtgctcagctcttaccacccctctattcactggtttttatcttcggatttgttgggaatatgctggtggtactgatcctgatcaattgtaagaaacttaaatgcctcacagatatctacttattgaatctcgctatctctgacctgctgtttctgatcacgctgcccctttgggcgcacagcgccgcaaatgaatgggtttttgggaacgcaatgtgcaagctcttcaccgggctgtatcactag

SEQ ID NO: 218033 - DNA, 1083 bp, Artificial Sequence
  Description of Artificial Sequence: Synthetic coding sequence
atgctcagcacctcacgatccagattcatccggaacactaacgagtctggggaagaagtgacaaccttctttgactatgattacggggcaccttgccataaattcgatgttaaacagatcggtgcccagttacttccccctctgtactctttggtgttcatcttcggatttgtgggaaatatgctagtcgtgctcatcctgattaattgcaaaaagctcaaatgcctgactgatatatatctgctgaatctggctattagtgatctccttttccttattactctgccattgtgggcccacagtgccgcaaatgagtgggtctttggcaatgccatgtgcaaactatttacgggtctgtaccatatagggtattttggaggtatattctttattattctgttgaccatagatcgttacctggctattgtgcacgcagtctttgcacttaaggcaagaactgtaacattcggagtggtgacctctgtgataacgtggctggtggcagtgtttgctagcgttcccggaattatcttcaccaaatgtcaaaaggaggactctgtgtatgtatgcggaccatattttccacgaggatggaacaactttcacactataatgaggaacattctcggattggtgttgccccttctgattatggtgatttgttattccgggattctgaagacattgctcaggtgccgaaacgagaaaaagagacaccgtgcggtgagagtgatctttaccattatgatcgtatactttctgttttggaccccctacaacattgtcatcctcttgaatacttttcaggaattttttggcttatccaattgcgaatccacgagccagctggatcaggcaactcaggtgaccgagacactgggaatgacacattgctgtatcaatccaatcatatatgctttcgtcggggagaagtttcggcgatatctctcagttttcttccgtaagcacatcacgaagcgcttttgcaagcagtgtcctgtgttttatagagaaactgttgacggcgtgacatcaaccaacaccccctcaaccggtgagcaagaggtcagcgctggcctgtag

SEQ ID NO: 218034 - DNA, 1068 bp, Artificial Sequence
  Description of Artificial Sequence: Synthetic coding sequence
atgacaacttccttagatactgtggagaccttcggtactacatcatactacgacgacgtggggctgctttgtgaaaaggccgacactagagccttaatggcacaattcgtgccacctctctactccttagtgtttacagtcggccttttggggaacgtagttgtggtcatgatcctgatcaagtacaggagactccgcatcatgacaaatatttacctgctcaaccttgccatttccgatctgctgtttctcgtcactctgcctttctggatccattacgtgagaggccacaactgggttttcggtcatggcatgtgcaagctcctcagtggcttctaccacaccggtttgtattctgagatctttttcatcatcctcctgacaatcgatcggtatctcgcgattgtgcatgccgtatttgcgctccgtgctcggaccgtaacatttggagtgatcacctctatcgtgacttggggtctggccgtcctggccgctctgcctgagttcattttttacgaaactgaggagttgttcgaagaaacactttgtagtgccctgtaccctgaagacactgtttacagctggcgtcactttcatacattacgcatgactatcttttgcctcgtattaccgttgctcgtgatggccatttgctacacaggcattattaagactcttctgcggtgcccctctaagaaaaagtacaaagccattaggctcatttttgtaataatggccgtgttcttcattttctggactccctataacgttgctatcctgctgtcgtcttaccaatctatcctgttcggcaatgattgtgagaggagcaagcacctggacctcgttatgctcgtgacagaggttatagcctacagccactgttgcatgaatccagtgatttatgctttcgtaggcgagaggttcaggaagtatctgcgccattttttccacaggcaccttctgatgcatcttggacgctatatcccttttctgccctcggagaaactagagcgcacatctagtgtctccccctcaactgccgagcccgagttgtcgatcgtcttttag

SEQ ID NO: 218035 - DNA, 1068 bp, Artificial Sequence
  Description of Artificial Sequence: Synthetic coding sequence
atgacgactagcctcgataccgtggagaccttcggcaccacctcctactacgatgacgtcggtctgctctgcgagaaggccgacaccagggccctgatggcgcagttcgtcccacctctgtatagcctggtcttcactgtgggcttgctgggaaacgtggtcgtggttatgatcctgatcaagtataggcgcttacggattatgacaaacatctatctgttaaatctggccatcagcgacctgctcttccttgtgaccctccctttctggatacattacgtgcgcggtcacaactgggttttcggacacggtatgtgcaaattactctcagggttctatcacacgggtctttattccgaaattttttttatcatcttgttaaccatcgataggtacttagctattgtgcacgcagtgtttgctctgcgcgctaggacagtgacctttggtgtaattaccagtattgtgacatggggtttggccgtgctggccgcactgccggagttcattttctacgaaacggaagaactgttcgaggaaacactctgtagtgctctttaccctgaagatactgtgtattcttggaggcacttccacacccttagaatgaccatcttttgcttggtgctaccccttctggtcatggcaatatgttatactggaatcataaaaaccctgctgcggtgcccctctaaaaaaaaatataaggccatcagattgatcttcgtgatcatggctgttttttttatattctggactccctataacgtggcaatacttttgtcaagttaccagagtattctattcggcaatgactgcgaacgttccaaacatctcgacctagttatgttggtaacggaggtcatcgcttattcacattgttgcatgaatccagtcatatacgcttttgtcggcgaacggtttcggaaatatctgaggcacttcttccaccgtcacctgctaatgcatctcgggcgatacatcccattcctgcctagtgagaaactggaaagaactagctctgtaagtccctctactgcagaacccgagctctctatagtgttttag

SEQ ID NO: 218036 - DNA, 1068 bp, Artificial Sequence
  Description of Artificial Sequence: Synthetic coding sequence
atgacaacaagtctggataccgtcgagacttttgggactacatcatattacgacgatgttggcctcttatgtgagaaggctgatacaagagccctcatggctcagttcgtacccccactttatagcctggtcttcaccgttggcctccttggcaatgtggtggtcgtaatgatcctgatcaagtatagacggttaagaattatgaccaatatctatttgctgaatctggctattagtgacctgttattcttggttacactgccattttggattcactacgtaagagggcataactgggtgtttgggcatggaatgtgtaaattactgagtggattttatcataccggattgtattcagagatcttttttattatattacttactatcgatcggtacctggctattgttcacgccgtattcgccttacgcgctagaactgtcacgttcggtgttatcaccagcattgtaacctggggcctggctgtgctcgcagcgttgcctgagtttatcttctatgaaaccgaggagctgtttgaggaaactctgtgctctgctctgtacccagaggacacagtttactcttggcggcactttcacaccctgaggatgacaattttttgtctcgtgctgcccctgctagtcatggcgatctgctacacaggcatcattaaaacgttgctccgatgccctagtaagaaaaagtacaaagccatcaggttaattttcgtgatcatggctgttttctttattttctggaccccatacaatgtggcaatcttgctctcaagctaccagtcaattctgtttggaaacgattgcgaacggagtaaacacctggatctcgtgatgttggtgaccgaggtgatagcctacagccattgttgtatgaaccccgtgatctacgccttcgtaggagagagattcagaaaatacctcaggcattttttccatcgccatctgttgatgcatctgggcagatatatccccttcttgccgtcggagaagttagagcgcaccagttcagtcagcccatctaccgccgaacccgagctgagcattgtgttctag

SEQ ID NO: 218037 - DNA, 243 bp, Artificial Sequence
  Description of Artificial Sequence: Synthetic coding sequence
atgactacatctctggataccgtggagaccttcggcacaacttcctattacgacgatgtaggccttctgtgtgagaaagccgacactcgtgcgctcatggctcaatttgtcccacccctctacagtttagtgtttaccgtcggcctgctgggtaacgtggtggtggtcatgattctgattaaatacagaagacttcgcataatgaccaatatatacctcctgaatctcgcaatttcagactag

SEQ ID NO: 218038 - DNA, 66 bp, Artificial Sequence
  Description of Artificial Sequence: Synthetic coding sequence
atgacaacatccctggacaccgtcgagaccttcgggaccacaagctattacgacgatgtcggatag

SEQ ID NO: 218039 - DNA, 1068 bp, Artificial Sequence
  Description of Artificial Sequence: Synthetic coding sequence
atgaccacatccctggatacagtggagaccttcggcactaccagttattacgacgacgtgggcctcctgtgcgagaaggctgatacacgggcacttatggcccagttcgtcccccctctttattcacttgtcttcactgtggggctgctgggaaatgttgtagttgtgatgatcttgattaagtaccggcgactgcgcatcatgactaatatttatctcctcaacctagccatatctgacttgctatttttggtcacacttccattctggattcactatgtcaggggccacaactgggtctttggccatggaatgtgtaaacttctctccggattttaccataccgggctgtactcagagattttcttcataattctgcttaccattgaccgttaccttgctatcgtgcatgccgtctttgctttgagagctaggaccgtgacatttggtgttattacctcaattgtgacatggggcctggccgtgctggccgctctgccggagtttattttctacgagaccgaggagctgttcgaagagactttgtgctcagccctgtaccctgaggacacagtttacagttggcgccacttccatactctgagaatgaccatcttctgcctggtcttgccactcctcgtcatggccatttgctatacgggcatcattaagacactcttgcgttgcccctctaagaagaaatacaaagccatccgtctcatttttgtgattatggcagtgttttttattttttggacgccatacaacgtagcaatcctgctcagcagttaccagtctatcctctttggaaacgactgtgaacggagcaaacatctggatcttgttatgcttgtgactgaggtgatcgcttacagccactgttgcatgaaccctgtgatctatgcttttgttggtgagaggttccggaagtatctgcgccacttttttcatcggcacctccttatgcaccttggccgttatatccccttcctccccagtgaaaagcttgaacgaacatccagtgtgtctccctccacagcagagccagagctctccattgtgttctag

SEQ ID NO: 218040 - DNA, 1131 bp, Artificial Sequence
  Description of Artificial Sequence: Synthetic coding sequence
atgcccttcggaatcagaatgctgctcagggctcataagcctggctccagtagacgcagcgagatgactacatctttagacacagttgagacgttcggcaccacctcctactacgacgacgtcgggctgctctgtgaaaaggcagacacccgagctctgatggcccaattcgtaccacccctgtattccctggtgttcaccgtgggcctcctaggcaacgtggtggtcgttatgatacttattaagtatcggcgtttgcgtattatgaccaatatttaccttctgaaccttgccatttctgacctgctctttttggtgactttacccttctggattcattacgtgcgcggacacaattgggtctttggccacggcatgtgcaaattgctctcaggtttctaccataccggtctctacagtgagattttcttcattattttactgactattgacagatatctggcaatagtgcacgcggtttttgcgctgagagcccgtaccgtgacttttggggtcatcacatcaatcgtcacatggggtctggctgtcttagcagccctacctgaattcatcttctacgaaacagaggaattattcgaggagacgctgtgtagcgctctctacccagaagatactgtgtatagctggcgacacttccacacactgaggatgactattttctgcctggtcctcccactgctcgtcatggctatttgttacactggcatcatcaaaaccctgctcagatgcccttctaaaaaaaaatataaagctatccgactgatattcgtgattatggccgtgttcttcatcttctggaccccttacaatgtcgcaatacttctctccagttaccagtctatcctgttcgggaacgattgcgaacgctccaaacacctcgacctggtgatgctggtcactgaagtgatcgcctattcacattgctgcatgaaccctgtgatttacgcgtttgtgggggagagatttcgcaagtatttgaggcatttctttcatagacacctgctgatgcatttgggcagatatatcccctttctcccatctgaaaaactcgagaggacttcgagcgtcagcccttcaacggctgagcccgagctctctatcgtcttctag

SEQ ID NO: 218041 - DNA, 1083 bp, Artificial Sequence
  Description of Artificial Sequence: Synthetic coding sequence
atgaatcccaccgatattgctgataccaccctcgatgagtctatttattctaattattatctttacgaatctatccccaaaccttgcactaaagaaggtattaaggccttcggtgaactgtttctccctccactttactctctagtgttcgtgttcggtctgcttggcaatagcgtggtggtgctcgtgctgttcaagtataagcggctgcggagcatgacagacgtctatttgctcaatctggccatctctgacttgctgttcgtgttcagcctgccattttggggctattatgccgctgaccagtgggtgttcggacttgggttgtgcaaaatgatctcctggatgtacctggtgggcttctacagtgggatttttttcgtgatgctcatgtccattgacaggtatctggccatcgttcatgccgtgtttagcttacgcgctcggacactgacgtatggggtgattacaagtcttgctacttggtccgtcgcggtatttgctagtttgccgggtttcctgtttagcacctgctacacagagaggaatcacacctattgcaaaacaaagtacagcctcaactcaactacatggaaagttctgagctccctggaaataaacattctgggtttggttatacccttgggtatcatgctgttctgttactcaatgatcataaggactctccaacattgtaaaaacgaaaagaagaacaaagccgtaaagatgatctttgccgtggtcgttcttttcctgggattctggactccctataatatcgtcctgtttctggagaccctcgtggaactggaggtgctgcaggattgtaccttcgaacggtacctggattacgccattcaagccacggagactctggccttcgtccattgctgtctgaatcctatcatctacttcttcttgggcgaaaagtttcgtaagtacatcctccaactattcaaaacttgtcgtggtctgtttgtcctgtgtcagtactgtggactgttgcagatttattcagctgacaccccttcatcaagctacactcagtccacaatggaccatgatctgcatgacgccctctag

SEQ ID NO: 218042 - DNA, 1059 bp, Artificial Sequence
  Description of Artificial Sequence: Synthetic coding sequence
atggactatcaggtgtcatctcccatatacgatattaattactacacctctgagccatgccaaaaaataaacgtaaagcagatagccgcacggctcctgccacctctgtactctctggtgttcatttttgggtttgtgggcaatatgctggttatcctgatacttatcaactgcaagagactgaaaagtatgactgacatttatctccttaaccttgccatttccgatctcttctttcttctcactgttccattctgggctcattatgctgcagctcaatgggatttcgggaacactatgtgccaactgctgaccgggctgtactttattggctttttctcgggaatcttttttattatcttgctcacgatagacagatatctggcagtagtccatgccgtctttgcattaaaggccagaacagtgacgtttggggtggtgacttccgtgattacctgggtggtcgccgtctttgcctcattgcccggaataatctttacaaggagtcagaaagagggtctccactacacttgcagttcacactttccctacagtcagtatcagttctggaaaaattttcaaacattgaaaatcgttatactcggattagtactgcctctgcttgtgatggtgatctgctacagtggcatcctcaagactctcctccgttgccgaaacgagaagaagagacaccgggcagttcgccttatctttacaatcatgatcgtgtattttctgttttgggctccatataacatcgtgctcctcctgaatacattccaggaattcttcggactaaacaattgtagctccagtaatagactggatcaagctatgcaggtgacggagacactgggaatgactcactgctgcataaaccccataatttatgcctttgtaggagagaaattcaggaactatctcctggtcttttttcagaagcatattgccaaacgtttttgcaagtgttgtagtatctttcagcaagaggcccctgaacgggcttccagcgtatacactaggtccacgggggagcaggagatatccgtcggattatag

SEQ ID NO: 218043 - DNA, 1059 bp, Artificial Sequence
  Description of Artificial Sequence: Synthetic coding sequence
atggattatcaggtgtcatccccaatttatgatatcaattattacaccagcgagccctgccagaaaatcaatgtaaaacagatcgcagcacggctgcttcctcccttgtattcgcttgtttttattttcgggtttgtgggaaatatgctggtcatcctgatcctgattaattgcaagcgattaaagtcaatgaccgacatctacctcctgaacctcgcgatcagtgacctgtttttccttttaaccgtgcccttttgggcgcattacgccgcagcacaatgggacttcgggaacacaatgtgtcagcttctgactggactgtatttcattggctttttttccggcatctttttcatcatccttctgacaattgataggtatctggctgttgtgcacgccgtgttcgcactcaaagcaagaacggtgacatttggggtggtgacgtccgtgataacctgggtcgtcgctgttttcgcgtctttgcctgggatcatctttacacgtagccaaaaagagggactgcattatacctgcagcagccactttccatatagccagtatcagttctggaaaaattttcaaaccttaaagatcgtgattctcggtttagtgctgcctctccttgtgatggtgatctgttactcggggattcttaaaacactcctccgatgtagaaatgagaaaaaacggcacagggccgtgagactcatttttacaatcatgattgtatattttctgttctgggctccatacaatatcgttcttcttctgaatacctttcaagagtttttcgggttaaataattgtagttcatcaaacaggctggaccaggccatgcaagtcactgagaccttaggcatgacccattgttgcattaaccctataatctatgctttcgtaggagagaaatttagaaactatctgcttgtgttttttcagaaacacattgctaagcgcttttgcaaatgttgttccatctttcagcaggaggcccctgagagagcttcatccgtctacacacgctccacgggagagcaggaaatctccgtgggactgtag

SEQ ID NO: 218044 - DNA, 999 bp, Artificial Sequence
  Description of Artificial Sequence: Synthetic coding sequence
cttcccaaaaatcagtgcgaagcaaatcggtccccaccaccagcctcggccctgctgaccggcgtacatctgtggttctgcaacatgctggtgattctgatattaataaattgtaagcgtttgaagtcaatgaccgatatttatctcctgaatcttgccatctccgacttgttttttctgctaactgtccctttttgggcccactacgccgcagctcagtgggattttggcaacaccatgtgtcaattgctgaccgggctgtacttcatcggcttttttagcggcatcttcttcataatcttactgacaatagatcggtacttggcggtggtacatgcagtgtttgcactgaaggccagaaccgtgacctttggcgttgttacaagtgtaataacatgggtggttgcggtgttcgcctctctgcccggtatcatatttacgcgatcacagaaggaggggcttcactatacctgcagttctcactttccgtacagccagtatcagttttggaaaaactttcagacactgaaaatcgtgattctgggtctggtcttgccgctgctcgttatggtcatttgctactcagggatactgaagaccctgctcagatgtaggaacgaaaagaaaaggcaccgcgcagtgcgcctgatttttactattatgatcgtatatttcctgttctgggcgccttacaatatagtgttgcttcttaatacttttcaggaattcttcggcctgaataattgctcctcttccaaccgcttggaccaggccatgcaagtgaccgaaacattgggaatgacccattgttgtatcaaccctattatctatgccttcgtgggagaaaagttccgcaactacctcctagttttttttcagaaacatatcgctaaaagattctgcaagtgctgtagtatatttcagcaggaagccccagaacgggcaagctcagtgtacacaagaagtactggggagcaggaaatctctgtgggactctag

SEQ ID NO: 218045 - DNA, 1059 bp, Artificial Sequence
  Description of Artificial Sequence: Synthetic coding sequence
atggattatcaggtgtcatctcccatctatgacatcaactattacacctctgagccgtgtcaaaagatcaatgtgaagcagattgctgcgcgacttctcccaccgctgtactctctagtgtttatttttggattcgtcggtaacatgctggtgatcctcatactgatcaactgcaaaaggcttaagagcatgaccgacatttacttgctaaacctggccatcagtgacctcttctttttgcttaccgtacccttctgggctcattacgctgcagctcagtgggactttggcaatacgatgtgtcaactgctgaccggtctctacttcattggattttttagtggcatcttctttattattttgctgaccatcgaccgttatctcgccgtcgtacatgctgtttttgcactcaaagctaggaccgtgaccttcggggttgtgacatccgttatcacatgggtagtcgccgttttcgccagccttccagggatcatctttacacggagtcaaaaggagggtctccactacacatgctcgagccactttccctattcccagtaccagttctggaagaactttcagacccttaagattgtaatactcggactggttctcccgctgcttgtgatggtcatttgctacagtggtatcctgaaaactttattacggtgcagaaatgaaaagaaaaggcaccgagccgtccgactgatttttactataatgattgtgtacttcctattttgggcgccttataatatagtcctccttcttaacacctttcaggagttttttggacttaacaattgcagctcctccaatagactcgatcaggccatgcaagtcaccgagacactgggcatgacccattgttgtataaaccctatcatatatgcgttcgttggcgaaaagttcaggaattacctgctcgtattttttcaaaaacatatcgcaaagcgtttttgcaagtgctgcagcatctttcagcaggaggcccctgaacgagctagttctgtctataccagatccactggggagcaagaaatttcagtggggctgtag

SEQ ID NO: 218046 - DNA, 1125 bp, Artificial Sequence
  Description of Artificial Sequence: Synthetic coding sequence
atgtcaggggagtcgatgaatttctcagacgtgtttgattcatctgaggactatttcgtgtccgtcaacacctcttattatagtgtcgactcagagatgttgctgtgttcacttcaagaagtcagacaattcagtcggctgttcgtgcctattgcctatagtcttatttgcgtgttcggattgttgggtaatatcttggtggtgataacattcgccttctataaaaaagcacgttcgatgaccgacgtatacctgctcaatatggctatcgcagatatcctttttgtcctcacccttcccttctgggctgtgagccatgctaccggggcatgggtcttctctaatgcaacttgcaagctcttgaagggaatttacgccatcaacttcaactgcggaatgcttctcctcacatgtatatcgatggatcgctacattgccatagtccaagctactaagagcttccgtcttcgatctcggaccttgccccgttccaagattatttgtttggtagtctggggactgtctgttattatctcgtccagcaccttcgtatttaatcagaagtacaatactcaagggtctgacgtctgtgagccaaagtatcagaccgtgtcagaaccgattcgatggaaattattgatgcttggcctggagctcctgtttggcttcttcattccactcatgtttatgattttctgctacacttttatcgtgaagacactggtccaagcccagaactcaaagcgtcacaaggccattcgcgtcatcatcgcggtggtgctcgttttcctcgcctgtcagatccctcacaatatggtcctcttggtcacagctgctaacctggggaaaatgaatcgcagctgtcagtcagaaaaattgatagggtacacaaagaccgtaaccgaggttctggcttttctacactgctgtctgaatcccgtgctctacgcattcattggccaaaaattccgcaactactttcttaaaatcctgaaagatctctggtgcgtgcggaggaaatacaaatcgagcggattctcctgtgctggacgctattccgagaacatttcccggcagacttcagagacggctgataacgataatgcttcatccttcacaatgtag

SEQ ID NO: 218047 - DNA, 1125 bp, Artificial Sequence
  Description of Artificial Sequence: Synthetic coding sequence
atgagcggtgagtcaatgaatttcagtgacgtgtttgactcaagcgaagactatttcgtttcagtaaacaccagttactacagtgtggactccgaaatgttactatgctcgctacaggaggtgcgccagttcagtcggttgttcgttcccatcgcctatagcctgatatgtgtattcggacttctgggaaacatccttgtagtgatcaccttcgccttctataaaaaagcaaggtctatgactgatgtgtacctgcttaatatggcaattgccgatattcttttcgtcctaaccctgcccttttgggctgtctctcatgcaaccggcgcttgggtgttctcgaatgccacgtgtaaactgcttaagggaatttacgcgatcaattttaattgtggcatgctcctcctgacatgtatcagcatggatcggtatattgccatcgttcaggcaaccaagtcttttagattgagaagcagaacactgccaagatcgaagattatatgtctggttgtctggggactttctgtcattatttcaagtagtactttcgtgtttaaccagaaatacaacacccagggatctgacgtttgcgagcctaagtaccagactgtgtccgagccaatccgctggaaattgctcatgcttggcctggaacttctctttggatttttcataccactcatgttcatgatcttttgttatacattcatagtaaagactctcgtgcaggcccagaattctaagcgacacaaagcaattcgcgtaattatcgccgtagtgctggtgtttctggcatgccagatcccacataacatggttctgttggtgacggcagcaaacctgggtaagatgaatcgatcctgccagtcggagaagcttattggctacaccaagaccgtcacagaggtccttgccttcctacattgctgcctgaatccggtgttatacgcattcattggacagaaattccgcaattatttccttaagatcttgaaggacctgtggtgcgttagacgaaagtataagtcaagtggctttagctgtgcaggacggtactccgagaatattagtagacagacatctgagacggctgacaatgacaacgcatccagcttcacgatgtag

SEQ ID NO: 218048 - DNA, 1125 bp, Artificial Sequence
  Description of Artificial Sequence: Synthetic coding sequence
atgtccggagagtcaatgaatttttctgatgtcttcgattcatcagaagattatttcgtatcagtgaatacctcatattattccgtcgactcagagatgctgctgtgctccctccaggaggtccgtcagttcagccgactgttcgtcccaattgcctattctttgatttgcgtgtttggactgctgggcaacatcttggtcgtgatcacattcgcattttacaagaaggcccgtagcatgacagacgtctacctgctgaacatggcaatcgcagacatcctgttcgtcctgaccctccctttttgggcggtttcccacgctactggcgcttgggtgttctctaatgctacgtgtaaactgctgaagggcatttacgcgattaattttaactgtggaatgctgctgctcacctgtatatcaatggacaggtatatcgccattgttcaagccaccaagagtttcaggctgaggagtcgcacattgcccagaagtaagattatttgtctcgtggtgtggggtctgtcagtcatcatctcaagtagcacctttgtgtttaaccagaaatataacacacagggctccgatgtctgcgaaccaaagtaccagaccgtgtccgagccaattcgatggaaactgttaatgctgggcctggagcttctgtttggctttttcatccccctgatgttcatgattttttgttacacctttatcgttaaaactctggtccaggcgcagaacagtaaacgccacaaggccatccgggtcattattgcggtggtgcttgtgttcttggcctgtcagattccacacaacatggtgctgttggtgactgctgcgaatctgggtaaaatgaacaggagctgtcaaagcgagaagctgatcggctatactaagacagtcacggaggtgctagccttcctgcactgctgcttgaatccggttctatatgcctttatcggccagaagttccgaaattattttcttaaaatccttaaagatctctggtgtgttagacgaaagtataagtcttcagggtttagctgcgccggacggtactccgaaaacatcagtaggcaaacttccgaaacagctgataatgacaatgcttcttcctttaccatgtag

SEQ ID NO: 218049 - DNA, 1137 bp, Artificial Sequence
  Description of Artificial Sequence: Synthetic coding sequence
atggatctcgggaagcctatgaagagtgtgctggtggttgccctcttggtgatttttcaggtgtgcttgtgccaggacgaagtgacagatgattatattggcgataacactactgtagactatacattgtttgagagcttatgtagcaagaaggatgtgcgaaactttaaggcctggtttctcccgataatgtactccatcatttgtttcgtggggcttcttggcaatggactagtggtgctcacctatatctacttcaaaagactgaagacgatgactgacacctatctgcttaaccttgcagtggcagatatactgttccttttaactcttcccttttgggcttattctgcggctaaaagctgggtcttcggtgtgcatttttgtaaacttattttcgccatttataaaatgtcgtttttttccggcatgctgcttctgctttgtatttcaattgaccgttacgttgccattgtgcaggctgtgtctgcccatcgccacagagcacgggttctcctgattagcaaactcagctgtgtagggatctggatactcgctaccgtgctatcgattccagaactgctttattctgatctgcagcgtagcagctccgaacaggccatgagatgcagccttatcaccgagcacgtggaagccttcatcaccatccaggtggcccagatggtcataggttttctagtcccgctgctggcaatgtctttctgctatctcgtgattattaggaccctactccaggcccgaaacttcgagcgaaataaagccattaaagtaattatcgcggtcgtggtggtgttcatcgtttttcaacttccctacaacggggtcgtgcttgcccagaccgtggccaatttcaatattacatctagcacgtgcgagctgagtaaacaattaaatatcgcttatgacgtaacctactctctggcatgtgtgaggtgttgcgtcaacccgttcctgtatgctttcattggcgtaaaatttcgtaatgacctctttaagctctttaaagatctcggctgcctctcccaggaacaactccgccagtggtcttcctgtcgacatattcgtcgctcatccatgtcagtggaagccgagaccacaactaccttttctccctag

SEQ ID NO: 218050 - DNA, 1068 bp, Artificial Sequence
  Description of Artificial Sequence: Synthetic coding sequence
atggattatacactggacttgtcggtgactacagtcacagactactactaccctgacatattcagttccccgtgcgacgctgaacttatccaaaccaacggcaaattactgctggctgtgttctactgtctcctgtttgtgttcagtttattgggcaattctctcgtgatactcgtcctggtcgtgtgtaagaagcttcgcagtatcacagacgtttacctgctcaatttagccctatcggatctgctgtttgtgttcagctttcctttccagacatactatctgttggaccaatgggtttttggaactgttatgtgcaaggtcgtgagcgggttttactacattggtttttactcttctatgttcttcatcaccttgatgagcgtggacagatatctggccgttgtgcacgctgtgtatgcattgaaggtgcggacaattcgtatgggcacgactctgtgcctcgcggtttggctgaccgcaatcatggcaactatccctctgttagtattctaccaggtcgccagcgaggacggtgtcctgcagtgttactccttctataaccagcagaccctgaagtggaagatctttacaaactttaaaatgaatatccttgggctcctgatcccgttcacaatcttcatgttctgctatatcaagattctgcaccagttaaagcgatgccagaaccacaataaaaccaaggccataaggttagtgctgattgtggttattgcctccctacttttctgggttccttttaacgtggtcctgtttctgaccagcctgcattctatgcacatcttagacggctgctcaatatcacagcaactaacatacgccacgcatgtgacagaaataatctcatttacccattgctgtgtcaacccagtgatctatgcctttgtgggcgaaaagtttaaaaaacacctgagtgagattttccagaaaagttgttcacagattttcaactacctcggtaggcagatgccaagggagtcgtgcgagaagtcttccagttgccagcagcactctagtcgaagttccagcgtggactatattctctag

SEQ ID NO: 218051 - DNA, 819 bp, Artificial Sequence
  Description of Artificial Sequence: Synthetic coding sequence
atgaggaatttgttcaggcagatgacctactacttgctagatcaatgggtgtttggcaccgtaatgtgcaaggttgtgagcggcttttattatatcgggttttatagctccatgtttttcatcaccttaatgagtgtcgatcgatatctagctgtggttcacgcagtgtatgccttaaaagttagaaccatacgtatgggaaccaccttatgcctggcagtgtggctgaccgccatcatggcaaccatccccctcctcgtgttttatcaggtggccagtgaagatggagtactccagtgctactccttctataatcagcagaccttgaagtggaaaatatttactaactttaagatgaatatcttgggattactgatccccttcacgatttttatgttttgctatattaagattctacatcagttgaagagatgtcaaaatcataataaaactaaggcaatccgtctggtcctaatcgtcgtgatcgcctccctgctgttctgggtgccgtttaatgtcgtgttgttccttacaagtctgcactccatgcatattctggatggatgcagcataagtcagcagctcacatacgctacacatgtgaccgaaataatcagctttacccattgttgtgtcaatcctgtgatctacgcctttgttggcgaaaaattcaaaaaacacctgtctgaaatcttccagaaaagctgcagccagatttttaactatctgggacgtcagatgcccagagaaagctgtgagaagagctcttcatgtcagcagcattctagccggtcttcatccgttgactatatcctgtag

SEQ ID NO: 218052 - DNA, 1074 bp, Artificial Sequence
  Description of Artificial Sequence: Synthetic coding sequence
atggctgatgactatggcagtgagtctactagcagtatggaggattatgttaattttaatttcacagatttctactgcgagaagaacaatgtgcggcaatttgcctcgcactttttgccacctctgtattggctcgtgttcatcgtgggggctttagggaattctcttgtcatcttggtgtattggtattgcacacgtgtgaaaaccatgacggacatgttcttgcttaatctggccatcgctgatctgctttttctggttaccctgcctttctgggcaatcgcagctgcagatcagtggaagtttcagacctttatgtgtaaagtcgtgaactctatgtacaaaatgaatttctattcatgcgttctgctcatcatgtgcatcagcgtggaccgctacatcgctatcgctcaggcaatgagggctcatacttggcgggaaaagagactattatatagcaaaatggtgtgtttcactatttgggtactagcagccgcactatgcattccagagatcctgtatagtcagatcaaggaggaatcagggattgccatatgtaccatggtttacccttccgatgagtccaccaaacttaagtcagcggttcttaccctcaaagtaattctgggctttttcttgccctttgttgtaatggcttgctgttatacaatcatcattcatacattgatacaggcaaagaaaagctccaagcacaaggccctcaaagtcactataactgtcctgacagttttcgtgctgagccagttcccttataattgcatcttgctggtccagaccatcgatgcttatgccatgtttattagcaactgtgcggtgtctacaaacattgacatctgcttccaggtcactcaaaccatagcgttctttcatagttgcctcaacccggtcctgtatgtattcgttggcgagcgatttaggagagatctggttaagactttaaaaaacctgggatgcatttcacaggcccagtgggtctcattcactcgccgtgaaggcagccttaaattgtcttccatgcttttggagaccacctctggggctctgtccctgtag

SEQ ID NO: 218053 - DNA, 1110 bp, Artificial Sequence
  Description of Artificial Sequence: Synthetic coding sequence
atgacccccactgattttacaagccccatcccaaacatggccgatgattatggctccgagtccaccagtagcatggaggactacgttaacttcaattttacagatttctattgtgagaagaataacgttagacagttcgccagccattttctgccccctctgtactggcttgtattcattgtaggcgctctgggtaactcattagtcatactggtgtactggtattgcacacgcgtcaaaaccatgactgatatgttcctgctaaatttagctatcgcagacctcctctttctcgtcacattgcctttctgggcaatcgccgctgccgaccagtggaaatttcagacttttatgtgcaaagttgtgaattcaatgtacaagatgaacttttactcctgcgtgttactaatcatgtgcatctccgtagatcggtacatagccattgcacaggccatgcgtgcacacacgtggcgagagaagaggttgctgtattcaaaaatggtttgttttaccatctgggttctggccgcagccctgtgcatccccgaaatcttatattcacaaattaaagaggagtcgggtatagcgatctgtaccatggtatacccaagcgacgaatcaaccaaactgaaatctgccgtgctgactctgaaggtcatcctaggcttcttcctgccattcgtcgtgatggcctgctgttatacgattatcatccacacactgatccaggctaagaaatccagtaaacacaaagccctgaaggtgaccatcacagttttgactgtgtttgttctgagtcagttcccatataactgcattttgctcgtgcagaccatcgacgcttatgccatgttcatatccaattgtgcagtctccaccaacattgatatatgctttcaagtcacccagactattgcattctttcattcttgcctaaacccggtcctgtacgttttcgttggagagagattcagaagagacctggtaaaaacgctcaaaaacctagggtgcatttcacaggcccaatgggtgtctttcactcggcgagaaggcagcctgaaactgtcttcaatgcttctggagaccactagtggggcactttcactgtag

SEQ ID NO: 218054 - DNA, 1074 bp, Artificial Sequence
  Description of Artificial Sequence: Synthetic coding sequence
atggccgacgattatggcagcgaatcaacgtcctccatggaggattacgtaaatttcaactttacggacttttattgtgagaaaaataacgtgcgccagttcgccagccacttcttgcccccactgtactggctcgtgttcatcgtgggagcactcggtaacagcttggtcatcctggtgtactggtattgcacacgcgtcaaaacgatgacagacatgtttctcctgaatcttgcaatcgctgacctgctgtttttggtgactcttcctttttgggccattgccgctgcagatcaatggaagttccagactttcatgtgtaaggtagtgaattctatgtataagatgaatttctactcatgtgtcttgctgatcatgtgcatcagtgtcgaccgctacatcgccatagctcaggccatgagggcacatacgtggcgcgagaagagattactgtactcaaaaatggtgtgtttcacaatttgggtgctcgcggctgctttgtgtattcctgaaatactatattcacagatcaaagaggaaagtggcatcgctatctgcacaatggtttacccaagtgacgagtcgaccaagttaaagtctgccgttctgactctgaaggttatcctaggcttcttcctaccttttgtggttatggcttgctgctacaccataattatacacaccctgatccaggctaaaaaaagctctaagcacaaagctctcaaagtgaccatcacggtgctcaccgtgtttgtactttctcaattcccttacaattgtatcctcctcgttcagacaatcgacgcttacgcaatgttcatctccaactgcgccgtgtccacaaacatcgacatctgtttccaggtgacccagacaattgcattctttcactcttgcctcaatccggtactctatgtctttgtgggggagaggttcagacgcgacctcgtgaagacactgaaaaatctcggatgcattagtcaagctcagtgggtatcattcactaggagagagggatcactgaaactcagcagcatgctcctggagaccacatctggcgctctcagtctgtag

SEQ ID NO: 218055 - DNA, 1053 bp, Artificial Sequence
  Description of Artificial Sequence: Synthetic coding sequence
atggcactggagcagaaccagtcaacagattattattatgaagagaatgagatgaatggaacgtacgattactcccaatatgagcttatatgcatcaaggaagatgtgagggaatttgctaaggtgttcttacccgtgtttctaactatcgtttttgtgatcggcctcgccggaaattccatggttgtggctatctacgcctattacaagaaacagcggaccaaaaccgacgtctacatccttaacctcgccgtggctgacctgttgctactcttcacccttcccttctgggcggtgaacgctgtgcacggctgggttcttgggaaaatcatgtgtaaaataacatctgctttgtataccctgaacttcgttagtgggatgcagtttctggcgtgcatctcaatcgatcgttatgtagcagtgactaaggtcccctcgcagagtggagttgggaaaccctgctggatcatatgtttttgtgtgtggatggctgcgatcctactctccatcccccagttggtgttctacactgtcaatgataatgccagatgcatcccaattttcccaagatacttaggcaccagtatgaaagctcttattcagatgttagaaatctgtatcggattcgttgtgccctttcttatcatgggcgtgtgctacttcatcacggcacgcacactcatgaagatgcctaatattaagattagtagacctctgaaagtgctgctgaccgtggtgattgtgtttattgtgacacagttgccttacaacattgtcaaattctgtcgggctatcgatatcatctattccctgattacctcctgtaatatgagcaaacggatggacatcgctatccaggtgactgagtccatcgcactctttcactcctgtctgaaccccatcttatatgttttcatgggtgcatctttcaaaaactatgtgatgaaagtagctaaaaaatatggctcttggcgtcgacagcgtcaaagtgtcgaagaattcccatttgattccgaagggcctaccgaaccaacatctacttttagtatctag

SEQ ID NO: 218056 - DNA, 825 bp, Artificial Sequence
  Description of Artificial Sequence: Synthetic coding sequence
atggccctagagcaaaaccagtctacagactactactatgaggagaacgaaatgaatgggacctacgattactctcagtatgaattgatctgcatcaaggaagatgtcagagagtttgcaaaagtattcctcccagtgttcttgacgatcgtttttgtcattggacttgctggaaacagtatggtagtagccatctacgcgtactataaaaaacaaagaactaagaccgatgtgtacattctgaacctggcggttgccgatctgctgctgttgtttaccttgccattttgggcagtaaacgctgtccacggttgggtgttagggaagataatgtgcaagatcacgagcgccctttacacattaaatttcgtgagcggcatgcagttcttggcctgtatttctatcgatcgatacgttgcagtgaccaaggtgccctctcagagcggcgtcggcaagccatgttggatcatctgcttttgcgtgtggatggcggctatactgctttccattccacagctcgttttttacactgtgaacgataatgccagatgtattcctatcttcccgagatatctcggtactagcatgaaagcccttatccaaatgctggagatttgtattggatttgtggtgccattcctaatcatgggggtttgttatttcataactgccaggacactgatgaagatgccaaatataaaaatttcgcgtccattgaaagtcctcctgactgtggtgattgtattcattgtgacccagctgcccttcgcctggatccacatgaatgatgcattcccctccaataagacgagtgccctgttttag

SEQ ID NO: 218057 - DNA, 1071 bp, Artificial Sequence
  Description of Artificial Sequence: Synthetic coding sequence
atgatttacacacgatttctgaagggcagcctgaagatggcaaattataccttggcccctgaagacgagtacgacgtgctgatcgaaggggagttggagtcagacgaggcggaacaatgtgacaagtatgacgctcaggcactcagcgcccaacttgtaccctcactgtgctcagcagtcttcgtgatcggcgtcctcgacaatttgctggtggtgttgatcttggtgaaatataagggtttgaaacgcgtcgaaaacatttatctgctgaacctggcggtatcgaatctgtgtttcctgctcactctcccattttgggcccacgccggaggagatccaatgtgcaagattttaataggtctctacttcgtggggctgtactccgagacatttttcaattgtctgcttactgtgcagaggtatctggtattcttacacaaaggtaattttttctctgctcgaaggagagtgccttgcggtatcatcacctccgtcctcgcatgggtaacagccatccttgctaccctcccagagttcgtggtttataagcctcagatggaagatcagaaatacaaatgcgctttcagccgcaccccttttttgccggctgatgagacattctggaaacacttcctcactctgaaaatgaacatttctgttttagtgctgcccctttttatctttacctttctgtatgtgcagatgaggaagactctccgtttccgagagcagagatattcactgtttaagttagtcttcgccatcatggttgttttcctcttaatgtgggccccatacaacatcgccttcttcctttccacctttaaggagcacttttccctctccgattgtaagtcatcttacaacctggacaagtctgttcacattacaaagctgatcgctactacccactgttgtatcaacccactgctttacgcattccttgacggcacctttagtaagtatctgtgtcgctgctttcacctgagatcaaacaccccactgcagcctcggggacagagtgcccagggtacatcccgtgaagagcctgaccattctaccgaggtatag

SEQ ID NO: 218058 - DNA, 1035 bp, Artificial Sequence
  Description of Artificial Sequence: Synthetic coding sequence
atggcgaactatactttagcacctgaggatgaatacgacgtgttaattgaaggcgagttggagagtgacgaagccgagcaatgtgacaaatacgatgcccaggctttatctgcccaacttgtgccctctctgtgcagcgctgtcttcgtcattggggttttggacaatctgctggtggtgctgattctggtcaaatacaaagggctaaagagagtggaaaacatttatctgcttaatctggctgtgagcaacctatgttttttgttaaccctgcccttctgggcacatgctggcggtgatcctatgtgtaaaatcctgatcggtctgtatttcgtggggctctactcagagacattcttcaactgcctgttgacggtgcagcgttacctggtcttcctgcataagggcaatttctttagcgctagacggagggtgccatgtgggattattacttctgtcctggcctgggtgactgccatccttgctactctgcctgagtttgtcgtctataagccccagatggaggatcagaaatacaaatgcgccttttctagaactccctttctgccggcagatgagactttttggaagcactttctcactctgaagatgaacattagtgtgctcgtgctgccactattcatctttacgttcctgtacgtccagatgcggaagacgcttagattccgggagcaacggtacagcctgtttaaactggtgttcgctattatggtcgttttcctgctcatgtgggcgccttataatattgcctttttcctgtccacgttcaaggaacacttttcactgagcgattgtaagtcaagctacaacctggacaaatcagtgcacattactaaactaatcgcgaccacacattgttgtattaatcctttgctctacgcatttctcgatggaacattctccaagtacctctgcaggtgtttccatctcaggtcgaacactcccctgcagcccaggggacagtctgcccagggaacttcacgggaggaacccgatcacagcacggaagtttag

SEQ ID NO: 218059 - DNA, 1035 bp, Artificial Sequence
  Description of Artificial Sequence: Synthetic coding sequence
atggccaattacaccctggcaccagaggacgagtacgacgtactcatcgagggtgagctcgagtccgacgaagccgagcagtgcgacaagtacgatgcccaggcgctcagcgcccagctggtaccctctctgtgcagtgccgtgttcgtcatcggcgtcctggataacctgctcgtcgtgcttatactcgtgaagtacaagggcctgaaaagagttgagaacatttatctcctgaatctggcggtcagcaatctatgcttcctcttgacactgcccttctgggcccacgccggtggagatccgatgtgtaagatcctgatcggattgtacttcgttggtttgtacagtgaaacatttttcaattgtcttctgacagttcagaggtacctggtttttcttcataaaggtaatttctttagcgcgcgaaggcgggttccctgtggtatcatcacaagtgtattagcctgggtcaccgccatcctggctacattgccagaatttgttgtgtataagccacaaatggaggatcagaagtacaaatgtgccttcagtcgcaccccatttctgcctgctgatgaaaccttttggaagcatttcttgactctcaagatgaacatcagcgtgctggtcctgcccttgtttatcttcaccttcctgtatgtgcagatgcgtaagacactgcgctttcgggaacagcgctacagcctgttcaagttggtgttcgctattatggttgtttttttactgatgtgggccccatataatatcgccttctttctttctaccttcaaagagcacttcagcctttcagattgtaaatcttcctataatctggacaagagcgtccacataaccaagcttatagctacgacccattgttgtatcaatccgctgctctacgcttttcttgacggcacattcagtaagtatctgtgcaggtgttttcacctcaggagcaacacgccgctacaaccaagagggcagtctgcccagggtacctcgcgagaggagcccgaccatagtactgaagtctag

SEQ ID NO: 218060 - DNA, 1035 bp, Artificial Sequence
  Description of Artificial Sequence: Synthetic coding sequence
atggctaactacaccctggcgcctgaagacgagtatgatgttcttatagaaggcgagttagaaagcgatgaggcagagcaatgcgacaagtacgatgctcaggctctgtctgcccagttggttccctccctttgtagtgccgtcttcgtgatcggggtgctcgacaacttactggtcgtcctcattctcgtaaagtataaaggcttaaagagggtggagaacatctacctgctaaacctcgccgtcagcaacctgtgcttcctcctgaccctgccgttctgggcccacgccggtggggacccaatgtgcaagatcctgatcggactgtattttgtggggctctactccgaaaccttctttaactgcctgctgacagttcagcggtacctggtgtttttgcacaaagggaatttcttttccgcccgaagaagagtgccgtgtgggattataacctccgtcctcgcctgggtgacagctattctcgccacattacctgaattcgttgtgtacaaaccacaaatggaagatcagaaatacaagtgtgcgttttcccgtaccccctttctgcctgctgatgagactttttggaaacattttctgactctcaagatgaacatatctgtcctggtattaccactttttatttttacatttttgtacgtgcaaatgaggaagaccttgcgttttagggagcagcgctactcactgttcaagctggtgtttgctattatggtggtctttctgctcatgtgggccccttacaatattgccttttttttgtccacattcaaggagcacttctcactgtccgactgcaagtcttcctataacctcgacaagtcagtgcatatcacgaaactgatcgccaccacacactgctgtattaatccactactttacgcgtttctcgacgggactttctccaagtacctgtgtaggtgcttccatcttcgatctaacaccccactgcaacccagggggcagagcgctcaggggacgtcccgcgaagagccagatcattctaccgaggtgtag

SEQ ID NO: 218061 - DNA, 654 bp, Artificial Sequence
  Description of Artificial Sequence: Synthetic coding sequence
atggcaaattacaccctcgcccctgaagacgaatatgacgtgctgattgagggggagcttgagtccgatgaagccgagcagtgtgacaaatacgacgctcaggctttgagcgctcagctagtgccctccctgtgtagcgccgtcttcgtcattggagttctggacaatttattggtggtgctaatcttagtcaagtataaaggactgaagcgcgtggagaacatctaccttctcaacctggctgtcagcaatttatgttttcttctgaccctcccattctgggcacacgctggcggagacccaatgtgcaaaatcctgattggtctctattttgtggggctgtactccgagacatttttcaattgccttttgacagtgcagcgctacctggtctttttgcacaaagggaactttttttccgccaggcgtcgggtgccctgcggaattatcaccagcgtcttagcttgggtgactgccattctggccacactacctgaatttgtggtgtataagccacaaatggaagaccagaagtacaagtgtgcgttctctaggaccccatttctgcctgctgatgagactttttggaaacacttcttaaccttgaagatgaatatatcagtgctggttttaccactctttatcttcacgtag

SEQ ID NO: 218062 - DNA, 1194 bp, Artificial Sequence
  Description of Artificial Sequence: Synthetic coding sequence
atggcccctatctccctatcttggctccttcgattggctactttctgtcatttgaccgtcctgctggctggacagcaccacggtgttacaaagtgcaacataacttgttcgaaaatgacatctaagataccagtagccttgctcattcactatcagcagaaccaggcctcgtgtggcaagcgggctattattctagaaacgcgacaacatcgtctgttttgtgctgatcccaaggagcaatgggtgaaagatgctatgcagcacctggacaggcaggccgcagcactcacaagaaatggcggtactttcgaaaaacagattggcgaagttaagccccgaaccacaccggctgctggaggcatggatgaatccgtggtgctcgaacctgaggccacgggtgagtcctcttctctcgagccaactcctagtagccaagaagctcagagggcattggggacaagccctgagctgccaaccggcgtcaccggctcatctggcactcggctgccgccaactcctaaagcacaggacgggggacccgtgggaactgaactgtttcgggtacccccagtgtcgactgctgcaacttggcagtcaagcgccccacatcagcccggtccgtccctgtgggcagaggccaagacatcagaagcgcctagcacacaggacccctcaacacaggccagcacggcttcatcaccagctccagaggaaaacgctccctcggaaggtcaacgggtttggggccagggtcagagccccaggcccgaaaattctcttgagagagaagaaatgggacctgttcctgcccatacagacgcgttccaggactgggggccaggcagcatggcccacgtgagcgttgtgcctgtgagttctgaaggaaccccgagcagagagcctgtggcctctggatcttggacgccaaaggccgaggagccaattcacgccacaatggatcctcagagattgggcgtccttatcacccccgtaccagacgcccaggccgctacacgtaggcaggcagtcggcctcctggcattcttgggcttgctcttctgcctgggcgtggccatgttcacatatcagtctctgcaaggctgccccaggaagatggcaggagaaatggccgaagggctacgatatatacctcggtcctgtggcagcaacagttacgtgctggtccctgtttag

SEQ ID NO: 218063 - DNA, 1164 bp, Artificial Sequence
  Description of Artificial Sequence: Synthetic coding sequence
atgcgagaaccccttgaggcctttaagctcgccgacctcgactttcggaagagttccctcgcttcgggctggaggatggctagcggtgcatttacaatggaccagtttccagagtctgtgacggagaatttcgagtatgacgaccttgccgaagcgtgctacatcggggacatagtagtcttcggcaccgtttttctgagtattttttatagtgtgatttttgccatcgggctggtcggcaacctactcgtggtgtttgcactgaccaactctaaaaagccaaagtccgtgaccgacatctacttgttgaatttagccctgagcgatctgcttttcgttgccacactcccattttggactcactatctgatcaacgagaaggggttacacaacgcaatgtgtaaatttaccacagccttcttctttattgggtttttcggttctatcttttttatcaccgtaatttcgatcgacagatacctggccatcgtcctcgctgccaactctatgaacaatcgtactgtgcaacatggcgttacgatctctctgggagtgtgggctgctgcgatcctggttgcggctccccagttcatgttcaccaaacaaaaagagaacgagtgtcttggcgactatccggaagtgctgcaggaaatctggcccgttttacggaacgtcgaaacaaactttctaggcttcctgttacctctgttgataatgtcttattgctattttcgtatcatacagacacttttctcgtgtaagaatcataagaaggccaaagccattaagctcatcctcctggtcgtgatagtgtttttcctgttttggacaccatataatgtgatgatctttctagagaccctaaaactatatgacttttttcccagctgtgatatgcgcaaggatttgcggcttgcactgagcgttacagagactgtggccttctcacattgctgcttgaacccactaatatacgcttttgccggtgagaagtttagacgttatctgtatcacttgtacggtaagtgtctcgcggtcctgtgcggtagatctgtgcacgtggacttctctagttctgagagccagcggagccgtcacggctctgtgctttcctccaatttcacctaccacacctcagatggagacgcactgctgctgctctag

SEQ ID NO: 218064 - DNA, 1068 bp, Artificial Sequence
  Description of Artificial Sequence: Synthetic coding sequence
atggaccagtttcccgaaagcgtcacagagaactttgaatatgatgacttggcggaggcctgctacattggcgacattgtggtctttggaaccgtctttctgtccattttttattccgtgatattcgcaatcggccttgtcggcaacctgctcgttgtgttcgctctgaccaattccaagaagcctaaaagcgtgaccgacatatacttattaaacttggccctgtcagatttgctcttcgtagccacgctgcccttctggacacactatctcatcaacgagaagggtctccacaatgcaatgtgcaaattcactaccgctttcttctttattggcttctttggatccatattctttattactgttatctcaattgaccgataccttgcaatcgtactggcagccaactcaatgaataataggactgtgcaacatggagtgacaatcagcctgggagtttgggccgctgctattcttgtagctgcaccacagttcatgtttaccaaacagaaggagaacgagtgtttgggcgactatccagaggtgctgcaagagatctggcctgtgctgcgcaacgtggagactaactttttgggttttttactgccactgctcatcatgtcctattgctatttccgcattatacagacactattctcatgcaagaaccataaaaaagctaaagcaattaaactgattctgctggtcgttatagtgttcttcttgttctggaccccctataatgtgatgatcttcctcgaaaccctgaagctctacgatttcttcccctcgtgtgacatgcggaaggacctcaggctggccctgtccgttactgaaaccgtggctttttcccactgttgtctcaacccgttaatctacgcctttgccggagaaaaattccgaaggtacctctatcacctgtacggaaagtgcctcgctgtgctgtgtggcagatccgtgcacgttgatttttccagcagcgagtctcagcggtcccggcatggctcagtgctttctagtaacttcacctaccacacctcagacggcgatgcactgctattgctatag

SEQ ID NO: 218065 - DNA, 321 bp, Artificial Sequence
  Description of Artificial Sequence: Synthetic coding sequence
atggaccagtttcctgagagtgtgacggagaatttcgagtatgacgacttagccgaggcctgctacatcggggatattgtggtcttcggaacagttttcctctcaatcttctattcagtgatttttgccatcggcctggtaggtaatctcctggttgtgtttgccctgacaaactcaaagaaacccaaaagcgttacggatatttacctcctgaacctggccctgtcagacctgctcttcgtagccactctgcccttttggacccattacctcatcaacgaaaaaggtttacacaatgccatgtgtaagtttactacttag

SEQ ID NO: 218066 - DNA, 501 bp, Artificial Sequence
  Description of Artificial Sequence: Synthetic coding sequence
atggatcagtttcccgaatctgtcacggaaaacttcgaatatgatgacctggccgaggcttgttacatcggcgacattgtagtcttcggaaccgtgtttctgtcaatcttctattccgtgatctttgcaataggcctcgtgggaaatctgttggtcgttttcgccctcaccaacagtaagaagcctaagtcggtgacagacatctatctcctgaacctcgccttgtccgacctgttatttgtggctaccctgcccttttggacccactacctgatcaatgaaaaaggcctgcacaacgccatgtgtaagttcaccacggcattttttttcatcgggttctttgggtctatattttttataacggtgatctccattgacagatatctggcaatcgtgctggccgcaaactccatgaataaccgaaccgtgcagcacggcgttactatatctttgggagtctgggccgctgctatcttggtggcagccccacagtttatgtag

SEQ ID NO: 218067 - DNA, 1092 bp, Artificial Sequence
  Description of Artificial Sequence: Synthetic coding sequence
atggcatcaggcaaagcatttacaatggatcagttcccagaaagcgtgaccgagaacttcgaatatgacgacctagctgaggcctgttatattggggacattgtggtgttcggcacagtcttcctgagcatattctactccgtcatcttcgcaatcggcctggtggggaatcttctggtggtgtttgctctcactaacagcaaaaagccaaagagcgtgaccgatatctatctgctcaatttggctctcagtgacctgttgtttgtagctactctgcctttctggactcattacctaatcaacgaaaaaggcctgcacaatgccatgtgtaagtttacaactgctttttttttcataggtttttttggttcaatcttctttataactgtgataagtatagaccgatatctggctatagttctcgctgcgaattcgatgaacaaccggacagtccaacacggggtgaccatttcgctcggggtgtgggcagcagccattctggttgccgctccccagtttatgttcaccaagcagaaagagaatgaatgcttaggggactatcctgaagtgctacaagagatttggccagtgctgagaaacgtcgagacaaacttcttgggtttcttgctacccttattgattatgtcttattgctatttccggatcatccagacgctgttcagttgcaagaaccataagaaggccaaagctatcaagctcatcctgcttgtagtgatagtgtttttcctgttctggacaccctataacgtgatgattttccttgaaactcttaaactttacgatttctttccgtcatgcgatatgaggaaagatctacgcttggcgctgtccgtaaccgagacggtagccttcagccattgttgtctcaatcccctgatctacgcttttgctggagagaagttccggcgatacctgtatcacctttacggcaagtgcctggcagtactgtgtggcaggagcgtgcacgtcgacttcagttcgagcgaatcgcaacgctcccgacacggatccgtgctaagcagtaatttcacatatcacacatccgacggcgacgcgctattgctgttgtag

SEQ ID NO: 218068 - DNA, 1068 bp, Artificial Sequence
  Description of Artificial Sequence: Synthetic coding sequence
atggatcagttccccgaatccgttaccgaaaatttcgaatacgacgacctggccgaggcttgttacattggggacatcgtagtcttcggtactgtgttcctaagcatcttctactccgtgatcttcgcgatcggtcttgtgggcaacctccttgtcgtattcgcacttaccaattctaagaaacccaagagtgtaaccgacatctacttgctgaacctggccctgagtgatctgcttttcgtagctacgctgcctttttggacacactatctgataaatgaaaagggtctacataacgcaatgtgtaagttcacgacagcattcttcttcattgggttttttggatccatcttttttataaccgtgatttctattgataggtatctggccatagtgctggcggcaaactctatgaataacagaactgttcagcacggggtgactattagtcttggggtctgggcagccgcaatcctggtcgctgctccacagttcatgttcaccaaacaaaaggagaacgaatgtctgggagactacccagaggttcttcaggagatctggccagttctaaggaatgtagagaccaactttttaggctttctcttaccactgcttatcatgtcttactgctattttcggatcatccaaacattattcagttgtaaaaaccataagaaagccaaggccatcaaactcattctgttagtggtcatagtgttttttctgttttggacaccatacaacgttatgatcttccttgaaactttgaaactatatgacttctttccatcttgcgacatgaggaaagatctccggctggccctcagtgtgacggaaacagtggctttctcccactgttgcctcaacccactcatctacgcctttgccggtgagaaatttcggcgatacctgtatcatctgtatggcaaatgtctcgcagtcctgtgtggtcgctctgtgcatgtggactttagttcttcagaaagccagcgatcacgccacggctctgtgctgtcctctaacttcacttaccatactagtgacggggacgcgctgctgttactttag

SEQ ID NO: 218069 - DNA, 1068 bp, Artificial Sequence
  Description of Artificial Sequence: Synthetic coding sequence
atggaccagtttccggagagcgtgaccgagaatttcgagtacgacgacttggccgaggcctgctacatcggtgacatagtggtgtttggaacagtgttcctctccatcttctattcggtgattttcgcgatcggcctggtagggaatctgctggtggtgttcgcattgaccaatagtaagaaacctaagtccgttaccgatatatacctactcaatttggcccttagtgacttgttatttgtcgccactctaccattttggacccattaccttatcaatgagaagggccttcataacgctatgtgcaaatttactacggcctttttcttcattggattctttggttccattttctttattacagtgatatcaatcgataggtatctggccattgttctggcagctaacagcatgaacaatcgaactgtgcaacacggcgttactatctctctcggggtgtgggccgcagctatactggtggccgcaccacagtttatgtttaccaaacagaaggagaacgagtgtctgggtgactatccagaagtccttcaggagatttggcctgtactgcggaacgtggagaccaacttcctaggctttctgctgcccctcctgattatgtcatattgctacttccgcatcatccagacactgttctcatgcaaaaatcacaaaaaagcaaaagctattaagttgatcttgctggtggtgatcgttttctttctgttttggactccttacaacgtgatgatcttcctggaaaccctcaagctgtacgatttctttccaagctgcgacatgagaaaggatctgagattagcgctttctgtcactgaaaccgtggccttcagccactgttgtctcaatcctcttatatatgcctttgcgggtgagaaatttcgccgatacctctatcatctctatggcaaatgtctggcggtgctgtgtggaagaagtgtgcacgtggacttctcaagcagcgagtcacagaggagccgacatgggagcgtgctgtcttcgaacttcacctaccacacatctgatggcgatgccttgctcctcctctag

SEQ ID NO: 218070 - DNA, 324 bp, Artificial Sequence
  Description of Artificial Sequence: Synthetic coding sequence
atggctagagccgctctaagcgccgctccaagtaatcccaggctgctgcgagtagctttgctgctcctgctcctggtggccgcaggcagaagggccgcaggagcctctgtcgccaccgagttaaggtgccaatgcctgcagaccttgcaagggatacatcctaagaacatccaatctgtgaacgttaaaagtccaggcccacactgcgcacagacagaggtgatagcgacgctgaaaaacggcagaaaagcatgcttgaaccctgcctctcctatcgtcaagaagatcattgagaagatgctgaactccgataagagcaactag

SEQ ID NO: 218071 - DNA, 285 bp, Artificial Sequence
  Description of Artificial Sequence: Synthetic coding sequence
atgtctgtcaaggggatggctatcgcgctggctgttatcctctgtgcaacggtcgttcagggtttccccatgtttaagagggggaggtgcctttgcattggacctggtgtgaaagctgtgaaggtcgcagacatcgaaaaagctagtattatgtatccatcaaataactgtgataagatagaggtgataatcacactaaaagaaaataaggggcagcgatgcttgaaccccaagagcaaacaggctagactaatcatcaaaaaagtggagcgaaagaacttctag

SEQ ID NO: 218072 - DNA, 285 bp, Artificial Sequence
  Description of Artificial Sequence: Synthetic coding sequence
atgagtgtgaagggcatggcgattgctttagccgtgattttgtgcgctaccgtcgttcaggggttccccatgttcaaaagagggaggtgcctctgtatcggacccggagtcaaggcagtcaaggtggctgatatcgagaaagccagcattatgtacccatccaacaattgcgacaagatagaagttattattacattgaaagaaaacaaggggcagcgctgtctgaatccaaagagcaaacaggccagattaatcatcaaaaaggtggaacggaagaatttttag

SEQ ID NO: 218073 - DNA, 336 bp, Artificial Sequence
  Description of Artificial Sequence: Synthetic coding sequence
atgtccctgttgccaaggagggcaccacctgtttccatgcgactgctcgcggcagccttgctcctgctgctgctggcactttacactgctagggtggatggctccaaatgcaaatgttccaggaaggggcctaagattcggtacagcgatgtcaaaaagctggagatgaagcctaaatacccgcattgcgaggaaaagatggtgattattacaacaaagtctgtgtctcgatatcgcggtcaggagcactgccttcaccctaagttgcaatctacgaaaagattcattaagtggtacaacgcctggaacgagaaaagacgggtctatgaggagtag

SEQ ID NO: 218074 - DNA, 300 bp, Artificial Sequence
  Description of Artificial Sequence: Synthetic coding sequence
atgcgtttgctcgccgctgcactactgctgctgctgttggctttgtacacagccagggtggatgggtcaaaatgtaagtgtagtaggaagggacccaaaatacgctactccgacgtaaagaaactcgagatgaagcctaagtacccccactgtgaggaaaagatggttataatcactactaagagtgtgtccagatacagaggccaagagcactgtctgcacccaaagctgcaaagcaccaagagattcatcaagtggtataacgcctggaatgagaagcgtcgcgtctatgaagagtag

SEQ ID NO: 218075 - DNA, 822 bp, Artificial Sequence
  Description of Artificial Sequence: Synthetic coding sequence
atgtccggcagccaatccgaggtcgcacctagcccccagagcccccgatctcctgaaatggggagagacctgagacccggttcccgcgtgctccttctgttgctgcttctactgctggtctatctgacccaaccaggaaatggcaatgaggggtccgtgaccggcagctgctactgtgggaagcgaatcagcagtgactctccacctagtgtgcagtttatgaaccggcttaggaagcatctccgagcgtatcataggtgcctttattatactcggttccagctgttgtcgtggagtgtgtgcggaggaaacaaagatccttgggtccaggagctgatgtcctgtctggatctgaaagagtgtggccatgcatactccgggattgtggcgcaccagaaacacctcctgcctacatctccccctatcagccaggcctccgagggcgcaagctccgacatccacacaccagcccaaatgctgttatctactttgcagtcaactcagagacctaccctccctgtcggtagcctgtccagcgataaggagctgaccagacctaacgagacaacaatccacaccgccggacactctctggcagccggtccagaagccggagaaaaccagaagcagcccgaaaaaaatgctggcccaaccgcccgaacctcggccactgtacccgtgctctgcttactggcaatcatctttatactgaccgccgctctttcatacgtcctctgtaaaaggcgcagaggccagagcccccaatctagccctgacctgcccgtgcattacattccagtggctcctgacagtaacacgtag

SEQ ID NO: 218076 - DNA, 822 bp, Artificial Sequence
  Description of Artificial Sequence: Synthetic coding sequence
atgtctggcagccagagtgaggtcgctccgtcacctcagagcccgaggtctcccgaaatgggaagggacctgcgcccaggatcaagagttctgctcctccttttgctgcttctgttagtgtaccttactcagcccggaaatggaaacgagggtagtgtgacaggttcctgttattgcggaaaaagaatatcatctgactcccccccaagcgtccagtttatgaatcgactgaggaagcatctgagggcatatcataggtgtctctattacactaggttccagctgttatcttggtcagtttgtggcggaaacaaagatccatgggttcaggagctgatgtcctgcctggatctcaaggagtgcggacatgcatatagcggaatcgtggcacaccagaagcacctgctgccaaccagcccgccaatctctcaagcttctgaaggcgcttcctctgacatccatactccagctcagatgttgctcagtaccctgcaaagcacccagaggccgaccttgcctgtgggctcactctcatctgacaaagagctaacacgacccaacgagaccacgatccacacggctggacattcactggcggcaggtcctgaggcaggagagaaccagaaacaaccggaaaagaacgctggtccaacggcaaggactagcgcaaccgtccccgtgctgtgtctgctggccataatttttatcctgacagctgccctatcatatgtcttgtgtaagcgcagacgcggtcagagcccacaatcttcccctgatctgccagtccactacatcccagtggcccctgactctaacacctag

SEQ ID NO: 218077 - DNA, 360 bp, Artificial Sequence
  Description of Artificial Sequence: Synthetic coding sequence
atgaaggttcttatttcatctcttctgctattgctccccctcatgctgatgtccatggtgagctcaagcttgaaccctggagtggccaggggccaccgcgaccgcggacaggcttcccgcagatggctacaggagggcggacaggaatgcgagtgtaaggattggttcctcagggcaccacgcaggaagttcatgacagtgtccggtttgcctaaaaaacagtgcccctgcgatcattttaaaggtaacgtgaagaaaacccggcatcagcggcaccaccggaagccaaataaacactctcgggcttgccagcagtttctgaaacagtgccaactcaggtctttcgctctgcccctatag

SEQ ID NO: 218078 - DNA, 360 bp, Artificial Sequence
  Description of Artificial Sequence: Synthetic coding sequence
atgaaggttctgatcagctctcttctcctcctactgccgctgatgctcatgtcgatggtgtcctcttccctcaaccccggtgtagctcgaggacacagagatcgcggtcaggcctcacgtaggtggttgcaggaaggtggccaagagtgcgaatgcaaggattggtttttgcgcgcaccccgtagaaagtttatgacagtaagcggactccctaaaaaacagtgcccatgcgaccattttaaggggaatgtcaagaaaacccgccatcaaagacaccaccggaaacccaacaaacattcgcgggcttgtcagcagttcttgaagcagtgccaactgcgctcatttgcactgccactttag

SEQ ID NO: 218079 - DNA, 324 bp, Artificial Sequence
  Description of Artificial Sequence: Synthetic coding sequence
atggcacgggcaacattatcagctgcgccttcaaacccgagactgttgcgggtggcgctgctgttgctgcttctagtggccgcttcacgtagagcggcaggtgcgccactggccactgaactccgatgccagtgcctgcaaactctgcagggcattcatctgaaaaacatccaatctgtgaaggtaaaatctcctggaccacattgcgcccagacggaggtaattgccacgctgaagaacggccaaaaggcctgtctgaacccagcctctccaatggtgaagaagatcattgagaaaatgctgaaaaatggcaagtctaactag

SEQ ID NO: 218080 - DNA, 324 bp, Artificial Sequence
  Description of Artificial Sequence: Synthetic coding sequence
atggcccacgcaaccttgtcggctgctcccagtaacccaaggctactacgggtggcgctgcttttactgctgctcgtggctgcctcgcggagggcggctggcgcttccgtggtgacagagttgcgttgtcaatgcctgcagacactgcagggtatccacctgaagaatatccaaagtgtaaatgtcaggagccctggccctcactgcgcccagactgaggtcatagctacgttgaagaacggaaagaaggcatgccttaacccggcttcccctatggtgcagaagattatcgaaaagatattgaacaagggctctactaactag

SEQ ID NO: 218081 - DNA, 345 bp, Artificial Sequence
  Description of Artificial Sequence: Synthetic coding sequence
atgagcttgctctcctcccgcgcagctagagttccaggaccatcgagtagtctgtgtgccttactcgtgcttctcctgctactgactcagcccggtccaattgcctctgccggaccagccgctgcagtcctccgcgagctcagatgcgtctgcttgcagactacccagggcgtacatccaaagatgatttccaacctgcaggtttttgccataggtccacagtgttcgaaagtggaggtggtggcctcccttaagaatgggaaggaaatatgccttgaccccgaggctccattcttgaagaaagttatccagaagatcctcgatggaggcaacaaggagaattag

SEQ ID NO: 218082 - DNA, 1053 bp, Artificial Sequence
  Description of Artificial Sequence: Synthetic coding sequence
atgtctaacatcacagacccacagatgtgggatttcgatgatcttaattttacgggcatgccgcctgctgacgaagactactctccctgtatgttggaaaccgaaaccctaaacaaatatgttgtaatcatcgcttacgccttggtgtttctgttgagcctcctgggcaattctctggtaatgctggttattttgtattcaagggtgggacgctcagtgacagacgtttatctgctgaatctggctctcgctgacctcttgtttgccctgactctgcccatttgggccgcttcgaaggtcaacggctggatatttggaacttttctctgtaaagtggtctccttgctcaaggaagttaatttctacagtgggattctcctcctggcatgtatctcagtcgataggtacctggctatcgtacatgccacccgtaccctcactcaaaagaggcacttggtgaaatttgtatgtctcggatgctgggggctttcaatgaacctgtccttacctttctttctgttccggcaggcataccatcctaataactcttcccctgtctgttacgaagtcctggggaatgatacagccaagtggagaatggtgttacgcatcttgccccacacctttggatttatcgttccccttttcgtcatgctcttttgttacggtttcacgctgcgcactctgttcaaggcccacatgggccagaagcacagagcaatgagagtgatctttgctgtggtactgatctttctgttgtgctggctgccatacaacttggtgctgctcgccgatacgcttatgcggactcaggtaatacaggaaagctgcgaaaggcgtaacaacatcggcagggctctggacgcgacagagatccttggattcctgcatagttgtctcaaccctatcatctatgctttcattggccagaattttaggcatgggtttctcaagatcctcgccatgcacgggttagtgtccaaagaattcctcgccagacacagggtgacctcttacacctcttcatccgtaaatgttagctcaaatctatag

SEQ ID NO: 218083 - DNA, 885 bp, Artificial Sequence
  Description of Artificial Sequence: Synthetic coding sequence
atgtctaacatcactgacccacagatgtgggatttcgacgacctgaactttacaggtatgccacctgcagacgaggattactcaccctgtatgctggaaacagagacactgaacaagtacgtcgtgatcatcgcgtatgccttggtttttctcctctctcttttggggaactcactcgtgatgctggtcatattgtacagcagagtggggaggagcgtcaccgacgtgtatctcttaaaccttgccatcgtgcatgcaacaagaactctgacccagaaaaggcacctggtgaaattcgtatgcctgggatgctggggtttgtctatgaatcttagtctgccttttttcctgtttaggcaggcttatcatccaaacaactccagcccggtctgctacgaagttctaggtaacgacacggcaaaatggcgaatggtacttcggatccttcctcacaccttcggcttcattgtgcccttattcgtgatgcttttctgctacgggttcacactgagaacactcttcaaagcacatatgggccagaagcacagggctatgagggtgatcttcgctgtagtattgatcttcctcttgtgttggctgccctacaacctggtgctgctggcagataccctcatgaggactcaggtgattcaggagagttgtgagcgcaggaataatattggtagagcgctcgacgctacagaaattctcggcttcctgcattcctgcctgaatccaatcatctatgctttcatcggacaaaactttcgtcacggattcctaaagatactagccatgcacggccttgtgtctaaagagttcctcgccagacaccgggtgaccagttacacgagcagtagtgtgaacgtgtcgagcaacctctag

SEQ ID NO: 218084 - DNA, 804 bp, Artificial Sequence
  Description of Artificial Sequence: Synthetic coding sequence
atggtgctcgaggtgagcgaccatcaggttctgaatgatgcggaagtcgcagctttgttagaaaacttctcatccagttatgactacggagaaaacgaatccgatagctgctgtacctctccaccatgtccccaagacttttccctgaactttgaccgggcttttcttccggcactctacagcttactcttcctgcttggattactcggaaatggcgctgtagctgccgtcctgctgtcccggaggacagctctttcctcaacagatactttcctcctgcaccttgcggtagcagacacactgttggtgctgacactgcctctctgggccgtagatgcagcagtgcagtgggtattcggcagtgggctgtgtaaagtcgccggagctctgtttaacattaacttctacgctggggctctgctgctggcatgcatctcttttgacaggtatctgaacatcgtgcacgcaacgcaactctatcgtagaggccctcccgctagagtgactctgacgtgtctggccgtctggggcctctgcctgctctttgccctgcctgacttcattttcctaagtgcacaccatgacgaacgactgaacgccacccattgccagtataactttccacaggggtcttcttctggatctggctgcgggtgctgctcctgtgcttgggctgcgccaacaagagaagggtcacggggatctcataggctgcccgcaggcatccatccaggcctgcggcctcagagacctcctacccgtgcctgtgaggcgggtatccgagcccctctctcacccacatag

SEQ ID NO: 218085 - DNA, 1248 bp, Artificial Sequence
  Description of Artificial Sequence: Synthetic coding sequence
atggaactgcgcaaatatggccctggaaggctggcagggacggtcatcggcggagctgcacagtccaaaagccaaactaaatcagattctatcactaaagagttcctccctggcttgtacacagccccttcaagcccttttcccccttcccaggtgagcgatcaccaggtcctcaatgatgcagaagttgccgctctactagagaacttcagctcgagctatgattatggcgagaacgagtccgacagctgctgcaccagtccaccttgtcctcaggatttttccctgaactttgatagagctttcttgcctgccctctacagtctcctcttcctgctgggcctgttaggaaatggtgccgttgctgccgtgctcttgtcccgcaggaccgctctgtcaagcactgacaccttcttgctacaccttgcagttgccgacactctccttgtactcactctccccctctgggctgtcgacgctgcggtgcagtgggtgttcggcagcgggctgtgcaaagtggcaggagcactgttcaacattaatttttacgcaggcgctctactgctggcctgcattagctttgatcgatacctgaatatcgtgcacgccacacagctttaccggagaggaccgccagcgagagttacactcacctgcttggccgtttggggattatgtctgctcttcgccttacccgatttcattttcctctcagctcatcacgatgaacgccttaacgcgacccattgccaatataacttcccacaggtcggaaggactgccctgcgcgtgttacaactagttgccggatttttgttgccattacttgtgatggcatattgctacgcccatatccttgctgtcctgcttgtgtcccggggacagcgaagactcagagcgatgcgtctggtggttgtggtggtggtcgcttttgcgctgtgctggactccatatcacctggtggtcctcgttgacatccttatggatctcggagccttggctagaaattgcgggagggaatctagagtcgatgtggccaaaagcgtgacttccggcctaggatatatgcactgctgccttaaccctttgctctacgcttttgtcggggtgaagtttagggagcgtatgtggatgctgctattgcggttggggtgtcccaatcagcggggtctgcagcgccagccttcatcctcaaggagggattccagctggagcgaaacctcagaagcttcttactccggcctatag

SEQ ID NO: 218086 - DNA, 1107 bp, Artificial Sequence
  Description of Artificial Sequence: Synthetic coding sequence
atggtcctggaggtctccgatcaccaggttctgaatgacgctgaagtcgcggcactcctggaaaacttctcgtcctcctatgactatggcgagaatgagtccgattcttgttgcacttcccccccatgtccgcaggacttttctctcaatttcgacagagcgttcctgcccgctctctattccctgctgttcctactgggactgctgggcaatggcgcagtggcggctgtactgctgagccggagaacggcattatcctctactgatacattcttgcttcacctggccgtcgctgacacattactcgtccttacacttcctctttgggctgtcgacgccgcagtgcagtgggtcttcgggagcgggctttgtaaggttgcaggggctctattcaatattaatttttacgccggagccctactgctggcttgcatatcttttgaccgttaccttaacattgtgcacgctactcagttatacagaagaggccctccggcaagagtgacattgacttgcctggccgtgtggggactgtgtttgctatttgcactgcctgactttatcttcctaagcgcacaccacgatgagcgtctgaacgctactcattgtcagtacaatttcccacaagtgggcaggacagccctccgggtgctgcaacttgtcgcagggtttcttctccctctcctcgtgatggcctactgttacgctcacatcctcgccgtgctcctagtcagtagggggcagaggagactgagggccatgagactagtggtggtcgtcgtcgtggcctttgccttatgctggaccccgtaccacctggtggttctggtggacatcctgatggatctgggcgctctggcaaggaattgtgggagagagtcacgcgtcgatgtggctaagtcagtaaccagtgggctaggatatatgcattgctgtcttaacccactgctttatgctttcgtgggcgtaaaatttcgcgaacgtatgtggatgttactgctacggcttggttgtccaaatcaacgcggtctgcagcgccaaccatccagttctagacgagactcctcttggagcgagacatccgaggctagttattcggggctgtag

SEQ ID NO: 218087 - DNA, 1119 bp, Artificial Sequence
  Description of Artificial Sequence: Synthetic coding sequence
atgaattatccccttacgcttgagatggacctcgagaatctagaggatctgttttgggagctcgatcgcttggataactacaacgatacatcactggtggaaaaccacctgtgccctgccacggagggacccctcatggctagcttcaaagctgtttttgtaccggtggcctactctctgatattcctgctgggcgtcatcggcaacgtactcgtgttagtgatactcgagcgacatcgtcaaacgcgaagcagcacagagacgttcctgtttcacctggcggttgccgacctgctgctggtgtttattctcccctttgcagttgccgaaggctctgtgggttgggtcctgggcacctttttatgtaagaccgtaatcgctctgcacaaagtgaacttttattgtagtagcttgttgctcgcctgcatagcggtagatcgatacttggccatagtacacgctgttcacgcctaccgacatcggcgactgctgagcatccatattacctgcggcacgatttggctggtgggcttccttctggctctgcccgaaatcctcttcgccaaggtctctcagggccatcacaataatagtctgccacggtgcactttttcacaggaaaaccaggccgagacccacgcgtggttcacctcaagatttttataccacgtggcgggattcttacttccaatgctcgtgatggggtggtgctacgttggagtcgtccaccggctccgtcaggcacagaggcgaccacaaagacagaaggcagtgcgggtggcaattctggtgacatcgatctttttcctgtgctggtctccttaccacatcgtcatcttcttggatactctcgctcggctcaaggccgtcgacaacacctgcaaattgaatggtagtcttcccgttgcaattacgatgtgcgagtttctgggtttagctcattgctgcctcaatcccatgctttatacatttgctggcgtgaaattcaggagcgatctgagcaggctgttaactaagttgggttgcaccgggccagcatctttgtgtcagttatttccctcgtggagaagaagtagtctgagcgaatctgagaacgctactagcctgaccaccttctag

SEQ ID NO: 218088 - DNA, 1029 bp, Artificial Sequence
  Description of Artificial Sequence: Synthetic coding sequence
atggcagaacacgattatcacgaggattatgggttctccagcttcaacgactcgtcacaggaggagcatcaagattttctgcaattctccaaagttttcctgccttgcatgtacctcgttgtatttgtgtgcggtctcgtgggaaactcattagtgctagtcatttctatcttttaccataagctgcaaagcctcacggacgtgttcctcgtcaatctccccctggcagatttagtttttgtgtgcacgttgcctttctgggcctatgccggaatccacgagtgggtcttcgggcaagtcatgtgcaagtctttgttaggcatctacactattaatttctacacttctatgctgattctcacttgcattaccgtcgatcggttcatcgtggtggtgaaagccactaaggcttacaaccaacaggccaagcgcatgacttgggggaaggtgacttccctgttgatctgggttataagtctgcttgttagtctgccccagataatctatgggaatgtgttcaatctggacaaactgatctgcgggtatcatgacgaagcaatctcgacagtcgtattggccacccaaatgacactgggattcttcctcccgctgctcaccatgatcgtgtgctacagcgtcatcattaagacactgttacacgccggaggattccagaaacacagatcactcaagattattttcctcgtcatggccgtgtttctgttgacccagatgccgtttaacttgatgaagtttataagatctactcactgggaatattatgcaatgacatccttccactataccattatggtcaccgaagctatcgcttatctgcgggcatgtcttaatcccgtattgtacgccttcgtgtccctcaagtttcggaagaatttttggaagttggtgaaggatatagggtgccttccataccttggcgtgagccatcagtggaaatcgtccgaagacaacagtaagactttttcagcaagccacaacgtagaagctacttcaatgtttcaactgtag

SEQ ID NO: 218089 - DNA, 1029 bp, Artificial Sequence
  Description of Artificial Sequence: Synthetic coding sequence
atggctgaacatgattaccacgaggattacggctttagctctttcaatgattctagccaagaagaacaccaagatttcctgcagttctcaaaggtgttcctcccttgcatgtacttagtggtgttcgtgtgtgggttagtgggcaatagtctggttctagtgatatctattttttatcacaagctccaatccctgacagacgtgttcctggttaacttgccactggctgacttagttttcgtatgcacattaccgttttgggcatacgccggtattcatgagtgggtcttcggccaagttatgtgcaagtcattgctgggcatctacactattaacttctatacctctatgttaatccttacctgcattaccgtcgataggttcattgtggtggtgaaagctacaaaagcctacaaccagcaagccaagcgcatgacttggggtaaggtgacaagcctactgatttgggtaattagcctgctggtgtcgctcccacagatcatatatggtaatgtgttcaatctcgataaactgatctgtggataccacgatgaggcgatatctaccgtcgtgctcgcaacccaaatgaccctggggttttttctgcccttgttaactatgattgtctgttattcggtcatcattaagaccttgttacatgcgggaggatttcagaagcatagatcgctgaagattattttcctggttatggccgtatttctgctaactcagatgccttttaatctcatgaagtttatccgatctacccactgggagtactacgccatgacctcctttcactacactattatggtcactgaggccattgcatatcttcgtgcttgcctgaaccccgtgctttatgcctttgtcagcctcaaattcagaaaaaatttctggaagttggtcaaagatatcggctgcttaccctacctgggcgtgtcacaccagtggaagtcctccgaagacaatagcaaaacattttccgcctcccacaatgtggaggccacatctatgtttcagctgtag

SEQ ID NO: 218090 - DNA, 1029 bp, Artificial Sequence
  Description of Artificial Sequence: Synthetic coding sequence
atggctgagcacgactaccacgaggactatggcttcagcagtttcaatgactcaagccaggaagagcaccaggacttcttgcaatttagtaaagtcttcctgccttgtatgtacctggtcgtgtttgtgtgcgggctcgtaggtaacagcttggtgctggtgatatccattttctaccacaaattgcagagtctgacagatgtgtttcttgtgaaccttccactggccgacctggttttcgtgtgcaccctccctttctgggcttatgccggaattcatgagtgggtgtttggacaggtgatgtgcaaaagtttactgggaatttataccataaatttctacacctccatgcttatactaacttgcatcactgtggatagattcattgtggtggtcaaagccacaaaggcctataaccagcaggcaaagcgcatgacctggggaaaagtcacttccctgctcatctgggtgatctcacttctagtgagtctgccgcaaatcatctacggtaacgtgttcaacttagataagctcatttgtggataccacgatgaagctatttccaccgtggtgctggctacgcagatgaccttaggattcttcctcccactgctgacaatgatagtttgctatagtgtcatcattaagactttactccacgccggaggctttcagaaacacagaagccttaagataatcttcttggtaatggcggtgtttctcctgacgcagatgccgttcaatctgatgaagttcatacgcagcacccattgggagtattacgccatgacctccttccattacaccattatggtgactgaggcgatcgcatatctgagggcctgtctgaaccctgtactgtacgcttttgtgtccctgaaattccgaaaaaacttttggaaattggtgaaggacattggctgtctgccttatctcggggtatcccaccagtggaagagcagcgaagacaactctaaaactttcagcgcttcacacaatgtcgaggcaacctctatgtttcagctctag

SEQ ID NO: 218091 - DNA, 1029 bp, Artificial Sequence
  Description of Artificial Sequence: Synthetic coding sequence
atggccgagcacgactaccatgaagattatggcttttcttcctttaatgactccagccaggaggaacaccaggacttccttcagttcagcaaggtgtttctgccttgcatgtaccttgtggtgtttgtgtgcggcctagtaggcaattccttggtactggtgatttcaatattttaccataagctacagagcctgacagatgtgtttctggttaatctacccctggccgacctggtcttcgtgtgtacactgcccttttgggcctatgctggaatccatgaatgggtctttggacaagtgatgtgtaaaagcctgttgggcatttacaccatcaatttctatacctctatgctcattctgacttgcatcacagtagatagattcatcgtggtggtgaaggctaccaaggcctataatcagcaggccaaaagaatgacttgggggaaggtgacctccctgctgatctgggtgatttccttgctggtgtcgttaccgcaaatcatctatggaaatgtgtttaaccttgacaaattaatatgcggctatcatgacgaggcaatctcgacagtggtgcttgccacccagatgactctgggcttcttcctgcccctgctcaccatgatcgtttgctacagcgtcatcataaagaccctgcttcatgcgggtgggtttcagaaacacaggtccctgaagatcattttcctagtgatggccgtgttcttacttacccagatgccattcaacttgatgaagttcattcggtccacccactgggagtattacgctatgacaagctttcattatacaatcatggtgaccgaggcaatcgcttaccttcgcgcttgtcttaaccctgtcctgtacgcgtttgtcagcttgaaattccggaagaacttctggaaactggtgaaggacataggctgccttccctatctcggggtcagtcaccaatggaagtcgtccgaagacaactccaagactttcagcgcatctcataacgttgaggctacatccatgtttcagctgtag

SEQ ID NO: 218092 - DNA, 1089 bp, Artificial Sequence
  Description of Artificial Sequence: Synthetic coding sequence
atggatctccatctatttgactattcagagccgggtaacttctctgatattagctggccctgcaattcctccgattgtattgtagtggacactgttatgtgccctaatatgcccaacaagtctgtcctgctatacactctgtcattcatttatatattcatattcgtgattggaatgattgcaaatagcgttgtagtctgggtcaatattcaggcaaagaccacggggtacgacacacattgttacattcttaatttggcaattgcagacctatgggtggtgctgaccatccctgtgtgggtggtaagcctcgttcaacataatcagtggcctatgggtgaactgacgtgtaaggtaacccatctaatattttccataaatctcttcgggtccatattcttccttacatgtatgtcagtggatcgctatctatctattacatactttacaaacacgcccagctcgaggaagaaaatggtgaggcgagtggtctgcattttagtttggcttctcgctttctgcgtgtctttacccgacacgtactatctgaagaccgttactagtgcctcgaacaacgaaacttactgccgctcgttctatcccgagcactctattaaggaatggttaatcgggatggagcttgtttctgtcgtccttgggttcgctgtccccttttcaattatcgctgtcttttatttccttctcgctagagcaatttctgcctcttccgatcaggaaaagcatagctctcggaagatcatattctcttacgtagtggttttcctggtctgttggctgccatatcacgtcgcagtattactagacattttttcgatcctacactatatcccttttacttgtcgactggaacatgccctctttactgccctccacgttacccagtgcctgagcttggtgcactgttgtgtgaaccctgtcctgtatagttttattaaccgcaattatcggtacgagctcatgaaggcctttatcttcaagtacagcgccaagacaggcttaacgaagcttattgacgcctccagggtatcagagaccgaatacagcgctcttgaacaatccaccaagtag

SEQ ID NO: 218093 - DNA, 636 bp, Artificial Sequence
  Description of Artificial Sequence: Synthetic coding sequence
atggacctgcaccttttcgattattccgagcctggcaacttctctgacatttcatggccatgcaattcaagcgactgtattgtggtcgatactgtgatgtgccccaatatgccgaacaaaagtgtcctgttgtacaccctgtcgttcatctatatcttcatctttgtgatcgggatgatagccaactccgtggtggtgtgggttaacatccaggccaagactacaggctacgacacacactgctatatcctgaacctggcgatcgcagacttgtgggtcgtgctgactatcccggtgtgggtggtgagccttgtgcagcacaaccagtggcctatgggggaattaacgtgtaaggtgactcatctcattttttccatcaacctcttcggatccatctttttccttacctgcatgtctgtggacaggtacttatccataacttattttaccaatactccgtcaagtcgtaagaagatggtgcgccgtgtggtctgtatccttgtgtggttgctggccttttgtgtttctctgcctgatacatattatttaaaaaccgtcacctctgcgtccaacaatgaaacttactgccgcagtttctatcctgaacattccatcaaggagtggttgatcgggtag

SEQ ID NO: 218094 - DNA, 1155 bp, Artificial Sequence
  Description of Artificial Sequence: Synthetic coding sequence
atggccgctacagcctcccctcagccactcgcaaccgaggatgctgactctgagaactctagtttttattactatgattaccttgacgaggtagcctttatgctttgccggaaagatgctgtcgtgtctttcggcaaggtctttctccccgtattctatagtctgatctttgtcctgggcctgagcgggaatttgctcttactcatggtactcttgcgctacgtccccaggcgtcggatggtcgagatataccttcttaacttagctattagtaacctgctgttcttagtaacgctgccgttctggggcatctctgtagcctggcattgggtttttggtagcttcctgtgtaaaatggtaagtactttgtacacgataaatttctactctggtatctttttcatctcatgcatgtcactggataaataccttgagatcgttcatgcacaaccctaccatagattgagaacaagagctaaatccctgcttctggccaccattgtgtgggccgtaagtctggctgtgagtattccagatatggtttttgtgcagactcacgagaacccaaaaggggtttggaattgtcatgcagactttggcggtcatgggactatttggaagctgttcttgcgtttccaacagaatctgctgggtttcctgctgcccttgctggctatgatattcttttactcacggatcggttgtgtccttgttcgactccgaccggctgggcagggccgtgcgttgaagatagccgcagcgctggtcgtcgcctttttcgtactctggtttccatacaacctgactctgtttttgcacactttactcgacttgcaggtgtttggcaactgcgaggtgagccagcacctcgactacgcactccaggtgactgagagcatcgctttcctgcactgttgcttttcaccaattctgtatgctttctcttcccatagattccgtcaatacctcaaggcattcctagcagcagtgcttggctggcatctggctcccggtactgcacaggcttctctttcttcatgcagcgaatctagcattttgaccgcccaagaagagatgaccggtatgaatgatctgggcgagaggcagagtgaaaattaccctaataaagaggatgtcgggaacaaatccgcttag

SEQ ID NO: 218095 - DNA, 1155 bp, Artificial Sequence
  Description of Artificial Sequence: Synthetic coding sequence
atggctgccactgcttctcctcagcccttagccaccgaagacgccgactctgaaaatagctccttctactactacgattacttggatgaggtagccttcatgctctgccggaaagatgccgttgtcagcttcggaaaagtttttttacctgtcttttactcactgatcttcgtgctgggcctctcaggaaatctacttttgctcatggtcttacttcgatacgtcccccgacgacggatggtggaaatctatctgctcaatctggcgatctccaacctgttgttcttagtcaccctgccattctggggaattagtgttgcctggcactgggtatttggatccttcctgtgcaagatggtgtccacactttacactattaacttttacagcggtatcttttttatatcttgtatgagtcttgataaatatctggagatcgtgcacgcacagccctaccacaggttgaggacccgggcaaaatcattgctactcgcgacaattgtttgggcagtgtctctggctgtatcaatacctgatatggtttttgtccaaactcacgaaaatcccaaaggcgtatggaattgccacgctgacttcgggggacacggcaccatatggaagttatttctgagattccagcagaaccttctgggtttcctgctccccctcctggccatgatatttttctattctaggatcggatgcgtgcttgtgcgactgcgtccagcaggtcagggtagggccctgaaaatcgccgcagcactggtggttgcctttttcgtattatggtttccttataacctcactttatttctacacactctgctcgacctgcaggtgtttgggaactgtgaagtgtcgcagcatctcgactacgcactgcaggtcaccgaaagcatcgcgttcctacattgttgcttttctccaatcctgtatgctttctctagccaccgctttcggcagtatctcaaggcctttctggccgctgtgctcgggtggcacttagcccctgggacagcccaggcctccctgagcagttgtagtgagtcgtcaattctaactgcgcaagaggaaatgaccggtatgaatgacctgggcgagcgtcagtcagaaaactaccccaataaggaggacgtgggtaacaaatctgcctag

SEQ ID NO: 218096 - DNA, 1155 bp, Artificial Sequence
  Description of Artificial Sequence: Synthetic coding sequence
atggctgcgactgcatcaccacaaccgctcgccacagaggatgctgacagtgagaacagttccttttattactatgactatttagacgaagtggcgtttatgttgtgtaggaaggatgccgtcgtgtctttcggtaaagtcttcctgcctgtcttctatagcctgatttttgtgttgggtctctctggcaatctcctgctgcttatggtcttgctaagatatgtccctcgacgcagaatggtggagatctatttacttaatctggccatatcaaatctactttttcttgtgactctcccattctggggcattagcgttgcctggcattgggtgtttgggagcttcctgtgtaagatggtttcaactctatatacaattaatttctactctggtatttttttcataagttgcatgtccttggacaagtacctcgaaattgtccacgctcaaccatatcatcgactgagaacccgggctaaatcactccttcttgccacaattgtgtgggctgttagcctggcggtgtcgattccggacatggtctttgtgcagacccacgaaaatcccaagggagtttggaactgtcacgctgactttggaggccacggaacaatctggaagctctttctaagatttcagcagaacttgctcggttttttgctgccgcttctggccatgatcttcttttacagtcgcattggttgcgttctagtgcgcttgagacctgccggtcaaggcagggcactgaaaatcgctgcggcactggtggtggcgttcttcgtcctgtggttcccttataatttgactctatttctccatactctcctggaccttcaggtgttcggcaactgtgaggtgtctcaacatctggattacgcgctccaagtcacagaaagcatcgccttcctgcattgttgcttttccccgattctgtacgccttctcctcacaccggtttaggcagtacctcaaggccttccttgcagctgtgcttggatggcatttagcgcctggaactgcacaggcgtccctcagcagctgcagcgaatcctccatcttgaccgcccaggaggagatgacggggatgaacgacctgggtgagcgccagtccgaaaactaccctaataaggaggacgtaggaaataagtcagcatag

SEQ ID NO: 218097 - DNA, 1122 bp, Artificial Sequence
  Description of Artificial Sequence: Synthetic coding sequence
atgcggatggaagacgaagactacaacacctctatctcgtatggcgatgagtacccggactacttggactctattgtagtgcttgaagacctctctcccctcgaagcgagagtaacccggatcttccttgtcgtcgtgtattcaatcgtttgcttcctggggatactgggcaacggccttgttattatcattgcgacctttaagatgaagaaaacagtcaacatggtctggtttttgaacctggctgttgctgatttcctctttaatgtcttcctgcccattcacatcacatatgccgcaatggactaccactgggtcttcggcaccgcaatgtgcaagatatctaactttctcctcattcacaacatgtttacaagtgtgtttctgctgacaataatcagctccgaccgatgcatcagcgtgctgttgcctgtgtggagccagaatcaccgaagcgtgagacttgcatacatggcatgcatggtgatctgggtgctcgctttctttcttagtagccccagtctggtgttccgagacaccgcaaatctgcatggtaagattagttgctttaacaatttcagtctctcaacaccagggtcaagttcctggccaactcactcccagatggaccccgtgggttattccaggcatatggtcgtgactgtgactaggttcttatgcggtttccttgtgcccgtacttataattactgcctgctatctcaccatcgtatgtaagttacagagaaacaggctggccaaaactaagaaacccttcaaaattatcgtgactattattattaccttcttcctgtgttggtgcccttatcatacgctcaatctcctggagctccatcacacagcaatgcccggaagtgtctttagcctcggtctccccctggccacagccttggcaattgctaactcctgcatgaatccaatactttatgtctttatgggccaggacttcaaaaaatttaaagtggctcttttcagccggttggtcaatgccctgagtgaagatacagggcatagctcttacccatcccataggagttttaccaagatgagctctatgaatgaacgcactagcatgaatgagcgggaaactggtatgttgtag

SEQ ID NO: 218098 - DNA, 1116 bp, Artificial Sequence
  Description of Artificial Sequence: Synthetic coding sequence
atggaagacgaagattacaatacaagcatctcgtacggggatgaataccccgactatcttgatagtattgtagtgctggaggatctgtcaccactcgaagctagagtgactaggatatttctggtggtagtgtatagcattgtatgctttctggggattctgggcaacgggttggtgattattatcgccaccttcaagatgaagaaaaccgttaatatggtctggtttctgaacctggctgtcgctgacttcctgtttaatgtgttcttgccgattcacatcacgtatgcggcaatggactatcactgggtttttggaaccgcaatgtgtaaaatctccaattttcttttaatccataatatgtttaccagtgtgtttttacttacaatcatttcttctgaccggtgtatatccgtgcttttacccgtctggtcccagaaccataggtcagttcgccttgcatacatggcatgtatggttatctgggtgctcgctttcttcctgtcgagcccttctctggtgttcagagacactgcaaacctccatgggaagataagctgctttaataattttagtctgtcgactcccggtagctcgagctggcccacacactctcagatggaccctgtgggatattcccggcatatggtcgtgactgttacaagatttctctgcggcttcctcgtcccggtgctgattatcacagcgtgttatctgacaatcgtgtgtaagctgcagcggaacagactcgctaaaacaaagaaaccgtttaagattatcgttacgatcataatcacattctttctgtgttggtgcccataccataccctgaaccttttagagctacatcacactgcgatgcctggttctgtgttcagcctagggctgcctctcgccactgccctggctattgctaactcatgtatgaatcctattttgtacgtgtttatggggcaggactttaagaagtttaaagtcgccctgttcagtcggctcgtaaatgccctctctgaggacacagggcatagttcctatcccagccacagatcattcactaagatgtcgtccatgaatgaaagaacctcgatgaacgaacgcgagacgggcatgctgtag

SEQ ID NO: 218099 - DNA, 1122 bp, Artificial Sequence
  Description of Artificial Sequence: Synthetic coding sequence
atgcgaatggaagatgaggattacaatacaagcatatcatacggagacgaatatccagattacctggactcgatcgtggtgcttgaggacttatcacctctggaagctagggtgacaaggatatttcttgtcgtggtatattcaattgtctgctttcttgggatcctgggcaatggtttggtgattatcatagctacgtttaagatgaaaaagactgttaacatggtgtggtttctaaatctggccgtcgcagatttcctgttcaacgtgttcttacccatccacatcacgtatgcagccatggactaccactgggtgtttggaactgcgatgtgtaagatttcaaacttccttctcattcataacatgttcacaagcgtgtttcttctgactatcatatctagtgaccgctgtatctctgtgctgctgcccgtctggtctcagaaccacagaagcgtgagattggcttacatggcatgcatggtgatctgggtactggccttctttttaagctccccatctttagtgttcagagacaccgccaacctgcacggcaagatctcatgtttcaacaatttctctctgagcacgccgggtagctcctcatggcctactcattcccagatggatcccgtgggttacagtcggcacatggtggttaccgtaactcggttcctctgtggcttcttggtaccagttcttataattaccgcctgttacttgactatcgtgtgtaagctgcagagaaatagattggccaaaacgaagaagccctttaaaatcatcgtgacgatcataatcacctttttcctttgctggtgtccatatcatacattgaatctgctcgagctacaccacactgcaatgcccggaagcgtcttcagcctgggcctgcccttggctactgccctagcaattgcaaacagttgcatgaaccccatattgtacgtgtttatggggcaagatttcaagaagttcaaagtggctctgttcagccgactagtgaatgccctatccgaagacaccggtcactccagctaccctagccaccgtagcttcaccaagatgtcctcgatgaatgagagaacttctatgaatgagagggaaacagggatgctatag

SEQ ID NO: 218100 - DNA, 432 bp, Artificial Sequence
  Description of Artificial Sequence: Synthetic coding sequence
atgagaatggaagacgaggattataacacttctatcagttatggcgacgagtaccccgattatctggattccattgtcgttcttgaggatctgagtccgttggaagcccgagtcactaggatattcctcgtcgtggtgtactctattgtatgttttctcgggatcctcgggaacggactggtgatcataatcgccacattcaaaatgaagaagaccgtaaacatggtatggttccttaatcttgcagtggcagacttccttttcaacgtgtttctccctatccacatcacatatgccgctatggattatcactgggtattcggaaccgccatgtgcaagatcagcaacttcctgctgattcacaacatgtttaccagtgtgtttctgctgaccataattagtagcgacagatgtattagtgtgctgctctag

SEQ ID NO: 218101 - DNA, 1122 bp, Artificial Sequence
  Description of Artificial Sequence: Synthetic coding sequence
atgcgcatggaggacgaggactacaacacgtctattagctatggggacgagtatcccgattacctggactctatcgtggttctggaagacctttcacctctagaggccagagtgaccaggatttttctggtggtggtttactcaattgtctgtttcctcggcattctggggaatggcctggtaataatcattgcaacctttaagatgaagaagacagtgaatatggtctggtttctgaatttggcagtcgctgacttcctttttaatgtatttctgcccatacacattacctacgcagcgatggactaccattgggtgttcggaacagcaatgtgcaaaattagcaattttctgcttatccacaatatgttcacatccgtcttcttgctgacgatcatcagtagcgatcgctgcatcagcgtgcttctgcctgtgtggtcacagaatcacagaagcgttcgcctggcctatatggcctgcatggtgatatgggttttggcctttttcctatccagcccctcgttggtgtttagggataccgctaacttgcacgggaaaatttcttgcttcaacaatttctccctgagcacccctgggtcttcgtcctggcccacacacagccagatggaccctgtgggctacagccgtcatatggttgtgaccgtcacccgcttcctgtgtggatttctggtacccgttctgatcatcactgcctgttatcttaccattgtctgcaaattacagcgaaataggctcgcaaagacgaagaagccatttaagatcatcgtcaccatcattatcacatttttcctctgctggtgcccgtaccatacactcaatttgctggaactccaccacaccgctatgcccggaagtgtgttctcccttggtttacccttagccacagccctagccattgctaacagttgtatgaatccaattctgtatgtcttcatggggcaggacttcaaaaaatttaaggtcgcacttttcagtaggttggttaatgctctttctgaagacactggacattcttcttatccttcccaccgctccttcacaaaaatgagcagcatgaatgaaaggaccagcatgaacgagcgcgagaccgggatgttatag

SEQ ID NO: 218102 - DNA, 444 bp, Artificial Sequence
  Description of Artificial Sequence: Synthetic coding sequence
atgcggatggaggatgaagattacaatacttcaattagctacggggacgagtatcccgattatctggacagtattgtcgtgctcgaggacctgagcccgttagaggctagggtaacccgaatttttctggtggtggtctactctattgtatgtttcttgggcattctgggaaacgggcttgtgattatcatcgcgacatttaagatgaagaagactgtaaacatggtctggttcctcaacctggcggtggctgatttcctgttcaatgtatttctgcctatccacatcacatacgccgctatggattatcattgggtattcgggacagctatgtgcaagatctcaaacttcttgttgatccataacatgttcacctcagtgtttctactcaccatcatctcctcagatagatgtatttcagtactgctgcccgtctggtcctag

SEQ ID NO: 218103 - DNA, 1116 bp, Artificial Sequence
  Description of Artificial Sequence: Synthetic coding sequence
atggaggatgaggactacaatactagtatctcttatggggacgagtaccctgactatctggactcaattgtggttctcgaggacttatctccactagaagcgagggtcaccagaatattccttgtggtggtatactccatagtgtgtttcctcggaatcctggggaatggcctcgtcataatcattgccacgttcaagatgaagaagacagttaacatggtgtggttcctgaatctggctgtcgccgacttcttattcaatgtattcctgcctatccacatcacatacgctgcaatggattaccactgggtattcggtactgcaatgtgcaagatcagcaactttttgttgatccacaatatgttcaccagcgtgtttctgctcacaatcatatcgtctgaccgctgcatttcagttctgcttcctgtgtggagccaaaatcaccgaagtgtgaggctggcctatatggcatgtatggttatttgggtccttgccttctttctgagctccccatcgctggtcttccgcgacactgccaatctgcacggaaaaattagttgcttcaacaacttctcactttcaaccccaggctcttctagctggcccacacatagccagatggatcctgtgggatattccaggcacatggttgttaccgtcacgagatttctgtgcggctttctggtgcctgtgttaataatcaccgcgtgctacctgaccatcgtgtgtaagctgcagcgtaacagactagcaaaaactaagaaaccctttaaaatcatcgtcacaattatcatcactttcttcctgtgctggtgtccttaccacacgcttaatctgttagaactgcaccatacagcgatgcctggctccgtcttcagcctcggacttcctctggctaccgctctggcaatagccaatagttgtatgaatcccatattgtatgtctttatgggtcaggacttcaagaaattcaaggtggctctgttcagcaggttggtcaacgccctctccgaagatacagggcattcatcttaccccagtcatcggtcattcacgaagatgtccagtatgaatgagcggacctcaatgaatgagcgggagacgggaatgttatag

SEQ ID NO: 218104 - DNA, 1005 bp, Artificial Sequence
  Description of Artificial Sequence: Synthetic coding sequence
atgccttcaaaggaatcctggtctgggaggaagacaaaccgtgccgcagttcataaatcaaagcaggaaggcagacagcaggatctgctaattgctgcactgggaatgaaacttggcagccccaaaagctccgtgacgatatggcagccactgaagctattcgcctacagccagctgacaagcctcgtgcgacgtgctaccctgaaagaaaatgaacaaatccctaagtacgaaaaaatccacaactttaaggtgcacacatttagaggcccacactggtgcgagtactgtgctaactttatgtggggtcttatcgcccaaggggtcaaatgtgcggattgcggtctgaatgttcataagcagtgcagcaagatggtgccgaatgattgtaaacctgatctgaaacatgtgaagaaagtttattcctgcgatcttactaccctggtaaaggcccacactaccaagcggcctatggtggttgatatgtgtattcgggagatagaatctagaggacttaatagcgaaggcctttacagagtttcaggtttctccgatctgatcgaagacgttaaaatggcctttgatcgcgacggtgagaaggcagacatctctgtcaatatgtatgaggatatcaacattatcaccggcgcactgaagctgtatttccgggacctccctattcctcttataacatatgacgcttatcctaagttcatcgaatctgcgaagatcatggacccagacgagcaactggagaccctacacgaagcactgaagctgcttcctcccgctcactgtgagaccttgagatatctaatggctcacttgaagagggtgactctgcacgagaaggagaaccttatgaatgcagaaaatttgggcatcgtgtttggtcctaccttgatgcgttccccggagctcgacgcaatggcagctctcaacgatatccgctaccagcggctggtcgttgagttgttaatcaaaaatgaggacatactgttttag

SEQ ID NO: 218105 - DNA, 1302 bp, Artificial Sequence
  Description of Artificial Sequence: Synthetic coding sequence
atggcattaaccctttttgataccgacgaatatcgccctccagtgtggaagagttacctgtaccagctgcaacaggaggctcctcatcctcggagaataacgtgcacctgcgaagtcgagaacagaccgaagtattatggcagagagtttcatgggatgatatctcgtgaagcagcagaccaacttctgatcgtggccgaagggtcatatctcattagagaatcacagaggcagcccggtacttataccctggctctgcgtttcggcagccagacgaggaattttcgcctctattatgatggcaagcacttcgtgggcgaaaagaggtttgagtctatccacgatctcgtgactgatggcctaattaccctctatatagagacaaaggcagccgaatacatcgctaagatgactatcaaccccatttatgaacatgtgggctacactaccttgaacagagagcccgcatataagaagcacatgcctgtgctcaaagagactcacgacgaaagggacagtaccgggcaggacggcgtatcagagaaacgggtgcataccttcagaggccctcactggtgcgagtactgcgccaatttcatgtgggggctgatcgcccaaggcgttaaatgcgcagactgtggcctcaacgtgcacaagcagtgtagcaagatggtgcctaacgattgtaagcctgacctgaaacatgtgaagaaagtgtactcttgcgatttgacaaccctggtgaaagcccacactacgaagcgacctatggtggtcgatatgtgtataagagaaattgagtctaggggactcaatagtgagggactgtaccgcgtttctggcttttctgatttgatcgaagatgtcaagatggcatttgatagagatggcgaaaaggcagatatttcggtgaacatgtatgaagacatcaacatcatcaccggcgcactgaaactctacttcagagaccttccaattcccctgattacatacgacgcctatcctaagttcatagagagtgccaaaatcatggatcccgacgaacagctggagaccctgcacgaagcattgaagcttttacctcctgcccattgtgagacactgcgctatctaatggcccacctcaagagagtcaccttacacgagaaggagaatttgatgaacgccgagaacctcggcattgttttcggcccaacgctaatgagaagccctgagcttgacgcgatggccgcactaaacgacatcaggtatcaaaggctggtggtcgaactgttgatcaagaacgaggacattctgttttag

SEQ ID NO: 218106 - DNA, 1380 bp, Artificial Sequence
  Description of Artificial Sequence: Synthetic coding sequence
atggcgctcacgctgtttgacaccgatgaatatagacctcctgtttggaagtcctacctgtaccagttacagcaggaggccccacatcctcgtcgcattacttgtacgtgtgaggtagaaaatcgtcccaaatactacggtcgagagtttcacgggatgatttcccgagaggccgctgaccaacttctgattgtcgctgaaggaagctatctcatccgagagagccaacgccaacccggaacctacactttggcacttaggttcggcagccagacaagaaacttccgcctgtactatgacggaaaacatttcgtgggggagaagcgcttcgaatctattcacgacctggtgactgatggcttaattacactctacattgaaaccaaggccgcagaatatattgcaaaaatgaccataaatcccatatatgaacatgtaggttacaccactctgaatcgagagcccgcttacaagaagcatatgcccgttttgaaggaaacacacgatgagagggacagtacaggtcaggatggcgtttccgagaagagactgactagtctggtccgccgagccaccctgaaggagaacgaacagatcccaaagtatgaaaagattcacaattttaaggtgcataccttccgcggtcctcactggtgtgagtactgcgcgaactttatgtggggtcttatcgctcagggggtaaagtgtgccgactgcgggctgaatgtacataaacagtgctccaaaatggtgccgaacgattgcaagcccgacctgaaacacgttaaaaaagtgtactcttgtgacctgacaactctcgtcaaagctcacaccactaaacgcccaatggttgtggatatgtgtatcagggagattgagtccaggggcttaaacagcgaagggctgtatagggtgtcgggttttagcgacctaatcgaggacgtgaagatggccttcgatcgggatggggagaaagctgacatctcagtaaatatgtacgaagacatcaacattattaccggtgcgttgaaactctatttccgcgatttacccatccccctaatcacatacgacgcttacccaaagttcatcgagtccgccaaaatcatggaccccgacgaacagctggagacccttcatgaagccctcaaattactcccaccggctcactgtgaaactctgagatacctgatggcccatctcaaaagggtcacccttcacgagaaggaaaatcttatgaacgccgagaacctgggaattgtgttcggtcctaccctcatgcggagccctgagctggatgcaatggcagctctgaacgacatcagataccagagactggtggtagaattgctcattaaaaatgaagacattctgttttag

SEQ ID NO: 218107 - DNA, 1167 bp, Artificial Sequence
  Description of Artificial Sequence: Synthetic coding sequence
atgaccgctagcgtcctcttgcaccctcggtggattgagcctacagtcatgttcctctatgacaacggaggcggattggtggctgacgagcttaacaagaacatggagggggcagccgctgccgcagcggcagcggctgccgctgctgctgcaggggcaggtgggggtgggttcccacaccccgctgccgctgcagccggtggcaatttttccgttgcggctgctgctgcagccgcagcggctgctgctgccaaccaatgtaggaaccttatggcccatccggctccgctggctcccggagctgcatcagcttattctagtgcccctggagaagctcccccaagcgcggctgctgccgcagctgcagcagccgcagctgctgccgctgcggcagcggctagtagtagtggcggacccggaccagccggtccagcaggcgctgaagcagccaaacagtgtagtccttgctcagcggcagcacagtcctcttcgggtccagccgctttgccctatggttacttcgggtctggctattacccctgcgctaggatgggtcctcacccgaacgctatcaaatcctgcgcccagccagcctctgctgccgcagcggcagccttcgcggacaagtatatggatactgccggacccgcagccgaggagttctctagccgagcaaaggaatttgcattttatcaccaggggtatgctgctgggccttaccatcatcaccagcctatgccaggctatcttgacatgcccgtcgtgccagggcttgggggtcccggagagtcgcgtcacgagcctctgggcctgcccatggaatcctatcaaccttgggctttaccaaacggttggaacggccagatgtattgtcccaaggaacaggcgcaacctccccatttatggaagagcacactgcctgacgttgtgtcccacccaagcgatgcctcttcctatcgccgtgggcgtaagaagagagtaccttacaccaaggtgcaactaaaagaactggagagggaatatgctactaacaagttcatcacgaaggacaaaaggaggagaatttctgctactacaaatctgagtgagaggcaggtcacaatatggtttcagaaccggagggtgaaggagaaaaaggtcatcaataaactcaaaactacatcatag

SEQ ID NO: 218108 - DNA, 999 bp, Artificial Sequence
  Description of Artificial Sequence: Synthetic coding sequence
atgttctcggaagagctctggttagagaacgaaaagaaatgtgctgtggttaggaaaagtaaacagggtagaaagagacaggaactgttggccgtggctttcggggtgaaggtcggcgtgaaagggggatttctgtggccacccttaaagcttttcgcttgcagccagatctcgtcccttgtgaggcgagcggcactgacacataatgacaatcactttaactatgaaaagactcacaatttcaaagtgcacacttttcgaggccctcattggtgtgagtattgtgcaaactttatgtggggtctgattgcgcagggagtgagatgtagtgactgcggcctcaacgtgcataagcagtgctccaagcacgtgccaaacgactgccagcccgacttgaaacggataaagaaggtctattgctgcgatttaactactttagtgaaggcacataatacgcaacgccctatggtggtagacatctgtattcgtgaaatcgaggccagaggattgaaatccgagggactatacagagtgtccggcttcacagagcacatagaggatgtcaaaatggcatttgaccgggatggggaaaaagccgatattagtgcaaacgtgtaccccgatattaatataatcacaggggcacttaagctttatttccgtgatctccccattccagttatcacctacgacacgtactcgaaatttatagacgcagccaaaatttcgaacgctgatgagaggctggaagccgtacacgaggtgctcatgctgctgccccctgctcattacgagacgctccggtatttaatgatccacctaaagaaggttactatgaatgagaaagacaactttatgaatgccgagaacctcggcatcgttttcggtccgaccctgatgcgcccacccgaggactccaccctgaccactttgcacgacatgcgttaccagaaattaatcgtgcagatcctgatcgagaacgaggacgtgcttttctag

SEQ ID NO: 218109 - DNA, 525 bp, Artificial Sequence
  Description of Artificial Sequence: Synthetic coding sequence
atggccgcttccagcaattcctctctcagcggcagtagcgtcagctctgtttattcggagccgaggtccccaagagagctccctaagtacgccgaagagtaccagccacctatatggaagagttacttgtatcaactccagcaggaagccccaagaccgaaacggataatctgcccgagggaggtggagaaccgcccaaagtattacggccgagagtttcacgggatcatctctagagaacaggccgacgaactgctgggaggggtggaaggcgcttacatccttcgcgagtcacagcggcagcccggttgctacactctggccctccgatttggcaatcagactctgaattataggctgtttcatgacgggaaacattttgtcggtgaaaagcgctttgagagtattcatgatctcgttactgacgggttgataacattgtacatcgagactaaggctgcagaatatatttccaagatgacaactaatccaatttatgagcacatcggatatgcaactctttag

SEQ ID NO: 218110 - DNA, 825 bp, Artificial Sequence
  Description of Artificial Sequence: Synthetic coding sequence
atgttttccgaggagctttggctcgagaacgaaaagaagtgtgcagtcgtgcgaaagagcaaacagggacgcaaacgccaggagctgctcgccgtggcttttggcgtcaaagtgggtgtgaaaggaggctttctgtggcctcccctcaagttgttcgcttgctcccaaatctcaagtttagtccggagggctgcactgactcacaatgataatcatttcaattacgaaaagacacacaatttcaaagttcacaccttccgcggaccacattggtgtgagtactgcgccaacttcatgtggggtcttattgcacagggcgtgaggtgtagtggcctgaaaagcgagggattgtaccgcgtcagcggtttcaccgagcatatcgaagatgtcaagatggcttttgatcgggacggtgagaaggccgacattagcgccaacgtgtacccagacatcaacataatcacgggcgcattaaaattgtattttagagacctcccgatccctgtgatcacgtacgatacgtattcgaagtttatcgacgcagccaaaatttctaacgcagacgagagactcgaagctgtgcacgaggtgcttatgctgctgcctcctgcccactacgaaaccctccgatacctgatgatccacctgaaaaaggtcactatgaacgagaaagacaattttatgaacgctgagaacctcggtattgtttttggacctacactgatgagacccccagaggactctacgctaactacactgcacgatatgcggtatcaaaaactgatagtccagatccttattgagaatgaggacgtcctgttctag

SEQ ID NO: 218111 - DNA, 864 bp, Artificial Sequence
  Description of Artificial Sequence: Synthetic coding sequence
atgtttagcgaggaattgtggcttgaaaatgagaagaagtgtgctgtagtgaggaaaagcaaacaggggagaaagagacaagagctgctcgcagtagcctttggtgtgaaggttcacacattccgaggacctcattggtgcgagtactgcgcaaatttcatgtggggactgattgcacagggggttagatgcagcgactgcggcctaaacgtccacaaacagtgcagcaagcatgttcctaacgactgtcagccagatctgaaacggatcaagaaggtgtattgctgcgatctgacaactcttgtgaaagcacataacactcaaaggcctatggtagttgatatctgcatccgggagatcgaggctcgtggactgaaatctgaagggctgtacagagtatccgggttcaccgagcacattgaggacgtcaagatggctttcgaccgggatggagaaaaggccgacatttctgcaaatgtgtaccctgatattaatatcattactggggctctgaagctgtactttcgggatctgccgatccctgtgatcacttatgatacatactctaagttcatcgacgcagccaagataagtaacgctgatgagcgtctcgaggccgttcacgaggttttaatgttgttgcctccagctcattatgagactctcaggtatctgatgatccaccttaaaaaagtcactatgaatgagaaggacaatttcatgaacgccgaaaacctgggcattgtatttgggcctactctaatgcgtccacccgaagactcaacactgacaactctgcacgacatgcgttatcagaagctcatcgttcaaatactgatagaaaacgaagacgtgctcttctag

SEQ ID NO: 218112 - DNA, 579 bp, Artificial Sequence
  Description of Artificial Sequence: Synthetic coding sequence
atggccgctagcagcaactcttctttgagtggttccagtgtctcaagtgacgccgaagaatatcagccaccaatttggaagtcttacctctatcagctccagcaagaagcgcctcgacccaaacgtatcatctgccccagagaggtagagaatagacccaaatactatggccgagagtttcatgggattatcagccgggaacaggctgacgagttactgggaggcgttgaaggagcttatatcctgagggaatcccagcggcaacctggatgctacaccctggcgcttcgcaaccccacaaagatatcaaatgccgatgagaggcttgaggcagtgcacgaagtcctcatgctcctgccgcctgctcattacgagactctacgctacctaatgattcacctcaaaaaagttacaatgaatgaaaaagataacttcatgaatgcagagaatctaggcatcgtctttgggcctacccttatgaggcccccagaagactcaacattgacaactctacacgacatgcgttatcagaagctgatcgtacagattctaatcgagaacgaagatgtcttattctag

SEQ ID NO: 218113 - DNA, 861 bp, Artificial Sequence
  Description of Artificial Sequence: Synthetic coding sequence
atgttcagcgaggagttgtggctggaaaacgaaaagaagtgtgccgtggtgcgcaagtcaaagcaggggagaaagagacaggagctcctcgccgtggcctttggagttaaggtgggggtaaagggcggttttctgtggccacctttgaaactgtttgcctgttcacaaattagctctttagtgaggcgggctgccctgacccacaacgacaatcactttaactacgagaaaactcacaattttaaagtgcataccttccgaggtcctcactggtgcgagtactgcgccaattttatgtggggactgattgcccagggtgtacggtgctcagactgtgggctgaacgtacacaagcagtgcagcaagcacgtgcccaacgactgccagccggatctcaagagaatcaaaaaggtttactgttgcgatctcacaacactcgtgaaggcccacaacacccagaggcctatggtcgtggacatttgcattagggagatcgaggcaagaggcctcaagtccgagggcttataccgggtgtccggcttcaccgaacatatagaagatgtcaagatggccttcgatcgagagatcagtaatgccgatgaaaggctggaggccgtccatgaggtgctcatgctactgccacccgctcactatgaaactctgcgatacctgatgatccatttaaaaaaagttaccatgaatgaaaaggacaactttatgaatgctgaaaatcttggaatcgtattcgggcctacattgatgagaccaccggaagatagtactttgaccacactacatgacatgcgctatcagaagctgattgtgcagatcctaatcgagaatgaggatgtgctgttctag

SEQ ID NO: 218114 - DNA, 1446 bp, Artificial Sequence
  Description of Artificial Sequence: Synthetic coding sequence
atggctgcctcctcaaattcatccctgagcggatcttctgtgtcttccgtgtattcagaacctcgctccccgagggaactccccaaatatgctgaagaataccaacccccaatttggaagagctatctgtaccaactgcaacaagaggctccacggcctaagcggattatttgtcctagggaggtggaaaatcggccaaagtattatggcagagagttccacggaataatctctcgcgagcaggcagatgaactgctgggtggcgtggagggagcatacatcctgcgcgaaagtcagcgtcagccaggttgttataccctcgcattgcgctttggaaaccaaacgctcaattaccggctgtttcatgatgggaaacactttgttggagagaagagattcgagagtatccatgaccttgttacagatggacttatcacgctgtacattgaaaccaaagccgctgaatacattagtaaaatgactactaacccaatttatgaacatataggttatgccaccctgcttcgggaaaaggtatctaggcggctgtctagatcaaagaacgaaccacggaagactaacgtaacgcacgaggagcacaccgctgttgagaagatcagttcactagttagaagggccgcactgacacataatgataaccacttcaattacgaaaagacccacaatttcaaggtgcacacattccggggaccccattggtgcgagtactgtgccaactttatgtggggactcattgcccagggtgtccggtgctctgactgcggcttgaatgtgcacaagcagtgctcaaaacatgtccctaacgactgtcaacctgacctgaagaggataaaaaaggtgtattgttgtgacctgactaccctcgtcaaggctcataatacacagcggccaatggtggtggacatttgtattcgagagatcgaggccaggggcctcaaatccgaaggactgtaccgcgtaagcggatttaccgagcatattgaagacgtcaagatggcatttgatagggatggggaaaaggctgacatcagtgctaacgtgtatcctgacatcaatatcattacaggcgctctgaagctgtacttccgcgatctgccaatcccagtaattacgtacgacacatactctaagttcatagacgcagccaagatctcaaacgccgacgaaaggctcgaagccgttcatgaggtgttgatgctcctcccacccgctcattatgagaccctcagatacttgatgattcatctgaagaaagtgaccatgaacgaaaaggacaactttatgaacgccgagaatttagggattgtcttcgggcctaccctgatgagacctccagaggactcaacattgacgacactgcacgatatgaggtaccaaaagctcatcgtgcagatcctgatcgagaatgaagatgtgctcttctag

SEQ ID NO: 218115 - DNA, 975 bp, Artificial Sequence
  Description of Artificial Sequence: Synthetic coding sequence
atggccgctagctcaaactcctctttgtcgggctcctccgtgagttctgatgctgaggaataccaaccccctatttggaagtcttatctgtaccagctgcagcaggaagcgcctagacccaagagaatcatctgtcctagagagatcagtagcctcgtacgtcgcgctgccctgacacacaatgataatcactttaactacgaaaagacccataatttcaaggtgcatacctttaggggaccccactggtgcgaatattgtgctaatttcatgtgggggcttatcgcgcagggcgtccggtgttccgactgcggcctgaatgttcacaaacagtgctctaagcacgtccccaatgactgtcagccggatctcaagagaattaagaaagtgtattgctgcgatttgaccaccctcgttaaggcccacaacactcagcggccaatggttgtggatatctgtatccgtgagattgaggcacgcggactaaaatctgaagggctgtacagggtttccgggtttactgaacacattgaggatgtgaagatggcgtttgatagggacggagagaaggctgacatatccgcaaatgtttacccagacatcaacatcattacaggtgcgcttaagttgtatttccgggatctgcctatcccggtgataacctatgatacttacagtaagttcatcgacgctgccaaaatttcaaatgccgatgaaaggctggaggccgtgcacgaagtgctgatgttgctgcccccagcgcattacgagaccctgaggtacctgatgatccacctgaagaaggttacaatgaacgagaaggacaatttcatgaacgctgagaatttgggtatcgtgtttggaccaaccttaatgcgaccaccagaggactccacccttactacactgcacgacatgcgctaccagaagctcatcgtacagattctgatcgagaacgaagatgtgctgttctag

SEQ ID NO: 218116 - DNA, 1632 bp, Artificial Sequence
  Description of Artificial Sequence: Synthetic coding sequence
atgacccagacgcatcgggctaagtcagccagcagctgccccaatctgctcgtccctgagacatggcctcaccaggtcagcgcctcccatgcagggaggtccaaacaaccacagggcggtattttgaagatcaatgaagaacacagaagaggcgcaatacaagaccttctggcatcccccggtttcacctttggcaaacgggtggtgttcgactctcactgcctaaagcggcaacataccttcgctgatggcctccattctagctgcacgtcaaacgcggaagagtaccagccgcctatttggaagagttatctgtatcaactgcaacaagaagcacctcggcctaaaaggataatctgtccccgagaagtcgagaaccgcccaaaatattatggtagagagtttcacggaatcatctcacgcgaacaggccgatgagctgcttgggggagtggagggggcatacattctgagagaatcccagcggcagcctggttgttacaccctcgccctccgctttggcaaccagaccctcaattatcgcctcttccacgacggcaagcactttgtgggggaaaagaggttcgagtctatccacgacctcgtgaccgatggcctgatcacactatatattgaaaccaaagctgccgaatatatctcgaaaatgaccacaaaccccatttatgagcacattggctacgccaccttgttacgcgagaaggtgtcgcgtcgcctgagcagaagtaaaaatgagccaagaaaaacaaatgtgacccacgaagaacacaccgcagtggaaaaaatcagcagcctggtgcgaagggccgctctaacccacaatgataatcatttcaattacgaaaagacccacaacttcaaggtacatacattccgtggaccacactggtgcgagtattgtgcgaacttcatgtggggtctaattgcacagggtgttaggtgctccgattgtgggctcaacgtccataaacagtgttccaagcacgtaccaaacgattgtcagccagacctcaaacgcatcaagaaggtctactgctgcgatcttaccactctcgtgaaagcacacaatactcagaggccgatggtggtggatatatgtattcgagagatcgaagccagggggctgaagtcggaaggactgtatcgtgtatctggcttcactgaacacatcgaagacgtcaaaatggcttttgatcgtgacggtgaaaaggcagatatcagcgcgaatgtctatccagacattaatattatcaccggagcgctgaagctgtatttcagagacctaccgataccggtgatcacgtatgacacttacagcaaatttatcgatgccgctaagatttccaatgcagatgaaagactcgaggccgtccacgaagtccttatgttactccctccagctcattatgaaaccctccgttatctgatgattcacctcaaaaaagtgacaatgaacgagaaggataacttcatgaatgccgaaaacctgggtattgtgttcggacctacactgatgcggccacctgaagattcaaccctgaccacactccacgacatgagataccagaaactgattgtccagattcttatcgagaacgaggacgtgctgttttag

SEQ ID NO: 218117 - DNA, 1362 bp, Artificial Sequence
  Description of Artificial Sequence: Synthetic coding sequence
atggatgccgaggagtaccagcccccaatctggaaaagttacctatatcagcttcagcaggaggctcccaggccgaaacggataatctgtccaagggaggtagagaacaggccaaagtactacggtagggaattccacggcattatcagtcgcgagcaggccgatgaattgttaggcggagtggagggcgcatatatcctcagggaatcccagcgccagcctggatgttacaccctggccctgcggttcgggaaccagaccctgaactacagactctttcatgatggaaaacattttgtgggagagaagaggttcgaaagcatacatgatttagtgacggatgggttgattacactctacattgagactaaggctgccgaatacatttcaaagatgactacaaatcctatctatgaacacatcgggtatgccactctgttgagggagaaagtttccaggcgactgagtaggtccaagaacgaaccgagaaagacgaatgtgacgcacgaagagcacaccgctgtagagaaaatctcttccctggttcgtagagctgcactgacccacaatgataatcactttaattacgaaaagacccacaattttaaagtccataccttcaggggaccccattggtgcgagtattgcgctaattttatgtggggacttatcgcacagggagtcaggtgctcagattgtggcctcaatgtgcacaaacagtgttccaagcacgttccaaacgactgtcaacctgacttgaagaggatcaagaaggtgtattgctgtgacttaacaaccctagtgaaagctcacaatacacagcgtcccatggtcgtagacatctgtatacgggagatagaagcgagaggactgaagtccgagggtctgtaccgcgtgagcgggtttacagaacacattgaggatgtcaagatggcgttcgacagagatggagagaaggctgatatctctgctaatgtttacccagatattaatatcatcaccggggctttaaaattatatttcagggacctgcccattcccgtaatcacatacgacacctacagtaagttcatagacgcagccaagatttctaatgctgatgaacgattggaggctgtgcacgaggtgctgatgctgctcccccctgcccattacgaaactctacggtatctgatgatccatctcaaaaaagtgacaatgaacgagaaagacaattttatgaatgccgaaaacttgggaattgtctttggccctacactgatgagaccaccagaggattccacactgacaacgttgcacgatatgcggtatcaaaagctgatcgtacaaattcttatcgagaatgaagatgtccttttctag

SEQ ID NO: 218118 - DNA, 1152 bp, Artificial Sequence
  Description of Artificial Sequence: Synthetic coding sequence
atgggagtgaaggcctcccagacaggctttgtggttcttgtcttgttgcagtgctgctccgcctacaaactcgtgtgctactatactagttggtctcaatacagggagggcgacggatcatgcttcccagatgcactagacagatttctgtgtactcacattatctatagtttcgctaacatatccaacgaccacattgatacttgggaatggaacgacgtgaccctgtatggcatgctcaatacattaaagaaccggaaccccaatctgaaaacacttctgagcgtcggtgggtggaatttcggctctcagcggttttccaagattgcctcaaacacacaatccaggcgcacatttatcaagtccgtccccccatttcttagaacccatggtttcgacggcttggacctggcttggctgtatcctggcagacgagataagcagcacttcactaccctcataaaggagatgaaagccgagttcattaaagaagcccagccaggaaagaaacagctgctgctgagcgccgcactgtctgccggaaaagtgacaatcgactcctcatacgatattgccaaaatcagccagcatctggactttatctccattatgacatacgattttcacggggcatggcggggtacgactggacatcactctccgctgttccgcggacaggaggatgcctcacccgacagattctccaatacggactatgccgtcgggtacatgctgaggcttggcgcaccggcaagtaagctagtgatgggcatacctacctttggacgatcattcacattggccagtagcgagaccggtgttggagcacctatttcgggacccggtattccgggtagattcacaaaggaagcaggaaccctcgcctactacgaaatctgcgacttccttcgaggggcaacggtccaccggatattgggtcagcaggtgccctacgccaccaaaggcaaccagtgggtcggatatgacgatcaggagtcggttaagtcaaaagtgcagtacctgaaggaccggcagctcgccggtgccatggtgtgggccttggatctggacgactttcagggcagcttttgcggccaggacctgagattccctttgactaatgctatcaaggacgctctcgctgctacttag

SEQ ID NO: 218119 - DNA, 459 bp, Artificial Sequence
  Description of Artificial Sequence: Synthetic coding sequence
taactgctgctctccgccgcactgtcagctgggaaggtgaccatagacagcagctacgatattgcaaagatctcccagcacctggattttatatcaatcatgacatatgacttccacggcgcatggaggggtacaaccgggcaccattcgcccctattccggggacaggaagacgcctcacccgaccgatttagcaataccatctgcgactttctgcggggtgccactgtccatcggattttggggcagcaggtgccgtacgccacaaagggtaaccagtgggtaggctacgatgaccaggaaagcgtgaagtctaaggttcagtatctcaaagatagacaactcgccggtgccatggtttgggctctggacttagatgacttccaggggagtttttgcggccaagatttgagattccctcttaccaatgctatcaaggatgcactggcggcaacgtag

SEQ ID NO: 218120 - DNA, 306 bp, Artificial Sequence
  Description of Artificial Sequence: Synthetic coding sequence
atggtgagcacccctgagaatcgacaaactttcataacaagcgttatcaagtttctgcgtcagtacgagtttgacgggctagatttcgattgggaataccccggatcccgcggaagcccccctcaggacaagcatctcttcactgtcctcgtgcagatgaggaaactcaagtaccgggaggatctctcgaaccttccaaagatcactcagcttgtgggtatcataacctcatctgcagtctggccacagagtccgcttctactgagcataacgctggggtgcccattgctgctcaggaatgcttag

SEQ ID NO: 218121 - DNA, 1431 bp, Artificial Sequence
  Description of Artificial Sequence: Synthetic coding sequence
atgacaaagctgattcttttgactggcctggttttgatcctaaacctacaactgggcagcgcgtatcagctaacatgctactttactaactgggcccagtatcgccctggcttagggcgttttatgcccgacaacatcgacccctgcctgtgcactcacctgatctatgccttcgcgggaaggcaaaataacgagatcacaacgattgaatggaacgatgtgactttatatcaagcttttaacggactgaagaataaaaactcgcagctcaagacgttgttagccataggaggctggaacttcggcaccgcgccattcactgccatggttagcacccctgagaacaggcagaccttcatcacaagcgtgatcaaattccttcgtcaatatgaattcgacggcttagatttcgactgggagtacccaggatcccggggttcacctccacaggacaagcatctattcaccgtcctcgtgcaggagatgcgtgaagcttttgagcaggaggcaaagcaaattaacaaacctaggttaatggttacggcagcagtcgctgccggtattagcaacatccaatccggctacgagatacctcagttatcccaatatctcgattatatccatgtgatgacatacgatctccacgggtcatgggaaggctatacgggggaaaatagtcccctctataaataccctactgatacaggaagcaatgcttacctgaacgtagactacgttatgaactactggaaagataacggcgcaccagcagagaagctgattgttgggttccccacctacggccataatttcatcctctccaacccgagcaatacaggcatcggtgccccaacatccggagctgggcctgcaggaccatatgcaaaggagtcagggatctgggcatattacgaaatatgcacatttttgaagaatggggctacgcaggggtgggacgcacctcaggaggtaccatacgcataccagggtaacgtttgggtagggtacgacaacattaagagcttcgatattaaggcccaatggctcaagcacaacaaatttggcggtgccatggtctgggccatagacctggacgattttacagggaccttctgcaatcaaggaaagttccccctaatctccacactgaaaaaggcactgggcctgcaatcagcctcctgcacagcgcctgcccagcctattgagccgatcaccgcggctccttcaggtagtggcaacggtagcggcagcagcagctctgggggttcaagcggcggttccggattctgtgcagtgcgcgcaaacggcctataccccgtggcgaacaaccgtaacgcattttggcattgtgtcaatggcgtgacataccaacaaaactgccaggccggactcgtgttcgataccagctgtgattgctgcaactgggcatag

SEQ ID NO: 218122 - DNA, 948 bp, Artificial Sequence
  Description of Artificial Sequence: Synthetic coding sequence
atgcgggaagccttcgagcaagaagcgaagcaaatcaataaacccagactcatggtgactgcggcagtggctgccggtattagcaacattcagagtggatacgagatccctcagctttcccaatatctggattatatccacgtgatgacttatgatctccacggttcctgggaagggtataccggagaaaatagcccactgtacaaatatccgactgatactggcagcaacgcctaccttaatgtggactacgtaatgaattattggaaagacaacggagctcccgctgagaagctgatcgttggatttccaacatacgggcataattttattctgtctaacccttcgaatacaggtattggtgccccaacctctggggcaggccctgcagggccttacgctaaagaatcaggcatttgggcatattacgaaatctgcacattcctaaaaaacggggcaacgcagggatgggatgccccacaggaagttccctacgcatatcagggtaacgtgtgggtggggtacgataacattaaatcatttgacattaaggcccagtggctgaaacacaataaattcggaggtgctatggtctgggccatcgacctggatgattttaccggcactttttgcaaccagggtaaattcccactcatctctacccttaaaaaagccctcgggctgcagagcgcttcatgtacagccccagcccagcccattgagcctattaccgccgctccatctggctcaggcaatggcagcggcagtagtagctccggcggttcgtctggcggttccgggttttgcgcggtgcgggcaaatggcctgtatccggtcgccaataaccgcaacgccttttggcactgtgtgaatggcgttacatatcagcagaactgccaggctggacttgtgtttgacacatcttgtgactgttgcaattgggcatag

SEQ ID NO: 218123 - DNA, 1431 bp, Artificial Sequence
  Description of Artificial Sequence: Synthetic coding sequence
atgacgaagcttatccttcttaccggtctggttctgattttaaacctgcagctcggatcagcataccagttaacttgttactttactaattgggctcaatatcggcctggactaggacgctttatgccagacaatattgacccctgtttgtgtacccacctgatatacgctttcgcaggcagacagaacaatgagatcaccaccatagaatggaatgatgtcaccctctatcaggcctttaacgggttgaaaaataaaaactctcagctaaagaccctgttggctatcggcggatggaactttggcacagccccttttaccgctatggtgtcaactcctgagaataggcagacctttattacttccgttattaagttccttcggcaatacgagtttgatggactcgatttcgactgggagtatcccggatcccgcggttcgcctccgcaagacaagcacctctttaccgtgctagtgcaagagatgagggaggcctttgagcaagaggcaaaacagataaataaacctcgactgatggtgactgcagccgtggccgctggaatctctaacattcaatcaggttatgaaatcccacagctctctcaatacttggattacatacatgtgatgacgtatgatttacatggcagctgggagggatataccggcgagaactctcctctctataagtatcctaccgacacaggttcgaacgcttatcttaacgttgactacgtcatgaactactggaaggacaatggcgctccagctgaaaagctgatcgtgggctttccaacttacgggcacaacttcattctgtcaaaccccagcaatacaggcatcggtgctcctaccagtggcgctggccctgccggaccttacgcgaaagagagtgggatctgggcgtattacgagatctgcactttcctgaagaacggagcaactcaaggttgggatgcccctcaggaagtgccctacgcctaccagggaaatgtctgggtcggctacgacaatataaagtcgttcgatattaaggcacagtggctgaaacacaacaaatttggtggagccatggtttgggccatcgacttggacgattttacgggtacattctgtaaccagggaaagtttcctctgatctccaccttgaaaaaagccttaggccttcagtcagcctcctgcacagcaccagctcaacccatagagcctattacagccgcaccatcaggctcaggcaacggaagtggaagcagctccagcggagggtctagcggagggtcaggattctgcgcagtgagagcaaatggactgtaccccgtcgctaataataggaacgcgttctggcactgcgtgaacggggtcacctatcaacagaactgtcaggcaggcctggtattcgacacgtcatgcgactgctgcaactgggcctag

SEQ ID NO: 218124 - DNA, 1263 bp, Artificial Sequence
  Description of Artificial Sequence: Synthetic coding sequence
gagacttcatctagcgtgcacgagcaggtcgccgactcgggagcacaggccgtggcgtttcagtccggtggtgaaagtagcatcgtgtggaacagccagctgaaaacgctgttggctatcggagggtggaacttcggaaccgcccctttcaccgcaatggtgtccaccccggagaacaggcagaccttcatcacctctgtgattaagttcctgcgccagtacgagttcgatggcttagattttgactgggagtaccccggaagtcggggaagtcccccacaggataagcatctttttactgtgctggttcaggaaatgagagaggcattcgaacaggaagctaagcagattaacaagccaagactgatggtcactgctgccgtcgccgcagggatatcaaacatccagagtggctatgagatcccacagctgtcccagtacttggattacattcacgtgatgacatatgatctgcatggcagctgggagggttacaccggagagaattctccactgtataagtatcctacagacactggtagcaacgcgtacctcaacgtggactacgtgatgaactactggaaagacaatggagctccagcagaaaaacttatcgttggctttcccacctacgggcacaacttcattctctctaatccctccaacacggggatcggcgcacctacatcaggtgccggtcctgccggtccttacgcaaaggagagcggtatctgggcatactatgaaatttgtacttttttgaagaatggcgctacacagggctgggacgccccacaggaggtgccatacgcttatcaaggcaacgtttgggttggctatgacaatatcaaatcattcgacatcaaagcccagtggctgaaacacaataaatttgggggtgctatggtatgggccatagatctggatgattttactggcaccttttgcaaccaggggaaatttcctctaatctctactctgaaaaaggctcttggcctgcaatcggcatcatgcactgcgcctgcccagcctattgaacccataacggccgctccatccggctctgggaacgggtcaggaagctccagctccgggggatcatctggcggaagcggattctgtgccgtccgcgctaacggtctatacccggtcgcaaataatcggaatgccttttggcattgcgtcaacggagtgacataccagcagaattgccaggcgggtctggtgttcgatacctcctgcgattgctgtaattgggcatag

SEQ ID NO: 218125 - DNA, 1107 bp, Artificial Sequence
  Description of Artificial Sequence: Synthetic coding sequence
atggtctcaacccctgaaaatagacaaacctttataacaagcgtgataaagttcctcaggcaatatgagtttgacggactcgatttcgactgggaatacccgggttcaaggggctcccctccacaggacaaacatttgtttaccgtattggtgcaggagatgcgagaagccttcgaacaagaggcgaagcagatcaacaagcctcggttgatggtgaccgccgcagtggccgctgggataagcaatatccagtccggatacgagataccacaactgtcacagtatctggactacatccatgtgatgacctatgatctgcacgggtcgtgggagggatatacaggagagaactccccgctgtataagtatcccaccgacacaggctctaacgcttacctcaacgttgattatgtgatgaactactggaaggataatggcgcacccgcagaaaaactcatcgtaggtttccctacctatgggcacaatttcattctgagcaatccatctaacacaggcatcggtgccccaaccagcggagcagggccagccggaccttacgccaaagagagcgggatttgggcttactacgaaatttgcacatttttaaagaatggcgctacacaagggtgggatgcccctcaggaggttccgtacgcataccagggtaatgtctgggtgggatatgataacatcaaatccttcgacattaaggcacagtggttaaagcacaacaaattcgggggtgccatggtctgggctattgaccttgacgacttcaccggaaccttttgtaatcagggaaaattccccctcatttcaacattaaagaaagctttaggtctccagagcgcttcttgcacagcccctgctcagcccatcgagccgattaccgcagccccatccgggtccggcaatggatcaggcagctctagctccgggggaagttccggcggatccggattttgcgcagtgcgcgctaacggcctgtatcccgtggccaacaaccggaatgcattctggcattgcgtgaatggagtgacgtaccaacagaactgccaggccggattggtgttcgatacaagttgtgactgttgtaattgggcctag

SEQ ID NO: 218126 - DNA, 948 bp, Artificial Sequence
  Description of Artificial Sequence: Synthetic coding sequence
atgagggaggcttttgagcaggaagccaagcagatcaacaagccacggctcatggtaaccgccgctgtggctgctggcattagcaatatccaatctggttatgagatccctcaactgtctcagtacctggattatattcacgtcatgacctacgacctccatggatcctgggaaggctatactggcgaaaactctccactctataaataccccactgacactggttcgaacgcatacttaaacgtcgattacgttatgaactactggaaggataatggtgcccctgccgaaaaactaatagtcggatttcctacctatgggcataatttcatcctgtccaacccttccaacacaggaatcggagccccaaccagcggagcagggcctgcgggaccctacgccaaagagtctggaatttgggcatattatgaaatttgcaccttccttaagaatggggcaacccagggttgggacgcccctcaggaagtgccctacgcctaccaggggaatgtttgggtgggatacgataacattaagtcattcgatatcaaggcacagtggctgaaacacaataaattcggtggcgcaatggtgtgggctatcgacctggatgatttcactggcaccttttgcaaccaggggaaattcccattgataagcacccttaagaaagctctaggacttcagtccgcctcgtgtacggccccagctcagccaatcgagccaattacagccgctccatcaggcagtggtaatggctcaggatcttcatcctcaggaggctcctcaggtggatctggcttctgtgcagtccgcgcaaacggcctttatcccgtggccaacaaccgaaacgctttttggcactgcgttaacggcgtcacttaccagcagaactgccaagcgggacttgtgttcgacaccagttgtgattgctgtaactgggcttag

SEQ ID NO: 218127 - DNA, 948 bp, Artificial Sequence
  Description of Artificial Sequence: Synthetic coding sequence
atgagagaagcttttgaacaggaagcaaagcagatcaataaaccacgccttatggtcaccgctgccgttgctgctggaatcagcaatattcagagcggctacgaaatcccccagttgagccagtacctggactatatccatgtgatgacatacgatcttcatgggtcatgggaagggtacacaggggagaattcacctctgtacaagtatccaactgatactggaagtaatgcttatctgaacgttgattacgttatgaactattggaaggataatggggcacctgccgagaagctgatcgttggtttccctacctacgggcacaattttatcctgtcaaacccatccaatacaggcataggggctccgacatccggcgctggccctgccggtccgtatgccaaggaaagcggcatttgggcctactatgagatctgtacattcttgaaaaatggcgctacccagggctgggatgctccacaggaggtgccttatgcttaccagggcaatgtctgggtggggtacgacaacatcaaatcattcgacataaaggcccaatggctcaaacataacaaatttgggggagccatggtgtgggccatcgacttggatgacttcactgggaccttttgcaaccaaggcaagtttcccctcatctctacccttaaaaaggccctgggtttgcagagtgcctcctgtacggcacctgcccagcccattgagcccatcactgcggcacccagcggatctggcaacggcagcggttcctctagttccggaggttcctccggcggaagtgggttttgcgctgttagagcgaatgggctgtaccccgttgcaaacaacaggaacgccttctggcactgtgtgaatggcgtaacataccagcaaaattgccaggcaggtctcgtgtttgacacgtcttgcgactgttgcaactgggcctag

SEQ ID NO: 218128 - DNA, 864 bp, Artificial Sequence
  Description of Artificial Sequence: Synthetic coding sequence
atgcgcgaggctttcgagcaagaagccaagcagattaataaaccgcgactgatggttaccgccgctgtcgctgccggtatatccaacatccagagcggctacgagatccctcagctgtcacagtatctggattatattcatgttatgacctacgatctccatggaagctgggaagggtacaccggggaaaattccccactctacaagtatccaacagataccggctccaacgcatacctgaacgtcgactatgtgatgaattattggaaagacaatggagctcctgccgagaagttgatcgtggggttcccgacgtacgggcacaatttcattttatccaatccatcgaatactgggatcggagctcccacaagcggagccggacctgccggaccatacgccaaggaatctggcatatgggcctattatgagatctgtactttcctgaaaaacggtgcgacgcaaggctgggacgctcctcaagaagtcccatacgcatatcaaggaaatgtctgggtcggatatgacaatatcaagtcctttgacatcaaagcccagtggctcaagcataacaaattcggcggagctatggtttgggcgatcgacctggatgatttcactggcactttctgcaaccaaggtaaattccctttaatttcgaccttaaagaaggcactgggattgcaatctgccagctgtaccgcacccgctcagcccatcgagcctattaccgcagctccgagtggaagtggcaacggaagtgggtccagttcaagtggcggatcatcgggcggaagcggtttctgcgcggtgcgagccaatggtctgtatcccgtggccaataataggaacgcattctggtag

SEQ ID NO: 218129 - DNA, 1158 bp, Artificial Sequence
  Description of Artificial Sequence: Synthetic coding sequence
atgagtcgccctcagttgcggaggtggaggctagtaagctctcctccaagtggtgtcccgggactggccctgcttgctctactggcactgcttgcgctccggctcgccgctggaaccgactgcccatgcccagaacccgagttatgccgaccaatacgccaccaccccgattttgaggtcttcgtattcgacgtgggccagaaaacgtggaaatcgtatgattggtctcagatcaccacagtggcgacattcggcaaatacgacagtgagctcatgtgttatgcgcactccaagggcgcaagggtagtactgaaaggcgacgtttccctgaaagatatcatagaccccgcttttagggctagttggatagcccaaaagctgaatcttgccaaaacacaatacatggacggaattaatatagatatcgagcaggaggtcaactgcctcagccctgagtacgacgccttgaccgccctcgtgaaagaaacgacggacagctttcaccgcgagattgagggctctcaggtgaccttcgatgttgcttggagccctaagaatatcgaccggagatgctataattacacgggtatagccgacgcctgcgatttcctgttcgtaatgtcttatgacgagcagtctcagatctggagcgagtgcattgctgccgctaacgcaccctacaatcaaacattaaccggctacaacgactacattaagatgtccattaatcccaaaaaactcgtgatgggtgtgccttggtacgggtacgattacacttgcttgaatttgtccgaagatcacgtgtgcacaattgctaaagtacccttccgcggagcgccatgttcagacgcagctggccgacaagtcccctacaagaccatcatgaagcagataaattcatctatttccgggaatctttgggacaaagaccagcgcgcaccatactacaattataaagatccagcagggcatttccatcaagtctggtatgataatccacaatccatctctcttaaagcaacatatattcagaattataggctgcgtggcattggcatgtggaacgcaaactgcctggactactcaggtgatgcagtggccaaacagcagaccgaagaaatgtgggaggtgctaaaacccaagctgcttcagaggtag

SEQ ID NO: 218130 - DNA, 2967 bp, Artificial Sequence
  Description of Artificial Sequence: Synthetic coding sequence
atggagcagtctagaagccagcagaggggcggagagcagtcatggtgggggagcgatcctcagtaccagtatatgccattcgaacattgcacatcttacggactgccatcggagaacggaggcctgcagcacagattgagaaaagatgcgggaccacgacacaatgtgcatcctactcagatttacgggcaccataaggagcagttcagcgaccgcgagcaagatatcggcatgcctaaaaagacagggtctagttccaccgttgactcaaaggacgaggaccattactctaaatgccaggactgtattcatagactgggccaggtggtgcggcgtaaactgggggaggacggcatttttctggtgttgctcggcctattgatggccctggtttcgtggtcgatggattatgtgtctgctaagtctctgcaggcttataagtggagttacgctcagatgcagccgagcctgccgctccagttcctcgtgtgggtgacattcccccttgttctcatacttttttcagccctattttgccatctgatatctccccaggcagtgggatccggtatcccagagatgaaaaccatactccggggagtggtactcaaggagtacctaactatgaaagcatttgtagctaaagtggtggcgctgacagcaggcctcggctcaggcattccagtgggaaaagaggggcctttcgtgcatattgctagcatctgtgccgcagtgctgtccaagttcatgtccgtcttttgtggtgtttatgagcaaccatactactattccgacattcttacagtcggatgcgccgtcggggtcgggtgctgctttgggacaccgctcggaggcgtacttttctctattgaagtgacttctacttatttcgcagtgaggaattactggcgcggattcttcgccgctaccttttccgcctttgtgttccgcgttctagcagtatggaacaaggatgccgtaaccatcaccgcgctgtttaggactaatttcagaatggactttccttttgacttaaaggagctgccagccttcgccgcaatcggaatatgctgtggcttactgggggcagtgtttgtgtatttacacagacaggtaatgttgggcgtccggaagcataaggcattgagccagtttctggctaaacataggctgctctaccctggtattgtgacatttgtcatcgccagttttaccttcccacccggtatggggcagttcatggcaggcgaacttatgccaagagaagccatcagtacccttttcgacaacaacacgtgggttaaacacgccggtgaccccgagtcccttggccagtcagccgtgtggatccatccacgagtgaatgtggtgataattatctttctattttttgtgatgaagttctggatgtccatagtcgcaacgacaatgcctatcccatgcggaggatttatgccggtatttgtcttgggcgctgcttttgggcgtcttgttggcgagattatggcaatgctgttcccggatggcatcctctttgacgacattatctacaaaattttgcccggtggctacgcagtcatcggagcagccgcactgacgggtgccgtctctcatacagtctccactgcagtgatctgctttgaattaactggccagatcgcccatattttgcctatgatggtagctgttatcttggctaacatggtggcccagtctcttcagcccagcctctatgattcaattatacaagtgaaaaaactcccttaccttccggatttaggctggaaccagctctcaaagtacacaatttttgtggaggatatcatggtacgagacgtgaagtttgtgtcagcttcatacacttatggagaattgcgcaccctgctccagactaccacagtgaagacgcttcctttggtggatagcaaggacagtatgatactgctaggatcggtggagcgttctgaactacaggccctgcttcagaggcatctgtgcccagaacgaaggcttagggcggcacaggagatggcaagaaagctaagtgagctgccgtacgacggaaaggctaggctggccggagaaggacttcctggcgctccacccggtcgccctgagagcttcgccttcgtggacgaagacgaggatgaagatctgtctggcaaaagcgagttgcccccaagccttgccctgcatccatctacaactgccccactgagccccgaagaacctaacggccctctgcctgggcacaaacagcagccagaggcaccggagccagcaggccagcgcccaagcatttttcagagtcttctgcattgcttgctcggcagggcgagaccaactaaaaaaaaaactacacaagatagtacagacctcgtcgacaatatgagccctgaggagatcgaagcctgggaacaggaacaacttagccagcctgtgtgtttcgactcctgctgcatcgatcagagcccctttcagctggtcgaacagactacgctgcataagacacacacgctgtttagcctccttggtctgcaccttgcatacgtgacatctatgggcaagctgcgcggagtccttgccttagaggaattgcagaaagccatcgaggggcacacaaagtcaggagtccagcttcgaccgccattggcatcctttaggaatacaacaagcacaagaaagtctactggggctccacctagctccgccgagaattggaacttaccagaagacagacccggtgcaaccggaaccggagatgttatcgccgctagtcctgagacaccagttccaagtccctcacccgagccacctttaagtcttgctcctggcaaggtagaaggcgagctcgaagagctggagctggttgagtcaccaggactggaagaagagttagccgacattctgcaaggtccaagtctgagaagtactgatgaggaggacgaagacgagctgatcctgtag

SEQ ID NO: 218131 - DNA, 2697 bp, Artificial Sequence
  Description of Artificial Sequence: Synthetic coding sequence
atggccgcagctgccgcagaggaagggatggagcctagggcactgcagtacgaacagacactgatgtacggcaggtacacgcaggatctgggagcattcgcaaaggaagaagccgctcggattcgattgggcggacctgagccgtggaagggacccccatccagccgcgctgctccagagctgcttgaatatgggcgaagcagatgcgctagatgccgggtgtgctccgtgagatgccacaagttcctagttagcagggttggggaagactggatctttctagtactcttgggtttgctcatggccttagtgtcgtgggttatggattatgccattgcagcgtgcctgcaagcacagcagtggatgagtagggggctcaatacttctatcttgctgcagtatttagcttgggttacttatccagtagtcctcattacctttagtgctggattcacacaaatcctggctcctcaggccgtaggttctggaattcccgagatgaagacgatcctccggggtgtggtgttaaaagaatatcttacactcaagaccttcatcgccaaagttatagggctgacttgcgccctgggatcagggatgcccctggggaaggagggcccatttgtccacattgcatctatgtgcgcggctctgctaagcaagtttctttcactcttcggaggtatatacgagaacgagtcacggaacacagaaatgttggcggcagcctgcgcggttggcgtcggatgttgttttgccgctcctattgggggagtgttgttcagcattgaagtgacctcaacctttttcgccgtgagaaattactggaggggatttttcgcggcaaccttctcagcctttatcttcagggtgctggcagtctggaaccgggatgaggaaaccattaccgccctcttcaagactagattccgattggacttcccgtttgatctgcaggagctgcctgccttcgctgtgattggaatcgcatccggcttcgggggagctttgtttgtgtatttgaaccgaaaaattgtgcaagtaatgagaaagcagaagaccattaaccgcttcctgatgcgcaagaggttgctctttcccgctttggtgaccctcctaatttcgacactaacgttccctccaggctttgggcagtttatggctggacagttgtcgcaaaaggagactttagtgactctgtttgacaaccgtacctgggtacgccagggactcgtggaagaactggagcctcctagtacctcccaggcctggaatcctccgagagctaacgtgttccttaccctggtcatttttatcctgatgaagttttggatgtccgcactggctacaacaatcccagtgccctgtggcgcatttatgcctgtgttcgtcattggtgcggcttttggcagactggtgggggaatctatggccgcatggtttcccgatggcatccacactgacagcagcacttacagaattgttcctggcggatacgctgtggtgggagctgctgcgcttgccggagctgttactcatacagtttcaaccgccgtcatcgtctttgagctaacagggcagatagcgcacatacttccagttatgatagcagttatccttgcaaacgctgttgcccaatcacttcaaccgtcactctacgacagcatcataaggataaagaaactcccttacctgcccgaacttggctggggaagacaccagcaatatcgtgttcgagtggaggacattatggtgcgagacgtgcctcacgttgctctgagctgtacttttcgggatctgcgtttagcactgcaccgcactaaaggtcgcatgcttgctctagtcgaatctccggagagcatgatcctgctcggttctatagaaagaagccaggtggtagccctgttaggggctcagctctcacctgccaggcgtcggcagcatatgcaagagcgcagggcaactcaaacttccccgctgtcagatcaggagggtccccctaccccagaggccagtgtgtgtttccaggtgaacacggaagactcggctttccccgcagcacggggagaaacacataagcccttgaagcccgctttgaagcggggacctagtgttacgaggaatctgggggaaagccccaccgggagcgccgaaagcgccggaatcgctcttcgatcactgttctgcgggtctccgccacctgaggctgccagcgaaaagctggagtcatgtgagaaacgaaaactgaaacgcgttagaattagtctcgcaagcgatgccgacctagaaggggaaatgagtccggaagaaatcctggagtgggaagaacagcagctagatgagcccgtaaactttagtgattgcaagatcgatcctgctccatttcaattagtagaacgcacaagtctgcacaagacacatacaatctttagcctgctgggtgtggaccacgcatatgtgacctctataggtcgcctcataggaatcgttacattgaaggagctgagaaaagctatcgaaggcagcgtcacagcccagggggtaaaggtgagaccccctctagcttctttcagggattctgccacctcctcttccgacacagagacgactgaagtgcatgctctgtgggggcctcatagccgacacggtctccccagggaaggtagtccctcagactcagacgataaatgccagtag

SEQ ID NO: 218132 - DNA, 381 bp, Artificial Sequence
  Description of Artificial Sequence: Synthetic coding sequence
atgcgtaagcggctgctcttccccgcattggttacgttactcatcagtaccctcacatttcctccagggttcggtcaatttatggccggacagctctctcagaaggaaacactcgtaaccctgttcgacaaccggacctgggttcgtcaagggctggtggaagagctagaaccaccctccactagtcaggcttggaatcctcccagggctaatgtatttctgacacttgtcatcttcattctgatgaaacatctgggcgtatggtgggttaaggcatggctgccaggcagccaaatggaatttattaggaccgctgcccctactggtctgtgcctgggtgctactctctggagcggacagctgcgatggcaagagaggtag

SEQ ID NO: 218133 - DNA, 2601 bp, Artificial Sequence
  Description of Artificial Sequence: Synthetic coding sequence
atggagtctgagcagttatttcaccgcggatattacaggaactcatataactcgattacatccgctagctccgatgaagaactgttagatggtgcaggagttattatggacttccagacatcagaggatgacaacttgctagacggcgataccgctgtaggaacccactacaccatgaccaacggcggatccattaatagttcaacccaccttctagacctcctcgatgaacctattcctggcgtcggtacctatgatgacttccacacaattgactgggtcagagagaagtgcaaagaccgcgagcgccatcgtagaataaattccaagaaaaaagaatcagcatgggaaatgaccaagagcctctacgatgcttggagcggttggctggtggttacattgaccggcttagcttcaggggcactcgcaggactcattgacatcgctgccgattggatgactgatctgaaggagggcatctgtctttctgctctgtggtacaaccacgagcagtgctgctgggggtccaatgagacaactttcgaagagcgcgacaagtgcccccagtggaagacctgggcggaattgatcataggccaggccgagggacctggttcatacattatgaactatattatgtatatcttttgggctctctcatttgctttcctggctgtcagcctggtgaaggtgtttgccccttatgcctgcggatcaggcatacccgaaataaaaaccatcttgagcggctttataataagagggtacttagggaaatggaccctgatgatcaagacaattacgttagtgttggccgtagcctcaggcctctccctcgggaaggagggaccactcgttcatgtggcatgctgctgcggcaatatattttcctatctatttccaaaatactccacaaacgaggctaaaaagcgcgaggtgctgagcgccgctagtgccgctggggtctcagtcgcattcggtgcccctattggcggagtgctcttcagcctcgaggaggtatcttactatttcccactcaagacactgtggcgaagttttttcgcggctctagtcgctgctttcgtactcaggtcaataaaccccttcggcaatagccggctggtgctgttttacgtggaataccacactccatggtatttatttgaactcttccccttcatactattgggcgtctttggaggcctttggggagcattcttcattcgcgctaacattgcatggtgtcgccgtcgcaagagcactaagttcgggaagtacccggtgctggaagtgattattgtggcagccattactgctgtgattgcttttcctaacccctacacccggctcaacacttccgagctgattaaagagctgtttactgactgtggacctctcgagagctccagcctctgcgattatcgcaacgatatgaacgcgagtaagatcgtagatgatatccccgataggccagccggaattggggtgtactcagccatttggcagctgtgcctcgcgctcatcttcaagattatcatgaccgtcttcacatttggtatcaaggtcccctctgggttattcatccccagcatggctatcggtgccatcgcaggaaggatcgttggcatagctgtggagcagctggcctactatcaccatgattggtttatctttaaggagtggtgcgaggtgggtgcagattgtattacacccggactgtatgccatggtcggcgctgcagcttgcctcgggggtgtgacaagaatgaccgtcagcctggtggtaatcgtctttgagctgactggaggcttagagtacatcgtgccgttgatggcagccgtgatgacatctaaatgggtaggagatgccttcgggagagaggggatctacgaagcgcacatacgccttaatggctaccccttcctcgacgccaaggaggagttcacacacacaaccttggccgctgacgtcatgaggccccgtagaaacgaccccccacttgctgtgctaacccaggacaatatgacggtcgacgatattgagaacatgattaacgagacttcctataatggatttcccgtcatcatgtccaaggagagtcagcggcttgtcggttttgccctgcgacgagacctcactatcgcaatcgaaagcgcaaggaagaagcaggagggcatcgtggggtcttcccgagtctgttttgcccaacacacaccctccctgccggcagagtcccctaggcctctgaagttgcgttctatcctggatatgtctccctttactgtgacagaccacacccccatggagatcgttgtggatatattcagaaagctgggtctgcggcaatgtctcgtcacacacaacgggatcgtgctgggcataattacgaagaagaacatcttggaacatctggaacagttgaaacaacacgtggaacctcttgctccaccatggcattacaacaaaaaaaggtaccctcccgcatacggtccagacggaaaaccaaggccccgatttaacaatgtgcaactgaacctaacagacgaggagcgtgaggagacagaagaggaggtgtacctgttgaacagcacaacgttgtag

SEQ ID NO: 218134 - DNA, 2376 bp, Artificial Sequence
  Description of Artificial Sequence: Synthetic coding sequence
atggaatcggagcagttgtttcatcggggatactatagaaactcttataactccatcacctccgcctcttccgatgaggagctccttgacggagcgggagtgatcatggatttccagacctcggaagatgacaatctgcttgacggcgacaccgcggtcgggacgcactataccatgacaaacgggggaagcatcaactccagcacccatctactggacctgctggacgagcctatcccaggcgtcggtacctatgacgacttccatactatcgattgggtgcgtgagaaatgtaaggaccgggagcggcatcgcaggatcaactcaaagaagaaggagtcagcctgggagatgactaagtctctgtatgacgcctggagcgggtggctcgtggttaccctcaccggtttggcctccggagctctggccggtctgattgacatcgcagcagattggatgactgatctgaaagaaggtatatgcttatccgctctgtggtacaaccatgaacagtgttgttgggggtctaatgaaactacctttgaagagcgcgataaatgccctcaatggaaaacatgggcggagttaataattggacaggcggaaggaccaggaagctatatcatgaattatatcatgtatatattctgggccctgtcttttgccttccttgccgtatctctggtcaaagtttttgccccatacgcctgtggttccggtattcctgagattaaaacgattttatccgggtttataattcgcggatacttgggaaagtggaccctaatgatcaaaaccattacattggtattggccgttgcctcggggctgagccttgggaaagaaggaccgctggtccatgtcgcatgttgttgcggcaatatcttcagttacctgtttccaaagtatagcacgaatgaagccaagaagcgggaggttagttactacttccccctcaagacactctggcgatccttctttgccgctctggtcgcagcttttgttttaagatctattaatcctttcggaaactcaagactagtattgttctatgtggagtaccacacaccgtggtacttgtttgaactgtttccctttatcctcctcggggtgtttggaggtctgtggggggcttttttcatcagggctaatatcgcttggtgtcgacgcaggaaaagtacaaagttcggtaaataccctgtgctggaggtgatcatcgttgccgctatcacagccgtcatcgctttccccaacccgtatactagattgaacacctccgagctcatcaaggaactcttcacagattgcgggcctcttgaatcctcatccctgtgcgattaccgaaacgatatgaatgcgtcaaaaatcgtagacgatattcccgaccggcctgcaggcatcggggtttatagcgccatttggcagctgtgcctggcactcatctttaagattatcatgacagtgtttactttcgggatcaaggtgccaagtggcctgtttatcccttctatggccataggcgcaattgctggacgcatcgtgggcatcgcggttgaacaattggcctattatcatcatgattggttcattttcaaggaatggtgtgaggtcggagcagactgtatcacgcccggtttatatgcgatggtcggtgctgcggcttgcctaggcggtgttaccaggatgactgtatcactggtggtgatagtgttcgagcttacaggtggtttggaatacatcgtacctctgatggccgcagtaatgaccagtaaatgggtgggtgatgcgtttgggagggaaggaatttatgaagctcacatcaggcttaacggatacccttttctcgacgcgaaagaggagttcacgcataccaccctcgccgcagatgttatgcggccacggagaaatgatcctcccctagcggtgctgacacaggacaacatgacagtggatgacattgagaacatgatcaacgagacatcttacaatggcttccccgtgatcatgagtaaagaatcccagagactcgtcgggtttgcgcttagacgggacctgacaattgctattgagagcgccaggaaaaagcaagaggggattgtgggcagctctagagtgtgcttcgcacagcatacgccgtccctcccagccgagtcccccagacctctaaaactgcggagcattttggatatgtctccttttacagtgactgatcataccccaatggagatagtggttgatatcttccgcaagctgggcctgagacagtgcctggtgactcacaacggcagactcctggggatcatcaccaagaaagacattctgaggcatatggcccagaccgctaatcaggatcccgcttccatcatgtttaactag

SEQ ID NO: 218135 - DNA, 2406 bp, Artificial Sequence
  Description of Artificial Sequence: Synthetic coding sequence
atggtgacattacagctcggtgagtcccattacgtagtccaggccggtctacagctgttgggatccagcaatccacccgctctggcaagccaggtggccgagatcaccggtacccactacactatgaccaacggcggttctatcaacagctctactcatttgctggacctgctggacgaacctatccctggcgtagggacatacgacgatttccacaccatagattgggtacgcgagaagtgcaaggacagagagcggcatagaagaataaactctaaaaagaaggagtctgcttgggaaatgaccaaatcattgtacgacgcatggtcaggatggcttgttgtgacgctgacaggattggcctcaggggcattggctggtctcatcgatatagccgctgactggatgactgacctgaaagaaggaatatgtctaagtgccctgtggtacaaccatgagcaatgctgttgggggagcaatgaaacaactttcgaggaacgcgataagtgtcctcagtggaaaacctgggctgagcttattattggtcaggcagagggccctggatcatacatcatgaattacattatgtatatcttctgggcattgagctttgcttttctcgcagtgtctcttgtgaaggtgtttgccccatatgcatgtggctctggcatcccagagatcaagaccatcctgtccggatttatcattcggggatatctcggtaaatggacactgatgatcaagactattaccctggtgctcgctgtcgcgtccggcctgtccctaggaaaggagggcccactggttcacgtcgcatgttgttgcggcaacatttttagctatctttttcccaagtactctactaatgaggccaaaaaacgggaggttttgagcgctgccagcgcagccggagttagcgtggctttcggcgcaccaatcggaggcgtactctttagtctcgaagaagtctcctattatttccctcttaagacattgtggaggagtttttttgccgcactggtggccgcatttgttctgcgatccattaatccctttggcaacagcagactggtgctgttttacgtagaataccataccccttggtacttattcgaacttttcccattcatactgttaggtgtgtttggtgggctttggggagccttcttcatcagagcaaacatcgcctggtgtagaagacgcaagtctacaaaatttgggaagtaccctgtgctggaggtgattatagtggcagcaataacggcagtgatcgcttttcccaacccatatacccggttgaatactagcgaactcattaaagagctgttcactgattgcggccctctggagagcagcagcctctgcgactacagaaatgacatgaacgctagtaaaatcgtagatgacattccggataggcctgccggtatcggtgtgtacagcgcaatttggcagttgtgtctggcactgatcttcaaaattattatgactgtattcaccttcgggataaaagtccccagtggtctgttcatcccaagtatggctatcggcgcaatcgctggaaggatagtggggatagctgtagagcaactggcctactaccaccacgattggtttattttcaaggagtggtgcgaggtgggagcggactgtattacgcctggactctacgccatggtcggtgctgctgcctgtctgggcggtgtaacccgcatgaccgtctctctggttgttattgtttttgagttaactgggggacttgagtatattgtgcctctgatggcagccgtgatgactagcaagtgggtgggagacgctttcgggagagaaggaatatatgaagcccacatccggctaaatggatatcctttcttggacgccaaagaggagttcacccatacaacacttgcagccgatgttatgaggcctagaagaaacgaccctccacttgctgtgttgacccaagataatatgactgtggacgatatcgaaaacatgatcaatgaaacatcttataatgggttccccgtcatcatgagcaaggagtcacagcggttggttgggtttgcactgcgccgagatttgactatcgccatcgaatccgcacgcaagaaacaagaggggatcgtggggtctagccgggtctgctttgcccaacacactccatccctgcccgctgagagcccaaggcccctaaaacttaggtccatcctggacatgtctccatttaccgtgacagatcacacaccaatggagatcgtggtcgatatctttaggaagttgggtctgcggcagtgcttagttacccataatggcagactgttgggaatcattaccaaaaaagatattttgcgacatatggcccagaccgctaaccaagatcctgctagtattatgtttaattag

SEQ ID NO: 218136 - DNA, 522 bp, Artificial Sequence
  Description of Artificial Sequence: Synthetic coding sequence
atggaaagcgagcagctcttccaccgtggctattaccggaattcttacaattccatcacctctgcgtcttccgacgaagagctgctcgatggagccggagtgataatggattttcaaacatcggaagacgacaatcttttggatggcgacaccgcggtgggaactcattacacaatgacaaacgggggatctatcaactcctcaacacatctgttggacctgctcgacgaaccgatacccggagttggcacctacgacgactttcacacgattgactgggtgcgtgagaaatgtaaggacagggagaggcatcggagaattaactctaaaaaaaaggaatccgcttgggaaatgacaaaatcactgtatgacgcctggtccgggtggctggttgtgacccttacaggactggcatccggggctctggcaggtttgattgacatcgcagctgactggatgactgacctgaaggaggggatctgtttaagtgccctgtggtacaaccacgagcagtgttgttag

SEQ ID NO: 218137 - DNA, 420 bp, Artificial Sequence
  Description of Artificial Sequence: Synthetic coding sequence
atggagagcgagcagctcttccatcgagggtactacagaaactcttataattctattacttccgcaagcagcgatgaggagctccttgatggcgcaggcgtaattatggacttccaaaccagtgaagacgacaacctccttgacggggacactgctgtggggacacactacacaatgaccaacggtggaagcatcaacagctcgactcatctgctggacttattagacgaacccattcctggcgtggggacatacgacgattttcacacgatcgattgggtccgcgagaaatgcaaggaccgtgagagacacaggaggatcaatagtaaaaagaaggagtctgcctgggagatgacgaagagtctgtacgacgcttggtctgggtggttggtggtgaccctcaccggtctagcctcgtag

SEQ ID NO: 218138 - DNA, 2457 bp, Artificial Sequence
  Description of Artificial Sequence: Synthetic coding sequence
atggagtctgagcagttattccaccgaggttactaccgaaattcatacaacagcatcaccagcgcctccagtgatgaagaactgcttgacggggcaggtgttatcatggactttcagacatctgaagatgataacctgctagatggcgataccgctgtcgggacccattataccatgacaaacggcggatccatcaactcaagcacacacctgctggatcttctcgatgaaccaatcccgggagtcggtacttacgacgacttccataccatagactgggtccgggagaaatgtaaagatcgcgaaagacatcggcgtatcaatagcaagaaaaaggaatccgcctgggaaatgacaaagtcgctgtatgatgcgtggtctggctggctagttgtgacactcactggtctggccagtggtgctctggcgggtctgattgatatcgccgcagattggatgacagatctcaaggaaggaatatgcctttcagcactctggtataaccacgagcagtgctgctggggcagcaacgagactacctttgaggagcgagacaaatgcccgcagtggaaaacctgggctgagcttattatcgggcaggccgagggccctggatcttacatcatgaattacatcatgtacattttctgggctctatcattcgccttcctggctgtgtcactggtgaaagtatttgcgccttacgcctgcggctccggcattcccgagatcaaaaccatattaagcggattcataataaggggctatctcggaaagtggactttgatgattaaaacgattaccttggtcctggcagtggcatcaggcctcagcctggggaaagaggggcctctcgtgcacgtggcctgctgttgcgggaacatcttcagttatctgttcccaaaatacagtacaaacgaggctaagaagcgggaggtgctttcggctgcctccgcagcaggagtgtcagtggctttcggggcacctataggcggagtgttatttagcctggaggaagtgagctattattttccactgaagactctctggagatctttttttgcagcactggtcgccgcattcgtcctgcgaagcatcaacccttttggaaattctcgactcgtgttattttacgtcgaatatcatactccgtggtacctctttgagctttttccttttattcttttgggggtttttggcggactgtggggggctttcttcatccgggcaaacattgcctggtgccgaaggcgcaaaagtacaaaatttggcaagtatcccgttctggaggtgataatcgtcgccgcaatcacagctgtcatcgcctttccaaacccctataccaggctcaacaccagtgagctgattaaagagctgtttacagactgtgggccactcgagtcctcatccctgtgcgattacaggaacgacatgaatgcaagtaagatagtggatgacatacccgacagaccagctggcatcggcgtgtatagcgcaatatggcagctgtgcctggccctgatttttaagatcattatgaccgtgtttacctttggaattaaagtgccttctggtttattcatacctagcatggccattggcgctatcgccggaagaattgtcggaattgccgtcgaacagctggcctattatcaccatgattggtttatcttcaaagagtggtgcgaggtgggggctgattgcataacccccggactgtacgcaatggtaggagccgctgcctgtttggggggagtcaccagaatgacagtttctctggtggtgatcgtattcgagttgaccggagggttggaatatatcgtccccctgatggcagccgttatgaccagcaagtgggtgggtgatgcattcgggagagagggcatctacgaggcccacatcagattaaacggttaccccttcctcgatgccaaggaagaattcacacacaccactctggcagcagacgttatgagacctcgcagaaacgaccctcccttggctgtgctcacccaggataacatgaccgtggatgacattgagaatatgatcaatgagacatcatacaatggtttccccgtcataatgtccaaggagagtcagagactcgttggcttcgcgctgaggcgggaccttacgattgcgattgagtcagccagaaaaaagcaggaaggaatcgtggggtcctctcgagtctgcttcgcacaacataccccctctttacctgctgaaagtccaagaccactcaaactgcggtccattttagacatgtcacctttcactgttaccgatcacacccccatggaaattgtggtagacatttttaggaagctgggcctccgtcagtgtctggtgactcacaacggccgtctgttaggaatcatcaccaaaaaggacatattgcgtcatatggctcaaactgcaaatcaagatcccgctagcatcatgtttaactag

SEQ ID NO: 218139 - DNA, 576 bp, Artificial Sequence
  Description of Artificial Sequence: Synthetic coding sequence
atggaatcggaacagctctttcatcggggttattatagaaacagttataattccatcaccagtgccagctccgacgaggaactcctggatggagccggagtaataatggactttcagacttcagaggatgacaatctgctcgacggggataccgcagtggggacccactacactatgacaaacggaggatcgatcaattcctcaactcacttgttagacttgttggatgaaccaattcctggtgtaggtacttacgatgactttcatacgattgattgggtgagagaaaaatgcaaagatagagaacgccaccgaagaattaatagtaagaagaaggagtctgcctgggagatgaccaagtcattatatgatgcctggagtggctggttggtggtaactctgaccggactggctagcggcgctctcgccggactgattgacattgccgctgactggatgaccgacctgaaagaaggcatctgcctgtctgccctctggtacaatcacgaacagtgttgctggggctccaacgaaactacctttgagaagaagaaaaaaaagaagaagaaagcatag

SEQ ID NO: 218140 - DNA, 2190 bp, Artificial Sequence
  Description of Artificial Sequence: Synthetic coding sequence
atggtcaatgccggagccatgagtgggtcgggtaaccttatggatttcttggacgaaccgttccccgatgtgggcacctacgaggattttcacacgatcgattggcttagggaaaaaagcagggacaccgaccgacatagaaaaatcacttcaaaatccaaggagtccatttgggaatttataaagagtctcctggatgcttggagtgggtgggttgttatgctgcttattggtctgctggccggaacattggcaggcgttatcgatctggctgtggactggatgactgacctgaaagagggggtttgtctttctgccttttggtatagccacgaacagtgctgctggacgtccaacgaaacgacatttgaagaccgggataagtgccctctgtggcagaagtggtctgaactgctcgtaaatcagtccgaaggtgcttctgcgtacattctgaactaccttatgtatattctttgggccctcctgttcgcatttttggcggtgtccctggtgagagtgttcgctccttatgcctgtggctcaggaataccagagatcaagaccattctctccggcttcatcatccgcggttacctgggtaagtggaccctcctcataaaaacggtgactcttgtgctggtcgtgagcagcggcctgtccctaggtaaggaagggcctctggtgcatgtggcttgttgttgcggaaacttcttctcgtcacttttttcaaaatattcaaagaatgaggggaagaggcgagaagtcttatccgccgcagcagccgctggagtctctgtagcctttggggcacccatcggaggcgttttgttttctctggaggaagtgtcctattattttcctctgaagacgctgtggagatctttcttcgccgctttagtggctgcatttaccctgcgaagcattaacccatttggaaattctcgtctggtccttttctatgtggagtaccacacaccttggcgccgaaagaccacaaggttggggaaataccccgttcttgaggtgatagtggtgaccgctattaccgcaatcattgcttaccccaatccctacacaaggcagtctacttccgagctcattagcgagttgtttaacgattgcggtgccctcgagtctagccaactttgcgactatatcaacgacccaaacatgacaagaccggtagacgacatccctgaccgcccagcaggtgtgggcgtgtacactgcaatgtggcagctggctcttgctttaatctttaaaattgtcgttaccatctttacattcggcatgaaaatcccatccggactttttatcccatctatggccgtgggcgctatagcaggcagaatggttggaattggagtggaacagctggcctatcaccaccatgattggatcatttttagaaattggtgccgtccaggagccgactgcgtaacccccggactctacgcaatggtaggtgccgctgcttgtctgggtggggtgactagaatgactgtgtccctagtggtgatcatgtttgaactcacaggtggcctcgagtacatcgttcctctaatggctgctgctgtaaccagcaaatgggtggccgatgccttcggtaaggagggcatctatgaggcccatatccatctgaatggttacccttttttggacgtgaaagatgagttcacccaccgcacactggcaactgatgtgatgcgtcctagacgaggggaacctccgctgtctgtgctaacacaggacagcatgacagttgaggatgtagagacactgattaaggaaaccgattacaacggcttccccgttgttgtgtcccgagatagtgaaaggctgatcggattcgcacagcgaagagagcttatcctggccatcaaaaacgctcggcagagacaggaaggcatcgtgagcaacagcattatgtatttcaccgaggaaccacccgagcttcccgctaactccccccatcccctgaagttgcgtaggatcctgaatctgtcccccttcacagtgactgatcataccccaatggagacagtcgtggacatcttccgtaaattaggcctgcgccagtgtctcgtgacacggtccgggcgactgttggggatcattaccaaaaaggatgtgctccgtcacatggcacagatggctaatcaggaccctgaatcgatcatgttcaactag

SEQ ID NO: 218141 - DNA, 2283 bp, Artificial Sequence
  Description of Artificial Sequence: Synthetic coding sequence
atggtaaacgccggagccatgtcagggagcgggaatctgatggacttcctggacgagccattcccagacgtcggcacctacgaggacttccatacaattgactggcttagagagaaaagtagggacactgacaggcaccgcaagattacttccaagtccaaagagagcatctgggagttcattaaatctcttttagacgcctggagcggctgggtcgtcatgctgctcattggcttgttggcaggaaccttggccggagtaattgatctcgcggtcgactggatgactgatctgaaagaaggcgtttgcctatccgccttctggtactcccacgagcagtgttgttggaccagtaacgagacaaccttcgaggaccgcgacaagtgcccgctgtggcaaaagtggtctgaactgctggttaatcagtccgaaggcgcatccgcttatatcttgaattatcttatgtatattctatgggctttgctcttcgcctttctggcagtgagcctcgtgagagtgttcgctccttacgcatgtggttcgggtatccctgaaatcaaaactattctgagtggttttatcatccggggatatctaggaaagtggaccctcttgattaaaacggttacactcgtgctagttgtcagcagcggcctgtcccttggcaaggaagggccactcgttcacgtcgcctgttgctgtgggaacttcttctccagtctgttttccaagtactctaagaacgagggtaaaaggcgcgaagtgctgagcgcggcagccgcagctggtgtcagcgtcgccttcggtgccccaatcgggggagttttattcagtctagaggaagtgtcatactactttcctctcaagacgctgtggaggtcttttttcgccgctctggttgcagcgtttaccctgagaagtatcaaccctttcggcaactcgcggcttgtgctcttctatgttgagtatcacaccccctggtacatggccgaactattcccgtttatactccttggcgtgtttgggggtctttgggggactctgtttatcagatgtaacattgcctggtgccgtcgtcgtaaaaccaccagactgggtaaatatccagtgctggaagtgatcgtggtgaccgcaataacagcaatcatcgcctatccaaatccatatacacggcagtctacatccgagctgatcagtgaactgtttaacgattgtggagccctggagagctcacaactttgcgactatatcaatgatcctaacatgacgaggcctgtcgacgatattcctgacaggcctgccggtgtcggagtgtacactgcaatgtggcagcttgccctagccctcatctttaagatcgtcgtgactatattcacgtttggtatgaagatcccaagtgggctcttcataccttctatggctgtcggcgctatcgccggacgaatggtgggaatcggtgtggaacaacttgcgtatcatcaccacgattggattattttcaggaattggtgtcgccctggcgctgattgtgtgacaccaggactctatgctatggtcggcgcagccgcatgcctgggaggagtgacgagaatgaccgtatctctcgtggtaattatgttcgaactgaccggtggacttgagtacattgtgcctctcatggcagcagctgtcacttctaagtgggtggctgatgccttcgggaaggaaggcatctatgaagcacatatacatttgaacggatatcccttcctcgatgttaaagacgaatttacacatcgtaccttagcaaccgatgtcatgcgtccccgacggggtgagcctccactcagcgttctgacacaggactccatgacagtagaagatgttgagacactgatcaaagaaaccgactataacggattccctgtggtggtctccagggattccgagaggttgattgggtttgcccagaggcgggagcttattctcgcaatcaagaatgccagacagaggcaagagggcattgtgtctaactctattatgtattttactgaggaaccccctgaattgcccgcaaatagcccacacccgcttaagctcaggagaatccttaacctgagtccatttaccgttactgaccataccccgatggagaccgtcgtcgatatcttcagaaagctgggcctgcgacagtgtctcgtgaccagatcgggaaggctgctggggataatcactaagaaagacgtcttgcggcatatggctcagatggcaaaccaggatcctgagtccatcatgttcaattag

SEQ ID NO: 218142 - DNA, 2001 bp, Artificial Sequence
  Description of Artificial Sequence: Synthetic coding sequence
atgactgacctaaaagagggagtgtgtctgagcgctttttggtacagccacgaacaatgttgctggacttctaacgaaactacatttgaagaccgcgacaaatgtccactgtggcaaaagtggagtgaactgctcgtgaaccagtcagaaggggcaagcgcttatatcctgaattatttgatgtacattctgtgggcgctgctctttgcatttctggccgtcagtcttgttagagtgttcgcgccttacgcgtgtggcagtggcattccagagattaagaccatcctctctgggttcattattcgcggatatctgggaaagtggacactgctgatcaaaacagttaccctcgttctcgtagtgagctctggcctctctctggggaaggaggggccactggttcacgtagcctgttgctgcggaaattttttctccagtctgtttagtaagtatagcaaaaatgaaggcaaaagacgtgaggttttgtccgccgctgccgcagccggtgtatctgtcgctttcggtgcgcctatcggcggagttctttttagccttgaagaagtatcctattactttcctcttaagaccttatggagatctttctttgctgccctggtcgcagcattcacactgcgaagtattaaccccttcggaaatagccggctggtgctgttctatgtggagtaccatacaccctggtatatggcagagctgttcccattcatcctcctcggcgtcttcgggggattatggggtaccctgttcatccgctgcaatatcgcctggtgccgcaggagaaagacaacccggttagggaagtatccagtcctggaggttatcgttgtgacagccatcactgccattatcgcttacccaaatccttacacccgacaaagtaccagtgagctaatctctgaactgttcaacgattgcggagctcttgaatcgtctcaactctgcgattacattaacgatcctaacatgactaggcccgtggatgacatcccagaccggcctgccggtgtgggagtgtacaccgctatgtggcagcttgctctcgctcttatttttaagatcgttgtcaccatatttactttcggaatgaaaattccttctgggctcttcattccctccatggcggttggtgccatcgcaggtcggatggtggggatcggggtagagcagctggcctaccatcatcacgactggatcatctttcggaattggtgtcgcccaggagccgactgcgtgacaccaggattgtatgctatggtgggcgctgcagcgtgcttaggcggagtaaccagaatgaccgtgtcactggtggtcatcatgtttgaattaactgggggactggaatatatcgttcctttaatggcggcagccgttacaagcaagtgggtcgctgatgcttttggcaaagaaggaatttacgaagcacacattcacttgaatggatatcccttcctggacgtgaaggacgagtttacccatcggacactggccaccgacgtgatgcggccacggcgaggggagcctcctttgagcgtcttgacacaggacagcatgactgtggaagatgtcgagactttgataaaagaaactgactacaatggcttcccagttgtggtgtctcgcgactccgaacgacttatcggctttgctcaacggcgtgaactgattctggccataaaaaacgccagacagcgacaggaggggatcgtcagtaactcgataatgtatttcactgaggagcccccagagctgccagccaacagtccacacccattaaagctccgcagaattctgaacttatcccctttcacagtgaccgaccatacgcccatggaaacagtcgttgacattttccggaagctgggcctcagacaatgcctggtaaccagaagtggcaggctgttgggaattatcacgaagaaggacgtccttcgtcatatggcgcagatggctaatcaggatcccgaatcaatcatgttcaactag

SEQ ID NO: 218143 - DNA, 459 bp, Artificial Sequence
  Description of Artificial Sequence: Synthetic coding sequence
atggtgaacgccggagcaatgagtgggtcgggcaacctaatggattttctggacgaaccctttccagacgttggtacttacgaggatttccatactatcgattggttgcgagagaagtcccgcgacaccgacagacacaggaagatcacaagcaaatctaaagaatctatttgggagttcatcaaaagcttgctggatgcctggtcgggctgggtggttatgctgctgatcggccttctggctgggactctcgcaggggtcattgaccttgccgtagattggatgacagatttaaaggaaggcgtctgtttgtcagcattctggtactcccacgaacagtgctgttggacctcaaatgagacaaccttcgaggacagggacaaatgcccactctggcagaagtggtccgagctactggtcaaccagtctgaagtgctctctgccgcagccgctgcttag

SEQ ID NO: 218144 - DNA, 2241 bp, Artificial Sequence
  Description of Artificial Sequence: Synthetic coding sequence
atggacttccttgaagaaccgatccctggcgtcggaacgtatgacgacttcaatacaattgattgggtgcgagagaagtctcgggatcgagaccgacaccgcgagataacgaataaatccaaggaaagtacctgggccctgatccacagcgtgtccgacgcatttagcggctggctgcttatgctcctcatcgggttactgtcgggatccctcgctggactcatcgatatctccgcccactggatgactgatctgaaagaaggcatctgcacggggggattctggttcaaccatgaacactgttgctggaactctgagcacgtcacgtttgaggagagggataaatgtcccgagtggaattcatggagccagctgatcattagcacagacgagggcgctttcgcctatatcgttaactatttcatgtacgtcctgtgggctctgctgttcgcctttctagccgtctccttggtaaaggtgttcgccccatacgcctgtgggtcggggatcccagaaatcaagactatcttgtccgggttcattatacgagggtatctggggaagtggacgctcgtcatcaaaaccattacattggtgcttgcagtcagctcaggcttatcccttgggaaggaagggccacttgtccacgtggcctgctgttgtgggaacatactctgccattgcttcaacaagtacagaaaaaacgaggccaagagacgcgaagttctgagcgctgccgctgctgcaggcgttagcgtagcttttggagcccctatcggtggcgtgctattttcactggaggaggtgagttactacttccctcttaaaaccctgtggcggtccttttttgcggctctggtggcagctttcaccttaaggtccattaaccccttcggcaactcccgcctcgtgctgttctacgtggaatttcataccccatggcatctcttcgaattggtcccctttattctccttgggatctttggaggtttgtggggtgcgctcttcatcagaactaatatcgcttggtgtaggaaacgcaaaaccacccagctgggcaagtaccccgtcatcgaggtcctcgtagtgaccgctattacagccattctggcgtttcctaacgaatatacaagaatgagcacaagcgagttgatctcagaactgttcaacgactgcggtctgttagattcaagcaaactctgcgattacgagaatagattcaatacgtccaagggcggtgagctgccagacaggcctgctggtgtgggggtatatagtgcgatgtggcaactcgctctaaccctgattctcaaaatcgtgattactatcttcacttttgggatgaagatccctagcggcctttttatacccagcatggccgtgggggctatagctggccgtctcctgggggttggcatggagcagctggcttattaccaccaggagtggactgtctttaatagctggtgcagccagggcgcagattgcataacgccagggctctacgcaatggtcggagcagccgcatgtctcggaggagtaactcgtatgaccgttagtctggttgtgatcatgttcgaacttactggcggactcgagtacattgtgcccctaatggctgcagctatgacatcgaaatgggtagcagacgccctgggtagagagggcatctacgatgcgcacattcgactcaacggctatccttttctcgaggccaaggaagaatttgcccacaaaaccctagccatggatgtgatgaaaccacgtaggaatgaccccctgttgactgtgctgacccaggattccatgactgtcgaagacgttgaaacgatcatctcagagaccacctattcaggtttcccggtggtggtcagcagggagagccagcgactggtgggatttgtgttgcgtcgagatttgatcatttcgatcgagaacgcccgaaagaaacaggacggcgtagtgagtacgagcatcatctactttaccgagcactccccccctctacctccctatactcccccaacattgaagcttcgcaacatcttagatctcagccccttcaccgtgacagacctgacccccatggagatagtcgtggacattttccgtaagctgggactcaggcagtgcctggtcacacacaacggaagattgctaggcattattaccaagaaagacgtcttgaagcatatcgctcagatggcaaatcaggatccagattccatcctctttaactag

SEQ ID NO: 218145 - DNA, 2451 bp, Artificial Sequence
  Description of Artificial Sequence: Synthetic coding sequence
atggcaatgtggcagggcgcaatggacaataggggatttcagcagggtagtttttctagctttcagaattctagctccgatgaggatctcatggatatccctgccactgcgatggacttttcaatgcgagatgacgtgccacccctggaccgcgaggtaggagaagataaaagttacaatgggggaggcatcggctccagcaaccggattatggactttctagaagaacccatacccggagtgggtacttatgatgacttcaataccattgactgggtcagggaaaagagcagggacagagacagacaccgggaaattacaaataagtcaaaggaaagtacatgggccctcatccactccgtgtctgatgccttctccgggtggcttctaatgctcctcatcggattgctgtcaggatcccttgccggactcattgatatatcggctcactggatgactgatctgaaagaagggatttgtaccggaggtttctggttcaaccatgagcactgttgttggaactccgaacacgtgacttttgaggaacgcgataagtgccctgagtggaacagctggtcccagctcataatctcgacggacgaaggcgctttcgcttatatcgtgaactacttcatgtacgtgttatgggctctcttgttcgcatttctcgccgtgtcacttgtcaaggtatttgcgccatatgcttgcggctcaggaatccccgaaatcaaaacaatcctctccggttttatcattagaggttatctgggcaaatggaccttggtgattaaaacaattactttggtgctggcagtgtcatccggcctttccctcggcaaggagggccctttagtgcatgtggcttgctgctgtgggaatattctatgccactgcttcaataagtatcggaagaacgaggccaagagacgcgaggtgctgagcgcagccgctgcggcaggcgtctccgtggcttttggagcccctatcggaggggtattgttttccctggaggaggtttcttactactttcctcttaagaccctctggagatcattcttcgccgctctcgttgcagcatttacattgcgctctatcaaccccttcggcaacagtagactggtgctgttctacgtggaattccacaccccatggcacctctttgagctggtgccattcatattactgggtattttcggaggcttgtggggagccctttttatccgtaccaacatcgcctggtgtcgtaagagaaagacaactcagctgggcaagtatccagtgatcgaagttctcgtggtgacagctatcacagccattctggcgttccctaacgagtataccaggatgagcacttccgagctgattagcgagttgttcaacgactgcggtctgctggacagttcaaagttatgtgactacgagaacaggttcaatacttcaaagggtggagagctacctgatcgccctgctggcgtgggagtctatagtgcaatgtggcaactggccttgacccttatcctcaaaatagtcatcaccatcttcacatttggtatgaaaatcccttcgggtttgtttattccctctatggcagtaggggctatagctggcaggctgttgggcgtcggtatggaacagcttgcctactaccaccaggagtggactgtcttcaattcttggtgcagccagggggcagactgtatcacacccggattgtatgctatggtgggagctgccgcatgcctggggggtgtgacacgcatgacagttagcctggtggtgatcatgtttgaactaacaggagggcttgagtacatcgtgccactcatggcagccgcaatgacctccaagtgggtagccgacgcgctgggtagggaaggaatctatgatgcacacatccgactgaatggctaccctttcctggaagccaaggaggaattcgcccacaagacactcgcaatggacgtcatgaaacctcggaggaatgacccacttctaacagtattaactcaagacagtatgacagttgaagacgtagagaccatcataagtgagactacctactcaggcttccctgtcgtggtgagtagggaaagtcaaagactagtagggttcgtgctgaggcgcgacctgatcattagcatagaaaatgcgagaaagaaacaggacggcgtggtgagcacatcaatcatttatttcacagagcacagtccgccactgcccccatataccccccctactctcaaactgcggaatattctggacttgagcccctttaccgtcacagacttgactcctatggagatcgttgtggacatttttaggaagctgggcctaaggcagtgtctggtgacacataatggccgactcctgggaatcatcacgaagaaggatgtcctgaaacacatcgcccagatggcaaatcaagatccagattcaatcctcttcaattag

SEQ ID NO: 218146 - DNA, 2451 bp, Artificial Sequence
  Description of Artificial Sequence: Synthetic coding sequence
atggcaatgtggcaaggtgccatggacaatagaggctttcaacagggttcgttctcttctttccagaatagctcatcagacgaggaccttatggacatacccgctacagcaatggatttctccatgcgcgatgacgtccccccactagaccgagaggtgggcgaagacaagtcttataacggtggcggaattggctctagtaatcggataatggatttccttgaggagccaatccccggagtggggacttatgatgattttaataccatcgactgggtgagggaaaaaagccgggatagagataggcatagagaaatcactaataaatctaaggaatcaacatgggccctaatccacagtgtctccgacgcctttagcggctggttactgatgttgctcatcggactgctgtctggaagcctggcaggactgatcgatatatctgcacattggatgaccgacctgaaggaaggcatatgtacaggcggtttttggtttaaccacgagcattgctgttggaactcagaacatgtgacgttcgaggagagggacaaatgcccagagtggaattcatggagccagttaattatatcaaccgacgaaggcgcttttgcttacatcgttaattactttatgtacgtcctctgggctctcctctttgctttcttagccgttagtctcgtaaaggtattcgccccatatgcatgcgggtcgggcattcccgaaattaaaacaatcctgtctgggttcatcatccgtggatacctgggaaaatggacgttggttatcaagaccataaccctggtcctcgccgtatcttccggactatctcttggcaaggagggccctctggtgcacgttgcctgttgttgtggcaacattctgtgccattgcttcaacaaatacaggaaaaacgaggccaaacgcagggaagttctgagcgctgcagcagccgcaggtgtatctgtggcattcggcgctcctataggaggcgtgttgttcagtctcgaagaggtctcgtactacttcccgctgaagaccctatggcgctccttcttcgccgctctcgtcgcggcattcaccctgcgaagcatcaatcccttcgggaactcaaggttagtgctgttctacgttgaatttcatactccttggcaccttttcgaattagtgccctttatccttcttggcattttcggcggactgtggggcgctttgttcattcggactaacatagcttggtgtagaaagagaaagacgactcagttgggcaaatatcccgtaatcgaagtgctggttgtgacagccatcaccgctatcctggcctttcctaacgaatacacccggatgtccacgtccgaactcatcagcgagctgtttaatgactgtggcttgctcgactccagcaaactgtgtgattatgaaaataggtttaacacttccaaagggggagagctacccgatcgccctgcaggtgtgggggtctattcagcaatgtggcaattagcgctgacgctgatcctgaaaatcgttattaccatattcacttttggcatgaagatccccagtgggctgttcatcccatctatggccgtgggcgctattgcagggagacttctcggtgtcggtatggagcagctggcatattaccatcaagagtggacagtgtttaattcctggtgttcccagggagccgattgcattactcccggactgtacgctatggtgggggcagctgcttgtctgggtggcgtgactaggatgacagtgtccctagtggtaattatgtttgagcttactggtggcctggaatatattgttcctttgatggcagctgctatgacgtcaaaatgggtcgcagacgcactgggcagagaagggatttacgatgcccacatacgcttaaatggttacccgttcctcgaagcaaaggaagagtttgcacataagaccctggccatggatgtgatgaagccgagaaggaacgaccctctactgacagtcctgacccaggattccatgactgtggaagacgtggagacaattatatccgaaaccacttactcagggtttccagtggtcgtgtcaagagagtctcaaagactggtgggatttgtgttacgcagagatctcatcattagtattgagaacgctaggaagaaacaggacggggtggtgtccaccagcattatctacttcaccgaacacagcccacccttgcctccctacaccccaccgacactcaagctgcgtaacatcctggatctctctccatttaccgttacggacctaacacccatggaaattgttgtggatatatttcggaaactggggctgcgccaatgtctggtgactcacaatggaagactgctggggattattacaaagaaagacgtcctaaagcacatcgctcagatggcaaaccaggatcccgactctattctctttaattag

SEQ ID NO: 218147 - DNA, 2241 bp, Artificial Sequence
  Description of Artificial Sequence: Synthetic coding sequence
atggactttttggaggaacccattcctggagtggggacctacgatgactttaacaccattgactgggtccgcgagaagtctagggaccgagatcgccacagggagattaccaacaaatcgaaggaaagtacatgggctctgatacacagcgtaagtgacgctttctcaggctggctgttgatgctcctcataggcctcctctccggctctctggctggccttattgacatatcagctcactggatgaccgacctgaaggaaggaatttgtactggaggtttttggtttaatcacgaacattgttgttggaattcggaacacgttacgttcgaggagcgcgacaagtgtccagagtggaactcctggagtcagttaatcatttccaccgatgagggagcattcgcgtacattgtaaattatttcatgtatgtgctctgggccctgcttttcgcgtttctggccgtgtcgctggtgaaagtgtttgctccgtacgcttgtggtagtggtatccctgagatcaagacaatcctgagcggcttcataattcgaggttacttgggcaagtggacgctggtcatcaaaaccatcaccttagtgctcgcggtcagctcagggctttcacttggaaaggaagggcctttggtacacgtggcctgttgttgtggtaacatcctctgccactgcttcaacaagtatcggaaaaatgaggccaaaaggcgcgaagtactctcagcagcagccgctgctggagtgtcagtagctttcggggcacctatcggcggagtgctattcagcctcgaggaagtaagctattactttccacttaaaaccctctggcgctcattctttgctgcactcgtagctgccttcactctcagaagtatcaaccctttcggcaacagtcggttggtccttttttatgtggaattccacacaccatggcatctgtttgagctggtgcctttcattctgctcggcatatttggcggactttggggcgctctgttcattcgtaccaacattgcctggtgtcggaagcgaaaaaccactcagctgggcaagtaccccgtcattgaagtgcttgtggtcacagcaatcaccgcgattcttgccttccctaacgagtatacgaggatgagcacgtctgagctcatctcagaactgttcaacgattgtgggcttctggattcctctaaactttgtgactacgaaaatagatttaatacctcgaaagggggtgagctgccggacagacccgctggggtaggggtgtattccgcgatgtggcagttagccttgactcttattcttaagatagtcatcacaatattcacattcggtatgaagatcccaagcggacttttcattccctctatggctgtgggagcaattgctggacggctccttggggtgggcatggagcagctggcctactatcaccaagagtggactgtgtttaactcctggtgttcgcagggcgctgattgtattacacccggactatatgccatggttggagcggctgcctgcctgggtggggtgactcgaatgaccgtgagtctggttgtgatcatgtttgagctgactggtggcctggaatatatcgtccctcttatggccgcagccatgacaagtaaatgggtggctgacgcactcggcagagagggcatatacgacgcacatattaggttaaatggctatccttttcttgaggctaaagaggagttcgctcataagactctggcgatggatgtgatgaagccgagacgtaatgacccactgttgaccgttctgactcaggactccatgaccgtggaggatgttgagaccattatatcagaaactacctattcaggtttcccagtcgtggtgagccgcgaatcccagcgacttgtgggctttgttcttagacgggaccttattattagtatcgaaaatgccagaaagaagcaggacggcgtcgtgtcaacctcaatcatttactttacagaacattcgccaccactgccaccctatactcctcccactttaaagctgcggaacatcctcgacctgtctccatttacggtgacagatctcaccccaatggagattgtcgtcgatatattccgaaagttgggcctaaggcagtgtctcgtaacccataatgggaggctgctgggaattattactaagaaagacgtattgaagcacatcgctcagatggcaaatcaggaccctgatagtatacttttcaactag

SEQ ID NO: 218148 - DNA, 1947 bp, Artificial Sequence
  Description of Artificial Sequence: Synthetic coding sequence
atgaatattgtcgccggtaccctctctatgtcacccttaaaacgcgataagtgccctgaatggaacagctggagtcaactaatcatttctaccgacgagggtgcgttcgcatacatcgtaaattatttcatgtacgtgctctgggcccttctttttgctttcctggcagttagtttggtgaaggtgttcgccccttatgcctgcggatctggaattccagaaatcaaaaccatcttgtctggctttattataagaggatatctagggaaatggaccctagtgattaagaccattaccctcgtgctcgcagtttcctccgggctgtctctggggaaggaaggccctctggtccatgtagcctgctgttgcggcaacatcctctgtcactgctttaataagtaccggaagaacgaagccaagcggcgagaagtgctgtctgccgctgctgcggctggcgtctccgtcgcttttggagccccaatcggtggggtgcttttctccttggaggaagtctcttattatttcccactcaaaaccttatggagatccttctttgctgccctcgttgcagcctttaccttacgcagcattaacccttttggaaatagtcgtttagtactcttctacgtggaattccacacgccctggcacttgttcgaacttgtccccttcatcctgctcggcatcttcgggggactgtggggcgctctcttcatcagaaccaatatcgcctggtgccgaaagcgcaagactacgcaactgggaaagtacccagtcattgaagtgcttgtggttactgccatcaccgctatactggcctttccaaatgagtatacgcgaatgagtacatctgagctgataagtgaactatttaacgactgcggactgctcgactcctcaaaattgtgtgattatgaaaatcggttcaatactagtaaaggcggagaattgcccgataggcctgccggtgttggggtctactcagcaatgtggcagctggcactcactctgatcctgaagatcgtcatcactatttttacattcggcatgaagattccatcaggactgtttatcccgtccatggccgttggggctattgccggtaggctgctgggtgtcggtatggagcagctggcctattatcatcaggagtggacagtctttaactcttggtgctcacagggcgctgattgcatcacccctggcctgtacgcaatggtgggggcagctgcctgcttgggtggagttaccaggatgacagtttccctggtggtgatcatgttcgaattgacgggcggtctggaatatatcgtccctctgatggcagccgcaatgacgagcaagtgggtggccgacgcgctcggtcgcgaaggcatatacgacgctcatattcgcctgaacggttatccctttttagaggccaaagaagaatttgcccataagaccttggccatggacgtgatgaagcccagacgtaacgacccgctgctgacggtgctgacgcaggactcaatgacagtcgaggacgtggaaactattatttccgagaccacctattctggctttcctgttgtggtctctcgggagtcccagcggctagtgggattcgttctacgacgcgacctgattatatctatagagaatgccagaaaaaagcaggatggcgtggtgtctacctcaataatttacttcaccgaacactcaccccctctaccaccatatacgccgccaacattgaaactgagaaatatcttggacctatctccgtttactgtcactgacctaactcccatggagatcgtggtcgacattttccggaagctcggcctgcgacagtgtttggtcacccataacggaaggctgctaggcataataaccaaaaaagatgtgctgaaacacattgcccagatggctaaccaggaccccgattctatccttttcaactag

SEQ ID NO: 218149 - DNA, 1062 bp, Artificial Sequence
  Description of Artificial Sequence: Synthetic coding sequence
atggcgggatgtcgtggctcactgtgctgttgctgcaggtggtgctgttgctgtggggagcgggaaactcgcacccccgaagagctcaccattctgggggagacccaggaggaggaggacgagatattgccaagaaaagattacgagtctctagactacgatcgctgtatcaatgatccttatctcgaggtcctggaaacaatggacaataagaaggggaggagatacgaagctgttaagtggatggtcgtgttcgctatcggtgtatgtacaggtcttgttggtcttttcgtcgatttttttgtgcgactgttcacccagctgaaatttggggttgtccagacctccgtggaggaatgctcccagaagggatgcctggcgttatctctgctggagctgctcggctttaatctcacatttgttttcctcgcaagtctcttggtgctgatcgaacctgttgccgctgggagcgggatccctgaggtgaagtgctatttgaacggtgtaaaagtgcccggtattgtgcgtctgaggaccctcctgtgcaaggtcttgggagtgctgtttagcgtggccggaggactatttgtcgagaaagagggacccatgatccacagcggaagtgtcgtaggagctggcctgccgcagttccaaagcatctcacttaggaaaatccagttcaactttccatactttcggtcagatcgtgataaacgcgacttcgtttccgccggagctgcggctggagtggccgcagcttttggagctcctatcggaggtaccttgttttcactcgaagagggttcttctttttggaatcagggcttaacatggaaggttctgttttgcagcatgagtgccacctttaccttgaatttctttcgtagtgggatccagttcgggagctgggggagctttcagctacccggtctgctgaacttcggcgagttcaagagtctgcgtgaacccccttgcgtaagcggtaatcaccgagggggtgtttgtggtctggacggagtgaggagaatgccaactgatgtgcttttcgaatccaataggtag

SEQ ID NO: 218150 - DNA, 2610 bp, Artificial Sequence
  Description of Artificial Sequence: Synthetic coding sequence
atggccggatgccgcggatcgctgtgttgttgttgtagatggtgttgctgctgcggagaaagggagacccgaacaccggaagagctcacgattttgggagagacacaggaagaagaagacgaaattctgcctagaaaggattatgagagcctggactatgaccggtgtataaacgacccttacctggaggtgctggaaacgatggacaataagaaaggcagaaggtatgaagccgtgaaatggatggtggtgtttgcgatcggagtttgcaccggactagttggcttgtttgtcgacttctttgtgaggttattcactcagctcaaattcggtgtggttcaaacaagcgtggaagaatgttcacagaagggatgtctcgcgctcagtctcctcgaactgttaggatttaacctgacctttgtgtttctggccagcttacttgtcctgatcgaacctgtcgccgctgggtccggaatccctgaggtgaaatgttacctgaacggagtgaaggtgcccggtatcgtgcggctcagaacactcttgtgcaaagtgctgggcgtgctgtttagtgtggctggcggacttttcgtagaaaaggagggcccaatgatccactcgggcagcgttgtgggcgctggcctcccacagttccagtcgattagcctccgcaaaatacagtttaattttccctattttcgatccgacagggataagcgcgacttcgtgtctgctggtgctgccgctggcgtcgctgccgcatttggcgctcccataggcggaaccctgttctcactggaggaaggtagttcattttggaatcagggtctgacctggaaggtgctcttttgctctatgtcagctacgtttaccctgaatttctttaggagtggcatccagttcgggtcctgggggtcctttcagcttcctggactactgaatttcggagagtttaagtgttccgacagcgacaaaaaatgccatctctggaccgctatggatttagggttcttcgttgtcatgggcgtgattggcggactgctgggagccaccttcaattgccttaacaagagacttgcgaagtaccgtatgcgaaatgtgcaccctaaaccaaagctagttcgggtgttggagagcttactcgtgagcttggtcaccaccgtggtggtcttcgtcgcttcaatggtgctgggtgaatgccggcaaatgtctagtagcagccagatcggaaatgactctttccaactgcaggtcaccgaggacgtgaattccagtatcaagacattcttctgccccaatgacacatacaacgatatggcaactttgtttttcaacccccaggaaagcgcaatcttgcagctatttcaccaggatggtacgttctcccctgttacattggcgctattttttgtgctatattttctgttggcttgctggacctacggcattagcgtaccgagtgggctctttgtgccctctttgttgtgtggagccgcattcggacggcttgtggcaaatgtactcaaaagctacatcgggctcgggcacatatactctgggacattcgcactgataggagcggctgcctttcttggcggagttgtgcggatgaccatctcactgacagtgattctaattgagtccaccaacgagattacgtacggcctccctatcatggtgacgctgatggtagccaaatggaccggagatttcttcaacaagggtatctatgacatccacgtcggtcttcgaggagtgccattgctggaatgggaaacagaggtagagatggacaaattacgggcatctgatatcatggaacccaacctgacgtatgtgtacccccatacccgtatccaatcactggtgagtattctgcgcacaaccgttcatcatgcctttccagtagtgacagagaatcggggtaatgaaaaagagtttatgaagggcaaccagctgatctctaacaacataaagttcaagaaaagctccatcctgacccgggctggcgaacagcgcaagcgtagccaatcgatgaagagctaccctagctcagaactccgcaatatgtgcgatgagcacattgcttcagaggaaccagccgaaaaggaggacctgttgcaacagatgctcgagcggagatatacaccgtatccaaacctttatcccgaccagagtccaagtgaagactggacaatggaggagcgctttcggccactgacatttcacggattgattctgcgctctcagctagtgacgctgctggtccgcggtgtgtgttattcagaaagtcaatcgagcgcctcccagcctcggttgagttatgcagagatggccgaagattacccacgctatccagacattcacgacctcgacctgactctcctcaatcctagaatgatcgtcgacgtgacaccctatatgaacccatccccctttactgtctctcccaacacacacgtctctcaggtgtttaacctgtttagaactatggggctgcgccatttgcctgtggtaaatgccgttggagaaatagtcggcattatcacacgacacaatcttacctatgaatttttgcaagctcggctgagacagcactatcagactatttag

SEQ ID NO: 218151 - DNA, 2544 bp, Artificial Sequence
  Description of Artificial Sequence: Synthetic coding sequence
atggctggctgccgcggatctttatgttgctgttgcaggtggtgctgttgttgcggagagcgggagacacgaaccccagaggaactgacaatccttggggagactcaagaggaagaggatgagatcctcccgagaaaagactacgaaaagggaagaaggtacgaagcagtgaagtggatggtggtgtttgccataggcgtgtgtacaggcctcgtggggctgttcgttgatttcttcgtgcggctttttacccaactcaagtttggtgtcgttcagacatcagtggaggaatgttcacaaaagggttgcctggccctgagtctactggagcttctcggtttcaatttgactttcgtctttctagccagcttgctcgtgctaatagaaccggtggctgccggatctgggatccccgaagtgaaatgctaccttaacggcgtcaaggtcccgggtattgttcgcctgcgaaccctcctgtgcaaggtgttgggtgtgttgtttagcgtcgctggtggactatttgtggaaaaggaaggacctatgattcacagtggttctgtggttggtgcgggtttgccccaattccagtccatctctctgagaaagattcagtttaactttccctatttccgttcagatcgggacaaaagagacttcgtctctgcgggagcagctgccggagtggcagccgcatttggtgctcccatcgggggtacgctgttcagccttgaggagggctctagtttctggaaccagggtctgacatggaaggtattgttctgttctatgagtgcgacattcacgctcaattttttcagatcgggcattcagtttggctcttggggttcattccagctgcctgggcttctgaactttggggagttcaaatgctccgactcagataagaagtgtcacctttggacagcaatggatctcggcttcttcgtcgtgatgggcgtcataggcggtctgttaggtgccacctttaactgcctaaataaacgactcgctaagtaccgcatgcggaacgtgcatcctaaaccgaaactcgtccgagtgctcgaaagcctcctggtttccctggtcaccactgtcgtcgtttttgtggcttccatggtgcttggcgagtgtcggcagatgtcatcaagctcccagatcggtaatgactcctttcagctccaggttaccgaagatgtcaactcctcaattaaaaccttcttttgccccaatgacacttataacgacatggctacattattcttcaatcctcaggagtcagctattctgcagcttttccaccaggatggcaccttctccccggtcacactggcgctgttctttgtcctgtatttcctactggcgtgctggacatatggaatctccgtgccctcaggcctctttgtgcctagcctgctgtgtggagctgcatttggtaggttagtcgctaacgttctcaagagctatattggactgggacacatctactctggaacattcgccttgattggagccgctgcattccttggaggcgtggtccgtatgactatttctctaacagttatcttaattgagtccaccaatgagattacatatggactgccaataatggtgaccttgatggtcgctaagtggactggcgactttttcaataaggggatctacgatattcacgtcgggcttagaggcgttcccttgttggaatgggaaacggaagtggagatggacaagctgcgggctagcgacatcatggagccgaatctgacctatgtgtacccccacactaggatccagagtttggtgtccatacttaggaccactgtgcatcatgcgtttccggtcgtgaccgagaatcggggaaacgaaaaagaattcatgaagggtaaccagctgatttcgaacaatataaaatttaagaagtcgtctatattgacaagggcaggtgaacagcgcaagcgaagccagtctatgaagtcttaccctagcagcgaactcaggaatatgtgtgacgagcacatagcttctgaagaaccggctgagaaggaggatctcctgcagcagatgctcgagcgtcggtacactccttacccaaatctttacccggaccagtcaccttctgaggattggactatggaggaacgcttccgcccacttacttttcatggattgatactgaggagtcagctcgtcacactgttggtgagaggagtgtgttattctgaatcccaatctagtgccagtcagcccagattgtcctatgcagaaatggccgaagactaccccagatatccagatattcacgaccttgacctgaccttactcaatccgaggatgattgttgatgtgactccctacatgaatccttcgcctttcacagtgtcacccaatactcacgtatcccaagtattcaatctgttccgtacaatgggcctcaggcatttgcccgtggtgaacgcagtaggagagattgtgggcatcatcactaggcataatctcacttatgaattcctgcaggcaaggctgcgccagcactaccagaccatttag

SEQ ID NO: 218152 - DNA, 963 bp, Artificial Sequence
  Description of Artificial Sequence: Synthetic coding sequence
atggccggatgtagagggtccttgtgctgttgttgtaggtggtgctgttgctgtggcgaaagggaaacacgaacccccgaggagctgacaattctgggtgagactcaagaggaagaggacgaaatcctaccacggaaagattatgagtctctagactacgacaggtgcataaatgacccctacctcgaagttctggagacaatggataacaaaaaaggtcggagatatgaggcagttaaatggatggtggtgttcgccattggagtttgcaccggcctagtggggctgtttgttgacttctttgttagattgttcacgcagctaaagttcggagtggttcagacgagcgtggaagagtgttcccagaagggatgtctggcactctcactgctggaactgctgggatttaacttaacttttgtgtttctggcatctcttctcgtgctgattgaaccagtcgctgccggatctggaattcctgaggtgaaatgctatctgaatggagttaaggtgccgggtattgtgcgtctgcgaaccctcctctgcaaggtcttaggcgtgttgtttagcgtggccggagggctgtttgtcgagaaagaggggccaatgatccattccggctcggtggtcggcgcaggactgcctcagtttcagtcaatcagtcttcgcaaaatccaatttaatttcccatattttaggtccgaccggtatgggaaaaggcaggaaaggctatgcatatctaggagcggatgctggagttgctgtagcttcagaggggcaaatcgaggctacctggtccaaagtaggggtggattcgtactgctggaacccagagcccatgtggagagcgctctgctcttccatgtctgtcacctgcatccccagctgctgcccttttgggattcagtctggaaattagggttcctcccagcgccttggatcgcagaattgtggagagtatag

SEQ ID NO: 218153 - DNA, 927 bp, Artificial Sequence
  Description of Artificial Sequence: Synthetic coding sequence
atggccggttgccgaggatcactgtgttgctgttgtcggtggtgctgttgctgcggcgagcgagagacgcggactcctgaggagttgactattttaggcgagactcaggaggaggaggacgagattctcccccgaaaagattacgaatctctagactatgaccggtgtataaacgacccttatctcgaggttctcgaaactatggataacaaaaaagggagacgatacgaagctgtgaaatggatggtggtgttcgccatcggcgtttgtacaggactggttgggctttttgtggacttctttgtgagactgttcactcaactcaaattcggggttgtacaaaccagcgtagaagaatgctcccagaaaggatgtctggccttgtctttgctggaactgctgggatttaacttgactttcgttttcctggcaagtctcttggttctgatcgaacctgtcgctgcaggcagcggaatccccgaggtcaagtgttatcttaacggtgttaaagtgccaggaatagtcagacttcggacgcttctgtgcaaggttctgggcgtcctattctccgtagctggaggtctcttcgtggagaaggaaggacccatgattcacagcggaagtgtagtgggagccggtctcccacagtttcaatcaattagtctaagaaagatccagtttaatttcccctacttcagatccgaccgaagcggatgctggagctgttgctcctttaggggcgcaaatcggggatatctagtgcagtctcgcggaggattcgtgctcctcgagcctagggctcacgtggagtcagctcttctgttccacgtctgtcacctccaccctcaactgcttcctttctgggacagcgtttggaagctggggttcctacctgccccatggattgccgagttgtggcgcgtctag

SEQ ID NO: 218154 - DNA, 1062 bp, Artificial Sequence
  Description of Artificial Sequence: Synthetic coding sequence
atggccggatgtagaggctcactgtgctgctgctgccgctggtgttgctgttgcggagagcgcgaaaccagaacaccagaggaactgaccatactcggtgaaacgcaggaggaggaagatgagattctgccgcgaaaagactatgagtcactggattacgatcggtgtatcaatgatccgtacttagaagtcctggaaaccatggacaacaaaaaaggccgaagatacgaggcagtcaagtggatggtcgtgttcgctattggggtctgtaccggtctcgtagggttattcgtggattttttcgtcagattatttacacagctcaaattcggcgttgtgcagacttcagttgaggaatgttcgcagaaagggtgtctggccctgtcactcctcgaacttctaggcttcaatctcacatttgtgtttctcgcttccctactggtgctgattgagcctgtggccgcaggaagcggaattcccgaagtgaagtgctatttgaacggcgtcaaagtgccaggcatcgtccggttacgcaccttactgtgcaaggtgctgggagtcctgtttagcgttgccggtggactgttcgtggaaaaagagggcccaatgattcatagtggatccgtcgtcggagcagggctgccccagtttcagagtattagcttgcggaaaatacagttcaacttcccttatttcagaagcgaccgggacaagcgagattttgttagtgccggagctgcggcaggggttgccgcagcattcggagcaccaataggtggaacgcttttctcccttgaagagggaagcagtttctggaatcagggacttacttggaaggtcctcttctgcagcatgagcgcaactttcaccctgaacttcttccggtcaggaattcagtttggttcttgggggtcttttcagctccctgggttgttaaactttggggagtttaagagcctcagggaacccccatgcgtatccgggaaccacagaggaggcgtatgtggtctcgatggtgtgcggaggatgcctaccgacgtgctcttcgagtcaaacagatag

SEQ ID NO: 218155 - DNA, 2862 bp, Artificial Sequence
  Description of Artificial Sequence: Synthetic coding sequence
atggctggctgcaggggctctctgtgctgctgttgtagatggtgttgctgctgcggggaacgagaaaccaggaccccagaggagttgacaattctgggagagactcaagaagaggaagatgagattttaccccgtaaagactacgagagcctggattacgaccgatgcataaacgacccttatctggaggtactagagacaatggataacaaaaagggtcgccgatatgaagccgtcaaatggatggttgtcttcgcaatcggagtatgtaccggcctagtaggtctgtttgtcgatttttttgtccggttgttcacgcagctgaagttcggcgtcgtccagacctcggtggaggaatgtagccagaaaggttgtctggccttgagcctgcttgaattactggggtttaacctcactttcgtttttctggcctctctgctggtgctgattgagcctgtggccgcaggtagcgggatccccgaggttaaatgttacctcaacggcgtcaaggttcccggaatcgtcagactgagaactctcctgtgcaaggtgctgggcgtccttttcagcgtagcaggcggtctcttcgtggaaaaagaggggccaatgatacacagcgggagtgtcgttggggcagggctgccccagtttcaatctataagcctgcgcaagattcagtttaatttcccttatttccggagcgatcgcgataaaagagattttgtatcggccggtgctgcagccggtgtggcagccgctttcggagcaccaatcggtggcactctattttccctcgaagaagggagctccttttggaatcaggggctgacctggaaggtcttgttttgtagcatgtctgctacctttactttaaatttttttcggtctggcatccaatttggaagctggggtagctttcagctgccgggacttttgaatttcggtgaattcaagtgtagcgactccgataaaaagtgccacctctggacagccatggacctaggtttctttgtggttatgggcgtcatcgggggactgctgggcgcaaccttcaactgcctgaacaaaaggctggcgaaataccgaatgcgtaacgtccaccccaaaccaaagttggttcgagttctggagagcctactggtctctctagtcacaaccgtggtcgtctttgtagccagcatggttctgggcgagtgtaggcagatgagctcgtcctctcagattggaaacgattcgttccaactacaggtgacggaggatgtaaacagctcaattaagactttcttctgtcccaacgatacctacaatgacatggccactttatttttcaacccacaggagagtgcaattttacagctgtttcaccaggatggcacctttagccccgtgaccttagcgctttttttcgtcctgtattttcttctggcctgctggacttacggtatctccgttcccagcgggttgtttgtacctagtctgctttgtggagcggcttttgggagactggtggcgaacgtgcttaaatcctacattggactgggccacatctacagcggcacatttgccctgattggcgcagctgcttttctgggcggagtggttcgcatgactatatccctgaccgtgattctgatcgagagtaccaacgagatcacatacggcctgccgatcatggttactctgatggtggcaaagtggacaggcgattttttcaataaaggcatttatgacatccacgtcggcctgcggggtgtacctctcctggagtgggagaccgaggtcgaaatggacaagttgcgagcttccgacatcatggaaccgaatttaacctacgtatatcctcacacccggatccagagcctcgtgagtatcctccgtactacggttcaccatgccttccctgttgtcacagaaaaccgcggaaatgagaaggagtttatgaaaggcaaccagttaatctccaataatataaagttcaagaagagttctattctcactagagcgggtgaacagagaaagaggagccagtctatgaagtcttatccctcttctgaacttagaaatatgtgtgatgaacacattgccagtgaggagcccgctgagaaagaagatctcctgcagcaaatgctagagcgacggtataccccctacccaaatctttacccagaccaatccccgtcagaggattggactatggaggaaagatttcggccactgacctttcacggccttatccttcgtagccaattggtcaccctcctggtgcggggtgtctgctattctgagtcacagtctagcgcttcccagccccgactgagttacgctgagatggcagaagattatcctcgatatcctgacattcatgacctggacctgactttgctgaatcctcggatgattgttgacgtgacgccttacatgaatccttcaccattcaccgtgtctcccaatacccacgtctctcaggtgttcaaccttttccgcacgatgggccttcggcaccttccggttgtaaacgcagtcggggaagtgtccgaagcccctgcgctgccgccaccccttagggaagacccactggccagatgttgcctatgcacacaggcatcgcatcagaaacgcaggcacccaactcggcgtggggaatgtggacctacgctggcgctgaaccccgctcggttgccttgcaccagggacccgtttccttgtcttccagcggacggcacaagtgttccactcgcagtcttgtcctcacagtccagagctagcacccgtttatgcctgccccctgagatgctgcttttcacaccataccactggtgcagtctggtactgcacctgcggagggacctgcgaatccgttag

SEQ ID NO: 218156 - DNA, 369 bp, Artificial Sequence
  Description of Artificial Sequence: Synthetic coding sequence
atggctggatgcagaggatcgctctgttgctgttgtcgctggtgctgctgctgtggcgagagggagacgcggactccagaggagctgaccatcctcggggaaacccaggaggaagaggacgagatattgcctcggaaggattacgaatccttagattatgacagatgcatcaacgacccttacctggaagtgttagaaaccatggataataaaaaaggcaggagatacgaggccgtgaaatggatggtggtgttcgctatcggagtatgtacgggtctggtgggattatttgtggacttttttgtgcgcctgtttacccagctcaagttcggggtcgtgcagacctacaaattccagatgaaaatgtag

SEQ ID NO: 218157 - DNA, 2277 bp, Artificial Sequence
  Description of Artificial Sequence: Synthetic coding sequence
tcacctcggagcgctctgttccgcgtgggccacatgagctccgtggaactcgacgacgagctccttgacccagacatggaccccccacatcccttcccaaaagagattccacacaatgagaagctgttgagtctcaagtacgagagcttggactacgataattctgaaaaccagctgtttctagaagaagagagacgcatcaaccacaccgcctttcggactgtggaaatcaagcgctgggtgatttgtgcactgatcggaattctgacgggactagtggcgtgcttcatcgatattgtggtcgaaaatctggcgggacttaagtatagagtgatcaaaggcaacatcgataagttcacagagaaaggcggtctcagtttctctcttcttctctgggcaactctcaacgcagctttcgtactcgtcgggagtgtgatagtggctttcatcgagcccgttgccgctggctctggaataccacaaatcaagtgcttcctcaatggagtcaagataccgcatgtcgttcgccttaagacccttgtgatcaaggtcagcggtgttatcctgtctgttgtgggagggctggcagttgggaaagagggtccaatgatccacagcgggagcgtcatcgcggctgggattagccagggacgatctacctctctgaaaagagacttcaagatatttgaatacttccggcgtgacaccgaaaagcgcgattttgtcagtgctggagccgcagctggtgtttcagccgcatttggcgctcccgtcgggggagttctgttctcactggaagagggcgcttctttctggaatcagtttttgacctggaggatattttttgcatctatgatatccactttcacactgaactttgtgttatcaatataccatggaaacatgtgggatctctcaagtcccggactgatcaactttggacggtttgattccgagaaaatggcttacaccatccacgaaatccccgttttcatcgccatgggcgttgtgggcggagtattgggagcggtgttcaatgccctgaactactggcttacaatgtttcggatacggtatatccacaggccttgtctgcaagtgatcgaggcagttctggttgctgctgtgactgccaccgtagccttcgtgctcatctattcttcgcgagattgtcaacctctgcagggaggctccatgtcatatcccctgcaactgttttgtgctgacggagagtataactcgatggccgcagcctttttcaacacaccagaaaagagtgtggtgtctctgttccacgatccacccggatcttacaatcctttaaccctgggactctttacgctcgtgtacttctttcttgcgtgctggacgtatggtttgaccgtgtctgccggtgtgtttattcctagtctgctgataggggctgcctggggtcggctgttcgggatttcacttagctatctcaccggggctgccatttgggccgatcccggaaaatatgctttaatgggtgcagcagcacagctcgggggaattgtccgcatgacattgagtttgacggtcattatgatggaagctacttccaacgtaacatatgggttcccaatcatgctggtgctcatgactgccaaaatcgtaggcgatgtcttcatagaagggctgtacgatatgcatattcagctacagtccgttccgttccttcactgggaagcccctgtgacctctcattctctcaccgctcgcgaggtgatgagtactccagtgacctgtctgagacggagagaaaaagtgggagtgattgtagatgtgcttagcgacactgcttctaatcataacggctttccggtggtcgaacacgcagatgacacgcaacccgctaggctgcaggggctcatactgagaagccagttgatagtactgcttaaacacaaagtgttcgtcgagcgatctaacttaggcctggttcagcgtagactccgcctcaaagacttccgcgacgcgtacccaaggtttcctcccattcagtccatccatgtcagtcaggacgaaagagagtgtacgatggatttgagcgaatttatgaacccaagcccttacacagtaccacaggaagccagtctgcctagggtgttcaagctctttcgggcactgggccttcgccacctggtggtcgtcgataaccggaaccaagtagtagggctagttaccaggaaagatttggcccgatacaggctgggcaagcgcggtctggaggaactctctctggcgcagacgtag

SEQ ID NO: 218158 - DNA, 2418 bp, Artificial Sequence
  Description of Artificial Sequence: Synthetic coding sequence
atggccaatgtatccaaaaaggtctcttggtctggcagggatcgagacgatgaggaggccgcaccccttctgagacggacggcaagaccagggggtggcacccctctgctgaatggggctgggccaggtgccgcacgccagtctccacggtcagcactgttcagggtgggacacatgagctctgtggaactggacgatgaactgcttgacccagacatggaccctccgcatccctttcctaaggagatcccccataacgagaagctgctgagtctgaagtatgagagcctggactatgataattctgagaatcaactgtttcttgaggaagaacgtagaataaatcacacagccttccgtaccgtggaaattaagcggtgggtcatctgcgctctgattggtattttaacagggctggtggcatgttttattgatatcgtagtagagaacctggccggactgaaataccgggtgattaagggcaacattgacaagttcaccgaaaaggggggtctatccttttctttgctcctgtgggccactctgaatgccgctttcgtccttgttggctccgtcatcgtggccttcattgaacctgtcgctgctggctctggcatcccccagattaaatgctttctcaacggtgtcaagatccctcacgtcgtccggttgaagacattggtgatcaaggtttccggcgttattttgagcgtggtggggggtctggccgtagggaaagaaggaccaatgatccattccggatccgttatagccgctggaatctcccagggccgtagtaccagcctgaagagggactttaaaatattcgaatatttccgccgagataccgagaaacgggacttcgtgtctgctggggctgctgccggagtgtctgccgcattcggagcccctgtgggaggagtactcttctccctcgaggaaggcgcttctttctggaaccagtttttgacctggcggatcttttttgccagtatgatcagcaccttcaccttgaatttcgtactgtctatttatcacggtaatatgtgggatctgagctctcccggactgataaatttcgggagatttgacagtgagaagatggcatatacaatccacgagatcccggtgtttatcgctatgggggtagtgggaggcgttttgggcgctgtatttaatgcccttaattattggcttacgatgtttcgcattcgttatattcatcgaccatgcttacaggtcatcgaagctgttttggtagcagccgtgactgccaccgtcgcatttgttctcatttacagctcacgcgattgtcaaccactccaagggggaagcatgagctatcccctgcagcttttctgtgcggacggagagtataacagtatggccgcagccttcttcaacactcccgagaaatcagtcgtgtctcttttccatgatcccccaggcagctacaaccccctgacattgggactgtttaccctggtgtatttctttttggcctgctggacgtacgggctgaccgttagcgctggggtttttattccttcactgctcatcggggctgcatgggggaggttattcgggattagcctcagttatctcaccggtgcagccatctgggcagatcctggcaagtacgctctgatgggagctgccgctcagcttggtggaatcgtgcgcatgaccctttctctcaccgtaatcatgatggaggctacgtcgaacgtgacttatggtttccctataatgctagttctgatgactgccaagattgttggcgacgtattcatcgaggggctgtacgatatgcacattcagctgcaaagtgttccatttctgcactgggaggcacctgtcacgtcgcacagcctgacagcccgtgaggtgatgtccacccccgtgacttgcctgaggaggagagagaaagttggagtcatcgttgacgtgttatccgatacagcttccaaccacaatggattccccgtcgtagagcacgccgacgatactcagcccgcacgactgcagggcctgatcctccgttcacagctgatcgtattgttgaaacacaaagtcttcgtggaacgctctaatctcggtctggttcagcggaggctgcgtctgaaggacttccgggatgcctatcctcgctttccacctatccagagcatccatgtcagccaggacgagcgggagtgtacaatggatctctccgaatttatgaacccgtcaccctataccgtcccccaagaggcatcgctccctcgggtttttaagttatttcgagccctggggctacggcacctcgtcgtggtcgacaaccgtaaccaggtggtgggcctggtgacaagaaaggacctggcacgctaccgcttaggaaaaaggggtctcgaggaactctcattggcacagacttag

SEQ ID NO: 218159 - DNA, 2244 bp, Artificial Sequence
  Description of Artificial Sequence: Synthetic coding sequence
atgtcctctgtagagttggacgacgaactattagacccagacatggacccgcctcatccatttccgaaggaaattcctcataacgagaagctactgtcactgaagtacgagtctctggattatgataacagcgaaaatcagctgtttctggaagaagaaagacgcattaatcacaccgcatttaggaccgtcgagattaagaggtgggtgatttgtgctttaatcggaatcctgactggcttagtggcctgctttattgacattgtagttgagaatctcgccggactcaaataccgggtgatcaaggggaatattgataagtttaccgagaaaggtggtctttccttcagtctcttgttatgggctaccctcaatgccgcttttgttctcgtggggtctgttatagtagcattcatcgaacctgtcgcagcaggctccggaattcctcagattaaatgtttcctgaacggcgtgaaaattccccacgtggtgagattgaaaacactggttataaaagtctccggcgttatcctctccgtggtgggagggctggccgtgggaaaggaaggccctatgatacactcggggtcagtcatcgctgctggaatctcccaggggagaagcacttctctgaagcgcgacttcaagattttcgaatattttcgacgcgacaccgagaagagggactttgtgtcggccggtgcggcagccggtgtatccgccgcttttggagcaccagtcggcggagtgctatttagtctggaggaaggagcctcgttctggaatcaatttctgacctggaggatatttttcgctagtatgattagcacttttacgttgaacttcgttttatccatctaccacgggaacatgtgggacctttcttcccccggattgatcaactttggtaggttcgactctgagaagatggcttatactatccatgagattcctgtgtttattgccatgggtgttgtggggggagtcctgggtgctgttttcaatgcactgaattattggctcaccatgttcaggattcgctatatccacaggccttgcctgcaggtgattgaagccgtactggtggctgctgtcaccgctacagtggccttcgttctgatctattcctctagagattgccaacctctgcagggcggatccatgtcttacccactccagctcttttgcgccgatggcgaatataactctatggctgccgcattcttcaacaccccagagaagtctgtggtgagcctgttccatgatcctcccggtagctacaatccacttacactcggcctctttaccctcgtgtatttctttttggcatgttggacatacggactcaccgtgagcgccggtgtgtttatccccagccttctgataggggctgcctggggtagactcttcggcatatcgctgtcttatcttacaggggcagctatctgggcagacccgggtaaatatgccctcatgggcgcagcagcacaactgggaggtatagtacggatgacactgtccctgaccgttatcatgatggaagctacaagcaatgtcacctacgggtttcccatcatgctggtcctgatgactgcgaagatcgtgggtgatgtgtttatcgagggactttacgatatgcacattcagctgcagtctgtgccctttctccactgggaggctccagttacctctcacagtttgaccgcacgggaagtcatgtcaaccccagtcacctgtctaagacggagggagaaggtgggagtcatcgtcgacgtcctctcagacaccgcgtcaaatcacaatgggtttcctgttgttgagcacgctgatgacacccaacccgctcgactgcagggacttatattacggtcacagctgatagtgttgttgaaacataaggtgtttgttgagcgctctaacttagggttagtacaaagaaggctccgcctgaaagacttccgggatgcctaccccagattcccgcctatccagtcaattcatgtttcgcaggatgaacgagagtgtactatggatctgtcagagtttatgaacccctcaccatatactgtgccgcaggaagcaagtctgccaagagtgttcaagctgttcagagccctggggcttcgccatttagtcgttgtagacaatcggaaccaggtggtaggactagttacccgaaaggaccttgctcggtaccggttaggtaagcgtgggctggaagagttgagtctggcacagacatag

SEQ ID NO: 218160 - DNA, 2346 bp, Artificial Sequence
  Description of Artificial Sequence: Synthetic coding sequence
atggccaacgttagcaagaaggtcagctggtccggtagagaccgggatgatgaggaagccgcacctttgctgaggcgcacggccagaccagggggagggaccccgcttctgaatggagccggtccaggagccgcaaggcaggacatggacccaccccaccctttccccaaagaaattccgcacaacgagaaactactctcgctcaaatacgaatccctcgactatgacaacagtgagaatcaattatttctggaagaggagcgacgcatcaaccacaccgcctttcgcacggtcgaaatcaagagatgggtaatttgtgcgctgattgggattctgacagggctggttgcctgttttattgacattgtcgtggagaatttggccggtctcaaatatagagtgattaagggcaacatcgacaagttcactgagaagggaggtctctccttttctctcttgttgtgggccacgcttaatgcagcattcgttctggtgggtagtgtgatcgttgctttcatcgagcctgtagccgcaggctctggtatcccccaaataaagtgctttctcaatggggtcaagataccacacgtcgttaggctaaaaacgttggttattaaagtgtctggtgtgattttaagcgtggttgggggactcgccgtgggaaaagagggcccaatgattcattcaggctctgtcattgccgctggcatatcccaggggaggtctactagtctgaagcgcgactttaagatctttgaatacttcagaagagacacagagaaacgggattttgtttccgctggcgcagccgcaggcgtgagcgccgcttttggggcaccagtcggaggggttttgttcagcctggaagaaggagcgagtttctggaaccaattcctaacctggaggattttttttgcctcaatgatcagtacttttacactaaacttcgtgttatccatttaccacggcaacatgtgggatttaagctcacctggcttgattaactttggccgtttcgacagcgagaagatggcttataccatccatgagatccctgtctttattgctatgggcgtggttggaggggtgttaggcgctgtattcaacgccttgaactactggcttactatgttcagaatcagatatattcataggccctgccttcaggtgatcgaagcggtgctagtcgcagccgtgactgcaactgtagcttttgtccttatttattccagcagggactgccaaccactgcaagggggttcaatgagctatccgctccagctgttttgcgccgatggcgagtacaattctatggccgcagccttcttcaacacccccgagaagagtgtggtctctctcttccatgacccacccggaagctacaatccactgacgctcggcctctttaccctggtgtacttctttctagcctgctggacatacggcctgaccgtttccgccggtgtgtttatcccgtccctcttaatcggggcagcgtggggtagactcttcggtatctccctgtcctaccttacaggagccgctatctgggctgatcctgggaaatatgccctgatgggagcggcagcccaattaggtggaattgtcagaatgacgctgtctctgaccgtcatcatgatggaggcgacctccaatgtaacgtacggtttccccatcatgctcgtacttatgaccgctaaaatagttggtgacgtgtttattgaaggactgtacgatatgcacatccagctgcagtcagtccccttcctgcattgggaggcccctgtgacctcgcattcccttacagcgagggaagtgatgagtacaccagtcacttgtctccgcaggcgggaaaaagtcggcgtgattgtcgatgtactgtccgataccgcatccaatcacaatgggttccctgtggttgaacacgctgacgacactcagccagcccgtctacaggggttgatccttcggagtcagctgattgtccttctcaagcacaaagtgttcgtggagcgatctaatctcggtttagttcagcgtagactgcgcctcaaagatttcagagatgcctatcccagattcccacccatccaaagcatccacgtttcccaggacgaaagagaatgcactatggatctgagtgagtttatgaacccctccccttacactgtcccacaggaggcctccctccctcgagtctttaaacttttccgagcattaggcctgcgacaccttgttgtcgtggataatcgcaaccaagtggtcggcctcgtgaccaggaaagatttggcgaggtacaggctgggaaagcgtgggctggaggagctgagcctcgctcagacttag

SEQ ID NO: 218161 - DNA, 1545 bp, Artificial Sequence
  Description of Artificial Sequence: Synthetic coding sequence
atggtcctcgatctagatctatttcgagtggacaagggcggagatccagctcttatccgagagacacaggaaaagcgcttcaaagacccgggtctggtggatcaattagtcaaggccgattctgaatggcgaagatgccgatttcgggcagataatctaaataaacttaaaaatctttgtagcaagacgatcggcgagaagatgaaaaagaaggaacctgtcggcgacgatgaatctgttccagaaaacgtgttatccttcgacgacctgactgccgacgctcttgccaatctgaaagtcagccaaattaaaaaagtgcggctgttaattgatgaggcgatcctgaaatgcgacgctgaaagaatcaagcttgaagcagaacgcttcgagaacctaagggagatcggtaatttactgcacccttccgtcccgatctccaatgatgaggacgtggacaacaaggttgaacgcatctggggagattgtaccgtgcggaagaagtactcccatgtcgaccttgtggtaatggttgatgggtttgaaggcgagaagggagcagtggtggccggtagtagggggtactttttgaaaggggttcttgtttttctggaacaggctctcatccagtacgccctacggacgttggggtcccgaggctacattcctatatacacacccttcttcatgcggaaagaagttatgcaggaagttgcacagctgtctcagttcgacgaggaactgtataaagtcataggtaaaggctccgaaaagagtgatgacaattcttatgacgagaagtatctgattgccacatccgagcagcccatcgccgcattgcaccgggacgaatggctcaggcctgaagaccttcccatcaagtatgcgggactttctacatgcttccgccaggaggtaggatcccacggaagggatactcggggaatcttccgggttcaccagttcgaaaagatcgaacagttcgtctattcctcacctcacgataacaagtcttgggagatgtttgaagagatgataaccactgctgaagagttctaccagtctcttgggatcccctatcacatcgtgaatatcgtgagcggctccctgaatcacgccgcatccaagaagcttgatcttgaagcctggtttccgggaagcggtgcatttagggagttagtgagctgctcaaattgcacagactaccaagcgcgtaggttacgtatccgctatggtcaaaccaagaagatgatggataaggttgaattcgtgcacatgctcaatgctaccatgtgtgccaccaccagaactatatgcgccattctggaaaattaccagacggaaaaaggaatcaccgtcccggaaaaactgaaagaatttatgccccctggcttgcaggagcttatcccatttgtaaagcctgcccctattgagcaggaacctagcaagaaacagaagaagcagcacgagggctccaagaaaaaggctgcagctagggacgtgaccttggagaaccggctgcaaaacatggaagtaacagacgcatag

SEQ ID NO: 218162 - DNA, 2745 bp, Artificial Sequence
  Description of Artificial Sequence: Synthetic coding sequence
atggggccttttaaatcatctgtgttcatactaattctacacctgcttgaaggtgcactaagcaattcgttgattcagctgaacaataatggttatgagggcattgtggtggcgattgatcctaatgttcctgaggacgagacactcatacaacaaattaaagatatggtgactcaggcctctctgtacctgctcgaggcaaccggcaaaaggttttactttaagaacgtcgccatactgattcctgagacatggaaaacaaaggcagactacgtgaggcccaaactcgaaacttataaaaatgccgatgtcctggtcgccgaatccacacccccaggcaacgacgagccttacactgagcagatggggaattgtggtgagaaaggcgagcgcatacatctcacgccagacttcattgccggtaaaaagcttgccgaatatgggccacaaggcagagcctttgttcacgaatgggcccacttacgttggggcgtgtttgacgagtataataatgatgagaaattctatttatcgaatggtaggatccaggccgtacgctgttcagccggaattacaggcacaaacgttgttaagaaatgtcagggtggctcgtgttacaccaagcgctgcacatttaataaggtcacaggactgtatgaaaagggatgcgaatttgtcttacagtcacggcagactgaaaaagcttcaattatgttcgcccaacatgtcgattctatcgtggagttctgcacagagcagaaccataataaggaggcgccaaataaacagaaccaaaaatgcaacctgagatccacctgggaggtgatccgcgactcagaagactttaagaaaacaacccccatgactactcaaccaccgaaccccactttttcccttctccagatcggtcagcgcatcgtctgcttggtcctcgataagagcggctcaatggccactggcaatcgcttaaatagactgaaccaggccggacagctctttctgctgcagactgtcgagctgggctcctgggtcggcatggtgacttttgatagcgcggctcacgtacagaatgagctgatacagatcaacagcggttctgatcgagatacactggcgaagcgcctcccggcagccgcaagcggtggcacttccatttgcagcggtttgcgtagcgccttcaccgtgattcgcaaaaaatatcctacagacgggtctgaaattgtgctccttactgatggagaggataacactatcagcggatgcttcaacgaagttaaacagtcaggggctattatccatacagttgccctaggcccttctgcagctcaggagctggaggaactttcgaagatgacgggcggactgcagacctacgcctccgaccaggtccagaacaatggactgatcgatgccttcggggctctgtccagcggcaacggtgcggtctcccagaggagtatccagctggaaagcaaggggttaacgctgcaaaactcacagtggatgaacggcacagtaattgttgactcaacagtcggcaaagacactctcttcctcatcacctggacgatgcagcccccacagattctcttgtgggacccatccggccagaaacagggtggctttgtggtcgacaaaaatacaaagatggcctatcttcagatacccggaattgctaaagtagggacctggaagtacagtttgcaggccagtagtcagacccttacactaacagtcacgtctagggccagcaacgccacccttccccctatcacagtaacttcgaagaccaacaaagacacctcgaaattcccaagtccattggtggtttatgccaacattaggcagggcgctagccctattctgcgcgcatcagtaaccgccttaattgaatcagtaaacgggaaaacagtgactttagaacttctggacaatggggctggggctgacgccacaaaggatgacggggtgtacagtaggtactttacaacctacgacaccaatgggcgttactctgtcaaggttcgggctcttggcggagtgaacgccgctcggagaagagtgatcccccagcaatccggggctctctacattccaggatggatcgaaaacgatgaaatacagtggaacccacctagacctgagatcaacaaagacgacgtgcagcacaaacaagtttgtttctcccgcacatcatctggaggaagcttcgttgctagcgacgtacctaatgcgcctatccctgatctcttcccaccaggtcagatcacagatttaaaggcggaaatacatggcggtagcctgattaatcttacatggacagccccaggagatgactacgaccatggcaccgcccacaaatatatcattagaattagtactagtatcctggacctgagagacaaatttaatgagagtctccaggtgaacaccacggcactcataccaaaggaagccaactccgaggaagtttttttgttcaagccagagaatataacttttgaaaacggcacagatctgtttattgcgattcaagccgttgataaggttgatctcaaatcagagattagcaatattgcccgtgtatccctgttcatcccacctcagacccctccggaaacacccagtcccgatgagacttccgccccttgtcccaatattcacattaacagcactatccccggtatacatattctcaagattatgtggaaatggatcggcgagctccaactgtccattgcatag

SEQ ID NO: 218163 - DNA, 987 bp, Artificial Sequence
  Description of Artificial Sequence: Synthetic coding sequence
atgactacccagcctcccaaccctactttctccttgctccaaattgggcagagaatcgtatgcctagtgttagacaagtctggatccatggcgacagggaatagactgaacagactcaaccaggctgggcagctcttcctactgcagaccgtggagctgggctcctgggtgggaatggtaacattcgactccgccgcacacgtccaaaacgagctaatccagattaattctggatctgatagggacaccctcgcgaaacgtctccctgcagccgcttctggaggcacatcaatttgctcagggctccgatccgcctttaccgtcattagaaaaaagtaccctactgacggctctgagatcgtgctgttgaccgacggcgaagacaacacgatctccggatgcttcaatgaagtgaagcagagtggagcaattatccacaccgtggcccttggcccatccgcagctcaggagcttgaggaactgtctaaaatgaccggcggtctccaaacgtacgcttcagatcaggtgcagaacaatggcctcatagatgcattcggggctctgagctctgggaacggagcagtctctcagcggtccatccaattagagtctaaaggtttgaccctccagaatagccagtggatgaatggaactgttatagttgatagcacggtgggcaaggatactctgttccttatcacatggaccatgcagccgccacagattctgctgtgggatccgtcagggcagaagcagggcggattcgtggtagacaagaatacaaagatggcctacctgcaaatcccaggcatcgctaaggtcggcacctggaaatatagccttcaggcttcctcacagacccttactcttacagtgacttcccgagcgagcaacgcaactcttcccccaattaccgtgacatctaagaccaataaggatacttccaacctccccaactcccaaggtcagtgtcattcccccgattag

SEQ ID NO: 218164 - DNA, 2064 bp, Artificial Sequence
  Description of Artificial Sequence: Synthetic coding sequence
atggaggaactggtcgggttgcgggaggggttcagcggcgatcccgtgacactgcaggagctgtgggggccttgtcctcacattcggagggccatccaaggaggcctcgaatggttaaagcagaaagtctttagactaggcgaggactggtatttcctcatgactctcggagtcctgatggcactggtatcctacgcaatgaacttcgccattggatgcgtggtcagggcccatcagtggttatacagagaaataggcgatagccacttgttgagatacctctcttggactgtctaccccgtagcactggtgtctttttccagcggattttcgcaaagcatcactccgagtagtggcggatccggcattcccgaactgaagacaatgctcgcaggcgtcattctggaggattatctggacataaagaacttcggcgcaaaggtggtgggcctgtcctgcacactggccactggctcgaccttattcctcggaaaagtcggcccattcgttcacttgagcgtcatgatcgcagcttacctcgggagggtaagaaccactacaatcggggagccagaaaacaaatcaaagcaaaatgagatgttggtggccgcagctgcagtgggcgtcgccaccgtgtttgcagcgcctttctctggcgttctgttttccattgaggtgatgtcaagtcattttagcgtccgggactattggcggggtttttttgctgctacctgcggtgcttttatttttaggctgctcgcagtgtttaatagcgaacaggagaccatcactagtctgtacaaaacttctttccgggttgatgtgccatttgacctcccggagattttcttttttgttgctttaggcggtatatgtggagttctgtcgtgcgcctacttgttctgccaaaggacgtttctcagcttcattaagacgaaccgctacagcagcaaactgttggctaccagcaagcccgtatattctgctctcgcgacactactgctagctagcattacataccccccaggcgtgggccacttcctggcttctaggctgtcaatgaaacagcacttggactctctcttcgataaccatagctgggccctaatgactcagaacagctctccaccatggcccgaggagctggatccacagcacttgtggtgggagtggtatcatccgcgatttacgatatttggtactttggccttctttctggtcatgaaattctggatgctgatcttggctactaccatccccatgccagctgggtatttcatgcctattttcattctgggggcagccattggcagactgttaggcgaagccctagcagtggctttcccagagggcattgtaaccggcggagtcactaacccaatcatgccagggggatatgctctcgccggagctgccgcattttctggtgccgtgacccacactatcagcactgctttgttggcttttgagctcacgggacaaatcgttcatgctttgccagtgctcatggcggtgctggccgcaaacgctatcgcacagtcatgccaaccatctttctacgacggtaccatcatcgttaaaaaactcccttatttgccaaggatcctcggccgtaacattggatctcatcatgtgcgagtggaacacttcatgaaccactctattactactctagctaaggatacacccctggaggaggtggtcaaggtggtaacgagcactgatgttaccgaatatcccttggtggagtccactgaaagtcaaatcttagtcggtattgtacaacgagcacagctggttcaagccctgcaagcggaaccaccttcgcgggctccgggacaccagcagtgtttgcaggacattctcgctaggggatgcccaacagaacctgtgacgctgaccttattctccgaaaccaccctgcaccaggcacagaacctgttcaagctcttaaatctccagagtttgttcgtaacaagtagaggcagagcagtgggctgcgtctcgtgggtcgaaatgaagaaggccatttccaaccttaccaatcccccagcaccaaagtag

SEQ ID NO: 218165 - DNA, 2061 bp, Artificial Sequence
  Description of Artificial Sequence: Synthetic coding sequence
atggaggagctggtcggcctgcgcgagggctttagtggtgaccccgtgaccttacaagaactctgggggccttgtccccacattcgcagagcaattcaagggggactcgagtggctgaaacagaaagtgtttaggctgggggaggactggtactttctgatgacgctgggggtccttatggccctcgtgtcttacgcaatgaacttcgccattgggtgcgtggtgcgcgcacatcagtggctgtaccgagagatcggcgattcccacctgctgagatacctctcctggactgtgtaccctgtcgctctggtgtcattcagcagcggattttcacagtcaatcacgccttcatctggagggagcggaattcccgaactgaagacaatgctggcaggagtgattttggaagactatcttgatattaaaaattttggcgctaaggtggtaggtctgtcctgcaccctggccaccggcagcaccctgtttcttggtaaagtgggacccttcgtgcatctgtcggttatgattgccgcttaccttggaagggtcaggactacaacaattggcgagccagagaacaagtccaagcaaaacgagatgctcgtagccgcagctgcagtcggagtagcaacggtctttgctgcccctttcagtggggtgcttttctccatcgaggtcatgtcctcacacttttcagtacgggattattggagaggatttttcgccgcaacctgtggggcattcatttttcggcttctggcagtattcaatagcgagcaggaaactatcacttcactatataagaccagctttagggtcgatgtgccgttcgacctccctgagatctttttcttcgttgctttgggcggtatttgcggagtgctttcctgcgcataccttttctgtcaacgcacatttctttcttttataaagacaaatagatattcctctaaacttctggcaacttccaaacctgtgtattcggcactcgcaacgttgcttctggcatccattacgtaccccccaggtgttggccatttcctcgccagcagactgtccatgaagcagcatctggacagcctctttgacaaccactcttgggccctcatgactcaaaactccagcccaccatggccggaggagctagatccacagcacctatggtgggagtggtatcaccccaggtttacaatcttcggcacattggcttttttcctggtgatgaagttctggatgctaatcctcgcaactaccattcccatgcctgcgggttatttcatgcccatctttatcttgggtgcagccataggaaggctgctgggtgaggccctagcggtcgcatttccagaggggattgttacagggggtgtgacgaatcctataatgccgggagggtacgccctggcgggagcagcagcattctcgggtgccgtaacccacactatttcaacagcactgctcgctttcgagctgacaggacaaatcgtccacgccctccccgtgttgatggcagtacttgccgctaacgcaatcgcccagagctgtcagccgtcattctacgacggcacgatcatcgtgaaaaaactgccctacctccctagaatcctaggaaggaacatcggcagtcatcacgtccgagtcgagcactttatgaaccattccatcaccacgttggctaaggacacacctctggaagaggtggttaaagtggttacttctaccgacgtcaccgagtatcccctggtcgagtccactgagtcccagatattggtcggcattgtgcagcgggctcaattagtgcaagccttgcaggccgaacccccaagccgcgcacctggtcaccagtgtctgcaagacatcctcgccagaggatgtcccacggagcccgtcactctgaccctcttcagcgaaacaactctgcaccaggctcagaatctatttaaattgttgaacttacagagcctctttgtgactagccgcggaagagccgtgggatgtgtgagttgggtggagatgaaaaaggccatctcaaacttgaccaacccgcctgccccaaaatag

SEQ ID NO: 218166 - DNA, 2061 bp, Artificial Sequence
  Description of Artificial Sequence: Synthetic coding sequence
atggaggagttggtggggctgcgtgagggattttccggtgaccccgttactctacaggagctgtgggggccatgtccacacatccgaagggctatacaggggggacttgagtggctcaagcaaaaagtctttaggcttggagaagattggtattttttaatgacgcttggcgtgcttatggccctcgtctcttacgcaatgaacttcgccatagggtgcgtggttcgtgcccatcagtggttatatagggagatcggagactcccatctgctgcgctacctctcctggactgtttacccagtggcactggtttcttttagctctgggtttagccagagtatcaccccatcgtccggcggatcgggcattcctgaattgaaaactatgctggcaggagtgatactggaggattacctagacatcaaaaattttggcgctaaggtcgtggggttaagctgtactttagcaacgggttcaacgctcttcctagggaaagtcgggcctttcgtgcatctgtcggtgatgattgcagcgtacttaggccgtgtaagaaccactaccatcggcgagccagagaacaagagtaagcagaacgagatgctggttgcagctgccgctgtgggcgtggcgactgtgttcgcagctccttttagcggggtcctgttttccatagaggtcatgtcgagccatttctccgtacgcgattactggaggggattcttcgcagctacttgtggcgcatttatcttccggctgttggcagttttcaattctgaacaggaaacgatcacctctttgtataaaacttccttccgggtagatgtgccttttgacctgcctgaaatattcttcttcgtggctctaggtggcatatgtggcgtactcagctgtgcgtatctcttttgtcagagaacctttctgtcttttattaagactaacaggtactccagcaagctgctggctacttcaaagccagtgtatagcgctctggcaacactactcttagcttccataacatacccccctggtgtggggcacttcttagccagtcggttgtcaatgaaacaacatctggattccctctttgataaccacagctgggcacttatgactcagaacagctcacccccatggcccgaagagctggatccacaacacctatggtgggagtggtatcaccctcggtttactatcttcgggaccctggctttctttcttgttatgaaattttggatgctgattttagcaacaaccatccctatgccagccggatattttatgccgattttcattctgggagccgctatcggtcgcttactcggcgaagctcttgcagtggccttccccgaggggatcgtgaccgggggagttacaaatccgataatgcccggtggctatgccttggcaggcgcagccgctttctccggggctgtcacacataccatttccaccgctctcctggcattcgagctgacaggccaaatcgtccacgccctgccagtcttgatggccgtgctagccgcaaatgctatcgcccagagctgtcagccgagtttttacgatggcacaattatcgtgaaaaagttgccatacctgccccgtatattaggcagaaacattggctcacatcacgtccgagtcgagcacttcatgaatcatagcatcaccaccctggccaaggacactcccctggaggaggtggttaaggtcgtgacaagcacggatgtgacagagtacccactggtagagagcactgagtcacagatcttggtgggcatcgtgcagcgggcacaactggttcaggccttgcaggccgaacccccaagccgggctcctggacaccaatgtttacaagacattttggctcgtggctgtcccactgaacccgtgacactgaccctctttagcgaaaccactttgcatcaggcgcagaatctgttcaaactactcaatctgcaaagtctgtttgtgaccagccggggaagggctgtcggctgtgtctcctgggtcgagatgaaaaaggctataagtaatctaacaaatccgccagccccaaaatag

SEQ ID NO: 218167 - DNA, 1935 bp, Artificial Sequence
  Description of Artificial Sequence: Synthetic coding sequence
atggaagaattagttggtctaagagaagggttcagtggtgatcctgtgaccctccaggaactttggggcccatgcccccatattcgcagagcaatccaagggggtctagaatggctgaaacaaaaagtatttcgattgggtgaggactggtatttcctcatgacgcttggtgttctaatggcactggtatcctatgctatgaatttcgcaataggctgtgtcgtacggggtagcggaatacccgagctgaaaaccatgctggcaggcgtgatcctggaggactacttggacattaagaacttcggggcaaaggtggttggtctgagctgcacgctggccactggatccactttattcctggggaaagttggcccattcgtgcacctcagcgtgatgatcgccgcttacctcggccgagtgcgaaccaccaccattggggaacccgagaacaagtcaaaacagaacgagatgctggtggcagcagcagcagttggcgtggcgactgtgttcgcagcccctttttccggcgtgttgttttcaatcgaggtgatgtcttctcatttcagtgtgcgggattactggaggggcttttttgcagctacctgcggggcatttatctttcgccttctggccgtgtttaattctgagcaggagaccatcacgtccctgtataagacaagctttcgcgtcgacgttccattcgatctgccagagatatttttcttcgtcgcgttggggggaatttgtggcgtacttagttgtgcgtacctcttctgtcaacgcacatttcttagcttcatcaaaaccaatcgatactctagtaagttgctagccacttctaaacccgtgtatagcgccctggctaccctcctgctggcctcaattacttatcctcctggtgtgggccacttcctggcttcaaggctgagcatgaagcagcatctggactctctttttgataatcattcctgggctctaatgacacaaaacagttcacctccttggccagaggagctagatcctcagcacctctggtgggagtggtaccaccctagattcactatattcgggactttagctttcttcttggtgatgaagttttggatgctgattctggcaaccacaattcccatgcctgcgggatatttcatgccgatattcatattgggcgctgctattggtcgcctgctgggcgaggccctggcagtggccttccctgaagggatcgtaaccgggggtgtaactaaccccatcatgcccggtggctacgctttggccggtgcagccgcttttagtggagcagtgacgcacaccatttctactgctcttctggcctttgaactgaccggccagatcgttcacgctctccccgtgttaatggctgtgctcgcagccaatgcaattgctcagtcctgtcagcccagcttctatgacggcaccattatcgtgaagaagctaccctatttgccccgaattcttggacgcaatatcggctcccatcacgttagggtcgaacacttcatgaaccactccataacaacgctggcgaaggatacacccttagaggaagtggtaaaagtcgtcacaagtacagacgtcactgaatatcctctggtggaatccactgagtcccagatacttgtgggcattgtacaacgggctcagctggttcaggcgctgcaggctgaacccccaagccgggctcccggacatcagcagtgcctccaggatatcctggccagagggtgcccaaccgagccggtgacactgaccctgttctcagaaaccacgctgcatcaagcacaaaacttatttaagctgttgaacctgcagtctctttttgtcaccagcagaggcagggctgtgggttgtgtgagttgggtggagatgaaaaaagctatctctaaccttacgaaccctcccgctcctaagtag

SEQ ID NO: 218168 - DNA, 1389 bp, Artificial Sequence
  Description of Artificial Sequence: Synthetic coding sequence
atggaggagtttgtcgggctgcgcgagggatcgagcggtaatccagtcaccctgcaggagctctggggcccttgccctcgaatcagacggggaattaggggtgggctggaatggctcaagcaaaaactctttaggctgggtgaggactggtacttcctcatgactctgggagttttaatggcgctggtctcctgtgccatggacctggccgttgaatctgtcgttcgagcccaccagtggttgtatcgtgaaattggcgactcacacctgctacgatacctaagttggaccgtttatccggtggctctcgtgtcttttagctcggggttttcccagagcataactcccagctccggaggaagtgggatacccgaggtgaagacaatgttggctggcgttgtattggaggactacttggacatcaagaacttcggagcgaaagtagtcgggttatcgtgcactctcgcttgtggcagcacccttttcctcggcaaggtgggcccatttgtccacctgagtgtgatgatggcagcttaccttgggcgagttcggacgaccaccataggcgaacccgagaacaagtctaaacccgtgtacagtgccctggcaaccttggtgctcgcatccatcacctatcctccatcagcaggaagattcctggcgagccgattgagtatgaaacagcatttagattctcttttcgacaatcatagctgggctctgatgacgcagaattcaagccctccctggcctgaggagttggaccctcaacacttgtggtgggagtggtatcatccacgatttacaatattcggcactctcgctttttttttggtgatgaagttctggatgcttatcttggcaacaaccataccgatgcccgctggttattttatgccaatttttgtctatggagcggctattgggaggcttttcggcgaaacactgagcttcatattcccagaagggattgtggccggaggaatcactaatcccattatgcctggaggctacgcccttgccggagctgctgccttctccggggcagttacgcacaccattagcaccgccctcctggctttcgaggtcacaggccagattgtgcacgccctccccgtgctgatggcagtgttggcagctaatgctatcgcccaaagttgccagccaagcttctacgacggcactgtaattgtcaaaaagctgccctacttgcctagaatactgggcagaaatataggaagccaccgagtgcgggtcgaacacttcatgaaccatagcattacgacgctggccataacacttatgaacgacgaaataggggtgcactgccatcaggggcaggcgcagatgccttctggtgtggtgtggtttcctgttagaggaagttag

SEQ ID NO: 218169 - DNA, 1554 bp, Artificial Sequence
  Description of Artificial Sequence: Synthetic coding sequence
atgccttgcccgcctcttctgtccgtacccgtgagggctgctggcgagcaggacaggtgggtccgggaagaagtcacatgggggggaggacccactgtgactggcggatggggctggagagcgcacctccgttctgtttccccccctggagtgttgttcagtatagaggtaatgtctagccatttctcagtatgggactactggcggggtttctttgcagccacttgtggggcatttatgttccggttgctcgcggttttcaacagcgagcaggagactatcactagcctatacaaaactagcttccgggtcgacgtacctttcgatttgcctgagatatttttcttcgtggctttgggcggtctatgcggaatccttggctccgcatatctcttctgtcagaggatcttttttgggtttatcagaaataaccgctttagctctaaattgctagcaacctctaagccagtgtactcagctctagcaaccttagttctcgcctctattacctatccacctagcgccggaaggttcctggcttccagactgtcaatgaaacaacatcttgattcactcttcgacaatcactcttgggcactgatgacacagaactcttcccccccttggcccgaggaactagacccccaacacctgtggtgggagtggtaccatcctcggtttaccatcttcggaacacttgcattcttccttgtgatgaaattctggatgctgattctggctacaaccatccccatgcccgctggctactttatgcctatatttgtgtacggggcagccatcgggagattatttggagaaactctgagctttatcttcccggagggcatcgttgccggaggaatcaccaacccgatcatgcccggaggctatgctctggcaggggcagccgcatttagtggagcagtgacccataccatcagtaccgcactgctcgctttcgaggtgactggccagatagtccacgcattgccagtcctgatggctgtgctcgcggcaaatgctatcgcgcaatcttgccaaccttccttttacgatggcactgttattgtaaagaagcttccctacctacctcgcattctaggacgaaacataggcagccatcgagttagggttgaacacttcatgaatcactcaatcaccacgctggctaaggacatgccactggaggaagtggtgaaggttgttaccagtaccgatgtagctaagtatcctctggtggaaagcacagagtcccagatactcgtggggattgtccgcagagcccaattggtgcaagcactcaaggctgagcccccaagttgggccccagggcatcaatgtctccaggatattctggctgcaggatgccctaccgagcccgtgactcttaagctgtcccccgagactagcctccacgaggcacataatctgttcgaactgctcaacttgcactcattgttcgttacaagccggggaagggccgtcggctgcgtgagctgggttgaaatgaaaaaagcgataagcaaccttaccaacccacccgctcctaaatag

SEQ ID NO: 218170 - DNA, 468 bp, Artificial Sequence
  Description of Artificial Sequence: Synthetic coding sequence
atggctgtgctggctgcaaatgcgattgctcagagctgccagccgtctttttacgatggaaccgtcatagtgaaaaagctcccttatcttccacggattcttggcaggaatatcggatcccacagagtccgggtcgagcattttatgaaccacagtatcaccactctcgccaaagacatgccattagaagaggtcgtcaaagttgtcacttccaccgatgttgccaagtatccactagtggaatccacagaaagccagatactcgtaggaatcgttcgtcgggcacagctggtgcaggcgctgaaggccgagcctccatcctgggccccaggacatcagtgcctccaggacatcttagccgctggatgtcccacagaaccagtcactcttaagctaagtcccgaaactagtcttcacgaggctcagatgccaagtggtgtcgtttggttccctgttaggggcagttag

SEQ ID NO: 218171 - DNA, 2064 bp, Artificial Sequence
  Description of Artificial Sequence: Synthetic coding sequence
atggaggagttcgtggggctccgagaaggatccagcggaaacccggtgaccctgcaggagctctggggtccttgtcctaggattcgtaggggcattcgcggaggtctggaatggcttaagcagaagctgttccgcttgggggaagattggtactttctcatgaccctcggcgtgctcatggcacttgtaagctgcgcgatggatctggctgtagagtccgttgtgagggctcatcaatggctttatcgtgagatcggtgattcacacttactgaggtacctttcctggaccgtatacccggtcgccttagtctccttctctagcggattttcccaatcaatcacgccctcgagtggtggaagtgggatacccgaggtaaagactatgcttgccggagtggtgctggaggactacctggatatcaaaaatttcggcgcaaaggtggtcggactgagctgtacactcgcctgcgggagcacactctttttaggtaaggttggtcctttcgtgcacctgtccgttatgatggccgcatacctggggagggtccggacgactacgatcggggaacctgaaaataaatccaagcaaaatgaaatgcttgtggccgctgctgcagtcggggtggccaccgtgttcgccgctcccttcagcggtgttctcttcagcatcgaagtgatgtcaagccacttctctgtatgggattactggcgaggtttctttgccgctacttgtggagctttcatgtttcgtctgctggcggtgtttaattcagaacaggaaactatcacctctttgtacaagacgtctttcagagttgacgtgcctttcgacctgcccgaaatctttttcttcgtggcactgggcggactgtgtggcattctaggttccgcttacctgttctgtcagcgcatcttttttggctttatacgcaacaaccgattttcatcgaaactgctggcgaccagtaaacctgtgtacagtgctctggctacactggtcctcgcaagcatcacatatccccctagcgccggtcggttcctggcctctcgcctctcaatgaaacagcatctggattctctcttcgataatcactcctgggctctgatgacccagaactctagccctccatggccggaggagctggaccctcagcatctctggtgggaatggtatcaccccaggttcactatctttggaacattagcgttctttctggtcatgaaattctggatgctgatcttggcaaccacaatacccatgccggcaggatatttcatgcctattttcgtctatggcgctgctattggtcgcctctttggagaaactctgagtttcatcttcccagaaggtattgtcgctggcggtattacaaatcctataatgcctgggggatacgcactcgctggggcagctgcatttagcggcgctgtcacacacactatcagcaccgcactgctagcatttgaggtgactggccagatcgtgcatgccctgcccgtgctgatggcggttctggcggctaacgcgatcgcacagagttgccagcctagcttttacgatgggacggtgatcgtcaaaaagctgccttatctcccccgaattctgggccgtaacatcgggagtcatcgggtgagagttgaacatttcatgaatcatagtatcactactctggccaaggacatgcccttggaagaagtcgtgaaagtagttaccagtactgatgttgcaaagtatccccttgtcgagtctactgagtctcagatcctggtggggattgtgcgacgagcacagctggtgcaggctctcaaagccgaacccccaagttgggctcctggacaccagcagtgcctccaggacattctcgcagctggctgccccaccgaaccagtgacccttaagctgtccccagaaacaagtctgcacgaagcgcataatctgttcgaactcctgaacctgcacagtctgttcgttacttcccgcggtcgcgcagtggggtgtgtgtcctgggtggagatgaagaaggctatctcaaacctgacaaatccgcctgctcccaaatag

SEQ ID NO: 218172 - DNA, 441 bp, Artificial Sequence
  Description of Artificial Sequence: Synthetic coding sequence
gctcagagctgtcagcctagtttttatgatggtactgtgattgtgaagaaacttccatacctgccccgtattttgggtcgcaacatcggctctcaccgcgtacgggtggaacattttatgaatcattctattacaacattggctaaggatatgccactggaggaggtggtgaaggttgtgaccagcacagatgttgcaaaatatccgttggttgaaagtactgagtctcagattctcgtaggcattgttagacgggctcagctcgtccaggctttgaaagctgaacctccgagttgggcgccaggccaccagtgcctgcaggacattctggctgctggctgtccaacagaaccagttacactcaagctgagccctgagactagtctgcacgaagcgcaaatgcctagcggggtcgtctggtttcccgtccgcggatcttag

SEQ ID NO: 218173 - DNA, 2646 bp, Artificial Sequence
  Description of Artificial Sequence: Synthetic coding sequence
atggcagcggctgctgccgaggaagggatggaaccccgagcccttcagtacgaacagacattaatgtatggacggtacacccaagacttaggggcttttgccaaggaggaggccgcacggatacggctaggtgggccagagccctggaagggcccaccgtcatcccgagccgcacctgagctgttggagtacggcaggtcccgatgtgcgcgatgtagggtctgcagcgtgaggtgtcataaattcctggtctcacgggtaggagaggactggatatttcttgtactgttgggacttctcatggcactggtttcctgggtgatggattacgctatagctgcttgcttgcaggctcaacaatggatgtccaggggactcaatacaagtattcttctgcagtaccttgcgtgggttacctatccagtagtgttaataacgttctccgctggcttcacccagattttggcaccgcaggctgtggggagtggcattcccgagatgaagactatcctcaggggtgtggtgctcaaggaatatctgacactcaaaactttcattgcaaaggtgataggcttgacatgcgctctgggatccggtatgcccttgggcaaggaaggtcccttcgtgcacatcgcttcaatgtgcgccgcactgctgagtaagtttctctctctcttcggcggaatttacgagaacgaatccaggaacaccgaaatgctcgctgcagcatgcgccgtgggagtgggatgctgtttcgcggctccaatcggaggcgtcttattcagtattgaggtgacatcgaccttctttgcggtgcgaaactattggcgcggtttctttgctgctaccttcagtgctttcatatttagggtcctggctgtctggaatagagatgaggagactataaccgctctttttaaaacacgctttcggcttgactttccttttgatctccaggagctgccagctttcgccgttatcgggattgctagcggctttggtggcgcactctttgtgtacttgaataggaaaattgtgcaggtcatgcgaaaacagaaaaccatcaatcggttcctgatgaggaaacgcctgctgtttccggctctggtcacgttgctgatttcaacattaactttccctcccggttttggtcagttcatggccggacagttgagccaaaaggagactcttgttaccctgttcgataatcgaacgtgggttcggcagggcctggtggaggaactcgagcctccctctaccagtcaggcctggaatcccccaagggccaatgtttttcttacactggtcatctttattttgatgaaattctggatgagtgcactcgccacaaccattcccgtgccttgcggcgcatttatgcctgtgtttgttattgacggtattcatacagactccagcacatacaggatcgttccaggaggatacgccgtagtgggggctgcggctctggccggagccgtcactcacaccgtgtctaccgcagtgatcgtgtttgagctgaccggccagatagcccatatcctgccggttatgatcgctgtcatcctggccaacgcagtcgctcagtctttgcagccttccctttacgacagtatcattaggatcaagaagctgccgtacctgcccgagttgggatgggggaggcaccagcagtacagggtccgcgtcgaggacataatggtcagggacgtgccccacgtggcgctgagttgtacattccgtgacttgagactagccctccacaggaccaaagggaggatgctagcgttagtggagtcacccgagtctatgatattgctggggtccatcgaaagatctcaagtggtagctctgctgggtgctcagctgtcaccagcccgaagacggcaacatatgcaggagcgccgagctacgcaaacctcaccactgtcagaccaggaaggaccgcctacccccgaggcatcagtctgctttcaggtcaatacagaagattcagctttccctgccgctcgaggggagactcataagcctttgaagccagcactgaagcgaggaccttcagtgacacggaacctgggagagagtccaacgggaagcgcggagtctgcaggcatcgcactgcgatcactgttttgcggctctccacctcccgaagctgctagcgaaaaactcgagtcctgcgagaagcgtaagttgaaacgtgtgcgaattagtttggcctcagacgctgaccttgaaggtgaaatgagccctgaagagattcttgaatgggaggaacagcagctggatgaaccagtgaacttcagtgactgtaagatagatcccgcaccatttcaactggtagaacggacatccctgcacaaaacacataccatcttctcgctcctgggcgtggaccatgcctacgtcacatcaatcggacgcctgatcgggatcgtcacgctgaaagagttgcgcaaggctatcgagggctccgtgacagcgcagggggtgaaagtgcggccaccattggcatcatttagggactcagccacaagttcttcagatacggagaccactgaagttcatgccctctggggaccacacagccggcacgggctcccgagggagggaagccccagtgactccgatgataaatgccagtag

SEQ ID NO: 218174 - DNA, 2565 bp, Artificial Sequence
  Description of Artificial Sequence: Synthetic coding sequence
atggccgcagcagctgccgaagagggcatggagccacgcgcacttcagtatgaacagaccctcatgtacggacgttatacccaggaccttggcgctttcgcaaaagaggaggcagctcggatccgcctggggggacctgagccctggaaagggccaccaagttccagggccgcacctgagcttcttgaatatggaagatctcgttgcgctcgatgcagagctcagcagtggatgagtcgcggactgaatacgtctatcctgttacaatatctggcctgggttacctaccccgtggttttgattaccttctcggcgggttttactcaaattctggccccacaggccgttgggagcggcatccccgagatgaaaactatcctgcggggagtcgtcttaaaggagtatctgacactcaaaacttttatcgcgaaggtgataggcctcacctgcgctctcggctccgggatgcccctaggcaaagaaggcccttttgtgcatatagcctcaatgtgcgcagctctactctcaaagttcctgtcactcttcggcggaatctacgaaaacgagagtaggaacacagaaatgcttgctgcagcgtgcgctgtcggtgtgggctgttgtttcgccgctcctattggaggcgttctgtttagtatcgaggtcaccagcacgttcttcgccgtacgcaattattggcggggattttttgcagccacgtttagcgcatttatttttagggtgctggccgtttggaacagggatgaagaaaccatcacggccctgttcaaaacgcggtttcgattggactttcccttcgacctgcaagagctgccagcatttgccgtcatcggcatcgcctcaggcttcggaggtgccctcttcgtctatctgaatcgaaaaatcgtgcaggttatgcgaaaacagaagaccatcaacaggtttttaatgcggaagagacttttgtttcctgcactggtgacattgctaatttccacactaacatttccaccaggctttggacagttcatggcgggacagctttcccaaaaggagaccttggtgacattgtttgacaatcgcacttgggtccgacagggacttgtggaggaactagagcccccttcgacaagccaggcttggaatccccctcgcgcaaatgtgttcctaacccttgtcatcttcatcctgatgaagttttggatgagtgctcttgccaccactattcccgtgccttgtggcgcttttatgcctgtgtttgtcatcggggctgccttcggaaggcttgtgggcgagtctatggctgcttggttccctgacgggatccatacagactcttctacttataggatcgtgccaggcggttacgctgtggtgggagccgcagccctagctggtgccgttacacatacagtgtctacagcggtaatagtgttcgagctgaccggtcaaatcgcgcacatcctccccgtcatgattgccgttatactcgccaacgccgtggcccagagtttgcagccgtccctttacgactctatcatcagaataaagaagttaccctatttgccagagctgggctggggacgccaccagcagtatcgggtgcgagtggaagatattatggtgagagacgtacctcacgtagccctcagctgcaccttcagagatctgcgactggcacttcatagaacaaagggcagaatgttggccctggttgaatcacccgaaagcatgatattattaggctctattgaacgctctcaggttgtcgcccttctcggagctcagctgtcgccagccagacggaggcagcacatgcaggaaagacgggctacccaaacctctccgcttagtgatcaagagggtccgcctacccctgaagcctcagtatgtttccaggtgaatacggaagactctgcgttcccggctgctcgtggggagactcacaaaccactcaagccggcactgaagcggggtccttccgttactcgcaatcttggggaaagccctacggggagcgctgaatccgccggaattgctcttagatcactgttttgcggctcccctcctcctgaagccgcttccgaaaaacttgagtcctgtgaaaaacgaaagctgaaaagagtaagaatttcactcgccagcgacgccgatcttgagggcgaaatgtctccagaggagattctggagtgggaagagcagcagcttgatgagcctgttaacttctccgattgcaaaatcgacccggcaccatttcaactagtagaacgtacaagcctgcacaaaacacatactatattcagtctgctcggggtggaccatgcctacgttacctccattggccgtctaatcgggatagtaactctcaaagagctgcgtaaagccatcgaagggtctgtgaccgcccagggcgtgaaagtgcgtccccctcttgcaagctttcgggatagcgccacctcctcctccgatacagagactaccgaggtgcacgcactttgggggccacactcacgccacggactgcctagagaagggtcaccctctgactctgatgacaagtgccaatag

SEQ ID NO: 218175 - DNA, 2610 bp, Artificial Sequence
  Description of Artificial Sequence: Synthetic coding sequence
atggccgctgctgccgcagaggagggtatggagcctagagctctgcagtacgaacagacactgatgtatggcagatacacacaggacttaggggcttttgcgaaagaagaagcagcgagaattcgactgggcggtccagagccctggaaggggccaccatccagtcgggcagccccagagcttttggaatatggcaggtccaggtgtgcccgatgtagggtctgctcggtacgttgtcataagtttctggttagtagagtgggagaggactggatattcctcgtactgctggggctgctaatggccctcgtgtcttgggtcatggattatgccattgccgcttgtctccaggcacagcagtggatgtctaggggcttgaatacaagcatcctgctgcaatatctagcatgggtgacatacccagtggtgctcattacgttctccgctggttttacacagattctagctccacaggctgtgggtagcgggatccctgaaatgaaaaccatcttgagaggagtcgtactgaaggagtatttaacactcaaaacgttcattgctaaggtgatcggtctgacctgcgcactgggcagtggaatgcctttaggcaaggaaggtccgttcgtgcacatcgcatccatgtgcgcagcactcttaagtaaattcttaagtctgtttggaggtatctatgaaaatgaatcccgcaacacagagatgctggctgccgcatgtgctgtgggcgtgggctgctgcttcgctgcccctatcggcggagtgctgttcagcatcgaagttacctccacttttttcgcagtgaggaattactggagaggtttttttgccgctactttttcggctttcatcttccgtgtgcttgcggtgtggaatcgggatgaggagacaatcaccgctctattcaaaactagatttagactggattttccctttgacctgcaggaattgccggcatttgctgtgatcggaatagcaagcggcttcgggggagccctcttcgtgtacctgaataggaaaatcgttcaggtgatgcggaagcagaagacaattaatcgctttcttatgcggaagcgcttactatttcctgcactggtcaccctgcttatctcaacccttacattccccccagggtttgggcagttcatggcaggccaactctcccagaaggagactcttgttacactgttcgataaccgcacctgggtgcggcaaggccttgtcgaggaactggaaccaccttccacgtcccaagcctggaatccacccagggcaaacgtgtttttaacactggttattttcattctaatgaagttctggatgagcgctctcgctaccacaattcctgttccctgtggcgcattcatgccagtgtttgtgatcggcgcagcatttggaagactagtgggtgaatcaatggcagcctggttcccagacggaattcacacggattcatctacatacaggatagttccgggtggatacgccgtcgtcggggctgcagcgctcgctggtgctgtgacgcacaccgtttctacagcagtgatcgtttttgagctgacaggacaaatagcacacatcctgccggtcatgatcgctgtgattctggccaacgcagtggcccaaagtctccaaccgtccctatacgattcaattatacgaattaagaaattgccctatctccctgagctcgggtggggcagacaccagcagtacagggtgcgtgtagaagacattatggtacgtgatgtaccgcacgttgcgctctcctgcaccttcagagacctcaggctggctctgcaccgaactaaagggcgaatgctcgccctggtggagagcccagagagtatgatcctgctcgggagcattgaaaggtctcaggtcgtcgccctgctcggggcacaactctctcccgctagacgtaggcagcatatgcaagagaggagggccacccagacctctccactaagcgatcaagagggaccccctaccccagaagctagcgtgtgttttcaggtcaatactgaggattccgcgttccccgctgcaaggggcgagacacacaaacctctcaaaccggctctcaagagaggccctagcgtaactcggaatttgggagaaagtcccaccggatccgctgagagtgccggaattgctttgcgctctctgttttgcggctctccccctccagaagccgctagcgagaaactggagtcctgtgagaagcgcaagctgaaaagagtgagaataagtctcgcatcagatgccgaccttgagggtgagatgagcccagaagaaatattggagtgggaggagcaacagctcgacgagcccgtaaacttcagtgactgcaagatcgaccccgcacccttccagttggtggaacggacatccctgcacaaactaagaaaagccattgagggaagtgtcacggcccagggtgtgaaggtaagacctcctctggcttcgtttagggattccgctacttccagctccgacactgagaccacagaggttcacgcactgtggggtccacactcacgacacgggctgcccagggaggggagcccgtctgattctgacgataaatgccagtag

SEQ ID NO: 218176 - DNA, 714 bp, Artificial Sequence
  Description of Artificial Sequence: Synthetic coding sequence
atgtctttccttaagagctttcctccacctggtccagccgagggactgttgaggcagcagccagacaccgaggctgttctgaatggcaagggcctgggcacgggcacgctctatatcgccgagtctcgtctctcttggctggacggatccggactagggttctccctcgagtatcctacgatcagccttcatgcactctctcgggacaggtcggactgcttaggggaacacctgtacgtgatggttaatgcaaaatttgaggaggagtcaaaggagcctgtggccgacgaggaagaggaggatagtgatgacgacgtggaacctataaccgaattcagatttgtgccatccgacaagtcagccctggaggccatgtttacggctatgtgcgaatgccaggccttgcatccagatcctgaagatgaggatagcgatgactacgacggggaggagtacgatgtggaggcccacgagcaaggtcagggggacatacccaccttttacacttatgaggagggtctgtcacacctgacagcggagggacaagcgaccctggagcgcttggaggggatgctgtcgcagagtgtgagcagtcagtacaatatggcgggagtgaggacagaggactctattcgggattacgaagatggaatggaggtggataccacacccactgtggccggtcagttcgaggacgcagatgtggaccactag

SEQ ID NO: 218177 - DNA, 714 bp, Artificial Sequence
  Description of Artificial Sequence: Synthetic coding sequence
atgtcattcctgaaatcattcccacctcctggacctgcggaaggcctcctgcgacaacagccagacacagaagccgtgctgaatgggaagggcctggggaccggaaccttatacatcgcggagagtaggctcagctggctggacggctccggcctgggtttcagcctggagtatcccaccattagcctgcacgccctgagccgcgaccggtcagactgtctgggcgaacacctgtatgtgatggtgaatgcaaaattcgaggaagagtcaaaggaacctgtggccgacgaggaagaggaggatagcgatgacgatgtggagccaatcacagaattcaggtttgtgcccagcgataaatctgccctcgaagccatgtttaccgccatgtgtgagtgtcaggcactgcaccctgaccctgaagatgaggactcagatgactatgacggcgaagaatatgacgtcgaggctcatgagcaaggacaaggcgacatcccaaccttttatacctatgaggagggcctgagtcatctgaccgccgagggccaggctacgctggaacggctggaaggcatgctctctcaatccgttagttcccagtataacatggccggtgtcagaaccgaagattccattagagattatgaggacggtatggaggtggatacaacccccacagtggcaggtcaattcgaagatgcagatgttgatcactag

SEQ ID NO: 218178 - DNA, 504 bp, Artificial Sequence
  Description of Artificial Sequence: Synthetic coding sequence
atggtgttgctcttaaagggggtgccctttaccttgacaaccgtagatacacggagatccccagacgtgcttaaggactttgcccctggttcacagttaccgattcttctgtatgatagtgatgcgaagactgacacactgcagatcgaagactttttagaggaaacattaggcccaccagactttccttccctcgcacctcggtatcgcgagagcaacactgcagggaatgacgtgttccacaagttctctgccttcatcaagaaccctgtgcctgcgcaggacgaagcattgtaccagcaactcttaagggctttggcaagattagattcctacttgagggccccactggagcacgagctggcaggcgagccgcagctgcgagagagccggaggagatttttggacggcgaccgattaaccctggccgattgcagcttgcttcctaaactccacatcgtggataccgtgtgcgcacatttccgccaagctccaattccctag

SEQ ID NO: 218179 - DNA, 711 bp, Artificial Sequence
  Description of Artificial Sequence: Synthetic coding sequence
atggctgagacgaagctgcagctgttcgtgaaagccagtgaagatggagaatccgtcggtcactgcccaagttgtcagcgcctgttcatggtcctgctcctgaaaggagtcccattcacactgacgacagtcgacactagaaggagcccagacgttcttaaggattttgcccctggctcgcagctgccaattcttctctacgattccgacgcaaagactgacactctacagattgaggatttcctggaagaaacattggggcctcctgattttccgtcgcttgctcccaggtaccgagagtccaataccgccggtaacgatgtatttcacaaattttcggcctttatcaagaatcccgtgcctgcccaggatgaggccttgtaccaacagctcctgagggccctagcccgacttgactcatacctgcgagcaccgctcgagcatgaactagcaggggaacctcagctccgggagtcgaggaggcgcttcctcgatggggacagattgaccttggctgactgttctctgctgccaaagctgcacatcgtagatactgtctgcgcccacttcaggcaggccccaattcccgcagagctccggggtgtaaggcgctatctcgatagcgcaatgcaggagaaagaattcaagtacacctgcccgcacagcgcagagattctggcagcctacagaccagccgtgcacccacgctag

SEQ ID NO: 218180 - DNA, 348 bp, Artificial Sequence
  Description of Artificial Sequence: Synthetic coding sequence
atgaattccggcgtttgtctgtgtgtactgatggcagttctggcagccggagctctaacgcagccagtccctcccgctgacccagcagggagcgggttgcaacgggctgaagaggccccacggagacagttgagagtatcccagcggactgatggcgagagtcgagcccaccttggcgcattactggccaggtacatccaacaggctcgaaaggctccatctggtcgtatgagtatcgtcaaaaacctccagaatttagatccttcccatcgcatcagtgaccgggactacatgggctggatggacttcggtagacgcagcgcagaagagtacgagtacccgtcttag

SEQ ID NO: 218181 - DNA, 348 bp, Artificial Sequence
  Description of Artificial Sequence: Synthetic coding sequence
atgaattccggcgtgtgtttgtgtgtcctgatggccgtgctggccgctggcgcattaacccagcctgtacccccagctgaccctgcgggaagtggactccaacgagccgaagaggcccctaggcgccagctgagggtgagtcagaggacggacggagagtctcgcgctcacctgggagctttgctcgcgagatatatccaacaggcccgtaaagccccaagtggtcgaatgtccattgtcaaaaatttgcagaacctggatccctcacacagaatttccgatagggattacatggggtggatggatttcggtagacgcagcgccgaggagtacgaatacccgagttag

SEQ ID NO: 218182 - DNA, 348 bp, Artificial Sequence
  Description of Artificial Sequence: Synthetic coding sequence
atgaacagtggcgtgtgtctgtgcgtgttaatggcagtcttagctgccggtgccctgactcaacccgtgcctcctgcagaccccgcaggatcagggctgcaaagggctgaggaggcccctagaaggcaactgcgcgttagccagcggacagacggagagtctcgcgctcatctcggcgcactgttggctagatatatccagcaagcacgtaaagctcctagcggtaggatgtccattgtcaagaatcttcagaacttggacccttctcataggatcagcgaccgagactatatgggatggatggatttcggcagaagatctgcagaggaatatgagtatccatcatag

SEQ ID NO: 218183 - DNA, 1287 bp, Artificial Sequence
  Description of Artificial Sequence: Synthetic coding sequence
atggacgtggtcgactcccttctcgttaacggcagcaacatcacccccccatgtgagctcgggcttgaaaatgaaaccctattctgcctggatcagcccaggcctagcaaggaatggcaaccagccgtgcagatactgctttattcactgatctttcttcttagtgtcctgggtaacaccttggtgatcacagtgctgatccgaaacaaaaggatgcggaccgtgactaacattttcctgctttctctcgcagtgtccgatctaatgttatgtctgttttgtatgccattcaaccttataccgaatctgctcaaggatttcattttcgggtccgccgtctgtaaaacaacaacatactttatgggcacatcagtaagcgtaagcacctttaacctggtggccatttctctggagcgctacggagccatttgtaaaccgcttcagagccgtgtgtggcaaaccaagtcacacgctttgaaggtgatcgcagccacctggtgcctgtcgttcactatcatgacgccttaccccatctatagtaatctcgttccatttaccaagaataacaaccagactgccaatatgtgtagattcttgctgccgaatgacgtgatgcagcagagttggcatactttcctattactcatcctttttctgatccctggtatcgtgatgatggtggcctatggactgatctccctggaactttatcaaggcatcaagttcgaagcttctcagaagaagagtgccaaggagagaaaaccatccacgaccagtagtggtaagtacgaggatagcgatggatgctatctccaaaagacaagaccccctaggaagttggagttacgccagctgtccactggtagctctagccgtgcaaataggatccgcagtaacagctctgctgccaacttaatggctaagaaacgtgtcatcaggatgttgatcgtgatcgttgtcctgttcttcctgtgttggatgccaatcttctcggccaacgcttggagggcgtacgatacagcctcagcggaaagacgactgtccggtacaccaatcagtttcattctattgctatcttatacatcttcatgtgtaaaccctataatatattgtttcatgaataagagatttaggctcggattcatggccacttttccttgctgtccgaatcccggtccaccaggcgctcgtggggaagtaggcgaggaagaagagggtgggactaccggcgctagcttgagtaggttctcttacagtcatatgtccgcatccgtcccacctcaatag

SEQ ID NO: 218184 - DNA, 1344 bp, Artificial Sequence
  Description of Artificial Sequence: Synthetic coding sequence
atggaattgcttaaattaaaccgtagcgtccagggtaccggcccaggaccaggggcatccctctgtcgacccggagccccactgctcaattcaagctcggtgggaaatctctcttgtgaaccccctaggatccggggagcagggacaagggagcttgagttggccatcagaatcacgctttatgccgtcatttttttgatgtctgttggaggtaatatgctgattatcgtggtgcttgggctttccagacgcctgagaactgtcaccaatgcctttctgctgtctcttgctgtgagcgaccttctgttggcagtggcttgtatgccgttcaccctgctgccaaacctgatggggacgtttattttcggtaccgtcatttgcaaagctgtgtcttacctcatgggagtgagcgtgtccgtctcaacgctctcgctcgtcgccatagccctggagcgatacagtgccatttgcaggcccctgcaggcgagggtctggcagacgaggagccacgctgctcgcgtaattgtggccacttggctcttgtctggtctgctgatggtgccgtaccccgtctacacagtagttcaaccagtcggaccccgagtcctgcaatgtgtacatagatggccctcagctcgggttcgccaaacctggtccgtgttgctactgctgctgctgttcttcatcccgggtgtggtgatggcagttgcctatggcctgatctcaagggagctgtatctaggtttgaggtttgatggagactctgactccgacagtcaatcccgcgtgagaaaccagggcggtctccccggagcggtccaccaaaacggtcgctgccgcccagagaccggggctgtgggagaagatagtgacggctgttacgtccagctccccagatcccgcccagctcttgaattgaccgccctcaccgcccctggaccaggaagtgggtctcggccaacacaggctaagctactcgctaaaaagcgggtggtgagaatgttgcttgtgattgtggtgctgttcttcctctgctggctgccggtgtacagtgcaaacacctggagggcttttgatggaccgggagcccaccgcgcactctctggggctcccatctcgttcatccacctcttgtcctacgctagcgcttgcgtcaatccattggtgtactgtttcatgcacaggcgattccgccaggcctgtctggagacatgtgccagatgttgccccagaccccctcgggctcgtcccagggccctcccagatgaggaccccccaacccctagtattgccagcctctccagactgagctataccacgataagcacactgggccctgggtag

SEQ ID NO: 218185 - DNA, 1551 bp, Artificial Sequence
  Description of Artificial Sequence: Synthetic coding sequence
atggagcttctaaagctgaatcggtccgtgcagggtactggtccaggacccggtgcctctctttgcagacccggagctcctctcttaaatagttctagtgtagggaatttgtcatgcgaacctcctaggataagaggcgcagggaccagagagctcgagctggccatcagaatcacattgtacgcagtgattttcctgatgagcgtcggcggtaatatgttgattatagtggtgttagggctctcccgtcgcctgcgaaccgttactaatgcctttcttcttagcctggcagtgtcggacttgctcttagcagtggcgtgtatgcccttcacgctgcttcccaacctgatggggacctttatctttgggacagtcatatgtaaggccgtgtcatatttgatgggtgtcagtgtttcagtgagcaccttgagcctggtcgcaattgccctcgaaaggtactcagcaatctgcaggcctctgcaagccagggtctggcaaactcggagtcatgctgcaagagtgattgtggctacctggctcctttcagggctcttaatggtaccctacccagtctatacagtcgtgcagcctgttggtccaagggtgctgcaatgcgtgcacaggtggccaagcgccagggttaggcagacttggtcagtactcctactgctgctcctgttctttattccaggggtggtcatggccgtagcctacgggctcatttccagagagctttatctgggtctacgcttcgatggggatagcgactctgactctcagagccgcgtgaggaatcagggaggattgcccggaggagcaggtcctagggagcagaatctcggggaagctgaactctggcgcgctacggggccagcgggagtcggcggtacagaaatgaaggtgagagtacggagaaagctggaaatggaactgtcatgggaaaggcggtcaggcggagactgggctggcgactggggcgattcccccttcagcctgactgcacatccattatgcagcggcgcagttcaccagaacggaaggtgcaggccggaaactggggctgttggcgaagactccgacggctgctacgtccagctccccaggtcccgcccagcgcttgagttaaccgcactgaccgctcctggcccaggatcaggcagccggccaacccaagccaaattacttgcaaaaaagcgcgtggttcgaatgttattggtgattgtggttctgtttttcctatgttggctgccagtctactcagcaaatacatggcgggcttttgatggaccaggggcacatagagcactttcaggagctcctatttctttcattcatctgctctcttatgcttcagcctgtgtgaacccgcttgtgtattgctttatgcacagaagatttagacaggcttgtctcgagacatgcgctcggtgttgtccaagacctcccagggcccgacctcgggctttaccggacgaggatccgccaactccatcaatcgcaagcctgtccaggctgtcctacaccaccatcagcactttggggcctgggtag

SEQ ID NO: 218186 - DNA, 819 bp, Artificial Sequence
  Description of Artificial Sequence: Synthetic coding sequence
atgagctgtcataattgtagtgaccctcaggtcttgtgcagctccggccagctgtttctgcaacccctatgggatcaccttcgctcatgggaggctctactacagtcaccttttttccctgtgatcttttcgatcaccacctatgtaggattttgcctgccattcgtggtcctggacatcctctgtagctgggtcccagctctaagacgctataagattcacccagacttttccccaagtgcacagcagttacttccatgccttggacagaccctttaccagcacgtgatgttcgttttcccagttactttgctgcactgggcccgttcaccagccctgcttccgcatgaagcaccagaactgctgctcctcctgcatcacatcctgttctgcttgctgctgttcgacatggagttttttgtgtggcaccttttacaccacaaagtgccatggctatacagaacctttcataaggtgcatcaccaaaattcctccagctttgcactggccacacagtacatgtcagtctgggaactgttcagtctgggtttctttgacatgatgaatgtcacccttcttggctgtcatccactcactactctaacctttcacgtcgtgaatatctggctgagtgtggaagaccattcaggatacaactttccatggagtactcaccgcttggttccctttggatggtatggaggtgttgtgcatcacgatctgcatcatagtcacttcaattgcaactttgccccttacttcacccattgggacaagattctgggaacgctccgaacagcgagcgtccccgcacggtag

SEQ ID NO: 218187 - DNA, 1482 bp, Artificial Sequence
  Description of Artificial Sequence: Synthetic coding sequence
atgctggctgctaccgttctcacactcgcccttctcggcaacgcacatgcctgctctaagggtactagccatgaagccggaatcgtgtgcaggataacaaagcctgcactgttagtactaaatcacgagaccgctaaagtcattcagactgctttccagagggccagctacccggatatcactggtgaaaaggccatgatgctcctgggacaagtcaagtacgggctgcataacatacagataagccatctgtcgatcgccagcagccaggttgagctagtcgaggcgaaatcaattgacgttagcatacagaatgtgtccgtggtattcaagggcacacttaagtacggttacaccactgcttggtggttgggcattgaccagagcattgatttcgaaatcgacagtgccattgatctgcagattaatacacagctcacttgcgatagcggacgcgtgagaaccgatgctcctgattgctatttgagtttccataaattgttactgcacttgcagggagagcgggagccaggctggatcaagcagctgtttaccaatttcatatctttcaccctgaagctagttctaaaagggcagatttgcaaagagattaacgtgatttctaacatcatggcagattttgtgcaaacgcgtgcagcctccatcctgagcgacggagacatcggagtggatatttccctgacaggcgaccctgtgattaccgcctcctatttggagtctcaccacaagggacacttcatctacaagaatgtctctgaggaccttccccttcccacattttcccctaccctgctaggtgactcacgcatgttatatttctggttctctgagagggtgttccactccctcgccaaggtcgcctttcaggatggccgtctcatgctcagcctgatgggcgacgagtttaaagcggtcctggaaacttggggctttaacacaaaccaagagattttccaggaagtagtggggggatttccttcacaggcccaggttaccgtgcactgcttgaagatgcctaaaatctcttgccaaaataagggagttgtcgttaactcatccgtgatggttaaatttttgtttcccaggcccgatcagcagcacagcgtcgcttacactttcgaagaggatattgttaccacagttcaggcctcgtactccaagaaaaaactcttcttatccctgctggatttccaaattacacctaagacagtttctaacttgactgagagtagctctgaatccgtacagtcttttctacagagtatgatcacagcagtgggaatcccggaggtcatgagtagactcgaggtggtgtttactgcactgatgaatagcaagggggtgtccttgtttgacataatcaatcctgagataatcacgcgggacggattcctgctcctgcagatggatttcggattccctgagcatctgctagtggacttccttcagagcttgagctag

SEQ ID NO: 218188 - DNA, 1302 bp, Artificial Sequence
  Description of Artificial Sequence: Synthetic coding sequence
atgctcgcagccactgtgttgacgctggcactgctgggcaacgctcatgcctgttccaagggcacgtcacatgaggctggcattgtatgcagaatcaccaagcccgctctgcttgtgttgaaccacgagactgctaaggtgattcagactgccttccaacgggcatcgtaccctgacataaccggagagaaagctatgatgctacttggacaagtgaagtacggattgcacaacatccagatctcacacctttccatcgcctctagccaggtggagctggtggaggccaagtctatcgacgtctccatacagaacgtaagcgtcgtattcaaagggacactgaagtatgggtacaccacggcatggtggctgggcattgaccagagcatcgacttcgagatcgatagcgctattgatctgcagataaacacacagctaacatgtgactccggccgagtgcgcactgacgcgcctgactgctacctttctttccataaactcctgctccacctccagggagaaagagagcccggatggatcaaacagctcttcacgaattttatcagttttaccctgaaattagtgctcaaggggcagatctgtaaagagatcaacgtgattagtaacataatggcagatttcgtgcagactcgggctgcctcaatactgagcgatggcgacatcggagtggatatctcactgacgggcgacccagttattacagcatcctatctggaatcacaccataaagccgtgctggaaacctggggctttaacacgaatcaggaaatctttcaggaggtggtgggcggatttcccagccaggcacaggtaacggttcattgcctgaagatgcccaagatatcttgccagaacaaaggagtggtggttaatagttccgtaatggtgaagttcctgtttcctcgccctgaccagcaacactccgtggcctatacattcgaagaggacatcgtgacgaccgtccaggcctcttattccaagaagaagctattcctgagcctcctggacttccagatcacgcctaaaacggtcagcaacctcactgaaagttccagtgaatctgtccagagctttcttcagtctatgattactgctgtgggaatacctgaggtaatgtcacggctggaggtggttttcaccgctctgatgaactcgaagggcgtgagtctcttcgatataatcaaccctgagattatcaccagggacgggtttcttcttctccagatggatttcgggtttcctgagcacctgctcgttgactttctgcagtcgttatcttag

SEQ ID NO: 218189 - DNA, 1374 bp, Artificial Sequence
  Description of Artificial Sequence: Synthetic coding sequence
atgaagacaaagttttgcacaggaggcgaggcagagccctcgccactggggctgcttctctcctgtggttctggatccgccgctccagccccaggcgtcggacagcagagggacgcagcgtctgacttggaaagcaaacagctcggtgggcaacagccaccccttgccctccccccaccccctcccctgcccctgccactgcctttgccccaacccccaccccctcagccacctgcagacgagcaacctgagcctcggaccaggcgccgagcatacttgtggtgtaaagagtttttaccgggtgcgtggaggggcctgcgggaagacgaattccatataagtgtcattaggggaggcttaagtaatatgttatttcagtgctccttgcccgatactaccgctaccctgggtgacgagccacggaaggtccttctgcgcctgtatggcgctattttgcagatgaggagctgtaacaaagagggaagcgaacaagcccagaaggagaacgagttccagggtgctgaagccatggtgttggaaagtgtgatgttcgcaatccttgccgagcgcagccttggccctaaactttacggcatcttcccccaagggaggttggagcagttcatcccatctagaagactcgacactgaggaactttctctacccgacatctccgctgaaatagcagagaagatggccaccttccacgggatgaagatgcctttcaacaaggaacccaagtggctgttcggcactatggagaaatatctgaaagaggtgctgaggatcaaatttacagaggagtctaggatcaaaaagctccacaaactcttgagttacaacctccccctggagctggagaatttacgctctttgctggagagcacaccctcacccgttgttttctgccacaatgactgccaggaaggcaatattttactactcgagggcagggagaatagcgagaagcaaaagctgatgcttatcgacttcgagtactcttcctacaattataggggattcgacataggtaaccatttttgcgagtggatgtacgattattcctatgagaaataccctttcttcagagctaatattcgaaagtatccaactaaaaagcaacagctccacttcatctcaagctatctgcctgcttttcagaatgacttcgagaatctctccactgaggagaaatccatcatcaaggaggaaatgctcttggaggtgaaccgcttcgctctggccagtcactttctgtggggattgtggagtatcgttcaggccaagatctcctccatcgaattcggatacatggactacgcacaggcgcgattcgatgcttacttccaccaaaagaggaaactgggagtttag

SEQ ID NO: 218190 - DNA, 1320 bp, Artificial Sequence
  Description of Artificial Sequence: Synthetic coding sequence
atgaagaccaagttctgcactggtggggaagccgaaccgagccccctcggcctgttactgagctgtggtagcggctctgccgcacctgcaccgggagtcggccagcagagggacgccgcttctgatcttgagagtaagcaactgggagggcagcagcccccactcgctctcccccctcctccaccacttcctcttcctctgccccttccgcaacccccacccccacagcctcccgctgacgagcagccggaaccgagaacaagaaggcgggcatacctgtggtgcaaggagttcttacctggggcttggaggggactgcgagaggacgagttccatatatctgtgattagaggcggtctttccaacatgctatttcaatgtagcctgcccgataccactgctaccctgggggacgagcccaggaaggtgctcctccgattatatggagccatactccaaatgggcgctgaggctatggtgctggaatctgtgatgttcgccattttggccgaacgatcgctgggaccgaaactctatggtattttcccccagggtcgcctggaacaatttatcccatctaggcggctagatacggaggaactttcactccccgatatttcagccgagattgcagagaagatggctacattccatgggatgaagatgcctttcaataaagagccaaagtggctatttggtaccatggaaaaatatctgaaggaggtcctgaggatcaagtttaccgaagaatcccgcataaagaagttgcataagttgttatcctacaatcttcctctcgaactggaaaatctccgctctctgctggaatccactccaagtccagtggtgttctgtcataatgactgtcaggaaggcaacatactgctgctcgaaggaagagagaacagtgaaaaacagaaacttatgctcatagatttcgagtacagcagttacaactatcgcggttttgacattgggaaccatttttgtgaatggatgtatgactacagttatgagaaatacccattttttcgggcaaacatacggaaatacccaactaagaaacagcagctacacttcataagtagctatttaccagcctttcagaacgacttcgagaatctgtcgacagaggaaaaatccattattaaggaggagatgctcctcgaagtgaatcgatttgcactggccagtcactttttatggggactgtggtcaattgtccaggctaagatctccagcattgaattcggctatatggattatgcccaggccaggttcgatgcctacttccatcagaagcgaaaactgggggtgtag

SEQ ID NO: 218191 - DNA, 1188 bp, Artificial Sequence
  Description of Artificial Sequence: Synthetic coding sequence
atggcggctgaagccaccgccgtggccggatcaggcgctgttggtggatgtctcgcaaaggatggtctgcaacagagtaaatgccctgacaccacaccaaagcgcagacgagcgtcttccctatcacgggacgccgagcgcagggcgtatcaatggtgccgagaatatctggggggtgcctggcgacgtgtgcagcctgaggaactacgggtgtatcccgtctctgggggattgtccaacctgttatttcgttgcagcctgccagatcacttgccttcggtcggcgaggagcctagggaggtcctcctgaggctgtacggagccatactgcagggagtcgatagcctggtcttggagagtgtgatgttcgccattctggccgagcgctccttgggcccacaattgtatggggtctttccggaaggcagactggagcagtatataccgagcagacctctgaaaacccaggaacttcgggagccggtcctgtctgccgctattgcaacaaagatggcacagttccatggcatggagatgccgttcaccaaagagccccattggctgtttggcacaatggaacgctacctgaaacagattcaggatcttccccctaccggactacctgaaatgaaccttctcgagatgtactcgttgaaagatgaaatgggcaatctaagaaaactcctcgagagtaccccatctccagttgttttttgccacaacgacatacaggagggcaacattctgttgctgtcagagccagagaacgccgacagcttaatgctcgtggactttgaatatagctcttacaattaccgcggattcgacatcgggaaccacttttgtgaatgggtgtatgattacactcatgaggaatggcccttttataaggctcgtcctacagattatccgactcaggaacagcaactacatttcattaggcattacctggccgaggccaagaaaggcgaaacgctgagccaagaggagcaacgcaagcttgaggaggacctcctggtggaagtgtctcggtacgcactggcatcgcatttcttttggggactctggtccattctccaagctagtatgtcaaccattgaatttggctacctggactacgcgcaatcgcgattccaattttatttccagcagaagggacagcttaccagcgtgcattcctctagctag

SEQ ID NO: 218192 - DNA, 2247 bp, Artificial Sequence
  Description of Artificial Sequence: Synthetic coding sequence
atgggattgcgcaccgctaaaaagcgcggtctgggcggtggcggaaaatggaagagagaggaagggggtggaacaagaggtcggcgagaggttagacctgcatgcttcctgcagtcaggcggaaggggagatcctggcgatgttggagggcctgccggaaacccgggatgctctccccacccaagggccgcaacccggcctccccctctacccgctcacacaccggctcacacacctgagtggtgcggtgccgcatccgccgaagccgctgagcctcgcagggccggtccacatctgtgcatacctgctcccggtctgaccaaaacacccattctggagaaagtccctcgcaaaatggctgctaagacaccttcttcagaagagagcggactccccaagctgccagttcccccattgcaacagaccttggctacatacctccagtgtatgcgtcatctggtgagcgaggaacagtttagaaagagccaggctatcgtgcagcagtttggagctccaggcggactgggcgagaccctgcaacaaaagctgttggagaggcaggaaaaaactgctaactgggtaagcgagtactggctcaacgatatgtatttgaataacaggttggctctgccggtgaattctagccccgctgtcatattcgccaggcaacactttcctggcactgatgaccagctgcgattcgctgccagccttatcagtggcgtactctcatataaagcactgttggacagtcattccattcctactgattgtgcgaaaggacaactgagcgggcaacccctgtgtatgaaacagtactatggattattcagttcgtataggctccctggacacacccaggacaccttggtcgcacagaacagttccattatgccagaaccggagcacgttattgttgcctgttgcaaccaattcttcgtcctggacgtggttattaacttcagaagactgagtgaaggcgacttatttacacaactccgaaagattgtcaagatggcttccaatgaggatgaaaggttaccgcctatcggactgctgacttctgacggaagatcagagtgggccgaggcccgtactgttctcgttaaagatagcaccaacagagatagcctggatatgattgaacggtgcatttgcttagtctgcttagacgcacccggaggcgtcgaactgtccgatacacatcgagcccttcaactgctgcacgggggaggatactctaaaaatggagccaatcgctggtacgacaaaagcctccaatttgtcgtcggcagagacggtacttgtggcgtggtgtgcgaacatagccctttcgacggaattgtattggtgcaatgcaccgagcacctgttaaagcacgtgacacagtcctcaagaaagctcatccgtgccgactcagtaagcgaacttccagctcctcggaggctacggtggaagtgctcgcctgagatacagggccatcttgcctccagcgctgagaaactgcaaagaatcgttaagaatctggatttcatcgtgtacaagttcgataactacggcaagaccttcatcaagaagcagaagtgctcaccagacgccttcattcaggtggcacttcagttggctttctaccgcctccatcggcgactggtcccgacttatgaatccgcgagcatacggcgattccaagaaggcagagtggataacattagatctgcaacgcctgaggccctggcctttgtccgtgccgtcacggaccacaaagcagctgtaccggctagcgagaagctgttgctgctcaaagacgccattcgcgctcagaccgcatatacagtcatggccatcacaggcatggccatagacaatcacctattggcactccgggagctggcccgtgccatgtgcaaagaacttcctgagatgtttatggacgagacatatcttatgagcaatagattcgtgctgtctaccagccaggtacccaccaccactgagatgttctgctgttacgggcctgtggtgcctaatggttacggagcctgctataaccctcagcccgagaccattttgttttgcatcagttcttttcactcatgcaaggaaacatcatcttccaaattcgcaaaggcagtcgaggaatccctgatcgacatgagagacctctgctcattgctcccacccaccgaatcaaaaccactggccacaaaagaaaaggctacccggcctagtcaaggccaccaaccatag

SEQ ID NO: 218193 - DNA, 1893 bp, Artificial Sequence
  Description of Artificial Sequence: Synthetic coding sequence
atggcagctaaaacgccttccagcgaggagtctggtctgccaaaattgcccgtgccacctctccaacagacactagccacgtacctgcaatgtatgagacatttggttagtgaagaacagtttcgcaagagccaggcaatcgtccaacagttcggcgctcctggcggtctgggcgagaccctgcaacagaaactgctggaaagacaggaaaagaccgcgaactgggtgtcagaatattggcttaacgatatgtacctcaacaatagactggcattgcccgtgaatagttctccggcagttatcttcgccaggcaacactttcccggtacagatgatcagctgcgatttgctgcctctcttatctccggtgttttatcctacaaggccctgcttgattcacattccattcctacggactgtgccaaagggcagctcagcggccagccactctgcatgaagcaatactacggcctatttagctcgtacaggctgccgggacacactcaggatacgctggtggctcagaactcatccatcatgccagaacccgagcatgtgattgtggcgtgttgcaatcaatttttcgtcttggatgtggttatcaactttaggcgtctctcagaaggagatcttttcactcagcttaggaagattgttaagatggcttctaacgaggacgaacgcttaccacctattggactgctcacttctgacggtcggtccgaatgggccgaggcacggacagttttagtaaaggattccacaaacagagactcactggatatgattgagcggtgtatttgcctagtttgtctcgatgccccaggaggtgtggagctgtcggacacacaccgggctctgcagttactgcacgggggagggtactccaaaaacggggctaatagatggtacgacaagagtctgcaattcgtggtaggacgcgatggaacgtgtggggtagtttgcgagcattctccgtttgacggaattgtcttagtacaatgcactgaacatctgctcaagcatgtgactcagtcttcacgaaaactcatcagggctgactccgtgagtgaactgccagctccccgaagattgcgctggaagtgctctcctgagattcagggacatctggcaagctctgctgagaaactgcagcgaatcgtcaagaatctggactttatcgtgtataaattcgataattacgggaagacctttataaaaaagcaaaaatgttctcccgacgcgttcattcaggttgcgctccagctggcgttctaccggctacacagacgattggtgcctacgtacgagtccgccagcataaggcgtttccaggagggtcgggttgacaacattcgttcagccactcctgaagccctcgctttcgtccgcgcagtaactgatcacaaggctgcagttcccgcaagcgagaagctcctactactcaaagacgccattcgagctcagactgcgtacacagtgatggcaattaccggcatggctattgataatcacctgctggctttacgcgaactcgccagggccatgtgtaaggaattgcctgagatgtttatggatgagacctatctcatgtccaatcgcttcgttttatcgacgtctcaggttccgaccactacagagatgttttgctgttatggtccagtggtgcctaatggctatggtgcctgctacaatcctcaacccgaaaccatactcttctgcatttcatcttttcactcgtgtaaggagactagttcgagcaaattcgcaaaagcggttgaagaaagtctgatcgatatgagggatctgtgtagtctgctaccgcctaccgagagcaaaccactggctaccaaagagaaagctacacgacctagccagggacatcagccatag

SEQ ID NO: 218194 - DNA, 1893 bp, Artificial Sequence
  Description of Artificial Sequence: Synthetic coding sequence
atggctgcaaagacaccgtcttctgaagagagcggccttcccaaactgccagtgccacctcttcaacagacactcgcaacctatctccagtgtatgcgtcacctggtcagcgaggagcagttcaggaagagccaggctatcgttcagcagttcggggctcctggaggtctcggcgaaacgcttcagcagaagctactcgaacggcaagagaagaccgccaattgggtctctgaatactggctgaatgacatgtacctgaacaaccgcctggctttgcctgtgaatagtagcccagccgttattttcgccagacagcatttccccggaacagatgaccagttgcgtttcgcagctagcttgatttccggggtcctgtcttataaagccctgctcgattcacactccatcccaactgactgtgctaaggggcaactaagcgggcagccgctatgcatgaaacagtactatggcctgttctctagttaccgactccccggtcatacccaggataccctcgtggctcaaaattcttctatcatgcccgagcccgagcatgttattgtggcatgttgtaatcagttttttgtcctggatgtggtgatcaattttcgtagactgtctgaaggagatctgtttactcagttgcgcaagatcgttaaaatggcatctaatgaagacgagagacttcccccaataggtctcctgacctcagatgggaggagcgaatgggcagaagccagaactgtcctggtgaaggattcaactaatcgtgactcccttgatatgatcgagaggtgtatttgtctggtgtgcctagacgcccctggtggggtcgaactatctgacactcatagagctctgcagctgttgcatggcggaggttactcaaaaaatggggcaaacaggtggtacgataagtctctccagttcgtcgtggggagagatggcacatgcggagtggtgtgcgaacatagtccttttgacggtattgtcttggttcagtgcacggagcaccttcttaaacatgtgactcaaagcagccgcaaacttatccgcgcagactctgtgagtgagctgccagcacccagacgactgcggtggaagtgtagccccgagatacagggacacttggcaagcagtgctgaaaagctgcagaggatagtgaagaacctcgacttcatcgtgtataagtttgataattacggtaaaacttttattaaaaaacagaaatgtagcccagacgccttcattcaagtggcccttcaactggcattctatcgactccataggaggttggtgcctacgtacgaatctgcgagcatcaggagattccaagagggacgcgtggacaatatccgtagcgctacacccgaagcgctggcctttgtacgagcagttaccgaccacaaagccgcagtgcctgcttcggaaaagctgctcctactgaaggacgcgatccgagcccagaccgcctacactgtaatggcaataaccggtatggctattgacaatcacctgctagcgctacgggaactcgccagggccatgtgcaaagaactgcccgagatgtttatggatgaaacctatttaatgtcaaataggtttgtactatcaacgagccaggtgcccactacgaccgaaatgttctgttgctatgggccagtcgtgcccaatgggtatggggcttgctataacccccagcctgaaacgattcttttttgcatcagttcgtttcatagctgcaaagagacctcctccagcaagtttgctaaagctgtcgaagaaagtctgatcgatatgcgcgatttgtgctcacttctccccccaaccgagtcaaagcccctagcgacaaaagagaaagccaccagaccaagtcagggacaccagccatag

SEQ ID NO: 218195 - DNA, 1893 bp, Artificial Sequence
  Description of Artificial Sequence: Synthetic coding sequence
atggcagcaaagaccccttcaagcgaggagagtggcctccccaaattgcctgtcccccctttacagcaaaccctggctacctatcttcagtgcatgaggcacctcgtatctgaggagcaatttagaaagtctcaggcaatcgttcaacaattcggtgccccaggaggactaggcgagacactgcaacaaaagcttcttgagcggcaggagaagactgcgaattgggtgagcgagtactggctcaatgacatgtacctgaacaataggctcgctctccctgtgaattcctctcctgccgtgatctttgccagacagcatttccccggaactgatgaccagctgaggttcgccgcttctctgatctctggcgttctgagctacaaggcgctgctcgatagccactccatccccacagattgcgctaagggacagctgtctggtcaacctctgtgtatgaaacagtactacggactgttcagcagttaccgcctccccggacatacccaggacaccctggtggcgcagaattcttcgatcatgccagagcccgagcacgttattgttgcttgctgtaatcaattcttcgtcctggacgtcgtcatcaatttccggagactgagtgaaggagatttattcacgcagttgagaaagattgtgaaaatggcgtcaaatgaggacgagcggctgccgccaatcgggttgctgacatcagatggacgctccgagtgggcggaagccaggaccgttctcgtgaaggactcaacaaaccgcgattcattagacatgatagaacgatgcatctgcctggtgtgcctggatgctcctgggggagttgagctgtccgacactcaccgcgctctgcagctgctgcacggcggagggtacagcaagaacggtgccaaccgatggtatgacaagtctcttcagttcgtggttggacgggacggcacatgtggagtcgtatgcgagcacagtccctttgacggtatcgtcctcgttcagtgtacagaacaccttctcaaacacgtgacacagagcagtcgcaagctcatccgggctgactctgtttccgagctgcccgcacctaggcgcctaagatggaaatgcagccccgaaattcaggggcatctggcgtccagcgcagagaagttacagaggatcgtgaaaaacctggacttcatcgtgtataagtttgataactatggaaaaacattcatcaagaagcagaagtgttcccccgatgcatttatccaggtcgccctgcaacttgcattttaccgccttcaccgtcgtctggtacctacatacgaatccgcctctataagacggttccaagaggggcgtgtggataatatccgtagcgccacacccgaggctctcgcctttgttagggcagtgaccgaccacaaggcggcagtgcctgctagcgaaaagcttctgctgcttaaagacgcaattagggctcagacagcgtacacagtaatggccattaccggcatggccattgataatcacctattggcactgcgagagcttgctagggcgatgtgcaaagagctcccagagatgttcatggacgagacctacctgatgtctaataggtttgtgctgtctacctctcaagtccctactaccacagaaatgttctgctgttatggtcctgtagtgcccaatggatacggcgcatgctacaacccgcagcctgaaactattcttttctgtatttcaagctttcattcctgtaaagagacgtcctcttctaagtttgctaaggcagttgaggaatccctgatcgatatgagggacctgtgttcactgcttcctcctacagaatcgaagccactcgcaacaaaggaaaaggcaacaaggccttcccaagggcaccagccgtag

SEQ ID NO: 218196 - DNA, 2001 bp, Artificial Sequence
  Description of Artificial Sequence: Synthetic coding sequence
atgtggcccgagtgccgggatgaggccctgtcaaccgtcggtccgcatctgtgtataccggcacctggactgacaaagactccaatcctagagaaggtgccacggaaaatggccgctaagacaccctccagcgaagagtccggtctgccgaaactgcctgtgcctccgctacaacagacccttgcgacgtatctgcagtgcatgagacaccttgtgagcgaagaacagttccgcaagtcccaagccatagtgcagcagttcggagcccctggaggcctgggtgaaacattgcagcagaagctgctggaacggcaggaaaaaacagcgaattgggtatctgagtactggctcaatgacatgtatcttaataataggttggctctgcctgttaatagtagcccagctgtaattttcgcgaggcaacatttccccggaaccgacgatcagctgcggtttgcagcctctctgattagtggggtactctcctataaagctctcttagacagtcacagcattccgaccgactgtgcaaaaggccagctgtccggtcaaccactgtgcatgaagcagtactacggcctgttttctagctatcgcctgcccggacacacccaagacactctcgttgctcagaactccagtataatgcccgaacccgagcatgtgattgtagcctgctgcaatcagttttttgtgctcgacgttgtgattaatttcagacgcctttctgagggagacctttttacccagctcaggaagattgtcaagatggcctctaacgaagatgagcggcttccccctatcggcctcctgacgtccgacggccgtagcgaatgggcagaggcccgaacagtcctggtcaaggacagcaccaatagggattccctggacatgatagaaaggtgcatctgcctggtttgcctggatgcacctgggggagtggaactgagtgacacccatcgcgcacttcaactgctgcacgggggtgggtattcaaagaatggcgcaaaccgatggtatgacaagtcgctgcagtttgtggtcggcagggatgggacctgtggggtggtgtgcgaacattcccctttcgacggcatcgtcctagtacaatgtacagaacaccttttgaagcacgttacacaatccagccggaagttgatcagagcagactcagtcagcgaactgcctgcccctcgaagacttcgctggaagtgcagccccgaaatacagggtcacctcgcatcctcagcggaaaagctccaacggatcgtgaagaacctggattttattgtttataagttcgataactatgggaagacattcatcaagaaacagaagtgctctcctgatgccttcatccaagtcgcattgcagctcgcattctaccggctccacagaaggctcgtccccacctatgaatcagctagcattaggcgatttcaagaagggagggtagacaacatcagatctgccacaccggaggccctggctttcgtgagggcagtgactgaccacaaagccgcagtccctgcttctgagaagctcctgttgctcaaggacgctatccgggcacagacagcttataccgtgatggctattaccggtatggccattgacaatcatcttctggccttaagagagctcgcccgagccatgtgcaaagaactgcctgagatgttcatggatgagacgtacctaatgtctaaccgttttgtgctgagcacgagtcaagtccccacaactacggagatgttctgttgctacggacccgtggtgccaaacggctatggagcttgttacaacccacagccagagaccattctgttttgtatttcttcctttcatagttgtaaggagacctcaagcagcaagtttgccaaggctgttgaagagtctctcatcgacatgcgtgatctttgcagtctgctgccacctacagagagcaagccactggctacaaaggagaaagcaacacggccttcccagggacatcagccatag

SEQ ID NO: 218197 - DNA, 1638 bp, Artificial Sequence
  Description of Artificial Sequence: Synthetic coding sequence
atggccgctaagaccccaagcagtgaggagagtggattgccaaagctgcccgtgccccctctgcagcagaccctagcaacttatttgcagtgtatgaggcacctagtatccgaggaacagttccgtaaatcccaggcaattgtgcagcagttcggcgcacccggaggcctgggcgaaactctccagcagaagctgttagagcgccaggagaaaaccgccaactgggtcagtgaatattggctcaatgacatgtatttaaacaatcgcttggctttgccagttaattcgtcacccgctgttatcttcgccagacagcatttccctggcaccgacgaccagttaagattcgctgcatccctgataagcggagtgttatcctacaaagccctactggattcacactcaattcccaccgactgtgcgaaaggccaactctccggccagccgctttgcatgaaacaatattatggactgttctcctcatatcgcctacccggacatactcaggatacgctggtcgctcagaactcatcaatcatgcccgagcctgaacatgttattgtggcatgttgtaatcagttcttcgtgttagatgtggtcataaacttcagacgtcttagcgaaggcgaccttttcactcagctgcgcaagatcgtcaaaatggcatctaacgaagacgagcggctgcctcccatcggactgttgacttctgatggtcggtccgagtgggcggaagcgcgtaccgtgctagtgaaggattcgacaaaccgagactctctggacatgatcgagcgctgcatttgtttggtgtgtttggatgcacccggaggggtggagctttcagatacacaccgtgccctccagctgttacacggagggggttattcaaaaaacggcgctaacagatggtatgataaaagcttgcagtttgttgtcggcagagatgggacatgtggggttgtgtgtgagcatagccctttcgatggaattgtattggtccagtgtaccgagcacctgttgaagcacgtgacccagagcagcagaaaattgattcgggctgattccgtgtccgagttaccagccccacgcagattgcgctggaagtgttctcctgagatccagggccacctcgcctcgtccgctgaaaaactccagcggattgtgaagaacctggactttatcgtgtacaaattcgataattacggcaagacatttatcaagaaacagaagtgtagtccggatgctttcattcaagttgcactccagcttgccttctatcgcttgcaccgcaggctcgtaccaacatacgagtctgcttccatccgcaggttccaggaagggagagtggataacatacgtagcgccacaccagaggcgctggcctttgtgagagccgtcactgaccacaaggcagccgttcccgcttctgagaagctgttgttgctgaaggacgccattcgagcacagaccgcttacacagtaatggcaatcaccggaatggccatagataaccacctcttagccttacgcgagcttgctcgggctatgtgcaaggagttacccgagatgttcatggacgagacatatctcatgtcaaataggtttgtactgtctacctcccagctatgttggccatag

SEQ ID NO: 218198 - DNA, 1383 bp, Artificial Sequence
  Description of Artificial Sequence: Synthetic coding sequence
atgaatacgagtgcacctcccgcagtttcccccaatatcaccgtacttgctcccggtaagggaccttggcaggtcgcatttataggcatcaccaccggtcttttgtctttagctacagtgacaggaaacctgctggttctgatttcatttaaggttaataccgagttgaagactgtaaataattattttctactcagtctggcctgcgccgatctgataatcggaacattttccatgaacctctatacgacctatttgctgatgggacactgggcactggggaccctggcgtgtgacctgtggctcgccctggactatgtcgcatccaacgccagcgttatgaacttgctgcttatctcgttcgaccggtacttctcagtcaccagaccactttcttatcgggctaagcgaactccaagaagagcggcactaatgattggattggcctggttggtgtccttcgttttgtgggctccagccattttgttttggcagtatctcgttggggaaagaactgtcctggccggacagtgctacatacagtttctcagtcagccgatcatcaccttcgggaccgccatggccgcattctatctccccgtgactgtgatgtgcaccctatactggcggatttaccgagaaaccgagaatcgcgctcgagaactcgctgctttgcagggctccgaaacaccgggtaagggagggggaagttcctcctctagtgagcgatcccaacctggcgctgagggttcccccgaaacgccccctggccgatgctgtagatgttgtcgggctccacgattgctgcaagcctacagttggaaggaggaagaagaggaggatgaaggctccatggaaagcctcacctcttctgaaggcgaggagccgggatcagaggttgtgataaagatgcctatggtggaccccgaggcccaggcacctacaaagcaaccccctcgcagcagcccaaacactgtcaagcggcctacaaaaaaaggacgagatagagccggaaagggacagaagccaagagggaaggagcagctcgccaagcggaaaaccttttctctggttaaggagaagaaagcggctaggacactctctgccatcctattggcgttcatactcacatggactccctataatataatggtactcgtgtccacgttttgcaaagactgcgtaccggaaaccctttgggaactcggttattggctgtgctacgtgaatagtacaattaaccctatgtgctacgccctttgcaacaaagcgttcagagacacttttcggctgttactgctctgtaggtgggacaaaaggcgctggagaaagatccctaagaggcccggatccgtacataggactccctcccgccaatgctag

SEQ ID NO: 218199 - DNA, 405 bp, Artificial Sequence
  Description of Artificial Sequence: Synthetic coding sequence
atgaacacttctgcccctccagccgtcagtcctaatatcaccgttctggctcccggaaagggtccctggcaggtagcgtttattggaataaccacgggattgctctccttggctacggtcaccggcaacctgctcgtactgatctcttttaaggtaaacaccgaactgaagaccgtgaacaattactttctgctatccctggcctgtgcggatctcatcatcggcacctttagtatgaacctgtataccacctacttgctaatgggccactgggccctcgggactttggcttgtgatctgtggctggcactagattacgtggccagcaacgcctcagtcatgaatcttctgttgatttcctttgaccgctactttagcgttacccgtcctttaagctatagatag

SEQ ID NO: 218200 - DNA, 1365 bp, Artificial Sequence
  Description of Artificial Sequence: Synthetic coding sequence
atgaacaccagcgcccctcctgctgtcagccccaatataacagtcctagcacctgggaaggggccatggcaggtagctttcattgggatcacaaccgggcttctgtccctggctactgtgaccgggaaccttctcgtcctgatatccttcaaagtaaacactgaactgaaaacagtcaataactatttcctcctctcactggcatgtgctgatcttattatcggaactttttcaatgaacttatataccacttacctgctaatggggcattgggcgttaggcacgctggcctgtgacctgtggctcgccctcgactacgttgcttctaacgcctcggtgatgaatctcttactgatctcatttgaccgctatttcagcgtcacgcggcctctgagctatcgtgcgaagaggacccccagaagagccgctctgatgatcggattagcttggctggtgtcctttgtcttgtgggcccctgcaattcttttttggcagtatctggtgggagaacgcaccgtcttggctggccaatgctacatccagtttcttagtcagcctattataacctttggaactgctatggcggcattttacttgcctgtcacagttatgtgcaccctgtattggcgcatctatcgtgagacagaaaatcgggctagagaattagcagccctacagggttcggaaacaccaggaaaggggggaggatcatcttcgagctccgagcggagtcagcccggagcagaaggttccccagagactccacccggaagatgttgcaggtgttgccgagctcctagactgctccaggcatattcctggaaagaggaagaggaagaggacgaaggcagcatggaaagcctgaccagcagcgagggcgaagagcctggctctgaggttgtgatcaaaatgcccatggtggacccagaagcccaggcaccgaccaagcagcccccaagatccagcccgaacacagtcaaacgaccgactaagaaagggagagacagggcaggcaaaggtcaaaagccgaggggcaaggaacagctggctaaacggaaaacattttctctggtgaaagagaagaaagccgcaaggacactgtcggccattctgctcgcattcattctaacctggacaccttataatatcatggtcctggtgtcaaccttctgcaaagactgtgttcccgaaactctctgggagctgggatactggctgtgttatgtaaactcaaccattaatcctatgtgctacgccttgtgcaacaaggctttccgcgatactttcaggcttctgctgctatgtcggtgggacaaaaggaggtggagaaagatccctaaaagacccggatctgtccatcggtag

SEQ ID NO: 218201 - DNA, 1401 bp, Artificial Sequence
  Description of Artificial Sequence: Synthetic coding sequence
atgaacaattcaacgaacagctccaataattctcttgctctaacgtcaccatataagacctttgaagttgtattcattgtactagtggcagggtctttaagtttagttacaataatcggtaacatactggtgatggtgtccatcaaggtgaacagacatttgcaaaccgtgaacaattattttctgttttctctggcttgcgcagatctaatcatcggggtgttctcaatgaacctttacaccctttacaccgtgatcggttattggcccctggggccagtagtttgcgatttgtggctggcacttgattacgtggtgtccaacgcatctgtaatgaacctgttgattatatcctttgaccggtacttttgtgtgaccaagccactgacgtatccagtaaagaggacaaccaaaatggccggaatgatgattgcagcggcttgggtgttgtcatttatcctgtgggcgccagcaatattgttttggcaattcatagtcggggtacggactgtggaagatggagagtgttacattcaattcttttcgaatgccgctgtgaccttcggaacagcaatcgcagccttctatctgcctgttataattatgaccgtactgtactggcacatcagccgggcaagtaagtctcggattaaaaaggataagaaggagcctgtcgccaatcaggatcccgtctcccccagccttgtacagggccgaatcgtcaagccaaataacaacaacatgccttcgtctgatgatggcctcgaacataacaagatccagaacggcaaggctccgagagatcccgtgactgaaaattgcgttcagggggaagaaaaagaaagtagtaacgactcaacatcagtgtcagccgttgctagcaatatgagggatgacgagattacacaagacgagaacaccgtttcaacgtcacttggccattcaaaggatgaaaatagcaaacaaacttgcattaggattggaactaaaactcccaagtccgattcttgtacccctactaacaccacagtagaggtggtgggttcatccggacagaacggagacgagaagcagaacatcgtggctagaaaaattgttaagatgacaaaacagccagcaaaaaaaaagcctcctcctagtcgggaaaagaaggtcacaaggactatcctcgcaatactgttggcctttattatcacatgggcgccatacaacgttatggtgctgattaacaccttctgcgcaccctgtatccctaacacagtgtggaccattggctactggttatgttacataaacagcacgattaatcccgcttgttacgctctgtgcaacgcaacatttaagaagaccttcaagcatcttttaatgtgccactacaagaatatcggggctaccaggtag

SEQ ID NO: 218202 - DNA, 1401 bp, Artificial Sequence
  Description of Artificial Sequence: Synthetic coding sequence
atgaataatagcaccaactcctccaacaattccctcgcactgacttccccttataaaacttttgaggttgtctttatcgtgttggtcgcagggtccttgagtttggtgacgatcatcggcaacatcttagtcatggtgtcaatcaaagttaatcgccacctgcagacagtcaataactactttctatttagtctcgcctgcgccgatctgattattggcgtatttagcatgaacttgtacaccctgtataccgttatcggttactggcccttgggcccagttgtgtgcgacctctggctggccctggattatgtcgtgagtaatgccagtgtgatgaacctcctcattatcagttttgataggtacttctgtgttacgaaacccctgacctatcccgtaaagagaacaacgaagatggctggcatgatgatagcagccgcatgggtgctaagttttatcctgtgggccccagcaatcctgttctggcaattcattgtgggcgtccggaccgtcgaagatggagaatgttatatccagttcttttctaacgcggctgttacatttgggaccgcaattgctgccttctacttacctgtgattattatgaccgtgctttactggcacatttctagggcaagtaaatcccggattaagaaggataagaaagaacccgtggccaatcaagaccctgtaagcccctctttggtgcagggacgcatcgtgaagccaaacaacaacaacatgccctcatcagacgatggtttagagcataataagattcagaacggcaaggctcctcgggatcccgtcacagagaactgcgtccagggagaagagaaggagagcagcaacgatagtacaagcgtgtctgccgtggcctccaacatgcgagacgatgaaatcactcaggatgaaaatacagtgtccacctccctgggccattccaaagatgaaaacagcaagcagacatgtatacgaattgggacaaagacccccaaatctgattcttgtactcctactaacacaacggttgaggttgtcggcagcagcgggcaaaacggcgacgaaaagcagaacatagtagcacgcaagatcgtcaagatgactaaacagcccgcaaaaaaaaagcctccaccgtcacgggaaaagaaagtgacccgaaccattttagccatcttactggcttttataattacatgggccccatacaacgtgatggttctgattaatacattctgcgctccctgcatacccaatactgtgtggactattggatactggctctgttacatcaattcaacgatcaatcccgcatgctatgccttgtgcaatgccacattcaagaagacatttaaacatctgctaatgtgtcattataaaaacattggtgccactcgctag

SEQ ID NO: 218203 - DNA, 1401 bp, Artificial Sequence
  Description of Artificial Sequence: Synthetic coding sequence
atgaacaattccactaactcctccaacaattcccttgcattgacgtctccttacaagactttcgaggtggtgtttatcgtactggtggccggatccttatccctcgttactatcattggcaatattctcgtgatggtatctatcaaggtgaaccgccacctccagacagtgaacaactattttctcttttctctggcctgtgccgatctcatcatcggggtgttctcaatgaacttgtatactctgtacaccgttattgggtactggcccctgggacccgtggtgtgtgacttgtggctggcactggactacgtggtttctaacgcatccgtgatgaacctgctaattatatccttcgaccggtacttctgtgtcacaaagcctcttacatacccagtcaaacggacgacaaagatggcaggaatgatgatcgccgctgcatgggtgctgtccttcattctgtgggcccctgcgattctgttctggcagtttatagtgggcgttcggaccgtggaggatggcgagtgttacattcaatttttttcaaacgctgccgtcacattcggaaccgcaatcgccgcattctacctacctgttatcattatgaccgtgctgtactggcatatttcaagagccagtaaatcgcgcatcaagaaagacaaaaaagaaccagtagccaaccaggatcctgtctccccgtctctcgtgcaggggcgaatcgtgaagcctaacaacaacaacatgccgagtagcgatgatggtctggaacacaataagatccaaaatgggaaggccccaagagaccctgtcacagagaactgcgttcagggtgaggaaaaagaaagtagcaatgattccacctctgtttcagccgttgccagtaatatgagggatgatgagatcacacaggacgagaacactgtttcaacctcccttggacattcaaaagacgaaaacagcaagcagacctgcatcagaatcggcacaaaaacgcccaaaagcgatagctgcactcccaccaacacaacagtggaggtggttgggtcgtctggtcaaaacggggacgagaaacagaatattgttgcccgaaaaatcgtgaagatgacaaaacaacccgcaaagaagaaacctccaccgtcccgagaaaagaaggtcacccgcaccatcctagctatcttgttggctttcatcattacatgggctccatataacgtcatggtgctcattaacaccttctgcgccccttgcatcccgaacacagtctggactatcggatactggttatgttatattaactcgacaataaacccggcttgttacgctttgtgcaatgctacatttaaaaagacattcaaacatctgctcatgtgccactacaaaaatattggagcaacacgatag

SEQ ID NO: 218204 - DNA, 1401 bp, Artificial Sequence
  Description of Artificial Sequence: Synthetic coding sequence
atgaataacagcaccaattccagcaacaactcactggccctgacttcgccttacaagacatttgaagtcgtctttatcgttctggtggccggatctctgtcgctcgtgactatcataggaaatatccttgtgatggtctctataaaagttaaccggcatctgcagacggtgaataactattttcttttctcgctggcatgtgccgacctcattatcggagtgttttcaatgaatctgtacacactgtacaccgtcatagggtactggcccctgggacccgtggtatgtgacctgtggcttgcactggattacgttgtctctaatgcatcagtcatgaaccttctgatcatatcgttcgaccgctacttctgcgtcactaaacccttgacatacccagtgaagaggaccacaaagatggccggtatgatgattgccgcagcttgggtgctgagctttatcctctgggctccggctattctgttctggcagtttatcgtcggagtgcgtacagtcgaagatggcgaatgctacattcagttttttagcaatgcagccgtgacctttgggactgccatagcggcattctatctgccagtcatcatcatgacagtgctctattggcacatatctcgcgctagtaaatccagaattaagaaggataagaaggagcccgtcgccaaccaggatcctgttagcccaagtctcgttcaaggccgaattgtcaagcccaataacaacaatatgccatcatcagatgacggtttggagcacaacaaaattcaaaatgggaaagcgcctcgggatccagttacagagaattgcgtgcagggcgaggaaaaagagagctccaatgattctacctcagtgagcgctgtggctagcaacatgcgagatgatgaaatcacccaggacgaaaacaccgtgtctacatcattaggccattcaaaagacgaaaactccaagcaaacgtgcatacgcataggaaccaagactcctaagtcggactcctgcacaccaactaatacaaccgttgaggtggtcgggtcttcaggtcagaacggggatgagaaacagaatatcgtggctaggaagattgtcaagatgaccaagcagcctgcaaaaaaaaagccaccaccaagcagggagaagaaagtaacacgtacaatactcgcaattctgctggcttttataataacatgggcgccttacaacgtcatggtgctgataaataccttctgtgctccttgtatacctaacactgtctggaccattggttactggctgtgttatattaatagtaccattaatcctgcgtgttacgccctgtgcaacgctacttttaagaagacgtttaagcacctgctgatgtgccattacaagaatatcggtgccacgaggtag

SEQ ID NO: 218205 - DNA, 1401 bp, Artificial Sequence
  Description of Artificial Sequence: Synthetic coding sequence
atgaataattcaaccaattcctctaacaatagcctcgcactgacaagcccctacaagacgttcgaggttgtttttattgttctggtggctgggtccctgagcctggtcaccattataggtaacatcctggtgatggtatctattaaggtgaaccggcacctgcaaaccgtgaacaactatttcttgttctccctagcgtgcgcagacctcatcatcggcgtgttctccatgaatctctatacattgtacacagtgattggatattggccactcgggccagtcgtgtgtgatttatggttggctctcgactacgtggttagtaatgcgagcgtgatgaacctgctaattatcagctttgaccgctatttctgcgttaccaagcccctgacgtacccagtgaagagaacgacaaagatggcagggatgatgattgctgcagcttgggtgctcagctttatcctgtgggcaccagccatattattttggcaattcatcgtgggcgttcgcaccgtcgaggatggggaatgctacattcagttcttctccaatgccgctgtaactttcggcacagcaattgctgctttctatctgcccgtgatcataatgaccgtgctgtattggcatattagccgggcttccaaatcccgcataaagaaggataagaaggagccagtcgccaatcaagatcctgtctctccgagcttggttcagggccgaatcgttaaacccaacaataacaatatgccgagcagtgatgatggactggaacacaataagattcagaatgggaaggccccacgggacccagttactgagaattgcgtgcagggtgaggaaaaggagtcctccaatgacagcacttcggtaagcgcagtagcgagtaatatgagggacgatgaaattacgcaggacgaaaatactgtcagtacgagcctgggccactctaaagacgaaaatagcaagcagacctgtatccgcattggcacgaagacaccaaaatcggattcatgcacaccgaccaatacaaccgtggaggtggtaggctccagtggccaaaacggagatgagaaacagaacattgtggccagaaagatcgttaaaatgactaagcaacccgctaaaaaaaagccacccccaagcagagagaagaaagtcacacgcacaatcctggcaatattacttgccttcatcattacctgggcaccgtacaatgtgatggtactgattaacaccttctgcgctccctgcataccaaacacagtttggaccatagggtactggttgtgctatatcaattcaacaatcaatcctgcctgctacgcgctgtgtaacgctacttttaaaaaaacattcaaacacctgttaatgtgtcattacaagaacatcggagctactcggtag

SEQ ID NO: 218206 - DNA, 1401 bp, Artificial Sequence
  Description of Artificial Sequence: Synthetic coding sequence
atgaataactctaccaatagttctaacaatagcctcgcactcacatccccctacaaaacattcgaggtcgtgttcatcgtactggtcgctggctccctttctctggtcaccattatcggaaacattctggtgatggtcagcattaaagtgaaccgacacctccagaccgtcaacaactacttcctgttttccctcgcttgcgctgacttaatcatcggcgtgttcagcatgaatctgtatacgctgtacactgtgattggctattggccccttggacccgtggtgtgtgacctgtggctggcgcttgactacgttgtgtctaatgcaagcgtgatgaatctgttgatcatctccttcgatcggtacttttgcgttacgaagccgcttacatatcccgtcaagaggacaacaaagatggccggtatgatgatagcggctgcttgggtgcttagttttatcctgtgggctcccgctattttattctggcagttcattgtgggggttcggaccgtcgaagacggcgagtgttatatacaattttttagcaacgccgcagtgacatttggcactgcgattgccgcattctatcttcccgttatcattatgactgtcctttactggcacatttcgagagcatctaagagtcgtattaagaaggacaagaaagaaccagttgctaaccaagaccccgtgtctccaagtctggttcaaggacgcatagtgaagccaaataacaacaatatgccctctagtgacgacggtctggagcacaacaagatccagaacgggaaggccccaagggacccggtgaccgaaaactgcgtgcagggcgaagagaaagagtctagtaatgactccactagtgtgagcgcagtagcgtctaacatgcgcgatgatgagatcacgcaggacgaaaatacagtgagcactagcctgggacactccaaggatgaaaactcaaaacagacttgtatcaggatcggaaccaagacgccaaagtccgattcctgtactcccacgaacactactgttgaggtagttggctcctccggccagaatggggatgagaagcagaatatcgtagcgaggaagatcgtaaaaatgactaaacagcccgctaaaaagaagcctccaccgagccgcgaaaaaaaagtgacgaggaccattctggccatcctccttgccttcatcatcacctgggccccatacaacgtgatggtattgatcaacacattctgtgcgccatgcattcccaacaccgtgtggactatcggctattggctgtgttacatcaacagtacaattaacccggcatgttatgcattgtgtaacgccacattcaaaaagaccttcaagcatctcctgatgtgccactacaagaacataggggctacgaggtag

SEQ ID NO: 218207 - DNA, 1773 bp, Artificial Sequence
  Description of Artificial Sequence: Synthetic coding sequence
atgacgttacacaacaattctacgaccagtcctttgtttcctaacatttcttcatcttggattcacagccctagcgacgctggtctgcccccaggcactgtgacccattttggatcctacaatgtatcgcgagccgctgggaatttttcttccccagatggtaccactgacgatcctctgggcggacatacagtgtggcaggtggtattcattgcgttcctgaccgggatcctggccctagtcaccattatcggaaacatcttagtcatcgtgtctttcaaagtaaataaacagctcaaaacggtgaacaattactttcttttaagtctggcctgtgcagacctcattattggggtcatttctatgaacttgtttactacgtacatcattatgaaccgatgggctttggggaatctggcatgtgacctctggctggctattgattacgtcgctagcaatgctagcgtgatgaaccttctggttattagcttcgaccgctacttctctatcactagaccattgacgtaccgcgcaaaaaggaccacgaagcgggctggcgtaatgatcggtctagcctgggtaatttcctttgtgctgtgggccccagcaatcctattctggcaatactttgtcggcaaaagaacagtgccacctggggagtgtttcatccaatttctgagcgaacctacaatcacctttgggacagcaattgccgctttctacatgccggtgaccatcatgaccatcttatactggcgtatctacaaagaaaccgaaaaaaggaccaaagaactcgctggcttgcaggccagtggcactgaagccgaaacagaaaactttgttcaccctaccggctcttcgcgctcttgtagttcgtatgaattacagcaacagagtatgaaacgcagtaatcgccgtaagtacgggcgatgccacttctggttcaccaccaagagctggaagccttcgagtgagcagatggatcaggaccatagttcttcagacagctggaacaataatgacgcagctgcaagcttggaaaattcggcctcaagtgacgaagaagatattggaagcgaaactagggctatctattccatagtgctaaaactgcccggtcactccaccatacttaatagtacaaaactccccagttctgacaatctgcaggttcccgaggaagagcttggaatggtcgatctggaaagaaaagccgataaactccaggcccagaagagtgtcgacgatggcggtagttttccgaagagcttctccaaactccccatccaactggaaagcgctgtggacaccgccaagacaagcgacgttaactcctctgtcgggaagagcacggccaccctacccctgagtttcaaggaggctacccttgctaagcgctttgccctgaagacacgatcccagatcaccaaacgtaaacgaatgtctctagtcaaagagaaaaaagccgctcaaactttgtctgccatcctgctcgcgttcatcattacctggacaccctacaacattatggtcttggtaaacaccttttgtgactcatgtatccccaaaacgttctggaatttaggatactggctatgctatattaattccaccgtgaatccagtctgttacgccctctgtaataaaactttcaggaccacattcaaaatgctgttattgtgccaatgcgataaaaagaagcggcgaaagcagcagtatcagcagcggcagtctgtgattttccacaagcgcgcaccggaacaggccctctag

SEQ ID NO: 218208 - DNA, 333 bp, Artificial Sequence
  Description of Artificial Sequence: Synthetic coding sequence
atgaccttgcacaataacagcactacaagcccactgttccccaatatcagcagctcttggatacatagtccttccgacgccggtttaccaccaggtaccgtgacacatttcgggtcctacaatgtatcaagagccgcaggcaattttagctcacctgacggcactaccgacgatcccttgggcggacacacagtgtggcaggtggtttttatcgctttcctcaccggcattctagcactggtcactatcatcggaaatatcctggtcatcgtgagcttcaaagtaaataagcagttaaaaacagtcaataattacttcctccttagcctgtag

SEQ ID NO: 218209 - DNA, 1440 bp, Artificial Sequence
  Description of Artificial Sequence: Synthetic coding sequence
atggccaactttaccccagtcaacggctcttcgggaaatcagtcagtacggctagtcacttcctcctcacacaaccgctacgagaccgtggagatggtttttatcgccaccgtcacaggaagcctctcactggtgactgtggttggcaacattctcgtcatgctgagcataaaggtaaatagacagctacagacggtgaataattactttcttttctcactcgcgtgtgcagacctgatcatcggcgcatttagcatgaacctgtatactgtctacattattaaaggatactggcccctgggcgcagtcgtgtgcgacctatggttagccctggattatgtggtctccaacgctagtgtcatgaatttactcattatctcatttgacaggtacttctgcgtgaccaagccacttacatatccagcacgccgaaccactaagatggcaggattgatgatagcagctgcttgggtgctcagcttcgtgctatgggcacccgctatactgttctggcagttcgtcgtgggtaaaagaaccgtgccagataaccagtgttttatccagtttctgtcgaaccccgctgtgacattcgggacagccatagctgccttttacctccctgtggtgatcatgacagtcctgtatatccacatttcactcgcctcacgatcacgcgtccacaaacaccgccctgaaggaccgaaagaaaaaaaagctaaaactctcgcttttcttaagtcgccgctgatgaagcagagcgtcaaaaagccacccccaggggaagctgctcgggaggaacttagaaatggtaaacttgaagaagcaccgcctccagcattaccaccccctcccaggcctgtggctgacaaggacacttcaaacgaatcctccagtggctcagccacacagaatacgaaagaaagaccagccactgaactgtcaactacggaagccacaacccctgctatgcccgctcccccactgcagcccagagctctcaaccctgctagccgatggtccaagatccagatcgtcacgaagcagaccgggaatgaatgcgtcaccgctattgagatcgtgcccgctacgcccgcaggaatgagaccggctgcgaatgttgctcggaaattcgcatctatcgctcggaaccaggtgagaaaaaaacggcagatggctgcgagagaaaggaaggtcacaagaacaatttttgcgattctgctggcgttcattctgacatggaccccctacaatgtgatggtgttggttaatactttctgtcagagttgcatcccggacaccgtctggtcgattggttactggctgtgctacgttaattccacgattaatccggcttgttacgccctttgtaatgctacctttaaaaaaaccttcaggcatctgttgctgtgccagtacagaaatatcggaaccgcgagatag

SEQ ID NO: 218210 - DNA, 1599 bp, Artificial Sequence
  Description of Artificial Sequence: Synthetic coding sequence
atggagggtgattcatatcataatgcaacaaccgtgaatggtacaccggtgaatcaccaaccgctagaaaggcacaggctgtgggaggtgataacgatagcagcagtgactgccgtggtctccctgattactattgtcggaaatgttctggtgatgattagctttaaggtgaactcccagctcaaaactgttaacaattattacttgctgagcctggcttgtgccgatctgatcataggtatcttcagcatgaacctatacactacgtatatcctaatgggtagatgggccctggggtctttggcctgtgatctctggttagcccttgactatgtggccagcaatgcttcagtgatgaatttgctggtgatctcctttgacagatacttcagtatcacccgtcccctgacttatagagcgaaacggacccctaaacgcgcaggcatcatgataggactggcatggcttatctcatttatactctgggccccagccattctttgttggcagtatttagtggggaagagaaccgtgccactcgacgagtgtcagattcaattcttgagtgagccaactatcacattcggaaccgcaatcgctgcattttatatccccgtttcagtgatgaccatcttgtattgtaggatctatcgagaaacagagaaaaggaccaaggacctcgccgaccttcaggggtctgatagcgtgaccaaggccgaaaaaaggaaaccggcacacagagctttgtttcgttcctgcttacggtgtccacggccaactttggcccaaagggaaaggaaccaggcttcctggtcgtcgtctcggcgatcaacctccacgacaggaaagcctagccaagccaccggcccatccgccaattgggctaaagcggagcagctcacaacatgcagctcctacccgagcagcgaagacgaagacaaacctgcaaccgatccagtcctgcaggtagtctacaagtctcagggaaaggagagcccaggggaagagtttagcgccgaagagacggaggagacattcgtgaaggcagagaccgaaaagagcgactacgatacccccaattacctgctgtcccccgctgccgcacacagacccaagtctcagaagtgcgtggcttataaatttaggctcgtggtaaaagcagatggaaaccaggagacgaataacggatgtcacaaggtcaaaattatgccttgtccatttcctgtggccaaagaaccaagtacaaagggcttgaatcctaaccccagtcaccagatgactaagagaaaacgcgtggtgcttgttaaggaacggaaagctgctcagaccctgtccgctattctacttgccttcatcatcacttggacaccctataacattatggttttagtctccactttctgtgataaatgtgtgcccgtgaccctctggcatctcggatactggctgtgctatgtcaactccaccgtaaacccaatctgctatgctctgtgtaatcggacatttcggaaaacctttaaaatgctgctcttgtgcagatggaagaagaagaaggtggaggagaaactctactggcaggggaatagcaagctaccatag

SEQ ID NO: 218211 - DNA, 1599 bp, Artificial Sequence
  Description of Artificial Sequence: Synthetic coding sequence
atggagggcgatagttaccacaatgcaaccaccgtaaacggtacaccagtgaaccatcaaccactcgaacggcataggctgtgggaagttatcacgatcgcagccgtcaccgctgtggtaagcttgatcactatcgtcggaaacgtgctggtaatgatctctttcaaagttaacagccaactgaagacagttaacaattactatttactatccttagcctgcgccgacctcattatcggcattttctcaatgaatttgtacaccacatacatattgatgggtcgttgggccctggggtccctggcttgtgacttgtggctcgcactggactacgttgcgtctaacgcctctgtcatgaacctgctcgtgattagcttcgaccgctacttcagtataacccgaccgctgacataccgggcaaagcgaacgccaaaaagagcagggatcatgattggcctcgcgtggctcatctcatttatattatgggcgccagccattctgtgttggcagtatttggtcggcaagaggaccgttccgttggacgagtgccaaatacagttcttaagtgagcccactattaccttcggtactgctattgcagccttctatattcccgtgagcgtaatgacaatcctgtactgcaggatctatcgcgagaccgaaaagcgaacaaaagacctggccgaccttcagggcagcgattctgtgaccaaggctgagaaaagaaaaccggctcatcgggctctctttcgatcctgtctgcgctgcccgagacctacactggcgcagcgcgaaaggaatcaggcctcttggtcgtcgtcccgacgctctacctctaccaccggaaaaccttcccaggctaccggtccgtcagcgaactgggccaaagctgaacagcttacgacgtgttcttcatatccttcgagcgaggacgaagacaaaccagcaactgatccagtgctgcaagtagtttataaatcacaggggaaagagtcaccaggcgaagagttcagcgcggaggaaaccgaggaaacctttgtaaaggccgagactgagaaatcagattatgacaccccaaactatttactgtcccccgctgccgctcaccgacctaagtcacagaaatgcgtagcatacaagttccgactagtggtcaaagctgatggtaatcaggaaactaataacggatgccacaaggtcaaaatcatgccctgccccttccccgtggctaaggaacctagcacgaagggcctgaacccgaatcctagtcaccagatgacaaaaagaaaacgcgttgtgctcgtgaaagagagaaaggcggcacagaccctgagcgcaattctcttggcctttatcattacgtggaccccttacaacattatggtactggtctctacattttgtgacaagtgtgtccccgtgacattgtggcacctcgggtactggttatgttacgtgaattccacagtgaaccccatttgttacgcactgtgtaatcggacatttaggaagacctttaagatgctcctgctctgcaggtggaaaaaaaagaaggtggaggagaagctttactggcaggggaactcaaaattgccctag

SEQ ID NO: 218212 - DNA, 69 bp, Artificial Sequence
  Description of Artificial Sequence: Synthetic coding sequence
atggaaggagacagctaccacaacgcaaccactgttaatgggaccccagtgaatcaccaacccctctag

SEQ ID NO: 218213 - DNA, 1449 bp, Artificial Sequence
  Description of Artificial Sequence: Synthetic coding sequence
atggaaccctggccactgttgctgctcttctccctgtgttccgccggattagtcctcggtagtgaacacgagacacgccttgtagccaaactgtttaaggattactcttctgtggttagacctgtggaggaccaccgccaggtcgtcgaagttaccgtgggattacaactcatccaactcataaatgtggacgaagtaaaccagatagtgacaacaaacgtccgactcaaacagggggacatggttgatctcccacggccatcctgcgttaccctgggtgtacctctgttctctcacctgcagaacgagcagtgggtggattataatctcaagtggaaccccgatgactatggcggtgtaaagaaaattcacattcctagtgagaagatctggcgcccagacttggtgctgtataacaacgctgacggtgatttcgctatcgtgaagtttactaaggtcctgctccagtacactggccacattacatggaccccacctgctatctttaaatcctactgcgaaattatcgtgacacacttccccttcgacgaacaaaactgcagtatgaagctgggaacctggacttacgatggcagcgtggttgccatcaatcctgagagcgatcaacctgatctatctaattttatggagagtggggagtgggtcataaaagagagccgaggctggaaacacagcgtgacatacagttgctgccctgatacaccttacctcgatatcacataccacttcgttatgcaacggctgcccttgtactttatcgtgaacgttatcattccttgtcttctcttctccttccttaccggcctggtcttttatcttccaaccgacagtggtgagaagatgacgttgagcatatctgtgttgctaagcctcaccgtattcctcctggttattgtggaactaattccatcaaccagttccgcagtgcccctaatcggcaagtacatgttatttacaatggtttttgtaatagcgtctataatcatcaccgtcatcgtcattaatacccatcaccgctcccctagcacacatgtgatgccaaactgggttaggaaggttttcatagacacaatccctaatattatgttcttctctacaatgaagagaccatcccgggagaagcaggacaaaaagatattcacggaggacatcgacatctcagatattagcggaaagcccggacctccgccaatgggctttcacagcccattaattaagcacccggaagtcaagagtgctatcgaaggcattaaatacatcgcggagactatgaagagtgatcaggagtccaacaatgctgctgctgaatggaagtacgtagcaatggtcatggatcacatactgctcggagtgttcatgctggtgtgcattattggaacgctcgccgtgttcgctgggagactcatcgagctcaatcaacagggatag

SEQ ID NO: 218214 - DNA, 1374 bp, Artificial Sequence
  Description of Artificial Sequence: Synthetic coding sequence
atggaaccctggcccctcctgctacttttttcattatgtagcgctgggctggttctgggaagtgagcatgaaacgaggttagtagcgaagctttttaaagactacagctctgtggtgagaccagtcgaagatcatagacaggtcgtcgaggtgacagtggggctccagctcattcagttgattaacgtggatgaggtgaaccaaatcgtgaccaccaatgtacgactgaagcagcagtgggtagactataacctgaaatggaatccagatgactatggcggagttaaaaagattcacatcccctccgagaaaatctggcgccctgaccttgtgctgtataacaatgcggatggcgatttcgccattgttaagtttactaaagtcctgctgcagtacacaggacacatcacatggaccccacccgctatcttcaagtcatactgcgaaatcattgtaacgcactttccattcgacgagcagaattgttctatgaagctgggcacctggacctacgatggatccgtagttgcgattaatcccgaatctgaccagccggatctgtctaatttcatggagtccggggagtgggttatcaaagagtctcgtgggtggaaacatagtgtgacatacagctgttgcccggacacaccttacctggatataacctaccattttgtgatgcagcgactgcccctgtatttcattgtgaacgttatcatcccatgtttgctgttctctttcctgactggtcttgttttttatctgcctactgattccggcgagaagatgacactcagtatttctgtgcttctgagcctcactgtgttccttctcgtgatcgttgagctgatcccttcaacatcatccgctgtgcctctaataggtaaatatatgcttttcacgatggtgttcgtcatcgccagcatcatcattacagtcattgtcattaacacccaccaccggagtccaagtacccatgtaatgcctaattgggtgcgaaaagtgtttatcgatactatccctaatatcatgttttttagcacaatgaaacgcccttctcgggagaaacaggacaaaaagatctttacggaagacatcgatatctctgatatttccggaaaacctggaccgccaccaatgggcttccactccccgcttattaagcatcctgaggttaaatccgctattgaaggcattaagtatattgcagagacaatgaagtcagaccaggaaagtaataatgccgcagcggaatggaagtatgtggccatggtgatggaccacattctgttgggagtgtttatgctggtatgcattatagggactctcgcggtgtttgccggaaggctgatcgagttaaatcagcaggggtag

SEQ ID NO: 218215 - DNA, 1353 bp, Artificial Sequence
  Description of Artificial Sequence: Synthetic coding sequence
atggggttgcgcagccaccatctctcactgggacttctactcctattcctgctgccagctgagtgcctcggcgctgagggccgtctagccctcaaactgtttcgggacctattcgccaactatacctccgcccttcggccagttgccgatactgaccagacactgaatgtgacgctggaggtcactctctctcagattattgatatggatgaaagaaaccaggtcttaactctgtacctgtggattagacaggagtggaccgacgcatacctgaggtgggatcctaacgcttacgggggacttgatgcgattaggatcccctcaagcctggtgtggaggcccgacatcgtcctctataacaaggcagacgcccagcctcccggttccgcctccaccaatgtagtgcttaggcacgatggtgcggtgcgctgggacgccccagccataactcgctcatcctgcagggtggatgtcgcagcttttcctttcgatgcccagcactgtggccttaccttcgggtcatggactcatgggggtcaccagctggatgtgcgccctcgaggagcggcagcctccctcgcggattttgtcgaaaacgtggaatggcgtgtccttggtatgccagccaggagacgcgtgctgacctatggatgttgctccgaaccttacccagacgtaacttttacattattactacgacggagagccgcagcctacgtttgcaacttactgctgccctgtgtgctgattagtctgctcgcccctctggccttccatctgcctgcggactctggagagaaagtatcattgggcgtgacggttctattggcacttacagtgtttcagctgctgctggccgaaagcatgccccctgccgaaagcgtacctctgatcgggaagtattacatggctaccatgacgatggtaaccttttctactgccctcacaattcttatcatgaacctgcactattgcggcccttctgtgaggcctgtgcccgcatgggctagagccctccttctagggcacctggccaggggactgtgtgtccgcgagcgcggagagccttgtggacagtccaggccccctgaactgtccccatcacctcaatctcctgaaggaggtgcaggtcctccagccggtccctgtcacgaacctcgctgtctctgccggcaggaggcgctcctgcatcatgtggccaccattgccaacaccttcagatctcaccgagctgctcagcggtgccacgaggattggaaacgcctggctagagtgatggaccgcttcttccttgctatcttcttctcaatggctttagtaatgtctttgctggttttggttcaggccctctag

SEQ ID NO: 218216 - DNA, 1590 bp, Artificial Sequence
  Description of Artificial Sequence: Synthetic coding sequence
atggggccatcatgccctgtgtttctatcttttacaaaactgtcgctctggtggctcctactgactcccgcaggcggtgaggaggcgaaaagaccgccaccacgagcgccaggcgatcctctctcatcaccgtcaccgacagccctccctcaggggggttcacatacagagacagaggatagattgtttaagcatcttttcagggggtataataggtgggccagacccgtgcccaatacgtcagacgtcgtcatcgtccgcttcggcctgagtattgctcagctgatagatgtggacgagaagaaccagatgatgaccaccaatgtctggctgaagcaggagtggtcagattacaagttgaggtggaaccctacggatttcggaaatattacaagtctgagagtaccaagcgaaatgatctggattcccgatatagtcctttataataacgccgacggcgagttcgctgtcactcacatgacaaaggcccacctgttcagtactggcacagtgcattgggtgccaccagctatttacaaatcttcctgttccatagacgtgaccttttttccctttgaccagcagaactgtaagatgaagtttgggtcctggacttacgataaggccaagatagatcttgaacagatggaacaaaccgtagatctgaaggattattgggaaagtggagaatgggccatcgtcaatgcaacagggacatataactcaaagaaatacgattgttgcgctgagatttaccccgatgttacttacgctttcgtgattcggagactgccactgttttacacaattaatctgatcatcccctgcctgttaatctcgtgtttgaccgtattggtcttctaccttccctcagactgcggagagaagatcaccctatgtatctctgtgctcctctccctcacggtctttttgctgctaatcaccgagattattccatccacaagcctggtcattcctctcattggagagtacctcctcttcacaatgatctttgttaccctatctatcgtgattactgttttcgtacttaatgttcaccatagatccccttctactcatacaatgccacactgggtacggggagccctgcttgggtgtgttcccagatggctccttatgaaccggcctccccctcctgttgaactttgtcatccattacggctgaaactatctcccagttatcactggctggagagtaacgttgatgccgaagagcgggaggtggttgttgaagaggaagatcgatgggcgtgtgccggacacgttgctccaagtgtgggaacgctgtgttctcacggtcacctgcatagcggggcttccggacctaaagccgaagccctgctccaggaaggcgagctgttgctgagtccacacatgcagaaggccctcgagggtgttcactatattgccgatcatcttaggtccgaggacgctgactcctccgtgaaggaggactggaaatacgtggccatggtgattgatcggattttcttgtggttgttcattatcgtctgttttcttggcactataggcctgtttttgcccccttttctggctggaatgatttag

SEQ ID NO: 218217 - DNA, 1590 bp, Artificial Sequence
  Description of Artificial Sequence: Synthetic coding sequence
atgggcccttcatgtcccgtttttctgtctttcactaaactctccctgtggtggctgctgcttacaccggcaggcggagaagaagctaagcgaccaccaccacgggcacccggagaccccctctcttcgccctctcccacagccctccctcagggaggatctcatacagagaccgaggacagactatttaaacacctctttaggggctataaccggtgggccagacccgtgccaaacacgtctgacgtggtgattgttcgtttcggtctgagcattgcgcaactgatagatgtcgacgagaaaaaccaaatgatgactacaaacgtgtggttgaagcaggagtggagtgactataagctgcggtggaatcctacggattttggtaacattacttctctgcgggttccatccgagatgatctggatccctgacatcgtactatacaataacgctgatggagagtttgccgttacccatatgactaaggcacatctgttttcaactgggacagtgcactgggtgccacccgctatttacaagtcttcctgttccattgacgtcacattttttccattcgaccaacagaactgcaagatgaagttcggatcctggacctatgataaggctaagattgatctagagcagatggaacagaccgtcgatctgaaagactactgggagagtggcgaatgggccatagtaaacgcaactgggacttacaatagtaagaaatatgactgttgtgctgagatctatcccgacgtaacctacgcttttgtcatcagacggctgcctttgttctatacaatcaaccttatcattccctgcctgctgatttcttgccttacagtgctggtgttttacctgcccagtgattgtggtgaaaaaatcactctgtgtattagcgtcctactgtctttaaccgtttttcttttgctgatcaccgagatcatcccgagtacgtccttggtaatccctttgatcggcgaatatcttctattcactatgatcttcgttacattgagcattgtgatcaccgtgtttgtattgaatgtccaccatcgaagcccatctacccacacaatgccccactgggtgaggggagccctgctgggatgtgtccctcggtggctgctgatgaatagaccccctcctccggtggagctctgccaccctctccggcttaagctgtccccaagttatcattggctagaaagcaatgttgatgccgaagaaagagaggtagtcgtcgaagaggaggacaggtgggcttgtgctggtcacgtcgcacccagcgtcggaacgctctgctctcacggccatctccatagtggagcttcagggccaaaagctgaggcgctgctccaagaaggggaactgctactctccccacacatgcagaaagccttagaaggggttcattatatcgccgaccaccttcggagcgaggatgccgacagttccgtaaaggaggattggaagtatgtggctatggttatcgatcgcatttttctatggctgtttattatcgtctgtttcctcgggacaatcggactctttttgccaccatttcttgctggtatgatctag

SEQ ID NO: 218218 - DNA, 1518 bp, Artificial Sequence
  Description of Artificial Sequence: Synthetic coding sequence
atggggtccggccctctgagtctgcctctggctctgagcccccctagactgttactgctgctcctgctcagcctgctaccagtagccagagcatctgaagccgagcatcgactgtttgagcggctgtttgaagactataacgagattatccggccagtcgcaaatgtcagcgaccccgttattatccactttgaagtgagtatgtcacaactggtgaaagtcgatgaagtcaatcagatcatggaaaccaacctgtggcttaaacaaatctggaacgattataagctcaagtggaatcctagcgactatgggggagctgagttcatgcgggtgcccgcacagaaaatctggaagcccgacatcgtcctgtacaacaacgcagttggcgacttccaagtggacgataagaccaaggccctgttgaaatacacaggcgaggtcacctggatacctccggcaattttcaagtctagttgcaaaattgatgtgacctactttccttttgattaccagaactgcaccatgaagttcggatcctggagctatgataaagccaagatcgatctcgtcctgattggcagctccatgaatcttaaagactattgggagtccggggagtgggctatcataaaggcaccaggttacaagcatgacattaaatataattgctgcgaagagatttatccagacatcacttatagcttgtatatcaggcggctgcccttgttttatactatcaatctcatcatcccctgtttgctaatatctttcctgacagtcttggtgttttatctccccagtgactgtggggagaaagtgacgctgtgcatatcagtccttctgtccttgactgtgtttctgctggttattaccgaaaccatcccatctaccagtttagtaatccccctgattggcgagtaccttctgtttacaatgatctttgtcactttgtcaatcgtgattacggtcttcgtcctgaacgtacattaccgcacaccaaccacccacaccatgccgagctgggtcaaaaccgtgttcctgaatcttcttccacgcgtgatgttcatgactagaccgacttcaaatgaaggcaacgcccaaaaaccacgccctttatacggcgcagagttatctaacctgaattgcttctctcgtgcagaaagcaaaggttgcaaggagggctacccttgtcaggacggaatgtgcggttattgtcaccatcgccgtatcaaaatctctaatttttcagcgaatctgactcggtccagttccagcgaatctgtagacgcggtgttgagcttatctgcactgagccctgaaattaaagaggcaatccagtccgtgaaatatattgcagagaatatgaaagcacagaacgaggcgaaagaaatccaagatgattggaaatatgttgcaatggtgatagacagaatctttctgtgggtatttacattggtttgtatcctcggtaccgctggtctctttctgcagcctctgatggcacgcgaagacgcctag

SEQ ID NO: 218219 - DNA, 939 bp, Artificial Sequence
  Description of Artificial Sequence: Synthetic coding sequence
acaaaggccctgttgaagtataccggagaggtaacctggattcccccagcaattttcaagagcagctgtaagattgacgtaacatactttccatttgattaccagaactgcaccatgaagtttggcagctggagttacgacaaggcaaaaattgatctggtgctcataggatcatcaatgaacctgaaggattactgggaatcaggggagtgggctattattaaagccccagggtataaacatgacatcaagtacaactgctgtgaggagatttacccagatatcacctactccctgtacatccgtaggctgcccctgttttacacgatcaatctcattatcccatgcttactgattagcttcctcaccgttttggttttttacttaccgtctgactgtggcgagaaggtgaccctgtgcattagtgtgctgctaagtctgacagtgttcctgctggtgatcactgaaaccattccaagtacctctcttgtgattcctctaataggggaatatctgttgttcacgatgatttttgtgacccttagcatcgtgattacagtctttgtattaaacgtgcattacagaaccccaacaactcatacaatgccctcttgggtgaagacagtgtttctcaacttattgccacgtgttatgttcatgacgcgccctacaagtaatgagggcaatgcccagaagccaagaccgctgtacggagcaagtcctaaggccgcaaggcgggagattaaagaagcgatccagagcgtgaagtatatcgcagagaacatgaaggcgcagaatgaagccaaagaaatccaggatgattggaagtacgtcgctatggtgatagaccgcatttttctttgggtgtttaccttagtttgcattcttgggactgctggactcttcttacaacctctgatggccagagaggacgcctag

SEQ ID NO: 218220 - DNA, 1470 bp, Artificial Sequence
  Description of Artificial Sequence: Synthetic coding sequence
atgggctctggtcctctgagtctgcccttggccctgtcgcctcccaggttactcctgctgctgttgttgtcccttttgcctgtggcccgtgcatccgaggcagagcataggctctttgaacgactgttcgaagattacaatgaaatcattaggcccgtggcaaacgtgagcgatcctgttatcatacactttgaagtctccatgagtcagctggtcaaagttgatgaagttaatcagatcatggaaaccaatttatggctgaaacagatctggaatgattacaaactgaaatggaatccttcggattatggtggagcggaattcatgcgggtccctgcccagaaaatttggaaacccgacatcgttctgtataacaacgccgtgggcgacttccaagtagacgacaagaccaaagcgttgttgaaatacacaggagaggtcacctggataccaccggcaatctttaaaagctcctgcaaaatcgacgtgacctactttccatttgactatcagaactgcacaatgaagttcggttcctggtcctacgacaaggccaagatcgatctggtgctgataggaagctccatgaatctgaaggactactgggaaagcggcgagtgggccatcataaaagcccctgggtacaagcacgatatcaaatataattgctgcgaggagatctaccccgacatcacttactccttatatattcgccgtctccccttattctatacaataaacctgattattccttgtcttctcatcagcttccttaccgtgctagtcttctacctcccttcagactgtggagagaaggtgactctttgcatctccgtgttgctgagcctgaccgttttcctcctggtcatcacagagacaattccaagcacgtcactagtgattcctttgatcggcgagtacctgcttttcaccatgattttcgtgactctatctattgtgatcacagtgtttgtgctgaatgtacattatagaacccctacgacccacactatgccatcatgggttaagacggtgttcctgaatcttctgccacgtgtcatgttcatgaccaggccaacatccaacgaagggaacgctcagaaaccccgtccactctacggtgccgagctgtctaatctaaactgcttttccagagccgagagtaaaggctgcaaggaaggctacccttgccaggatggaatgtgcgggtactgccatcatcggcgaatcaaaatttcaaatttctccgccaatctcacgcgctcaagcagctccgaaagtgtggatgccgttctgtcgctgagcgcactctccccagagattaaggaggccatacaatcagtaaagtatattgctgaaaatatgaaggcccagaacgaggctaaggaagaacagaaggcccaagagatacagcaattgaagcgaaaagagaaaagcaccgagacttctgaccaggaaccaggattgtag

SEQ ID NO: 218221 - DNA, 1518 bp, Artificial Sequence
  Description of Artificial Sequence: Synthetic coding sequence
atgggttcgggacccttgagcctgcctttggctctgagtcccccacgccttctgttgctgctgttgctaagcctgcttcctgttgccagggcttcagaagcagaacaccggctcttcgaacgcctcttcgaggattacaacgagatcattaggcccgtggccaacgtgtccgacccggtcatcatacatttcgaagtgagtatgtctcagctggttaaagtcgatgaagtgaaccagatcatggaaacaaatctatggcttaaacagatttggaacgattacaaattgaagtggaatccctctgattatggcggagccgaattcatgcgggtgcctgcacagaaaatctggaaacctgacatcgtcctgtataacaacgcagtcggtgatttccaggtagacgataaaacgaaagcattactgaaatatacgggtgaggttacttggatccccccagcgatctttaaatcttcgtgtaaaatcgacgttacgtacttccccttcgactaccagaattgcactatgaaattcggtagctggagttatgataaggcaaaaatcgacctggtcctgatcgggtcgtcaatgaacctgaaagattactgggaatctggagaatgggcaattattaaggcacccggttacaagcatgacattaagtacaactgctgcgaggagatctaccccgatataacatatagcttgtatatccggcgtctgcctttgttctacacgatcaacctgatcattccatgcctcctaatctcatttctgactgtgcttgtgttctaccttccaagcgactgcggggagaaagtgactctgtgcatatcggtgcttctttccctgaccgtgttcctgctcgtcatcacggaaaccattccttcaacatccctggtgatccctcttataggagaatatctgctatttacaatgatcttcgtaactctgagtattgtgattacagtgttcgtgctcaacgtacattaccgcacgcctaccactcacactatgcctagctgggtgaagacagtgttcctcaacctgctgcctcgggtcatgtttatgacgcgtcccacaagcaatgagggcaacgcccaaaagccacggccattgtacggcgcagaactgagcaaccttaactgtttttcaagagccgagagcaagggatgtaaggaaggatacccctgtcaggatggcatgtgtggctactgtcatcacaggagaatcaaaatttccaattttagcgcaaacctgacgaggtccagtagttctgagagcgtggatgcagtgctgagtctctccgctctgtccccggagatcaaagaggccatacagtctgttaaatacatcgcagaaaacatgaaggctcaaaacgaggccaaggagatacaggacgattggaagtacgttgccatggtgatcgaccggatcttcctgtgggtatttactcttgtatgtatccttggtactgcagggctgttcttacagcccctgatggccagagaagacgcatag

SEQ ID NO: 218222 - DNA, 1602 bp, Artificial Sequence
  Description of Artificial Sequence: Synthetic coding sequence
gccccagagcctggcgaggcgcctcggctggatagggcccaccctgggtgcgcctgtgctgagctttctctgctgtggctgtgctgttgcactttcacgagtgctgacggtgatttcgcagttacccacctgaccaaagcccacctcttccacgatggaagagtccagtggaccccacctgcaatctataagagcagctgctccatcgatgtgacatttttcccatttgatcagcagaactgtactatgaaattcggctcttggacctatgataaagctaaaatagatctggtcaatatgcattccagggtagaccagctggatttctgggagtcaggcgagtgggtcattgtggacgccgtagggacctacaacactaggaaatacgaatgttgtgccgagatctatccagatatcacatacgcatttgttattcggagactgcccctattctataccatcaatctcatcataccctgtctgctcatctcctgcctcactgtgctggtcttctatctcccctcggagtgcggggagaaaatcacactttgcattagcgtactactctctctcacggtgttcctgttgcttataacagagataatcccatcgactagccttgtgatcccattaattggggagtatctccttttcacaatgatatttgtcaccttgagcatcgttatcactgtctttgttcttaacgtccatcaccgctctccacggacccacaccatgcctacgtgggtgcggagagtattccttgacatagtcccacgcttattgctgatgaagagaccatccgtggtcaaggacaactgccgtagactgattgagtccatgcacaaaatggcttccgcacccagattttggcccgaaccagagggcgagccgccagcaactagcgggacgcagagcctgcatccaccctccccttcattctgtgttccactcgatgttccagcggagcctggtccctcttgcaagagcccaagtgaccagctgccaccccaacaaccccttgaggccgagaaagcctcacctcacccttctcccggaccatgtagacctccccatggcacccaggctccagggcttgctaaagccagatcattaagtgtgcagcacatgagcagccctggagaagccgtggaaggtggggtaaggtgcaggagcaggtccatacagtattgcgtccctagagatgacgctgcgcctgaggccgacggccaggctgcaggcgcactggctagccgaaatacacattccgccgaactgcccccaccagaccagccctcgccttgcaagtgcacatgcaaaaaggagccatcttccgtgagtccttcagcaacggtgaagacgcgttccaccaaagcccctcctcctcatttgccgctatcaccggctctcacacgcgcagtagaaggggtgcagtacatagcagatcatctcaaagccgaggacacagacttctccgtcaaggaggactggaagtacgtggctatggtcatcgatcgtatttttctgtggatgttcatcattgtgtgtctgctcggaaccgttgggctgttccttccaccatggcttgctggtatgatctag

SEQ ID NO: 218223 - DNA, 1884 bp, Artificial Sequence
  Description of Artificial Sequence: Synthetic coding sequence
atggagcttggaggacccggagcaccacgccttctgccccctcttctgctgctcttgggcacagggttactgagagcttcttcacatgtagagacccgggcacacgccgaggagaggctcttaaagaagctattctcgggttacaacaaatggtcccgccctgtggccaatatctctgatgttgttttagtacgttttggactaagtatcgcgcagctcattgatgtggacgaaaaaaatcagatgatgacaacgaatgtctgggtcaagcaagagtggcacgattataaattgcgatgggatcccgcagactatgaaaacgtgacctctatccggatacccagtgagctcatatggcgccctgacatcgttctgtataataacgcagacggggacttcgccgtgacacatttaacgaaggcgcacctatttcatgacggccgagtccagtggactcctcctgctatctacaagtcttcttgttctatcgacgtcaccttttttcccttcgatcagcagaactgtactatgaagtttggttcttggacctacgataaagccaagattgacctagtgaatatgcattcacgtgtggaccaactcgacttttgggagtcgggagaatgggtaattgtcgatgcagtgggaacttataataccagaaaatacgaatgttgcgccgagatctatcctgacattacttatgcttttgttatccgcagattgccacttttctacacaattaatctcattatcccgtgtctgcttatctcatgtctgactgttctcgtgttttacctcccatctgagtgtggcgagaagattacgctctgcatttctgtgcttctctctctcaccgtctttttgcttctgatcacagaaatcattccttccacctccctggttataccgttaattggcgagtatctcttgttcacaatgatatttgtaacgctgagtatagtcattaccgtgtttgtcctcaacgtccaccatcggtccccaagaacacacaccatgcccacatgggtgcggagagttttcctggatattgtcccgaggctgctgctgatgaagcgcccaagcgtagtgaaggataactgcagaagattgatagaatcaatgcacaagatggcatccgcccctcgcttctggcccgaaccagagggggagccgccagcaacttccggcactcaaagcctgcatcctccctcaccctccttctgtgttccactcgacgtgccagccgaacccggaccctcgtgcaagtccccctcggatcaattgcctccacagcagcctttagaggccgaaaaagccagcccccacccttcccctggcccttgccgtcctcctcatggtacacaagccccagggctcgcaaaagctcggagtcttagtgtgcagcatatgtcctctcccggagaggcagttgaaggtggggtccgctgtagaagtcgctccatccagtactgtgttccgagagatgatgcggctccagaagccgacgggcaggccgcaggggcacttgccagccgaaacacacactcagcagaactgccccctcccgatcagccaagcccatgcaaatgcacctgtaaaaaggagcctagcagcgtttctccgtccgcaaccgtaaaaactcgttctacgaaggcccctccaccacacctccccttgagccctgcacttactagagccgttgaaggggtgcaatacatcgctgatcatttgaaggccgaagataccgactttagcgtgaaagaagactggaaatatgtggccatggtcatcgatagaatttttttgtggatgtttattatcgtgtgtctcctggggactgtgggtctttttctcccaccttggctggccggaatgatttag

SEQ ID NO: 218224 - DNA, 1671 bp, Artificial Sequence
  Description of Artificial Sequence: Synthetic coding sequence
atgcgcatgagcccccctagtgccagccctccctccagcagcggaggccgaacgagtagttctactacaactgccggagagcccttttgggctggcgtgctgtttgctatcaggccccaccccggactctctggcagaattgtgtggaccgcaggctgcccaggagagggagccgatggagattttgccgtcacacacttgaccaaggctcatctgtttcacgacgggagggtccagtggaccccccctgccatctacaagagctcctgcagtatcgacgttactttttttccgttcgatcaacaaaactgcacaatgaagtttggatcttggacttatgataaggctaagatagacctggtcaacatgcactcaagggtggatcagctggatttttgggagtcgggggagtgggtgatcgtggatgcagtggggacctataatacacgcaaatacgaatgctgtgcagaaatatacccggatattacctatgccttcgtgatcaggcgactcccactcttttataccattaacttaataatcccgtgcttgttgatatcatgcctgacggtgctggtgttttacctgccatccgagtgcggcgagaaaattactctttgcatcagcgttctcttatctctgacagtgttcctgttactgatcaccgaaatcatccctagtacgagtctggtaatcccacttatcggtgagtatctgcttttcaccatgatttttgtgactctgagcatcgttatcacggtgttcgtgcttaacgtgcatcacaggtccccaaggacgcacaccatgcctacatgggtgaggcgggtttttctggatattgtaccaaggctcctgttgatgaaacgcccttcagttgtaaaagacaactgtcgtaggctgattgagtctatgcacaaaatggctagcgctccccgtttctggcctgagcctgaaggagaacccccagcaacctccggcacccagtctctgcacccccctagcccttctttctgcgtgccgctggatgtccccgctgaaccaggaccgtcttgcaagtcccctagcgatcagctgcccccacagcagcctctggaggcagagaaagcctcacctcacccctctccaggcccatgtaggcctccgcacggcacacaggcacctggtctggcgaaagccaggtccctaagtgtccagcacatgagctcacccggtgaagctgtggaaggcggagtgcgctgccggtcccgctccattcagtactgcgtgcccagggatgatgcagcccctgaagcagatggtcaggcagcaggcgctctggcgtcaaggaatacacattccgctgaattgcccccacccgaccagccctcaccgtgcaaatgcacctgtaagaaagaaccatcatcagtaagccccagcgccaccgtcaagactagaagcacaaaggcccctccaccacacttgccactcagccccgctctaactcgagccgtggaaggcgtccaatatatcgctgatcacttgaaagccgaggacaccgacttcagcgtgaaggaagactggaagtacgtcgccatggttattgatcgaattttcctgtggatgttcatcattgtgtgcctgctggggactgtgggactcttcctgcccccttggctggcgggaatgatctag

SEQ ID NO: 218225 - DNA, 1407 bp, Artificial Sequence
  Description of Artificial Sequence: Synthetic coding sequence
atggctgccagaggcagtggcccacgggcactgcgtttactgctcttggtgcagttagttgctggtaggtgcggacttgcaggagctgccggaggagctcaacggggtctgtccgagccttccagcatcgccaagcatgaagatagcctgcttaaagacttgtttcaggactatgaaagatgggttcgtccggtggaacatctaaatgataaaattaagatcaagtttggcctcgccatttcccagttggtggacgtcgacgagaagaatcagctgatgaccaccaacgtctggctgaagcaggaatggattgacgtaaagttgaggtggaacccggatgactacggcggaatcaaggtgatccgcgtcccctcggattccgtgtggacaccagatatagtcttgtttgataacgccgatgggcgttttgaaggaacatcgaccaagaccgtgatccgctacaatgggaccgttacttggacgcctcctgccaattacaaatccagctgcactatcgacgtcactttcttcccctttgacttgcagaattgttcaatgaagtttggtagctggacgtatgatgggtcacaggttgatatcatcttggaggaccaggatgtggataaaagggacttctttgataacggcgaatgggaaattgttagcgccaccgggagtaagggaaatagaaccgacagttgttgctggtatccatacgtgacctacagttttgttatcaagagactgccactcttctacactctgttcctgatcataccttgtattggcttgagctttctaactgtcttagttttttatctgcccagcaatgagggggagaagatctgtctgtgtacttcagtcctggtatccctgacagtcttcctcctcgtgatcgaggagattatcccttcttccagcaaggtgattcctctgatcggtgagtacctagtgttcaccatgattttcgttaccctctctattatggtgactgtgtttgctatcaacatacaccatcgatcctctagcacccacaacgctatggcgccactggtgcggaagatctttctccacactctcccaaaacttctttgtatgcgatcacacgtggatcgttacttcactcaaaaggaagagaccgaatccggctctggacctaagtcttctcgaaataccctcgaggccgcactggacagtatccgctacatcaccagacacattatgaaagagaacgatgtgcgcgaggttgttgaggattggaagtttatcgcacaagtcttggatcggatgtttctatggacgtttctctttgtgtcaatcgttggctccctgggactctttgttccggtgatttataagtgggcgaacatcctgatacctgttcacatcggcaatgctaataaatag

SEQ ID NO: 218226 - DNA, 1485 bp, Artificial Sequence
  Description of Artificial Sequence: Synthetic coding sequence
atgctgacatctaagggacagggatttctgcacggcggtctgtgtttgtggctgtgtgtgtttacgcccttcttcaagggctgcgtagggtgtgctacagaggaacgcttgttccataagctgttctcccattataaccagttcatcaggcccgtggaaaacgtctctgatccagtaacggttcactttgaggttgctattacccagctcgccaatgttgacgaagtcaatcagatcatggagaccaatctctggcttcgacacatttggaatgattacaagttgcgctgggacccaatggaatatgatggaatcgaaactctccgggttcccgctgacaaaatctggaaacctgacatcgtactatacaataatgcggtcggggactttcaggttgaagggaagactaaagccctgctgaagtacaacggtatgattacatggacccctcccgctatctttaaatccagctgtcccatggacatcactttctttccttttgatcaccagaattgtagtctgaaatttggttcctggacctacgacaaagccgagatagaccttttaataataggctccaaggtcgatatgaacgacttctgggagaacagtgagtgggaaatcatcgatgcgtccggctacaaacatgacattaaatacaattgttgcgaggagatttataccgacatcacttactctttctatatcagaaggctgcctatgttttacacaatcaatcttatcattccctgcttatttattagtttcctgacggtgctggtgttctacctgccaagcgattgtggggagaaagtcacgctgtgtattagtgtgctgcttagcctgactgtctttttgctagtcattacagaaacaatcccgagcacgagccttgtcgtcccactggtaggcgagtacctactgtttactatgatattcgtgaccctgtcaattgtggtgaccgtgttcgtgttaaacatccactatcgaaccccaaccacgcacacaatgcctcggtgggtgaagaccgtcttcctgaagcttcttcctcaggtgttgcttatgcgctggccactggacaaaacacggggtactggcagtgatgcagtgcctcgtggattggccaggagacccgctaaagggaaactggcttctcatggggagccaagacatcttaaagagtgtttccactgccataaatctaatgaattggcaacctccaaacgccgactgagccaccagccactgcaatgggtggtggagaattccgagcatagcccggaggtggaagatgttataaactcagttcagttcatcgccgaaaatatgaaatcccataacgaaaccaaggaagttgaagacgattggaaatacgtcgcaatggtagttgacagagttttcctgtgggttttcatcatcgtgtgcgtgtttgggactgctgggctgtttctgcagcccctgctcgggaatactgggaaaagttag

SEQ ID NO: 218227 - DNA, 1440 bp, Artificial Sequence
  Description of Artificial Sequence: Synthetic coding sequence
atgcttacctcaaaaggccagggctttctgcacggcggattatgtctgtggctgtgcgtgttcacacccttctttaagggctgcgtgggatgtgcgacggaggagagattatttcataagctcttttcacactacaatcaatttatcaggccagtggagaatgttagcgatcccgtcaccgttcactttgaagtggccataactcagcttgccaatgtcatatggaacgactacaagctgcgctgggatcctatggagtacgatggcattgagactctgagggtgcccgctgataagatctggaaaccagatatcgtgttgtacaacaacgcagtcggagattttcaggtggaggggaagaccaaggcactgctgaaatataatgggatgatcacgtggacacctcccgcaatattcaaatcatcgtgccccatggacatcacgttctttccctttgatcatcagaactgctctctcaagtttggtagctggacctatgacaaggcagagattgacctcctcatcattggttccaaagtcgacatgaacgacttctgggagaactccgagtgggagattatcgacgcaagtggttacaagcacgacattaaatataactgctgtgaggaaatctatacggacattacatatagcttttacattaggcggttgcccatgttttatacgattaacctgattataccttgcctgttcatctcttttctgactgtgctggtgttctaccttccgtccgactgcggggagaaggtgacattgtgtatctcggttctgctctccctgactgtttttctcctggtgattaccgaaactatcccatccaccagcctcgtcgtaccccttgttggggagtatctcctgtttacaatgatctttgtcacactcagcatcgtggtgacagtgttcgtcctgaatattcactacagaactccaactactcacacaatgccaaggtgggtgaaaacagtttttcttaaactcttgccacaggtgcttctgatgcgatggccactggacaaaaccagggggacggggtcagacgctgttccgagaggcctggccagacgcccagccaagggaaaactggctagtcacggtgagccgagacacctgaaagaatgtttccattgtcataaaagcaatgagcttgctactagcaaacgacgactgtctcaccagcctttgcagtgggtcgtcgagaactcggaacatagtccagaggttgaagacgtgatcaatagcgttcaatttatcgcggaaaacatgaagtcacataatgagaccaaagaggtagaggacgattggaaatatgtagctatggtcgtggaccgtgtgtttttgtgggtgtttattatcgtgtgcgtgttcgggacagccggactgtttctgcagcctctgctcggaaatactggcaagtcctag

SEQ ID NO: 218228 - DNA, 1509 bp, Artificial Sequence
  Description of Artificial Sequence: Synthetic coding sequence
atgaggtgtagcccaggtggagtctggttggcccttgcggctagcctgctgcacgtgtccctgcagggagagtttcagagaaaactttacaaggagttagtgaaaaattacaatcccctggagagacctgttgcaaacgactctcagcctttgacagtgtacttctccttgtcactgttacagattatggacgtcgacgagaagaatcaggtgttaacaactaatatttggctccagatgagctggactgaccattatcttcagtggaatgtctccgagtaccccggtgtgaaaacagtgcgtttcccagatggccaaatatggaaacctgacattctcctgtacaacagcgcagatgagaggttcgatgctacatttcacactaacgtattggtcaattcttcaggccactgtcagtacctccccccaggtatcttcaagtcaagctgttacatcgatgtgcgctggttcccattcgacgtgcagcattgtaaactgaagttcggctcctggtcttatggtggctggagcttggacctgcagatgcaagaggcagacatcagtggctatattccaaacggtgagtgggacttagtgggtatcccaggaaaaaggagtgaacgtttctatgaatgctgcaaggaaccctaccccgatgtgacatttaccgtgacaatgcggcgtcgcaccttatattatggcctcaacctattgatcccatgcgtgctcattagtgctctcgctctcctggtcttcttgctgcccgctgatagtggtgagaagatatctctgggcataaccgtgttgctttcgctgaccgttttcatgctccttgttgcagaaattatgcccgcaacatcggacagcgttccactcattgcgcagtacttcgcttcgacaatgattatcgtaggcctgagcgtagtggtcactgtgatcgttttgcagtaccatcaccacgaccccgacggaggcaagatgcccaaatggacgcgagttattcttctcaactggtgcgcctggttcctgaggatgaaacgccctggcgaagataaggtacgcccagcatgccagcataagcaacgtagatgtagtctggcctctgttgagatgtcagccgtcgcgcctccgccagccagtaatgggaacctgctttacattggctttcggggtcttgacggtgtgcattgtgtcccaacccccgactctggtgtcgtttgtgggaggatggcctgcagtcccacccacgatgaacatctgctccacggcggtcaaccaccagagggagaccctgatctcgcaaagatcttggaggaagtgcgatacattgcaaacagatttaggtgccaggacgaatcagaggcagtttgcagcgaatggaaatttgcggcttgcgtcgtggatcgcctctgtctcatggctttctcagtgtttaccatcatctgcacaatagggattctaatgtcggctcccaacttcgtagaggcagtgagtaaggactttgcgtag

SEQ ID NO: 218229 - DNA, 210 bp, Artificial Sequence
  Description of Artificial Sequence: Synthetic coding sequence
atgcagaagtactgtatttaccagcacttccagttccagttactaatacaacacctgtggatagcagcaaactgcgatatctgggctaaagtagctcgggtgatcggactactggcttcacacaaaactgaccttcaagaaaacacccccgttgtggaggctttccccaactccccacgaaccccaacactacctggggtgctgacatag

SEQ ID NO: 218230 - DNA, 1239 bp, Artificial Sequence
  Description of Artificial Sequence: Synthetic coding sequence
atgcaaaaatactgtatctatcaacacttccagtttcagctcttaatccagcatctgtggatcgctgccaattgcgatatcgcagacgaacgctttgatgctacatttcacaccaacgtgctggtcaactcttcagggcactgccagtacctcccacctggtattttcaaaagtagttgctatatcgacgtcaggtggtttccttttgatgttcagcactgtaaattgaagttcggatcttggtcttacggtgggtggtctctcgatctccagatgcaggaggcagacatctcgggttatattcccaatggagagtgggatctcgtggggatccctgggaagcggagtgagaggttctacgaatgctgcaaggagccttatcccgatgtgaccttcactgttactatgcggagacggaccctttattatggactaaacctgctgattccatgcgtgctcatatcggcactggctctcctggtctttcttctaccggcagactctggcgaaaaaatctccctcggaattacagtgctgctttctttaaccgtctttatgctgctcgtcgctgaaattatgcctgccacgtcagactccgtgccgctcatagcgcagtacttcgcctccacgatgataatcgttggccttagcgtcgtagtcaccgtgattgttctgcaataccaccaccacgacccggatggtggcaagatgcctaaatggactagggtgatcttgctgaattggtgcgcgtggtttctcagaatgaaacgaccaggggaagacaaagtgcgaccagcctgtcagcataaacagagacgatgctcactagcctcagtggagatgtcagccgtcgctcccccaccagcaagcaacggaaatcttctgtatatcggatttcggggactagatggtgtgcattgcgtacccacaccagattcgggagtggtctgtggaagaatggcctgtagtcccacccacgacgagcatcttctccacggcggacagccgcctgagggcgacccagacctggcaaagatattggaagaagttagatacatcgccaaccggtttcgatgtcaggatgagtctgaggcagtgtgttctgagtggaaattcgctgcgtgcgtcgttgataggttgtgcctgatggcctttagtgtgtttaccatcatctgcactattgggatactaatgagtgcgcctaacttcgtggaggcagtgagtaaggatttcgcttag

SEQ ID NO: 218231 - DNA, 447 bp, Artificial Sequence
  Description of Artificial Sequence: Synthetic coding sequence
atgaggtgctccccagggggtgtgtggcttgcactagccgctagtctcttgcatgtgtcactacaaggggaatttcagaggaaattgtacaaagagcttgtcaaaaactataaccccctggaacgccctgtagcgaatgactcccagcctctaaccgtatacttctccctgtcactgctgcagatcatggacgtggacgaaaaaaaccaggtgctgaccaccaacatctggctgcagatgtcttggacagatcactacctgcagtggaatgtgagcgaatacccaggggttaaaaccgtgcgcttcccagatggccagatctggaaacctgatatactgctctacaacagctcatacgatcagcaacaagaggtgctcgcttatgggatgcattgttggtcgcctcagttcggcccaacatcttcttccatgtttcctgttgtatag

SEQ ID NO: 218232 - DNA, 600 bp, Artificial Sequence
  Description of Artificial Sequence: Synthetic coding sequence
atgactaattcccgcaaatgctggccaatgggctgcacggccggtgcccatagcctcgatccccatccacggctgtgtagtttgttatgcatcggagaattttgtgggagggacggatgttccgccgacgagagatttgatgctaccttccacacgaatgtcttggtcaatagtagcggccactgccagtacctgcctccaggcatcttcaagtccagttgttatatagatgtgagatggttcccattcgacgttcaacactgtaaattaaagtttgggtcatggtcatacggcggatggtccctggacctgcaaatgcaggaagccgatatttccggctacatccctaacggtgaatgggatcttgtgggaattccaggcaaacggtccgagcgtttctatgagtgctgcaaggaaccttacccagacgtgacattcaccgtgacaatgaggagaagaactctgtattacggattgaacttacttattccttgtgttctcattagtgccctggccctgttagttttccttcttcctgccgattccggggaaaaaataagccttggcatcaccgtactgctctccttgacagtgttctag

SEQ ID NO: 218233 - DNA, 1596 bp, Artificial Sequence
  Description of Artificial Sequence: Synthetic coding sequence
atgaggtgtagtcccggtggagtgtggcttgctctggccgctagcctgctacatggaaaggccacagctagcccccctagtactcctccctgggatcccggacacatcccaggggctagcgtccgtcccgctccaggacccgttagtttgcagggcgaatttcagagaaagctgtataaagaacttgtgaagaattataacccccttgaaaggcctgtggcaaacgattcgcagccattgacggtgtacttcagtctatcgctcctgcagatcatggacgtggatgaaaaaaatcaggttcttacaaccaacatatggctccagatgtcctggaccgaccattatctccagtggaacgtatcagagtatcccggtgtgaagaccgtacgcttcccagacgggcagatctggaaacccgacattctgctctacaactctgctgacgagaggttcgatgctacctttcacaccaacgttctggttaattcgtctggccactgccagtatctcccccctgggatttttaaaagctcttgctatattgacgttcgatggtttccctttgacgttcagcactgtaagctgaaattcggttcctggagctacgggggatggtcacttgacctgcagatgcaagaggcggacatcagtggttacattccaaacggagagtgggacctggttggaattccaggcaaacgaagcgaacgattctatgagtgctgcaaagaaccgtatcctgacgtcaccttcaccgtgacaatgcgacgaaggaccctgtactacgggctgaacctcctgattccctgcgttctgatttccgcacttgccttgttggtgttccttctccccgctgattctggtgagaaaatctccctcggcatcaccgttttgttaagccttaccgtgttcatgcttttagttgccgagattatgcctgccactagtgacagcgtgccattaattgcccagtatttcgcctcaaccatgataattgtgggcttaagcgtggtggtaaccgtcatagtgctgcagtatcatcatcacgatcctgatggcggtaagatgcccaagtggactcgcgtaatcctcttaaactggtgtgcctggttcctgcggatgaaaaggccgggtgaggataaggtgcggcctgcctgtcagcacaagcagagacgctgctcactggcttcagtggaaatgtcagcggtggccccacccccagcatcaaatggaaacctcctttatattggctttcggggacttgacggcgtccactgtgtgcctaccccagattctggcgtcgtgtgtgggagaatggcctgctcccccactcacgatgagcatctcctccacgggggacagccgcctgaaggtgacccggacctggcaaagatcctagaggaagtccgctacatcgccaatcgatttaggtgtcaggacgagtctgaggccgtgtgctcagagtggaagttcgcagcctgcgtggtggaccgtctttgtctaatggctttttccgtattcacgattatttgcacaatcggcattcttatgtcagcgcctaactttgtggaagctgtgtcaaaagatttcgcctag

SEQ ID NO: 218234 - DNA, 966 bp, Artificial Sequence
  Description of Artificial Sequence: Synthetic coding sequence
atgcaagaagcggacatttccggctacatcccaaacggtgagtgggaccttgtcggtattcccggtaagcggtcagaaaggttctatgaatgctgtaaggagccttatccagacgtgactttcactgtgactatgcgtcgcaggactctctactacggactgaatttgctaattccgtgcgtgctgatcagtgctctcgctcttcttgtgttcttgcttcccgcagactccggcgaaaaaatctctctgggcatcacagttctgctgtcactcaccgtttttatgctcctagttgccgaaataatgcctgcaactagtgatagcgtgcctctcatcgcccagtatttcgcgtcaaccatgattatcgttgggctcagcgttgtcgtcacggttatcgtgctgcagtatcaccaccacgaccctgacgggggtaagatgccaaagtggacgagggtgatattgttgaattggtgtgcgtggtttcttcggatgaaacggccaggggaggacaaagtacggccagcctgtcagcacaagcaaagaaggtgcagtctcgccagcgtcgagatgtccgctgttgcgccaccccctgctagtaacggaaaccttctgtacattggctttcgtggactagacggggttcattgcgtgccaacccctgattccggtgtagtgtgcggcagaatggcctgcagtccaacccatgatgagcacctacttcacgggggacagcccccagaaggagacccagacctcgcgaaaatcctagaggaggtcagatatatagccaacaggtttaggtgtcaggatgaatcagaagctgtatgcagtgagtggaaattcgcggcatgcgtggtggataggctatgtctcatggccttttccgtgttcactattatttgcaccatcggaatccttatgtccgcccctaactttgtcgaagcggtctcaaaggattttgcatag

SEQ ID NO: 218235 - DNA, 1440 bp, Artificial Sequence
  Description of Artificial Sequence: Synthetic coding sequence
atgaattggagccactcatgcatctctttctgttggatctatttcgccgcatctcgcctgagggccgctgagactgcagatgggaaatacgctcagaaactgtttaacgatctgttcgaagactattctaacgcactgaggcccgtagaggacacagacaaagtgttaaatgtgacactgcagatcactctgagccagattaaggacatggatgagcggaatcagattctgaccgcgtatttatggatccggcaaatctggcacgacgcctacctcacctgggacagagatcagtatgatggcctcgatagcattcgaattccgtccgacctggtgtggcggccagatatagtgttgtataacaaggcagacgatgaatcatcagagcccgtcaatacaaatgtggtgcttcgctatgatggccttatcacgtgggacgctcccgcaataaccaaaagttcttgtgttgtcgacgtgacgtactttccattcgacaatcagcagtgcaacttgacatttggatcctggacctataacgggaaccaggtcgacatctttaacgccctcgacagcggggaccttagcgattttatcgaggacgtggagtgggaggtgcacggaatgcctgccgtgaagaacgttatctcctatggatgctgttcggagccgtaccctgatgtgactttcactctgctgctgaagcgtagatcctcgttttatatagtcaatcttttaattccttgtgttcttatctctttcctcgcacccctgtctttctaccttccggcagcatcaggggagaaggtgagtctaggagtcacaatactgctggccatgaccgttttccagctgatggtcgcagagataatgcccgcttctgaaaacgtccccttgattggcaagtactatattgccaccatggcgctaatcaccgcgtccactgctctcaccatcatggtgatgaatatccatttttgcggcgcagaggccagaccagtcccccactgggctcgggttgtgattctaaaatacatgagtcgggtgctgttcgtctatgacgtgggagagtcatgcctgtctcctcaccactcgagggaacgggaccatctgacaaaggtgtactccaaactccctgagtctaacttgaaggccgcaagaaataaggacctgagccggaaaaaggacatgaacaaaaggttgaagaacgaccttggctgtcagggcaaaaacccacaagaagccgaatcgtactgtgctcagtataaggttctgactaggaatattgaatatattgctaaatgcctgaaggatcacaaagccaccaactctaagggtagcgagtggaagaaggttgccaaggtaatcgacagatttttcatgtggatcttctttatcatggtattcgtaatgactatcctgatcattgccagggctgactag

SEQ ID NO: 218236 - DNA, 1506 bp, Artificial Sequence
  Description of Artificial Sequence: Synthetic coding sequence
atgactccaggggcactactcatgcttctgggcgctctgggggcacctctcgcccctggggttagaggctctgaggccgagggacgcctgagggagaaactgttttcaggatatgactcttccgtgagaccagccagggaggtgggagacagggtgagggtgtctgtggggttaattctcgcccagcttatttccctgaatgaaaaggatgaagagatgtctaccaaggtgtacttggacttagagtggaccgattaccggctctcctgggaccctgcggaacacgatggaattgacagcttaagaatcactgcagaatcggtgtggctgccagatgttgtacttctgaacaacaatgatggcaactttgatgttgctctcgacatctctgtggtggtgtcaagcgacggcagcgttaggtggcagcccccagggatctaccggtcgtcctgtagtatacaggtcacatactttccttttgactggcagaactgtaccatggtgttctcctcttacagctatgactctagcgaagtgtctctgcagaccggcctgggcccagatggacaggggcaccaggaaattcacatccacgaaggtacattcattgagaacggacagtgggagattattcacaaaccgtcccgactgattcagcctccaggcgatccacgaggaggacgcgagggacagagacaagaggtcatcttctacctgattattcgccgtaaaccactgttctatctggttaatgtgatagcaccatgtatactgatcacactgttagcaatattcgtgttctatctaccccctgatgcaggggagaagatgggtctgagcattttcgcactcctcacactgaccgtattcctcctactcctagcggataaggtccccgaaacgtcactgagtgtgcctataatcatcaagtatctcatgtttactatggtactggtcaccttctctgtgattttatccgtggtcgttctgaacctgcaccacaggtcaccacacacccaccagatgccattgtgggtgcggcagatctttatacataaacttcctctttacttacgcttgaagcggcctaaacccgagagagacctgatgcccgaacctccccactgtagttctcccggttccggttggggcagaggcactgacgaatactttataagaaaacctcccagtgatttcttatttcccaagcccaaccgattccagccagagttatccgcccctgatctccggagattcatcgacggcccaaacagagctgttgcccttctccccgagctcagagaagtggtcagtagcatctcgtacatcgccagacagctgcaggaacaagaggaccatgacgcgctcaaagaggactggcagtttgtggctatggtcgtcgataggctgtttctatggacctttattatctttacatcggtaggcaccctggtgatctttctggacgctacgtaccacttgccgccacccgacccctttccgtag

SEQ ID NO: 218237 - DNA, 1290 bp, Artificial Sequence
  Description of Artificial Sequence: Synthetic coding sequence
atgtctacaaaggtctacttggacctggaatggacagactacaggctgagttgggacccagctgagcatgacgggatcgattctctgcgtattaccgccgaatcagtctggctgccagatgtggtgcttctgaataacaatgacggcaatttcgacgtggcgttggacatctctgtagtggtgagctccgacggcagtgtgcgttggcagccacccggtatttataggagcagttgttccatccaggttacatatttcccgtttgattggcaaaactgtaccatggtattctctagctacagctacgactccagtgaggtgagtttacagacaggcctcggccctgacggacaggggcaccaggagatccatatccacgagggaactttcatcgaaaatggccagtgggagatcatccataagccgagcaggctcattcagccccctggcgacccgagaggcggtcgagaaggccagcgccaagaggtgatcttctacttgatcatccgccgaaaacctctgttttatctggtcaatgttatcgctccctgtatacttatcaccctactagcaatcttcgtcttctaccttccccctgatgcaggagagaaaatgggattgtccatctttgccttactgaccctgactgtatttctcttgctgcttgcagacaaagtcccggaaacttcactgtctgtgcccatcatcatcaaatatctgatgttcactatggttctagtgactttttcggttattttgagcgtcgttgtgctgaatctacaccaccgatccccccatacccaccagatgccactgtgggtcagacagatcttcatacacaagctgcctctgtacctccgactcaagagaccaaaaccagaaagagacctaatgccagagcctccacattgttcttccccaggatccggttggggacggggtacagacgaatacttcatccggaagcctccttctgatttcctgttccccaaacccaatagattccaaccagagctgtcagctccggatctgcggaggtttatcgatggtcccaatcgagccgttgctcttttaccagagctaagggaagtggtctcctccatttcttacattgccagacaattgcaggagcaggaggaccacgatgctcttaaggaagattggcaattcgtcgcaatggtggtggatcgcctatttttgtggactttcataattttcactagcgtggggacactcgtcatcttcttggacgccacatatcatttaccaccccctgacccattcccttag

SEQ ID NO: 218238 - DNA, 1509 bp, Artificial Sequence
  Description of Artificial Sequence: Synthetic coding sequence
atggccagaagatgtggacctgtagctctgctgctgggcttcggactcttgcgcctgtgcagtggagtgtgggggacagataccgaagagaggctggtggagcacctgctggatcccagtaggtataacaagctgattcggcctgccaccaacggatctgagctggtcacggtacagctcatggtgtccctggcacagttgatctcagtccacgagcgggagcaaatcatgaccactaacgtctggctcacccaagaatgggaagactacagactaacttggaaacctgaggagttcgataacatgaagaaggtcagactgccatcgaaacatatttggctgcccgatgtcgtgctgtataacaatgctgatggtatgtacgaagtgagcttttactccaatgcagttgtgtcgtatgacgggtctatcttttggttgcccccagccatctacaaaagcgcatgtaaaatcgaagtcaagcattttcccttcgaccaacaaaactgcacaatgaaattcaggtcctggacctatgaccggacagaaatcgacctagttctgaagtcagaggttgctagtttggacgatttcacaccctcaggagagtgggacatcgtggcactgcccggacgacggaacgaaaatcctgatgattctacttacgtcgatattacgtacgacttcatcatccgtcgcaaaccactcttctacaccattaacttgatcatcccttgtgtcctgatcacgtcactggctatactggtattttatctcccctcagactgcggtgaaaagatgacgctgtgcatctctgtcctactggctttgaccgtctttctgctgttgatcagtaaaatcgtgccacccactagcctagacgttcctttggttggtaagtatttgatgtttactatggtccttgtgactttttcaattgtgacctcggtgtgcgttttgaacgttcaccatcgaagccctaccactcacaccatggccccatgggtgaaagtggtatttctggaaaaactacctgcactgttgttcatgcaacagccacgtcaccattgcgcaagacagcggctgcggctgagacgacgccaacgagaacgcgagggggcaggagcattatttttcagggaagccccaggagcagattcctgtacctgtttcgtgaacagagcctctgtgcagggactggcaggcgcatttggagccgagcctgcaccagtggccggaccaggccgttccggtgaaccatgcgggtgtgggttgagagaggccgttgatggggttaggttcatagctgatcacatgcgatccgaagacgatgaccagtcggtgtcagaagattggaagtacgtcgccatggtaattgatcggctctttctttggatttttgtctttgtgtgtgtattcgggacgataggtatgttcctgcaaccattgtttcagaattacaccaccactacatttctgcattcagatcacagcgccccatcaagcaagtag

SEQ ID NO: 218239 - DNA, 1377 bp, Artificial Sequence
  Description of Artificial Sequence: Synthetic coding sequence
atgctcccagacttcatgctggtgcttatagtactgggcatcccgagcagcgccaccactgggtttaattcaattgctgagaatgaggatgcacttctgcgccatctattccaggggtaccagaaatgggtcaggccagtattgcactccaacgacacaatcaaggtttactttggactgaagatctcacagctcgtagacgtggacgaaaagaatcagctcatgacaacaaacgtttggctcaaacaagagtggaccgatcataagctgcggtggaatcctgatgactacgggggaattcatagtattaaagtcccatccgaatccctttggcttccggacatcgttcttttcgaaaatgctgatggaagatttgaggggagccttatgaccaaggtgattgtgaaatccaatgggacagtcgtatggaccccacctgcgtcctacaagtcttcatgcacgatggatgtgacattcttccctttcgaccgacaaaattgttccatgaagttcgggagctggacctatgacggcactatggtcgacctcatcctgattaacgagaacgtggatcgcaaggattttttcgataatggcgaatgggaaattctaaatgctaaaggtatgaaggggaatcggagggacggggtctacagctacccctttataacatattcttttgtgcttcgcagactgccacttttctacacactattccttataatcccctgtctggggttatcttttctgacagtcctggtcttttacttgccttctgacgaaggagagaagctgtccctaagtacaagtgtgctggtcagccttacagtgtttctcctggtcattgaagagatcatccccagctcctccaaggtaatccctctgatcggagaatacctactgtttatcatgatctttgtgacactgagcattatcgtaacagttttcgtgattaatgtacaccatcggagctcctcaacctaccatcccatggcaccatgggtcaaacgactgttcttacagaaactgccaaagctgttgtgcatgaaggaccacgttgatcggtattcaagcccggagaaggaagagagtcaaccggttgttaaaggaaaggtgctcgaaaagaagaaacagaaacagttgtcggatggcgagaaagttctagtcgcttttctcgagaaggccgcagattccatacgctacatctctagacacgttaagaaagaacacttcatctcacaagtcgtgcaggattggaagttcgtggctcaggtacttgaccgaatttttttgtggctgttccttatcgtttccgtgaccggcagcgtgctgatctttacgcctgcgcttaaaatgtggcttcactcttaccactag

SEQ ID NO: 218240 - DNA, 1497 bp, Artificial Sequence
  Description of Artificial Sequence: Synthetic coding sequence
atgcgcagggccccatctttggttctgtttttcctggtggcactgtgtggaaggggcaattgccgggttgctaatgcagaggaaaaactgatggatgacctgctgaacaaaactcgctacaacaatctgatccgcccagccaccagctcttcccagctcatctctatcaagctgcagctctcacttgcacagctgattagcgtcaacgagagggagcagattatgaccaccaacgtgtggctgaaacaagagtggacagactaccgactgacatggaatagttctaggtacgaaggtgtaaacattctacgaatcccagcaaaacgaatttggttacccgacatcgtgctatacaataatgctgatggtacgtatgaggtctccgtgtacacgaatcttatcgtcagaagcaatggcagcgtactttggctgcccccagcgatctacaagagcgcttgtaaaattgaagtgaagtacttcccttttgatcagcaaaactgtactctgaagttccgaagttggacttacgaccataccgaaattgatatggtcctgatgactccgactgcctcaatggacgacttcactcctagtggggagtgggatatcgtcgcgcttccaggacgcaggaccgtcaatccccaggatcctagctatgtggacgtaacctatgactttattattaagagaaagcctctcttctatactatcaatttgatcatcccctgcgtgctaactacccttctggctatcttagtattctatctgccaagtgactgtggggagaagatgacgctgtgcatcagcgtgttgctggcgctcactttttttctgttactgatatctaagattgtccccccaacctctttagacgtccccctgatcggcaagtatttgatgtttaccatggtgctggtcacatttagtattgtaacgtccgtgtgtgtgctgaacgtgcaccatagatccccatctacccacaccatggcgccttgggtgaagcggtgctttcttcacaagctccccaccttcctgtttatgaagagaccgggtcctgactccagccccgctagagcctttcctcccagcaagtcttgtgttaccaagcccgaagccacagccacaagcacctcaccctcaaatttttacgggaacagtatgtactttgtgaaccctgcatccgcagccagtaagtcaccagctgggagtactcctgttgcaattccccgagacttttggctgcgctcctcaggcagatttaggcaggatgtccaggaggctctcgaaggagtcagcttcatcgctcaacacatgaaaaatgatgatgaagaccagtcagtcgtggaagactggaagtacgtggcaatggtcgtggatagactgtttctgtgggtgttcatgttcgtttgtgtactgggaaccgtcgggctctttctgcctcccctttttcagactcacgctgcctccgagggaccctatgctgcacagcgggattag

SEQ ID NO: 218241 - DNA, 696 bp, Artificial Sequence
  Description of Artificial Sequence: Synthetic coding sequence
atgagacgagctccaagtctggttctgttcttcttggtcgccctgtgtggccgaggaaactgcagagtcgctaatgcggaagagaagctgatggatgacctgctgaataaaacgcgctataataacctgatcaggcctgcaactagtagcagtcaactgatatcaatcaagcttcagctcagcctcgcccagctgatatcagtcaatgaaagagagcagatcatgacaactaacgtgtggctaaagcaggaatggacagactatcggttgacatggaactcctctcgctacgagggagtgaacatactgcgcattccagccaaacgcatttggcttcctgacatcgtcctctataataaatctttgcggacaggatctacctggctctggtggtggactggatgttcttgcgggtgtagctgtctttgcgcttcctgggccctgtggggatcctcttacaggccctctagtcggcctatgcagcttctgcgtggacccacactgccctccgtgacggagggacctttaggttgtggagtccggggatgtgaatggccaggcggacatttcgccgcttctttctgggtggtcgcagacgaagcgttatccaagtacgtctccattggacatcagccgcatcaaacaagtcacagtagagggacgggtaaagacggagggctcggctgccctctgtag

SEQ ID NO: 218242 - DNA, 1554 bp, Artificial Sequence
  Description of Artificial Sequence: Synthetic coding sequence
atggaaggccctgtgcttaccctgggattactggccgctctggcagtttgcggctcttgggggctgaatgaagaggaaagactgattagacacctcttccaggagaagggctacaacaaagagttgcggcctgtggctcacaaagaggagagcgtcgacgtggccctggctctcaccctaagcaatttgattagtttaaaagaagtagaagaaactctcacaacaaatgtatggatcgagcatggatggacagacaaccgcctgaagtggaacgcagaggagttcggcaatatttctgtcctcagactccccccagacatggtctggctgccagagattgttctcgaaaataataatgacggctcatttcagatctcctactcttgtaatgtcctcgtgtaccactatggtttcgtgtactggctaccacctgcgatttttcgctccagctgccctatctccgtgacgtattttcctttcgattggcagaactgttcactgaaatttagtagcttgaaatatacagcaaaagaaatcaccctgtccctgaagcaggacgccaaagaaaatcgtacataccctgtcgaatggatcatcattgaccctgaggggttcactgagaacggagagtgggaaatagtccaccgacccgcaagggtcaacgtggacccaagggcccctcttgactctccgtccagacaggacattacattctacctgataatcagacgtaagcctttgttttacataatcaacatcctggttccgtgcgtcttgattagttttatggtgaatttagtgttttacttacctgcggactccggagagaagacgagcgtggcgatcagcgtcttattggctcagagcgtgtttcttttgctgatctctaaacggcttcctgccaccagcatggcgataccactgattggcaaattcctcctgttcggcatggtcctagtcaccatggtggttgtaatttgcgttatcgttttaaacatccactttaggactccatctactcacgtactgtcggagggagtgaagaagttgttcctggagaccttgcctgaattgctgcacatgagccgcccagcagaggacgggccatctccaggagcactggtgcggagatcatccagtttggggtacattagcaaggcagaagagtacttcctccttaagagccgatcagacctaatgttcgaaaagcaatcagaacgccatgggttggccaggcgcctaactacagcacgacgacccccagcttccagtgaacaggcccagcaggagctgtttaacgaattgaaacctgctgttgacggggcaaatttcattgtcaaccacatgagggatcagaataactacaacgaagagaaggattcatggaaccgggtggctagaactgtggatagactctgtctcttcgtggtgactccggtgatggttgtgggcacggcttggatcttccttcaaggggtctataatcagccgccacctcaaccatttcctggggatccttacagttacaacgttcaagacaaaaggttcatttag

SEQ ID NO: 218243 - DNA, 708 bp, Artificial Sequence
  Description of Artificial Sequence: Synthetic coding sequence
atggagggtccggttttaacactgggcttactggcggcactggccgtttgcggcagttgggggctaaatgaagaagaaagactgatcaggcatctgtttcaggaaaagggttataataaagaattaaggcccgttgctcacaaagaggaatctgtggacgtcgcccttgcactcactctgtcaaatctgattagcttaaaagaagtggaagagacgttaacaaccaatgtctggatcgagcacggatggacggataaccgtttgaagtggaacgcagaagaatttggtaacattagcgtcttacgccttcctccagatatggtatggctgccggagatcgttttggagaataataatgacggaagttttcaaatctcctattcctgtaacgtgctcgtgtatcattacgggttcgtgtattggctgccacctgcaatttttaggtcatcatgccctatcagcgtgacatatttcccgttcgactggcagaactgcagcctgaaatttcgtgaaagaggtgtcggcgattcgcctcccgcagggcagggccagaggggccctcagagtcccagcggtcagccgcaaccccctggtcatcatctactgcctcaccaccctccacaggccccattgctgcaccaccaacaccctggtgcgcttagggcccacctgctacacggccaacccggacttctacctacggggtag

SEQ ID NO: 218244 - DNA, 972 bp, Artificial Sequence
  Description of Artificial Sequence: Synthetic coding sequence
atgctgaagaacttagagacttccgtgagctgtgcatcgcctcggacttggtgtgggtcgcagaggctctgctggaggacaacaatgactgctccctccaggagccccacccccgcaacttgcctgtcaaccactactgcttcttgtactggctgtcatctgccatcgagtgctcctcctgccccatctctttccccaatttccccatctaccggcagaaccgccccttcatctagcggaggtgagaaaacttccgtcgccatttccgttcttttggcccagtccgttttcctcctattaataagcaaacgcctcccggcaacatctatggccatccctttgattgggaaattcctgctctttggcatggtgctggtcacaatggtcgtggtgatctgtgtgatcgtgttgaacatccacttccgaaccccttccacacacgttctgtccgaaggtgtaaagaagctattcctggaaaccctacccgagctgctccatatgtcaagaccagctgaggatggcccttcccccggagctctggtgaggcggagcagctcactgggatatatatcaaaggccgaagagtattttctactcaagtcaaggtcagacttgatgttcgagaagcagtccgagcgccacgggctcgcaagacgactaactacagctcggcgtccccctgccagctcggaacaagcccagcaagagctgtttaacgaactgaaacctgccgtagacggagctaacttcatcgtaaaccacatgagggaccagaacaactataacgaagagaaggatagctggaatcgagtcgcaagaactgtagaccggctgtgcctgtttgtggtcacgcctgtgatggtagtcggaacagcctggatttttctgcaaggggtgtacaaccagcctcccccacagcctttcccaggggatccttatagttataatgtgcaggataaacgatttatatag

SEQ ID NO: 218245 - DNA, 708 bp, Artificial Sequence
  Description of Artificial Sequence: Synthetic coding sequence
atggaaggccctgtgttgacactagggttattagcggctctggctgtgtgcggctcttggggcctcaacgaggaggagcggcttatcaggcatctctttcaggagaagggctacaataaggaactgaggcccgttgctcacaaggaggaaagcgttgacgtcgcactggcgttaaccctgtcgaatctgatctcccttaaagaggtcgaggaaacactcacgacaaacgtctggatcgaacacggttggacggacaaccgcctgaagtggaacgctgaggagtttggaaacattagcgtcctccggctccctcccgatatggtgtggctccccgaaatagttctcgagaacaataatgacggcagctttcagatttcatacagctgcaatgtgctggtgtaccattacggatttgtctattggctgccccctgccatcttccgatcttcatgtcctataagcgtcacttattttccttttgattggcaaaactgttctctgaagtttcgggagaggggcgtgggtgacagtccacctgcaggccaaggccagcgtgggcctcagtcaccaagtgggcaacctcaacccccaggacaccatctgcttccccatcatcctcctcaggcacctctcctccaccaccagcaccccggtgccctgcgcgctcaccttctccacgggcaaccaggcttactccctacaggatag

SEQ ID NO: 218246 - DNA, 1509 bp, Artificial Sequence
  Description of Artificial Sequence: Synthetic coding sequence
atggaggggcctgtgctcacgctgggcctcctcgctgcactggctgtctgcggatcatggggcctcaacgaagaggagaggctgatacgtcatttgttccaggaaaagggctataataaggaactgcggcctgtggctcataaggaagagtcggtggacgttgccctggcccttacactgtcaaacctcatatctctcggatggactgataaccggctgaaatggaatgcggaagagtttggcaacatatcagttctgcgtctgccacccgatatggtgtggctaccggaaatcgtgttagagaataacaacgatgggtcctttcagatctcctacagttgcaacgttcttgtttaccattacggctttgtgtactggcttcctccggcaattttccgcagctcctgccccatttcggtcacttacttcccgtttgattggcagaattgctccctcaagttctcatctctgaaatacactgccaaggaaatcaccctaagtctcaagcaagatgccaaggagaataggacttaccctgtggagtggatcattattgaccccgaaggattcacagaaaacggggagtgggaaattgttcatcggcctgctcgtgtcaacgtggacccgagggcacctctcgactccccctcccggcaagacattaccttttatctcattattagacgtaagccactgttctatatcattaacattttagttccctgtgtgctcatttcttttatggtgaatctggtcttttatctgcccgctgactccggcgaaaagacctcagttgctatctctgtgttgcttgcacaatccgttttcttgctgctcatttccaagaggctccccgctacatccatggctatcccactgatagggaaattcctgctgttcggaatggtactggtgaccatggtggtggtaatatgtgttatcgttttaaatatccatttcaggaccccatcaactcatgtactctcagaaggcgtcaagaagctcttcctggagaccttgccagaactgctacacatgtcgcgtcctgctgaagacggaccgagccctggggcactcgtcaggaggagttcaagcttgggatatatctcaaaggctgaggagtactttctgctgaaatcacggagcgatcttatgtttgagaagcagtccgagcgccacggccttgccaggagacttaccactgctcgtcggccacccgcttccagcgaacaggctcagcaggaactattcaatgagcttaaacctgctgtggatggtgcaaattttattgttaaccacatgagggaccagaacaactataacgaagagaaagactcttggaatcgggtagcaagaacagtggataggctttgcttgttcgtagttacccccgtcatggtggtggggactgcttggatctttcttcagggagtgtacaaccaacctccccctcagccctttccaggcgacccatatagttacaatgtccaggacaagaggtttatctag

SEQ ID NO: 218247 - DNA, 1482 bp, Artificial Sequence
  Description of Artificial Sequence: Synthetic coding sequence
atggcaagagctcccttgggcgtgctcttacttctgggactcctgggtagaggggttggcaaaaacgaggagctgaggttatatcaccacttatttaataattatgaccctggcagtagacctgtgagggaacctgaagacaccgttaccatctcgctgaaagttacactgaccaatctgatttcgttgaatgaaaaggaagagactctgactactagcgtatggatcggtatcgactggcaggattaccgcttgaattattctaaagacgattttggtggaatcgagaccttaagggtcccctcagagttggtgtggctaccagaaatcgtcttagaaaataatatagacggacagttcggagtggcctacgacgcgaatgtgcttgtctatgaaggaggcagtgtgacctggctgcctccggcaatatacaggtctgtgtgtgccgtagaagtaacttatttccctttcgactggcaaaattgctcactgatcttcaggagccaaacatataatgcggaggaagtggagttcaccttcgctgtggataacgatggaaaaaccataaataagatagacatagacaccgaagcatacaccgagaacggggagtgggctattgacttctgcccaggcgtgatccgcaggcaccatggaggtgcaacggacggccctggagaaaccgatgtgatttattctcttattattaggcgaaagcccctgttttatgttatcaatatcatcgtcccctgtgtgctcatcagtggcttagtacttttggcctactttttgcctgcccaggccggaggccaaaagtgcacagtttccattaacgtgctgctggcccagacagtttttttgtttcttatcgcccagaagattccagaaacatcattatctgtacctttgttagggagatttctgatatttgtcatggtggtggccactctgatcgtaatgaattgcgttattgtgctaaatgtgtctcagagaactccgactactcatgccatgagcccaagattgcgccatgtgctcttggaactcctgccacggctgctcggcagccctccccctcctgaagcacctcgggctgcgagtcctccacgtcgtgcctcctcggtcggtttgttattgcgggctgaggaactgatcttaaagaaacccagatcggaacttgtgttcgaaggacagcggcaccgccaaggaacctggacggcagccttttgccagagcttgggcgcagccgcacctgaggtgcggtgctgcgtggatgccgttaacttcgtggctgaaagtacccgtgatcaagaggctacgggagaagaagtttccgattgggtccgcatggggaacgcgctggacaatatctgtttctgggcggcattggttctgttcagcgtcgggagttcacttatcttcctgggcgcatacttcaatcgcgttcctgatcttccatacgctccctgcatccagccatag

SEQ ID NO: 218248 - DNA, 1554 bp, Artificial Sequence
  Description of Artificial Sequence: Synthetic coding sequence
atgcacggcggacaagggcctttgttattgctcctgctcctcgcagtttgcctcggcgcacaaggacgcaaccaggaggaaaggttgctggccgacttgatgcagaattatgatcctaatctgagacctgctgagcgtgatagcgatgtagtgaacgtctctcttaaacttacactgacgaatctaatctccctgaacgaaagagaagaagcactgaccacgaatgtttggatcgagatgcagtggtgtgactatagactccgctgggatcccagggattatgagggactctgggtgctgagggtcccgtctaccatggtgtggagaccagacatcgtgttagaaaacaacgtggatggtgttttcgaggttgctctctactgcaatgtgcttgtctcccccgacggctgtatttattggctccccccagcaattttccggtctgcatgctcaatctctgtgacctacttccctttcgattggcaaaattgcagtctcatcttccagtcccagacatattctacaaatgaaatcgaccttcagttgtcccaagaggatggccagactatagaatggatctttatcgatcctgaagccttcactgagaacggcgagtgggcaatccagcacagacccgcaaaaatgcttctggacccagcagcaccggcacaggaagcgggtcaccagaaggtggtattttatttacttatccaacgcaagcctctgttctacgtcattaacatcatagcgccttgcgtactgatctctagcgtggctatccttatccacttcttgcccgcaaaggccggtgggcagaagtgcaccgttgccattaacgtattgcttgcccaaacagttttcctcttcctcgtcgcgaaaaaagtgcctgagacgagtcaggccgttcccctgatctccaaatacctcaccttcctgctcgtggtcactattctcatcgtggtgaacgccgtggtcgtcctgaacgtatcacttcgaagcccccacacacattcaatggcccgtggcgtaaggaaagtgttcctgcgcttattacctcagcttcttagaatgcatgttcgacccttggctccagccgctgtgcaggacacccaatcacgcttacagaatggatcatccggctggtctattactactggtgaggaagtggccctctgccttccgaggtccgaactgttgttccaacagtggcagcgccagggattggtggccgctgctctcgagaagctcgaaaaggggccagagctgggcctatcccagttttgtgggtcactgaagcaggcagcgcctgctatccaagcctgtgtcgaggcatgcaatctcattgcatgtgcgagacaccaacagagccattttgataacggcaacgaggagtggttccttgtcggaagggttctggaccgcgtttgttttctcgccatgttgtctctgtttatttgcgggacagcgggtattttcttgatggcccactacaatagggtgcctgctctcccatttcccggtgaccccagaccgtatctgccgagcccagattag

SEQ ID NO: 218249 - DNA, 1554 bp, Artificial Sequence
  Description of Artificial Sequence: Synthetic coding sequence
atgcacggcggtcaggggccattactattgctgctgctgctggcggtgtgtctgggagcccaagggagaaaccaggaagagcggcttttggccgacctgatgcaaaattatgaccctaacctccgtcctgcggaaagagattccgacgttgtaaacgtgagcctgaaactcacccttacaaaccttataagtctgaatgaacgcgaggaggctctcacaacgaacgtatggatagagatgcagtggtgcgactaccggctgcgctgggatcctcgggattatgaggggctgtgggtgttacgagtgccgagcaccatggtgtggagacctgacattgttctggagaacaatgtggatggggtattcgaggtcgccctgtattgcaacgtcttggtgagccccgacggatgcatttattggctgccgccagcaatttttcggtccgcctgttcaatctcagtcacatacttcccgtttgattggcagaactgctccctgatattccagagtcagacctacagcaccaatgaaatagacttacagttgtcacaggaggacggccagactattgagtggattttcatcgatcctgaagcctttaccgaaaatggcgagtgggccatccagcatagaccagctaagatgcttctggatcccgcagcccctgcccaggaggcaggccaccaaaaggtggtgttctatctgcttatccaacgaaagcccctcttctacgtgatcaatatcatcgcaccctgcgtgctgatatcctcggtggcaattctgatacactttctccccgctaaagccggaggacaaaagtgtacagttgctattaacgtgttactcgcacagacagtttttctcttccttgtggctaagaaagtgcctgaaaccagccaggctgtccctctgattagcaagtatctcaccttcctgcttgtcgtcaccattcttatcgtggtgaacgctgtggtagtgcttaacgtgagcttgagaagcccacatacacactcaatggctcgtggcgtgcgtaaggtctttttgagactccttcctcaactcctaagaatgcacgtgcgccctttagcccctgccgctgtgcaggacacgcagtctaggttacaaaatggctccagcggatggagtatcactaccggggaggaggttgctttatgccttccaagaagcgaactactcttccaacagtggcagcgtcaggggctggtggccgctgctctggaaaaactggagaagggcccagaactcggtttaagccagttctgcggcagcctcaagcaggctgcccctgcgatacaggcatgcgtggaagcctgtaacctcatcgcttgcgcacggcaccagcaaagccactttgacaacggtaacgaagagtggtttttggtgggccgtgtcctggatagggtgtgcttcctcgctatgctctccctgtttatctgcggtaccgcaggcatatttctgatggcccattacaatagagtgccagctcttccattcccgggtgacccacgcccttatctcccatcgcctgattag

SEQ ID NO: 218250 - DNA, 1080 bp, Artificial Sequence
  Description of Artificial Sequence: Synthetic coding sequence
atggtaaggcctatgcttcttttatctctgggacttttggctggattgctgcccgcactggccgcttgcccacaaaactgccactgccactctgatctgcagcacgtgatttgtgacaaggtcggactgcagaaaatccccaaagtcagtgaaaaaaccaagctgctcaatctccagaggaataatttcccggtgctggctgccaacagtttcagagctatgccgaatctcgtgagcctccatttacagcactgtcagatccgagaggtcgcagccggtgcgttcagaggtctgaagcaactgatctatctctacctgtctcacaacgatataagggtgctgcgcgctggagcctttgatgatctcacagagctgacctatctgtacctggaccataataaggtcacagaattgccgcgtgggcttctctccccactggtcaacctgtttatcttgcagcttaacaataacaagatccgcgaacttcgcgctggagcgttccagggagccaaggatcttcgctggctttacctgagtgagaacgctctcagttcattacagcccggagctctggacgacgtggagaacctggccaaattccacgttgaccggaatcagctgtcctcttatccaagtgctgcgttgagtaaattacgagtcgtggaggagcttaaactgtctcataatcccttgaagtctataccagataacgccttccagtcctttggcagatacctcgagactctgtggcttgacaacactaacctggagaagttctccgatggagcttttcttggggtgaccaccctcaaacatgttcatctggagaataaccggcttaaccaattaccaagcaatttcccctttgatagtctggaaacgctggcattgaccaacaatccctggaagtgtacttgccagctgcgcggactgcggcgatggctggaagccaaggcctctcgccctgacgctacctgcgcaagtcccgctaagttcaaaggtcaacacatcagagacaccgacgctttcagaagctgtaaatttcctacaaaaagatccaagaaggcaggacggcattag

SEQ ID NO: 218251 - DNA, 129 bp, Artificial Sequence
  Description of Artificial Sequence: Synthetic coding sequence
taggccagccggcctgacgccacctgtgcatctccagccaaatttaaaggccagcacattcgggacaccgacgcattccgctcctgcaagtttcctacaaaacgctccaagaaggcagggagacactag

SEQ ID NO: 218252 - DNA, 1080 bp, Artificial Sequence
  Description of Artificial Sequence: Synthetic coding sequence
atggtacggccaatgttgctactgtcactggggttactggccggattgctgcctgccctagctgcctgtccccaaaattgtcactgccactcagacttgcaacacgtgatatgtgacaaagttggcctgcaaaagataccaaaagttagtgagaaaaccaagctgttgaacctgcagcgcaataacttccccgtgcttgctgctaactcgtttcgcgcaatgcctaatttggtgagcctccacctgcagcactgtcaaatcagagaagtagccgctggcgcattccgcggactgaagcagctgatttatctctacttgagccacaacgacatcagggtcctcagagccggagcattcgatgatcttactgagctgacatacctctatctggaccataataaggtgacagaattacctaggggcttgttgtcacctttggtaaacttgtttatactccaactgaataataacaaaatccgtgagctccgcgctggggcattccaaggggctaaagacctcaggtggctgtacctgagtgaaaacgccctctctagtttacagccaggggcactggatgacgttgagaacctagcaaagtttcacgtggaccgtaatcagctctccagttatcccagcgcagccctcagcaagctccgcgttgtggaggaactgaagctctctcacaaccctctgaaaagtataccagacaacgcttttcagtcctttggcagatatcttgaaacgctatggctggataataccaacctggagaagttcagtgatggagcttttttaggggtcaccactctgaagcacgtgcacttggaaaataataggctgaatcaactcccatccaactttcccttcgactccctggaaacacttgccctaaccaataacccatggaagtgtacctgccaactgagaggcttgcgcagatggctggaagcaaaggcctccaggcccgatgcaacctgcgccagtcctgccaaattcaaaggccagcacatacgcgacacggatgcattccgctcatgtaagtttcccacaaaacggtcaaagaaggctgggaggcactag

SEQ ID NO: 218253 - DNA, 2328 bp, Artificial Sequence
  Description of Artificial Sequence: Synthetic coding sequence
atgcgagccagtctgctcctgtctgttttgagacccgcagggccagtcgcagtcggaatcagtctggggttcaccctgtctctcttatctgttacctgggtcgaagagccgtgcggccctggcccacctcagcctggagatagcgaactgccacccagagggaacacgaacgcagccagacgccctaattcagttcaacccggtgccgaacgggagaaacctggggctggggaaggcgctggagaaaactgggagcccagagtgctgccttaccatccagcacagccaggacaagccgctaagaaagccgtgagaacacgctatattagtacagagctaggtataaggcaacgtctgctggtagcggtcctgacctcgcaaaccacacttcccactctgggggtcgccgtcaatagaaccctcggccatcgcctggagagagtagttttcctgaccggagcccgaggcaggagggcaccccctgggatggcagtggtgactctgggcgaagagaggcccatcggccacctgcatctcgccttaaggcatctgctcgaacagcacggtgatgacttcgattggtttttcctggtgcctgacactacatacacggaggcacacgggctggccaggctcactgggcatctttcattagcgtctgcagctcacctgtacctggggcgaccccaggatttcataggaggcgaaccaactcccggacgatactgccacgggggatttggggtactcctgtcgaggatgctgctacagcagttgcgaccccacttggagggatgcagaaacgacatagtctctgccagacctgatgagtggctgggtcggtgtatactggacgccactggggttggctgtactggtgatcatgaaggggtgcattatagccatctggagctgtcccccggagagcctgtgcaggaaggcgatcctcactttagatctgccctgacggcacaccccgtgagggacccggtgcacatgtatcagctgcacaaggcattcgcacgcgcagagctggaaagaacgtatcaagagattcaggagctgcagtgggagattcagaacacaagccatctggccgtggacggggaccaagctgcggcatggccggtagggatccctgcgccatctcgccctgcctctcggtttgaggttctgaggtgggactacttcacagaacaacacgcatttagctgcgccgacggtagccccagatgccccctgaggggtgctgaccgcgctgacgtggctgatgtcctcggcactgcactggaggagcttaaccggagatatcaccccgctctgaggctgcagaaacagcagctggtcaacgggtatcgtagatttgaccccgcacggggaatggaatacactttggatttacagctcgaggcgctcacgccccagggcggtcgacgcccactaacccgccgtgtacagctcctacgaccattgagtcgtgtagagattctgcctgtaccatacgttaccgaggcatcgaggctcacagtcctgctaccactggcagcagcggagcgggaccttgcaccagggttcctggaagcatttgccaccgcagcgttggagcccggagatgcagctgcggctctcacactgctacttctgtatgagccacgccaagcccagcgagtggcccacgccgacgtgttcgccccagtcaaggcacacgtcgcagaactagagaggcgcttccccggagcgagagtgccttggctgagtgtgcaaacagctgcaccatcaccactgcgactcatggatctgctgagtaaaaaacacccgctcgacactttgttcctgttagctggccctgacacagtgttgacacccgatttcctgaatcgctgccgtatgcacgcaataagcggctggcaagctttctttcccatgcacttccaagcctttcacccggcagttgctcctccgcagggtccaggccctcccgaactgggcagggacacagggagattcgacagacaggctgccagcgaagcatgcttctataattcagactatgtcgcagcccgaggaaggcttgccgctgcgagcgaacaggaagaagagcttctggagagcctcgacgtctatgaactgtttctgcacttctcatctcttcatgtcctgcgagccgtcgagcctgcccttctgcagcgctatcgggcacagacctgttctgctaggctgtcagaagatttataccaccgctgtttacagtcagttctggaggggctaggatctaggactcaacttgccatgcttctcttcgaacaggagcaaggcaactcaacctag

SEQ ID NO: 218254 - DNA, 1842 bp, Artificial Sequence
  Description of Artificial Sequence: Synthetic coding sequence
atggctgtggtgacactgggagaggaaaggcctatcggccatttgcacttagctttacggcatctgctggaacagcacggtgacgacttcgactggttttttctcgtgccggataccacctatactgaggctcatggtctggccaggctcacaggtcacttatcccttgcctctgcggctcacctatacctaggcaggcctcaggacttcatcgggggagaacccaccccgggaagatactgtcacggtggatttggggtcttgctgagccgaatgctcctccaacagctacgcccacacctggagggctgccggaatgacattgtgtcagcaagacccgacgagtggttgggaagatgcatattggatgcgactggtgtcggctgcactggcgaccacgagggggtacattactctcacctggagctttctcctggcgagcctgtccaggagggagacccccactttcggtctgccctcacagctcacccagtgcgcgatcccgtccacatgtaccagctgcacaaagcctttgcacgggctgaactcgaaagaacttaccaggaaattcaagagcttcaatgggaaattcagaacacctcccatctggctgtggatggcgaccaggcagccgcttggccggtgggaattccagccccttctagaccagccagccggtttgaggtgctgcggtgggactatttcacagagcaacacgctttctcttgcgccgatggtagccctcggtgcccattgagaggagcagatagggctgatgtggccgatgtcctgggtaccgcactggaggagcttaataggcggtaccatcctgctctgaggcttcagaaacagcaacttgttaatgggtatcggcgatttgacccagccaggggaatggagtatactctggatctacagcttgaagcactgacaccacaagggggtcgaagaccactcacgaggcgtgtgcaattgcttcgtcctctctccagggttgaaatcctgcctgttccctatgtgaccgaggcctcacgtctgaccgtgttgcttccactcgctgctgctgagagggacctggccccaggatttctcgaagccttcgctaccgctgcgttggaaccaggagacgccgctgccgcactgacactactgttactttatgagcctagacaggctcagagggttgcccacgcggacgtctttgcacctgttaaggcacatgtagccgagctagaacgtcgcttcccgggtgcaagggtgccctggctctctgtgcagaccgccgctccctcgcccctgcgcttaatggacctcctcagtaagaaacacccactggatacattatttttgctggcgggtcccgatacagtgctgaccccagatttcctcaacaggtgcaggatgcacgcaattagcgggtggcaggcctttttccccatgcattttcaggccttccatccggctgttgcccctccgcaaggacccggacctccggaactcgggcgagacactggaaggtttgatcgtcaggcggcttctgaggcctgtttttataacagcgactatgtcgctgctcggggacgtctggccgcagcatccgagcaagaggaggaactgttagagtctctagacgtctacgaactctttctgcatttcagtagcttgcacgtcctcagggcagttgagccggctcttctgcaacgctaccgcgctcaaacatgttccgctaggctgtccgaggacttgtatcatcgctgtctgcagagcgttttagaagggctgggcagcagaacccaattagcaatgctgctgtttgagcaagaacaggggaactcaacctag

SEQ ID NO: 218255 - DNA, 2319 bp, Artificial Sequence
  Description of Artificial Sequence: Synthetic coding sequence
atgcgtctgtctagcctgctggccctgctgaggcctgccctccctctgatcctgggcctgagtttgggctgtagcctctccctcctgcgggtcagctggatccagggggaaggagaagatccctgcgtcgaagctgtgggcgaaaggggcggtccacagaatcccgatagtcgggctagactagaccagtccgacgaggactttaaaccacgaattgtgccttattacagagacccaaacaagccatataaaaaggtccttaggactcgatacatccagacagagctggggagcagagaacggttactcgtggccgtgctgacctcgcgagcaacactgtcgacgctggcagttgcggtaaacaggacagtggcccaccattttcccaggctcctatactttacaggccagcgcggagcccgtgcgcctgccggaatgcaagtggtctctcacggagatgagagacccgcatggctcatgtctgaaaccttgagacacttacacacgcactttggggcagactatgattggtttttcataatgcaggatgatacgtacgtgcaggctcccagactggccgcactcgctggtcacctgagcataaatcaagacctgtacctcggacgagccgaagaatttatcggcgcaggcgaacaggccaggtattgccacggtggttttggttacttactctcacgctcactgctcctcaggctgcgcccacacttggacggctgcagaggcgatatcctgtccgcaagacccgatgaatggcttgggcgttgtttaattgactctctcggagtcggatgcgtgtcacagcaccagggtcagcagtaccgatcattcgagctcgcaaaaaatagagaccccgagaaagaaggttcaagcgccttcctgagtgcatttgccgtgcaccccgtgagtgagggcaccctcatgtaccggctgcacaaacgcttcagtgccctggagctggaaagggcctactctgagattgaacagctgcaggctcagatacgaaacctcaccgtgctcacgcccgagggtgaagccggactgtcatggcctgttggtctgccagctccctttaccccccattctagattcgaggtcttgggatgggattactttaccgagcagcacaccttcagctgtgccgacggcgctcccaagtgtcccctccagggggctagtcgcgctgacgtcggagacgctctcgaaacagccctggagcaattgaaccggcgatatcagccgaggctgagattccaaaagcagagactgctcaatggctaccggagattcgaccctgctcggggtatggagtatacactcgacctactgctggagtgcgtaactcaaagaggccaccggcgagcgcttgccagaagagtttcactcctgaggcccctttccagggttgaaatcctgccgatgccttatgttacagaggccacacgggtgcagttggtgctgcccttactagtcgccgaggccgctgctgcccctgcttttctcgaggcctttgccgctaacgtgctcgagcctagggaacatgccctgctgacgctcttgctcgtctatggtccccgagagggtgggcgtggcgcacccgacccttttctcggcgtcaaggctgcagcagcggaattagagaggcggtaccccggtaccagacttgcttggctggcagtgcgggcagaagctccctctcaggtccgcctgatggacgtagttagcaaaaagcaccctgtcgacaccttatttttcctgaccacagtttggacaaggcccggacccgaagtgctgaaccggtgcagaatgaatgctatttccggatggcaggctttcttccccgtgcacttccaagagttcaatcccgcattatccccacaacgttctccccctggaccgcctggagcagggccagacccgcctagcccccctggggcagatccctcccggggagccccaatcgggggaaggtttgataggcaggccagcgctgaggggtgcttctataatgctgattatcttgcggcacgtgcgagacttgcgggtgaactggcaggacaggaagaggaagaggctcttgaagggctcgaagtgatggatgtgttcctgaggttttccgggttgcatctgttccgggcagtcgagccgggtctggtgcagaaattttcgctgcgcgactgcagccctagactctctgaggagctataccatcgttgcaggctgtccaacttagaggggctgggtgggagagcgcagctagcaatggcgctattcgaacaggaacaggccaattctacctag

SEQ ID NO: 218256 - DNA, 2004 bp, Artificial Sequence
  Description of Artificial Sequence: Synthetic coding sequence
atgcggctgtcgtccctgctggcactgctgaggccagctctccctctcatcttaggcctaagtcttggatgcagcctgtctttgctccgagtgagctggatccagggagagggagaggatccttgcgtcgaggctgttggagagagagggggacctcaaaatcccgacagtcgggctcggttagatcagtctgacgaggactttaagcccagaattgtcccttattatagagaccctaacaagccctacaagaaggtcctccgaaccaggtacatccagacggagctgggttcacgggagaggctgctcgtagctgttctgactagcagagccacattgagcaccctggccgtggcagtgaatagaacagtggcccatcacttcccaagacttctttactttacggggcaacggggagcacgggcacctgctggtatgcaggtggtctcccatggagatgagagaccagcatggctgatgtcggaaactctgagacacttacatactcatttcggcgcagattatgactggttctttattatgcaggacgacacatatgtgcaggcacccaggcttgcagccttggccggtcacttatcaatcaatcaggacctgtatctcggacgtgcggaggagttcattggcgctggagagcaggcccgatactgtcacggtggctttggctatcttctcagtcggtcacttctcctacgcctgcgaccccatctggacgggtgtcgaggtgatattttgagcgcacggccagatgagtggctgggtcgatgcctgattgactctcttggtgtcggttgtgtatcccagcaccaggggcagcagtacagatctttcgaactcgctaaaaaccgagatccagaaaaagaggggtcctctgccttcctgtctgcttttgccgtacaccctgtctcagagggcaccctgatgtacaggctgcataagcggttctctgcactggagttagagcgggcttattcagagatcgagcagttacaggctcagattaggaacttaaccgttctcacacctgagggagaagctggactgtcttggcccgtgggactacctgcaccattcacgccccactctcgttttgaggttctgggatgggattattttactgaacagcacactttctcctgcgccgacggagcacccaaatgtccactgcagggagccagtcgggctgacgtgggtgacgcactggagacagccctggaacaactgaatagacggtatcagcctcggctgcgatttcagaagcagcggctattgaacggctataggcgatttgacccagctaggggaatggagtacacactggacttgctgctggaatgcgtgacacagcggggacacagaagggccctggccaggcgggtgagccttctccgccctctgtcccgagttgaaattctccctatgccctacgtgacggaagccacaagggtgcagctggttctgccacttttggttgcagaggcagctgctgcaccggctttcctggaggcgtttgctgctaatgtcctagaacctcgagaacatgccctcctaactctgcttcttgtgtatggccctcgtgaggggggacggggagcccctgacccattcttaggagtaaaggccgctgcggctgagttggagcgcagataccccggaacacgcttggcctggctggctgttcgggctgaagcaccaagtcaggtacggctcatggacgtcgtctcaaagaaacatcccgttgataccctcttctttctcacgactgtctggacaagacctggacccgaggtgctgaaccggtgtagaatgaatgctatctctggatggcaggctttcttcccagtacatttccaggaattcaaccccgctctgagcccgcagcgtagtccaccaccgaacctaatcaccttccctctcagtgcttctgcacccggaagggctagacaagacggaggtcagatcgagaactgttgttgcatcttctag

SEQ ID NO: 218257 - DNA, 6968 bp, Artificial Sequence
  Description of Artificial Sequence: Synthetic coding sequence
atgcagtccggtccaagaccgcctctgcctgctcctggcttggccctggccctcaccctgaccatgctcgcaaggctggcctctgccgcatccttttttggagagaatcatttggaagtgcccgtggccaccgcccttaccgatatagatctgcagctgcaatttagcacttctcagcccgaggctctcttgctgcttgccgctggtccagccgaccacttgctgctgcagctgtattccggaaggcttcaggtgcgtttagtcttaggacaagaggaacttagattgcagaccccagctgagacactcttgtctgattcaatccctcacacggtggtactgactgtcgtggaagggtgggctacactatccgtcgacggcttcctgaatgccagtagtgccgtccctggcgctccactagaggttccttacggcctgtttgtgggcggaacaggaactttgggtttgccataccttcgagggactagccgaccgctacggggttgcctacatgctgccacactgaacggccgtagtcttttacgccctctcacgcccgatgtgcatgaggggtgtgccgaggagttcagcgccagtgacgacgtggccctggggttttctgggcctcacagcctggccgctttccccgcatggggtacacaggacgagggtaccttagagtttacgttaaccacccagagccggcaggcacctttggctttccaggccggtgggaggcgaggcgatttcatttatgtcgatatattcgagggccatttgagagcagtggtagagaaaggacagggaacagtattgttgcacaactcagtcccagtagccgacgggcagcctcacgaggtctcagtgcacatcaatgcccatcgactcgaaatttctgttgatcaataccccactcacacgtctaacaggggagtgctgtcctacctggagcctcgaggtagtctcctgctagggggtctggatgccgaggcttcgagacatctgcaggagcacaggctaggcctgacccccgaggccaccaatgcatcactcctggggtgtatggaggacctgagtgtaaatggccagaggagaggtctaagggaagcgctcctcacgcgtaatatggctgctggctgccgcctcgaagaggaggagtatgaggacgacgcatacggccactatgaggccttttccacgctggccccagaggcttggcctgcaatggaattacccgagccctgtgtacctgaacccggtctgccccctgttttcgcaaattttactcagttgctgactatctcacccctggtcgtcgctgaggggggtaccgcgtggctggaatggagacacgtccagcctactctggacttgatggaagccgagctccgcaagagtcaggtgctcttctcggtcactaggggggcacggcacggagaattggagctggatatccctggggctcaggccagaaaaatgttcaccctcctcgatgtagttaacagaaaagctagatttatccacgatggaagcgaagacacatccgatcaactcgtgctggaggtatctgtgacggccagagtccccatgccctcctgtctcaggcggggacaaacatatctgctgccgatccaggtaaaccctgtcaatgatccgccacacattattttcccgcacggatccctaatggtaatcctggagcatactcagaagcccctcgggccagaggtgttccaagcctacgatcccgatagcgcatgtgaaggattaaccttccaggttctgggaacgagcagcggactccctgtggagcggcgagaccaacccggagaaccagccaccgaattctcttgccgggaattggaggcaggtagtctcgtgtatgtccaccggggaggccctgcgcaggatctaactttcagagtctctgacggcctgcaagctagccctccagccactcttaaagtggtggccatccgcccagctatccagatccacagatctaccgggcttagactggcccagggatcagccatgcctatcctgccagctaacctgagcgtggaaaccaacgcagtcggtcaagatgtgtctgttcttttccgcgtgacgggtgcactgcagtttggggaactccagaagcagggcgcaggaggagtggagggggcagaatggtgggctacccaagccttccatcaaagagacgtcgagcagggccgagtgaggtacctctccactgacccccagcaccacgcttacgacacagtagagaacctggctctggaggtacaggtggggcaggagatcctcagcaatctttccttcccagtcaccatccaacgtgccacagtgtggatgttaagacttgaaccccttcacactcagaacacacagcaggaaacactaacaaccgcccatttggaagccactttagaggaagccggtccatctcctcctacattccattatgaagtggtgcaggcaccgaggaaggggaacctgcagcttcaaggcactagattaagtgacggccagggcttcacccaggatgatatccaagctggcagggtgacttatggagcaaccgcacgggcttcagaggccgtggaagacaccttccgcttccgcgtgaccgctccaccatacttttcccctctgtatactttcccaattcacatcggtggggatccagacgcccctgtgctcaccaacgtcctgctggttgtgcctgagggcggagagggggtcctgagcgcagaccacctcttcgtgaagtccctgaacagcgcctcttatctctatgaagtgatggaaagacccagacacggtaggctggcttggagagggacacaagataagaccactatggtcacaagtttcacgaacgaggacctcttgaggggtcggctggtctatcaacacgacgactctgaaaccactgaggatgatattccgttcgtcgctactagacagggtgagtcttctggcgatatggcttgggaagaagtgcggggtgtttttcgggtagctattcagcccgttaatgatcatgcgccagtgcaaacaatcagccgtatcttccatgttgcccgtggaggtaggcgactcctcactacggacgacgtggctttctctgatgccgactccggtttcgccgatgcccagctagtgctgaccagaaaagatctactctttggctccatagtcgccgtggatgagccgacgcggcctatttaccgcttcactcaggaggacttgagaaagaggcgtgtgctctttgtgcactccggtgctgatcggggatggatccagttacaggtcagtgacgggcagcaccaggctactgctcttctggaggtgcaagccagcgaaccatacttaagggtggctaacgggtcatccttagtcgttccacaagggggacagggcacaatcgacactgcagtcctgcatttggatacaaatttggacatcagaagcggagacgaagtccactatcatgtaaccgcaggacctcgatggggccagctagttagagccggacagcccgctacagccttttctcaacaggatcttttggacggagctgttctctattcccacaatgggtctctgtcaccccgagataccatggccttttccgtcgaggcaggtcccgtccacaccgacgccaccctacaggttaccatcgcgctggagggcccactcgccccactcaagctggtgaggcataagaagatatacgtgtttcagggcgaagcagccgagataaggcgcgatcagctggaggccgctcaagaagctgtacctccagccgatatcgtgttcagcgtgaaaagtcctcccagcgccggatacctggttatggtctcccgtggggctctggccgacgagcccccttcgcttgaccctgtgcagtcattttcgcaggaggccgtggatactggaagggtcctgtacctacactcacgcccagaagcctggtccgacgcctttagtttggacgttgcaagtggactgggggctcccctcgagggagtccttgtggagcttgaagtcctgccggcagcaattccgctcgaggcacagaatttcagcgtcccagaaggcggatcactcaccctggcgccacctctgctgcgtgtgagcggaccctacttcccaactctgttaggtctctcactccaagtgctcgaacctccccagcacggagctctgcagaaggaggacggccctcaggccaggactctttcggcattcagttggagaatggtggaggagcagctcattcgttacgtgcacgatgggtctgaaaccctgaccgactccttcgtgctaatggccaatgcttcggagatggaccggcaatctcatcccgtggcctttaccgtcacagtcctccctgtcaatgaccagcccccaatactgacaacaaacactggtctgcagatgtgggagggagctacagccccaatccctgccgaggccctgagaagcacagatggcgatagcgggtccgaggatttggtctacacaatcgaacagccctcaaacggtcgagtcgtgctccggggagcaccgggtacagaggtgcggtcttttacccaggcacagttggatggcggactggtgctcttttcacacaggggaaccctggatggtgggtttcgattccggcttagcgacggtgaacacaccagcccaggacactttttccgggtgactgcccagaaacaggtcctgctgtctctcaaggggagccagaccctgaccgtgtgccccggatccgtgcagcctttgtcctcccaaacgctaagggcctcttcatccgccggaacggacccccagctgttgctctatcgggttgtcagggggcctcaattaggacgcctgttccatgcacaacaggatagtaccggcgaggcactggtgaacttcacccaagccgaggtctatgcgggaaatatactgtatgaacacgaaatgcccccagaacccttttgggaagcccacgatacgctggagctccagctgagctccccccctgctcgtgacgtggccgctactttagccgtcgctgtctcttttgaggccgcttgtccccaaaggcccagccatctttggaagaacaaagggctgtgggtacctgaggggcagcgcgctcgtattacagtggcagcgttagacgcatccaaccttctggcttcggtgcccagcccacagcgttcggagcacgacgtactgttccaggtgacgcagttcccctcacgcggtcagctgcttgtgtccgaagaacccttgcacgcgggtcagccccatttcctgcaaagccagttggccgcaggtcagctggtctatgctcatgggggtggcggtacgcaacaggatggtttccatttcagggcccatctacagggtccagccggagcttccgtcgctggaccacagacttccgaagcattcgcaatcacagttcgagacgttaatgagaggccgccacagccccaggcgtcagttcccttgcgtctgactcgagggagccgggcaccaattagccgcgctcagctctctgtagtcgaccctgattcagcacctggagagatcgagtacgaggtgcagcgcgcaccccataatggctttctaagtctcgtcggtggcggactgggccctgtgacaagattcacacaggccgacgttgacagcggcaggctagctttcgtggctaatggctcctctgtcgccggtatcttccagctgtcaatgtctgatggcgcttccccgccactgccaatgagcctggccgtggatattttgcctagcgccattgaggtacagctccgggcaccgctggaagtgccgcaggctctcgggagatcatccctcagccagcagcaactacgggttgtttcagaccgggaggagcctgaggccgcataccgcctgatccaggggcctcagtacggccatcttttggtggggggtcgcccaacatccgcgttctcgcaatttcagatcgatcagggcgaggtggtgttcgccttcacgaatttttccagttcgcacgatcactttcgcgtactagctttggcccgaggagtgaacgcttcggccgtggtaaacgtcaccgtgagagcattgctccacgtctgggcgggtggcccttggccacaaggggctaccctgaggcttgaccccacagtactggacgccggagagctggccaaccgcacagggagtgtgccgagattccgactcctggaggggcctagacacgggcgagtggtgcgggttccccgagcacgcacggaacctgggggttcgcaactggtggaacagttcacgcagcaggatctcgaagacggtagactgggattggaggttggcaggcctgagggcagggcccctggccctgcaggtgacagcctaaccttagaattgtgggctcagggcgtgcccccagctgtggccagtttagactttgcgaccgagccctacaacgccgcacggccttacagtgtggcgctcctaagcgtgcctgaagctgcaagaactgaggctggcaaaccagaaagcagcactcctacaggggagccgggacctatggcctctagcccagagccagcagtggccaaaggcggattcctcagcttcctggaagccaatatgttcagcgtgataatcccaatgtgccttgtcttacttctgctcgccctgattctgccactgctgttctacctgcggaagcgcaacaagaccggcaaacacgacgtgcaagtgctcaccgcaaagcccagaaacggtctcgcaggagatacagaaacatttcgtaaggttgaacccggacaagcgatccccctcaccgcggtaccgggtcagggcccacccccaggcggtcagcccgatccagagttgttacaattctgtaggactcctaaccctgcattgaaaaacgggcaatattgggtata

SEQ ID NO: 218258 - DNA, 984 bp, Artificial Sequence
  Description of Artificial Sequence: Synthetic coding sequence
gagcaacatcgtgaggagccagaggctgcctataggcttattcagggtccacagtacgggcacctcctggtcggtgggagaccaacctccgctttttcgcagtttcaaatagaccagggagaggtcgtgttcgcatttactaatttcagctcttctcacgatcactttcgggtgttagccctggcgaggggagtcaacgccagtgcggtggtcaacgtcaccgtgagagcccttcttcacgtatgggccggaggtccttggccccagggcgcaacactcagactagaccccacagttctggatgccggagaactggctaacagaaccggtagtgtgccacggtttaggctgctcgagggaccgagacatggacgcgtggttcgggtccctcgggctcggaccgagccgggaggctctcagcttgtcgagcagttcacccagcaggacctggaggatggcaggctgggattagaggttggtagacccgagggtagggctccaggaccagcaggggactcgctgacactcgaactttgggcgcaaggcgtgccccctgccgtcgccagcctggattttgcgactgagccttataacgctgcaagaccatactcagtcgctctgctgtctgtaccagaagccgcaagaacggaggccggtaagcccgagagctctacaccaacaggggagccaggacccatggcatcaagcccagaaccggcagtcgcaaagggagggttcctgtcctttctggaggctaacatgttttcagttatcattcctatgtgtctcgttctcttactgttggccctgattctgcccctacttttctacctccgaaagaggaacaagacaggaaaacacgatgtccaggttctgactgccaaaccaaggaacggattggcaggggacaccgaaactttcaggaaagtggagccaggacaggccatacctctaaccgccgtaccgggtcaggggccaccctag

SEQ ID NO: 218259 - DNA, 2409 bp, Artificial Sequence
  Description of Artificial Sequence: Synthetic coding sequence
atggcggctcgcggacgcagggcctggttatccgtactccttggtctcgttttagggtttgtattagcttcccgcctcgtgttaccccgagcgagcgaactcaaaagagcgggtcccagacggcgagcttcacccgagggatgtcggtctggccaagcggcagcttcccaagctggtggtgctaggggagacgccaggggcgcacagctgtggccaccgggttcggatccggatggtggaccccgtgatcgcaattttctattcgtcggagtaatgactgcgcagaagtacttgcagactcgcgcagtggccgcttatcggacttggtctaagaccatacctggcaaagtgcaattcttctcgtccgaaggttccgacacaagcgtaccaatccctgtcgtgcctctgcgcggtgtggatgacagctatccgcctcagaaaaagtcctttatgatgctcaagtacatgcacgatcactacctggataaatacgagtggtttatgcgagccgatgatgacgtctatataaaaggggaccgtctagaaaactttctccggagcctgaacagtagcgagccattatttttgggccagactgggcttgggactacagaggagatgggcaagctggctctcgaaccgggtgagaacttctgcatggggggacccggagttattatgtcgagggaagtgctgagaagaatggttccacacataggaaagtgcttaagggaaatgtatactacacacgaagacgtggaggtgggaaggtgcgtgcgcagattcgctggcgtgcagtgcgtgtggtcctacgagatgcagcagctgttttatgaaaactacgaacagaacaaaaagggttatatccgcgacctccacaacagcaagatacaccaggccataactcttcatcctaataaaaatcccccttatcagtatagacttcacagctatatgctctctcggaagattagtgaactgcggcacaggaccattcagctgcatcgcgagatagtcttaatgagtaaatattcaaataccgaaatccataaggaagatctgcagctgggaattccacctagttttatgcggttccagcctagacagagggaagagatactggagtgggagttcctgacaggcaaatatttgtattccgctgttgacggtcagcctccacggagggggatggatagcgcccagagggaagcgctcgacgatattgtcatgcaggtcatggagatgatcaatgcgaatgctaagactcggggaaggattatagattttaaggagatccagtacgggtaccgacgtgtcaaccctatgtacggggctgagtacattctggacctactgctcttatacaagaagcataagggaaagaaaatgacagtccctgttcgcaggcacgcttacctgcagcagaccttctcgaaaattcagttcgtcgagcacgaagagctggacgcccaggagctcgcaaagcggatcaaccaggagtcgggttccctgtcattcttgtctaattctctgaagaagcttgtgcctttccagctccctggcagtaaaagcgaacataaagaacccaaagataaaaaaatcaacatccttatacccctgagtggccgtttcgatatgttcgtcaggttcatgggcaacttcgagaagacgtgtctgatcccaaaccagaatgtcaagctggttgtcctcctcttcaattccgattccaaccccgacaaagctaaacaggtcgagctcatgcgcgattatagaataaagtaccctaaggccgatatgcagatcttgccggtgtcaggggaattttcccgggcactggcactggaagttggctcctcacagtttaataacgaaagcctcttattcttctgcgatgtcgatctagtgttcaccaccgaatttctccagagatgtagagccaataccgtgttggggcagcagatttacttccctatcattttctcgcaatatgaccctaagatcgtctattcaggaaaagtccccagtgacaatcactttgcattcacccagaagaccggattctggcggaactatggatttggcatcacttgcatctataagggagacctggtgagggtggggggtttcgatgtatctattcagggctggggtcttgaggatgtggatctgtttaataaggtggttcaagctggcctgaaaacatttcggtctcaagaggtcggagtcgtccacgtccatcaccccgttttctgcgacccgaacctcgaccccaagcagtacaagatgtgtctgggctccaaggcttccacatatgggtcaacccagcaacttgcagagatgtggctggagaagaacgacccctcctattcaaaatcatctaataataacggatccgtcagaaccgcttag

SEQ ID NO: 218260 - DNA, 2649 bp, Artificial Sequence
  Description of Artificial Sequence: Synthetic coding sequence
atggccgtacgctcccgcaggccctggatgtcagtcgccctgggcttggtgttaggatttaccgctgcatcctggctaattgctcctcgcgttgcagaactctctgagaggaagcgcagaggttcctcactttgctcctactatggcagatcggcagctgggcctcgggctggcgctcagcaaccgctgccccaaccacagagccgcccacgtcaggagcagagtcccccacccgctaggcaggatttgcagggacctccacttccagaagctgccccagggatcacatccttcaggtcctctccatggcaacaacctccccctctccagcaacgcagacgaggcagggaaccagagggcgcaactggtttgcctggcgcacctgccgctgagggcgagccagaagaagaagatggaggcgcagcaggtcagcggagggacgggaggccgggatcaagccataacggttccggggacggcggtgcagcggctccaagtgctcgtcccagggactttctgtatgtgggagtcatgaccgctcaaaagtacctgggcagtcgggcattggctgcccagcgaacttgggccagattcatccctgggagggtcgaattcttcagcagtcagcagcccccaaatgcaggacagccaccgcctcccttgccagtgattgctctccctggagtggacgacagctaccctccccaaaagaagagcttcatgatgattaagtatatgcacgatcactatttagataagtatgagtggttcatgcgcgctgatgacgacgtgtatatcaaaggtgataaactagaggaattcttacgatccctgaactctagcaaacccctgtacttaggccagaccggcctgggaaatattgaggagttgggcaaactaggcctggaaccaggagagaatttttgtatgggtgggccagggatgatcttcagccgagaggtgctccgccgaatggtaccccatattggcgagtgcttgagagaaatgtatacgactcatgaagacgtcgaagtggggagatgcgtacgccgtttcggcggtacccagtgcgtctggagttatgagatgcagcagctcttccacgagaattatgaacacaataggaaaggctatattcaagatctgcacaactccaaaattcacgcggctatcacattgcaccctaacaaacgtcctgcttaccagtaccggctccataactatatgctctcccgaaagattagtgagctacgttacaggaccatccagctacatagagagtcggccttgatgtccaaactgagcaataccgaggtgtctaaggaggatcagcagctaggagttatccctagttttaatcactttcagccccgagagagaaacgaggttatcgaatgggagttcctgacaggcaaactcttgtactctgccgcagaaaaccaacctcctagacagtctctgagcagtatcctgagaaccgcattagatgacaccgttttacaagtgatggagatgattaacgaaaatgccaagtcacgtgggagactcattgactttaaagaaattcagtatggttacagacgcgtaaatccaatgcacggcgttgaatatatattagacttgttgctactttacaagaggcataaaggcaggaagcttaccgtccccgtacggcgacatgcctacctccagcagctcttttccaagcccttcttcagggaaaccgaggagttggatgtcaactctctggtggagtcaatcaactcggagacccagtcctttagttttattagcaactccctaaagattctcagtagctttcaaggtgcaaaggagatgggtggacacaacgagaagaaggtgcatatactggttcccttaattggtcggtacgatatctttctgaggttcatggaaaacttcgagaatatgtgtcttattccaaagcagaatgtgaaactagttattatcttattttcccgcgacagcggccaggatagttcaaaacacatcgagcttattaaaggctatcagaataagtatcctaaggctgagatgacgctcattcctatgaaaggagagttctcaagggggctgggcctggaaatggcatctgctcagttcgacaacgacacactcctgcttttctgtgacgtcgacctgattttccgggaagacttcctgcagcggtgcagggataatacaatccagggacagcaggtatactaccccatcatcttcagtcagtacgaccccaaggtgactaacggtggcaaccccccaactgacgactatttcattttcagcaagaaaactgggttttggagagattatgggtatggaatcacgtgtatctacaagtctgacctcctgggtgcaggagggttcgacacctcaattcaagggtggggactggaagatgttgatctgtacaacaaagtcatcctctccggtctccgacctttccggtcccaggaagtgggagtcgtgcatatctttcaccctgtgcactgcgaccctaacctggaccctaagcagtataaaatgtgcctaggcagcaaagcaagcacttttgccagtaccatgcagttagccgaattgtggctcgaaaagcatctgggcgtgcgttataacagaaccctttcatag

SEQ ID NO: 218261 - DNA, 2868 bp, Artificial Sequence
  Description of Artificial Sequence: Synthetic coding sequence
atgccaagtctgcccgcacctccagcccctctgctgctcctgggattattgctcctgggaagccgcccagctagaggcgcaggccctgaaccgcctgttcttcctatcaggtcagagaaagagcctttgccagttagaggggcagctgggtgcacctttggagggaaggtgtacgctctggacgaaacctggcaccctgatctcggcgagccttttggagtcatgaggtgtgtgctctgtgcctgcgaagccccacagtggggaaggagaacacgtggtcctgggagggtctcctgtaagaacatcaaacctgaatgtcccacccctgcgtgcgggcagccacgtcaactgcccggacactgttgccagacttgtccgcaggagcggtcaagtagtgaacgccagccatctgggttgtccttcgagtacccacgcgatcccgaacatagaagctattccgacaggggagaaccaggcgcagaggaacgcgctaggggcgacggccatactgactttgtcgccctccttaccggccctcggtcccaagctgtggcccgtgcaagagtgagtttactccgctcgagtctgcgcttctctattagttacaggcgcttggatagacccactaggatccgtttctccgatagtaatggctctgttctcttcgagcaccccgcagctcctacgcaggacgggctggtgtgcggcgtgtggagagccgtgcccaggttaagcttgcgattgttgcgtgctgaacagctccatgttgcattggtgaccctcacccacccatccggggaggtgtggggcccactgatcaggcaccgcgctctggcagccgaaacgttctcagccatcctgaccctggaaggaccaccccagcagggcgtgggtgggataacattgctaaccttgagcgataccgaagatagcctccacttccttctgctctttcgtggcctgctggagcccaggtccggaggacttacacaggttccattaagactccagatcttgcaccaggggcaacttctccgggagctccaagcaaacgtgtccgctcaggagcccggtttcgccgaggtgttaccgaacctgacagtccaggagatggattggttagtactgggagaattacagatggccctagaatgggctggacgcccaggtctcagaattagtggacacattgccgctaggaaatcctgcgatgtgctgcaatcagtcctgtgcggggctgacgccctgattcccgtgcagaccggcgctgctggttcagctagcctgacgctgctgggcaatgggtccctgatctaccaggtgcaagtggtcggtacttctagtgaggttgttgccatgaccctcgaaactaagccacagcggagagaccaacgtactgtgctctgtcatatggctggactccaacctgggggacacacagccgttgggatctgcccaggtctgggagctaggggcgctcatatgttgttgcaaaatgagctgtttcttaacgtcggcaccaaggattttcctgacggcgagctccgtggccatgtcgctgctctcccctactgcggccactctgcccgacacgacactcttcccgtgcccttagccggagctcttgttcttcctcctgtgaagtcccaggctgcgggacacgcatggttatcgctggacactcattgccatctgcactacgaggttcttctggctggattaggtggaagcgagcaaggcacggtaactgcgcacctgctcggtcctccgggaacgcccggaccacggagactgctgaaaggtttctatggtagcgaagcacagggagtggttaaagatcttgaacctgaactccttcgtcatttggccaaaggcatggcctcgcttatgattacgaccaaaggcagtccccgaggcgagcttcgcggacaggtgcatattgcaaatcagtgcgaagtcgggggactgcggctggaggccgctggcgctgagggtgttcgggcacttggggctcccgacacggcctccgctgctccccctgttgtccccggtctacctgctctcgcacctgccaagcctggtggcccaggtagacctagggacccaaatacctgcttctttgagggacagcaacggcctcatggtgccagatgggccccaaactacgatcccttgtgtagcctgtgtacctgccaacgacgcacagtcatatgcgatccagttgtgtgtccccctcccagctgcccccacccagtccaggcccctgaccagtgctgccctgtgtgtccggagaaacaggacgttagggatctgccaggcctcccacggagcagagatccgggagagggctgttactttgacggagatcgctcatggcgcgcagcagggacccgctggcaccccgtggtccctccttttggcctgataaaatgtgccgtttgcacctgcaaagggggaactggtgaagtgcactgtgagaaggtgcaatgtccacgcctggcttgcgcccagcccgttagagtaaatcccacggactgctgcaagcaatgccccgtgggcagtggggctcacccccagctcggagaccccatgcaggcggatggacccaggggatgccgattcgctggacagtggttcccagaatcccagtcctggcatccttccgtcccaccgtttggagaaatgtcttgtatcacctgcagatgtggggcaggcgtcccccattgtgagcgcgacgactgcagcttacctctctcatgcggaagtgggaaagaatcgcgctgctgttctcgctgtactgctcaccgccgtccagcccctgaaacaaggacagatccggaactggagaaagaagccgaggggtcctag

SEQ ID NO: 218262 - DNA, 285 bp, Artificial Sequence
  Description of Artificial Sequence: Synthetic coding sequence
atgccatcacttccagcccctcctgctcctctgttattgctgggcctactcctgctggggagtcgccctgctcgaggagcagggccagaaccccctgtgctccccatcaggtcagaaaaggagccactccctgtcaggggagcagctgggtgtacttttggcggtaaagtgtatgcgcttgacgaaacctggcacccggatctaggggaaccgttcggcgtgatgcggtgcgtgctgtgcgcttgtgaggccaccgggacgctgcgcccaagggagatgaagtag

SEQ ID NO: 218263 - DNA, 1512 bp, Artificial Sequence
  Description of Artificial Sequence: Synthetic coding sequence
ggggaacacttgtctcagaagggccctcatgtacgcccatgccgaaccaatcccggatctctggaagctcccgatagtactccaggcgcagcgacagctcggacaagcggacagtgcctctcacccggtgagtggggtagcggctctcggtgccacctatcatggccactggctatcgctcaccacactttattgtgtccccaggagcccggatttgctgaagttttgcctaacctgaccgtgcaagaaatggactggctcgtgttgggggagttacagatggccctggaatgggcgggtagaccgggactgcgcatctcagggcacattgccgctcggaaaagctgtgacgtgctgcagtctgttttgtgcggagccgacgccctgatacctgtgcaaaccggtgcagccggatcagcttccttgactcttttgggaaatggttcattgatttaccaggtgcaagtggtcggcacttcgtcggaggttgttgctatgactctggagaccaagccccagcgacgcgaccagaggaccgtgctgtgccatatggctggtttacagccgggtgggcacactgcggttggcatctgcccgggactgggcgcaagaggtgcccatatgttgttgcagaatgaactgttcctaaatgtgggcaccaaggactttcctgacggggagctcaggggccatgtcgctgccctgccttactgcggccactccgctcgccacgacacattacccgtgccactggccggtgctctggtgcttccaccggtgaaatcacaggccgctgggcacgcctggttgtctttggacacccattgccatctacactatgaagtgctgctagccggattagggggatctgaacagggcacagtcaccgcacatttactaggaccgcctggcactcccggtcctaggcgcctgctcaaagggttttatggttctgaagcacagggggtggtaaaggatcttgaaccagagctactgcgacatctcgccaaaggcatggccagcctgatgatcactaccaaaggcagcccgaggggcgaattgcgaggccaggtccacatcgctaaccaatgcgaagtcgggggactgcggctcgaggcggcaggtgctgagggggttcgcgcactgggcgcaccagatacagcaagtgctgctcccccagttgtgccgggtcttccagccttggcgcctgcaaagccgggaggacctggacggccacgcgaccccaacacatgcttttttgaaggacagcagaggccccatggggcacggtgggcaccgaattacgaccccctctgctccctttgtacatgtcagagaaggaccgtcatatgtgacccagtcgtgtgcccaccaccgagctgtcctcatccagtgcaggccccagaccagtgctgcccagtctgtcctgagaagcaggatgtgcgagacctgcccggtctaccaaggtcccgggacccaggagaaggtggccattggcgcggagcgctgtag

SEQ ID NO: 218264 - DNA, 2748 bp, Artificial Sequence
  Description of Artificial Sequence: Synthetic coding sequence
atgccctctcttccagcgccacccgctccccttctgctcttagggctgctcctgctggggagccgccctgcgcgaggggctggacccgaaccacccgttctgcctatcagatccgaaaaagagcctctgcctgtgcgaggggctgccggttgcacctttgggggtaaagtgtacgcactcgacgaaacctggcaccccgacctgggtgaaccttttggggttatgaggtgcgtgttatgcgcatgcgaggcacctcaatgggggaggagaacccgagggcctgggcgtgtctcctgcaagaatataaagccagaatgccctactcccgcttgcgggcagcctcgccaattgcccggacattgctgtcagacctgtccccaggagagaagctcgtccgagcgtcagccttctggtctgagttttgagtacccacgcgaccctgaacaccggagttactcagataggggcgaaccaggagcagaagaaagggctaggggagatgggcacactgacttcgtcgctctgctgactggaccaaggtctcaggctgttgcaagggccagggtctccctgttgaggagctctctgcggttttctatttcttacaggagattagacaggccaacaagaattagattttccgactccaacggcagcgtactttttgagcacccagcagctcccacccaggatggccttgtgtgcggagtgtggcgcgcagtgccgagattgtcgctgcggctcctgcgtgcagagcaactgcacgttgcattggttacccttacccaccccagcggtgaggtttggggtcctctaattcgccaccgtgctctggcggctgagaccttttctgctatactgactttggaaggccctcctcagcagggcgtggggggaatcacactcttgacccttagtgacacagaagatagcctccactttctgttgctctttcgcggactcctggagcctcgatcaggcggtctgacccaggttcccctccgcctgcagatattacaccaggggcagctgctaagggaactgcaagctaatgtctcggcgcaagagcccggattcgcggaggttctaccgaacctgacagtccaggaaatggactggctggttctgggtgagttgcagatggctctggaatgggctggcagacctgggttgcggatctctggacacatcgcggctcgaaagtcctgtgacgtgctgcagagtgtgctgtgtggtgctgacgcacttataccagttcagaccggcgcagcaggcagtgcatctctgaccctcctgggcaacgggagtctgatttatcaagcggtaggtatttgtcccggtttgggcgctcggggagcccacatgctgcttcagaatgagttgttcttgaatgtagggaccaaagatttcccggatggcgagttgcgcggacatgttgctgcattgccatactgtggccattctgccagacacgataccttgcctgtccccctggcaggagctctcgttcttccaccggttaagtctcaagcggcaggccacgcctggttgtccctggacacccattgccatctccactacgaggtcctgctcgctggactgggaggctctgagcagggcactgttactgcccacctgctcggtcctccaggcactcccggaccaaggcgcctgctgaaaggcttctacggttccgaagcacagggagtcgtcaaggacctggagcctgaactcctgaggcatctggctaagggcatggcttcgctgatgatcaccactaagggctcacccagaggcgaactaaggggccaggtccatattgccaaccagtgcgaagtgggtgggctgaggctggaggcggcaggcgctgaaggtgttcgggctttgggcgcaccagacactgcttccgcagcccctcccgtcgtccctggccttcccgctttggcccctgccaagcccggaggaccgggaaggccccgagaccccaacacctgcttctttgaaggacaacagagacctcatggggctcgatgggcacccaactacgaccccctgtgctctctatgcacatgtcagagacggaccgtgatatgtgaccccgtcgtgtgtcctccgccttcatgtccccaccctgttcaggccccagatcaatgttgccccgtgtgccctgaaaagcaggacgtacgagaccttccaggtctccccaggagtcgagatcccggagagggctgctattttgatggggaccgatcctggagagcagccggtactcgatggcaccctgtggtgccgcctttcgggcttatcaagtgcgctgtgtgcacatgcaaagggggaaccggtgaagtgcattgtgaaaaggtgcagtgtcctaggctggcttgcgcacagcccgtccgagtgaatcccactgactgctgtaagcagtgtccagtgggctctggcgctcatccgcagctgggtgaccctatgcaagcagatggaccaagggggtgcagatttgcgggtcagtggtttcccgaaagtcagtcctggcacccaagcgtgccaccgttcggagaaatgagctgcataacttgtcgctgtggcgcaggagttccccactgcgaaagggacgactgcagcctccctctctcttgcggctccggtaaagagagccgctgctgcagcaggtgtaccgcccacaggcggccagctcccgaaaccaggaccgacccggagttagaaaaggaagcagaaggcagctag

SEQ ID NO: 218265 - DNA, 1494 bp, Artificial Sequence
  Description of Artificial Sequence: Synthetic coding sequence
atggattggcttgtgctaggggaactgcaaatggccctggagtgggccggacgaccaggcctgcggatctccggtcatatcgccgctagaaagtcctgcgacgtgctgcaatcggttttgtgtggcgcagatgcgttgatacccgtgcagactggagctgccggtagcgctagcctcacgctgcttgggaatgggagcctcatctaccaggtgcaggtagtgggcacaagctctgaggtggtcgccatgacactggagactaagccccagcgcagggaccaacgcaccgtgctgtgccacatggctggcttgcagcctggagggcatacagcagtagggatctgcccaggtctaggtgcccgtggagcgcacatgctcctgcaaaatgaactatttttgaacgttggcactaaggatttcccagacggcgagttaagaggtcacgtcgccgcattaccatactgtggccatagtgctcgacacgataccctccctgtgcccctggccggagcattggtgctgccgcctgtgaagtcacaagcagctgggcacgcctggttgagcctggacactcactgtcatctgcactatgaggtcctgctggcaggcctggggggaagtgaacagggaacagtcactgcccatttgcttggccctcccggaacaccgggtccacgtagactgctgaagggtttctatggcagcgaagcgcagggcgtggttaaggatttagagccggaattgcttcggcacctggcgaaggggatggcttcactgatgataacaactaaaggctcgccccgaggcgaactgcgcggtcagcggcgaactgtgatctgtgaccctgtggtttgcccgccaccctcctgtccacatccagtccaggctcctgatcagtgttgccccgtctgccccgagaagcaggacgtgagagatctgccaggcttgcccaggtccagggatcctggggaaggctgttatttcgacggggatagaagctggagagctgccggtacacgatggcatcccgtcgtgccaccctttggactgatcaagtgcgcggtgtgtacttgtaaaggcggaacaggcgaggttcattgtgagaaagtccaatgtccgagacttgcatgcgcgcagcctgtgcgtgtgaatcccacagactgctgcaagcagtgccccgtggggtctggagcacatccacaacttggggatcctatgcaggccgacgggcctaggggatgtcgatttgctgggcagtggtttccagagtcacagagctggcacccttccgtgcccccatttggtgagatgtcatgtattacctgccggtgtggcgcaggggtcccgcattgcgaacgggacgactgtagccttcctctgtcctgcggcagtggcaaggaatccaggtgttgctcacggtgcaccgctcacagacggcctgccccagaaactagaaccgatcctgagctggaaaaggaagctgaagggtcctag

SEQ ID NO: 218266 - DNA, 3126 bp, Artificial Sequence
  Description of Artificial Sequence: Synthetic coding sequence
atggaaaacatgtttttgcagagctcaatgttaacgtgcattttcctgttgatttctgggtcatgtgaactctgtgctgaagagaacttctctaggagttacccatgtgatgagaaaaaacagaatgattcagtgatcgcagaatgttcaaataggcgactccaggaggtcccacagaccgtcggaaagtatgtaaccgagctggatctgtcagataattttatcacccacattacgaacgagtcatttcagggcctgcagaatctcacgaagatcaatctcaatcacaatccaaacgtacaacaccagaatgggaatccgggaatccagagtaacgggctcaatattacggacggggctttcctgaacctcaagaatttgcgtgagctgctgctggaggataaccaattgccccagatcccatccggactgccagaatcgcttacggaactcagtctgatccaaaacaacatttacaatataaccaaagaggggatctctcgtctgattaatctgaagaacctgtatctcgcatggaattgttattttaacaaggtttgcgagaagaccaacattgaagatggcgtcttcgaaaccctgacgaatctggagctgctctccttgagttttaatagtctctcgcacgttccacccaaactaccctcctccctgcgcaaactatttctttctaacacccagatcaagtacatctcagaagaggatttcaaaggtttgattaatctgactctgctggatctgtcaggcaactgtcctcggtgctttaatgcgccatttccttgtgtgccgtgtgacggaggggcatcgatcaatatagaccggtttgcatttcagaaccttactcaacttaggtatcttaatctctcatccacttctcttagaaagataaatgcggcatggtttaaaaacatgccacatctcaaagtgttagatctggagttcaattatttagtgggagaaattgcctcaggtgcatttttaacaatgcttccacggttagaaatcctcgacttgagctttaactacattaaaggtagctacccgcagcacattaacataagcagaaatttttctaagttgctgagtctgcgcgcacttcatctgcggggttacgtcttccaggagttaagagaagatgactttcagccactgatgcagctgcctaacctgtctaccatcaatctgggaattaacttcataaagcaaattgactttaaactatttcagaactttagcaacctcgaaataatttacttatctgagaataggatcagccctctggtgaaggacacaaggcaaagctacgcgaatagtagcagtttccagagacacatcagaaagcgcaggtctactgactttgagttcgatccacacagcaatttttatcattttacccgaccgctgataaagccacaatgtgctgcttatggtaaagccctcgacctgagtctgaattctatcttcttcattggccctaaccagtttgaaaatctgccggacatcgcctgtttaaacttgagcgccaactccaacgcacaggtgctatctggaaccgagttcagtgcgattccacatgtgaagtatctggatcttactaacaataggctggactttgataatgcctctgccctgacagaactgagcgacctggaggtgctggatttgagttataatagccattatttccgtattgctggagtgactcatcacctagaattcatacaaaacttcactaatctgaaggtacttaacctgagccataacaatatatacacccttactgataaatacaacctggaatcgaaaagcctggtcgaactggtgttttcaggaaatcgcctagacattctttggaacgacgacgataaccgctacatcagcattttcaaaggtctgaaaaatctaactaggctggacttgagcctgaatcggttgaaacatatcccaaatgaggccttcttaaacctccctgcttcgcttacggaactccatattaacgataacatgcttaagttttttaattggactctgctccaacagtttcctagactggagttactggacctgcgtgggaacaagctgctcttcctcacagacagcttgagtgatttcacatccagtcttcggactttactcctctctcacaacaggatcagccacctaccatcaggctttcttagtgaggtgagctcactgaaacacctggatctgtccagcaacttgctgaaaacaatcaataaaagcgccctggaaactaaaaccaccacgaaactgtccatgctggagctacacgggaatccgtttgagtgcacctgcgacataggcgactttcggcgatggatggacgagcacttaaacgtgaagatcccgcgactggtagatgtcatctgtgcgagtccgggtgaccaacgaggtaaatccatcgtttccctggagcttacaacatgtgttagtgacgtaaccgcggtcatcttgttttttttcaccttctttatcacgacaatggtcatgcttgcagccctggcgcaccacttgttttactgggatgtgtggttcatctacaacgtgtgtctggcaaaggtgaaaggttaccggtctctgagcacttcccagaccttttatgacgcctacataagttatgacacaaaggatgcctccgtgacagattgggtcatcaacgaactgcgctatcaccttgaagaaagccgagacaagaatgtccttctgtgcttggaggagagggattgggaccccggactggccatcattgacaacttgatgcagtctatcaatcagtccaaaaagacagttttcgtgctgaccaagaaatacgccaagagctggaattttaagaccgctttctatttggctttgcagcgcttgatggacgaaaacatggatgtgattatctttattctcctcgagccagtactacagcacagtcagtacctgcgcctgcgccagcgtatctgcaagtctagtatcttacaatggccagacaacccaaaagccgaaggtctgttttggcagacactaaggaacgttgtattaactgaaaatgactctaggtacaacaacatgtacgtcgacagtatcaaacagtactag

SEQ ID NO: 218267 - DNA, 1377 bp, Artificial Sequence
  Description of Artificial Sequence: Synthetic coding sequence
atgaggaagaagtggaaaatgggtggaatgaaatatattttttccctgctgttctttctgttactcgaagggggaaagactgaacaggtgaagcattccgaaacctactgcatgtttcaggataaaaaatatagagttggggaacgctggcacccataccttgagccctacggacttgtttattgcgtcaactgtatttgttctgagaacggcaatgtgctgtgcagcagggtgcggtgtcccaacgtacactgtctctcgcctgttcatattccacacctctgctgtcccaggtgtccagaggatagtctaccccctgtcaataacaaagtgacctcaaaaagttgtgaatacaacgggactacatatcagcatggagaacttttcgtggcagaggggctgtttcagaatcggcagccgaaccaatgcactcagtgctcctgctctgaaggcaacgtgtattgcgggctcaaaacttgtcccaagttgacatgtgccttccctgtttcagtgccagactcctgttgccgagtatgcaggggggacggtgaattgagctgggaacactccgatggcgatatatttcggcagccagcaaatcgtgaggctcggcatagctatcaccgcagtcactatgaccctcccccaagccgccaagcaggtgggctgtcacgctttccaggtgccaggtcacatcgtggcgctcttatggattctcaacaagctagcggaactattgtgcagatcgtgattaacaacaagcataagcatggacaggtctgcgtgagtaatggaaagacatatagtcacggggagtcctggcacccaaatttgagggcattcggaatcgttgagtgtgtcctgtgtacttgtaacgtaaccaaacaggaatgtaagaaaattcactgtcccaacagatacccatgtaagtaccctcaaaaaatagacggaaagtgctgcaaagtgtgcccaggtaagaaggcaaaggaagagcttcccggacagtcctttgacaacaagggctatttttgcggcgaggaaaccatgcccgtgtacgagtcagtcttcatggaggacggtgagactactcgaaaaatcgctcttgaaacagagcggcctccccaagtggaagtgcacgtttggacaatccggaaaggaattctacagcacttccacatcgaaaagatctctaaacggatgtttgaagaactgccacattttaagctcgttacaaggacaaccttgagtcaatggaagatattcacagaaggtgaggcacagatctcgcagatgtgcagctcaagagtctgtagaaccgaacttgaagacttggtgaaggtgctgtaccttgagcgctctgaaaagggtcattgctag

SEQ ID NO: 218268 - DNA, 1353 bp, Artificial Sequence
  Description of Artificial Sequence: Synthetic coding sequence
atgggcggtatgaaatacatatttagtctgctgtttttcttgctcttggaaggaggaaaaactgagcaggttaagcactccgagacatactgcatgttccaggataagaaatacagagtgggcgaaagatggcatccctatctcgaaccctatgggctggtatactgcgtaaactgcatctgcagcgagaacggcaacgtgttgtgctcaagggtgagatgtcctaacgtgcattgtctgagcccagtgcacataccacacctgtgttgtcccaggtgtccagactcccttccgccagtgaataacaaagtgacatcgaagtcatgcgaatataatggaacaacttatcagcatggcgaactgtttgtcgccgaaggcctgtttcagaaccgacagcctaatcagtgcacccagtgctcgtgctcagagggtaatgtgtattgcggactgaagacttgcccaaagctgacttgcgccttcccagtatcagtaccggatagttgctgccgggtgtgtagaggagatggcgagctctcttgggagcactctgatggcgatatattcagacagcctgcaaatagagaagccagacattcttaccatcgctctcactacgatccccctccctcccggcaggccggtggcctgtcccggttcccaggagccaggagtcacagaggcgcactgatggactcacagcaggcatccggaacaatagtacagattgtgatcaataacaagcacaagcatggccaggtttgcgtcagcaatggaaaaacctatagccacggtgagagctggcaccccaatctcagagcatttggaattgtcgaatgtgtgctctgcacttgcaacgtcacaaagcaggagtgtaaaaagatccattgcccaaatagatatccttgcaaataccctcagaagatcgacggtaaatgttgcaaagtttgtcctgggaagaaagcaaaagaactccctgggcagtcctttgacaacaaggggtacttttgcggggaggagaccatgccagtatacgaatcagtgtttatggaggacggcgaaacgacccggaaaatagctctcgaaacagagcgtcctcctcaagtggaagtgcacgtctggactatccgtaagggcatactccagcacttccatattgaaaagatcagcaagcgcatgttcgaggaactcccgcactttaagttagtgaccaggaccacattatctcagtggaaaattttcaccgaaggcgaggcacagatcagccagatgtgttcatcaagggtgtgtcgcacggaattagaagacctcgttaaagtgctctacctggaaagaagcgagaaaggtcactgttag

SEQ ID NO: 218269 - DNA, 1371 bp, Artificial Sequence
  Description of Artificial Sequence: Synthetic coding sequence
atgcggaaaaagtggaagatgggcggaatgaagtatattttctctctcctgttctttctcctgctagagggagggaagaccgaacaagtcaaacatagtgagacttactgtatgtttcaggacaaaaagtatagggtaggcgaaagatggcacccatacctcgagccgtacgggctggtgtattgtgtgaattgtatttgcagtgagaacggaaacgtgctctgttcccgcgtaaggtgtcccaacgtacattgtctatcgcctgtgcatatcccccacctgtgctgtccgaggtgtccagacagtctgcccccagtaaacaacaaggtaacgagcaagtcttgtgaatataatgggactacctatcagcacggggagctctttgtggccgaaggactgttccaaaataggcagcctaatcagtgcacccagtgtagttgttccgagggcaacgtgtattgtggcctgaagacctgtcccaagttgacgtgtgccttcccagtatccgtgcccgattcctgttgtcgggtgtgcaggggcgacggggaactgtcatgggagcactcagatggagacattttcagacagcctgcaaatagagaagccagacactcttaccaccgttcccactatgatccccctccatcaaggcaagctgggggattatctagattccccggagccaggagccacagaggcgcacttatggattctcagcaggccagcggcaccattgtccagatcgttataaacaacaaacataagcacggtcaggtgtgcgtttccaatggaaaaacatatagtcatggcgaatcttggcatcctaatctgcgggctttcggtattgtggaatgcgttctctgcacttgtaacgtgaccaagcaggaatgtaagaagatacattgccctaacaggtacccctgcaaatatccccagaagatcgatggcaagtgttgcaaagtttgccccggtaaaaaagctaaagagttgccaggccagagcttcgacaacaaaggctatttttgcggtgaagagacgatgccagtttatgagagtgtattcatggaagatggtgaaacgacgaggaaaatcgcgctagaaacagagaggcctccccaggtcgaagtgcacgtctggaccattcgtaaaggaatcctgcagcactttcacatcgaaaagatttccaagagaatgttcgaggagttgcctcattttaagttagtgactaggactacactttcgcagtggaagatatttactgagggggaagcgcaaatcagccaaatgtgttcctctcgggtctgtagaaccgaactcgaggaccttgtgaaagtgctctacctagagcgatcagaaaagggacattgttag

SEQ ID NO: 218270 - DNA, 1134 bp, Artificial Sequence
  Description of Artificial Sequence: Synthetic coding sequence
atgagaaaaaaatggaaaatgggaggaatgaaatacatcttctccctcctgttctttctgctgctcgagggcggaaaaacagagcaggtgaaacacagcgaaacgtactgcatgttccaagataagaaatacagggtgggcgaaagatggcacccatacctggaaccttacggcttagtatattgtgtgaactgcatttgctctgagaatgggaatgtactgtgttcccgagtgcgctgtccgaatgttcattgcttgtctccagtccacatcccccacctttgctgcccacggtgccctggtgacggggagctgtcttgggaacatagtgatggggatatatttcgccagccagccaatcgcgaggccagacacagctatcatcggtcccactatgacccaccgccatcccgccaggccggaggtctcagtcgttttcctggtgccaggtcacatcgtggggcattgatggatagtcagcaagcctcaggcacaatcgtgcagatagtgattaacaacaaacacaagcatggtcaagtttgtgtgagcaacggtaagacatactctcatggcgagagttggcacccaaacttacgcgctttcggcatcgtagaatgcgtcttgtgtacctgtaacgtgacaaagcaagagtgcaaaaaaattcattgccccaacagatacccttgtaagtacccccagaagattgacggaaagtgctgtaaggtatgccctggtaaaaaagccaaggaactgcccggtcaatccttcgacaacaaaggttatttttgtggtgaggagacaatgcccgtgtacgaatcggtttttatggaagatggagaaaccactcggaagattgccctagagaccgaacgcccaccacaagtggaggtacacgtttggaccatcaggaagggcatcctgcagcatttccatattgaaaagattagcaagcgcatgttcgaggagctgccccattttaagctggtgaccagaactacccttagtcaatggaagatcttcacagaaggggaagcccagatttcacagatgtgtagtagcagggtttgtcgaaccgaacttgaagacctcgtgaaagtcctgtatctggagaggtctgagaaaggtcactgctag

SEQ ID NO: 218271 - DNA, 1374 bp, Artificial Sequence
  Description of Artificial Sequence: Synthetic coding sequence
atgcgtaagaaatggaagatgggcggtatgaagtatatttttagtcttctgtttttcttgctcctcgaagggggaaagaccgagcaggtgaaacattccgaaacatactgtatgtttcaggacaagaagtacagggtgggggagagatggcacccttatttagagccttatggtctggtatactgtgtaaattgcatttgctcagaaaacgggaacgtactgtgctctcgcgtgaggtgcccgaatgtccactgcttgtctcccgtacacattccacatctttgttgtcccagatgtcctgatagcctccccccagttaacaataaggtgacctcaaagtcgtgtgagtacaacggtaccacataccaacatggagaattattcgtcgccgaagggctgttccagaaccgtcaacctaatcagtgcacacagtgtagctgctccgaaggtaacgtttactgcgggcttaagacctgccctaagctgacctgcgctttccccgtgtctgtgccggatagctgctgtagggtgtgcagaggagatggggagctctcctgggagcacagcgatggtgatatcttcagacagcccgcaaacagggaggccagacactcgtaccacagaagccactacgaccccccaccctctcggcaagccggtggcctgagtcggttccccggtgcaagaagccaccggggagccctcatggactcccaacaggcctcggggacaattgtgcagatagtgattaataataagcacaaacacggccaagtctgcgtgtcaaacggcaagacatattcacacggtgagtcctggcatcctaatctgcgagcattcggcattgtggagtgcgttctgtgcacttgtaatgtcaccaagcaggaatgcaaaaagattcactgccccaataggtacccctgtaaatatccacaaaaaatcgatggaaaatgctgtaaagtttgtcccggaaagaaggcgaaggaagagctgcctggccagtccttcgacaataaaggctacttttgtggtgaggagaccatgccggtctatgagtcggtttttatggaggatggcgaaaccacacggaagatcgctttagaaactgaacgcccacctcaagttgaggtgcacgtgtggaccatccgcaagggaatcctgcagcactttcatatcgaaaaaatcagcaagcgcatgtttgaggagctgcctcatttcaagttggtgactaggacgacactgtcccagtggaaaatcttcactgagggagaggcgcaaatcagtcaaatgtgcagcagtagggtctgtcgaactgaactagaggatttggtcaaagtgttgtatcttgagcgttccgagaagggccactgctag

SEQ ID NO: 218272 - DNA, 1137 bp, Artificial Sequence
  Description of Artificial Sequence: Synthetic coding sequence
atgcgtaagaagtggaagatgggtgggatgaagtatatcttcagccttcttttttttctactgctcgaaggtggaaagactgaacaagtgaagcactcagagacttactgcatgtttcaggacaagaagtaccgcgtcggggaaaggtggcatccatatttggagccctatgggctggtgtactgcgtgaactgtatctgctctgagaacggaaacgtcctctgtagcagagtgcgatgcccaaatgtccattgcctgagtccagttcatatccctcatttgtgttgcccccgatgcccaggcgacggcgaactctcctgggagcactctgacggggatattttcagacagcccgctaaccgggaagctagacacagctaccatcgatcccattatgacccccctccgtccagacaagccggtggcttgagtcggtttccaggcgctaggtctcaccgcggtgccctgatggactctcagcaggcttcaggcaccatcgtgcagatcgtaatcaacaataagcacaagcacgggcaagtgtgcgtttccaacggcaaaacttattcccatggcgagtcttggcaccccaacttacgtgcgtttgggattgtggagtgcgttttgtgcacgtgcaacgttaccaaacaggagtgcaagaagattcactgtcctaaccgatatccatgtaaatatcctcagaaaatagacggcaagtgctgcaaagtctgtccaggcaaaaaggccaaggaggagttacccggacagagtttcgacaataagggatatttctgcggcgaggaaacaatgcctgtgtatgagtctgttttcatggaggacggagagacaactagaaagattgctctggaaacagagcgtccaccacaggtggaggtccacgtgtggaccattagaaagggcattctgcagcatttccacatagaaaaaatatctaaacgcatgtttgaggagctgccacactttaagctcgttacccgcactacattaagtcagtggaagatcttcacagagggtgaggcccagatcagccagatgtgctcctctagggtgtgtcggaccgaactggaggatctggtgaaagtgctttacctcgagcgaagcgagaaaggccattgctag

SEQ ID NO: 218273 - DNA, 1356 bp, Artificial Sequence
  Description of Artificial Sequence: Synthetic coding sequence
atggttccggaagttcgggtcctctcttccctgctcgggctggcacttctttggttcccactggatagccatgccagggccaggcccgatatgttttgtctgtttcacggaaagcgttattctcctggggagagttggcatccctacttagagccccagggcctgatgtactgtctgcgttgcacttgttccgagggcgctcacgtcagctgctaccgactgcattgcccgccagttcattgtccacagcctgtaactgagcctcaacagtgctgccccaagtgtgttgagccgcatactccctcgggccttagagccccaccgaagagttgccagcataacgggactatgtaccagcacggcgaaatcttcagcgcccacgagctctttccttcccgactgcctaaccaatgcgttctgtgctcctgcaccgagggccagatttactgcggtctgaccacttgtccagaacccggttgccccgcacctctccccctgcctgacagctgttgtcaggcttgtaaggatgaggcctcagagcagtctgatgaagaggacagtgttcagagcctgcatggtgtgagacatccgcaagatccctgttccagcgatgccggacgaaagaggggacccggaacccccgcacctaccggccttagcgccccactgtctttcattccaagacacttcagaccaaagggagccggttcaactacagtgaagatcgttctgaaggagaaacataaaaaggcttgcgtgcatggaggcaagacttactctcacggggaagtatggcaccccgctttccgggcatttgggcctcttccctgtattctctgtacatgtgaggatgggaggcaagattgtcagagagtgacctgcccaacagagtacccttgccggcacccggaaaaggtagcagggaagtgctgcaagatttgtcctgaggataaggcggaccctggccattcagaaatttcctcgactcggtgccccaaggcccctggaagggttttggtgcacacatccgtctccccatcccccgacaatcttagaagattcgccctggaacacgaggccagcgatctggtggagatctacctctggaaactcgttaaagacgaagaaaccgaggcacagcgtggcgaggttccaggacctcgtccacactctcaaaatctgccactggatagcgatcaggagtcgcaggaggccaggctccctgagaggggcaccgctcttccgacagcccgatggcccccacggagatctttggagaggttaccgtcacccgatcctggtgccgaaggtcacgggcagagtaggcagtctgatcaggacatcacaaagacctag

SEQ ID NO: 218274 - DNA, 846 bp, Artificial Sequence
  Description of Artificial Sequence: Synthetic coding sequence
atgtaccagcacggcgagattttctcggcccatgagctgttcccatcaaggttacccaaccagtgtgtgttgtgtagttgcactgaagggcaaatctattgcggcctgactacctgccccgaaccaggctgcccggctccattgcctctccccgacagttgttgccaggcatgcaaggcgggtagttcctggggactgttgtgtagcgtcagcgattttcaccctagttgtcatttgcagagacatccccaggacccttgttcgtctgatgccggacgcaagcggggtcccggtacacctgctcccacaggcttaagtgcgcctctgtctttcatccccagacactttagacccaagggtgcaggctctaccaccgtgaagatcgtactgaaggaaaagcataagaaagcctgtgttcacggaggcaaaacttattcccatggcgaggtgtggcatcccgctttcagggcattcggacccctgccttgcatattgtgcacatgtgaggatgggcgtcaagactgtcagagggtaacctgtcccacggaatatccatgccgtcatccagaaaaagtggctgggaagtgctgcaagatctgtcctgaggataaagctgatccagggcacagtgagatctcatctactcggtgtccaaaagccccaggaagggtcctcgtgcacacctcagtgagtccctcacctgacaaccttcggagatttgccctggagcacgaggcctcagacttagtcgaaatctacctgtggaagctggtgaaaggagtgtttctggctcagactttagagctgaaagtcaccgcaagccctgataaagtcaccaagacctag

SEQ ID NO: 218275 - DNA, 1290 bp, Artificial Sequence
  Description of Artificial Sequence: Synthetic coding sequence
atggtgcctgaagtgcgagtcctgtcttcactcctgggtctggccctgctctggtttccacttgacagccacgccagggccagaccagacatgttctgcctgtttcacgggaaacggtactctcccggagagtcatggcacccataccttgagccccagggactgatgtattgtctgcggtgtacctgctccgagggagctcacgtaagctgctacagactccattgtcctcccgtgcactgccctcagcccgtaaccgagccccagcaatgttgccctaagtgcgtggaaccccacactccctctggccttagagcacctccgaagagctgtcagcataatggtacaatgtatcagcacggcgagattttctctgcccacgagctgttccctagcaggctgccaaatcagtgtgtactttgcagctgcacggagggtcagatctactgcggccttacgacgtgtccagagcctggctgccctgcgccactgcctttgcctgatagttgctgtcaggcttgtaaagacgaggcttcagaacagtctgacgaggaagacagtgtgcagtccctccacggagtgcgtcaccctcaagatccttgctcttccgatgctggacggaagcgaggacccggtacccctgcccctacaggtctgtccgcccctctatctttcataccgaggcattttagaccaaagggcgctgggagcactacagtgaagatcgtgctgaaggagaaacataaaaaagcgtgcgtacacggcggaaagacatactcccacggcgaggtgtggcacccggcttttagagccttcgggcctctcccctgcatcctttgcacttgcgaagacggaaggcaggattgtcagagggtgacgtgccccacggaatatccatgccgtcacccagaaaaggtcgcaggtaagtgttgtaagatttgtccagaggataaggctgatcccggacattcagagatatcatccacgaggtgccccaaggcccctggcagggtcctcgttcacacttcagtcagccctagtcctgacaacttacggaggtttgccctcgagcatgaagcgtccgaccttgtcgaaatttatttgtggaagctggtgaaaggcatctttcacttgactcagatcaaaaaagtgaggaagcaggacttccaaaaagaggcccaacactttcgattgttggccggacctcatgagggccactggaacgtgttcctggcacagaccttagaactgaaagtaacagcatcaccagacaaggtgactaagacttag

SEQ ID NO: 218276 - DNA, 840 bp, Artificial Sequence
  Description of Artificial Sequence: Synthetic coding sequence
atgtaccaacacggtgaaatcttttccgctcacgagctctttcctagccgtctgcccaatcagtgcgttctctgtagttgtaccgaggggcagatatactgtggtctgaccacatgtccagagccagggtgcccagcgcctctaccgctgcccgattcgtgctgtcaggcgtgcaaagatgaggcatctgagcagagcgacgaagaggatagtgtgcagagtctccacggggttcgccaccctcaagatccatgctcatccgacgcaggtagaaagcggggtccagggacgccagcacctactggcctctcagccccacttagtttcatcccccgacacttccgacccaagggtgccggatctaccacggtgaagatcgtacttaaggagaagcacaaaaaggcatgcgtccatggaggaaaaacctacagccacggcgaagtctggcaccccgcattccgggctttcggaccactgccctgtattctgtgtacctgcgaagatggccgacaggattgtcagagagtgacgtgtcccaccgaatacccttgccgccaccccgagaaggtggccggtaagtgctgtaagatctgtccagaggataaagccgaccccggtcacagtgaaatcagcagcactcgctgcccaaaggccccaggaagggtcctggtgcatacatcggtttctccaagccctgacaacttaagaagatttgcactggaacacgaggcttcagacctggtcgaaatctacctatggaagctcgtcaaagacgtgttcctggcccagacactggaactgaaggtgacggcttccccggacaaagtgactaaaacctag

SEQ ID NO: 218277 - DNA, 498 bp, Artificial Sequence
  Description of Artificial Sequence: Synthetic coding sequence
atggaaatgtttcaaggcctcttgttgctgcttctcctgtccatggggggtacatgggcaagcaaagagccattgcgcccacggtgccggcctatcaacgctaccctggctgtggagaaagaaggctgtccggtctgtatcacggtgaatactacaatctgcgctggttattgtcctacaatgaccagggtgctccagggagtgttgcctgccctcccccaagtggtgtgcaattatcgggatgtgagattcgaatccattcgattgcccggatgccccaggggagtgaaccctgtcgtatcctatgcagtcgccctgtcctgtcagtgtgcactctgtagacgaagcactactgactgtggcggacctaaagaccatccactgacctgtgacgaccccaggtttcaggattctagttcttctaaggcaccaccaccctctctcccgagtccaagtaggctgcctgggccttctgacactcctattctcccccagtag

SEQ ID NO: 218278 - DNA, 507 bp, Artificial Sequence
  Description of Artificial Sequence: Synthetic coding sequence
gctcctcggatggagatgtttcagggtttacttctccttcttctgttatcaatgggtgggacctgggctagtaaggaaccactgcggccaaggtgccggcctattaacgccactctggcagtggagaaggagggctgtccagtctgcatcactgtgaacaccactatctgcgcagggtactgtcctacaatgacccgcgtgctgcagggagttttacctgccctgccacaagtggtgtgcaattacagggacgttcgctttgagtccataagactccccggatgtcccaggggagttaacccagttgtgagttatgctgttgccctctcatgtcagtgcgctctctgcaggaggagcaccactgactgtggcggtcccaaagaccaccccctgacatgtgatgaccccaggttccaggatagctcgtcgagtaaggcacccccaccgtcactgccgagcccctcgcggctccccggtccatccgacaccccaatcttaccgcagtag

SEQ ID NO: 218279 - DNA, 654 bp, Artificial Sequence
  Description of Artificial Sequence: Synthetic coding sequence
atggcgcctggcagcagaacgagtctcctgcttgcctttgctctgttatgtcttccctggcttcaggaagctggggctgtgcaaactgttcccttaagccgcctgttcgaccatgctatgctgcaagcccatagagcacaccagctcgctatcgatacttatcaggaattcgaggaaacctacatacccaaagatcagaagtactcttttctccatgattcgcagacgtctttctgtttcagtgattctatccctacaccgtcgaacatggaagaaacacaacaaaagagtaacttagaactactcagaatctctctcctgttgattgagagctggctcgaacccgtgcgcttccttcggagtatgttcgccaataacctggtgtatgacacctccgactcagacgattaccatctgctgaaggatctagaagagggaatccagacgctgatggggcgattggaggacggttcccggaggacagggcagatcttgaaacagacctactccaaattcgatactaattcccacaaccatgatgcgcttctgaagaactacggcttgttatactgcttcagaaaggatatggacaaggtggaaaccttcctgaggatggttcaatgccggtctgtcgaaggttcttgcgggttctag

SEQ ID NO: 218280 - DNA, 771 bp, Artificial Sequence
  Description of Artificial Sequence: Synthetic coding sequence
atggctcctggtagccgcacatcgctgctcttggcctttgcactcctgtgtttaccatggctccaggaggccggagccgtgcagaccgtgccactatcccggcttttcgaccacgcgatgttgcaggcccaccgggctcaccagctggccattgatacataccaggaattcgaggagacctatatccccaaggatcaaaagtactcatttctgcatgattcacagaccagcttctgcttctcagacagtattcccactccaagtaatatggaagagacccagcagaagtcaaatctcgagcttttgagaatttcgctcctgctcatagagagctggttagagccggttcggtttctgcgttccatgttcgctaacaatctcgtgtatgatacaagcgacagcgacgattatcaccttctgaaagatctggaggaagggatacagacactaatgggcgtgcgtgtggcccctggcgtgactaaccctgggactcctctcgctagtagagcgggaggggagaaatattgctgccctttattcagttctaaggcactgacacaggagaactccccatactcctcttttaggcttgttaatccaccaggtttgtccctacatccagagggggagggtgggaaatggatcaacgagcggggtagggaacagtgcccgagtgcctggcccctgctcctgtttctgcattttgctgaggctggcagaagacagccacctgattgggccgatccccaagcagatcttcagcaggtctag

SEQ ID NO: 218281 - DNA, 369 bp, Artificial Sequence
  Description of Artificial Sequence: Synthetic coding sequence
atggcacccggttctcgaacctctctcctgctggcatttgcattgttatgtcttccctggctccaggaggccggagcggtccagacagtgccactgtctaggctgtttgaccacgctatgcttcaagctcaccgggctcaccagctggcaattgacacgtaccaggagtttcggcttgaggatggctctcggagaactggccagatactgaagcaaacgtattccaaattcgacactaacagtcacaatcacgatgccctgctgaagaactacggactgttgtactgtttcaggaaagatatggacaaggttgaaactttcctccgcatggtacaatgtcgtagcgtggagggcagttgcgggttctag

SEQ ID NO: 218282 - DNA, 552 bp, Artificial Sequence
  Description of Artificial Sequence: Synthetic coding sequence
atggctccaggttccaggacatccctgcttctggccttcgccttactctgtctcccgtggcttcaggaggccgaaacttatatcccgaaggaccagaagtattctttcctacacgatagtcagacatccttctgtttttcagactccatcccaaccccatcaaacatggaggaaacccaacaaaaaagcaatttggaattattaaggatttccctgctccttatcgagtcatggctggaaccagtcaggtttttgcgatctatgttcgccaataacctagtttatgacacctccgactccgatgactaccacttattgaaagatctggaagaaggtatccagacccttatggggcgtctggaggatggtagcagaaggactggacagatactgaaacaaacatacagcaagttcgataccaactcccataatcacgacgcactgcttaaaaattatggtctcctgtactgtttccggaaggacatggataaagtggaaaccttcctgcgcatggtgcaatgccgcagtgtggaagggtcttgcggtttctag

SEQ ID NO: 218283 - DNA, 504 bp, Artificial Sequence
  Description of Artificial Sequence: Synthetic coding sequence
atggccgctgggagtaggaccagcctgctgcttgccttcgccctactgtgcctcccatggctgcaggaggccggtgccgtccagaccgtcccattgagcagactcttcgatcacgccatgctgcaagcccaccgggcacaccaactggctattgacacctatcaggaatttgaagagacttacatccctaaggatcagaagtactctttccttcacgatagtcagacttccttctgcttcagcgattcgatccccaccccgagcaatatggaggagacccagcagaagtcaaacctggaacttttacgtataagcctcctgcttattgagtcctggcttgagcctgtgcgcttccttaggtctatgttcgccaacaatctcgtctatgataccagtgatagcgacgactaccacttactcaaagacctcgaggagggcatccaaactttaatgggggtccgagtggctccaggggtggctaatcctggtacacctctcgcatag

SEQ ID NO: 218284 - DNA, 369 bp, Artificial Sequence
  Description of Artificial Sequence: Synthetic coding sequence
atggccgcagggtcgaggactagcctgctgttggccttcgctctgctttgcctgccgtggctgcaagaagctggcgctgtgcagaccgtgcccctttctcgcttattcgatcacgcaatgctgcaggcacaccgggcacatcagctggccattgatacctaccaagaattccggttggaagacgggtctcggcgaacgggccagattctgaaacagacgtattccaagttcgacaccaatagtcataaccacgacgctctgttaaaaaactatggtcttttatattgctttagaaaagatatggataaagttgagactttcctaaggatggtgcagtgccgctcagtcgaggggtcatgcgggttttag

SEQ ID NO: 218285 - DNA, 654 bp, Artificial Sequence
  Description of Artificial Sequence: Synthetic coding sequence
atggccgcaggctctcggacgtcgttgcttctcgcttttgccttgttgtgccttccttggctgcaagaggccggtgccgttcagacagtgcctctctcccgcctctttgaccatgcaatgcttcaggcgcaccgcgctcaccagcttgccatcgatacctatcaggaatttgaggagacttatatacccaaagaccagaaatactccttcctccacgactcgcagactagtttctgcttttctgacagcatacctactccatcaaacatggaggagacccaacagaaaagcaacttggagctgctgcggattagtctgttgctgattgagtcatggcttgagccagtgcggttcttgaggagcatgttcgccaacaatcttgtttacgacacctctgatagtgacgattaccatctactgaaggacctggaggagggtatacagacccttatgggaagactggaggacggctcgaggaggacagggcaaatcctgaagcaaacctatagcaagttcgacactaattcccacaaccacgacgccctgcttaagaattacggcttgctttattgtttccgcaaggatatggataaggtggagacgtttctccgcatggtgcagtgtcgcagcgtggagggctcttgtggtttctag

SEQ ID NO: 218286 - DNA, 483 bp, Artificial Sequence
  Description of Artificial Sequence: Synthetic coding sequence
atggcagctggctcgaggacctccctgctccttgcctttgcattgctgtgtctgccctggctccaggaggcggattccattccaactcctagcaatatggaggaaacccagcagaaatcgaacttagagctgctccggatctcactgctccttatcgagagctggcttgagcccgtacgctttctgcgctcaatgttcgccaacaacttggtctacgacacatcagacagcgatgattatcacctgctcaaggatctggaggagggaatccagacactcatgggacggctggaggacggatctcgtcgcactggtcagattttgaagcagacttattctaaatttgatacgaatagtcacaatcatgacgccctgctgaaaaattacggcctcctctattgctttcgaaaagacatggacaaagtggagaccttcctgaggatggtgcagtgtaggagtgtagagggcagttgtggattctag

SEQ ID NO: 218287 - DNA, 498 bp, Artificial Sequence
  Description of Artificial Sequence: Synthetic coding sequence
tgaggatctcgaacctccttgctcctggccttcgcactcttatgcctgccatggcttcaggaagccggtgcggtacagaccgtccccctgtccagactgtttgaccatgctatgcttcaggcccacagagctcatcagctagccatagacacttaccaagaattcgaagagacatatatcccaaaagaccagaagtacagctttctgcacgatagtcagactagcttttgttttagcgattctattccaactccttcaaacatggaagagacacagcagaaatccaacctcgaactcctccggatcagcctcctcctcattgagtcttggttagagcccgtgcggttcctgcgcagcatgtttgccaacaatctcgtgtatgacacgtctgactccgacgactaccatttgctgaaagatttggaggaggggattcagactctcatgggcgtcagggtggctcctggtgtggccaacccgggaacccctctggcgtag

SEQ ID NO: 218288 - DNA, 669 bp, Artificial Sequence
  Description of Artificial Sequence: Synthetic coding sequence
atggccgcaggttcccgcacctccctcctccttgcctttgctctgctctgcctgccatggctgcaagaggcaggggcagtacaaacagtgcccctctctcggctgttcaaggaggctatgctacaggcccacagagctcatcaacttgccattgacacgtatcaggagtttattagcagttggggtatggaggcgtacattacaaaggagcagaaatatagcttccttcatgattcccagacaagtttttgtttttctgattctatccctacatcgtcaaacatggaagagacccaacagaaatccaacctggagttgctccatatctctcttctgttgatagagtcccgcctggagccggtccggttcctgaggagtacatttaccaacaacctggtgtatgatacttctgacagcgacgattatcatttactaaaggacctggaggaaggcattcagatgctcatgggtcggctggaggacgggtcacacctgacaggccagacactgaaacagacatactcaaagtttgataccaactcccacaatcacgacgccctgctgaagaactacggacttctgcattgctttaggaaggatatggacaaggtggagacgttcctaaggatggtgcagtgcaggagcgtggagggcagttgtgggttctag

SEQ ID NO: 218289 - DNA, 387 bp, Artificial Sequence
  Description of Artificial Sequence: Synthetic coding sequence
atggaagagactcaacaaaagtccaacctcgagctgctgcatattagcctgctgttgatagagtctcggctggaaccagtgaggttcctgaggtccacgtttacaaacaatctagtctacgacacatctgactctgatgactaccacctgctcaaggatctcgaggaaggcatacagatgctgatgggcaggctggaagatggatcccacctgacggggcagaccctcaagcagacttactccaagttcgacacaaattcccataatcacgacgccctcctcaaaaactacggcctgctgcactgcttcagaaaagatatggacaaagtggaaacgttcctgcggatggtgcagtgtaggtctgtcgagggctcttgtgggttctag

SEQ ID NO: 218290 - DNA, 522 bp, Artificial Sequence
  Description of Artificial Sequence: Synthetic coding sequence
atggccacaggaagtcgcaccagcctgctgttagccttcgccctgctatgcctgccttggttgcaggaggcgggtgctgtgcaaaccgtccctctcagtaggttgtttaaggaggccatgcttcaggcccatcgcgcacatcagctcgccatcgacacatatcaggaattcatttcctcatggggcatgggtgctggtcagggttggcaagagggcgtgactttccctcactggggatccaatggtcggcgactccgtagctctggattattctcagaagccaagatgcaggccgacgagcatcggttgagtcaggtgcccaggcgtgttacggtaggcgcagggcttcagcaccgcaaacagtggagtttccttgtgggaggtccctctccccgtaagaaacctatcagccagcgaaatcggtccatccattcatgcatgactccaaggccaccttctgcctcccagactcttttcaggcatccgcctacctggcggaaacggtccaggaatccgacgtag

SEQ ID NO: 218291 - DNA, 420 bp, Artificial Sequence
  Description of Artificial Sequence: Synthetic coding sequence
atggccgctgattctatacctaccagtagcaacatggaagagacgcagcagaaatctaatcttgaactgctgcacatctctctactactgattgagtccagacttgagcccgtgcgcttcctgcgtagcacctttaccaacaatttggtctatgatacctctgactcggacgattatcatctgctgaaggatctggaggagggtatacaaatgctgatggggcgactggaagatgggagccacctgactggccagacactgaagcagacttattccaagtttgacacaaatagtcataatcacgatgctctgttaaagaactacggactgctgcactgtttccgaaaagacatggataaggtggaaaccttccttagaatggtccaatgtcgttccgtcgaggggagctgtggcttctag

SEQ ID NO: 218292 - DNA, 1962 bp, Artificial Sequence
  Description of Artificial Sequence: Synthetic coding sequence
atggctgacactctgccctctgagtttgatgttatcgtgattggaacaggactccccgagagtatcatcgccgcagcttgtagtcgatccgggagacgtgtattgcatgtggattctagaagttattacgggggaaattgggcttcctttagcttctcaggattgttatcctggctcaaggaatatcaggaaaacagcgacatagtgtccgatagccctgtctggcaggaccagatcctggaaaatgaggaggccatcgccttgtctcgaaaagataaaactattcagcacgtggaagtattttgctatgcatcccaggacctgcacgaggacgtggaagaagctggggctctgcagaaaaaccatgcgctggtgacctcggccaactctaccgaggccgcagatagtgcctttctcccaacagaggatgagtccctcagcactatgtcatgtgaaatgctgaccgagcagacacccagcagcgaccctgagaatgcactggaggttaacggggcagaagtaacaggtgagaaggaaaaccattgcgacgacaaaacttgtgttccatcaacgtccgctgaggacatgtctgagaatgtgccaatcgcagaggacactactgaacagcccaaaaagaatcggattacctactctcaaatcatcaaggagggccgtcgattcaacattgaccttgtgtcaaagctgttgtactcaagagggttgttgattgatctactgattaaatcgaacgtttctagatacgcagagtttaaaaatataacccgtatcctcgctttccgggaggggagggtggaacaagtaccgtgttcgagggctgacgtgtttaactcaaaacaattgaccatggttgagaaacgtatgcttatgaagtttctgactttctgtatggaatacgagaaatatccagatgagtataaagggtacgaggaaatcactttttatgaatatctgaagactcaaaaacttaccccgaacttgcagtacatagtgatgcatagcatcgcgatgacgtcggaaaccgcgagctcaaccattgacggactgaaggcaactaagaacttcctgcactgtctaggcaggtatggaaatacaccatttctatttcctttgtatggccagggagagctgccacagtgtttttgtaggatgtgcgctgtgttcggaggcatctactgcttacgccattccgttcagtgtctcgtagtcgacaaggagtcgcgaaaatgtaaagcaattatcgatcagtttggacaacgcatcatctccgagcacttcctcgtggaagattcatacttccctgagaacatgtgctcaagagtgcagtaccgccaaattagccgggcagtgctgatcacagatcgatctgtgcttaaaacagatagtgaccaacagattagtatcctgactgtgcccgcagaggagcccggtacgttcgcagtgagggtgattgagctgtgtagctctactatgacttgcatgaagggtacctacctcgttcatctgacgtgcacctcctctaaaacagctcgagaggatctcgagtctgttgttcagaagttgttcgtcccttacaccgaaatggaaatagaaaatgaacaggtggagaagccccgaatcctatgggcactatacttcaacatgcgcgatagtagcgacatatcacgatcctgttacaacgacttgccatctaatgtatatgtgtgctccggtcccgactgtggcctgggtaatgataatgctgttaaacaggctgagaccttgttccaggagatttgcccgaatgaggatttttgccccccaccacccaatccagaggatatcatactggatggtgacagccttcaacctgaggcatccgagtccagtgcgatacctgaagccaattcggagaccttcaaggaatcaactaacctgggcaacctggaagagagtagtgagtag

SEQ ID NO: 218293 - DNA, 333 bp, Artificial Sequence
  Description of Artificial Sequence: Synthetic coding sequence
atggcagatacccttccaagcgagttcgatgtcatagtgatcggaacaggcctgcccgaatcaatcatcgccgctgcctgttctagatccggtcggcgagtcctgcacgtggactcccgttcttactacgggggaaactgggcctccttctcgttctcgggattactcagttggcttaaggagtaccaggagaactccgacatcgtgagcgatagtccagtctggcaggatcaaattctggaaaatgaagaggctattgccttgagtaggaaagacaaaacaatacagcacgtcgaggtgttctgttatgccagatcgacactcctgctttag

SEQ ID NO: 218294 - DNA, 1518 bp, Artificial Sequence
  Description of Artificial Sequence: Synthetic coding sequence
atgtcctgcgagatgctcacagagcaaacgccctcaagtgaccctgaaaatgctctggaggtgaatggggcagaagtaacaggggaaaaagaaaaccattgcgatgataagacctgcgtcccaagcacgtctgccgaagatatgtcagagaatgtgccaattgccgaggatactacagagcaaccaaagaaaaatcggatcacctattcccagattataaaagagggcaggaggttcaatattgacctagtcagcaaactgctgtattctcggggtctcctcattgatctgctcataaagtccaacgtatctagatacgccgagtttaagaacattaccaggatcctcgcctttcgcgaggggagagtcgagcaggtaccctgctccagggcagacgtgtttaactcaaaacagttaactatggtggaaaaaagaatgcttatgaaatttctgaccttctgcatggagtatgagaagtatcccgatgagtacaagggctacgaggagattacattctatgaatacctcaagacgcagaaactgacgcctaacctgcaatacatcgtcatgcacagcatcgcaatgacatctgagacggcttcgagcacaattgacggtctgaaagctacgaaaaattttctgcactgtttaggcaggtacggcaatacaccatttctatttccactgtatggccagggggagcttccccagtgtttttgccggatgtgcgcggtgttcgggggaatctactgcctgcgccattctgtgcaatgcctcgtagttgataaagagagcaggaagtgcaaggctattatcgaccagttcgggcagcggatcatcagcgagcattttctggtggaagattcttatttcccggaaaacatgtgctctagagtgcagtatagacagatttcaagagccgtgctgataaccgacaggtccgttttgaaaacagactcagatcaacagatttcaattttaactgtgcccgctgaggagcccggaactttcgctgtcagggtcatcgagctgtgtagtagtacaatgacatgtatgaaaggcacatacctggttcatctgacgtgcacatctagcaaaaccgccagggaggatctggaaagcgtggtgcaaaagctgttcgtgccctatacagagatggaaattgagaacgaacaagtggagaagcctcgcatcctgtgggccctgtactttaacatgagggactcaagcgacatcagtagaagttgctataatgacctgccctccaacgtctacgtctgctccggcccagactgtggcttgggtaatgataacgcggttaagcaggcagagactttgttccaggaaatttgccctaatgaagacttctgcccccctcctcctaacccggaggatatcatcctagatggggatagcctgcaacctgaagccagcgagtcgtcggccattcccgaggccaactccgagactttcaaggaaagcaccaacctgggcaacctggaagaatcctcagagtag

SEQ ID NO: 218295 - DNA, 1971 bp, Artificial Sequence
  Description of Artificial Sequence: Synthetic coding sequence
atggcagataatctcccaacagagtttgacgtcgtgataatcggaacaggcctaccggaaagtatcctggcagccgcatgtagtagatccggccagagagtgctccatattgattcgaggtcttattacgggggtaattgggccagcttctctttttccggactgctaagttggctgaaagaataccagcaaaacaacgatatcggagaggaaagcactgttgtctggcaagacctaatccacgaaaccgaagaagccatcaccctgcgaaagaaggacgagaccattcagcatacagaagcattttgttatgcctcccaagatatggaggataacgttgaggaaattggggctctccaaaagaatcctagtttgggagtctcaaacaccttcactgaggtgcttgactcggcattacccgaggagtctcagctgagctatttcaattctgacgagatgccagcaaaacacacccagaaatcagacaccgagattagcctggaggtgacggacgtggaggagagtgttgagaaggaaaagtactgcggggacaaaacgtgcatgcatacggtgagcgataaggacggggataaggatgaatcaaaaagcactgtggaggacaaggctgatgagcctatccggaaccgtattacttacagccagatcgtaaaagagggtagacgttttaatattgacctagtatcaaagcttctatacagtcaggggttgttgatcgacctcctcatcaaaagcgatgtcagtagatacgttgaattcaagaacgtgaccagaattctggcgtttagagaggggaaggtggaacaggtgccgtgcagtcgcgctgatgtgttcaatagcaaggaactgaccatggtcgagaaacgaatgctgatgaagttcctgaccttttgtctggagtacgaacagcatcccgacgaatatcaagctttccgccagtgctctttttcagagtaccttaagactaaaaaattgaccccaaacctgcagcacttcgtacttcacagcatcgcaatgacttccgagagcagctgcaccacaatcgacgggctaaacgctacaaaaaactttcttcagtgtctaggcagattcggaaataccccttttctctttcccctgtatggccaaggagagatcccacagggattctgcagaatgtgtgccgtgtttggaggaatctactgtcttcgccacaaggttcagtgctttgtcgtcgataaagagtcaggtaggtgtaaagccatcatcgaccattttggtcaaagaatcaatgcaaaatatttcatcgtggaggactcataccttagcgaggaaacctgtagtaacgtacagtacaaacaaatctcccgtgccgtgctgatcacggatcagtctatcctgaagactgacctcgaccaacagaccagtatcctgattgtgccaccggcagagccgggtgcctgtgccgtccgagtgaccgagctttgctctagcactatgacatgtatgaaggatacttatttggtccatctcacttgtagcagttccaaaacagcacgagaggatcttgaaagcgttgtcaagaagctgttcactccctacaccgaaactgagatcaatgaggaggagctgacgaagccgaggctgctgtgggccctctactttaatatgcgggactcttccggcatctctaggtcttcttacaacgggcttccgagtaatgtctatgtttgctccggcccagattgcggattgggcaatgagcatgccgtaaagcaggccgagaccctctttcaggaaatctttccaactgaagaattttgtccacccccaccgaaccctgaggacatcatcttcgacggggatgataaacagcccgaggccccagggacaaataacgtcgtcatggccaaacttgagagctcggaggagtccaaaaatctggaatcccccgaaaaacatttgcaaaactag

SEQ ID NO: 218296 - DNA, 1641 bp, Artificial Sequence
  Description of Artificial Sequence: Synthetic coding sequence
atggagcagcgtcgagtgaccgacttcttcgccaggcggaggcctggaccaccacgcatcgctcccccaaagctagcctgccggacaccaagccctgcgaggcctgctctgcgcgcaccagcttcagccacctccggaagccgtaagcgggcaagaccacctgctgcacccggtagagatcaggccagacctccggctcgaagacggctgcgactgagtgtggatgaggtttcgtcaccgtccacgccagaggcccctgatataccagcttgcccgagcccgggacaaaagatcaagaaatctacaccggctgccggacagccgcctcacctaactagcgcccaagaccaggacaccatttccgagctggcctcttgtctgcaacgggctcgcgagctgggcgctcgcgttcgagctcttaaggcgtctgcacaggacgcgggagaatcatgcacccccgaagctgaagggagacctgaagagccctgcggggagaaggcacccgcatatcaacgttttcatgcactagctcagcccggtttgccaggtctcgtgctgccatataagtatcaggtgcttgcagagatgtttaggtccatggacacaatagtgggaatgctccacaaccgcagtgagactccgaccttcgcaaaggtgcagcgcggtgttcaagatatgatgagacgtagatttgaagaatgcaacgtgggccagattaagacagtgtaccccgctagctatcggttccggcaggaacgcagtgtgcccacattcaaggatggaactcgacggtccgactatcagctcaccatcgagccactgctcgagcaggaggcagacggcgctgcaccgcagcttaccgctagtaggctgctgcagcgcagacagattttttcccagaaattggtcgagcatgtcaaagaacaccacaaggcgttcctcgccagcttatctccggctatggtagtacccgaggaccagctgacccgttggcatcccaggttcaatgtggacgaggtgcccgacatcgaaccagctgctctgccgcaaccgcctgcgaccgagaaactgacgactgctcaggaggtactcgccagagctcgcaatttaatttcccccaggatggagaaggctctaagccagctggccctcaggagtgctgctccaagttcacccggaagcccacgcccagcgctgcctgccactccaccagccacacctcccgctgccagtccgtctgccctgaaaggtgtaagtcaggacctcctcgaacggattagagccaaagaggcacagaaacaactcgctcagatgacaaggtgccccgaacaggaacagcgccttcagcggcttgagcgtctgcctgaactcgcacgggtgcttcgctctgttttcgtgagcgagcgaaaacctgccctctcaatggaggtggcgtgtgccagaatggttggttcttgttgtaccattatgagcccaggcgagatggagaagcatttgctgctgctgagtgagctgcttcccgattggctctctcttcacaggatccggaccgatacctatgtaaagctggataaagctgctgacttagcccatattaccgctcggttggcccaccagactagggccgaagaagggctttag

SEQ ID NO: 218297 - DNA, 306 bp, Artificial Sequence
  Description of Artificial Sequence: Synthetic coding sequence
atgcaacagcagcaacaactggcaagtgctcgaaacagacgcctagcccagcagatggaaaataggccgtctgtgcaggccgcattaaagctcaagcaaaaatccctgaagcaaaggttaggcaagagcaatattcaggctcggctgggacgtcccataggcgctctcgccagaggcgcaatcgggggtcggggactccccattatccaaagggggttgcccaggggaggcctgaggggtggacgggctacccgaacactgcttcgagggggaatgtcactgagaggacaatgttgtgtgccatag

SEQ ID NO: 218298 - DNA, 672 bp, Artificial Sequence
  Description of Artificial Sequence: Synthetic coding sequence
atgctcaagaacaagcagcctacaccagtgaatataagagcttcaatgcaacagcaacaacagctggcttctgcgaggaacaggcggctagcccagcagatggagaaccggcctagcgtgcaagcggcattgaaactgaagcagagtttaaagcagaggctcggcaaaagtaacatacaagcaaggttaggcaggcctattggcgctctggctcgaggggcaatcgggggaagagggctcccaataattcaacgcggattaccccgaggtgggttaagaggcggtcgtgcgacacggacccttctgcgtggagggatgtctcttcgagggcagaacctgctacgcggaggacgcgcagtggctccaagaatggggcttcgccgtggtggggttcgaggcagaggagggcctggaagggggggactgggacgtggggctatggggagggggggaatcggcggaagaggcagggggatgatcgggagaggcagaggcggattcggcggaagaggcaggggtcggggtcggggtagaggtgccttagcccgtcccgtgttgaccaaggaacagctcgataatcagctcgatgcctatatgagcaagaccaagggccacctcgatgcagagttagacgcatatatggcacagacagaccctgaaacaaacgactag

SEQ ID NO: 218299 - DNA, 609 bp, Artificial Sequence
  Description of Artificial Sequence: Synthetic coding sequence
atggccgctcagtccgctcccaaggtggtcttgaagtcaactacaaagatgagcctgaatgagcgcttcacaaacatgctgaaaaacaagcaacccacacccgtcaacatacgtgcctctatgcagcagcaacaacagctcgcaagcgcaagaaaccgccgtctagcacagcaaatggagaataggcccagtgtgcaggccgctttgaagctaaaacagagtctgaagcaaaggctgggtaagtctaacatccaggcacggttggggaggccaataggggctctggccaggggagccattggaggtagaggccttccaataattcagcggggactgcctagaggtggtcttcggggaggccgtgcaacccgaacactgctgagggggggaatgagcttgcggggaaggggtatgattggaagaggcaggggcggttttgggggaaggggcagaggccgagggagaggcaggggcgcactggcgaggcccgtgctgaccaaggaacagctggacaaccagctggacgcatatatgagtaagactaaggggcacctggatgcagaacttgacgcgtacatggctcagactgatccagagacaaacgactag

SEQ ID NO: 218300 - DNA, 747 bp, Artificial Sequence
  Description of Artificial Sequence: Synthetic coding sequence
atggccgcacagtcagcacctaaggtggtgctgaagtctacaaccaaaatgagcctgaatgagcgcttcacgaatatgttaaagaacaagcagcctacgcctgtcaacataagagcaagtatgcagcagcagcagcagttggcctccgcacgtaaccggagactggctcagcaaatggaaaaccgacccagtgtgcaggcggcacttaagctgaagcaatccctgaagcagaggctgggaaaatcgaacattcaggcacggctcggaaggccaatcggagctctcgccagaggggcaatcgggggtaggggtctccctatcatccagcggggtctgccaagaggtggactccggggtgggagggctactaggactttgcttagaggcggtatgtcactgaggggacaaaatttgctgcggggaggtagagctgtcgctccacggatgggattgagacggggaggagtgcggggtagggggggaccaggaagaggcggattgggcagaggggctatggggaggggcggaattggaggaaggggccgtggcatgatcggtcgaggcagaggaggatttggcggtcgagggcgtggtaggggtcggggaagaggagccctagctcggcctgtgctaacgaaagaacaactagacaatcagctggacgcgtacatgtccaagacgaaggggcatctggatgctgagttggatgcgtacatggctcaaacagaccccgaaacgaatgactag

SEQ ID NO: 218301 - DNA, 609 bp, Artificial Sequence
  Description of Artificial Sequence: Synthetic coding sequence
atggctgcgcagtccgcccctaaagtggttctaaagagtacaacgaaaatgtcgctgaatgagaggttcaccaacatgctcaagaacaagcaaccaacccctgtcaatatccgagcgagcatgcagcagcagcagcagttggcgagtgcccgtaacaggcgcctggctcagcagatggagaacagaccttctgtgcaggccgcactgaaactaaagcagtccctcaaacagaggctaggcaagtcaaatattcaggctagattgggacgccctataggagctttagcacgcggagccatagggggtcggggactgccaattattcaacgcggtctgccaagaggtgggctccggggtgggagagcgactaggacactgctccgaggcggaatgagcctcagagggagaggaatgataggaaggggcagggggggatttggtggcagaggccgtggccgagggaggggcaggggtgccctggcacgccctgtgctgacgaaggaacagctagataaccagctagacgcctacatgtcgaaaacaaaagggcatctagatgcagaactagatgcttacatggcacagaccgaccccgagacaaacgattag

SEQ ID NO: 218302 - DNA, 636 bp, Artificial Sequence
  Description of Artificial Sequence: Synthetic coding sequence
atggaggagctgtcttcggtaggggagcaagttttcgctgccgagtgtattctgagtaaacgcctccgcaaaggcaagctggaatatctggtaaagtggaggggttggtcaagcaagcataattcctgggagcctgaggaaaacatcctggaccccaggttgctactcgccttccagaaaaaggagcacgagaaggaggtgcagaacaggaagaggggaaaaaggccaagagggagacccagaaagttgaccgcaatgtcatcctgctcccggaggtccaagctcaaagtgggtgggtgcgctggatatgcggatcccacaagccagcaccccttgggcgtgggcggtcggcagcgggagggcctgggaccttccgggagaggttggcatttttgccagcagagcgttcccctgcttggaaagcaagagccaccgttttttctaagtctttcgttctgttgccaagggcctcagcctgctgaaagctcttcaccccctctaccaggcgcaagctgcttctcactatcatgcacacccctatgttgggttgcgggatctaattgctgcaggcaggcgctcttcccaccgaggggcagtttgggtgacggaaaggaacaggaagcatgtgtgcaatag

SEQ ID NO: 218303 - DNA, 1599 bp, Artificial Sequence
  Description of Artificial Sequence: Synthetic coding sequence
atggaggagcttagtagtgttggagaacaagttttcgctgccgaatgtattcttagcaaaagattgagaaaaggcaagctggagtacctggtcaagtggcgaggatggtcatcgaagcataattcttgggagcctgaagaaaacatcctggatcccagactcctcctggcatttcaaaagaaagaacacgaaaaggaggtacaaaatcgtaagcggggaaagagacctagaggtcgccctagaaagctcaccgccatgtctagttgcagcaggcggtcaaaattgaaagagcccgacgccccttctaagtcaaagtcaagttcctcctcctcctccagcacttcttcctctagcagttccgacgaagaagacgatagcgatctggacgccaaacggggtccacgagggagggagacccaccccgtgcctcagaagaaggcccagatcctagtcgccaagcctgaactcaaggacccaattcggaaaaagcgaggcagaaagccccttcctcctgaacagaaggctacacggaggcctgtgtccctcgcgaaggtcttaaaaaccgcccgtaaagacctgggcgcacctgcctccaagctgcctccccctttgagtgcgcctgttgccggtctggctgccctaaaagcgcacgctaaggaggcttgcggcggaccttccgctatggcgacgcccgaaaatctggcgtcattgatgaaaggaatggcgtcttcacccggaagaggtggaatttcatggcagtccagcatcgtgcactacatgaaccggatgactcagtcccaggcccaggcagcctcaagattagcgttaaaagcacaagctacaaacaaatgtggccttgggcttgatcttaaggtgcgaactcagaaaggagaactcggtatgagcccccctggatcaaagatacctaaggcaccgtccggaggggcagttgaacaaaaagtggggaatacgggcggacctccacatactcatggtgctagtcgggttcccgctggctgccccggtcctcagcctgcccctacacaagaactgagtctgcaggtgctcgacctgcaaagtgttaagaatggcatgcccggagtggggttgctggcaagacatgccaccgccactaaaggggtgcccgcaactaaccccgcacccggaaaggggacaggctcgggcctgattggagcctccggcgctaccatgccaaccgatacctcaaaatcagaaaagctggccagtcgggctgtggctccacctaccccagcctccaaacgcgattgtgtgaagggatccgctacaccatccggacaggagtcccgcaccgctcccggtgaggccaggaaagcagcaacccttcccgagatgtccgccggagaagagtcctcatcatcagacagtgatcctgacagcgctagccctccaagcaccggacagaacccttcagtgagtgttcaaacatcacaggactggaagcccactagatctttaattgagcacgtcttcgtcaccgatgtcacagcaaacctgatcacggttaccgtcaaagaatccccaaccagcgtgggcttcttcaacctgcggcactactag

SEQ ID NO: 218304 - DNA, 1935 bp, Artificial Sequence
  Description of Artificial Sequence: Synthetic coding sequence
atggaggcagaaaggggcccagagagaagacctgccgagaggagcagtccaggtcagaccccggaagagggggctcaagccctggcggaattcgcagccctacacggacccgcactccgtgcgagtggcgtccccgagcggtactggggcagactcttgcacaagcttgaacatgaggtgttcgacgcaggtgaagtgttcgggatcatgcaggtcgaggaggtggaagaggaagaggacgaagctgccagagaagtgcggaagcagcagcccaatccgggaaacgagctgtgttataaggttatcgttactcgcgagtccggcctgcaagccgctcatcctaattcaatttttctgatcgaccacgcatggacatgtcgcgtagagcacgctagacaacagttgcagcaggtgcccggactgctccaccgtatggccaacctaatgggcattgagttccatggtgagctgccaagcaccgaggccgttgccctcgtgcttgaagaaatgtggaaatttaatcaaacataccaactggctcatggcacggctgaagaaaagatgcctgtgtggtatatcatggacgagttcgggtcccggattcaacacgcagacgtgccatcatttgccacggcccctttcttctacatgccgcagcaggtagcctacactttgctatggccacttagggatctagatacaggtgaggaggtcacccgagactttgcctacggagagactgaccccctgataagaaagtgtatgctactgccttgggccccaaccgacatgttggacctatctagctgtacgccggagccgcctgcggaacactaccaggctatactcgaggagaataaagaaaaactgcctttagacatcaaccccgttgtccacccccacgggcacatattcaaagtttacacagacgtgcagcaggtagcttcttccctgacacatccacggttcacattgacccaaagcgaggcggacgcagatatcctgttcaacttttcccattttaaggactaccggaaattgagccaggagcggcctggcgtcctcttgaaccagttcccttgcgaaaacctgttaacagtcaaagattgtctcgcgtcaattgcacgcagagccggtggccctgagggcccaccctggctgcctaggacctttaacttacggactgagctgccccagtttgtgagttatttccaacagcgggaaagatggggggaagataaccattggatctgcaagccttggaacctagctaggtccctcgacacccatgttaccaaatctttgcactctataatccgccacagagaaagcacacctaaggtggttagtaagtatatcgaaagtcctgtgctgtttctgcgggaagacgttggaaaagtcaagttcgatatacgctatatcgtactcttgcgctccgtgcgccctcttcgcctgtttgtatatgacgtcttctggctgcggttcagtaacagagccttcgcactcaatgacctggatgactacgaaaagcactttaccgtgatgaactatgacccagatgtggtgctgaagcaggtacattgtgaggagtttattccagagtttgaaaaacagtatcctgaatttccctggacagatgtccaggctgagatctttcgagcgtttactgagctgtttcaggtggcttgtgccaagccacctcccctcggattgtgcgattacccttcctctagagctatgtatgcagtagatctgatgctaaagtgggacaatgggccagatggacgtcgggtgatgcagcctcagatcctggaggtcaacttcaatcccgattgcgaacgcgcttgtaggtatcatccaacattctttaacgacgtgttctcaactcttttcttggatcagccaggaggctgccatgtcacctgcctggtttag

SEQ ID NO: 218305 - DNA, 477 bp, Artificial Sequence
  Description of Artificial Sequence: Synthetic coding sequence
atggaattgagcgccatcggggaacaggtgtttgccgtggagagcatccggaagaaacgagtgaggaagggcaaagtggagtacctggttaagtggaagggttggcctccaaaatactccacttgggagcctgaggagcacatccttgaccctcgactggtaatggcctacgaagagaaggaagagagggatcgagcctcaggatatagaaaacgcggaccaaaacccaaacgtctactcctccaagagcctcctgcgccagacgtcttacaggccgctggggagtgggaacccgcagcccagccccctgaagaggaggccgatgcggacctcgctgaggggccacccccatggactccagcattgccctcttccgaagtcacagtgactgacattaccgctaactcaataaccgtcacatttcgcgaagcgcaggctgcagaagggttcttcagagatcggtcaggcaaattctag

SEQ ID NO: 218306 - DNA, 366 bp, Artificial Sequence
  Description of Artificial Sequence: Synthetic coding sequence
atggaattgagtgctattggtgagcaggtgttcgcggtggagagtatcaggaagaagcgtgttaggaagggcaaggttgagtatctggtgaagtggaagggttggcctcctaaggaggagagggatcgggcatcgggctaccgaaagagaggccctaagcctaaaaggctcttactgcaacgattgtatagcatggatctgcgcagcagtcacaaggccaaaggaaaggagaagttgtgctttagcttaacatgccccttgggtagcggctcgccagagggcgtggtgaaggctggcgctccagagctcgtagataaaggccctctggtaccaacattgcctttcccgctgaggaagcccagatag

SEQ ID NO: 218307 - DNA, 5133 bp, Artificial Sequence
  Description of Artificial Sequence: Synthetic coding sequence
atgaacggccactctgacgaagaatccgtgagaaactccagcggtgagtcctcccagagcgacgatgatagtggcagcgccagcggaagtggtagtggatcatccagcggatcaagcagtgatggctcttcctcccagtccggatcgtcagacagtgactctggtagtgagtctggttcccagtcagagtccgagtccgatacctcccgggaaaataaagtacaggctaagcctcctaaagtggacggcgcagagttctggaagagcagcccctccatactcgcagtgcagagatccgccatcctgaaaaagcagcagcagcaacagcagcaacagcaacatcaagcgtcttctaactccgggtccgaagaggactcctcaagctcggaggactccgacgactcaagtagtgaggttaagcgcaaaaaacataaggacgaggattggcaaatgagcggcagtgggagcccatcccagtccggctccgatagtgagtccgaagaggaacgtgaaaagtcttcttgcgatgaaaccgaatcagactacgagcctaagaataaagtcaagtcgagaaagccccagaaccgcagtaagtcgaaaaatggcaaaaagattctggggcagaagaaaagacagatcgattccagtgaggaagatgatgatgaagaagactacgacaatgacaagcgcagtagcaggaggcaggccacggtgaacgtctcatataaagaggatgaggaaatgaaaacagactcagacgacctcctcgaagtgtgcggggaggacgtcccacagccagaagaagaagagttcgaaacaatcgagcgattcatggactgcaggatcggaagaaagggagccaccggcgctaccaccacaatctatgccgtagaggcagacggagaccccaatgccggattcgaaaagaacaaagaacccggagagatccagtatctgattaaatggaagggatggtcacatatccataatacttgggaaaccgaggagacgttgaaacaacagaacgtgcgaggtatgaagaaattggacaattataaaaagaaagaccaggaaaccaagcgctggctgaagaacgcaagtcctgaggacgtggaatattataattgccaacaggagctaacggacgaccttcataaacaataccagattgtagagcggattatcgcacacagcaaccagaaatcagctgctggatacccagactactattgcaagtggcaaggtttgccatacagcgagtgttcatgggaagacggggctttgatcagtaagaagtttcaagcctgcattgacgagtacttctcccggaatcagtctaagacaaccccttttaaggattgtaaagttcttaagcagcggccacgtttcgtggctctcaaaaaacaaccaagttacatcggcggacacgaaggtcttgaacttagggactatcaactgaacggcttgaattggctggctcactcttggtgcaaaggaaactcatgcattctcgctgatgagatgggacttggaaaaaccatccagacaatctcttttcttaattacctgttccacgagcaccagctgtacgggcctttcctgctagttgtccctctgagcacactgacctcctggcagcgggagattcaaacctgggcaagccaaatgaacgctgtggtctacctgggcgatattaacagtcggaacatgatccgcacccacgaatggactcaccaccagacaaagcgcctaaagtttaatatactcctaacaacttatgagattcttcttaaggataaggcgtttttggggggactcaactgggcatttattggtgtcgacgaagcgcatcgcctgaagaacgatgacagtctcttatacaaaactttgattgactttaagtcaaaccaccgcctcctgattactgggacacctctgcagaacagccttaaggaactgtggagcctattacacttcattatgcccgaaaagtttagcagctgggaagattttgaagaagaacatggaaaagggagagagtacggctatgcctcacttcacaaggagcttgagccctttctgctgcggagggttaaaaaggatgttgaaaaatctcttccggcaaaggttgaacagattctgcgcatggagatgagtgctctgcagaagcagtactataagtggatacttacccggaactacaaagccctgagtaaggggagcaagggttccacgtccggtttcctgaatatcatgatggaattgaaaaagtgctgtaatcactgctatttgattaaaccaccagacaacaatgagttctacaacaaacaggaggcactgcagcatctcatccggagtagcgggaagctgatcctgctggacaaactcctcattcgattacgggagaggggaaatcgagtcctaattttctcacagatggtccggatgctagatatactggccgaatacttgaagtaccgccagttcccctttcagcgacttgacggcagtatcaagggagaactaaggaagcaggctctagaccacttcaatgctgaggggagtgaagatttctgttttctgctgtccacgagagcgggaggtctgggtatcaatctggcaagcgcagacaccgtcgtgatattcgacagcgactggaacccgcagaatgatctccaggcccaggccagagctcaccggataggacagaagaaacaggtgaacatatacaggctggtcactaaaggtagtgtggaagaggacattttggaacgggctaagaaaaaaatggtgctggatcatctcgtgatccaaaggatggacaccaccggtaagaccgtgctgcacaccggaagcgcacccagctcatctacaccttttaacaaggaggaactgagcgcgatactcaagttcggcgcagaggagctgttcaaggagcctgagggagaggagcaggagccccaagagatggatatcgacgaaatactaaaacgagctgaaacacacgagaatgagcccggtcctctaaccgtcggcgacgaacttctttcccaattcaaggtcgcaaacttctcgaatatggacgaagacgacatcgaactggagcccgaacgaaattcgaaaaactgggaggagataattcctgaggatcagcggcgaaggctcgaggaggaggaacgccagaaggaactggaggaaatttacatgctacctcgcatgcgcaactgcgcgaaacagatttctttcaatggctcagaggggagacgatctcggtctcggagatattcggggagcgattccgatagtatctcagaggggaagaggcctaaaaagcgcggacgtccccgaacaatacccagagaaaatatcaaaggcttctcagacgcagaaatcagacggttcatcaaaagttacaaaaagttcggtggacctttggagcgcctggatgccatcgccagggatgcagaactggtcgataaatccgagacggatctgcggaggctgggggagctcgtacataacgggtgtataaaagctctgaaggactctagctctggaactgagagaaccggaggcaggcttggcaaggtgaaaggcccaacttttcggatcagcggtgtacaggtgaacgcaaaattagtgatcagtcacgaggaggagcttattccactgcacaaatcaatcccttccgatcctgaggagcgcaagcaatacaccatcccctgtcatacaaaggcagctcattttgatatagactggggcaaagaggacgatagcaacttgttgataggtatctacgagtacggatacggcagctgggaaatgatcaagatggatcctgacctttccctgacgcataaaatcctgccagatgaccctgataaaaaaccgcaggccaagcagctccagaccagagctgactacctcattaagctcctcagtcgggatttggccaagaaagaggccctttctggtgccggtagttctaaacggcgaaaggctagggctaaaaagaataaagctatgaaatccattaaggtcaaagaggagatcaagtcggatagctcaccactcccaagcgagaagtcagacgaggacgacgataagctgagtgaatctaagagcgatggaagggagaggagcaaaaagtcctccgtttcagatgcgcctgttcacatcaccgcgagcggggaacccgtgcccatcagcgaagaaagcgaggagttggatcaaaaaaccttctccatctgtaaagagagaatgcgtcccgtcaaggcagcactgaaacagcttgacaggcctgagaagggcttgtctgagagagaacagctagaacacacccggcagtgtttaatcaagatcggcgatcacatcactgagtgtctgaaggagtacacaaacccagagcaaatcaagcagtggcgtaagaacctctggatttttgtttcaaagttcacagaatttgacgccaggaagctacataagctttataagcatgccattaagaagcgccaggaatctcagcagaattccgaccagaactccaatcttaacccccatgtgattcgtaacccagatgtggaacggctgaaggagaacactaaccatgacgattcctctcgtgattcttactctagtgatagacatttgacgcagtaccacgatcatcacaaggatcgacaccagggagacagctacaaaaagtccgactcacggaagaggccatactcaagcttctcgaatgggaaggaccaccgcgactgggaccactataagcaggacagccgctactattccgacagggagaagcatcgtaaactcgatgaccatcggagccgggatcacagatccaacctggagggctctctgaaagataggtcacatagtgaccatagatctcactccgatcatagactgcattctgaccatcgatcctcatcagagtacacccatcacaaatcctcacgtgactaccgctaccattcggactggcaaatggaccatcgcgcttctagctcgggcccacgatctcccctcgatcagagaagtccttacgggagccggtccccctttgaacattccgtcgaacacaagtccacgcctgagcatacctggagctcccggaagacctat

SEQ ID NO: 218308 - DNA, 903 bp, Artificial Sequence
  Description of Artificial Sequence: Synthetic coding sequence
atgttcagctttactggggtcctggtaatctacgaggtcttaaaaaaatgcatagggaaacttatttcactgcgggtatgtagtattgaaggttgtgtatgtgtctatgtgttcgttcctggagggaaagagttccacgagaaactcaacatattccaccagactaatctgatctgtctctttcttaattcctccaggaacttatggatctttgtttctaagtttaccgagttcgacgcccgaaaactccacaaactgtacaaacacgccatcaagaagcggcaggagtcccagcagaactccgatcaaaattcaaatcttaacccacacgtgatccgcaacccagacgtggagaggctgaaggagaacaccaaccatgacgacagctcaagagactcttactcctccgaccgccacctgactcagtaccacgaccatcacaaggacagacatcaaggcgactcctacaagaagtcagattcccgaaaaagaccctacagctccttttccaacggaaaagatcacagagactgggaccattacaaacaggattcgcgttactattcagaccgggaaaaacacagaaagctggatgatcaccggtctagagaccatcggtctaatctcgaaggatctcttaaggaccggtctcactctgatcatcgttcccatagcgaccatcgtctgcactccgatcatcggtcatcttctgagtatacacatcacaaaagctctcgcgattacagataccatagcgattggcaaatggaccacagggcttctagcagcggtccgaggtcgccactagatcaaaggtccccctatgggagtagatcgcctttcgagcattccgttgagcataaaagcactcctgaacacacttggagcagcaggaaaacctag

SEQ ID NO: 218309 - DNA, 624 bp, Artificial Sequence
  Description of Artificial Sequence: Synthetic coding sequence
atgaacggacactctgatgaggagtccgttcgtaacagttccggcgaatcatcccagtccgacgatgatagcgggtctgctagcggcagcggcagtggctcgtcatccgggtcttcgtcggacgggtccagttctcaatcaggatcatctgattcagactccggcagcgagagcgggagtcaaagcgagtctgagtcggataccagccgcgagaataaagtgcaggcgaaacctcctaaggtcgacggagcagaattctggaaatcctcccccagcattcttgctgtccaacgttccgctatcctgaagaaacagcagcagcagcagcagcaacagcagcaccaggcaagttccaatagtgggagtgaggaagatagctcctcttcagaagattctgacgacagtagcagcgaggttaaacgaaaaaaacataaagatgaagattggcagatgtccggttctggttcaccctcccagagcgggagtgactctgaatctgaggaggagcgagagaagagcagctgcgatgagaccgagtctgattacgaaccaaagaacaaggtgaaatcccggaaaccacagaaccgttctaaatctaaaaacgagaagaagaaaaagaagtag

SEQ ID NO: 218310 - DNA, 660 bp, Artificial Sequence
  Description of Artificial Sequence: Synthetic coding sequence
gtcggcgcagatagggactcaccaaccctgctacccgcaggaggctccaactggttagctcagaggttccactgccagaatggttgcatactgggggatgagatggggttgggcaagacttgtcagacaatcgcactcttcatttacctcgcaggtcgtttaaatgacgaaggaccgtttcttatcctctgccctctgagtgtagagcagctcgaaaggagaaatgctgagatatgctcacgttcctttctgtgcaacatctgtggggataaagaggaacgggcttgtctccagcaggacctgaaacaggagagtcgtttccacgtgcttctgaccacatatgaaatttgcctgaaggatgcatcatttcttaagagctttccatggtccgttctggtcgtggacgaggcacatcggttgaaaaatcagtctagcctcctgcacaaaacactgagcgaattctctgttgtgttctcattgctgctgactggcacccccatacaaaactcattacaggagctgtactccctcttgagcttcgttgagccagatcttttttctaaggaagaatgggaaatccttttcaacgccacacgcatactgcgaaagaatttatcccagcaggttaattgcaccaattcttgtagccacttctgctag

SEQ ID NO: 218311 - DNA, 1851 bp, Artificial Sequence
  Description of Artificial Sequence: Synthetic coding sequence
atgtccgccctacagaaaaaatattacaaagctatccttatgaaggacttggacgcgtttgagaacgaaacagccaaaaaggttaagctacagaatattctgagccagctccgaaagtgtgttgatcatccgtacctgttcgacggtgtagaaccagagcccttcgaggtgggagatcatctcacggaggcctcaggcaagctacatttgttggacaaactattggctttcctctactcaggtggtcatcgagtgctgctattctctcagatgacacaaatgcttgacatacttcaggactatatggattatcgcggatactcttatgaaagagtggacgggtccgtacgcggagaggagcgtcacctggcaattaaaaatttcggccagcagccaatctttgtgttcctgttatctacacgggctggcggagtcggaatgaacctcaccgccgcagacaccgtcattttcgtggacagtgatttcaatccccaaaatgacttgcaggcggctgcgagagcccacagaataggccagaacaaatccgttaaagtgattcgacttattggacgggatactgtcgaggaaatcgtgtatcgtaaggcggcttccaaactccaattaactaatatgataattgaaggaggccatttcaccctgggcgctcagaaacctgctgcggatgccgaccttcagctgtctgaaattctgaagttcggccttgacaaattactcgcgagtgaggggtccacaatggatgagatcgacctggaatctatccttggggagacgaaagacgggcagtgggtctcagatgcactgccagccgcagagggcggatcaagagaccaggaagaggggaagaaccacatgtatttgtttgagggtaaagactattccaaggaaccttctaaagaggaccggaagtcctttgaacagctggttaacctgcagaagaccctcctggagaaagcttctcaggaagggcgatcactccggaataaaggatcagtgctgattcctggactggtggaagggtctaccaagaggaagcgggttctgtctcctgaagagctcgaggatcgtcagaagaagcgacaggaggctgctgccaagcggaggaggctgattgaggagaaaaaacggcaaaaagaagaggccgagcataagaaaaaaatggcctggtgggaatcaaataactaccagagtttttgcttacctagtgaggagtccgaacctgaggacttggaaaacggggaagaatctagtgctgagcttgactaccaggatccagatgccacaagccttaaatacgtgagcggtgacgttactcatccacaagccggtgcggaggatgccctgatcgtgcactgtgtcgatgattccgggcattgggggaggggcggtttattcaccgctctcgagaagagaagcgccgaacctagaaaaatatacgagctggctgggaagatgaaggacctgtccctcgggggagtcctgctgttccccgtggacgacaaagaatctcggaataaaggacaggacctccttgccctgattgtggcccagcatagagaccgctctaacgttctgtcggggattaagatggcagccttggaggagggtctcaagaagatcttcctggccgcaaagaagaaaaaagctagcgtgcatctaccgcgaatagggcatgccactaaagggtttaattggtacggcaccgagcgacttatcagaaagcatttggcggcaaggggaatcccaacctatatatactatttccctaggagtaaatcggcagtcctgcacgctcagtcgtcttcctcctcaagtcggcagctcgttccctag

SEQ ID NO: 218312 - DNA, 2694 bp, Artificial Sequence
  Description of Artificial Sequence: Synthetic coding sequence
atggaacgggcaggcgctacttcccgtggcggacaagcacccggatttcttctgcggctgcacaccgagggccgtgccgaggcagcccgtgtgcaggagcaggatctgcgacaatggggcttgaccggaattcacctcaggtcctaccagttagaaggagtgaactggttggcccaacgtttccactgtcaaaacgggtgtatccttggtgatgagatgggactgggaaagacatgtcaaaccatagccctctttatttacttagcgggaaggttgaatgatgaagggcctttcttgatcctctgcccgctgagcgttctttccaattggaaagaggagatgcagcgttttgctccaggcctcagttgtgttacctacgccggagataaggaagagagagcgtgtctccaacaggaccttaaacaggagagccggttccacgttcttctgactacatacgaaatttgtctcaaagacgccagctttctcaagtccttcccatggtcagtgcttgtagtcgatgaggcacatcggcttaagaaccagagtagcctccttcacaagaccctttctgaattttccgtggtttttagcctgctcctgacgggcacaccgattcagaatagcctacaggagctgtactccctcctgagcttcgtggagcctgatttgttctccaaggaagaggtgggagactttatacagaggtatcaagatatcgagaaagagagcgagagtgcaagcgagctgcacaaacttctgcagccctttctgctacgtcgcgtaaaggcagaagtagccaccgaactgccgaaaaagacagaggttgtaatctatcacggcatgtcagctctacaaaagaagtactataaagccatcctgatgaaagacttggacgccttcgagaacgaaactgccaagaaggtcaagctgcagaacattctgtcccagctcaggaaatgtgttgaccatccttacttgtttgatggagtggagcccgaaccttttgaagtaggggaccatttgaccgaggccagtgggaagctccatcttctcgacaagctgctcgcttttctctattccggtgggcatcgtgtcctcctgtttagccagatgacccagatgttagacatcttgcaggactacatggactataggggttattcctatgaaagggtggatggtagcgtgcggggtgaagagaggcacctggcgataaagaacttcgggcaacagcccatcttcgtcttcttgctatctacaagagctggtggcgtcgggatgaatctcactgcggctgacacggttatcttcgtggattctgattttaatcctcagaatgacctgcaggccgcagcgcgagcgcatcgcattggccagaataagtctgtgaaggttatcagactgataggcagggacaccgtggaagagatagtgtatcgcaaagctgcatcaaagttacagctgaccaacatgattatagagggtggacactttacccttggcgcacagaagcccgcagccgacgccgatctgcaactcagcgaaatcctgaagtttggtctggacaagctactggccagtgaagggtctactatggacgagattgacctggagtccatacttggtgagaccaaggacggccagtgggtctctgacgctctccccgcagcagagggcggttcgcgcgaccaggaggagggcaaaaaccatatgtaccttttcgagggaaaggattactcaaaggagccaagtaaggaggatcggaagtccttcgagcagctggttaatctgcagaaaaccctgctggaaaaagcgtcccaggagggtaggtctctgaggaataaaggcagtgtcctcattccaggattggtggaaggctcaacgaaaagaaagagagtcctgagccccgaggaattagaggaccgccaaaagaaacgccaggaagccgcagccaagagacgacgcctgatcgaagagaaaaagcgacagaaagaggaagccgagcataaaaagaaaatggcatggtgggaatcaaacaactaccagtctttttgcctaccctcagaagagagtgagcccgaagatcttgaaaatggggaggagtcaagtgctgaactggactatcaagaccctgacgctacctctttaaaatatgtctccggtgacgtcactcatccgcaggcaggagccgaggatgccctgattgtccactgtgtcgatgattcggggcactggggtagagggggtctgtttaccgccctggaaaaaagaagcgcagaacctagaaaaatttacgagttagcaggcaagatgaaagatctctctttggggggtgtcttactttttcctgtcgacgataaagaatcacgaaacaagggccaggacctcttagcactgatcgtcgctcaacatagagaccgctcaaatgtgctgtctggtattaagatggcggcactggaagagggtcttaagaaaatttttctggcggcaaaaaagaaaaaagctagtgtgcatctgccccgtatcggccatgcaaccaagggatttaattggtatggcacggagagacttattagaaagcatctggccgctcggggaatccccacctacatatactacttcccaagatcaaaatcagccgtactgcacgcccagagttcctctagcagttcgcgacaattggttccttag

SEQ ID NO: 218313 - DNA, 2082 bp, Artificial Sequence
  Description of Artificial Sequence: Synthetic coding sequence
atggaaagagccggagccaccagccggggaggccaggcccctggatttcttttgagactgcacacagaaggaagggcagaggccgcaagggtgcaagagcaggatcttcgacagtggggcttgacagcgtcggagctacataaactcctccagcctttcctgctgagaagagttaaggccgaggtggcaacggaactcccaaaaaaaactgaagtggtgatttaccacggaatgagtgctctccagaaaaagtactataaagctatcctgatgaaggacctagatgccttcgaaaacgagactgccaaaaaggtgaaactgcagaacatcctgagccaactacggaagtgcgtggatcacccatatcttttcgacggagtggaaccggagccctttgaagtcggtgaccacctcaccgaggctagcggcaagctccacctcctagacaaactgctggcatttctatattctgggggtcacagagtcctactgttttctcaaatgacgcagatgctcgacattcttcaggactacatggactataggggttactcatatgaaagggtggatggcagcgtgcgtggagaggaacgtcacttagcaattaagaacttcggccagcagcccatcttcgtgtttctgttaagtacccgggctggcggagtcggtatgaatctgacagcagccgatacagttatattcgtcgacagtgacttcaacccccaaaacgatttgcaggccgcagcacgggctcatcgaatagggcagaacaaaagtgtgaaagtgatacgcctcatcgggagggataccgttgaagagattgtgtatagaaaggcagccagcaaactgcagctcacgaacatgatcatcgagggaggtcattttacccttggagcccagaagcctgccgcagatgctgatttacagttgtccgagatcctgaagtttggactggacaaacttctggctagtgaggggagtacaatggatgagatcgatttggagtcaattctgggcgagacaaaagacgggcagtgggtcagcgatgcccttcctgcggcagagggtggcagtagggatcaggaagaaggtaagaatcacatgtacttatttgaggggaaagactattccaaagagccgagcaaagaggaccgcaagtcattcgagcaactggtcaatctccagaaaacattgctcgagaaggcctcacaggagggtaggagtcttaggaacaaagggagcgtgctgattccaggccttgtggaaggctcaactaaacggaaacgggtactgagcccagaggaactggaggatcgccagaagaagaggcaggaggctgcggctaagcgcaggcgcttaattgaggagaaaaagaggcagaaggaggaggcggaacataaaaaaaagatggcctggtgggagtccaataattaccagtctttctgtctgccctcagaagaaagtgaaccagaggacctcgaaaacggagaggagtctagtgccgagctcgactaccaggatcctgacgccacatcactcaagtacgtcagcggagacgtgacccacccccaggccggagccgaagatgccctgattgtccactgtgtcgatgattcaggacactggggcagaggaggactgtttacagccttagaaaaaagatctgcagaaccacgcaaaatctatgagctggccggtaaaatgaaggacctgtcccttgggggtgtcctgctgtttccggtagacgacaaggagtcacgtaacaaagggcaggacctgctggctctgatagtcgcacagcatcgcgacaggtcaaacgttctctctggaatcaagatggcggcacttgaagagggcctcaagaaaatctttctggccgctaaaaaaaaaaaagccagtgtccatcttcccagaatcggtcatgccaccaagggatttaattggtatggcaccgaaagactgatcaggaagcacctggccgctagaggcatccccacatacatctactatttcccacggtcaaagagtgcagtgcttcatgcccagtcgtctagcagctcttcacgccagctggtgccctag

SEQ ID NO: 218314 - DNA, 2412 bp, Artificial Sequence
  Description of Artificial Sequence: Synthetic coding sequence
atggagagggcaggagccacatcccggggagggcaggcacccggtttcctgttgagactacacaccgagggtcgtgccgaagctgcgcgagtgcaggaacaggacctcagacagtggggcctgaccgggatccatctcaggtcttatcagctcgaaggtgtaaactggctggcccagaggttccattgccaaaacggctgtattctgggcgatgaaatggggctgggaaagacctgtcagaccattgcactgtttatctatttagcgggtcgactcaacgatgaaggtccattccttatcctgtgtcctttgtcagtgctaagcaactggaaagaggagatgcagaggttcgcacctgggctttcatgtgtgacctacgcaggcgacaaagaggaacgggcttgcttgcagcaagatctaaagcaagaatccaggtttcatgtgttgctgactacatacgagatctgcctaaaggatgcctctttcttgaagtccttcccttggagcgtcctggtggtggacgaagcgcatcgcctgaaaaaccaatccagtttactccataagaccctttctgagttttccgtggtcttttccctgcttttgacgggcacccctatccaaaattctttgcaggagctgtactcactgctgtcgtttgtcgaacctgatttgttctccaaggaagaagtgggagattttatacagcggtaccaggatatcgaaaaggagagtgaaagtgcatccgaattgcataagctgctccagccctttctcttgagacgcgtgaaggccgaagttgctacagagcttcctaagaaaaccgaagttgttatttatcatggcatgtcagccctgcagaagaagtactataaagccatattgatgaaggacctcgacgcgttcgaaaatgagaccgccaagaaagtaaagctgcagaatatcctgtctcagctccgtaagtgcgtggatcatccctacctcttcgacgggggtgttgggatgaacctcactgccgcagacaccgtcattttcgtggacagcgacttcaacccccagaacgatctccaggccgctgcccgagcccatcgaatcgggcagaacaagtcagtgaaagtcatcaggctgataggtagagacactgtggaagaaatcgtctatcgaaaggctgctagcaaactacagctcaccaacatgatcatcgagggcggacattttaccttaggggcacagaaacctgccgctgacgccgacctgcagctgtctgagatcttgaaatttggtctcgacaaactactagcctccgagggatccacaatggatgagattgacctcgagtcaattcttggtgagaccaaggacgggcaatgggtctctgatgctcttccagcagccgagggcggtagccgcgatcaggaagagggtaagaatcatatgtacctgttcgagggtaaggattactctaaggagccctctaaggaggatcggaagtcctttgagcagttagtgaatcttcaaaagaccctcctggagaaagccagccaggagggccgttcgcttcggaataagggatccgtactgatcccagggctggtggaaggcagtacaaaaaggaaacgagttctatcaccagaggaacttgaagacagacagaagaaaagacaggaggcagcagctaaacggagaaggcttatcgaggagaagaagcggcaaaaggaagaggccgagcataagaagaagatggcttggtgggaatctaataattaccagtccttctgcctgccctccgaggaaagcgagccggaggatctcgagaacggagaagagagctctgcggagctggactatcaggatccagacgctacctctctgaaatatgtatctggcgatgtgacacacccacaagccggagccgaagacgccttgattgtacattgtgtcgatgatagtgggcactggggacgtggcggattgtttactgctctggaaaagaggtccgcagagccacgcaaaatctatgagctcgcaggcaaaatgaaggatctgagccttggcggagtgttactctttccagtagatgacaaggagagcaggaacaagggacaagacctactagccctgatcgtggcccagcaccgcgaccgatccaatgtactgtccggaattaagatggcagccctagaagaaggcttaaagaaaattttcctggcagccaagaaaaaaaaggccagtgttcatctgcctcggataggccacgcaactaagggcttcaattggtatggaaccgagcgcctgatccgcaagcatttagcagcccgtgggattccgacatacatctattattttcccagatccaagtccgccgtgctgcatgcccaaagctcgtcttcctcttctagacagctcgtgccttag

SEQ ID NO: 218315 - DNA, 1305 bp, Artificial Sequence
  Description of Artificial Sequence: Synthetic coding sequence
atggccgtcagctgggagatgcgttgggcgtggggtcgtccagcacggttcgctccaggtctttcatgtgtcacttacgcaggcgacaaggaggaaagagcctgcctgcagcaagacttgaagcaggaatccagattccatgttttacttaccacttacgagatctgtctcaaagatgcttcttttctgaagtccttcccgtggagtgttctggtcgtggacgaggcccacaggctaaaaaaccaatcgtcccttcttcacaagactttatccgagttcagcgtggtgttctctctgttgctcaccggaacccctattcagaactcattacaggagttatactctttgttaagcttcgtggagcccgatctcttctccaaggaagaggtaggcgatttcatccagagatatcaagacattgagaaagagagtgaatctgcatcagagcttcacaagctgctccagccgttcctcctgaggagggtcaaggccgaagtcgcaactgaactgccgaagaagaccgaggtggttatttaccacgggatgagcgcattgcagaagaaatactacaaggcaatcttgatgaaagaccttgacgccttcgaaaatgaaactgccaaaaaggtgaaacttcaaaatatactaagccagctccgcaagtgcgtcgaccatccctatctgtttgacggtgtggaacccgagcccttcgaggtgggcgaccacctgacagaggcgagcgggaagctgcacctcctggacaaactgttggcctttctctacagtggagggcatagagtgcttctcttttcgcaaatgacccagatgctggacattttgcaggattacatggattaccgtggctactcatatgagcgcgtggacgggtccgtccgaggcgaggagcgccacctggctattaagaacttcggccagcaaccgatatttgtctttctgcttagcacccgtgcaggaggcgtgggcatgaacttaactgccgcagataccgttattttcgtggatagcgactttaatccacaaaatgatttgcaggctgcagctcgcgctcacaggatcggccagaataaatccgtcaaggttattagacttattggtagggacactgttgaggagatcgtgtacagaaaagccgcttcaaagctccagctcactaatatgatcatcgagggcggtcatttcaccctcggtgcccagaaacccgctgcagacgccgacctgcaggtgagatatagcaacttagtgtggatcaactgctggcccctgcgtggagccccttggatgaagtag

SEQ ID NO: 218316 - DNA, 5486 bp, Artificial Sequence
  Description of Artificial Sequence: Synthetic coding sequence
atgatgcgcaacaaggacaagagccaggaagaggactcaagtctgcacagcaatgcgtcatctcacagcgcaagcgaagaggcaagtgggagtgactctgggtcgcagtctgaatcagagcaggggtcagatcccggttccgggcatggaagtgaatccaattctagttcggaaagctccgagagccagtccgaatcagaatctgagagcgcagggagtaaaagccaacctgtgttaccagaggcgaaggaaaaacctgcttccaagaaggagagaatagcggatgtaaagaaaatgtgggaggagtatcccgacgtgtacggagtgcggagaagcaatagatcccggcaggaaccttcacggtttaacatcaaagaagaggccagcagcggcagtgagagtggatctccgaagcggagaggccaaagacaactgaaaaagcaggaaaaatggaaacaggaaccaagcgaggacgaacaggaacagggcacgtccgcagagagcgagcctgaacaaaagaaagtgaaggctcggcgacctgttccccgacgcacagtccctaaaccaagggtgaagaaacagcccaagactcagcgcggtaagcgcaagaaacaggattcaagcgacgaggacgacgacgacgacgaagcacccaaacggcaaacaagacggagagccgcaaaaaatgtgagctataaggaagatgacgattttgaaaccgacagcgatgacctgattgaaatgaccggggagggcgtggatgaacagcaggacaatagcgaaacaatcgagaaggtgttggatagcaggttgggcaaaaagggagccaccggtgcttcaacaactgtgtacgccattgaggctaacggagacccctctggtgatttcgatactgagaaagatgaaggagaaatccagtatttaatcaaatggaagggctggtcctatatccacagtacttgggaaagcgaggagagcctccaacaacagaaagttaagggcctgaaaaaactcgaaaatttcaagaaaaaagaagatgagatcaagcagtggttaggcaaagtgtcgcctgaggacgtggagtattttaactgtcagcaggaactcgcgtccgagctgaacaagcagtatcagatcgtcgagcgggtaatcgcagtcaaaacgtccaaatctaccctgggccaaacggacttcccggctcattcaaggaagcctgccccatccaacgagcccgagtatctctgtaaatggatgggcctgccttactctgagtgctcctgggaggatgaagccctgatagggaaaaagtttcagaactgcatagactctttccactcaaggaataacagcaaaactatccctaccagagagtgtaaggccctcaaacagcgaccacgcttcgttgcgctgaagaagcagccggcttacctgggaggggaaaacttggagctgcgcgactatcagcttgaggggctcaactggttggcccactcctggtgtaaaaataattctgtgatactcgcagatgaaatgggcctcggcaaaacgatccagaccatctcttttctgtcttatttgtttcatcaacaccagttgtacggcccattcctgatcgtcgtgccactcagtactttaacaagctggcaacgggaatttgagatttgggcccctgaaatcaatgtggtggtatacattggggatctgatgtctcgaaatacgatccgagaatatgagtggatccacagtcagaccaagagactcaaattcaacgcgcttatcacaacatacgagatcctactcaaggacaagaccgtcctgggctccattaattgggcctttctcggtgtggacgaggcccatcggctcaagaacgatgactctttattgtacaaaactctgatcgattttaagtccaaccaccggctcctcattaccggtacaccattgcagaacagtctaaaggaactgtggagcctgctccattttattatgcccgaaaagtttgaattttgggaggacttcgaggaggaccatggaaaggggagagagaatgggtaccaatcactgcacaaggttctcgagccatttcttttgagacgcgttaagaaggatgtagaaaaatcccttccagcgaaggttgagcaaattttgcgggttgaaatgagtgccttgcagaaacagtattataagtggatcctcaccagaaattataaagcacttgccaaaggcacccgcggaagcacttccggctttctaaacatcgtgatggagctgaagaaatgttgcaaccactgctacctgattaaacctccagaggagaacgagcgggaaaatggtcaagagatcttgttgagcttaattagatcctctgggaagctgattctacttgacaagctgctgaccaggctcagagagcgagggaaccgcgtgctgatcttcagccagatggtgcggatgcttgatattctcgcagaatacttaaccattaaacactatccttttcagaggctcgatgggtcaatcaaaggcgagattaggaaacaggcactcgaccattttaacgccgatggatctgaagatttctgcttcctgctatctacccgggctggcggactgggcatcaatctggcttctgccgataccgttgtcatattcgattctgattggaaccctcagaacgatctgcaggcccaagcgagagcgcataggattggacagaaaaagcaggtgaatatttaccgcctggtgaccaaggggacagttgaagaagagatcatagagagagctaagaaaaagatggtgctcgatcacctagtgatccagagaatggacacaactggccgaactatactggagaataattcgggcaggagcaactctaacccattcaataaggaggagttaacagccatcctcaagttcggggctgaggatctgtttaaagagctggaaggcgaagagtccgaaccacaggaaatggacattgacgagattctgcggctggccgaaacacgggaaaatgaagtgtcaacctccgcaactgacgagttattgtcacagtttaaggtggcaaatttcgctactatggaagacgaggaggaactggaagaaagacctcataaagattgggacgaaatcatccctgaggagcagcggaaaaaggttgaagaggaggaacggcagaaggagctggaggagatttatatgctgcccagaatccgatccagtaccaaaaaggcccaaacgaacgattctgactccgacacagagtctaagagacaagcccagagatcttctgcctcggagagcgaaaccgaggactcggatgatgacaagaaacccaaaaggagggggcgacccaggtcggtgcgcaaggaccttgttgaggggtttactgatgccgaaatacggaggtttatcaaggcctataagaagtttggtctgcctttggagaggcttgagtgtatcgcacgagatgccgagctggtcgataaaagtgttgctgatctgaagcggttgggagaactaattcataacagttgtgtttccgctatgcaggagtatgaggagcagctgaaagagaacgcgtccgagggcaaaggccctggaaagaggcgaggcccaaccatcaagatctcgggtgtgcaggttaacgtgaaaagtattatccagcacgaagaagaatttgagatgcttcacaaatccatccccgtagatccggaggaaaaaaagaagtactgtctcacttgtagggtgaaggctgctcacttcgacgtggaatggggtgtagaggacgatagtagattgctgttgggaatctatgagcatggatacggtaactgggagttaattaagaccgatcctgaacttaagctgaccgacaagatcctccctgtggagacagacaagaaaccccaaggcaagcagctgcagaccagagctgactacctcttgaagctgctccggaagggactggagaaaaaaggcgcagtaacagggggtgaagaggcgaaattaaaaaaaaggaagcctcgggtgaagaaggaaaacaaggtgccaagattgaaagaagagcatggaattgagttatctagtcccagacactctgacaatccaagcgaggagggcgaagtgaaggatgacggactggagaagagtccaatgaagaagaaacagaagaagaaggaaaataaagagaacaaggaaaaacagatgagctcaagaaaggacaaagaaggcgataaggaaaggaaaaaatcaaaggataagaaggagaagcccaagtcaggcgacgctaaaagcagttccaagtccaaacgcagtcagggtccagtccacatcactgccggatcagagccagtgcctataggcgaagacgaggacgatgacctggatcaggagaccttttctatttgcaaggagcgtatgagacccgtaaagaaagctctgaagcagctggacaagcccgataagggactgaatgttcaggaacagttagaacacaccagaaattgcctgcttaagataggggaccggatcgccgagtgtctgaaagcctattcagaccaggaacacatcaagttatggcggcgtaacctgtggatttttgtgagcaagtttacggaatttgacgcccgaaaattacacaaactatacaaaatggcccacaagaagcgctctcaagaggaagaggaacagaagaagaaggatgatgtgaccggcggaaagaaaccatttagacccgaagcgtccggaagctccagggactctctgatctcccagagtcatacctcacataacctgcacccacaaaaaccccatctgcccgcatcacatggccctcagatgcacggccaccctagagataattataatcacccgaacaagagacatttttcaaacgctgaccggggagattggcagagagagcgcaagtttaattacgggggtggcaataataatcctccgtggggatctgataggcatcaccagtacgaacagcattggtacaaagaccaccattacggggatcgtcgccatatggacgcgcatagatcgggctcatatcggccaaataatatgtcgcgaaaaaggccctacgaccagtattcctccgatcgcgatcacagaggtcatagagattactatgaccgtcaccatcatgactctaagcgtcggcgtagcgacgaattccgcccacaaaactatcatcagcaggatttccggagaatgtctgatcataggcccgctatgggctatcacggccaaggaccttcagatcattatagatcatttcataccgataagctgggcgaatataagcagcctttgccacctttacacccagctgtatccgatccaagatcgccgccttcacagaaatcccctcatgactctaaatccccattggaccaccgctccccactcgagagaagcctggaacagaagaacaatcctgattataattggaacgtgcgaaagactta

SEQ ID NO: 218317 - DNA, 1506 bp, Artificial Sequence
  Description of Artificial Sequence: Synthetic coding sequence
atgatgcgcaacaaggataagtcccaggaggaagactcatcgctgcactcaaatgctagctctcattcggctagcgaggaagcaagcggcagtgactctggctcgcaatccgaaagcgaacagggatccgatcccggatcaggccatggctccgaatcaaatagtagttctgagtcctccgagagccagagcgaatcagaaagcgagtccgcagggagcaagtcccaacctgtgctacccgaagcgaaggagaaacccgcttccaagaaagaacgaatcgcagacgtaaaaaagatgtgggaggagtatccggacgtatacggggttcggagatcaaatcggtcaaggcaagagcctagccgcttcaacatcaaagaggaagcgtcctctggatccgagtctggatcccctaaacggcgtggccagcgacagctgaagaaacaagagaaatggaaacaggaaccatctgaggacgagcaggaacaaggtactagtgccgaatctgaaccagagcagaagaaggtgaaggccaggcggcctgtgcccaggagaaccgtgcccaaacctcgagttaagaagcagcctaagactcagagaggcaaacggaaaaagcaggatagctcagatgaggacgacgatgatgatgaggcccctaagaggcagacgagaaggcgagcagccaagaatgtctcctataaggaggatgatgacttcgaaaccgattctgatgatctgatagagatgaccggcgagggcgtagacgaacagcaagataatagcgaaaccatcgagaaagtgttagactcccgtctgggaaagaaaggcgctaccggtgcctctactactgtgtacgccattgaggcaaacggggaccccagtggtgactttgatactgagaaagacgagggcgagatccagtatcttatcaaatggaaggggtggagctatattcattccacctgggagagtgaagagagtcttcagcagcagaaagtcaagggcctgaagaaattggaaaactttaaaaagaaggaagacgagattaagcagtggctcgggaaggtaagccccgaggacgtggaatacttcaactgtcagcaggaactggccagtgagttgaataagcagtatcagatcgtggagcgggtaattgcagtcaaaacgtccaagagtacactgggccagaccgacttcccggcacatagtcggaaacctgcccctagtaacgaacctgagtacttgtgcaagtggatgggactgccttatagtgaatgttcatgggaggatgaagctctgatcggcaagaagttccagaattgcatcgattcctttcattcacgcaataactccaagactatacctaccagagagtgtaaggccctgaagcaaaggcccagattcgtagcactcaaaaagcaaccggcatacctgggcggtgagaatctggagctgagagattatcaattagaggggttaaattggctggctcattcctggtgcaagtag

SEQ ID NO: 218318 - DNA, 1545 bp, Artificial Sequence
  Description of Artificial Sequence: Synthetic coding sequence
atggctcacaagcagagggaagactacctgaatctctcaccctgcgtctttacctggtacaggacattttcccagctggcgtttgatggggagaagctgagtcactccgcatccgaggaagccagtggttccgactccggctcacaatccgagtccgagcagggctcggatccaggttccggacatgggtccgaaagcaacagctccagcgagagctccgagtcccagtcggagagcgagagtgagtctgctggcagcaaaagccagccagttctccccgaagcaaaggaaaagcctgcgtctaagaaggagcgaattgccgatgtgaagaagatgtgggaggagtatcctgacgtgtacggcgttagacgatcaaataggagccggcaagagcctagtcggtttaacattaaagaggaagcgagctccggatctgagtccgggtcaccgaaaaggagaggacagagacaactcaagaagcaggaaaagtggaaacaggagccaagcgaagacgagcaggaacagggcacctcggctgagagcgaacccgaacagaaaaaggtgaaagcgaggaggcctgtgccaaggcggactgtgccgaaaccgagggtcaagaaacagcccaaaactcagaggggcaagcgcaagaaacaagattcttcagacgaggacgatgatgatgacgaggcaccaaaacgacaaacccgtagacgagcagcaaaaaacgtgagctataaggaggatgatgatttcgagacagacagtgacgatcttatcgagatgaccggggagggcgttgacgaacagcaggataattccgaaaccattgagaaggtcctagattcaaggctgggcaaaaagggggcaacgggcgctagcactacagtttacgccattgaagcgaatggcgatcccagcggcgacttcgacactgagaaggatgagggagaaatccaatacctgattaagtggaagggttggtcgtatattcatagtacgtgggagagcgaagagtctctgcaacaacagaaagttaaaggcctcaagaagcttgaaaattttaagaagaaggaggacgaaattaaacagtggctgggcaaagtcagcccagaagacgtagagtatttcaattgtcagcaggagctcgctagtgaactgaacaaacaatatcagattgtggagcgggtgatcgctgtgaagactagtaaatctacactgggccaaaccgatttccctgcccacagccgcaagccagctcccagcaatgaaccggagtatctctgcaaatggatgggcttgccctacagcgagtgctcctgggaagacgaagccttgatcggaaaaaaattccaaaactgcattgacagtttccactcgcggaacaatagcaagaccattcccacaagggagtgcaaagcactaaaacaaaggccccgtttcgtcgcgttgaagaagcagcccgcttatcttgggggagagaaccttgagctcagggattaccagctcgaggggcttaactggctggcccactcctggtgcaagtag

SEQ ID NO: 218319 - DNA, 552 bp, Artificial Sequence
  Description of Artificial Sequence: Synthetic coding sequence
atgatgcgcaacaaggacaaatcccaagaagaggattcttccctgcattcaaatgcctcttcccattctgcatcagaggaggcttctgggtctgacagcggatcgcagagcgagtccgaacagggctccgaccccggttcgggccatggaagtgagtctaattcatcttcagagtcctcggagagccaaagtgagagcgagagtgagtcggccggatctaaaagccagccggtcctgcccgaagccaaagaaaaacctgctagcaagaaagagaggattgctgacgtgaaaaaaatgtgggaggagtatcccgatgtttatggggtccgcagatctaacagaagtcgccaggaaccaagcagatttaacatcaaggaggaggctagttcaggctctgagtcaggatcgcccaagcggaggggtcagcggcagctcaaaaagcaagaaaaatggaaacaggagccctcagaggatgaacaggagcagggcacaagtgcggaaagcgagccagagcagaagaaggtgaaggctcgacggccagttccacggtag

SEQ ID NO: 218320 - DNA, 5220 bp, Artificial Sequence
  Description of Artificial Sequence: Synthetic coding sequence
atgatgcgcaacaaagacaagagccaggaggaggactcatcgctccactcgaatgccagctcccattctgccagcgaagaggcgtccgggagcgattctgggtctcaaagtgaatccgaacaggggtccgatcccggaagcggccatgggtccgaatcaaattcttcttcggaatcctccgaaagtcagtcagaatccgaaagtgaaagtgctggtagcaagagtcaaccagtgttgcctgaagccaaggagaagccagcatctaagaaagagcgcatcgccgacgtaaaaaagatgtgggaagaataccccgatgtgtacggcgtgcgtcggagcaacagatccagacaagagcctagcaggtttaatatcaaagaggaagcatccagtggcagtgaatctggcagtccaaaaagaagaggacagagacaactcaagaaacaagaaaagtggaaacaggaaccatccgaggatgagcaagagcagggaaccagcgctgagagcgaacctgagcaaaagaaggtgaaagccaggcggcctgtaccacggagaacagtgcctaaaccccgagtaaaaaagcaaccaaaaacgcaacgcggtaagcgcaaaaagcaagacagctctgatgaggatgatgacgacgatgaagcgcctaaaaggcaaacaagacgacgagccgctaagaacgtcagctacaaagaggatgacgatttcgaaacagattccgacgacctgattgaaatgacaggcgaaggggtggacgaacagcaggataactccgaaactattgagaaagtcctagactcccgactcggcaaaaagggcgctaccggtgctagtacaaccgtgtatgctattgaagctaacggcgatcccagtggagatttcgatacggaaaaggacgaaggtgaaattcaatacttgattaaatggaaaggatggtcttacattcactcaacctgggaatccgaagagtcacttcagcagcagaaggtcaaaggcttgaagaaactggaaaatttcaagaagaaggaagatgagattaagcaatggctgggcaaggtgagccccgaggatgtcgaatactttaattgccaacaagagctagcctcagaactcaataagcagtaccagatagtagagagagttatcgcagtaaagaccagcaaaagtacactgggtcagaccgactttccagcccacagccggaaacccgctccgtctaacgagccagagtatctttgtaagtggatgggattaccttacagtgagtgctcttgggaggatgaggcactgattgggaaaaagttccagaattgcattgactcatttcactcgcgcaataattcgaagacaatccccacaagggagtgcaaagccttgaagcagcgccctaggttcgtggctttgaaaaaacagcccgcttacctggggggtgagaatcttgaactgcgcgattatcagctagaagggcttaattggctggcccattcctggtgcaagaataattccgtaattctggccgacgaaatggggttaggcaaaactattcagactatctcgttcttatcttacctctttcatcagcaccagctctacgggccattccttattgtcgtgcccctttccacgttgactagctggcaaagagagtttgaaatttgggcacctgagattaacgtggtggtctacataggcgacttaatgtccaggaacaccattagggagtatgagtggatacattctcaaactaaaagactgaaatttaacgccctgattaccacgtacgagattttactcaaagataagactgtcctggggtccatcaattgggcattcctcggggtggacgaagcccatagactgaaaaacgatgattcactgctgtacaaaacgctgattgatttcaagagcaaccaccggcttctgatcacggggaccccattgcagaactcgttgaaagaactttggtctctgctgcatttcatcatgcccgagaaatttgagttttgggaagatttcgaagaggatcacggcaagggcagagaaaatggttaccaaagcctgcataaagtgctggaaccgttcttactgagaagagtaaagaaggatgttgaaaaatccttgcccgcaaaagtggaacaaatcctcagagtggagatgtccgcgctgcagaagcagtactataagtggattttgacacgtaactacaaggctctggcaaaggggactaggggatccacctccggattcctaaatatagtcatggagttgaaaaaatgttgtaatcactgctatctgatcaagccccctgaggaaaatgaacgtgagaacgggcaagaaatcctcctgagcctcatcaggagcagcggtaaactgatcctgctggacaaactgttaacccgtctgagagaacgaggcaatcgcgttttgatatttagtcaaatggtgcgcatgttggacattctcgcggaatatctcacaatcaagcattatccattccagaggctagatggttctattaaaggggagataagaaagcaagctctcgatcacttcaatgctgacgggagtgaggacttttgttttctgctcagcacacgagcagggggtttgggaatcaatttagcaagcgcggacaccgtggtgattttcgatagcgattggaatccccagaacgatctgcaggcccaagccagagctcacagaattgggcagaagaaacaggtcaacatctaccgactggtgacaaagggaaccgtcgaggaggaaattattgaacgggcaaaaaagaaaatggtgttggatcacctcgttattcagagaatggatacaacaggaaggacaatccttgaaaataactcaggtcgatcaaacagtaatccgttcaataaagaggagctgacggccatcttgaaattcggagcagaagatctttttaaagaactggagggtgaagagagtgagccgcaagagatggacattgacgagatcttacgtctcgcagagacaagagaaaatgaagtctctacctcagccacggatgagctgctgtctcagttcaaggttgccaacttcgccactatggaggacgaggaagaattagaagagcgtccccacaaggactgggatgagatcatccctgaggaacaaaggaagaaagtagaggaggaagagagacagaaagaattagaagaaatctatatgctgccgcgaataagatcctctaccaaaaaggcgcagacgaacgatagcgacagcgacaccgaaagcaagcgccaggcacaacgtagcagtgcgtctgaatcagaaacagaagatagtgacgatgataagaaacccaaaaggcggggacggcctagaagtgtgcggaaagatctggtggaaggttttacagatgcagaaattcgcagatttattaaggcatacaagaagttcggactgccgctcgaaagactggaatgtatcgccagagatgccgaattggttgacaagtcagtggctgatctcaaacggttaggggagctaatacacaactcatgcgtaagcgcgatgcaggaatacgaggagcaattgaaggagaatgcctcagaggggaagggccctgggaagcgtcgagggcctacaattaaaatcagtggcgtccaagtcaacgtgaagtctattatacagcatgaggaagaatttgagatgttgcacaagtctattccagtcgaccctgaagagaagaaaaagtactgtctcacctgtagagtgaaagccgcacattttgacgtggaatggggcgtcgaagacgactccagactgctgctaggaatttacgagcacggatacgggaattgggaactcatcaaaaccgatccagaactgaaacttacagataaaatactgccggtggaaacagataaaaaaccacaggggaagcagttacagactagagcagactacctactgaagctgctgagaaagggactggaaaagaagggcgctgttacaggaggcgaggaagcaaagctcaaaaagagaaaacctcgcgtcaaaaaggagaacaaggtacctcgtttgaaggaggagcatggcattgagctgagtagtccaagacactctgataacccatcagaggaaggggaagttaaagatgacggtctggagaaaagtcctatgaagaaaaagcagaaaaagaaagagaacaaggaaaataaggagaagcagatgtcttcccgaaaagataaggaaggcgacaaagagcgaaaaaaatccaaagataagaaagagaagcccaagtccggcgatgcaaagagcagcagcaaaagcaaaagatcccaagggcctgtacatattacggctgggagcgaaccagtgcctatcggagaggacgaagatgacgatctggatcaggagactttcagtatttgtaaggagcgcatgcgacccgtaaagaaagctctgaagcagttggacaagcccgataaaggtctcaatgtgcaggaacaactcgaacacacacgcaactgtttactgaagataggagatagaatcgctgaatgcttgaaagcgtacagcgatcaggagcacataaagctctggcgtagaaatttatggatcttcgtgagtaagttcactgagtttgacgcgagaaaactgcacaagctctataagatggcccacaagaagcggagtcaggaagaggaagaacagaaaaaaaaggacgacgtcaccgggggaaaaaaaccatttagacctgaagcatcagggtcctcacgggattctctgatctctcagtctcatacgagtcataatttgcacccacagaaacctcacctgcccgcatcacacgggcctcagatgcatggtcatcctagagacaattacaaccaccctaacaagcgtcacttttccaatgccgataggggagattggcagagagaaaggaagttcaattacggtgggggtaacaacaaccctccgtggggatctgacaggcaccatcagtacgagcaacactggtacaaggaccatcactacggagaccgtaggcatatggatgcccatcgcagcggatcctacaggcccaacaacatgagccggaaacggccatacgatcagtatagctctgatcgcgatcatagaggacatagggactactacgacagatacgctaagggttgtgaaacacctggggcaaacttgtgccaggagctcttcctgggacgcaagtac

SEQ ID NO: 218321 - DNA, 6002 bp, Artificial Sequence
  Description of Artificial Sequence: Synthetic coding sequence
atgaaagctgccgacacggtcattctctgggcaaggagcaagaatgatcaacttaggatttcctttccaccaggactttgttggggggaccggatgccagataaagatgatattcgtctcctgccgtctgctctcggagtgaaaaaaagaaagcgtggtccaaaaaagcagaaagagaataagcctggaaagcctcgcaagcggaagaaacgcgactcggaagaagaatttgggagcgaaagagacgaatacagagagaagtctgaatctggcggttccgagtacgggaccgggcctggccgtaagcgcaggagaaaacatagagagaagaaggaaaagaagaccaagagacggaagaagggtgaaggagacggcggacagaaacaggtagaacagaagagctcagccaccctccttctgacatggggattagaagatgtggaacatgtctttagcgaggaggattatcatacactgacaaactacaaggcctttagccagtttatgcgaccgttaattgcaaaaaagaatccgaaaatcccaatgtccaagatgatgacgatcctgggcgcaaagtggcgggagttttccgccaataaccctttcaaggggtcagctgctgctgtggccgcagcagcagcagctgctgcagccgctgtggccgagcaggtcagcgcagcagttagttctgcaactccaatcgccccatcaggcccaccagccctgcctccacctccagccgcagatatccagcctccacccataaggagggccaagaccaaggagggaaaaggtcccggacacaaacggagaagtaagagtccgagagttccagacggccgtaagaagcttcgtggcaagaagatggccccattaaagataaaactggggctgctcggcggaaaaagaaaaaaaggcggtagttatgtgtttcagtctgacgagggcccagaacctgaagctgaggaatccgatctggactctggttctgtgcacagcgcatcaggcagacctgacggtccagtccggacaaagaaattgaaacgagggaggcccggacggaagaaaaagaaggtgctcggatgtcccgcagtcgccggtgaggaggaggtcgacggctatgagacagaccatcaagactactgtgaggtttgccagcaaggaggcgaaattattctctgtgacacctgtcctagagcctatcaccttgtgtgccttgatcccgagcttgacagagcccctgaggggaagtggagttgtccacactgcgagaaggagggcgttcaatgggaagctaaggaggaggaggaagaatatgaggaggagggcgaagaagagggggagaaggaggaggaggacgatcacatggagtactgcagggtgtgcaaggacggcggtgagctgctgtgttgcgacgcatgcatctccagttatcacatacactgtctcaaccctcctctgcccgatatcccaaacggagaatggctctgcccaagatgcacctgccctgttctgaagggcagggtacagaaaattctgcactggcgctggggggagcctcccgtggccgtgccagcacctcagcaggcagatggtaacccggatgtcccacctccacgacctctgcaaggcagatctgagagagaattcttcgtaaaatgggtggggctcagctactggcactgcagctgggcgaaggagctacagcttgagatctttcacctcgtgatgtatcggaactaccagcgcaaaaacgatatggacgagccccctcccctggactacgggagcggagaagacgacgggaaatccgacaagcggaaggtcaaagacccccattacgccgaaatggaagaaaagtattacagatttgggatcaagccagaatggatgaccgtgcatcgaatcataaatcactcagtggataagaaggggaattaccattatctggtgaagtggcgcgacctgccatacgatcaatctacgtgggaggaagatgaaatgaatattccagagtatgaagaacataaacagtcatactggcgccaccgggaactgattatgggtgaggaccctgcgcagcctcgcaagtacaaaaagaaaaaaaaggaattgcagggcgacggcccacccagtagtcccacaaacgatcctacagtcaaatatgaaacccagcctagatttataaccgcaacaggaggaaccctccatatgtaccagctagagggactcaattggctcagattctcctgggcacagggtacagatacgattcttgcagacgagatggggctgggaaaaactatccagacaattgtgtttctgtatagcctctacaaggagggacacactaagggcccattccttgtgtcagcccctttgtctaccatcatcaactgggagcgggagttccagatgtgggcccctaagttttacgtggtaacgtatacgggcgacaaggattcccgcgctataattcgcgagaatgaattttcattcgaagataacgccattaaggggggtaaaaaggccttcaagatgaaacgggaagctcaagttaagtttcacgtgctgctcacctcgtacgagctcattaccatcgaccaagctgctttgggatccatcagatgggcatgtcttgtggttgacgaagctcataggctgaagaataaccagagcaagttcttcagggttcttaatggctataagattgaccataaattgcttctgacagggacacctctccaaaataatctggaggagctgttccacttactcaatttcctgacaccagagagatttaataaccttgagggatttcttgaagagttcgcagacataagcaaagaagaccaaatcaaaaaactgcacgatctcttaggtccgcatatgctgcggcgactgaaggccgacgtgtttaaaaacatgcctgccaagacggagctgatcgttcgggtagagttatcccccatgcagaagaagtactataagtacatcttgacaagaaacttcgaggccctaaactctcgaggcggtggcaaccaggtgtctctcctgaatataatgatggatctcaaaaaatgctgtaatcatccataccttttcccagtggcagctatggagtctcctaaattgcctagcggagcatatgagggcggagcactgatcaagagcagcggcaagctaatgctactgcagaaaatgctgcgtaaactgaaggagcaaggccatcgggtgttgatcttttcccagatgacaaaaatgttggacctcttggaggacttcctggactacgaggggtacaaatatgagagaatagacgggggtatcaccggcgctctaaggcaggaagcgatcgacaggtttaatgcccctggcgcacagcagttttgcttcttgctgtctacccgggcaggcggtctgggcattaatctcgccaccgccgatacagttatcatttttgacagcgattggaacccccacaatgatatacaggcattttcaagagcacaccgcattgggcaggccaataaggtgatgatctacagatttgtgacacgtgcgtctgtggaggagaggataacccaagtggcaaagaggaagatgatgcttactcatcttgtcgtcagaccaggactcggaagtaaagccggaagtatgtcaaaacaggaactcgatgatattctgaagttcgggactgaggagctcttcaaagatgagaacgaaggtgagaacaaagaagaggactcttctgtgatccactatgacaacgaggcaatcgcacgactcctcgatcgaaaccaggatgctaccgaggataccgatgtgcagaacatgaacgagtacctaagcagttttaaggtggcacagtacgtggttagggaggaagacaagattgaagaaattgaacgagagatcattaaacaggaggaaaatgtcgaccccgactactgggaaaaactgctccggcaccactatgagcagcagcaggaggacctggcacgcaacctggggaagggcaagagagtgaggaagcaggttaattacaacgacgctgcccaggaggaccaagataaccagagcgagtatagtgttggttccgaggaggaggatgaagacttcgacgagcgacccgagggaaggcggcagtccaagcggcaacttaggaacgagaaagacaaacctcttccccctctgttggctcgtgtgggtgggaacatagaggttctgggattcaataccaggcaaagaaaagcattcctgaacgctgtgatgcgttggggcatgcccccacaggatgcttttaccactcagtggctcgtgcgcgacctccgcggaaagacagagaaagaatttaaagcctacgtgtctctttttatgagacacctgtgcgagccaggggctgacggaagcgagactttcgccgacggagtgcctcgagaggggttatctcggcagcaagtcctgactcgaataggcgttatgtctctcgtgaagaagaaagtgcaagaatttgagcacattaacgggcgttggtcaatgcccgaactcatgccagacccatccgcagactctaaacgaagtagtcgtgcatcatcgccaaccaagacctcccccactacccccgaagccagcgccacaaactccccctgtacctccaaacccgcaactccagcaccatcagaaaaaggcgaagggatcagaacacccctggagaaagaggaagctgagaaccaggaagagaaacctgaaaaaaattctagaatcggagagaaaatggagaccgaagccgatgcaccgagtccggcaccaagcctgggcgagcggctcgaacccaggaaaataccactggaggacgaagtccccggtgttcctggcgaaatggagcccgaaccaggttacagaggcgaccgcgagaaatctgcaacagaatctaccccaggggagcgcggagaggaaaagccgctggacggtcaagagcatagagaacgaccagaaggcgaaacaggtgatctgggtaaaagagaagatgttaaaggcgatcgggagttacggccaggtcctagggatgaaccacgaagcaatgggagaagggaggaaaagacagagaagcccaggttcatgtttaatatcgcagacggaggatttaccgaactgcacacgctctggcagaatgaagagagggctgccatctcctccggcaagttaaatgagatttggcatcgcagacatgattactggctacttgccggtattgtcttgcacggctacgctaggtggcaagacattcaaaatgacgctcagtttgccattattaatgagcccttcaagaccgaggccaacaaagggaactttctggaaatgaagaataaattcctggccaggcgattcaaactccttgaacaggcactggtgattgaggagcagctgagacgggcagcatatcttaatttgtcccaggagcctgcacacccagccatggcgttacacgcaaggttcgctgaggccgagtgcttggccgagtctcatcagcatctgagcaaagagtcattggcagggaacaagcccgctaacgcagtacttcacaaagtgctgaatcaattagaagaactcctttctgacatgaaagctgatgtgactcggctcccggctaccctgagtcgtatcccgcctattgctgctcgcctgcagatgtcagaaaggagtattttgtctaggctggctagcaaagggaccgagccccaccctacacctgcttatcctcctggcccttacgctaccccacccggatatggagcggcttttagtgctgctccggtgggggcactggctgccgcaggtgctaactacagtcaaatgcccgcaggctcattcattaccgccgctaccaatggacctcccgtactggtgaagaaagagaaagaaatggttggagccctggttagtgatggccttgacaggaaggagcccagagcgggagaggtgatctgcattgacgacta

SEQ ID NO: 218322 - DNA, 5900 bp, Artificial Sequence
  Description of Artificial Sequence: Synthetic coding sequence
atgaaagccgcagacactgtgattctctgggctcggtctaaaaacgaccagctccgaatttcattcccaccgggattatgttggggagatagaatgcccgacaaggatgacattaggctgcttccctctgctctgggtgtcaagaaaaggaaacgcggacctaaaaagcagaaggagaacaagccagggaaaccacgtaagcgtaagaagcgagatagcgaagaggagttcggcagcgaacgcgacgagtatagggaaaagagcgagtctgggggtagcgagtacggtactggtcctggcagaaagagaagacgcaaacaccgggagaagaaggagaaaaagactaaacgaagaaagaagggcgagggtgacgggggtcaaaagcaggtcgagcaaaagagctccgcaacattattgctgacatggggattagaggacgtggaacatgtgttctcagaggaggattaccacaccctgactaactacaaagccttctcacaatttatgcggccactcattgccaagaaaaatccaaagatccctatgtctaaaatgatgactatactaggcgctaagtggcgagaatttagtgctaacaatccattcaaggggtctgctgctgcagttgcagctgctgctgcagcagctgccgctgctgtcgctgagcaggtgtccgccgcagtttccagtgctacacccatcgccccttcaggccctccagccctccctccgcctccggcagccgacatacaaccccctcccattaggagagccaagaccaaagaggggaaaggtcccggtcacaagaggcgctccaagagtcctcgcgtgccagatgggcgtaaaaagctgcgcggaaagaagatggcacccctgaaaatcaagctgggtctcctcggcggaaaacggaaaaaaggtggttcatatgtgtttcagtctgatgaaggcccagagccagaggctgaagagtcagacctcgacagcggctccgtgcactctgcttcaggtaggcccgatggtcccgttcggaccaagaagttaaaacgcggtagacccggacggaagaaaaagaaggttttaggttgtccagcagtggcaggagaggaagaagttgacggttacgagacagatcaccaggactattgcgaagtgtgccagcaggggggagaaattatactgtgtgacacctgtccccgagcctaccacctggtgtgtcttgaccccgaactggaccgggctcctgaaggcaaatggtcttgtccacactgcgagaaagagggtgtgcagtgggaagctaaagaggaagaagaggagtacgaggaggagggcgaagaggaaggcgaaaaggaggaggaagatgaccacatggagtactgtagagtctgtaaagatggcggagagctcctctgctgtgatgcatgcatcagttcttaccacatccattgtctgaaccccccactccccgacatccccaatggcgaatggttatgcccccgatgtacgtgtccggtactgaaggggcgtgtacagaaaattctccattggcggtggggggagccacccgtcgctgtccccgcaccacaacaagccgacggaaacccagatgtgccccctcccaggccgctgcagggcagaagcgaacgggagttctttgtgaaatgggtggggctgagctattggcattgtagctgggctaaggaactccagctcgagatctttcacctggttatgtatcgcaattatcagcgcaaaaatgatatggacgaaccacctccactggattacggcagcggtgaggacgatggtaagtccgataagcggaaagtaaaggacccgcattatgccgagatggaggagaagtactatcggtttggaatcaagcccgaatggatgaccgtgcaccgaatcatcaaccatagcgtggacaaaaaaggtaactaccactacctggtgaaatggcgcgatcttccttatgatcagtcgacatgggaggaggacgagatgaatattccggagtacgaagagcataagcaatcctactggagacatcgggagctcatcatgggtgaagaccccgcacagcctagaaagtataaaaagaaaaaaaaggaactgcagggggatggacccccaagttcccccactaacgatccaacagtgaaatacgaaacacagccacgcttcattactgccacaggaggaactttgcacatgtaccagctcgaggggctgaactggctccgattcagttgggcacaggggactgataccatactggctgacgaaatggggcttggaaagaccatccagaccatcgtgtttctttacagcctgtacaaggagggtcacaccaaaggtccgttcctggttagcgctccccttagcactattatcaattgggagagagaatttcagatgtgggcacctaagttctatgtagtgacgtacaccggggacaaggactcgcgagctatcatccgtgaaaatgagttctcttttgaagacaatgccatcaaaggaggtaaaaaagcattcaagatgaaacgcgaagcacaggtgaaattccatgtgttattgacctcttatgaactcatcaccattgatcaggctgcattaggatcaatacggtgggcttgtctagtggtggacgaggctcacaggctcaaaaataatcagtccaagtttttcagggtcctaaacggatacaagattgatcacaagctattgctgactgggactcctttgcagaacaacttagaggaactgttccacctcctgaattttttgaccccagagcggtttaataacctggaagggttcctggaagaattcgccgacatcagtaaggaagatcagattaagaagctacacgacctactggggcctcacatgctacggaggttgaaggccgacgtgttcaagaacatgcctgctaaaacagagctgatcgtgcgcgtggagctcagtcccatgcagaaaaagtactacaagtatatactgacacggaactttgaggccctgaattcaaggggaggtggcaaccaggtgagccttctgaacatcatgatggatctgaagaaatgttgtaaccatccatatctcttcccggtggccgctatggagtcccccaaactcccttccggagcctatgagggaggcgctctaataaagagctctggcaagctcatgctcttacagaagatgctcaggaaactcaaggagcagggacaccgggtgctcatcttttcacaaatgacaaaaatgctcgacctcctcgaggatttcttggactatgagggatataaatatgagcgcatagatggtggcatcaccggcgctctccggcaggaagcaatcgacagatttaacgcacccggtgcccagcaattttgctttctgttgagcacccgagccggaggcctcggcatcaacctggcaacggctgatacagtaatcatctttgactctgattggaatcctcacaatgacattcaggcctttagtcgggctcacaggatcggacaggccaacaaggtgatgatttaccgatttgttacaagggcctctgtcgaagaaagaattacacaggtggcgaaaagaaagatgatgctgacacacctggtcgtccgtcccggtctgggcagtaaagccggttcaatgtcgaagcaagagctagatgacattctgaagtttggaactgaggaactgtttaaggacgagaatgagggtgagaacaaggaagaagacagtagtgttatccactatgacaacgaagccatcgcccgtctcctagatcgtaatcaggatgccactgaggacacagacgttcaaaatatgaatgaatatctcagcagctttaaggtagctcagtatgtggtccgcgaggaggataaaatcgaggagatagaacgggagataatcaagcaggaggagaacgtcgacccagattactgggagaagctcctgagacatcactacgaacagcagcaggaagacctggccaggaacctcggcaaaggcaaacgcgtccgcaaacaagttaactacaacgacgcagctcaagaagatcaagataaccaatctgaatactccgtcggctctgaggaggaagatgaggacttcgatgaaagaccagagggcaggcgccaaagtaagcgccagctccgtaatgagaaggataagcctctcccgcctctcctggctagggtgggaggtaacatagaggtcctggggttcaacacaaggcaacgtaaggctttcctgaacgccgtgatgaggtgggggatgcctcctcaagacgcctttaccacacagtggctggtgcgggacctcagagggaagaccgagaaggagttcaaggcgtacgtcagtctcttcatgagacacctgtgtgagccgggtgctgacggctctgagacctttgccgacggggtgccaagagagggcttgagccggcagcaagttcttacacggattggagtcatgagcctagtaaaaaaaaaagttcaagagtttgagcacatcaacggcagatggagcatgcctgagctgatgcccgatcctagcgcagactcaaaaaggtcctccagggcctccagtccaaccaagacgtcgcccaccacacctgaagcttctgctaccaattctccttgcacaagcaaacctgccaccccagcaccatccgaaaagggggagggaatccgaacgccactggagaaagaggaggctgaaaaccaggaagagaagccagagaaaaactccagaattggggaaaagatggagacagaggccgatgccccaagccctgcacccagcctcggggaacggctggagccccgtaagatccccttggaggacgaggttcccggagtcccaggagagatggaacccgagcctggttatcgcggtgaccgggaaaaaagcgaggacgtgaagggagacagggaactgcgaccgggtcctagggacgagcccagaagcaatggtaggcgagaagagaaaacggagaagccgaggtttatgttcaacatcgccgacggcggatttacagaattacacactctgtggcagaatgaggaaagggccgctattagtagtggcaagttaaacgaaatctggcacaggagacatgattattggctgttggccggaatagtgctccacggatacgcaaggtggcaggatatccagaatgacgcccagtttgccattattaatgaacccttcaagacagaagcaaataagggcaactttctggaaatgaagaacaagttcctcgctcgacgctttaaactgctcgagcaggcactcgtgatagaggagcagctgcgtagggctgcctacctcaacctgtcgcaagaacccgctcaccccgcaatggcactccacgctcgcttcgccgaagcagagtgtctcgcagagagccatcagcacctttccaaagaaagcttggccggaaacaaaccagcaaatgcagtgctccataaagtgttgaaccagctggaggagctgctttcagatatgaaagcggacgtgactcgcctgcctgctaccctgtccaggattccaccaatagcggctcgcctgcagatgtccgagcgcagtattttatcccggctcgcttctaagggcaccgagccgcatcccacacctgcctacccacctgggccttacgctacacctcccggatacggggctgccttcagtgcagcacctgttggcgcactcgcggcagccggtgccaattacagccagatgcctgcagggtcattcatcacagccgctaccaacggtcctcctgtcctcgtgaaaaaagaaaaggaaatggttggcgctctggtttcagatggcttagacagaaaggagccaagagcaggcgaagtgatttgcatcgacgatta

SEQ ID NO: 218323 - DNA, 6179 bp, Artificial Sequence
  Description of Artificial Sequence: Synthetic coding sequence
atggcttctccgcttcgcgatgaagaagaggaggaggaggagatggttgtgtctgaggaggaggaagaggaggaggaagagggcgacgaggaagaggaagaggaagtggaagccgctgatgaagacgatgaagaggacgatgatgagggcgtgcttggcagggggccaggccatgataggggcagggataggcattctcctcccggatgccacctgtttccccctcctccaccccctcctccgccactacccccacctcccccaccaccacctccagacaaggatgacatccggcttctgccctctgcgctcggtgtgaagaaaaggaaacgcggtcctaaaaaacagaaggagaataagccaggtaaacctcgcaagcggaagaagagggatagcgaagaagagttcggctccgagagagacgagtatcgggaaaagtcagagtctggcggttctgaatatggtaccggaccaggaaggaaacgtcgaaggaaacaccgtgagaaaaaagagaagaaaaccaagcgtaggaaaaagggcgaaggagatggaggtcagaaacaggttgagcagaaatcatcggccacattactgctaacctggggtctcgaagatgtcgaacacgtgttcagcgaggaggattaccacacactgactaattacaaggcattcagtcaatttatgcgccctctgatcgccaaaaagaaccctaagatacccatgagtaagatgatgacgatcctcggagcgaaatggcgggagtttagtgctaataaccccttcaaggggagcgccgctgctgtcgcagcagctgcagcagcggcagccgctgccgtggccgagcaggtatccgccgcagtgtccagcgctactcccattgccccaagcggcccacctgcccttccccctccccctgccgctgatattcagccacctcctatcaggcgcgcaaagactaaagaaggcaagggacccggtcacaaacggagatcaaaatcgcctcgtgttcccgatggacggaaaaaactacgcggtaagaagatggcaccactgaagattaagctcggcctcctcggcggtaagaggaaaaagggtggcagctacgttttccagagcgatgagggccctgagcccgaggccgaagaaagcgacctcgatagtgggtccgtgcattcggccagtggcaggcctgatggacctgttaggaccaagaagctaaaacgcggacggccaggcagaaagaaaaagaaggttttgggctgtcccgctgtcgcaggagaagaggaagtcgacgggtatgagactgaccaccaggactactgcgaagtgtgccagcagggcggtgagatcatcctgtgcgatacttgtccacgggcataccacctggtttgccttgacccagaactggatagagctcctgagggtaagtggtcatgtccccattgtgagaaagaaggggtgcagtgggaagcaaaggaagaagaggaggagtatgaggaagagggcgaagaagaaggagagaaagaggaggaggatgaccatatggaatactgtagggtgtgtaaagacggtggagaacttctgtgctgtgatgcatgcatcagtagctaccacatacactgtctgaatcccccactgcctgacatacctaatggagagtggttgtgtccccgatgcacttgcccagtgttgaagggccgagtgcagaagatcctgcactggcggtggggtgaaccgccagtagctgtgcccgcaccacagcaagccgatggaaaccccgatgtgccaccccctaggccactgcagggacgctcagaaagagaatttttcgtgaagtgggtcggactctcctactggcactgcagttgggcaaaagagctccagctggaaattttccaccttgtgatgtataggaattaccagaggaagaatgacatggatgaaccacccccactggactacggaagtggggaagatgacggtaaaagcgacaaacgcaaagtaaaggatccccactatgccgaaatggaggaaaaatactatcggtttggaatcaagccggaatggatgaccgtgcatcgcattataaaccactccgtcgacaagaagggtaattaccactaccttgtgaagtggcgcgatctcccctatgaccagtctacttgggaagaggatgagatgaacatccctgagtatgaagagcacaagcagtcatactggcggcaccgcgagctcattatgggtgaagatcctgcacagcctcggaaatacaaaaagaagaagaaggagctgcagggagacgggcctccatcctcccctaccaatgacccaactgtcaaatatgaaacccagccacgatttatcacagccacaggaggaacattacacatgtaccaactggagggcctgaactggctgcgcttctcttgggcacagggaactgatactatactagccgacgaaatgggcctggggaagaccatccagacgattgtgttcctgtactccctgtataaggagggtcacacgaaaggtcccttcctagtctctgcccctttatccaccatcataaactgggagagagaattccagatgtgggccccaaagttttatgtggttacatacaccggcgacaaggattccagggcaataatacgggagaatgagttcagcttcgaagacaatgctataaagggcggtaaaaaagcctttaagatgaagcgagaggcacaggtgaaattccacgttctgctgaccagttacgagttgatcactatcgatcaagctgccctgggcagtattcggtgggcttgcctggtggtcgatgaggcccaccgcctcaaaaataatcagtcaaaattcttccgagtcctcaatggatataagattgaccacaaactcctgctgacagggacacctctgcaaaataaccttgaagagcttttccatctcctcaacttcctgacccccgaaagattcaacaacttggaggggtttttggaggagtttgccgatatctccaaggaggatcagattaaaaaactacatgacctgctgggaccccacatgttgaggcgactaaaagccgacgtgtttaaaaacatgcccgctaagacagagttgattgtccgcgtcgagctaagtcccatgcagaaaaaatactacaaatacatattgacacgaaacttcgaggccttgaacagtcggggaggcggtaaccaggtgagcttactgaacattatgatggatctgaagaagtgttgcaaccacccttacctgttcccggtcgcggctatggaatcacccaagctgccaagcggggcatacgagggcggagccttgataaagagctccgggaaacttatgctgctgcagaaaatgctccgcaagttaaaagagcaaggccacagagtgcttatctttagccagatgaccaaaatgctagatcttctagaggacttcttggattacgaagggtacaagtacgaacgcattgatggcggaattacaggcgcactgcggcaggaggccattgatcgtttcaatgcccctggagcccagcagttctgtttcttgctttctacgagggctggtggactggggatcaatctggcaacggccgacaccgtcattattttcgattcagactggaacccccacaacgatattcaggcgttttctcgcgctcatcggattggtcaggctaataaggtgatgatataccgttttgtcacaagggcgtcagtcgaggagagaatcacacaagtggccaagagaaagatgatgctgacacatctcgtcgtgcgtcccggtttaggctccaaggcaggctccatgagcaagcaggaactcgacgatatcctgaaatttgggaccgaggaactgttcaaagatgagaacgagggtgaaaataaagaggaggatagctcagtgatccactatgacaacgaggcaatagctcgcctccttgacagaaaccaggatgccacagaagataccgacgtgcaaaatatgaacgagtatcttagtagtttcaaagtggcccagtatgttgtgcgggaggaagataagatcgaagagatcgagcgagagatcatcaaacaagaagagaacgtggaccccgattattgggagaagcttctgcgacatcattacgaacagcagcaggaggatcttgccagaaatttaggaaaaggcaaacgcgtccgtaagcaagtcaattataacgacgccgcacaggaggatcaagacaaccaatcggagtattcagtaggaagtgaagaggaagatgaagattttgatgaaaggcccgaaggtcgtcgacaatcaaaaagacagctgcgaaatgaaaaagataagcccttgccacctctgctcgcaagagtcggagggaatattgaggtcctggggttcaacacccgacagaggaaggccttcctcaacgccgtcatgcggtggggtatgccccctcaggatgcatttacaactcaatggttggtgagggatcttaggggcaagactgagaaggaatttaaagcctatgtatcactgtttatgcgacatctttgtgaaccaggagctgatggctcagagacttttgcggacggagtgcccagggaggggctgtcccgtcagcaagttctgactcgtattggcgtcatgtctttagtgaagaaaaaagttcaggaattcgagcatatcaatgggagatggagcatgccagagctgatgcctgacccttctgcagactctaagaggtccagccgcgctagttcccctaccaagacgtcccccaccacaccggaagcctccgctactaactctccctgtaccagcaaacctgccacacctgcaccatcagaaaaaggcgagggcattcggacccctctggagaaagaagaagccgaaaatcaggaagaaaagccggagaagaactcgcggattggggagaagatggaaactgaagctgacgcgcctagtccggctcctagtcttggagaaaggctggagccgagaaagattccgctcgaggacgaagttcctggtgtacctggggagatggagccagagccaggatatcggggagacagggaaaagtctgccaccgaatctactcccggagaacgcggtgaggaaaagccactggacggacaagagcaccgggaaaggcctgaaggcgagacaggcgacctggggaagcgggaggacgtcaagggggaccgagaactgcgacctggaccgagagatgaacccaggagtaacgggagacgagaagaaaagacagagaaaccaagatttatgttcaacatagcggatggcggttttacagagctgcataccctttggcagaacgaagaaagagcagctattagttctggcaaattaaatgaaatctggcacaggagacacgactactggctcttagcagggatagttcttcacggctacgcccgttggcaggatatccaaaacgatgcacaatttgctatcatcaacgagccattcaaaaccgaggccaacaagggtaatttcctggaaatgaagaataagtttcttgctcggagattcaagctcttggagcaggcgctcgtgatcgaagaacagttgaggcgcgctgcttacctgaacctgtcccaggaaccagcccatcccgctatggctttgcatgccaggttcgccgaggccgagtgccttgccgagagtcatcagcatctgagcaaggaatccctggcaggcaacaagcctgccaatgcagtgctccacaaggtgctcaatcaactggaggaactattatcagatatgaaagccgatgtcacgcgcttgccggctaccttatcgagaattcccccaatagccgctcggttacagatgagcgagcggtccattctctctaggcttgccagcaaaggcaccgagccacaccctacacccgcatatccaccagggccttatgccactccacctggttacggagcagctttcagtgctgcccctgtgggcgctttggctgccgctggggcaaattattcccagatgccagccggaagtttcatcaccgcagccacaaacggccctcccgtgctcgtgaagaaagaaaaggagatggtaggtgcactggtgtccgatgggttggatagaaaagagccacgcgcaggtgaagtaatctgcatcgacgatta

SEQ ID NO: 218324 - DNA, 5865 bp, Artificial Sequence
  Description of Artificial Sequence: Synthetic coding sequence
atgcggggacccgtcgggacggaggaggagctcccgcgtctctttgccgaggaaatggaaaatgaggacgagatgtcggaggaagaggacggaggcctggaggcttttgacgacttttttcccgtggagcctgttagtctgccgaagaaaaagaagcccaagaagctgaaagagaataagtgtaagggtaaaaggaaaaaaaaggagggctcaaacgacgaactatccgagaatgaggaggacctcgaggaaaagtccgaatctgagggcagcgactactcccccaacaagaaaaaaaagaagaaattgaaagataagaaggaaaagaaagccaagagaaagaaaaaagacgaggacgaggatgataacgatgacggctgcttgaaggagccgaagagctcagggcaactgatggctgagtggggtctggacgatgttgattacctgttctctgaggaggattatcataccctaactaattataaggccttctctcaattccttcgccctttgattgccaaaaaaaatccaaagatcccgatgtctaagatgatgaccgtgcttggggcaaagtggcgggaattctctgcaaacaacccctttaagggatcatccgccgctgctgctgctgctgcagttgcggcagccgtggagacagttacgatcagtcccccactcgccgtgtccccgccacaggtcccacagcccgtgcccatcaggaaggcaaagaccaaagagggcaaaggccctggcgtcagaaagaaaattaaggggtccaaggatggaaagaagaaagggaaaggaaagaagacagcaggtctgaaattccgattcgggggtattagtaacaagcggaagaagggcagctcatccgaggaagatgagcgggaagagtccgactttgatagcgcatccattcacagtgcatcagttcggagcgaatgttccgcggcactgggaaagaaatccaagaggcgcaggaagaagaagcgcattgacgacggcgatggttacgagacagaccatcaagattattgtgaggtgtgccagcaggggggtgagattatcctctgtgacacttgcccccgagcttatcacctggtgtgcctggacccagaattagaaaaagcccctgagggcaagtggtcctgtccgcactgtgaaaaggaggggatccagtgggagccaaaggacgatgatgacgaggaggaggaggggggatgtgaggaagaggaagacgaccacatggagttctgtcgtgtctgcaaagatggcggagaactactctgctgcgacgcgtgtccaagttcctaccatctccactgcctcaatccgcctttgccggaaattccaaatggcgagtggctctgtccacggtgcacatgtccccctctcaagggcaaagtgcaacggatcctccattggcgctggacagaaccccctgcccctttcatggtgggactccctggacccgacgtcgagccaagtctgccacctccaaaacccctggagggaattcccgagcgcgaattcttcgtgaagtgggcaggtctgtcatactggcattgcagttgggttaaagagcttcaactggagctgtatcacaccgtgatgtacagaaattaccagagaaagaatgacatggatgaaccacctccgttcgattacggtagcggtgacgaagatgggaagtcggaaaagagaaagaacaaggatccactgtacgctaaaatggaggaacgcttctaccgctacgggattaagcctgaatggatgatgatacaccggatcttgaaccactcattcgacaagaagggagacgtgcattatctgattaagtggaaggacctgccttacgatcagtgtacctgggagatcgacgacatcgacatcccatattatgacaatctaaaacaagcctactggggccaccgcgagctgatgttgggggaggatacaagacttccaaaacgtctgctgaaaaaggggaagaagctccgagatgataaacaggagaagccgccagacactccaatagtagaccccaccgtgaagttcgacaaacagccatggtacatcgattccactggaggaaccctacatccctaccagttagaagggctgaactggcttagattttcatgggcccaggggaccgataccatcctagccgatgaaatgggcttgggaaagacagtgcagacaatagtgtttctgtactccctgtataaggaaggccacagtaaaggaccctacctagtctccgcacctctttctacgatcatcaactgggagcgcgagttcgagatgtgggccccagacttctacgtcgtgacgtacactggggacaaggagtcccgatctgtcatcagggagaatgagttctcctttgaggacaatgccatccggtctggcaaaaaagttttccggatgaaaaaagaggtgcagatcaaattccacgtgctgttgacatcttacgaactaataaccatcgaccaggcaattctggggtctattgagtgggcgtgccttgtcgttgatgaggctcacagattaaagaacaaccagtcaaaattttttagagtgcttaatagctataagattgattacaagcttctgctaactggaacccccttacaaaataaccttgaagagctgttccacttgcttaactttctgactcctgagaggtttaataacctcgaaggcttcttggaagaattcgctgacatctccaaggaggaccagatcaagaaactccatgaccttctgggtccgcacatgctgcgacgcctcaaagctgacgtcttcaaaaatatgccggcaaagactgaactgattgtgagggtggaactgtcccaaatgcagaagaaatactataaatttattctgaccagaaatttcgaagctctcaacagcaagggcggaggcaaccaggtgtccctgcttaacatcatgatggatttgaaaaagtgctgcaatcatccctatctctttcccgtggccgcagtcgaggctcctgtgctgcccaacgggagctacgacggcagttctctcgttaagagttctggaaagctcatgttgctacagaaaatgctgaaaaagttgagggatgaaggacaccgcgtcctgatctttagtcaaatgaccaagatgttggacctgctggaggattttcttgagtacgaaggctataagtacgagagaatcgatggcggaatcaccggcggactccgccaggaagctatcgatcggtttaatgcacctggggctcaacagttctgtttcctgctgtctacaagagctggtggattggggattaatctggccacggccgacacggtgattatatacgactccgattggaatccacataatgatatacaggcttttagccgggctcatcggatcggacaaaataagaaggtgatgatttatcggtttgtgacacgggcttccgtagaggagcggataacccaggtggcaaaacgcaagatgatgctcacccacctcgttgttaggcctggtttgggcagcaagagtggaagcatgaccaagcaggagctggacgatatcctcaagttcgggacagaggaactcttcaaagacgatgtcgaaggcatgatgtctcagggacaacggcctgtgacacctattccggacgtgcagagtagcaaaggcggaaacctggcagcttcagcaaagaagaagcatggcagcacacctcccggagataataaagacgtggaggattctagcgtgattcattacgacgatgctgccatatccaagttgctcgatcgtaatcaagacgctactgacgatactgagctgcagaatatgaatgagtatctcagctcatttaaggtggcacaatacgtggtgcgcgaggaggacggtgtggaggaagtggagcgcgagatcattaaacaggaagagaacgtcgaccctgattactgggaaaaactgcttaggcaccactacgagcagcagcaagaggatctggcaaggaatttgggtaagggcaaaagaatccgaaagcaagtgaactacaacgacgcaagccaggaggaccaggaatggcaagatgagttatctgacaatcagagtgaatattcaatcgggtctgaagacgaggacgaggatttcgaagaaaggcctgagggacaatccgggagacgtcagtctaggcgccagcttaaatctgatagggataagcccctgccccctctcctggccagggtgggtggaaacatcgaggtcctgggttttaatgctcggcagcggaaggcctttctgaatgcaatcatgaggtggggtatgccaccacaggacgcgtttaatagccactggcttgtgagggatctccgtgggaagtccgaaaaagagtttcgagcatatgtcagcctcttcatgcgccacctgtgcgagccgggagcggatggcgctgagacgtttgcggatggtgtgcccagagagggcctgagcagacagcatgtactgactcgaataggagtgatgtcactagtacgtaagaaggtacaggaattcgaacacgtaaatggcaagtacagcactcctgacttgataccagagggacccgaaggcaaaaagtctggtgaggtgatctcttctgatcctaacactcctgtgccagcgagcccggcacacctgctcccggcaccccttggactgcctgataaaatggaggcccagcttggatacatggatgaaaaagaccctggtgcccagaaacctcgacagcctctcgaggtgcaggctttgcccgctgctctggatagggtggagagcgaggacaagcacgagtcccccgcaagtaaagaacgggctagggaagaacgacctgaagagacagaaaaagcgccacccagtcccgagcagctgcctcgagaggaagttctgcccgaaaaagaaaagatcctggacaagctagagctatctttgatacatagtagaggggacagctcagaactacgcccagatgacaccaaagcggaggaaaaagaacctattgaaactcagcagaacggggacaaggaggaggatgacgagggcaaaaaggaggacaagaagggcaagtttaagtttatgtttaacattgctgacgggggatttacagaattacacaccctctggcagaacgaagagcgcgctgcagtctcttcaggaaagatctacgacatttggcacagaaggcatgactactggttgctggctggtatagttactcacggatatgccaggtggcaagatattcagaacgaccctagatacatgatcttaaacgaacctttcaaatcagaggtccacaaaggcaattatctggagatgaagaataagtttttggcccgtcgctttaagctgctggagcaagccttggttattgaagagcagctgcgcagagccgcatatctgaatatgacacaggatcccaatcatcccgcaatggccctgaacgccaggttagccgaggtagagtgcctcgcggagagccatcaacatcttagtaaagagagcttagcagggaataaacctgctaatgccgtcttacataaggtactcaaccagttggaggagctgctgagtgatatgaaagccgatgtgactcggctgccctccatgctgtccagaatccccccagttgccgctagactgcagatgtccgaacgtagcattctctcaaggctcacaaacagggccggagaccctactatccagcagggcgctttcgggtcatcgcagatgtactcaaacaattttgggcctaacttccggggtccaggccctggagggattgtcaattacaaccaaatgcccctcggcccatacgtcactgatatatac

SEQ ID NO: 218325 - DNA, 2427 bp, Artificial Sequence
  Description of Artificial Sequence: Synthetic coding sequence
atgatctacaggttcgttactcgcgctagtgtcgaagaaagaattactcaggttgcgaagagaaaaatgatgctcactcatctggtggtcagacctggtctcggttctaaaagtggttcaatgacaaagcaggagctggatgatatcttaaaattcggaactgaagagttgttcaaggacgatgtggaaggtatgatgtcccaggggcagagaccagtgactcctatccctgatgttcaatcctcaaaaggtggaaatctggcagcctctgctaagaaaaaacatgggagcaccccccctggggataataaagacgtggaggactctagcgtaatccattatgacgatgctgctatcagcaagttgcttgatcgaaaccaagacgccactgacgatactgagctgcagaatatgaatgagtatttgtcatcgttcaaagttgctcagtatgttgtcagagaggaggacggtgtggaagaagtcgagagagagatcatcaagcaggaggagaacgtggaccctgattactgggagaaattgttgaggcaccactatgagcaacagcaggaggatttggcgagaaatctcggtaaaggcaagagaatccgcaaacaggtcaactacaatgacgcctctcaggaagaccaggagtggcaggatgagctctccgataaccagagtgaatactcaattggcagcgaagacgaggatgaggattttgaagaacgcccagaaggccaatccggaagacggcagtccagacgacagctgaagtctgaccgagacaagcccttaccacctctgttggcgagggttggcggtaacatcgaggttctgggttttaatgcacggcagagaaaggccttcctcaacgctatcatgaggtggggtatgcctccccaggacgccttcaatagtcactggctggttagagatctgcgagggaaatccgaaaaagagttcagagcgtacgttagcctgttcatgcggcacttgtgcgaacccggagcagatggagccgagacctttgctgacggcgtcccacgggagggcctttccaggcagcatgtgctgacccggattggcgtgatgagcctggtgagaaagaaagtccaggaattcgagcatgtgaatggcaagtactcaaccccagatctcatccccgagggaccagagggtaagaagagcggcgaggtgatcagctcagaccctaatacccccgtacctgcatctcccgctcatcttttgcccgctccattaggcctcccagacaaaatggaggcacagcttggatatatggacgaaaaagacccaggtgctcagaagccacgccagcctctggaggttcaggcattgcctgcagctctggaccgagttgaaagcgaggataaacatgaatccccggcttcgaaggaacgcgctagagaggaaaggcctgaagaaaccgaaaaagcccctccttctcccgagcagttgcctcgagaagaggtcctgcctgagaaagagaagatcctcgacaagctggaacttagcctcatccactcgaggggtgatagcagtgagctccgcccagatgacacaaaagccgaagaaaaagaaccaatagagacccagcagaatggggataaagaagaagacgacgaaggtaagaaagaagataaaaagggcaaatttaagttcatgtttaacatcgcagacggtggattcacagaacttcacacactgtggcagaatgaggagcgggctgctgtgagctcaggtaagatctacgacatatggcataggaggcatgactactggctccttgccggaatagtcacgcatggctatgcccgatggcaggacatccagaacgaccccaggtacatgatactgaatgaacctttcaagtcagaggttcacaaaggcaactacctggagatgaagaacaaattcctggctcgccgatttaaactgctcgaacaggctctcgttattgaggaacaactccgcagagctgcctacctgaacatgacacaagacccaaaccatccagcgatggccttgaacgcccgattggcggaagtcgagtgtttagctgaatcacaccagcatctctctaaggaatcactcgccggaaataagccagcaaacgcagtcctccataaagttctgaatcagcttgaggaattgctgtccgacatgaaggctgatgttacccgcctcccttcgatgctgtctcgcatcccccctgttgccgctcgcctgcagatgagcgaaagaagcatcctgtcccggctcactaatcgagctggagatcctactatacaacagatctcatcccgtcctcgggactttcctgtcctccagaggtcctttccagcagaacccaggctcccgggtcacttgcctgaccctcatggaagggagaagctgcccccattttag

SEQ ID NO: 218326 - DNA, 3588 bp, Artificial Sequence
  Description of Artificial Sequence: Synthetic coding sequence
atggtgggccttccgggacccgatgtggaaccaagcctgcctcctcctaaaccccttgaaggaatccccgagcgcgagttctttgttaagtgggctggtttatcctactggcactgttcttgggtgaaggaactgcagctcgagctgtaccacacggtcatgtacaggaattaccagcggaagaatgacatggatgagccccctcccttcgactacggcagcggtgacgaggatggtaagtccgaaaagcggaaaaacaaggaccccttgtatgctaagatggaagagcgcttctacaggtatgggatcaagcccgagtggatgatgattcacaggattttaaaccacagcttcgataaaaagggggacgtgcactacctcataaaatggaaagacttaccgtatgaccagtgcacatgggaaatcgacgacattgatatcccgtactatgataatcttaagcaggcctattggggccacagagaactcatgttaggcgaagatacccgcctgccaaagcggcttctaaaaaaaggaaagaaacttagagatgataagcaggagaagccacccgacacccctatagtggaccctacagttaaattcgataagcagccatggtacatcgacagcactggcggaaccctgcacccatatcaattggaagggctcaattggctgcgcttctcatgggcacaggggactgacaccatactcgcagatgaaatgggcctgggtaaaacagtgcagacaatcgtatttctgtattcgctctataaggagggccacagcaagggcccttatctcgtttccgcacccctttccaccatcattaactgggagagagagttcgagatgtgggcaccggacttttacgtagtcacctatacaggagataaggaatctaggtcagttatcagagaaaacgaattttcctttgaagacaatgccataagatcgggcaaaaaggtctttaggatgaaaaaggaagtgcagattaaatttcacgtgctcctgactagctacgaactgattaccatcgaccaggctatcttggggagtattgagtgggcttgcctcgtggtcgatgaggcccaccggttgaagaacaaccagagcaagtttttccgggttctgaattcttacaagatcgattacaagctgctcctgactggaacaccattgcagaataatcttgaggagcttttccacctcttgaattttctcacaccagaaagatttaataatctggaaggatttctcgaggaattcgctgacatcagcaaagaggatcagattaagaaattgcacgacctgttaggccctcacatgctcagaagacttaaagctgacgtctttaagaacatgccagccaagaccgaactcatcgtgcgcgttgagctgagtcagatgcaaaagaagtattacaaatttatcctgactcggaactttgaggccctgaacagtaaagggggaggcaatcaagtgtctctgctcaatatcatgatggatttgaagaagtgttgtaatcacccgtatctctttccagtcgctgccgtggaggcgcctgtcctgccaaatggctcatatgatggttccagcttagttaaaagtagcggcaagctgatgctgttgcagaaaatgctcaagaaactccgggacgagggtcatcgcgtcctgatctttagccagatgacaaaaatgctcgacctattggaagactttctggagtacgaaggctataagtatgaaagaatcgacggcggaataacgggaggcctgcgacaggaagctattgacagatttaacgcacctggagctcagcagttttgctttctgctatccacgcgtgctggcggtctgggcataaacctcgccactgctgatacagtgataatctacgattctgattggaatcctcataacgatattcaagcctttagcagagcacaccggatcggccagaacaagaaggtcatgatttaccggttcgtgactcgggcttccgttgaggagcgcattacacaggttgctaagcggaagatgatgcttactcaccttgtcgtgcggccaggactgggcagcaagagtgggagcatgactaagcaggagctggatgatatcctcaaatttggcaccgaagagctttttaaagacgatgtggagggcatgatgagtcaggggcagcgtcctgttacgcccatccccgatgtacaaagcagcaagggaggcaaccttgcggcatcagccaagaaaaagcacggtagcacgcccccaggcgataacaaagatgtagaggatagtagcgtgatccactacgatgatgcagctatttcaaagctcctggatcgtaaccaggacgccactgacgataccgaactccaaaacatgaatgagtacctgtcgtcatttaaggtggcccagtatgtcgtgagagaagaggacggagtcgaggaagttgaaagagaaatcattaagcaggaggagaacgtggacccagactactgggagaagcttcttcggcaccattatgagcagcagcaggaggatctcgctaggaaccttggaaagggaaagcgcatcagaaaacaagtgaactacaatgacgccagtcaagaggaccaggagtggcaagatgaactgtctgataaccagagtgagtacagcattggaagtgaggatgaagatgaggacttcgaggagaggcctgaaggccagtcaggcagacgacagtcgcggaggcagctcaagtctgatcgggataaaccgctgcctcccctcttggctagagtgggtgggaacatcgaggtgttgggcttcaatgccagacaaagaaaagcttttctgaacgcaataatgagatggggcatgccaccacaggatgcgtttaatagccattggctggtgcgggacctgcgtggtaaaagcgagaaagagtttcgagcttatgtgagcctattcatgagacatttatgcgagcctggggctgatggagcggagacattcgccgatggggttccgcgtgaaggcttgagtcgtcaacatgtgctgacacggatcggggttatgtcgctggtgagaaagaaagtccaggaattcgagcatgtgaatggaaagtatagcacccccgacctgattccagagggcccagagggcaagaaaagcggggaggttatttcctctgatcctaatacgcccgtccctgcctctcccgctcatctgttgcccgctccccttggcctgcctgacaagatggaggcccagttgggctatatggacgaaaaggatcctggggcacagaaaccacgccagcccttggaagttcaggccctgcccgctgcacttgatcgggtagagtccgaggacaaacacgagtcaccagccagcaaggagcgggctagggaagaacgcccagagcaaacccccccagcgcaggcccagctcagaggagggcgtccattgtcccccggtacggcccctgggtggcaaagggaaggccctgggcttggcgctaggcgtgctaggtcccccagtcagggcggaccagggggtgggggaagctcctttggttcccaagccccactgtag

SEQ ID NO: 218327 - DNA, 2427 bp, Artificial Sequence
  Description of Artificial Sequence: Synthetic coding sequence
atgatttatcggtttgtaaccagagcatctgttgaggaacggataactcaggttgccaaacggaaaatgatgctgactcatctggtagtgaggcccggactgggaagcaaaagtggctctatgaccaagcaggagctggatgatatccttaagttcgggacagaggagttgttcaaggacgacgtcgaggggatgatgtctcagggccagcggcctgtgacccccatccctgacgtgcagagctccaaaggtgggaatctggctgcttcagctaaaaaaaaacacggttccacgcccccaggggacaacaaggacgtcgaggactcgtctgttatccattacgatgatgctgccattagcaagttactagaccgtaaccaggacgccacagacgacaccgaactccaaaatatgaatgagtatctctcctcgttcaaagtcgctcagtacgtcgtgcgagaggaggacggtgtcgaggaggtagaacgggaaattattaagcaagaggagaatgtggatccagactattgggaaaagctattacgtcaccactacgaacagcaacaggaggatctcgcaagaaacctcggtaagggaaagcgcatcagaaaacaggttaactataacgatgctagccaagaggatcaggaatggcaggacgagcttagcgataaccaatccgagtattctatcgggtcagaagatgaagacgaggatttcgaggaaaggcccgaggggcagtcgggccgaagacagagtaggagacagttaaaaagcgacagggacaagccgctgcctccgctgctggccagagtcggcggtaacattgaagtactgggttttaatgctagacagaggaaggccttcctgaatgctatcatgagatgggggatgccaccacaggatgcattcaattcacactggttagttcgggaccttcgcggaaaaagtgaaaaggaatttcgggcatacgtcagcctctttatgcggcacctttgtgaaccgggagctgatggcgctgaaacttttgccgatggcgtccctcgcgaaggcctgtcccggcagcacgtgctcactaggatcggagttatgtcacttgttcggaagaaagtgcaagagttcgagcacgtgaacggcaagtattccacaccagatcttattccagagggtcctgagggcaaaaaatcgggcgaggttatcagttctgacccaaatactccagtgcctgcaagcccagcccatctgttacccgcaccgttgggtttaccggacaaaatggaggcacaactgggctacatggacgagaaggaccccggagcccagaagcctagacagccactcgaggtccaggccttacccgctgcactggaccgagtcgagtccgaagataagcatgaaagccccgcttccaaggagcgggcacgcgaagagcgccctgaggagaccgaaaaagctcctccatcaccagagcagctgcccagagaggaagttctgcctgaaaaggagaagatcctggacaagctggagctctcactgatccattcccggggagacagctccgaattgaggccagatgatacaaaagccgaagaaaaggagcccattgagacccagcagaatggcgataaggaagaagacgacgagggaaaaaaggaagacaaaaagggcaaattcaagtttatgttcaacattgccgatggagggttcaccgagctgcacactctttggcagaatgaggaacgagcagcggtctcctctggcaagatttacgatatttggcaccgtagacacgactattggttgctagccggaatcgtgacccatggttacgcccgttggcaggacattcagaatgatcctaggtatatgattctgaatgaacccttcaaatcagaagtccacaagggtaactatcttgagatgaagaacaagttcctggccaggcgctttaaactgctcgaacaggctctagtcattgaggagcagttaagacgggctgcctatttgaacatgactcaagaccccaatcaccccgctatggccttgaatgcccgactcgccgaagtcgaatgcttggcagagtcccatcaacatctctccaaggaatccctggcaggaaacaagccagccaacgcggttctccacaaggtgctgaatcaactggaagagctgctgagcgatatgaaggctgacgtgaccaggttgccatctatgctgagcagaatcccgcctgtggccgcacgcctgcagatgtcagaacgcagcattctgtccaggctcaccaacagggctggagaccctaccatccagcagatatcgtccagaccacgggactttccagtgctccagagatcattcccagcagaaccgaggcttccgggacacctaccagacccccatggtagggagaagttgcccccattttag

SEQ ID NO: 218328 - DNA, 3288 bp, Artificial Sequence
  Description of Artificial Sequence: Synthetic coding sequence
atgattcatcgtatcctgaaccactcttttgataaaaagggcgatgtgcactatctgattaagtggaaagatttaccttacgatcaatgtacctgggagattgacgatattgacatcccctactacgacaaccttaagcaggcttattggggccaccgagagctgatgcttggagaggataccaggctgccaaagagactcctgaagaagggaaagaaactgagagacgataaacaggaaaagcctcctgacactcccatcgtagaccccaccgtgaagtttgataaacaaccatggtacattgattccaccggtggcaccctgcatccttatcaactggaaggcctgaactggctgcggttcagttgggcacaaggaacagacacaattctcgctgatgagatgggtctggggaagactgtccagaccatagtttttctctattcattgtacaaagagggccactcaaagggcccttacctcgtgagcgcccctttgtccactattatcaactgggagcgcgagtttgaaatgtgggccccagacttttacgtcgtgacttacactggagataaggaaagccggtcagtcatacgggaaaatgagttttcctttgaggataatgccatccgatcagggaaaaaagtgttccgtatgaaaaaggaggtgcagattaagttccacgtgctcctgactagctatgagcttatcacgattgatcaagccattctcggttcgatcgagtgggcttgtctggtcgtcgacgaagcacatcgtctgaagaacaaccagagtaagttctttcgtgtgctgaatagctataaaatcgactataagctgcttctgactggaaccccgctgcagaataacctcgaagagctgttccacctgctaaatttcctcactcccgagcgcttcaataatttagaaggcttcttggaagagtttgccgacatttctaaggaggaccaaatcaagaaacttcatgacctcctaggcccacatatgttgagacgtttaaaggccgacgtttttaaaaatatgcccgctaaaacagaattaatcgttcgtgtggagctaagtcagatgcaaaaaaagtactataagtttattctgacacggaatttcgaagccctcaactcaaagggtggaggtaatcaggtgtcactacttaatattatgatggatcttaagaagtgttgcaatcatccctacttgtttcccgttgccgctgtcgaggcacccgttctgcccaatggatcctatgatgggtccagcctggtaaagtctagcggtaaactgatgctactgcaaaaaatgctgaaaaagctcagggacgaaggccacagagtgctgatcttctcccagatgacaaagatgctggatctactggaagactttttagagtacgaaggatataagtacgagagaatcgacggcggaatcaccggcggattacgtcaggaagccatcgataggttcaacgccccaggtgctcagcagttttgcttcctgctgtcaactcgggcagggggtctcgggattaacttggccaccgcggacacggtcattatttacgattccgactggaatccacacaatgatatccaggcattctcccgggctcatagaatcggtcagaacaagaaggtgatgatatatcggtttgtgactagagctagcgttgaggagcgcataacccaagttgcaaagcgaaagatgatgctcacccacttggttgtgagacctggacttggttctaagagcgggtcaatgacaaaacaggagctggacgacatccttaagttcggcacagaggagctgttcaaggatgacgttgagggcatgatgtctcaaggccagcgcccagtgacaccaattccggacgtgcaatctagcaagggtggcaacctagccgctagtgccaagaaaaagcatggtagcacacccccaggtgacaacaaggacgtcgaggacagtagtgtaattcactacgatgatgctgcaatctcaaaactgcttgaccgcaaccaggatgccaccgatgacacagagttgcaaaatatgaatgagtatctgtccagctttaaggttgcccagtacgtcgttagagaggaggacggcgtggaagaagtcgaaagagagattatcaagcaagaggagaatgtggacccagactattgggaaaagctattgaggcatcactatgagcagcaacaggaggatttggctaggaatcttggtaagggaaagcgcattcggaaacaggtgaattacaatgacgcctcgcaggaagatcaggagtggcaggacgagctttctgacaatcagagcgaatatagtatcggttcagaggatgaggacgaagatttcgaggagaggccagaggggcagtccggcagacggcagtctaggagacagttgaagtctgaccgagacaaacctctcccaccgctgctcgcccgtgtgggagggaacattgaggttcttggattcaatgcacggcagagaaaagcattcctaaacgcaattatgaggtggggaatgcctccacaggatgcctttaactcacactggcttgtgcgtgatcttcggggtaagagtgagaaagagtttagagcctacgtaagcctgtttatgcgccacttgtgtgagccgggagcagatggagcagagacattcgcagacggagtgccgagggaggggctgtcccgacaacatgtcctgactcgaattggggtgatgtcattggtccggaaaaaggtgcaagagttcgaacacgttaacggcaagtacagtactccagacctcatcccagaaggccctgaaggtaagaaatctggtgaggtaatttcatccgatcctaatactccagttccagcaagtcctgctcacttacttcccgctccgctggggctgcctgataagatggaagcgcaacttgggtatatggatgagaaagacccgggagcacaaaaacctcggcagccgctggaggtccaggccctgcctgcagcgctggacagagtggaaagcgaagacaagcacgagtccccagcttccaaggagcgagccagggaggagcggccagaggaaacggagaaggcgccaccaagtcctgaacagcttcccagagcctcttgtagcgtcacccaagctggcgttcaatggagacatcgattaatgggcgcatttatcagcagcgcacaggctacactgcctccccagctgccggagcagagacgttgctttctgcgtcggcgaaggagttggacctcatggtcgtag

SEQ ID NO: 218329 - DNA, 3258 bp, Artificial Sequence
  Description of Artificial Sequence: Synthetic coding sequence
atgatccataggatcttgaatcattccttcgataagaagggtgatgttcattatctgattaaatggaaggacttgccctatgaccagtgtacctgggagatagatgatatagatattccctattatgacaatctgaagcaggcatattggggacacagggaactgatgctgggagaggacacacggctgcccaaacggctccttaaaaagggaaaaaaactgagagacgataagcaggagaagccccctgatacacccatcgttgatcctacagtcaagtttgacaagcagccctggtacatcgactcaacgggaggcacccttcacccttatcagctcgaagggctcaattggctgcgctttagctgggcccaaggaaccgatactatcttagctgacgagatggggcttggtaagactgtacagacgattgtgtttctgtacagtctttacaaggaaggacacagcaaagggccttacttggtatcagccccactctctaccatcatcaactgggaacgcgaatttgagatgtgggctcccgacttttatgtggtgacgtataccggtgacaaggaatcacgctctgtcattagggagaacgagtttagcttcgaagacaacgccatcagaagtggtaagaaagtgtttcgcatgaaaaaggaggtccagattaaattccacgttttgctgacgtcttacgagttgataactatcgaccaagctattttaggatcaattgaatgggcttgcttagtcgtcgacgaagcccacaggctcaaaaataatcaatcaaaattttttcgagtgctgaattcttacaagatcgactataagttgctcctgaccgggacccctctgcagaataatctggaagagctttttcatttactcaatttcttaactccagagcgcttcaacaacctcgagggtttccttgaggaatttgcagacatttcaaaagaggaccagattaaaaaacttcacgatctgctcggccctcacatgctgcgcagactaaaagcagacgtgtttaagaacatgcctgccaagaccgaacttatcgtgcgggttgagctgagccagatgcaaaaaaagtactataaattcatcctgacgcgtaacttcgaggcgctgaattctaaaggaggcggaaaccaagtgtccctgctgaacatcatgatggaccttaagaaatgttgcaaccacccctatttgtttccagtggccgctgtcgaagcaccagtgttgcccaatgggtcttatgatgggagtagccttgttaagtcaagtggcaaattaatgttactacagaaaatgttgaaaaaattgagagatgaaggtcatagagtactgatattcagtcagatgactaagatgctggatttgctggaagacttcttggaatacgaaggttataagtacgagagaattgatggaggcattactggaggacttagacaggaggccatcgacaggtttaacgctccaggcgctcagcagttctgctttcttctaagcacgcgcgcaggcggattaggtatcaacctggctactgccgacacagtgatcatctatgactccgattggaatcctcacaacgacatacaggccttttctagagcccatagaatcggacagaacaaaaaggtgatgatatataggttcgtgacccgagctagcgtggaggagcggatcactcaagtggcgaaaaggaaaatgatgcttacccatctagtggtcaggccaggcctgggcagcaagtcaggttctatgacaaagcaagaactggacgacattctgaaattcgggactgaggagctcttcaaggacgatgtggaggggatgatgtctcaggggcaacgacccgtgactcccatcccagatgtccaatcatctaaagggggaaacctggccgctagcgcgaagaagaagcatggatcgactccaccgggagataataaagacgtcgaggattcaagtgtgattcattacgacgacgccgctatctcaaagcttctcgacagaaaccaggatgcgaccgacgataccgagctgcaaaatatgaatgaatacttatcatccttcaaagtggcccagtacgttgtccgggaagaggacggggttgaggaagtggagcgagaaataattaagcaggaggaaaatgttgacccagattattgggagaaactccttcgccaccactacgaacagcaacaggaggacctggccaggaatttgggcaaaggcaagcgtattcgtaaacaagtcaactacaatgacgcctcccaagaggaccaggagtggcaggacgaactgagcgacaatcaaagcgaatactccatcggcagtgaagacgaagatgaagacttcgaagagcgcccagaagggcaatcaggtcgaaggcagagccgaaggcaactaaagtcagatagagacaaacctctcccaccactactggctcgcgtcgggggtaatatcgaagttttaggattcaacgccagacagcggaaggccttcctaaacgcgataatgcgctggggaatgccaccacaggacgcattcaatagtcactggctcgttcgtgatctgcgcggtaagtcagaaaaggaattccgcgcatacgtgtccttgtttatgagacacctttgtgagccgggagctgacggagccgaaactttcgcggatggcgtgcctagagaaggcttaagtagacagcatgtgctcacacggatcggcgtgatgagcctggtcaggaagaaggtgcaagagttcgagcatgttaacgggaaatatagcactccagacctgatccctgaagggccagaaggaaagaaaagtggtgaggtgataagctctgatcccaataccccagtccccgcttcacccgctcatctgctgcccgctcccctcggcctgcccgataaaatggaagcgcagctcggctacatggatgagaaagacccgggagctcaaaagcctagacagcctctcgaggtccaggcactgccggctgcactagaccgggttgaaagcgaagataagcacgagtccccggcaagcaaagaaagggcacgtgaggagcggccagaggaaaccgagaaagcccctccctcccccgaacaactgcccagagctagctgttcggtcacacaggccggagtgcagtggaggcatctcggtagctgggaacctttgagccctcggttaaaaagaccatcccacctcagtttcctgaaccgcggaggagcatcatag

SEQ ID NO: 218330 - DNA, 8994 bp, Artificial Sequence
  Description of Artificial Sequence: Synthetic coding sequence
atggcagatcctgggatgatgagtctctttggcgaggatggcaacatttttagcgaaggactggaaggattgggcgagtgcggctaccccgaaaacccagtcaacccaatgggtcaacagatgcctatcgaccagggcttcgctagtctgcaaccatctttacatcacccttcaaccaaccagaaccagacaaaactgacccacttcgaccactacaatcaatatgagcagcagaagatgcacttaatggatcaaccgaaccgcatgatgtctaacacgcctggaaatggcctggcgtcacctcactcacaataccacaccccccctgtcccccaggttcctcatggcggatctggagggggtcagatgggagtctatcctggtatgcagaacgaacggcacgggcagtcctttgtagatagtagctccatgtggggcccacgtgccgtgcaagtgccggaccagattagggccccataccagcagcagcagccgcagccccagccgcctcaacccgctccatccggaccacccgctcaggggcacccacagcatatgcagcagatggggtcctatatggccaggggtgactttagtatgcagcagcatggccaaccacaacagcggatgagccagttctcccaaggacaggagggcctaaatcaaggcaacccctttattgcaactagtggccctggacatctcagtcacgttccacagcagagtcccagcatggcgccttctcttagacattcagtgcagcagtttcaccatcacccctctaccgcattacatggcgagtccgtcgcacattctccccgtttctctccgaacccccctcagcagggagcagtgagaccccagaccctgaacttttctagtaggtctcagactgttccttcaccgactatcaacaatagcggtcagtacagccggtatccttattccaacttgaaccaaggcctagtcaacaatactggcatgaatcagaacctggggctgactaataacacccctatgaaccagtccgtgccacggtatccgaatgccgtcggttttcctagtaacagtggacaggggctaatgcaccagcaacctatccacccttccggctctctgaaccaaatgaacacacaaacaatgcaccccagccagccacagggtacctacgcgagtccaccccctatgtcacccatgaaggcaatgagcaaccccgctgggactcccccacctcaggtaaggcccggttctgccggaattcccatggaggtcggctcatatccaaacatgccccatccacagccaagccaccagcctccgggagctatggggataggccagaggaatatgggcccaaggaacatgcagcagagtcggccattcatcggcatgagttcagctccccgagaactcactggacatatgcgtcctaatggatgccccggagtggggttgggcgacccccaagccatccaggagaggctcattccagggcaacagcacccagggcagcagccatcattccaacagcttcccacctgccccccactgcaaccccaccctggcctccatcaccagagctctccccctcacccgcaccaccagccatgggcccagctgcatccctccccccagaacaccccccagaaggtgccagtccatcaacacagtccatctgaacctttccttgagaagccagttcccgacatgacccaagtgtcaggccctaatgctcagttagtcaagtccgacgactatctgccttcaattgagcagcagccccagcagaaaaagaagaaaaagaaaaataatcacattgtggccgaggatcccagcaagggtttcgggaaggacgactttcccggtggggtcgataaccaggagcttaaccgaaattcactagacggctctcaagaggagaaaaaaaaaaagaagcgcagtaaagccaagaaggaccccaaggagcctaaagagcccaaggagaagaaagagccaaaagaacccaaaaccccaaaagcgcctaagattccgaaggagccaaaggaaaagaaagctaagactgcaactcccaaaccaaaatcaagcaaaaagtcctcgaataagaagcccgattccgaggcaagcgcgctgaagaaaaaagtcaacaagggaaagactgagggctctgagaactcggacctggacaaaaccccaccacccagtccaccccctgaggaagatgaagatcctggcgtgcagaaaaggcgatcgtctaggcaggttaaacgaaagcgctacaccgaggatcttgaattcaaaatttccgatgaagaagcagatgatgcggacgccgctggcagggattctccctctaataccagccagtcggagcagcaggaatccgttgacgctgaaggtcccgtggtcgagaaaatcatgtccagtaggagtgtgaagaaacagaaagagtctggcgaagaggtggaaatcgaggaattctatgtgaagtacaaaaacttttcctatttacactgtcagtgggcgtcgatcgaagacttagagaaggacaaacgtatccagcagaagatcaagcggttcaaagcaaaacaaggacagaacaagtttttgagtgaaattgaggacgagctgtttaatcccgactatgtcgaggtggataggattatggattttgccagaagcaccgacgatcgcggtgaacccgtgactcactatttggtaaagtggtgtagtctgccttatgaagatagcacatgggagaggcggcaggatatcgaccaggccaaaatcgaggagttcgagaaattgatgagccgtgagccagagacagaacgggtggaaaggccgcctgccgacgactggaagaaaagtgagtcctccagggaatacaagaataacaataaactgcgcgagtatcagctcgagggagtcaactggctgttattcaactggtataatatgcggaactgtattttagcagatgagatgggcctaggaaagaccatccaaagcataacttttctgtatgagatctatcttaaaggcattcacggccctttcttggtgatcgccccactgagcaccatccccaattgggagcgggaattccggacatggacagagctgaatgtcgtggtctaccacgggagtcaggccagccgtagaaccatccagctgtacgagatgtactttaaagacccccagggacgcgtgatcaagggatcttacaaatttcacgccataatcaccacatttgagatgatcctcactgactgccccgaactgcgcaatataccctggagatgtgttgtcatcgatgaggcccaccggctgaagaaccgcaattgcaagcttcttgagggacttaaaatgatggacctggaacataaggtgcttctgacaggaactcccctgcagaataccgtcgaggagctgttttctctcctgcacttcctggagccatccagattcccctctgaaacaacctttatgcaggagtttggagatctgaagacagaagagcaggtccaaaagctgcaggcaatcctcaagcccatgatgctaagacgcctcaaggaggatgtcgagaagaatctcgccccaaaggaggaaactatcattgaggtcgaactgacgaatattcagaaaaagtactaccgagctatcctcgagaaaaatttcacattcctttcaaagggcggaggtcaggctaatgtacctaatttactaaatactatgatggagcttcgcaagtgctgcaatcacccctacctcattaatggtgcggaagagaagattctggaagagtttaaagagacccataatgctgaatcaccagactttcagctgcaggcaatgattcaggcagcaggtaagctggtgctgatcgataaactcctgccaaagttaaaagcaggtgggcacagggtactgattttttcccagatggtgcggtgtcttgacattttagaagactatcttatccagcggcgttacccctacgaacgcattgatgggagagtgcgcggaaatctgcgacaggccgctattgatcgtttcagcaagcccgacagcgaccgtttcgtctttctactctgcactagagccggaggtcttggtattaatttgactgccgctgacacatgtatcattttcgacagcgattggaacccacaaaacgacctgcaagcacaggctagatgccataggattgggcaatctaagtcagtgaaaatttatcgactgattacccgcaattcttatgaacgagagatgttcgataaggcaagccttaaactgggacttgacaaggctgtgctgcaatccatgtcgggcagggaaaacgctacaaacggcgtacagcagctatcgaagaaagaaatcgaggacctactgagaaagggcgcttatggggctctgatggacgaggaggacgaaggtagcaagttctgtgaagaggacattgatcagatattattgagaaggacccatactatcactatagagtcggaaggcaaagggagtacattcgcaaaggccagctttgtcgcctctggcaaccggaccgacatctccttagacgacccaaacttctggcagaagtgggccaaaaaggccgagctggatatagacgctcttaacggcagaaacaacttggttatcgatacccccagagtgaggaaacagacccgactgtactcagcagttaaagaagatgaactcatggagttttcagacctggagagtgatagtgaggagaagccatgcgccaagccgcgacgaccacaggataaaagccagggatacgcgagaagcgagtgctttcgcgtcgagaagaatttattggtgtacggctggggacggtggaccgacatcctttctcacggacgctataagcggcagctcacagagcaggatgttgaaactatttgccgaactattcttgtctactgccttaaccattataaaggcgacgaaaacattaagagctttatttgggatctgatcacccctacagcagatggacagacccgagccctggtgaatcactcaggtttaagcgcccctgtaccccgtggtagaaagggcaaaaaggtgaaagcccagagtacccaaccggtcgtgcaagatgccgactggctggcatcttgtaaccccgatgccctgtttcaagaagattcctacaagaagcatctgaagcaccactgcaataaagtactgctcagagtcagaatgctctattaccttcgtcaagaagtaataggcgatcaagccgacaagatactggaaggtgcggatagcagtgaggccgacgtgtggatcccagagccgttccatgcggaggtaccagctgactggtgggacaaggaagctgacaagagtttgctgattggggtgttcaagcatggatatgagaaatataactctatgcgggctgatcccgctctgtgctttctcgaacgagttggtatgccagacgctaaagcaatcgcagcagagcaacgagggaccgacatgctggccgacggaggcgacgggggagaattcgacagggaagacgaggaccctgaatacaagcctacaagaacgcccttcaaagatgaaatcgatgaatttgcgaactctccaagcgaggacaaggaagaatctatggagatccacgccactggaaaacattcagaatccaacgcggagctcggccagctctactggcccaacacttccacactcaccactcgcctgcggaggctaatcaccgcctatcagcggagctataagcgccaacagatgcgtcaggaagcactgatgaaaactgatcgaaggagaagacgaccacgagaagaggtcagggccctcgaagccgagcgcgaggctatcatctcagaaaagaggcagaagtggacacggcgtgaggaggccgacttttaccgcgttgtgagcactttcggggtcatttttgacccggtgaagcagcagtttgattggaaccagttccgcgcttttgcaaggttagataaaaagtccgacgaatcccttgagaaatacttttcttgttttgtggctatgtgtcgtcgtgtgtgcagaatgccggtcaaacccgacgacgaacctccagacctgtctagcatcattgaacccatcacagaggagagagccagcaggaccctttacaggatcgagcttctacggaaaattcgggagcaggtactgcaccatccacagctgggtgagaggctcaagctgtgtcagccaagccttgacctccctgagtggtgggagtgtgggagacatgatcgcgatctactggtgggcgcagccaaacatggcgtctccagaactgattaccacatcttaaacgaccccgagctgagctttctcgacgctcacaagaatttcgcccagaatcggggagcaggaaatacttcttcactcaatcctctagcagtggggttcgtccagaccccacccgtgatctccagcgcgcatattcaggacgagagggtcctggagcaagctgaagggaaagtggaggagcctgagaatcccgctgccaaggagaagtgtgaaggtaaggaggaggaggaagagacagatgggagtggcaaggagtccaagcaagagtgcgaggccgaagccagtagtgtaaaaaacgagctcaaaggggtagaggtaggagcagatactggctcaaaaagcatcagcgagaaaggatccgaggaagacgaggaggaaaaactggaagacgatgataagagtgaggaaagttctcaaccggaagccggagcagtgagcagaggcaaaaacttcgacgaggaatccaatgcctcaatgagcactgcccgtgacgagactcgggacgggttctatatggaggatggagatcctagtgttgcccagctgctgcacgagagaacctttgctttctcgttctggcccaaagatcgcgtcatgattaacagattagataacatctgcgaggcagtgctgaaaggcaaatggcctgttaatagaaggcagatgtttgactttcaaggcctgatccctgggtatacacctacaaccgtagactctcctctccagaaacgaagcttcgcagaactctcgatggttgggcaagcctccatatcgggttctgaagacattaccacgtccccccagttgtctaaagaagacgccttaaacctgagtgtcccaaggcagcgccgtcgacgccgacggaagatcgagatcgaggccgaacgggcagcaaagcgtagaaatctcatggaaatggttgcccagctcagagagtcacaagtggtgagcgagaatggccaggagaaggtggtcgatctgagcaaagcttcgagagaggcgacaagttccacctctaacttctcctctctgagtagcaagtttattctccctaatgtatccacacccgtgtcagacgcctttaagactcaaatggagctgctccaagcaggacttagcagaaccccgaccaggcacctcctgaatggctccttagttgacggagagcctccaatgaagaggaggagggggagaaggaagaacgtggagggattggacctgctgttcatgagccataagcgcactagcctctctgcagaagatgccgaggtgacaaaggcctttgaagaggatatcgagacccctccaactcggaacattccatctcccggacagctggaccctgacacccgaattccagtgataaatctggaggatggcacacgtctggttggcgaggacgcccctaaaaataaagacctggttgaatggctgaaattgcacccaacatataccgtcgatatgcctagttacgtgcccaaaaacgccgacgtgctttttagctctttccaaaagccaaagcaaaagcgacatcggtgtcggaatcctaacaaacttgatattaacaccctgacaggtgaagagcgcgtgcccgtcgtaaataagagaaatgggaagaagatgggcggagcaatggcccctcccatgaaggatctcccacggtggctggaagaaaaccccgagttcgcagtggcgcctgactggaccgatatcgtcaaacaaagcgggtttgtaccggagtccatgttcgacaggttgcttaccggccctgtcgtgagaggagaaggggcttcgcgccgtggacgcagacccaaatcagaaatagccagagctgccgctgctgctgccgcagtggcttcaacaagcgggattaaccccctgctggtgaactccctattcgcgggaatggatctcacttcattacagaacttacaaaatctgcagtctcttcaattggcaggtctcatgggtttccctcctggtctcgcaactgccgctactgccggtggcgatgcaaagaaccctgcagccgtgctgcccttgatgctgcccggtatggcaggactgccgaacgtgttcggcctgggcggattgcttaataacccactttctgctgccaccggcaacacaaccaccgcaagcagccagggggaaccggaagacagcacaagcaagggggaggaaaaaggcaacgagaacgaagatgagaacaaagattctgaaaagtcgaccgacgcagtgtcagccgctgatagcgcgaacggctcagtgggcgcagccacggcacccgcaggactcccttcaaacccgctggcgtttaatccattcctgctgagcaccatggcgcctggactgttctaccccagtatgttcctcccgccagggctcggcggtctgactctccccggattccccgcacttgccggactgcagaatgctgtgggatcatcagaggaaaaggcggcagacaaagccgaaggaggcccattcaaggatggagaaactctcgaggggtctgacgcagaagaatccttggataagactgcagaaagcagcctcctggaggacgagatcgcccagggcgaagaactggatagcttggacggcggagatgaaatcgagaataatgaaaatgacgagtac

SEQ ID NO: 218331 - DNA, 8993 bp, Artificial Sequence
  Description of Artificial Sequence: Synthetic coding sequence
atggccgaccctggcatgatgtccctttttggtgaggacgggaatattttctcggagggtctggagggtttgggagaatgcggatatcctgaaaatccggttaatccaatgggacagcagatgccaatcgaccaaggtttcgcaagcctccagccttccctgcatcatcccagcactaaccagaatcagaccaagctcacccactttgaccactacaaccagtacgagcaacaaaaaatgcacctgatggatcagccaaaccgaatgatgtctaacactccaggaaacggtctggcctcaccccacagccaataccacactccaccagtgccgcaggtacctcacgggggtagcggcggaggacaaatgggtgtttatcctgggatgcaaaacgaacgccatggacagtcgtttgtggattcttcttcaatgtgggggccacgcgcagtacaggtccccgatcagatcagggcgccataccaacagcagcaacctcagccccagcctcctcaacccgcaccatctgggccacccgcacagggtcatccacagcacatgcagcagatgggctcatatatggcgagaggtgacttctcaatgcagcagcacggtcaaccacagcagcggatgtcccagttctctcagggacaggaagggctgaatcagggtaatccttttatcgccacctctggaccgggtcacctgagccacgttccccagcaaagtccaagtatggctccatctttgaggcattcagtgcagcagtttcaccaccaccctagtactgccctacatggcgaatctgtggcacacagccctcggttcagccctaaccctccccagcagggagctgtgagacctcagactctcaatttcagctcacgttcacaaactgtccctagccccacgataaataacagtgggcagtattcgaggtatccgtattccaatctgaaccagggtttagtgaacaacactggaatgaaccagaacctgggactgacgaataatacacctatgaaccaatccgttccgcgttatccaaatgccgtggggtttccctccaactctggtcagggccttatgcaccagcagcccatccacccgtctggctcactgaaccagatgaatactcagaccatgcatccaagccagccccagggaacatacgcttccccccctccaatgagtcccatgaaggctatgtctaaccccgctgggacacccccacctcaggtccgacctggcagcgctggcatccccatggaggtgggttcttacccgaacatgccacatcctcagcccagtcatcagccaccaggcgctatgggcatcggacagcgaaatatgggaccaaggaatatgcagcagtcacgcccattcatcggtatgtcctctgcgcctcgggaattgacgggccacatgagacctaacggctgcccaggcgtgggcctcggtgatcctcaggcgatccaagaacgattaatccctggacaacagcatcccggtcagcagccctcattccaacagttgcccacgtgtccaccattacagcctcacccaggtctgcaccaccagtcctccccaccacacccacaccaccagccttgggcccagctccaccccagtccgcagaacactccccagaaggtgcccgtgcaccagcactcccctagcgagccgtttctggagaaaccagtccccgatatgacgcaggtctcaggacccaacgcccaactggtgaaaagcgatgactatctgccctcaattgaacaacagcctcagcagaaaaaaaaaaagaagaaaaacaaccatattgtagctgaggatccatcaaaaggtttcggcaaggatgactttccaggcggagtggacaaccaagaacttaaccggaacagtctggatggctcacaagaggaaaagaaaaaaaaaaagaggtctaaagcgaaaaaggatcccaaagaaccaaaagaacctaaggagaagaaggaaccaaaggagcccaagacgcccaaagcaccaaagataccaaaggaacctaaggagaaaaaagctaagaccgcaacacccaaacccaaatcctcaaaaaagtcctctaacaagaagcccgactccgaggcttctgctctgaagaagaaggttaacaaggggaaaaccgaaggatccgagaactccgacctggataagaccccccctccgagcccaccacccgaggaggatgaagacccaggtgtgcagaaacgtagaagttccagacaggttaagcgcaagagatatactgaagatctggaattcaagattagcgacgaagaggccgacgatgctgacgcagccggacgggacagcccttctaacacctcacagagcgaacagcaagaatccgtcgacgccgaagggcctgtcgttgaaaaaattatgtcttctaggtccgttaaaaagcagaaggagtccggtgaggaggtggagatagaagagttttatgtgaaatataaaaattttagttacctgcactgccagtgggcttcgatcgaggacttagagaaagataagaggatccagcagaagataaaaaggttcaaggccaagcagggccaaaacaagttcctgagcgagattgaggacgagctatttaaccccgattatgtcgaggtcgatcggatcatggacttcgctaggtcaaccgatgataggggagagcctgtaactcattaccttgtgaagtggtgctcgcttccgtacgaggattctacatgggaaagacgacaagacatcgaccaggctaaaatcgaagaattcgagaaactgatgtctcgagagccggagaccgagagagtagaaagaccgcctgctgatgactggaagaagagcgagtccagcagagagtacaaaaacaacaataagctacgtgagtatcagcttgaaggagttaactggctcttgttcaattggtataacatgcggaactgcatcctcgctgatgagatggggcttggcaaaactatccagagcatcacctttctatacgagatctacctgaaaggcattcatggcccattcctcgtcatcgcccctctgtcgacaataccaaattgggagagagaattccggacctggacggagctgaacgtagtggtctaccatgggtcccaggcgagccgcaggaccatccagctatatgagatgtatttcaaggacccacaaggaagggttatcaagggttcctataagtttcatgccataatcactacatttgagatgatcctgacggactgtcccgaattgaggaatattccatggagatgcgttgtaatagacgaggcgcataggttgaagaatcgaaattgcaagttgctggagggcctcaaaatgatggacctcgaacataaagtcctgctcaccggaactccattgcaaaatacggtggaggaactgtttagccttctccacttcctagagcccagtaggtttccttcagaaacaacctttatgcaggagtttggcgacctgaaaactgaggagcaggtgcagaagctccaggccattctgaagcctatgatgctccggaggctgaaggaggacgtggaaaaaaaccttgctccaaaagaagagacaattattgaagttgagctgaccaacattcagaaaaaatattaccgggctattctcgaaaagaactttacttttctgagcaagggtggcggacaagctaacgtgcctaatctcttaaacacaatgatggaactcaggaagtgttgcaaccacccatatctgattaacggtgccgaagaaaaaatcctggaggagttcaaagaaacacacaacgccgaatcacctgatttccagctgcaggccatgatccaggccgcaggcaaattggtgcttattgataagctcctgccaaaactgaaagcgggagggcacagagtacttatttttagtcagatggtcaggtgtctggacatactagaagattacctcatccaaagaaggtatccttatgagcgaatcgacggtagagtcaggggtaacctcaggcaggccgctattgatcgattctctaaacccgattccgacagatttgtctttcttttgtgcacgagagcaggtggcctgggaatcaacctgacagctgcagacacgtgcatcatctttgacagtgactggaacccccagaacgatctgcaggcccaggcacgatgccatagaatcggccagagcaagtcggttaaaatctaccggctcatcactcgaaactcttacgagagagaaatgttcgataaagcatctctcaagctggggttagataaagcagttttacagtctatgagcggccgtgaaaatgccaccaacggggtgcagcagcttagtaaaaaggagattgaggatttgttgcgcaagggcgcatatggggctctcatggacgaggaagatgagggatccaaattttgtgaagaggacatagaccaaattctgctgaggcggacccatacgatcacaatcgaatctgaaggcaagggctccactttcgcaaaggcctctttcgtggcgtccggcaaccggacagacataagcttggatgatcccaatttttggcagaagtgggctaagaaggcagagctggacattgatgccctgaatggaagaaacaacctcgtaatagatacccccagagtgagaaagcagacgaggttgtactctgcagtgaaggaagacgaactcatggagttcagcgatcttgaaagtgacagcgaggagaaaccatgtgctaaacccagaaggccccaagataaatcccaaggctacgcgaggagcgagtgcttccgagttgagaagaatttgctcgtgtatgggtggggcagatggacggatatactgagtcacggcagatacaaacgtcagctgaccgagcaggacgttgaaacaatctgccgtaccattctggtctattgtctcaatcactacaaaggggacgagaacataaagtcctttatttgggaccttataacaccgacagcagacggtcagacgagagctctggtaaaccacagcggcttatctgctcctgtaccgagaggcaggaaaggtaagaaggtgaaagcccagtcaacacaacctgttgtgcaggatgccgactggttggcctcctgtaaccctgatgcgttgttccaggaagactcctacaaaaagcacctcaaacatcactgcaacaaagtcctgctgagggtccggatgctgtactacttaagacaggaagtgataggggaccaggctgataagatcctggaaggggctgactctagtgaagctgatgtctggatccccgaacccttccacgcggaggtccctgcagactggtgggacaaagaggccgataagagcttgttaattggagtgtttaaacatggctacgagaagtacaactccatgagggccgatccagccctgtgctttctcgagagggtcgggatgcctgacgccaaggcgattgctgcggagcaacgagggactgacatgctggccgacggcggagacggcggagagttcgatcgcgaagacgaggaccccgagtataagccaactagaactccgttcaaggacgagatagacgaatttgcaaactcaccatctgaagataaggaggagtccatggagattcacgccacaggaaaacattccgaatccaacgctgaactgggacagttgtattggcccaatacatcaactcttaccacacgcctgcgtcggcttatcacggcgtaccagaggagctataaaaggcagcagatgcgccaggaagctctgatgaagactgacaggaggagacgtcgaccgcgagaagaagtgcgagcgcttgaagcggagagggaagcgatcatttccgagaagagacaaaagtggactagaagagaggaggctgacttctatagggtggtgagcaccttcggtgttatttttgatccagttaagcaacagttcgactggaatcagttcagagcttttgctcgactggacaagaagtcagacgagtcacttgagaaatatttcagctgtttcgtggccatgtgccgccgtgtatgccgaatgcctgtgaaaccagatgacgagccacccgatctctcttctattatcgagccgataacggaagaaagggcatcccgcaccctctacagaatcgagctattacggaagatccgcgaacaggtgctacatcatccacagttaggagagagacttaagctctgccagccatctctcgacctccctgaatggtgggagtgcggtaggcacgatcgagacctgttggtcggagctgccaagcacggcgttagtaggaccgattaccatattctgaacgaccctgaattatctttcctggatgctcacaagaactttgcccagaaccgcggagccggtaatacttccagtctgaaccccctcgctgtgggtttcgtacagactccgcctgtgattagctctgctcatatccaggatgagcgtgtattagagcaagcagaggggaaagtcgaggagccagaaaaccccgctgcgaaagaaaagtgcgaaggaaaagaagaggaggaggaaacagacgggtcagggaaggagtcaaagcaggagtgtgaggctgaggcctctagtgtgaagaatgagctcaaaggggtcgaggtgggagccgacaccgggtctaaatcgatttcagagaagggcagcgaggaagacgaggaagagaagctggaggacgatgataaatcagaggaaagttcccagcccgaggccggagccgtgagccgcggtaagaacttcgacgaggaaagtaatgcctcaatgagtacagccagggatgaaactagagacggattctatatggaagacggggatcccagcgttgctcagcttttgcacgagcgtacctttgctttctcgttttggcccaaggaccgcgtgatgatcaatcgattggacaacatatgcgaggcagttttaaagggcaaatggccggttaatcggcgtcagatgttcgattttcaggggctcattcccggatacacacctaccaccgtggatagccccctgcagaagcgctccttcgccgagctcagcatggtgggtcaggcttcaatttctggatcagaagatatcaccacttctccccaactgagcaaggaggatgcattaaacctcagtgttcccaggcagcggcgtcgcagaaggcggaagatcgaaatcgaagccgagcgagcagcaaaacggcgaaaccttatggagatggttgctcagctccgagaaagccaagttgtgagcgagaatgggcaagagaaggttgtggacctttcaaaagcatccagagaggcaaccagttccacctccaacttcagttccctctcttcgaagtttatcctgccgaacgtcagtactccagtgtccgacgcgtttaaaacccaaatggagttactacaggccggactcagcaggacaccaaccagacacttattaaacgggtcacttgtggatggcgaaccaccaatgaagcgtcgacgcggacggcgtaagaatgtcgagggcttggatcttctcttcatgagccacaaaagaacgtctttaagcgcagaagacgctgaggtgacaaaggcgttcgaggaggacatcgagaccccacccacaaggaacatcccatcaccagggcagctcgatccggatacccgaattccagtgataaacctcgaagatggcacgcggttagtcggcgaagatgcccctaagaacaaggacctggtcgagtggctgaagctccacccaacttatacagttgatatgccctcttatgttcctaaaaacgcagacgtgcttttcagctccttccaaaaacccaaacaaaagaggcataggtgccgaaaccctaacaaactcgacatcaatactcttaccggagaagagagagttcctgtcgttaacaaaagaaatggcaaaaaaatggggggagccatggccccacctatgaaggaccttccgaggtggctggaagagaacccagagttcgctgtggcccctgattggacagacatcgtgaagcagagcggttttgtacctgaaagcatgtttgatcgattgctgaccgggcctgtcgtacggggagaaggcgcttccagaaggggccgaagacctaagtcggagattgctagagcagccgctgcagcagcagcggtggcaagcacctctgggataaacccactcctcgtgaactcactgttcgctggcatggacctcacaagtctccagaatctgcagaatctgcagtcccttcagctggccggtctgatggggtttcctcctggcctggccacagctgctacagccggtggcgatgctaagaatcccgctgccgtgctgccactgatgcttcccggtatggccggtttacccaacgtatttgggctgggtggtctgctgaataatcctctctctgcagctactggaaacacaacaactgccagcagccagggtgagcctgaagactctacaagtaaaggtgaggaaaaggggaatgagaacgaggacgagaacaaggatagcgagaaatccacagatgcggtgtcggctgcggattctgccaatggcagtgttggcgcagcaacagccccagccggactgccttctaatcccttagctttcaatccttttttgctgagtacgatggcccctggtctgttttacccatccatgttcttacctccagggctgggagggttaactttgccagggttccccgcacttgcgggattgcagaatgccgtcggttctagcgaggagaaggctgccgataaggctgaagggggacccttcaaagacggcgagacactggagggctccgacgcagaggagagcctggacaagacagccgagagcagtctgctggaggatgagattgctcagggtgaggaactggatagtctggacgggggagacgagattgagaacaatgagaacgacgaata

SEQ ID NO: 218332 - DNA, 102 bp, Artificial Sequence
  Description of Artificial Sequence: Synthetic coding sequence
atggctgatcccggtatgatgagtctgttcggtgaggatggaaatattttctcggagggccttgaggggttgggggaatgcggctaccctgaaaatccctag

SEQ ID NO: 218333 - DNA, 6906 bp, Artificial Sequence
  Description of Artificial Sequence: Synthetic coding sequence
aaaggggagtccaagagaattacgttagtactacagcagccacagagtggcggtccgcaggggcacaggcatgttgtgctgggctcattacccggaaaaatagtgctccagggaaaccaattggccgcactcacccaggctaagaacgcacagggccagcctgcaaaggtcgtgaccatccaattgcaagtgcagcagcctcagcagaagatacagattgtgccacagccacccagttcccagccccagccgcaacagccaccatctacacagccagttactctgtcaagcgtgcagcaagctcagattatgggaccgggacagtcacctgggcagagattgagtgtgcccgtgaaagtggtcttgcagcctcaggcaggctcatctcagggtgctagctcaggtctgagcgtcgtcaaagtcctgtctgcttccgaagtcgccgctctgagttctcctgctagctctgccccacactccggtggaaaaaccggaatggaagaaaatcggcgattagagcatcagaagaagcaggaaaaagctaaccggatcgtagctgaggcgatagctagagctagggccaggggtgagcagaacattcctcgcgtccttaacgaggatgaactgccatcagttcgtccagaagaagagggagagaagaagagaagaaagaagagcgcaggtgagagactgaaggaggaaaaaccgaaaaagtccaagacgtccggagccagcaaaaccaagggaaagtcgaagcttaatactataaccccagtagtgggaaagaagaggaaaaggaatacatcttcagataacagtgatgtagaagtgatgcccgctcaatccccaagagaggacgaggagtcatccattcagaaacgacgttcgaatagacaggtgaaaagaaagaaatatactgaagacttggacatcaagatcacagatgacgaggaggaggaagaagtggacgtgacgggacccatcaagccagaacccattttgcccgagcctgtgcaagagcctgacggggagacactcccctccatgcagttttttgtagagaacccttccgaggaggacgcagctatcgttgacaaagtgttgagcatgcgaattgtgaagaaagagcttccatcaggccagtacacagaggctgaggagtttttcgtcaagtataagaattacagctacctgcactgcgaatgggcgaccatcagtcagctggaaaaggataaacgaatccaccagaagctgaagcgctttaaaacaaagatggcccagatgaggcatttcttccatgaagacgaggaaccgttcaacccagactatgtggaggtggatcggattctagacgaatctcacagcatcgacaaggataacggggaaccggtgatctactaccttgtaaagtggtgctccctgccctatgaggacagcacatgggaacttaaggaggacgtggatgaggggaagatcagagagtttaagcgcattcagagccgacaccctgaactgaaaagagtcaatcgtccccaggctagcgcttggaaaaaactggaactttcccacgagtataaaaaccgcaatcaactacgcgagtatcagctcgagggcgtcaattggttgttgttcaactggtataatcgccagaattgtatcctcgcagacgagatgggccttggtaaaacaatccagagcatcgctttccttcaggaggtttacaacgtcggaatacacggcccatttctggtgatcgctcccctctcaacaataacaaattgggagcgggagtttaacacttggacagagatgaacacaatcgtgtaccatggatccctggcgtcgagacagatgatccagcagtatgagatgtactgcaaggattctagggggcgactcatccccggtgcttataagtttgatgccctgattactacctttgaaatgatcctatctgactgtccggaactccgtgagatagaatggcgctgcgtgattatagatgaagctcacagacttaagaaccgtaactgcaagcttcttgattcattaaagcacatggacctggagcacaaagtgctcctcacaggcaccccattgcagaatacagttgaggagttgtttagtctgctgcactttctcgaaccctcccagttcccgtcagagagtgagttcctcaaggactttggtgacttaaagacagaggaacaggtgcagaaattgcaggcaatcctaaagccaatgatgctcagaaggcttaaggaagacgtggagaagaacctggccccaaagcaggagactattatcgaggttgaactaacaaatatacagaagaagtactacagagcaattctagaaaaaaacttctcgtttcttagcaagggtgccggacacaccaacatgccgaacttactcaataccatgatggagctgcgtaagtgctgcaaccacccatatctcatcaacggggctgaggaaaagattttgacagaatttcgggaggcttgtcatatcatcccccacgacttccatcttcaggcaatggtgagatcagccggaaaactggtgttgatcgataaattattaccaaaactgaaggccggaggacataaagtgctgatcttcagccagatggtccggtgcctggacatacttgaggattatctcattcagagaaggtacttatacgagcggatcgacggacgagtacgtggcaatttacgtcaggccgcaatcgaccggttttcaaagccggacagtgatcggttcgtttttcttttgtgcacaagggccggtggattggggataaaccttacggcagcagatacctgtatcatatttgacagtgattggaacccacagaatgatttgcaggctcaggcccgatgccatcgcataggccagagtaaagctgtgaaagtgtatagactgatcacaaggaattcctatgaacgagagatgttcgacaaggcaagcctaaaactggggctcgataaggccgttcttcagtcaatgagtggccgagatgggaatattactgggatacaacagttctccaaaaaggagatcgaggacctgctgcggaagggcgcttacgctgctatcatggaagaagatgatgagggcagcaagttctgcgaggaggatattgaccagatcctcctgagaagaaccacaacaattacgatagagtccgaagggaaaggcagtaccttcgcaaaggccagttttgtggcctcagaaaatagaacggacataagtctcgatgaccccaatttctggcagaaatgggctaaaaaagccgacctggacatggacttgctcaactctaagaacaatctcgtcattgataccccgcgtgtgcgtaagcagacacgacacttttccaccctgaaggatgacgatctggtggaattcagcgatctagagtcagaggacgatgagagaccgaggtcccggagacacgatcgccaccacgcctacgggaggacggactgctttagggtggaaaagcaccttttagtgtatggctggggtcgatggagggacattctctctcatggacgcttcaagagaagaatgaccgagcgcgacgtggaaaccatctgtagagccattctagtttattgtctgttgcattatcgcggagatgaaaatataaaggggtttatttgggaccttatcagccctgcagagaacggcaaaactaaggaactgcagaaccacagtgggctatcaattccggtgcctagaggcaggaagggcaagaaggtaaagtcacagagtacctttgacattcacaaggccgattggataaggaaatacaacccagatactctgttccaggacgagtcctacaagaaacatcttaagcatcagtgtaataaagttctcttacgggttcgtatgctgtattacctcagacaggaagttatcggagatcaagccgagaaggtactcggaggagccattgccagcgaaatcgacatctggttcccagtggtggaccagcttgaggtgccaacaacttggtgggattcggaagcggacaaaagcttgctgataggagtgtttaaacatgggtatgagaagtacaacaccatgcgtgctgatccagccctctgtttcctggagaaagctggacgccctgatgacaaggcgatagctgctgagcatcgcgttctggataacttttcagacattgtagaaggtgtcgatttcgacaaagattgcgaagatcccgagtacaaaccgctgcagggcccacctaaagaccaggatgacgaaggagaccccctcatgatgatggacgaagaaatcagcgtcattgacggggatgaggcacaggtgactcagcagcctggacacttgttctggccacccggtagtgcccttactgcgaggctgcgaagacttgttactgcctatcagcggagttacaaacgggagcagatgaaaattgaggctgccgaaaggggtgacaggcgtagacggagatgtgaggccgcatttaagctgaaagagattgccaggcgagaaaaacagcagaggtggacacgtcgggagcagacagacttttacagagtcgtttctactttcggagtcgagtacgatcctgatacaatgcagttccactgggataggtttcggaccttcgcccgtttggacaagaagaccgacgaatctttgacgaagtattttcatgggtttgtggcaatgtgccgacaagtgtgccgacttcctcctgccgcaggagacgagcccccagatccaaatctctttatcgagccaatcacagaagagcgggcaagccgaaccctgtatcgcatagagctgctccggagacttcgggaacaggtgctgtgtcatcctctgttagaggaccgtctcgccctctgtcagccccctggacccgagcttcccaagtggtgggagccggtacggcatgatggtgagctgctcaggggtgccgctagacatggtgtgtctcagaccgattgtaacattatgcaagatcccgactttagctttctggcagctcggatgaactacatgcaaaatcatcaggctggcgctcctgcaccctcattgtccagatgttccacaccgctgctccaccaacagtacactagcagaactgccagtcccctcccgctccggccagatgccccagtcgagaagtcaccagaagagactgccacccaagtgccgagcctcgaatccttgacgctgaagctagagcacgaggtggtcgccaggtctcgtcccactcctcaggactacgaaatgagagtatcaccaagtgatacaactcccttagtctctagatcagtgccccctgtcaagctcgaggacgaagatgacagtgattccgagctggacctgagtaaactgtcaccttcctcatcgagcagcagctcatcgagctccagctcatccagcaccgacgaaagtgaggacgagaaagaggaaaagctcaccgaccaatcacgaagtaaattgtatgatgaagagtccctgctttccctgactatgtctcaagatgggttccccaacgaagacggcgagcagatgactcccgagctgctcctcttgcaggaaagacagcgcgcatctgaatggcccaaggaccgagttttgatcaacagaatcgatttggtgtgtcaggccgtgctgagtgggaagtggccttctagcagacgctctcaagagatggtcacaggcggtatcctaggcccaggcaatcatctgctagatagcccatcccttacccccggagaatacggtgattctcctgttccaactcccaggtcttcgtccgccgcttctatggccgaagaggaagcaagcgcagtttccactgccgctgcgcaattcacaaagctaaggcgaggcatggacgaaaaggaattcaccgtccagatcaaggatgaagaggggctcaaattaacattccagaagcacaagctgatggccaacggagtgatgggggatggccacccattatttcacaaaaagaagggcaatcgaaaaaaattggttgagctggaagtggagtgcatggaagaacctaatcatctggatgttgacctggaaactaggatcccagtaataaataaagtcgacggcactctgctggtgggggaggacgccccaaggcgcgctgagctggagatgtggctgcaaggacatccagaattcgcagtggatcctagattcctcgcctacatggaggacagacggaaacaaaagtggcaacggtgcaaaaaaaacaataaggcggagctgaattgccttggcatggaaccagtacagaccgcgaactcacgcaacggtaagaagggtcatcacaccgaaaccgtgtttaatcgggtactgcccggaccaattgcacccgagtcctccaagaagagggccagaagaatgcgccctgacctctctaagatgatggccctgatgcagggcggaagtaccggtagtctctcactccacaacacatttcagcactcaagctccgggttacagtccgtgagttctctcggtcactcgtcagccacgtccgccagtctgccattcatgcctttcgtgatgggaggcgctccctcctctccgcatgtggactcctctactatgctgcatcaccaccaccatcatcctcatccccatcatcatcaccaccaccaccctggtctgcgcgctcccggttaccctagcagcccagtcacaacagctagcggaaccacgctgcggttacccccactgcagccagaggaggatgatgatgaagacgaggaagatgatgacgacctgagccaagggtatgatagctctgagagggacttcagcttgatagacgaccccatgatgcctgctaatagcgacagctccgaagatgcggatgactac

SEQ ID NO: 218334 - DNA, 7745 bp, Artificial Sequence
  Description of Artificial Sequence: Synthetic coding sequence
atggccgatccaattatggacctctttgatgatcccaatctctttggcttggacagtcttaccgacgacagtttcaaccaagtgacacaggaccctatcgaggaggcattggggctgccgagcagcctggattctctggaccagatgaatcaggacggcggaggaggggacgtggggaattcgagcgcctccgaactcgtccccccaccggaggaaacggcaccaactgaactgagcaaggagtcaaccgctcccgctcccgagtcaattaccctacacgactacacaacacagcccgcatctcaggaacagccagcccaacccgtcttacagacatcgactcccacctccggccttctacaggtcagtaagagccaggagatactctcacagggaaacccctttatgggggtaagcgccactgccgtgagttcctcttcagccggtggccaaccaccacaaagcgcccctaagatcgtgattctgaaggctccaccatcttcgtcagtgaccggcgcacatgtggcccagattcaggcccagggcataactagcacggcccagcccctggtggccggtacggcaaatggcggaaaggtgacgttcactaaggtcctcaccgggacaccgctccggccaggggtgagcatcgtatctggaaacacggtccttgccgctaaggttcctggaaaccaggctgctgtgcaaaggatcgtccaacctagccgtcctgtcaaacagctggttctgcaacccgtcaaaggctccgccccagcaggaaatccaggggctacagggccacccctgaaacccgcagtgaccctcacttccacccccacccagggcgaaagtaaacgcattaccctggttctccagcagcctcaaagcgggggaccccaggggcaccggcacgtcgttctcggcagtcttcctggcaagatcgtcctccagggcaaccagctggcagctttgacccaggcgaagaatgctcaaggacaacctgccaaagtcgtgacaatccagctacaggttcagcagccccagcagaagatccagattgtgcctcagcccccttctagccagccacagccccaacagcctccatccacccagccagtaaccctgtcctccgtccagcaggctcagatcatgggccctggtcagagccccggacaacgtttgagtgttcccgtgaaggtagtcctgcaacctcaggctggtagttctcagggggcttccagcggcctcagcgttgtcaaggtgttaagcgctagcgaggtggctgctctgagcagtccagccagcagcgctccacactctggaggaaaaactgggatggaggagaaccgcaggctcgaacaccagaaaaagcaggagaaggcaaaccgcatcgtggccgaggccattgcgagagctcgggctagaggcgaacagaatattccacgggtcctgaatgaggatgaacttccaagtgtccgccctgaggaagagggcgaaaagaaacgacgaaagaagtcagccggagagcggctcaaagaggagaaaccaaagaagtctaaaacgtcaggcgctagcaagacgaaaggaaagtcaaagcttaatacaatcacccctgtcgttgggaagaagcggaagcgcaacacctccagcgacaattcggacgtcgaggtgatgccagcacagtctccaagagaagacgaagaatcctctatccagaagcgaagaagcaatagacaggtgaagaggaagaagtacactgaggatttggacataaagatcacagacgacgaggaagaggaggaagtggatgttactgggccaatcaaaccagagccaattcttcctgagcccgtgcaggaacccgacggggagaccttaccctcaatgcagtttttcgtggagaatccatctgaggaggacgcagcgatagtagacaaggtgctgagtatgaggatcgtcaaaaaggagctgccaagtggtcagtacaccgaggcggaggaattttttgtcaagtacaaaaattattcatacttgcactgtgaatgggccactatctcccagttagaaaaggataagcgcatacaccagaaattgaagcgttttaaaactaagatggcccagatgcgacacttcttccatgaggatgaggaaccattcaatcccgattatgtcgaggtggacaggatcttagatgaatcacactctatcgacaaagacaacggagagcccgttatctactatctggtgaaatggtgctcccttccgtatgaagatagcacctgggaactgaaagaagatgtcgacgagggcaagatccgagagtttaaaagaattcagagccggcacccagaattgaaaagagtgaatcgccctcaggctagtgcgtggaaaaagctggaactgagccacgaatataaaaatcgcaaccagctgcgagaataccagcttgaaggggtcaactggctgctgttcaattggtacaatagacaaaactgtatcctcgccgacgaaatgggcctggggaaaactattcagagtattgctttcctgcaagaggtgtataacgtaggaattcacggccctttcttagttattgccccactttctactatcaccaactgggagagggagtttaatacatggaccgaaatgaatacaattgtttaccacggcagcctggccagcaggcagatgatccagcagtatgagatgtattgtaaggattccaggggtagactgattcctggtgcatataagttcgatgctctaatcacaaccttcgagatgatcctttccgattgtcctgaattaagggagatagaatggcgatgtgttataatcgatgaggctcatcggctgaaaaaccgaaattgtaagcttttggacagtctaaagcacatggacctggaacataaagtcctgttgactggcacgccgttacagaacaccgtggaggagctattctctctcttgcatttcctggagccatctcagttcccgagcgaaagcgagtttttaaaggactttggcgaccttaaaacagaggagcaggtgcaaaagctgcaagccatcctaaagcctatgatgctgcgcaggctcaaggaagacgtcgaaaagaatcttgccccaaagcaggagacgatcatcgaagtcgaactgacaaacatacagaaaaagtattacagagctattctcgaaaagaactttagttttttgagtaaaggggctggtcatacaaacatgccaaacctcctcaatacgatgatggagctgagaaagtgctgcaatcatccatacctgattaatggagcagaagagaaaatcctaaccgagttccgtgaggcttgccacatcatccctcacgacttccatctgcaggcaatggtcaggagtgccggtaagctcgttctgattgacaagttgctgccgaaactcaaagcagggggacacaaagttctgatcttcagtcagatggtacggtgcttggatatcctggaagactaccttatccagcgcagatacctatatgaaaggatcgacgggcgagtacggggtaacctgcgccaggccgctattgaccgattttccaaacccgattccgaccgtttcgttttcctgctgtgtactcgggcaggcggtttgggaattaatttaacagctgcagatacgtgtattatcttcgatagcgattggaacccccagaatgatttgcaggcgcaagcacgttgccatcgcattgggcagtctaaagcagtgaaagtctaccgccttattacccgtaactcctacgagagagagatgttcgataaagccagtctgaagctcggcctggataaggctgtgctccagtctatgtcagggagagacggtaacatcaccggaattcaacaattttccaaaaaggaaatagaggatttgctgcggaagggagcctatgcggctatcatggaagaagatgacgagggttctaagttctgtgaggaagatattgaccagattttgctacgtaggacaactaccatcactatcgagagcgagggaaaagggagtacgttcgctaaagccagcttcgtggcttcagagaatagaacagacatttccttagacgaccccaatttctggcagaaatgggccaagaaggccgacttggatatggatctgctgaactctaagaacaacctcgtcattgacaccccacgggtccgaaagcagactcgacacttttccactcttaaagacgacgacctggtggagttttccgatttggagtctgaggatgatgaacggccacgcagcagacgtcacgaccggcatcacgcttatggacgcacagactgcttcagggttgagaagcatctgctagtgtacgggtggggcagatggcgtgatatcctgtcgcatggcaggtttaaacgccgtatgaccgaacgagatgtcgagaccatctgcagggctatccttgtgtattgccttttgcactaccggggtgatgagaatatcaaagggttcatatgggacctgatctctcctgcagaaaacggcaaaaccaaagaactgcagaatcatagcggtctgtcaattcccgtgcccagaggcaggaaaggcaagaaggtgaagagtcaatctacgttcgatattcataaggccgattggatcagaaagtataatccagataccctgttccaagacgagagctacaagaagcatctgaagcaccagtgcaataaggtgctcctgcgtgtgagaatgttatattacctgcggcaagaggtgattggagatcaagccgaaaaagttctgggtggcgcaatcgcctcagagattgacatttggttccctgtcgtagatcaactcgaagtgcctaccacctggtgggacagcgaagctgataagtccctgctcattggcgtgtttaaacacgggtacgagaaatataacaccatgcgggcagaccctgccttgtgttttctggagaaggcgggtagaccagacgataaagcgatcgccgctgagcacagggtgctggacaacttttcggacatcgtcgagggcgtggacttcgataaagattgcgaggatccagaatataagccactgcaggggcctcctaaagatcaggatgacgaaggcgaccccctgatgatgatggacgaggagatcagtgtgatagatggggacgaagcccaggtcacccagcagcccggtcatctgttttggccccctgggtccgcgttaactgcacgtctaaggagacttgtgacagcataccaaaggtcttataaaagggaacagatgaaaattgaggctgccgagaggggagacaggcgtcgtaggcgatgtgaagctgccttcaaattaaaggagattgccaggagagagaagcaacagaggtggactaggcgtgagcaaactgacttttatcgggtggtgtccactttcggagttgaatatgacccagacaccatgcaatttcattgggacaggtttaggacgtttgctcgcctggataaaaaaacagatgagtccctgacaaaatacttccacggctttgtggcaatgtgccggcaggtctgccggctacctcccgctgctggggacgaacctcctgaccctaacctatttatcgaaccaatcacggaagagcgggcatccaggacactctaccggatagaacttctccgcagattgcgagagcaggtcctgtgtcaccccctgctcgaagacagattagccctctgccaaccccctggcccagagttgccaaagtggtgggaacccgtgagacatgacggggaattattgaggggcgctgccaggcacggagtgagccagaccgactgcaacatcatgcaggaccctgacttcagcttcctcgccgctaggatgaactatatgcaaaaccatcaggccggagctccagcaccatctctgtcaaggtgcagcactccgctgctgcatcagcagtacacctcccgcactgcctccccccttcccctacgcccagatgctcctgtagagaaatcaccagaagagacagcaacccaggtaccatccctcgagtccctgactctgaaacttgaacatgaggtagtcgctcgcagtcgtcctacgccccaggattatgaaatgcgcgtctccccttcagacactaccccgctcgtgtcaagatccgtgcctcctgtcaaacttgaggatgaagatgacagcgactctgagttggacttatcaaagctgtcgccatctagtagctcatcctcttccagcagcagctcttccagtagtacagatgaaagcgaagatgaaaaagaggaaaagctgactgatcaaagcagaagcaagctttatgacgaggagtcccttctgagcctcaccatgagccaggatggcttccctaacgaagacggcgaacaaatgactcccgaactgctgctgttgcaagagaggcagcgcgcttcagagtggcctaaagaccgggttttgattaacaggattgatctcgtgtgtcaagctgtgctgtctggcaagtggccttccagcagacgatcccaggagatggtgaccggagggattctcgggccaggcaaccacctgttggattctccgtcattgaccccgggagagtatggcgatagccccgtgcctacccctaggagttcatcggcagcatccatggcggaagaagaggccagcgctgtatccaccgccgctgctcagttcactaaactgcggagaggaatggacgagaaggagtttaccgtgcagatcaaggacgaggaaggcctcaagctgacatttcagaaacacaagcttatggccaacggggttatgggcgatggacacccattatttcacaaaaagaaaggaaaccgcaaaaagctggttgaactggaggttgagtgcatggaagaacctaaccacctggatgttgatttggaaacaaggatccccgtgattaataaggttgatggtaccctgctggtgggagaagatgctcctaggcgcgcagagctggaaatgtggctgcagggtcaccccgagtttgcagtcgacccccgttttctcgcatacatggaggacaggaggaagcagaaatggcagagatgcaaaaagaacaacaaagccgaattaaactgcttaggcatggaacctgtccagacagcgaactctcgaaacgggaagaaaggccatcacaccgagaccgtatttaacagggtgttaccaggacccatagcgcctgaaagtagcaaaaagcgcgctagaaggatgagacccgatttaagtaaaatgatggcattgatgcagggaggatccaccggcagtctcagtctccataacacctttcagcatagcagctcggggcttcagtctgtaagcagcctggggcattctagtgccacatcggcatcccttcctttcatgccgtttgttatgggaggagcgccatcctctcctcacgtggatagttcaaccatgctgcatcaccaccaccaccatcctcacccccaccaccatcatcaccatcatcccggtctgcgagccccaggttacccatcttcccccgtgacaaccgcttcaggaacaacacttagacttccgcctctgcagccagaagaagacgatgatgaagacgaagaagacgatgatgacctgagccagggatatgatagtagcgagcgggatttttcgttaatagatgaccctatgatgcccgcaaactcagactcatcagaagatgctgatgatta

SEQ ID NO: 218335 - DNA, 6908 bp, Artificial Sequence
  Description of Artificial Sequence: Synthetic coding sequence
atgaaaggggaaagcaaacgcattactctcgtactgcaacaaccacagtcggggggtcctcagggtcatcggcatgtggttctcggctccttaccaggcaaaatcgtcctgcaaggcaaccagctcgccgcacttacacaggctaagaacgcccagggccagcccgcaaaggtcgtgactattcaattgcaggtacagcagccccagcagaagattcagattgttccacagcccccaagttctcaaccgcagccacagcagcctccatccacccagcctgtgacactcagtagtgtgcagcaagcccagattatgggccctggacagtcgccaggacaacgactctccgtcccagtgaaagtcgtgctgcaaccacaggcgggatcctcgcagggcgcatcatcaggactatccgttgtgaaagttctcagcgcgagcgaagtcgccgctctgtcatccccagcctcgtcagccccacactctggaggcaaaacagggatggaggagaaccgtcgcctcgagcatcagaagaaacaggaaaaagccaacagaatcgttgctgaggcgatcgctcgggcaagggccaggggagaacagaatattccgagggttctcaacgaggatgagctgcccagcgtgagacccgaggaagaaggggaaaaaaaacgccgtaagaaaagcgcaggggaacgcttaaaggaggagaaacctaaaaagagcaaaacgagtggagccagcaaaaccaagggaaaatccaagctgaatactattactcccgtagtgggcaaaaagagaaaaaggaataccagtagcgataacagcgacgtggaagttatgcccgcacagtcacccagagaggacgaagagtccagcattcaaaagcgccgtagcaacaggcaggtgaagcgcaagaaatacacagaggacctggacataaaaatcaccgacgacgaagaggaggaggaagttgatgtcacgggccctatcaaaccagaacccattttgccagagcctgtccaggagccggacggtgagactctgcccagtatgcagttttttgtggagaatcctagcgaggaagatgctgctatcgtggataaggtgttgagcatgagaattgtgaagaaggaacttccatccggacagtataccgaggctgaggagttcttcgtgaagtacaaaaattattcttaccttcactgtgagtgggcgacaatcagccaactggaaaaggataaacgaatccatcagaagctgaaacggtttaagactaagatggcacagatgcgtcacttttttcacgaggacgaagaaccgttcaacccggattatgtcgaggtggacagaatactcgacgagtctcactcaattgacaaggacaacggcgagcctgtgatttattatctcgttaaatggtgtagcctgccttacgaggattctacgtgggagctcaaggaggacgttgatgaaggcaagatcagggaattcaaacgtatacagtcacgccaccccgaactgaagcgcgtcaatcggcctcaagcctcagcatggaaaaaactggagctgagccacgagtataagaaccggaaccagctaagagagtaccaactggaaggcgtaaactggttactcttcaactggtacaaccggcagaactgcatattggccgacgaaatggggttggggaagacaatccaaagcatagccttcctgcaggaggtctataatgtaggtattcacgggccttttctcgtgattgcaccactgagcacgatcactaactgggagcgagagttcaacacatggacagaaatgaacactatcgtgtatcatggatcactggccagtcggcagatgatccagcagtacgaaatgtattgcaaagacagcagaggcagactaatccccggtgcctacaaatttgacgccctcatcactacgtttgaaatgatcctttctgattgccccgaactccgcgagatcgaatggcgctgtgttattatcgatgaggctcataggctcaagaatcggaactgtaaactcctcgatagcctcaaacatatggatctggagcacaaggtgttgctcaccggaaccccactccaaaatacggtagaagagctgttttcccttctacattttctcgagccatctcagtttccctccgagtccgagttcctaaaggatttcggtgatcttaagactgaagaacaggttcagaaactccaggctatcctcaagcctatgatgctgagacggctgaaagaagacgtagagaagaacttggcccctaagcaagagacaatcattgaggtcgaattgaccaacattcagaagaaatactaccgggcaatcttggagaaaaacttctcattcctgagcaagggggctggtcacacaaatatgccaaacctcctcaatacaatgatggaactgagaaaatgctgcaaccatccttacctaatcaacggcgctgaagagaaaattctgacagagttcagagaagcatgccacataatcccacacgactttcatctacaagctatggtcagatctgctggtaagcttgtgctgatagacaagctgctcccaaagctgaaggcaggaggccacaaagttctgatattcagtcaaatggttcggtgcctcgatatactggaggattacctgatccaacgtcggtacttatatgaacggatcgacggcagagtaagagggaacctgagacaggctgcgatcgatagattctcaaagcccgattccgaccggttcgtcttcttgctgtgtacccgggctgggggactgggtataaacctcacagccgctgacacatgcatcatctttgacagcgactggaacccgcagaacgacctgcaggctcaggcgaggtgtcatcgaattggtcagtcgaaagctgtcaaggtataccggttgatcaccagaaatagctacgaaagagaaatgtttgacaaagcctctctgaagctcggtctcgataaggctgttctgcaatctatgagtggccgagatgggaatattacgggcatacagcagttttccaagaaagagatcgaagatttactcaggaaaggagcctatgcagctattatggaagaggatgatgaaggatcaaaattctgcgaagaagacatcgatcagattttgctcaggcggactacaaccattacaattgagtccgaaggtaaggggtctacctttgcaaaggcatcctttgtggccagcgagaaccgaacagacattagcctggatgaccctaatttttggcagaaatgggccaagaaagcagacttggacatggatttattaaattccaagaacaatctggtgattgatacgccacgggtccgcaaacagacacggcacttctccactctaaaggatgacgatctagtcgaattttcagatctggaaagcgaagacgacgaacgacccagatcacgtagacacgataggcatcatgcgtatgggagaaccgactgcttccgcgtcgaaaagcacctactagtttacgggtggggtaggtggagagatattctgagtcacggacggttcaaaagacggatgaccgaacgggacgtcgaaactatctgccgggctatattagtctattgccttctgcattatcgaggcgatgagaacatcaaggggtttatttgggatctgatttcccccgcagaaaatggcaaaactaaggagttacagaatcacagcggcctgagcatacctgtgcctcggggacgcaaagggaagaaagtcaaatcacagagcaccttcgatatccataaagctgattggatccgcaagtataatcccgacacactgtttcaggatgagtcctataaaaagcatcttaagcatcagtgtaataaggtgctgttacgggtgcggatgctgtattatcttcgacaagaggtgatcggggaccaggccgaaaaagttctgggtggagcaatcgctagcgagattgatatctggttcccggtggtggatcagctggaggtgcccactacttggtgggacagcgaggctgacaagtcactgctgataggcgtgttcaagcacggctatgagaaatataacaccatgcgggctgacccggctctgtgtttccttgagaaagccggaagacctgacgataaggctatagccgcagagcaccgggtgctggataacttcagcgacattgtagaaggagttgactttgacaaagactgtgaggatccagagtataaacccctccagggcccacctaaggaccaggacgatgaaggcgatcccctcatgatgatggatgaggagatcagtgtaatagacggggacgaggcccaggtcacacagcagcctggccatttattttggcctccaggtagtgcactcaccgctaggttacggagactggtgactgcttatcagcgatcttacaagagggagcaaatgaagattgaagctgcggagaggggagaccggagacgaaggcgctgcgaggctgcattcaagcttaaagaaatcgcacgtagggagaagcagcagagatggactagacgtgagcagacagacttttatcgcgtcgtgtccacgtttggcgtcgaatacgaccccgacaccatgcagtttcactgggatcgttttcgtaccttcgccaggttggataagaaaacagatgagtcattgaccaagtattttcacggctttgtcgccatgtgcaggcaggtctgtagattgccaccagctgcgggagatgagcctcctgacccaaatctgtttattgagccaatcaccgaggaacgcgcaagtcgaactttgtatcgaatagagctgctgaggcgcttgcgtgaacaggtgttatgccaccctttgttggaggatcgactggccctttgccagcccccaggtccagaactgcccaaatggtgggaacccgtgaggcatgacggcgagttgttgcggggtgctgcccgtcatggggtgtctcaaactgactgcaacatcatgcaggatcctgacttcagtttcctggcagcgcgaatgaactatatgcagaaccatcaggctggcgctccagccccttccctttctcgctgttccacacctttgctgcaccagcagtacacatcacgcaccgcaagccctttgcccctgagacccgatgctcctgtcgaaaagagtcctgaagaaacggctacccaggttccctccctagaatctctcacattaaagcttgaacacgaagtggtggccagatctcgcccaaccccacaggattacgaaatgagggttagcccatccgacacaacgcctcttgttagcaggtcggtccctcctgtcaagcttgaagatgaagatgactctgattccgaactcgatctttcaaagctctcaccttctagctccagttcaagctcatccagttcaagttcgtccagcacggatgagtctgaggatgagaaggaggagaaactcactgaccaatccagaagcaagctgtacgacgaggaaagcttgctgtctttgactatgtcccaagacgggttccctaatgaggacggtgagcaaatgacccctgagctgctgttgctgcaggagcgacagcgtgcctctgaatggccaaaggaccgagttctgataaacaggattgatctggtatgtcaggcagtcttatcaggcaaatggccaagctctaggcgatctcaggaaatggtgaccggcggaatccttggtcctggcaaccatctgctggatagcccttctctaaccccaggggaatatggcgactctccagtccccacacccagatcctcatccgctgcatctatggctgaggaagaagcctcggcagtatcaaccgcagcggcacaattcaccaagttgcggaggggtatggatgagaaggagttcactgtgcagattaaagacgaggaaggcctgaaactgacttttcagaagcataaactcatggccaacggtgtgatgggggatgggcacccactgtttcacaagaaaaaaggcaaccggaagaaactggttgagttagaggttgaatgtatggaagaaccaaaccatctcgatgtggatctcgaaacccggatccctgtgattaataaagtggatggcaccctactggtgggcgaagacgctcctcgcagagccgagctggagatgtggctgcagggacaccccgaatttgcggtagatcctcggttcctggcttacatggaggatcgcaggaaacagaaatggcagaggtgcaagaaaaataacaaagctgaactgaactgtctaggaatggagccggtgcagacagcgaatagcagaaatggaaagaagggacatcacaccgaaaccgtgtttaaccgcgtgttgcctgggccaattgcaccagaatccagtaagaaacgcgctcgaagaatgagacccgatctgagcaaaatgatggcgctgatgcaagggggttccacaggcagccttagtttacataacacgttccagcattcatccagcgggcttcagagcgtctcctcacttggacacagttccgctacctccgcctcgctcccatttatgcctttcgtgatggggggtgctccatcgtctccacacgtagatagctccaccatgctgcaccatcaccaccatcacccacatcctcaccatcatcaccaccaccatcccggattaagagcacctggatacccatctagccctgtcactactgcctctgggaccactcttcgactgcccccactgcagccagaggaggatgatgacgaggacgaagaggacgatgatgaccttagtcagggctatgacagctccgagagggacttttccctcatcgacgatcctatgatgccagctaattctgattccagcgaggacgcagacgacta

SEQ ID NO: 218336 - DNA, 7745 bp, Artificial Sequence
  Description of Artificial Sequence: Synthetic coding sequence
atggctgaccctattatggaccttttcgacgaccctaacctcttcggcctggattcacttacggacgattcctttaatcaagtaacacaggatccaatcgaggaggcattaggcctcccttccagccttgattccctcgaccagatgaatcaggacggtggcggtggggatgtgggaaatagcagcgcctctgagcttgtaccccctcctgaagaaactgcacccacagaactgtctaaggagagcacagctcccgctcctgagtctatcacgctccacgactatacaacacagccggcttctcaagagcagcctgcgcagcctgtcctgcagactagtacccccacctcagggcttttgcaggtgtctaagagccaggaaatcctgagccagggtaatccatttatgggcgtatccgctacagctgttagctccagttccgctggcggtcaaccgccacagtctgctcctaaaattgtgattctgaaagcccctccaagctcctccgtaactggggcacatgtggcccagatccaggcgcaaggcataacatccacagcacagcctctggtggcagggacagccaacgggggaaaagtgaccttcacaaaagttctgactggcactccactccggccaggcgtgagcatcgtgagcggcaacaccgtcctggctgccaaggtcccaggcaaccaagctgctgtgcagagaatcgttcagccatctaggccagtcaaacagttagtactgcagccagtgaaggggagcgcacctgctgggaaccctggggcaacaggaccacctctgaagccagctgtgactttaacaagcaccccgactcaaggcgaaagcaagaggataacactggttctgcaacagccccagtcaggcggaccacagggacaccggcatgttgtactcggtagcctgcccggtaaaatagtcctgcagggcaaccagcttgctgctctgacgcaggctaagaacgcccagggccaaccagccaaagtggtgaccatccagctccaggtccagcaaccacagcaaaagattcagatagtgccgcaaccgcctagctcacagcctcaaccgcagcagcccccaagtacacagcccgtcacactgtcttcggtgcagcaggctcaaataatggggcctggccaatcccctggccagcgattaagtgtgccagtgaaagtggtgctgcagccacaggcaggctctagccagggggcatctagcggtctgagcgttgtgaaagtcctttcggcctctgaagtcgccgctctgtctagccctgctagttctgctccccacagcggaggaaaaaccggaatggaagagaacagaaggctcgaacaccagaagaagcaggagaaggccaatagaatagttgccgaggcaatcgcgagggcaagggccagaggggagcaaaatatccccagagttctaaacgaggacgaactccctagtgtgaggccagaagaagagggcgagaagaaacgtcggaagaagagcgcaggagagcgcctcaaggaggaaaagcctaagaaatctaaaaccagcggcgctagtaagacaaaggggaaaagcaagctcaatactattacgcccgtcgttggaaagaagaggaaacggaacacgagctcagataatagtgacgtggaggtcatgcccgcacagtcaccaagggaagatgaggagtccagcatacagaaacgcagatcaaatcgccaagtgaaacggaagaaatatacagaggacctcgatataaagataaccgatgacgaagaggaggaggaggtggacgtgactggcccaataaaacccgaacctatcctaccagagccagtacaggaacccgatggagagaccctccctagtatgcagttcttcgtggagaatccctctgaagaggatgctgctattgtggataaagttctgtcaatgcgcattgtaaagaaagaattaccctccggacagtacactgaggctgaggagttctttgtgaaatataagaactatagttacttacattgtgagtgggccactatttcgcagctggagaaagacaaacgcattcaccaaaagctgaaaagattcaagaccaagatggcccagatgagacacttcttccatgaagatgaggagcctttcaaccctgattatgtggaagtcgaccgcatcctcgacgagtctcactctatcgacaaggacaacggcgagcctgtaatatactatctagtgaagtggtgttcgctcccgtatgaagattccacttgggagcttaaagaagatgttgatgaaggaaaaatccgggagttcaaaagaatccagtcgagacatcccgaactgaagcgggtgaatcgcccacaggcctcggcctggaaaaagttggagctgagtcacgagtataagaatagaaatcaactacgggaatatcagttggagggcgtgaattggctgctctttaactggtacaaccgccagaactgcattcttgctgacgagatgggtctgggcaaaactatacagtccattgcttttcttcaggaagtttataatgtcgggatccacggaccgttcttggtgatcgctcctttgtctaccataacgaattgggaacgcgagtttaatacctggacagagatgaacaccattgtataccacggaagtcttgccagtcgccagatgatccagcagtacgagatgtactgtaaggacagccggggacgactgatccccggagcatataagttcgacgctcttattacaacctttgagatgatcctgtcagactgtcctgagctgcgcgagatcgagtggaggtgcgtgataatcgacgaggctcacagactgaaaaatcggaactgcaagcttctagattccttgaaacacatggatctcgagcataaggtgttgcttacggggacaccccttcaaaacacagtagaagaacttttcagcctgctccattttctggagccttcccaattccctagtgaaagcgagtttttaaaggatttcggggatttaaagaccgaggaacaggtgcaaaaactacaggccatacttaaacctatgatgctgagaagactcaaagaagacgtggagaagaacttagcacctaaacaagagacaatcattgaagtcgaactgacgaacattcagaaaaagtattaccgagccatactggagaagaattttagctttctcagtaagggggcagggcataccaacatgcccaacttgttaaacacaatgatggagctaaggaaatgctgcaaccatccatacctgataaacggcgctgaagagaagatcctcacagagttccgcgaagcatgccacatcattccacacgacttccacctccaagcaatggtcaggtctgcaggcaagttagtgctgatcgacaagctgttacctaaactcaaggctggaggccataaggttctcattttctctcaaatggtcaggtgtctggacattttggaagattatttgatccagcgccgatatttgtatgagcggatcgacggaagagtgcgcggtaacctcagacaggccgctatcgacaggttcagcaagcctgatagcgaccgcttcgtgtttctcttgtgcacaagagctgggggtttaggcatcaatcttacagccgcagatacatgtataatatttgattcagattggaacccccaaaacgacctccaggcacaagccagatgtcataggattggacagtctaaggccgtcaaagtgtacagactgatcacccgcaacagctacgagcgggaaatgttcgacaaggccagcttgaaactgggactagacaaggcggttctgcagtcaatgtccgggagagacggaaacataaccggaatacaacaattcagtaaaaaagagattgaagacttgctccgcaagggtgcgtacgctgcaataatggaggaggatgacgaaggctccaagttctgcgaggaagacatagatcaaatcctgctgaggcgcaccactacaataaccatcgagtccgaaggaaaagggagcacatttgccaaagccagcttcgtggccagtgaaaacaggaccgatatatcgctggacgaccccaacttctggcagaagtgggccaaaaaggctgatcttgatatggacttactgaactctaagaacaaccttgtcatagacaccccaagggttaggaaacagacccgtcactttagcactcttaaggacgacgatctggtcgagttttcggatctagagagtgaggatgatgagagaccccgttcccggcgacacgaccgccatcatgcttacgggaggactgactgcttccgggtggaaaagcatttactggtgtacgggtggggcagatggagggacatcctaagccacggacgcttcaagcgcaggatgacagagcgcgatgtggagactatctgtcgcgcaatcctggtctactgtctgctgcactatcgaggggacgaaaacattaaaggattcatttgggatttaatcagtcctgctgagaatggaaaaaccaaagaactgcaaaatcacagcggactgtctatccctgttccaagggggagaaaaggcaagaaggtcaagtcacagagcacatttgatattcacaaagccgattggattagaaagtacaatccagatacgttattccaggacgaatcctataaaaagcatctgaaacaccagtgtaataaagtgctcttgagagtaagaatgctttattatctcaggcaagaagtgatcggggaccaggcagaaaaagtgcttggtggggcaatcgcgtccgagatcgacatctggttccccgtggttgatcagctcgaagttcctaccacatggtgggactctgaggccgataagagtcttctgattggcgtgtttaagcatggctacgaaaagtacaacaccatgcgcgcagacccggctctgtgcttccttgaaaaggccggtcgcccagacgacaaggctatagctgccgaacacagggtgctggacaatttctccgatatcgttgaaggtgtggactttgacaaagactgcgaagaccccgaatacaagccacttcaagggccacctaaagatcaggacgatgaaggggatcccctcatgatgatggacgaagagatctcggtgattgatggcgatgaggcacaggtgacacagcagcctggccacctattttggcccccaggatcagccttgacagcccgactgaggcgcctggtgacagcgtaccagcgcagttataaacgggagcagatgaaaattgaggcagcggaaaggggggaccgcaggcgcaggcgttgcgaggctgcctttaagctgaaggaaattgccaggagagagaaacagcaacgatggacgcgccgagaacaaacagatttttaccgcgtggtcagcacgttcggcgtcgagtatgatcccgataccatgcagttccactgggaccgcttcaggacttttgccagacttgacaagaagaccgacgaatctttgacaaagtacttccatgggttcgtcgcgatgtgcaggcaagtgtgccgcttaccacctgctgccggtgatgagccacccgacccgaacctgttcatagaacccattactgaggagcgtgcctcaaggaccctgtaccggattgaactccttcgacgtctgcgagagcaagtcctgtgtcatccactcctagaggaccgactggccttgtgtcaaccacccggacccgaactacctaagtggtgggagccggtgagacacgacggagaactgctaagaggcgctgcacggcacggtgtgagtcaaactgattgcaatattatgcaggacccagatttctcctttctggccgctagaatgaattacatgcagaaccaccaggcgggtgcacccgcaccatcactctcccgttgctcaaccccactattgcaccagcaatacacttcccgcacagccagtccattgccgctgcgaccagatgctccggtggagaagtccccagaagaaactgccacacaagtgccaagcttggagagcctgacccttaaactggagcacgaagtagtagcccgtagccgcccaactcctcaagattacgaaatgcgggtctctccctctgatacaactcccttagtctctaggtctgtgccaccagtaaagctcgaggacgaagacgactccgatagcgagttggatctgtccaaactgtcaccgtcttctagcagtagttcttctagtagtagctctagctccagtaccgacgaatcagaagacgaaaaagaagaaaagctgacggaccagagccgttcaaagctgtatgacgaggagagcctcctgtcactcacaatgtctcaggatgggttccctaatgaggacggagaacaaatgacgcctgagttactcctgctgcaagaacgccaaagggcctctgaatggcccaaggatagggtgctgattaatagaattgaccttgtatgtcaagcagtgctctcaggcaagtggccttcttcaagacggagccaggaaatggtcaccggaggcatactcggccctggaaaccacctgcttgacagccctagcttgacccccggtgaatatggagacagccctgtacctacccctaggtcttcaagcgcagcatccatggccgaagaggaggctagcgccgtgtctaccgcagcagctcagttcaccaaactgagaagggggatggatgagaaagagttcacagtgcagattaaagatgaggaaggcttaaagctcacctttcagaagcacaaactcatggctaatggagtgatgggtgacggacatcccctgtttcataaaaagaaaggcaatcgcaagaaacttgtcgagttagaggtggagtgtatggaagaacccaaccatctggatgttgatctggaaaccaggatcccggttattaataaagtcgacgggacactcttagtgggggaggacgctcccaggcgcgctgaattagagatgtggctccagggtcaccccgaattcgctgttgatcctcggtttctggcatacatggaagaccgacgtaagcagaaatggcagcggtgcaagaagaataataaggccgaactgaattgccttgggatggaaccagtgcaaaccgctaatagccggaacggtaagaaaggacaccacaccgaaaccgtgttcaatcgcgttctcccgggaccaatagcgccagagtctagcaaaaagcgagccaggagaatgcgacctgatctctccaaaatgatggccctgatgcagggtggatccaccggctccctctccttacataatacgtttcagcactcttccagcgggctgcagtccgtgtcctcactgggccatagctccgctactagtgcttctctgccttttatgccatttgtgatggggggtgccccatccagcccccacgttgactccagtacaatgctgcatcatcaccaccatcacccacatccccatcatcaccaccaccatcatcctggcctgcgcgcacccggatacccttccagcccagtgactacagcctcaggcaccacactgaggctgccccctctacagcctgaagaagacgacgacgaggacgaagaggatgacgacgatctctcccagggttacgactcatctgaaagagattttagcctcattgatgatcctatgatgcccgctaattccgacagctcagaggacgccgatgatta

SEQ ID NO: 218337 - DNA, 1797 bp, Artificial Sequence
  Description of Artificial Sequence: Synthetic coding sequence
atgaccttccaagctagccaccgctcggcctggggcaaatcaaggaagaaaaattggcagtatgagggacccacacaaaagttattcctgaagcgcaataacgtatctgctccggatggtccatcagaccctagtatcagtgtgtcaagcgagcagtcgggcgctcagcagcctcctgcccttcaagtcgaacgaatagttgacaaacgcaaaaacaagaagggtaagacggaatacctggtgcggtggaaaggatacgactctgaggacgatacttgggaacccgaacagcatcttgtaaattgcgaagaatacattcacgactttaaccgtcgtcacactgagaaacagaaagagagtactctcacaagaaccaatagaacaagcccgaataatgcgagaaaacagatatcccgcagcacaaatagcaacttttctaagacttcaccaaaagccctggtaatcggaaaggatcatgagagtaagaacagtcagctgtttgctgcttctcagaagttcagaaagaacaccgcgccatccctctccagcaggaaaaacatggatctggccaaaagtggcataaagatacttgtgccgaagtcccccgtgaagagtagaaccgccgtcgacgggttccaatcagagtcacccgagaaactggatcccgtggaacaaggacaggaggataccgttgccccagaggtcgcggctgagaaaccagttggggctttgcttggaccaggggctgaaagagcccgtatgggcagccggcctagaattcatcctctggtgccgcaggttcccggaccggtaaccgctgcaatggccacaggactcgctgtcaatgggaagggaacatccccctttatggatgcattgactgccaatggtacaacgaacattcaaacaagcgtgaccggagtgacagcttccaagagaaagttcatcgacgaccggagagaccagccgtttgataaaaggttacggtttagcgtgcggcagactgagtccgcttacaggtatcgcgacatcgtggtccggaaacaagacggtttcacccacatcttattaagtaccaaatcaagcgagaataactccctcaatcctgaagtgatgcgcgaggtgcagagcgccctatccacagccgctgctgacgattctaaattagtcctcctatcagccgtggggtctgtgttttgttgcgggctagattttatctacttcatcaggagactgacggatgacaggaaaagggagagtaccaagatggctgaggcaattcgcaacttcgtaaacacatttatacagtttaagaaaccaattatcgtcgccgttaacggcccagcaatcggcctgggcgcatccatcctccctctctgcgacgtagtctgggcaaacgagaaagcatggtttcaaacgccatacactacattcgggcagtctccagacggttgtagcaccgttatgttccccaagatcatgggtggggctagtgctaacgaaatgctgctgagcggccgaaagctcacagcccaggaggcttgtggcaagggtctcgtcagccaggtgttctggccgggaacttttacacaggaggtgatggtccgcatcaaggagcttgccagttgtaatcctgtcgtgctggaagagagtaaggcactggtgaggtgcaacatgaagatggaactcgaacaggctaacgaacgcgaatgcgaggtgctgaagaaaatttggggaagcgcccagggaatggactccatgttgaagtatttgcaaagaaagattgacgagttttag

SEQ ID NO: 218338 - DNA, 1239 bp, Artificial Sequence
  Description of Artificial Sequence: Synthetic coding sequence
atggatttggctaaaagcggaatcaaaatcctggtgcccaaatcacccgtgaaatcgagaaccgccgtggacgggtttcaaagtgaatcccctgagaagctagaccctgttgagcagggacaggaagataccgtggctccagaggtggctgccgaaaaacccgtgggcgctctgctgggcccaggcgctgaacgcgctaggatgggctctagaccacgaattcaccctctcgtcccacaggtcccgggacccgttactgcggctatggccaccgggttagcagtgaatggcaagggaacgagccctttcatggacgcactgacagccaacggcaccaccaatatccagacaagcgtgaccggcgtgaccgcctccaagagaaagtttatcgatgacagacgcgaccagcctttcgacaagaggctgcggttctctgtaagacagacagagtctgcttaccgatacagggatatcgttgtgcggaagcaagatggtttcacccacatcctcttgagcacaaagagctcagagaataactcacttaaccccgaggtgatgagagaggtgcaaagcgccctgtcaaccgctgcggcagacgattccaagctagtattgctgtctgccgtcggctcggtgttttgttgtggcctggacttcatttattttatccggaggctgactgacgacaggaaacgtgagtctactaaaatggcggaggccataaggaacttcgtgaatacattcatacagtttaaaaaacccataatagtggccgtgaacggtccggcaatcggcctgggagcgtccatcctgcccctctgcgacgtcgtatgggccaatgagaaggcatggttccagacaccatacactacattcggacagagtccagacggctgctccacggtcatgtttccaaagataatggggggagccagtgccaatgagatgctgctgtctggacgcaaactaacagctcaggaagcatgcggcaaagggctcgtcagccaagtgttctggcccggtacgtttacacaggaggtgatggtaaggattaaggaactggcctcctgcaatccagtggtactggaagagtccaaggctttggtgaggtgcaatatgaaaatggagcttgaacaggcaaatgagcgcgagtgcgaagtgttgaaaaagatttggggttccgctcaggggatggattctatgctgaaatatctccagagaaagatcgacgagttctag

SEQ ID NO: 218339 - DNA, 1635 bp, Artificial Sequence
  Description of Artificial Sequence: Synthetic coding sequence
atggcctccgaggagttatacgaggtcgagagaatcgtggacaaacggaagaacaagaaagggaagacagaatacctggttcgttggaaggggtacgacagcgaggatgatacctgggagcctgagcaacacctcgtgaattgcgaggagtatattcatgacttcaaccgccgtcacaccgaaaagcagaaggaaagcacgctcacacgaactaacagaaccagtcctaacaatgcgaggaaacagataagtagaagtaccaattctaacttctctaagacatcacccaaagcactcgtaatcggaaaagatcacgagagtaagaatagccaattgttcgctgcaagtcaaaaattcaggaagaatactgcgccttccctgagctcccggaagaacatggatctggccaagtctggaataaaaattctggttcctaagtccccagtgaagtctaggaccgccgtggacgggtttcagagcgaaagtccagagaagttggatcctgttgagcagggtcaagaagatactgtcgcccctgaagttgccgctgagaagcccgtcggcgcactgctggggcctggcgctgaaagggcgagaatggggtcccgacctcggatacatccactcgtgccacaggtaccaggcccagtcacggccgcaatggccactggcttggctgttaatggaaaaggtacctccccttttatggacgcgttaactgcgaatggaacgaccaatattcaaacatctgtaacaggggtaactgccagtaagcggaagttcatagatgataggagggatcagcccttcgacaaacggctgcgtttttcagtgagacagacggagagtgcctaccggtaccgggacattgtggtccgcaagcaagatgggttcacacacattcttctcagcaccaaatcgtccgaaaacaactccctcaatcctgaagtgatgcgggaagtgcagagcgccctcagtaccgccgctgcggacgacagcaaactggtactgctgtcggcagtgggcagcgtattttgctgcggcttagacttcatttacttcatcagaagactcaccgatgaccggaaacgggagagcaccaaaatggccgaagcgataaggaactttgtgaataccttcatccaatttaagaaaccaattattgtggcagtgaatggacccgcaatcggtctcggtgccagcatattacccttgtgcgacgttgtgtgggccaatgaaaaggcttggttccaaactccctacactacgttcggccagagccctgacggctgctccacggtaatgttcccaaaaattatggggggagcatctgctaacgagatgctgctaagtggacgaaagctcaccgctcaggaagcatgtgggaaaggcctcgtaagccaggttttttggccgggaaccttcacgcaggaggtgatggtacgcattaaggaacttgcatcctgcaacccagtggtcctggaggagagcaaagccctggtgaggtgtaacatgaagatggagctggaacaggctaatgaaagagagtgcgaagtgcttaagaagatctggggcagcgcacagggaatggatagcatgttgaaatacctgcagaggaaaattgacgaattctag

SEQ ID NO: 218340 - DNA, 1239 bp, Artificial Sequence
  Description of Artificial Sequence: Synthetic coding sequence
atggacctggctaagtctgggatcaaaatcctggttcccaaaagtcctgtcaagagccgcacagctgttgatggttttcagagcgagtcccctgaaaagctggacccagtggaacaagggcaggaggacactgtagctccggaagtcgccgctgagaagcccgtgggcgctctccttggtcctggcgcagaaagggcgagaatgggtagcagaccacgtatccaccccctggtgccccaagtgccaggaccggtcaccgcagccatggcaacaggacttgccgtgaacgggaagggaacctcgccattcatggacgcattaacagctaacggaacaaccaacattcagactagcgtgaccggcgtgacagcttccaaaaggaagttcattgacgatcgaagagaccagcccttcgacaaaaggcttagatttagtgtgcgtcagactgaatcagcttacagataccgcgatattgtcgtcagaaaacaagatgggtttacgcacatcctgctgagcacaaaaagctctgagaataacagccttaatcctgaggtgatgcgagaagtgcagagcgctctctccaccgcagcagcggacgattccaaactcgtactcctgagtgcagttggatccgtgttttgctgtggcctggactttatttacttcatcagaaggctgacagatgaccggaaaagggagagcactaagatggccgaagctattcgaaactttgtgaatacttttattcagtttaagaagccaattatcgtggcggtgaacggacctgccattggactcggggcatccatcctgcccctgtgtgatgtggtgtgggctaatgagaaggcttggtttcagacaccatacactacattcggtcagtcccctgacggatgcagtactgttatgttccctaagatcatgggcggagcgtctgcgaacgaaatgctgctgagtggaagaaaattaactgcgcaggaggcttgcggcaagggactggtcagccaagtgttttggcccggaaccttcacccaggaagttatggttagaatcaaggagctggcctcatgtaaccctgtggtactggaggagagtaaggccttagttaggtgtaacatgaaaatggaactggaacaggctaacgaaagagaatgcgaagttttgaagaagatttggggatccgcgcagggaatggattctatgctgaagtacctgcaacgcaaaattgacgagttctag

SEQ ID NO: 218341 - DNA, 1665 bp, Artificial Sequence
  Description of Artificial Sequence: Synthetic coding sequence
atggctagccaagaattcgaagtggaggctatcgttgacaaaaggcaggataaaaatgggaacacacaatatttagtacggtggaaggggtacgataaacaggatgatacatgggagcctgaacaacacctcatgaattgcgagaagtgtgttcatgactttaataggaggcagacagaaaaacagaagaaattgacttggaccactacatctaggatattctccaacaatgccaggaggcgtaccagtagaagtactaaagctaactattccaagaattctccaaagacacccgtgacagataagcaccaccgcagcaagaaccggaagctattcgccgcttcaaagaacgtgagacggaaagccgcttctattctttcagatactaagaatatggagatcattaatagcactatcgaaacgctagcaccagattctccatttgatcataaaaccgtctcagggttccagaagcttgaaaagcttgatcccattgctgcagatcaacaggatactgtggtgtttaaggttactgaggggaagcttctgagagatcctctgtcaaggcccggtgccgaacagactggcattcagaataagacacagatccatcctctgatgtcccagatgtcagggtccgttactgccagcatggccactggatctgcgacacggaagggaattgtcgtcctgattgatcctctggcagcgaacggcaccacagatatgcacacgagtgtcccacgtgttaaaggcggacagcggaacataacagatgattcaagagaccaaccatttatcaaaaaaatgcattttactataaggttgactgaaagcgcctctacgtatagggatatagtagtaaagaaagaagacggcttcacccagatcgtcctgagcacacgttcaacggagaaaaatgcactcaacaccgaggtgatcaaggaaatcgtgaatgccctgaacagtgccgctgcagacgacagtaagcttgtgcttttttctgctgctggctcagtattttgttgtggactggactttgggtatttcgtcaagcacctgagaaataatagaaacactgctagccttgagatggtcgatacaatcaaaaactttgtgaatacattcatccagttcaagaaacctattgttgtgtctgttaatggacccgcaatcggtttgggggctagtatccttcccttgtgcgacctggtatgggctaatgagaaagcctggttccagactccctacaccaccttcggccagtcccctgacggctgcagttctatcacctttccaaagatgatggggaaggccagcgccaatgagatgttgattgctgggagaaagctcacagcaagagaggcttgtgccaagggcctcgtgtcacaggtcttccttacaggaacatttacacaggaggtaatgatccagatcaaggaactggcttcctacaatcctattgtgctggaggaatgtaaggccctcgtgagatgtaacattaagcttgaactggagcaagccaacgagcgggagtgcgaggtcctccgtaagatctggagcagtgcccagggcatcgaatctatgctgaagatacctctcctggggtacaaagcagccttcccgccacgcaagactcagaacgaccagcgatggtgtccatag

SEQ ID NO: 218342 - DNA, 1623 bp, Artificial Sequence
  Description of Artificial Sequence: Synthetic coding sequence
atggcatcacaggagtttgaggttgaagctattgtggataaacgacaagacaagaacgggaatacacagtacctagtaagatggaaaggctatgacaaacaggacgacacctgggaaccagagcagcacctcatgaactgtgagaaatgtgttcatgacttcaacagacgacagacagagaaacaaaaaaagctgacatggacaacgacttcgcggatattctctaataacgcccgtagaagaacctcacgtagcacaaaggcgaattacagcaagaactcccccaagacacccgtcacggacaaacatcataggagcaaaaacaggaagttatttgcagcctctaagaatgtccggagaaaggctgctagcatactgagcgatacaaagaatatggaaattatcaattccactatcgagacattggctcctgatagtcccttcgatcacaaaacggtatctggcttccagaagttggagaagctggatccaatcgccgctgatcagcaggacacggtagttttcaaagtcacagagggtaaacttcttcgagaccctctcagcaggccgggtgccgaacagaccgggattcagaacaagactcagatccaccctctgatgagtcagatgtctgggtctgtcacagccagtatggccaccggcagcgccactcgaaaaggtattgtcgtcctcatcgacccacttgccgctaacgggactacggacatgcacacatctgtacccagggtgaaagggggtcaacgaaacatcaccgatgactccagggatcagcccttcatcaagaaaatgcactttactattaggctgacagaatccgcctccacgtaccgggacatagtcgtcaaaaaagaagacgggttcacacaaatcgtgttgagcacaaggagtaccgagaagaacgctctgaatacggaagtgattaaggagattgtgaacgccctgaatagcgccgcagcagatgactccaagctcgtactcttcagtgccgctggcagtgtgttttgttgtggcctggactttgggtactttgtgaaacacctccgaaacaatcgcaacactgcttccctggagatggttgacaccatcaagaactttgtgaatacatttatacaattcaaaaagccaatcgtagtatccgttaacggtccggctatcggactaggcgctagcatactgcccctgtgtgacctggtgtgggcgaatgagaaagcttggtttcagaccccatatacgaccttcggacaaagccctgacggctgctcatccattacttttcccaaaatgatgggtaaggcttccgcaaatgagatgttgatcgctgggagaaaactgacagcaagggaggcttgtgctaaagggctggttagccaggtgtttctaaccgggacttttactcaagaggtaatgatccagattaaggagctcgcatcatacaacccaattgtgctcgaggaatgtaaggctttggtaaggtgtaatattaaactggagctagagcaggccaacgagagagagtgcgaggtgcttcgtaaaatctggagtagtgcccagggtatcgagtctatgctgaaatatgttgagaacaagatagacgaattctag

SEQ ID NO: 218343 - DNA, 1170 bp, Artificial Sequence
  Description of Artificial Sequence: Synthetic coding sequence
atgggcaaaatggcagccgcagtgggctctgtggctaccctggccacagagcccggagaggacgcatttagaaagctgttccgcttttaccggcagtctaggccaggcacagcagacctggaaggggtgattgatttttcagccgctcatgccgcaagggggaaggggccaggggctcaaaaggtgataaaaagccagctcaacgtgtctagcgtgtctgagcagaatgcttacagggcgggactacagccagtttcaaagtggcaggcatatgggttaaaaggctatcctgggtttatatttatacctaatccctttttgcctggctaccagtggcattgggttaagcaatgtctgaagctgtacagtcagaagcccaatgtatgtaacctggacaagcatatgtcaaaagaggagacccaggatttatgggaacagagcaaggaattcctgcggtacaaagaggcaactaagagacgccctcgaagtctgctggagaagctgcgctgggtcactgtaggataccattataactgggacagcaagaagtacagcgctgaccactacactcctttcccttctgatttgggattcctctctgaacaagtggccgcagcatgcggattcgaggatttccgcgctgaagccggaatcctcaactactaccgactagatagtacgttagggattcacgtcgatcgctctgagctagaccactctaagcccttactcagctttagttttgggcagagcgccattttcttactgggcggtctgcaaagggacgaagctccaacagccatgtttatgcacagcggcgacattatgatcatgagcggattcagccgtctcttaaatcacgccgtgcccagggttctccccaatcccgaaggcgagggcctgccacactgtctcgaggcgccattgccggcagtactgcccagagacagtatggtagagccatgctcaatggaagattggcaggtctgcgccagctatttgaagaccgccagagtaaacatgacagtgcgacaggtactcgcaaccgatcagaacttccctctggaacccattgaggatgagaagagggatatctctaccgaaggattctgtcacctcgatgatcagaactccgaggtgaagcgggcacgaatcaaccctgactcttag

SEQ ID NO: 218344 - DNA, 921 bp, Artificial Sequence
  Description of Artificial Sequence: Synthetic coding sequence
atgagatctgccgcagtgcttgccctgcttctctgtgccggacaggtgaccgctcttccagtgaatagcccaatgaacaagggggataccgaagtcatgaaatgcatagtggaagtgatctcggataccctaagtaagccatcccccatgcccgtgagccaggagtgcttcgagactctgagaggcgatgaacggattctgagtatcctgaggcaccagaacctacttaaagagcttcaggacctagccctgcagggagccaaggaacgtgcccatcagcagaaaaaacatagcggcttcgaggacgagctctcagaggtactcgaaaaccagtccagtcaggctgaactgaaaggccgttcagaagctttggccgtagacggtgcaggcaagcccggagctgaggaagcccaggaccccgagggaaaaggcgaacaggagcactcccagcaaaaggaggaggaagaggagatggctgtggtcccacagggcttgtttcggggaggcaagagtggagagctggagcaagaagaagagaggctctctaaggagtgggaggatagcaaacgctggagcaaaatggatcaactcgcaaaggaacttacagcagagaagcggctggaaggccaagaagaagaagaggataaccgcgactctagtatgaaattatcgtttcgagcacgcgcttatgggtttcgcggacccggacctcagctgagaaggggatggcggcctagctccagggaagacagcctggaggccggtctccctctgcaggtgcggggttatccagaggaaaaaaaggaggaagaggggtctgcaaaccggaggccagaggaccaggagctggaatcactcagcgcaattgaggccgagctcgagaaggtcgcacaccaactacaggcgttgagacgaggctag

SEQ ID NO: 218345 - DNA, 2034 bp, Artificial Sequence
  Description of Artificial Sequence: Synthetic coding sequence
atgcagcctacgctgttgctgtcgctcttgggggctgttggcttagccgctgtgaacagcatgccagttgacaacaggaatcacaacgaggggatggtgacccgctgtatcatcgaggtcctgagcaatgccctttctaagagtagcgctcctcctatcacccctgagtgtagacaggtgcttaaaacaagccgaaaggacgttaaagataaggaaacgaccgaaaacgagaacacaaaattcgaagttaggctgttgagagatccagccgacgctagcgaggctcatgagtccagtagccgtggcgaagccggtgcccctggcgaagaagatattcaggggccaacaaaggccgatactgagaaatgggcagaggggggagggcactctcgcgaacgtgccgatgaacctcagtggtccttatacccaagcgacagccaagtaagcgaggaggtgaaaacaagacactccgaaaagtctcaacgggaagacgaggaagaagaagagggggaaaattaccagaaaggcgaacgcggtgaggatagtagcgaggagaaacatctcgaggagcctggcgagacccagaacgcattcctgaacgaacgaaagcaagcaagcgcgataaagaaggaagaactggtcgcacgctccgaaactcacgccgctggacattctcaggaaaaaactcactctcgtgaaaagtcttcacaggagagcggggaggagactggctcgcaggagaatcacccacaggaatcgaagggacagcctcgcagccaggaggaaagtgaggagggagaagaagatgccacctcggaagtggacaaacggaggacccgacccagacaccatcatggcaggtccagacccgatagaagcagccagggaggctccttgccttctgaggaaaagggacacccacaggaagagtccgaagaatccaatgtaagcatggcaagtcttggggaaaaacgggatcatcactccactcactatcgcgcatctgaggaggaacctgagtacggtgaggagattaagggttatccaggcgtccaggcacccgaggaccttgaatgggaaaggtaccgcggtcggggaagcgaagagtatagagcccctagaccccagtcggaagagagttgggacgaggaggacaagaggaactacccgagtttggagctggacaagatggcccacgggtacggcgaggagtcagaggaggagagaggcctggagcccggtaaaggcaggcaccataggggcagaggcggagaaccgagggcttatttcatgtcagatactcgggaggagaagagattcctgggcgaggggcatcacagagtacaggaaaaccagatggacaaggcgaggcgtcacccccaaggagcctggaaggaactggataggaactatttgaactacggagaggaaggggctcccggaaaatggcagcagcagggagatctccaggacaccaaagagaatcgtgaagaagccagatttcaggataaacaatattccagccaccataccgctgagaaaagaaaacgactgggggaactttttaacccctactacgacccactgcagtggaaaagttcccattttgagaggcgcgacaacatgaacgacaatttcctggagggagaagaggagaatgaactcactttaaacgaaaaaaacttcttcccagagtacaattatgactggtgggagaaaaagccgttttccgaggatgttaactgggggtacgagaagagaaatttagctcgagttcccaagttggatcttaagcgccagtatgaccgggtggcccagttggaccagcttctgcactacagaaaaaagtctgcagaattccccgatttctatgattccgaagagcctgtcagtacccatcaggaagcagaaaacgaaaaggaccgggctgaccagacagtactcacagaggatgaaaagaaggagttagagaacctggccgcaatggacctggagttgcaaaaaatcgccgagaagtttagccagcggggatag

SEQ ID NO: 218346 - DNA, 870 bp, Artificial Sequence
  Description of Artificial Sequence: Synthetic coding sequence
atgcccgtcgacaacagaaatcacaatgaaggcatggtgactcgttgtatcatagaggtgctgagcaatgcgctgagtaaatcttccgcgcctcccatcacaccggagtgccgacaggtgctaaaaacttctcgtaaagacgtcaaagacaaggagacgactgagaatgaaaatacaaaattcgaggtgcgtctcctgcgagaccccgcagacgctagtgaggctcacgagagctcaagtaggggggaggcaggcgctcccggtgaggaggacatccagggcccaacaaaggccgatacagaaaaatgggctgagggagggggacattccagggaacgcgctgacgaaccccagtggtcactgtatccaagcgattcccaggtgagcgaggaggttaagactcgtcacagtgagaagtcccagcgtgaggacgaagaggaggaagaaggagagaattatcaaaaaggtgaaagaggagaggactcctccgaggagaagcatcttgaggaaccgggagaaacccagaacgcgttcctgaacgagaggaaacaggcaagcgcgatcaaaaaagaggagctggtggctcgcagcgaaacacacgccgcaggccactcgcaggaaaaaacccatagtagggagaaatcttctcaggaatctggtgaggagaccggatcacaggaaaaccacccccaggagtctaagggacaaccacgttcccaagaagagtctgaggagggtgaagaggatgccacaagcgaggtcgataaaagaaggaccaggcctcgtcaccaccacggcagatctagaccggatcgttcttcccaggggggtagtttaccttctgaagaaaaaggccacccacaggaatag

SEQ ID NO: 218347 - DNA, 1806 bp, Artificial Sequence
  Description of Artificial Sequence: Synthetic coding sequence
atgccagaaagagaactgtggcctgctggcaccgggtccgaaccggtgactagggtcggctcatgcgactcaatgatgtcttccaccagtaccagatccggatcaagcgattcttcctacgatttcctttccaccgaggagaaagaatgtttgctgtttttggaagaaacaattggcagcttagatactgaggccgacagtggactttcaaccgacgaatccgaacctgctaccacaccccgagggttccgcgctctccccatcactcaacctactccacgaggaggcccagaggaaaccatcacccagcagggaaggacacctcgaaccgtgacagagtccagcagctcacaccctccagagcctcagggtctggggcttaggagtggaagctattctctccccagaaacatacacattgcccgaagtcagaactttaggaagtcgaccacacaggcttccagccacaatcctggcgaaccaggtaggctcgctcccgagcctgagaaggaacaggtgagccaatcttctcagccccgacaagcccctgctagcccacaggaggcagcacttgaccttgatgttgtgcttattccacctccggaagcctttagggacacgcagcctgagcagtgcagagaagcgtctctaccggaagggcctgggcagcagggccataccccccaactgcacactcccagttctagccaagagagggagcaaacgcccagtgaggccatgtcacagaaggccaaggaaacagtcagcactcggtacacacagccacagcctccgccagcaggtctgccccagaacgccagagcagaggacgcccctctgtcaagtggggaagacccaaacagccgacttgcacctttgacgacccctaaaccgagaaagctgccaccgaacatcgtgctgaagtcatcccggagcagcttccactctgatccacagcactggctctcccgacatacagaagctgcaccaggtgactccggactcattagttgttccctacaggagcagcggaaggctagaaaggaagcactcgagaaactgggcctgcctcaagaccaggacgaacccggactgcacctgtccaagcctaccagttcgattaggcccaaggagacccgggcacagcacttgtccccggcacccggtctggcccagcccgcagccccagctcaggcttccgccgctattccagccgctgggaaagccctggcacaggccccagcacctgcacccggtcccgctcagggccctctcccgatgaagagtcctgcgccaggaaatgtggccgctagcaagtccatgccgatatccattcctaaagccccacgtgctaatagcgctctgactccacctaagcctgagagcgggctgacgctccaggaaagcaatacccccggacttagacagatgaatttcaagtccaatacactcgaacgctccggcgtggggctgtcctcatacctgtcaaccgaaaaggacgccagtccgaagacttcaactagtttagggaagggtagtttcctggataaaatctccccttccgtgctgaggaactcccggcctagacctgccagccttggcacaggcaaggatttcgccggtattcaagtgggaaagttggcggacctcgaacaggagcagagcagcaaaaggctgtcttatcagggtcagagccgtgataagctgccacgccctccatgcgtgtctgtgaagatttcacctaagggtgtgcccaacgaacatagacgggaggctctgaagaagcttggcctgttaaaagaatag

SEQ ID NO: 218348 - DNA, 1068 bp, Artificial Sequence
  Description of Artificial Sequence: Synthetic coding sequence
atgagccagaaggcaaaggaaactgtctcgactagatacacccagccgcaaccacccccagctgggctcccccagaatgccagggctgaagatgccccactgtcctcaggcgaggatcctaatagtcgattggcgccacttactacccctaaaccacggaagctgcctcctaatattgttttaaaatcctctcgtagctcctttcactcagatcctcagcactggctgtctaggcacacagaagcggctccgggtgattccggtcttatctcctgttccctccaggagcagaggaaggcccgtaaagaagcgctcgagaaactggggctgccacaggaccaagacgagcccggactgcatctgagcaaacccactagctccattcggcctaaagagactcgagcccagcacctgtctcccgctcctggcctcgcgcaacctgctgcgccagcacaggcctccgccgcaatccctgctgctggaaaggccctggcccaggcccctgctcctgccccagggcctgcccagggtcccctgcctatgaaatctcctgctccagggaatgtggctgcttccaagagtatgcctatttcgattcccaaggcacctagagctaattctgcactgacccccccaaaacctgagtccgggttgaccctccaagaatcgaatactcccggtctgagacaaatgaactttaagtcaaacaccttggaacgcagcggagtgggcctgtcatcttacctctctacagaaaaggacgccagtcctaaaacctcaacatccctgggcaagggaagcttcctggacaagatttcaccttctgtgctccggaactcccggccacgacccgcaagtttgggtaccggcaaggattttgccggtattcaggttggcaagctcgccgatttagaacaggaacagagctctaagcggctgtcataccaagggcagtctcgggacaaactgccaagaccaccttgtgtgagtgttaaaatcagccccaagggggtgccgaatgaacatagacgtgaagccctcaaaaagctcggtctgctgaaggagtag

SEQ ID NO: 218349 - DNA, 1050 bp, Artificial Sequence
  Description of Artificial Sequence: Synthetic coding sequence
atggcagggcctgccatacacaccgctccaatgttgtttctcgttctgctgctgccactggaattgagcctcgcaggggctctggcccctgggactccagccaggaacttgccggaaaaccatatcgatctgccaggcccagcgttgtggacacctcaggcatcccaccatcgaaggagaggccctgggaagaaagagtggggtccaggcctcccgtcccaggcacaagacggggcagtggtaacagccaccagacaggcatctagactgcctgaggccgagggcctgctacctgagcagtcccctgctggccttctgcaagataaggaccttctgctgggcctggctcttccatacccagagaaggaaaaccggccaccaggatgggagcgtacgaggaagcggtctagggagcataagcgccgacgcgaccggctccgcctacaccaaggtagggcattggttcgcggtccctcgtccttgatgaagaaggccgagctcagcgaggcccaggttctggatgcagctatggaggagagctctacaagtttggctcccaccatgttctttctgacaacgttcgaagcggctcctgccacagaggaatccttgattctccccgtgacttcgcttcgtccacagcaggctcagcctcgcagcgacggagaggtcatgcccacattggatatggcgcttttcgattggacggattacgaggatttaaagccagatggatggccatctgccaaaaaaaaagagaagcatagggggaagttgtccagcgacggcaatgagaccagccctgcagagggcgaaccatgtgatcaccatcaggactgtttacccggtacctgttgcgacctgagggagcacctttgtacacctcacaatcgcggactcaacaacaagtgctttgacgactgtatgtgtgtagagggtttgcggtgctacgctaaattccaccggaataggagggtaaccagacgaaagggtcgctgcgttgaacctgaaactgcaaacggcgaccaaggaagtttcataaacgtgtag

SEQ ID NO: 218350 - DNA, 477 bp, Artificial Sequence
  Description of Artificial Sequence: Synthetic coding sequence
atgtgcttctcacgggctgacgccgcagataattaccccttcggaacttgtcagcagaggaaactgttcccacacttccaccccccaaacctcattggaaacaaattcgtacctctgcggggaagtccccaccgcggtcctgggtgttactttagtgacgaaatgaccccacatgctgggcgataccagaaagtttctcctcagcaggagaagcacaagcagaatttcgcacccttcaacgttctggtgccgagatttaagaactaccccaaagatacttactatcctagcccgggtgcctataatcccgaaaagaagccaccccctaaaatcgcttggccaatgaagtttggatctcccgattgggcacaggtgccttgcctccagaagagaaccttgaaggctgagctcagtaccgataaggacttccggaaacatcggaaccgcgtggcctacctatcgctctactataactag

SEQ ID NO: 218351 - DNA, 576 bp, Artificial Sequence
  Description of Artificial Sequence: Synthetic coding sequence
atgtgcttttcaagggccgacgccgctgacaattatcctttcgggacatgtcagcagcgaaagctgttcccacactttcatccaccgaacttaatcggcaacaagttcgtacctctgcgagggagtccacaccgagggcctggttgctactttagcgacgggtatgggctcgcttatgatctgtctaaaattcccactagcatcaagggctacacccttggtgccaggaccgctgtacgatttaagcccatccagaaagagatgactcctcatgctggcaggtatcagaaggtctccccccagcaggaaaagcacaaacagaatttcgcacctttcaatgtgctcgtccctcgttttaagaactaccctaaggacacatactacccctctcctggtgcctacaaccctgagaagaagcctccccctaaaattgcgtggcccatgaaatttggatcccccgattgggcccaagttccctgtctgcaaaagcggacgctgaaggctgaactgagtaccgacaaggacttcaggaaacatagaaacagggttgcctatctgtcattatactacaactag

SEQ ID NO: 218352 - DNA, 2055 bp, Artificial Sequence
  Description of Artificial Sequence: Synthetic coding sequence
atgtgggtgcttctgcgctccggttatcccctcagaatattgctccccttgcgaggtgaatggatgggaagaaggggactcccacggaatctcgccccagggcctccaagaaggaggtaccgtaaagaaaccctacaggccttagacatgccagtgctgcccgtgacggccactgagatccggcagtacttgcgcggacacggcattcccttccaggacgggcactcatgcctgagagcacttagcccattcgcagaaagctctcagctgaagggacagaccggcgtgacaacgtctttttcgctctttattgacaagaccaccggccacttcttatgcatgactagcttggcggaaggaagctgggaagatttccaggcgagcgtagagggaagaggcgacggtgccagggaggggtttctcctgtccaaagctccagagtttgaggattctgaagaagtcaggcggatatggaaccgcgctattcctctgtgggaactgccagaccaggaggaagtacaattagccgacacaatgttcggactcacaaaagtaacagatgatacactgaagcggttcagcgtaagatacttgcggcctgctcggtctctagtttttccatggttttcccctggaggcagcggactgcgcggtctcaagcttctcgaggcaaagtgccagggcgacggagtgtcctacgaagaaacgaccattcctcgaccctcggcttatcacaacctgttcgggctcccactgattagccgtagagacgcagaggtcgttctgacgagtagggagctggactccctggccctgaatcagagtacagggctgcctactctgacactgccacggggtacaacctgcctaccccctgccctgttaccctatctggaacagtttcggagaatcgtgttttggcttggagacgacctgcggtcctgggaggcagctaaactcttcgcccgtaaacttaatcctaaaagatgcttcctcgtgcgtcctggcgaccaacagccacgacccttggaagctcttaacggtggttttaacttatctcggatccttagaacagctctgcctgcatggcacaagtccatcgtctcattccggcagctgcgtgaagaggttcttggtgaattatcaaacgttgagcaggccgcaggcctgcgatggtctaggttccctgacttaaacaggatactcaagggacacagaaagggggaactgaccgtgttcacaggacccaccggtagtgggaagactaccttcatcagcgaatatgctctggatctgtgtagccagggggttaacacactgtggggctccttcgaaatatcgaatgtgagactcgcgagggtgatgcttactcagtttgctgaggggagactggaagatcagctagacaaatacgaccattgggctgacaggttcgaagatctacccctgtactttatgacgtttcacggccagcagtccattcgaacggtaatcgacacgatgcagcacgccgtgtacgtttacgatatttgccacgtaattatcgacaatctccaattcatgatgggccacgagcagctcagcaccgatcgcattgcggcacaagactatattattggggtgttccgaaagttcgcaacagacaacaattgtcacgtaaccctagtgattcatcctagaaaagaggatgatgataaagagttacagactgcgtctattttcggaagcgccaaagcctcccaggaagccgacaacgtcctgatcctccaggaccgaaaattagttactggacccggaaaacgctacctacaggtcagcaaaaaccgctttgatggagatgttggggtgttcccccttgagtttaataaaaattcactcactttctctattcctcctaagaacaaggctcggctgaagaaaattaaagacgatacagggcctgtggctaaaaaaccgtcttctggcaagaagggggctactacacagaatagcgagatctgtagcggacaggccccaacaccagaccagcccgacacaagcaagcgtagcaaatag

SEQ ID NO: 218353 - DNA, 1749 bp, Artificial Sequence
  Description of Artificial Sequence: Synthetic coding sequence
atgtgggtcttattgaggagcggttatccattgaggattttactcccgcttcgcggagaatggatgggacgacggggactccctagaaatctggcccctggcccacccaggcggaggtacaggaaagaaacgttacaagccctcgatatgccagttctgcctgtgactgctactgaaattcgacagtatcttcgcggacatggcatacccttccaggacgggcattcctgccttcgggcattaagcccattcgcagagtccagtcaactcaaaggacagaccggggtgactacctcattttcattgtttattgacaagaccactggacattttctctgcatgacctctctggctgagggaagctgggaagattttcaggcttcagtggagggacgcggtgatggagccagggagggttttctgctatctaaagcccctgaattcgaagatagcgaagaggttcggcgaatctggaacagagcaatacccctgtgggaactgcccgaccaagaggaggtacagctggctgacaccatgttcggcctgaccaaggtgactgacgataccttaaaacgcttttccgtgcgatacctccgacccgcacgcagtctcgtgttcccatggttctcccccggtggaagtgggctacggggtctgaaacttctggaagcaaagtgccaaggtgatggggtctcttatgaagagacaactataccgaggccgtctgcatatcacaatctttttggcctcccgttgatcagcaggagagatgccgaagtggtgctgacgagcagagagctggactcactcgctctgaaccaaagcactggactgcctaccctaaccttgccacggggaaccacctgccttcctcccgctctgcttccctatttggaacagtttcgcaggattgttttctggctgggggacgacctccgcagctgggaagccgcaaaattgttcgcacggaagctgaatcccaagcggtgcttcttggtacggccaggcgatcagcagccccgacctctggaagccctgaatggaggctttaacctgtctcggattttgaggactgcactgcctgcctggcacaaatctattgtctcatttcggcagctgcgcgaagaggtgctcggagagctgagcaatgttgagcaagcagctggactccggtggagtcggtttccagatcttaacaggattctcaagggacacaggaagggcgagctgaccgtattcacaggcccaactgggagcggcaaaactacatttatcagtgagtatgcactggatctgtgctcccaaggagtgaatactctgtggggtagctttgagatctctaacgtcagactcgctagagtgatgttgactcaattcgctgagggtcggttagaggatcagctggacaaatatgatcattgggcagatcggtttgaggatcttcccctctatttcatgactttccacggccagcaatctatccgaacagtgatcgacaccatgcaacatgccgtttatgtgtacgatatatgccacgtgatcatagacaacctacagttcatgatgggccacgagcagctgagcaccgaccgcattgctgctcaggactacattatcggcgtgttccgcaaatttgccacggataataactgccacgtcacactggtgatccatcctaggaaagaggatgatgacaaagaactgcagaccgctagtatcttcggctcagccaaggttagtgggctgtag

SEQ ID NO: 218354 - DNA, 1029 bp, Artificial Sequence
  Description of Artificial Sequence: Synthetic coding sequence
atgccgttcctattaggacttcggcaggataaagaggcttgcgtcggtacgaataaccagtcctacatttgcgatacaggccactgctgtgggcagtctcagtgctgcaattattactacgagctgtggtggttttggctcgtgtggaccattattattatcctgagctgctgttgcgtctgccaccacagacgagcaaagcacaggctgcaggcccagcagaggcagcacgagatcaacctaatcgcatatagggaggcccacaattattccgccctccctttctactttagattcctcccgaactatctgctgccaccttatgaggaggtcgtcaatcgccctcctacccctcccccaccttacagcgctttccagctgcagcagcagcagctgctccctccccagtgcgggccagcaggcggttctccacccggaatcgaccctactaggggaagccagggcgcacagtcaagtcccttgtctgagccatcacggagctcaacgagacccccttcgatagccgacccagacccatcagatttgcctgtcgaccgggcagcaacaaaagcccctgggatggagcccagcggctccgtggccggactgggggagctggaccctggcgcatttttggataaagacgctgagtgtagagaggaactgttgaaggacgacagcagtgaacatggggcaccagattcaaaggagaagacccctgggcgtcaccggagattcaccggggattctggaattgaggtatgcgtttgcaacagaggccatcacgatgatgaccttaaagaatttaataccctgatagatgatgcccttgatggacccctggacttctgcgattcttgtcacgttcgaccacctggcgacgaagaggaaggattatgccagtcttcggaggagcaggcccgtgagccgggacatccccacttaccacgcccaccggcttgcctgcttcttaacaccataaacgaacaggactcccccaattcccagtcctcatcatcccccagttag

SEQ ID NO: 218355 - DNA, 1092 bp, Artificial Sequence
  Description of Artificial Sequence: Synthetic coding sequence
atggagagaaggcggttactggggggaatggcactgcttctgctgcaagcactgccaagcccgctttcagccagagcagaacctccacaggacaaggaagcttgtgttggaactaacaaccagagctacatttgtgataccgggcattgttgcggccaatcccaatgttgtaattactactatgagctttggtggttctggttggtctggaccattataatcatcttgtcatgctgctgcgtatgccaccaccggagggccaaacacaggctccaggcgcagcagcgacagcatgaaatcaatttgatcgcttatcgggaggcacacaactacagtgccctgcccttctactttcggtttctcccaaattacttgctccccccatatgaagaggtagtgaaccggccacctacaccaccacccccttactccgccttccagcttcaacagcagcaactgctgcctcctcagtgtggacctgcaggcggatctcctcctggtatcgacccaacaagaggtagccaaggcgctcagagtagcccacttagtgagccatcacggtcctccacccgcccaccaagcattgcagacccagacccttcagacctgcctgtggacagagcggcaacaaaagccccaggcatggaacccagcggttctgtcgcgggactcggagagctggaccccggagcatttcttgataaagacgctgaatgtcgagaggaattgctcaaggatgattcctccgagcatggggcaccagactccaaagaaaagactccgggacgtcacaggcgctttaccggagacagtggtattgaggtatgcgtgtgcaaccgcggacaccatgacgacgacttaaaagagttcaataccttgattgatgacgctttggacggtcctctggatttctgtgatagctgccacgttagacccccaggcgacgaagaagaaggactgtgtcaatcatccgaagaacaagctagagagccgggacacccccacttgcctcgcccacctgcctgtctgctcctaaacaccataaacgagcaggactccccgaactctcagtccagctcttcgccctcatag

SEQ ID NO: 218356 - DNA, 1056 bp, Artificial Sequence
  Description of Artificial Sequence: Synthetic coding sequence
atggccaccgatgtgcagttagccgattatcccctcatgagcccaaaagcagagctcaaattggaaaaaaagagcggcaggaaacccaggtcgccccgagatagcggccctcagaaagagctggttataccagggatcgttgactttgaacgcattaggcgagctctgaggaccccaaaaccgcagacaccaggcacttattgtttcggacggctgagtcaccactctttcttctcccgacaccatccacacccccagcacgtaacccacatccaggacctgaccgggaaacccgtctgtgtggtaagggattttccagctccactgccagagtccactgttttcagcgggtgccaaatggggattcctactattagtgtgccaatcggggacccccaatccaatcgcaacccccagctatccagtgaggcatggaagaaggagctgaaggaattggcctcaagagttgccttcttaaccaaggaagatgaactgaagaagaaggagaaggaacaaaaggaggagcctctgcgggagcagggcgctaagtacagcgctgaaacaggccgactgatcccagccagcactcgggcagtcggcagaaggcggagccatcagggacagcagtcccagtcctctagccgccatgaaggggtgcaagccttcctgctgcaagatcaggaattgttggtgctggaattgctctgtaggattctcgaaacagatcttctgtctgctatccaattttggctgttatatgcaccccctaaggagaaagatctggccctgggactgctgcagactgctgtcgcccagctcctaccacagccactagtaagcataccaactgagaaactgctttcccagttacctgaggtgcatgagcctccacaggaaaagcaggagccaccgtgcagtcagtctccgaagaagacaaagatttcccctttcacaaagtctgagaaacccgagtacatcggtgaggcccaagtactccagatgcactcctcacagaacacagaaaagaagacatcaaaacccagggccgagtcttag

SEQ ID NO: 218357 - DNA, 321 bp, Artificial Sequence
  Description of Artificial Sequence: Synthetic coding sequence
cagtgcgctgagctgtggggtagtgtgcggaaaaattctgacaagttcttactatcaaggaaccttcacccctctaaagaagaataccgtcaacagataaagactccgggtgaggagtggagacagatactcgtgcactggcggtccagttctcccccagatgcttttaagccggaacacagggaagaggacatagaagccgaaggtagagagttgcggggacctaacacttgtacatgccttgcccaggagcagccacaggggttcagaggtgtgtctgtaagcacaacgtttactgcagttcctgatagtctcccatag

SEQ ID NO: 218358 - DNA, 753 bp, Artificial Sequence
  Description of Artificial Sequence: Synthetic coding sequence
atggctactgacgtgcaactggccgattatcctcttatgtcccccaaagccgaactgaaactggagaaaaagtccggacgcaagccacgcagccctagagactccggtccacaaaaggagctggttatccctggcattgtcgactttgaacgcatccgacgggcactacggactcccaaaccccagacgcccggtacctactgcttcggcaggctctctcaccacagcttcttctcccgtcaccatccacaccctcagcacgtgacacatatccaggacctcaccggtaagccagtatgtgttgtgcgagattttccggcaccccttcctgagagcaccgtcttttcaggctgccagatgggcatcccaacgatctcggttccgataggagacccacagtcaaatcggaatcctcagttgagctctgaagcttggaaaaaggaactcaaagagctcgctagtcgggtggcctttctgacgaaggaggatgagttgaagaaaaaggagaaggaacagaaggaggagccgctgagagagcagggcgctaagtattcggctgagaccggccgtcttattcctgccagcactcgcgctgtgggacgacgacgcagccaccagggtcagcagtcgcagagtagctcccgccatgagggtgtgcaggcgttcttactgcaggaccaagaactgttaaagaagacatctctttgggatagttgccgccaacagtggttgtcgagtttccccagcccttag

SEQ ID NO: 218359 - DNA, 951 bp, Artificial Sequence
  Description of Artificial Sequence: Synthetic coding sequence
agtcctaaggcagagctgaagctggaaaaaaagagtgggaggaagccccgtagccccagagattctggccctcagaaagagctggtaattcccggtattgtggactttgaaagaattaggcgcgctttgagaacccctaaaccacagacacctggcacttactgttttggcagattgtcacatcacagtttcttttcaagacaccatcctcatccacaacatgtgacccacatccaggatctgacagggaagcccgtatgcgttgtaagggattttccagcgcctcttccagagtccactgtgttctcaggctgtcaaatggggatccccacaatctccgtgcctattggggatccccagtcgaataggaacccacagctgtcaagcgcctggaagaaggagctgaaagagctggcttcgcgggtagcctttctgacaaaagaggacgagctcaaaaagaaggaagacaccacctccttgaactggaactgcaagagcagaaggccccaagcccctggcctgtccggaacagatttgggcgcagcagagctgggaattaagaaagagcagaaggaagaaccactgcgcgaacagggggcaaagtactcggccgagacagggcgtctcattccagcatcaaccagggccgtgggacgtaggcggtcacatcaggggcagcaatcacagtcctcctcccggcacgagggtgtgcaagcgtttctgttgcaggaccaggagctgctagggggtttgacctcccctggagcaccagtctccgatccagggaacagacttgccaaaagaaacccagttttggccgcattgaggagcgcccagggaaaaagacccagaagcggcacaccagcagatagctcaggctcggccccttcccctgcccctagcctgcacccgtataggaaggctcccaagccggcttcaaggagcgcctag

SEQ ID NO: 218360 - DNA, 498 bp, Artificial Sequence
  Description of Artificial Sequence: Synthetic coding sequence
atgtatatatcaccaaaggcggagctcaagctcgaaaagaagagtgggagaaaacctcgctctccgagggacagcggccctcagaaggagctggttatccccggaatcgtggacttcgaaagaatccggagggccctgaggactccaaaaccccagacacctggtacctactgttttggtagattgtcacatcactccttcttttctcggcatcaccctcacccccaacacgtcacccacatacaggatttgaccggcaagcccgtgtgtgtggttcgggatttccctgcgccactccccgagagcacagtgtttagcggttgccagatgggaatacctaccattagcgttcctattggcgatccacagtccaatcgaaatccacagctctccagtgcatggaagaaagaactgaaagaactcgccagtcgagtcgcgtttctaactaaagaagatgagctgaaaaaaaaggaggtcggggcagagcaccgaagctag

SEQ ID NO: 218361 - DNA, 672 bp, Artificial Sequence
  Description of Artificial Sequence: Synthetic coding sequence
atgttgtgggtccagcgtaaacggaggagaaaggagacaagtgagtgcccgtcagacaaagacaagtcacctgagtcacataaggcaaagaatgagtcctggatcaagtcccacttctcgagactgtccgaagagaagctggctcttgataataacgctagcgccagcggaaatgcaactcaaaccgaatctggttccgaggaagtgtcaagcactgtgcacattgaaactttcactacccgccacggggaagtcgggtccgcactccatcgggaatccttcacaagccgtcagaagacatccgggccatccgtcatccaggaaatccaccaggaatcaggaaaggctccaagcaccgacgaagctacatgggccgctgtcgccgcatgtacaaaggagatcgatacacagggccgtcacctggctcacagcatgcttcagagggcgatcgcataccaacacagcgggcatcttgaatcaaaagatatcaaccaggaagaacttcgcgctctggaggaggtggagatgaagttgcagaagaactttctcacccagcgggagaataccattgctggcgctaaccatacacacacattctatggccactctcatcactctcaccatggccacccgagtcatcagtcccatagcctgccgaacaggcgacactag

SEQ ID NO: 218362 - DNA, 399 bp, Artificial Sequence
  Description of Artificial Sequence: Synthetic coding sequence
atgggaaggacttggtgcggcatgtggagaaggagaagacccggtcgcagatctgctgtgccccgttggccacacctgtcctctcagagtggcgtcgaacccccagatcgctggaccggtacaccagggtggccctccagagatcaagaggccccaggcagcatgatgccgccagcagccgcacagccatccgcccacggcgcactggttcctcctgcaacagcacacgagcccgtggatcacccagcgttgcactggctggcgtgctgctgctgcttgagtctccccggacagcttcctctagctattcggttaggctgggatctcgatctcgaggccggtcccagcagcggtaaattatgcccccgagcccgaagatggcaacctctcccttcatag

SEQ ID NO: 218363 - DNA, 537 bp, Artificial Sequence
  Description of Artificial Sequence: Synthetic coding sequence
atggcctcttttctggtctggccactccgcactgcattaaggggcggtaagagttgggcagggcctggcgtcggctgtggcggagatggcgcacggggtgggggagagctatcattaagcaatttagacctccctggggcaggagaagctgggctggaacaccatcctttactaggacacctgttcatctctgcggtgccaaggtggcctcacctatcaagtcagtctggagtcgaaccccctgatcgatggaccggcaccccgggttggccctcccgtgaccaggaggcgccagggtctatgatgccaccagcggctgcgcaaccttctgcgcatggtgcattagtacctccagccactgcccatgaacctgtggatcaccctgccctacactggttagcttgctgttgctgtctatcacttcccggtcagttgcccttggctatccggctgggatgggacctggacctggaagcaggaccatctagcggaaaactgtgtcctcgggcacgaaggtggcagcccctgccaagttag

SEQ ID NO: 218364 - DNA, 1350 bp, Artificial Sequence
  Description of Artificial Sequence: Synthetic coding sequence
atgtggacagccctggtcctgatttggattttctctttgtcactgtccgaatcccatgccgctagtaatgacccccgaaacttcgtacccaataagatgtggaagggcttagtaaaacggaacgcttccgtggagaccgtcgataataaaacgtcagaagatgtgaccatggctgctgcctctccagttacattaacaaagggcacgtcagccgctcatctcaatagcatggaagtgacgacggaggatacctctcggacagatgttagtgagccagccacaagcgggggtgctgcagatggcgtgaccagtatcgcgccaacagcggtggcctcctcaaccacagccgctagcattaccacagccgcttctagtatgactgttgcttccagcgctccaaccacggccgctagctccactaccgtagcttcaatcgcccctaccaccgcagcaagttccatgacagcagcttcatccacgcccatgactctcgcgctgccagcacccactagcacttctactggcaggaccccatctactacagccacagggcacccttctctctctaccgcgctagcgcaggttcccaaaagctcagctttgccacgcaccgcaactttagccactctcgcaacacgggctcagaccgtggccacaaccgctaacaccagttccccaatgagcactcggccaagtcctagcaagcacatgcccagtgatacagccgcatccccagtacctcctatgcgacctcaagcccagggcccaatcagccaggtcagcgtggaccagccagtggtcaacaccacgaataaaagcacgcctatgccttcaaatacgaccccagagcccgctcccaccccaaccgtagtgaccaccaccaaggcccaggctagggaaccaaccgcgtctcctgtaccggtaccacacacatcacccatacccgaaatggaagcgatgtcacccacgactcagcctagtcctatgccttacacacagcgtgctgctggtcctggaacctcccaggcacccgagcaggtggaaactgaagccaccccaggcaccgattccacaggccctacgccgaggtcctcgggcggtacaaagatgcctgctactgatagctgccaaccttctactcaggggcagtatatggtggttactacagagccattaacccaagccgtggttgacaagacactcctccttgtcgtgctgctgctgggtgtgactctgttcatcacagtgttggtcttattcgcgttgcaggcttacgaaagctacaagaaaaaggattatacacaggtagactacctcatcaacggtatgtacgctgacagcgagatgtag

SEQ ID NO: 218365 - DNA, 78 bp, Artificial Sequence
  Description of Artificial Sequence: Synthetic coding sequence
atgtggacagccttggtcctcatctggatctttagtctgtctctgtcagaatcccacgctgcctctaacgatccctag

SEQ ID NO: 218366 - DNA, 3969 bp, Artificial Sequence
  Description of Artificial Sequence: Synthetic coding sequence
atgcctgtagtatggcctacattgctggacctgagcagagacgagtgtaaaaggatcctccggaagctggagcttgaagcttacgcaggggtcatttcggctctgcgcgcacaaggcgatttgacaaaagagaaaaaagatctgttaggcgagctctcgaaggtgttaagtatctctacagagagacatagggccgaagtgaggagagcagtgaacgacgaaaggttgaccaccattgctcacaatatgagcggtccaaacagtagcagtgaatggtccattgaaggcagacgattggtgcctttgatgcctcgcctggtccctcagactgctttcaccgtcaccgcaaacgctgtggctaatgcagccatacagcacaacgcaagccttcccgtcccagccgagactggatcgaaggaagttgtctgttactcctatacaagtacaacatctactcccacgtctacccctgtgccgtctggctctatcgctacggttaaaagccctcgcccagcttcacccgctagcaatgttgtggtcctaccctccggttcaacggtttatgtcaagtcagtctcctgcagcgacgaggatgagaagccacgcaaaagaaggagaacaaattcctcttcctctagtccagttgtactcaaggaggtgcccaaagctgtggtccctgtcagtaaaaccattactgtgcccgtgagtggtagccctaagatgtctaacataatgcagtccatcgccaattccctgccacctcatatgagccccgtgaaaattacttttaccaaaccatcaactcagacaacaaacacaacaacacagaaagtgataattgtgactacgtccccttcatctactttcgtgcctaacatcctgtccaagagtcacaattatgcggctgtgacaaaactggtccccacctcagtgattgcctctaccacacagaaaccccctgtcgttattaccgcctctcaaagcagcctagtgtctaattcttcatccgggagcagttcaagcactccatctccgattcctaacacagtggccgtgaccgctgtcgtgtcttctacaccaagcgtggtcatgtcaactgtcgcacagggggtctctacctccgccatcaagatggcatccacccgcctcccatctcctaaatctctggtgtctgcaccaacccaaattcttgctcaattcccgaaacagcaccagcagtcaccaaaacagcagttgtaccaggttcaacaacagacccaacaacaggtggctcaaccctctcccgtgtctcatcagcaacagcctcagcagtcccctttacccccagggatcaagcctacaatacagatcaaacaggaatcaggtgtaaagattattacccaacaagtgcagccgtctaaaattttaccaaagcctgtaaccgccactctgccaacatcatcaaattctccaattatggttgtgagctcaaacggtgccattatgacgaccaaactcgtaaccactccaactgggacacaggccacgtataccagaccaactgtgagcccctctatcggaaggatggcagcgacccccggagcagccacgtacgtgaaaaccacatcagggagcattataactgtggtgcctaaaagccttgcgacgctcggtggcaagataatttcaagcaacatcgtttccggcactactacgaagataacgacgattccaatgacttctaagcccaacgttatcgtggtgcagaagacaacagggaaaggaaccactatccagggcctccctggaaagaatgtagtcaccactctgctgaatgcaggcggagagaagacaattcagaccgtcccgacaggggcaaaacctgcgatcctgacagctacaaggcctatcacaaagatgatcgtgacacagcctaaggggatcggtagtactgtgcaaccggctgccaagattattcctacgaagatcgtgtatgggcagcagggaaaaacacaggtgctgattaagcctaaacccgtgaccttccaagctacggtcgtgtctgagcagactcgccaactggtaacggagacattgcagcaggcctcccgagtggccgaagcgggtaactcttcaatccaagagggcaaagaggagccgcaaaattacactgactcatcatcctcttcgactgagagctcccagtccagtcaggatagtcagcctgtggttcacgtgatagcgagccggagacaggattggagtgagcacgagatcgcgatggaaactagccccacgatcatttatcaggacgtaagtagtgagtcgcaaagtgccacatcaactattaaggcgttactggagctccagcaaacaacggttaaagagaagctggagtcgaaacctcggcagcctactatcgatctgtcccagatggccgtacctatacagatgacacaggagaagcgacactctcctgaatcccctagtattgcggttgtggaaagcgagctggtcgccgagtatattacaaccgaacggacagatgagggcaccgaagtcgccttcccactgctggttagtcacaggtctcagccacaacagccttcccagccccagcggaccttgttgcagcatgtggcacagtcgcagactgctacacagacatccgtggtggtgaaaagcattcccgcttcgagtcctggggctattacccacatcatgcagcaggcactgtcttctcacacggcatttaccaagcattcagaggagctgggcacggaagaaggtgaagtcgaggagatggatactctggatccccagacaggcctgttctacaggtcagctctcacccaaagtcagagtgctaaacagcagaaattgagccaaccccctctcgagcagacgcaactacaagtgaagacactgcagtgtttccagaccaagcaaaagcaaacgattcacctgcaggccgatcagctgcaacacaagctcccgcaaatgcctcaactgtcaattaggcaccagaaactaacccccctccaacaggagcaggctcagcccaaaccagacgtgcagcacacgcagcacccaatggttgctaaggatagacagctcccaacattgatggcccagccacctcagaccgtcgtgcaggtccttgcagtaaagaccacacagcaattgcccaagctgcagcaggcaccaaatcagcccaagatctatgttcagccacagactccacagagccaaatgtccctccccgcaagctcagagaagcagacagcgagccaggtcgaacagcctattattacacagggtagctcagttactaagatcacattcgaggggagacagcctccaactgtaaccaagattacgggaggatcatctgtacccaagttgacatctcctgtgacctctatttctcctattcaggcttccgaaaagacagctgtaagcgatatcttgaagatgtctctgatggaggcccagatagacacaaatgtggagcatatgatagtggacccgcctaaaaaggccttagctactagcatgctaaccggggaagcgggaagcttgccgtctacacacatggtagtggcgggaatggcaaacagcactccgcagcagcaaaaatgcagggagagctgctcatcaccctctacagttggtagctccctgacaacacgcaaaattgatcccccagcagttcccgctaccggacagttcatgaggatccagaacgtcggacagaagaaggccgaagagtcgcctgccgaaatcattatccaagcgattcctcaatatgctattccctgccattccagttccaatgtagtcgtcgaaccatctgggcttctggagctgaacaattttacctctcagcagttggacgatgaggagactgctatggagcaggacattgattcctcgaccgaggacggcacagaaccctcgccaagccaatcctccgccgagcggagttag

SEQ ID NO: 218367 - DNA, 3468 bp, Artificial Sequence
  Description of Artificial Sequence: Synthetic coding sequence
atgccggtggtgtggcctacgttactggacttgtctagggatgagtgcaaacgtattctgcgcaagctggaacttgaggcctacgcaggagttatctccgcgttacgcgctcagggagacctgacaaaggagaagaaggacctactgggtgaactctctaaagtgctgtctataagcactgagcgacatcgtgcggaagtacgcagggcggtgaacgacgagcggcttactaccatcgcacacaatatgagcggaccgaatagcagctcagagtggagcattgagggaaggcgcctggtacctctgatgcccagactcgtgccgcaaaccgcatttactgttaccgccaatgccgtcgcaaacgccgcaattcaacacaatgcttctctgccagtcccagcagaaaccggaagtaaggaggtggtctgttattcgtacactagcaccacctcaactcctacttccacccccgttccctctgggtcaatagcaacagtgaaaagtcccagaccagctagtcccgcttccaatgttgtcgttctgccatccgggtccacagtgtacgtgaagagtgtgagttgtagtgacgaggacgaaaagccccgaaagcggagacgcacaaactcgtcttcatctagcccagtggtgttaaaagaagtgcctaaggccgtcgtgcccgtgtccaaaaccattacggtgccggtctcaggtagccctaagatgagtaatatcatgcagagtattgcgaattccctgccaccccatatgagcccggtgaagattactttcactaagccctccacccagaccacaaacaccacaacccaaaaggtgataattgtgaccacaagccctagctcaacgtttgtaccaaacattctctcaaagtcccacaactacgctgccgtgacaaaactggtgcctacgagtgtgattgccagtaccacacaaaaacccccagtggtgataacggcatcacagtcctccctggtgtcgaatagctctagtggtagctcttcatccaccccgagtccaatccctaacaccgtcgctgtgaccgctgtagtgtcctcaacacccagtgtggtcatgtccacggtggcgcagggtgtatctacttctgccataaagatggctagcacacgactgccttcgcccaagagcctcgtgtctgctcctacacagattctggctcagttcccaaagcagcatcaacaaagccctaagcagcagctttaccaagttcagcagcagacacagcagcaggtggcccaacctagccctgtaagccaccagcagcagccacagcagagccctctcccacctggcataaagccgactattcagatcaaacaggaaagtggggtgaagatcattactcagcaggtacagccttccaagatactacccaagccagtgaccgctacactcccaacctcatcaaactccccaattatggtggtgagctctaatggcgcaattatgacgactaaactggtcactacgcctacaggcactcaggctacctacactcggccaactgtttccccttctattggcaggatggctgctactccaggagcagccacatatgtcaagactacatcgggatcgatcatcactgtcgtgcctaagtccctggccaccctgggcggaaagataatctcttccaacattgtttccggcaccaccaccaagattacaacaatacctatgacgagtaaacctaacgtgatcgtggttcagaaaactactggcaaggggaccacaatccagggcctgcccggtaagaatgtggtgacgaccctgctaaacgcgggtggtgagaagaccatacagactgtgccgacaggcgcaaagccagctatactgacagccacccggcctataactaagatgatcgtgactcaacctaaaggcatcggcagcaccgtgcagcccgcagctaaaattatcccgacaaagattgtgtacggccagcaggggaaaacgcaggtgctaatcaagcctaagcctgttacctttcaggccaccgtcgtgtccgaacaaactcgtcagctggtcactgaaacgttacaacaggcatctagggttgcggaggccggtaattcttctattcaggagggaaaggaagaaccccagaactacaccgattctagctcatcttcaactgagtcatctcagagttctcaggatagtcaacccgtagtgcatgtcatcgcctcacgtcgccaggactggagtgagcacgagatcgccatggagacatccccaactatcatatatcaagacgtgagcagcgagagtcaaagtgctacttcaacgattaaagctctcctcgaactccagcagactactgtcaaagaaaagcttgagagcaaacccaggcagcctacaatagatctgtcccagatggccgtgccaattcagatgacccaagaaaaacgccactcgcccgagagtccaagtattgccgtagtggaatccgaactcgttgccgagtacatcaccaccgagagaactgacgagggaacagaggtggcatttcctctgttagtgtcacaccgatcccagcctcagcagccgtcccaacctcagcgcaccctgctgcagcatgtggcccaatcacagaccgccacccagacctcggtagtcgtcaaatccatcccggcttcctcccctggagcgattacccacataatgcaacaagccttgtcatcccacaccgcttttaccaaacattcagaagagcttggaacagaggagggggaagttgaagaaatggacaccctagacccacagacaggcctcttttatagatcggccctaactcagtcacagtccgcaaaacagcagaagttgtctcaaccaccattggagcagactcagctgcaggtgaagactctccagtgcttccaaaccaagcaaaaacagaccatacatcttcaagcggatcagctgcagcacaagctcccgcagatgcctcaactgagcattcgccatcagaagctgacacccctccagcaggaacaggcacaacctaaaccagacgtccaacatactcaacacccaatggtcgctaaagatcggcaactacccacgcttatggcccaacctcctcaaactgtggtccaagtgctggcagtgaaaaccacccagcagctccccaaactgcaacaggctcccaaccagccaaaaatctacgtgcagccccagacacctcaatcacaaatgtctctgcctgcaagttctgaaaaacagacagcgtcccaggccattccgcagtacgccatcccatgccattcttcctctaatgtcgtcgtcgagccttctgggcttctggaactgaacaacttcacttcccagcaactcgacgacgaggaaactgccatggaacaggatattgacagcagtactgaggacgggactgagccgtctccctctcagtccagcgccgaacgcagttag

SEQ ID NO: 218368 - DNA, 3015 bp, Artificial Sequence
  Description of Artificial Sequence: Synthetic coding sequence
atgccagtggtatggcctactcttctagacctgagcagggacgaatgtaaaagaatcctccggaagctggagctcgaagcttacgctggcgtgatcagcgccctgcgcgcacagggtgacttgacgaaggaaaaaaaggacctcctcggcgaactcagtaaggttcttagcataagcactgagaggcaccgtgctgaagtccggagggccgttaatgacgagagattaaccaccattgcccacaacatgtctggccctaattctagttctgaatggagtatagaaggccgacgactagtgccccttatgcctagactcgttcctcagaccgctttcaccgttaccgccaacgccgtagctaatgctgccattcagcacaatgcctccctccccgtgccagcggaaaccggctccaaagagggagtgtcatgttcagatgaggacgaaaagccccgaaagaggcgcagaacaaatagctcttctagctctcccgttgtgttgaaagaggtgcccaaggccgtggttcccgtcagcaaaactataacagtgcccgtgtccggtagtcccaagatgtcaaacattatgcagtctatagcaaattcactccccccacatatgagtcccgtgaagataaccttcactaaacccagcactcagacaactaacacaaccacccaaaaggtgatcatcgtgacgaccagccccagctccacattcgtgcctaatattctgtcaaaaagtcataactacgccgctgtaactaaactggttcctacatccgtgattgcgagcaccacacaaaagccccctgtggttatcactgcttctcaatctagcttggtctcaaacagttcatccggtagctcgagtagcactccttcccccattccaaatacagtggctgtcactgcagtcgtgagctcaaccccatctgtggttatgagcaccgtggctcagggggttagcaccagtgccatcaagatggcatctacccgcctgcctagcccgaaaagcctagttagcgcccctactcagatcctcgcccagtttcccaagcagcaccaacaatcacctaaacagcagctctatcaggtgcagcagcaaactcagcagcaggtggcgcagccttctcctgtgtcccaccagcagcagccacaacagtctccattgcctccagggatcaaacccaccatccagataaagcaggaatccggggttaagatcatcacgcagcaggtacagccttccaagatactaccaaagcctgtgaccgctattctgactgccacaagacccatcacaaagatgatcgtaactcagcctaaggggattggctctaccgtccagccggctgcaaaaatcattccaactaagatcgtctatggtcaacaaggcaaaacccaagtgttgattaagcccaagcctgtcacttttcaggccacagttgtgtccgagcagacccggcagctagtgactgagactttgcagcaagcctcccgcgtcgcagaagccggaaatagctccatccaggaaggtaaggaagaacctcaaaactacaccgactcaagcagctcctctaccgaatcttctcaatcctcccaggtgagccatcggagtcagccacagcaaccgagtcagcctcagcggacgttgctgcagcacgtcgcccagtcccagactgccactcagaccagcgtcgtggtaaaatccatcccagccagtagcccaggtgcaattacccatattatgcagcaggcactgtctagtcataccgcatttactaaacattcagaagagttaggaacagaagagggggaggtggaagaaatggacacactagacccccagactggcttattctacagatcggcattgacgcaatcacagtcggctaaacagcagaagctaagccagccacccctagagcagacacagttgcaggttaagacattgcagtgcttccagacaaaacaaaaacagactatccacttacaggccgaccagctgcagcataagctccctcagatgccccaattaagcattcgccaccagaagttaactcccctgcagcaggaacaggcccagccaaagcccgatgtgcagcacacccagcatccaatggtcgctaaagatcggcagctaccgacactcatggcacagccccctcagacagtggtccaagtgctggcggtgaaaacaactcagcagctgccaaagctgcaacaggctcccaatcagcctaaaatttatgtccagccgcagactccccagtcgcaaatgtctctgcccgcttcttctgagaagcagacagcttcacaagtggagcagccgatcatcacacaggggtcaagtgtcaccaaaattactttcgaggggagacaacctcccaccgtgaccaaaattaccggaggatctagcgtgcctaagctaaccagcccagttaccagtatttctcctattcaggcctccgagaagacggccgttagcgatattctcaaaatgtcacttatggaggctcaaatcgacacaaacgtcgaacacatgatcgtggatcctcctaaaaaagctttggctacctccatgctcactggtgaagccggtagcctcccaagcacccacatggttgttgctggcatggctaactctaccccgcaacagcagaaatgtcgggaatcatgttcttctccaagtacagttggcagctctctgaccacccgtaaaatagatcctcctgcggttcccgcaaccggccagttcatgcgaattcagaatgtgggccagaagaaggctgaggagagcccagcagagattataatccaggccatcccccagtacgccataccttgccactcttcctcaaatgtcgttgtagaaccttccggcctgctggaactgaataactttacttctcagcagttagacgatgaggaaaccgctatggagcaggatatagattcatctaccgaggatggcacagaaccttcccccagccagagctcggcagagcgatcttag

SEQ ID NO: 218369 - DNA, 3969 bp, Artificial Sequence
  Description of Artificial Sequence: Synthetic coding sequence
atgcccgtggtatggcctactctgctggatctttcaagagacgagtgcaagagaatcctgcgaaagctggagctcgaagcatacgcgggagttatctctgccttgagggcccagggcgacttaaccaaggagaagaaggacttattgggcgaactgtccaaagtactctcaatctccactgagagacaccgggcagaggtccgcagagcagttaatgatgagagactaaccacgattgcccacaatatgtcagggcctaactcctcatccgaatggtccatcgaaggaaggaggctcgtgcctcttatgccccgacttgtccctcagactgccttcaccgttacagccaacgctgtggctaacgccgctattcagcacaatgcttcactgcccgtcccggctgagaccggctccaaggaggtagtctgttattcttatacctccacaacttccacccccacatctacccctgtgccctctgggtcaattgcaactgtcaagagccctcggccagcttccccagcctccaacgtcgtagtgttgccttctggatcgactgtctatgtaaagagtgtatcctgctcagatgaagacgagaagcctcgcaaaagaaggcgcactaactcttccagttctagtcccgtcgtgctcaaggaagtgcccaaagccgtcgtgcccgtctcaaagacgatcacagtgccagtctcggggtctcccaagatgtcgaacattatgcagtcaatcgcaaacagcctgcccccacatatgtcacctgtgaaaattacgttcacaaagccttctacccagactacaaatacgacaacacagaaagtgatcattgtcacgacctctccaagcagcacgttcgtgcccaatatcctgtctaagagccacaactatgccgctgtcactaagctggtgccaacttcggtgattgcatccacaacacagaagccgcctgtggtcataacagcctcacagtcaagtttagtgtccaacagttcgagtgggtcctctagctcgactccttccccaattcctaatacagttgccgttactgccgtggtgtcctcgacaccctccgttgttatgtccacggttgctcagggtgtctctactagcgccatcaagatggctagcacacggctcccatcaccaaaatctctggtgagtgcacctacccagatactggcacaattccctaaacagcaccaacagtcccccaagcagcagctctaccaagtacagcagcagacccagcaacaggttgcccagcccagcccagtgagccaccagcagcagccacaacaatctccgttaccgcctgggattaagccaacgatccagatcaaacaagagtcaggggttaagatcattactcaacaggtacagccttctaaaatcctccctaaacctgtcactgccactctgcccaccagctctaacagccctatcatggtggtgagctctaatggggcaattatgacaactaaactcgtgacaacacccaccggcacacaggcaacttatacacgcccaactgtcagcccctccatcggacggatggcagccactcccggtgccgcaacctacgtcaagacaacaagcggatcaattattaccgtagtgcctaagagtctagccacccttggaggcaaaattattagcagcaacattgtatcgggaaccaccaccaagattacaaccatccctatgactagcaagccaaatgttatcgtggtgcagaaaaccacagggaaagggaccactattcagggtctccccggaaaaaatgtggtcacaactttgttgaacgctggaggagaaaagacaatacagactgtacctaccggagcaaagcccgctatcctcaccgctacccgcccaattaccaaaatgattgtgacccagccaaagggaattggcagcaccgtacagcccgctgctaaaattattcccacgaagatagtctacgggcagcagggaaaaactcaagtcctgattaaacctaaaccggtgacttttcaggccactgtggtttccgaacagacaagacaactggtgacggagacgctgcagcaagcctctcgggtggctgaggcaggaaatagttcaatccaggaggggaaagaagagcctcagaattataccgacagcagctcctcatccaccgagagcagccagtcatcgcaggatagccagcccgtggttcacgttatcgctagtcgtagacaggattggagcgaacacgagattgccatggagacatctccaacaattatttatcaggatgtcagcagcgaaagccaatctgccacctctactatcaaggctctactggagcttcagcagacgaccgtgaaggaaaagctggaatcgaagccaaggcagccaactattgacctcagccaaatggcagtacccattcaaatgacccaggagaaacggcactcccccgagtctccgtctatagcagttgtcgaatctgagctcgtagccgaatacatcaccaccgaaaggactgacgaaggcactgaggtcgctttcccccttctggtgtcgcaccgcagtcaacctcagcagccctcacaacctcagaggacactgcttcagcacgttgcacagtctcagacggctactcaaacttccgttgttgtgaagtccataccggcatcttctccaggcgctatcacacacatcatgcaacaggccctgtctagtcatactgcgttcaccaaacacagcgaggaactaggtaccgaagaaggtgaggtggaagaaatggacaccctcgacccacagaccggcttattctatcgcagcgccctgacacagtcgcaaagtgctaaacagcaaaagctgtcacagcctccccttgaacagactcagctgcaggtaaagaccttacagtgtttccagaccaagcaaaagcagacaatccacctgcaggcagatcagctgcagcacaaattgccccaaatgccccaactctctattcggcaccagaagctaacccctctccaacaggagcaagctcaaccaaagcctgacgtccagcatactcagcatcctatggtggccaaagatagacagttgcctaccctgatggcacagcccccacaaactgtcgtacaagtgctggctgttaagactacccaacagctgcccaaactgcagcaggcacctaatcagccaaagatttatgtgcagccgcaaactcctcagtcccagatgtcactacctgctagtagcgagaagcagacagcctcacaggtggaacagcctatcataacgcagggtagctcagtgacgaagatcacgttcgagggtcggcagcctcctacagtgaccaaaattacaggcggatcatcagtgccgaaactgacttcccctgtgacctcaatctctccgatccaggctagcgagaagacggccgtgagtgatatactaaagatgagcctgatggaggcccaaatagacactaacgttgagcacatgattgtggacccacctaaaaaggcactggccactagtatgttaacaggagaggccggttcgttgccaagcacacacatggtggtggccggaatggccaatagtaccccacagcagcaaaagtgccgcgagagttgctccagcccttctaccgtggggtcaagcctgaccactaggaagatcgatcctcccgctgtccctgcgaccggacagtttatgaggatccaaaacgttggacaaaaaaaagctgaggagagcccggctgaaatcattatacaagccattccacagtacgctattccgtgccacagctcgagcaatgtggtggtggagccttccggattattggagctaaacaacttcactagtcagcagctggatgatgaagagacagctatggaacaagatattgacagcagcacagaagacggtacagaacctagcccctctcagagttccgcagaacggagttag

SEQ ID NO: 218370 - DNA, 624 bp, Artificial Sequence
  Description of Artificial Sequence: Synthetic coding sequence
atggctgttttccatgatatgcttctgcaacccttgggaatgtttctgtgtttatccctacagctgtccagcgctacatttatccgctacagcagcacttgttttactttcgacgaatactatacaataacactcgacatcaaggccagtagccacatctacgagagcaatgctgtgtattccgtgttcgtgccggtcaatgatagcgtgtatgctgttgtgatgaagactctggatgagaattcagattccgcaggcctttggcagagggctgataagaactgttattccaactccacatactacgtcaaagatcagtacatgaccgtgctggaggcacagtggcaggccccagagccggagaatatcactgaggtagagattcaagccttcaccgtgcagattcgggctctgcccattctgagtaccttaaagctgagggagaagttgagcaccctggctctggcagctaaaataccccagtctagcgccttcaagccgttcttcatgatcactcccaaaagcatcaggttggagggtctggctaatcaagtcttttcatcccccattacagaagcgatttatattcttttggcctttctcacgtctactctgctcttctag

SEQ ID NO: 218371 - DNA, 3708 bp, Artificial Sequence
  Description of Artificial Sequence: Synthetic coding sequence
atggaccacactgcatcccagaatgctcaggatctcattggcatcccccacctcggggtctctggttccagcacaaagtggcattcagaattatctcctacagagggccctcatagcgcaggtagttccacaccaggttttttgagccccatggccgaactatctcacccttctcccccacctcctgcgctaggcagtctacttcagctgcccgacgggtcgccctcatggtccatgctcgaggtggcgtctgggccagcgtctacccagcagattaaggctggcgtgccaggacgagtgcacaacggtgtatctctgccaacctttaagaacacagagactgctacccacgaggcagagcctcccttatttcagactgccgagtccggggcaattgagatgacatccaggaagctggccagcgccaccgccaatgacagtgctaatcctttgcatttgagtgccgctccagagaattcccgagggcctgcactttccgcggagcacacatcaagcttggtgccgagcctgcacataactacgttaggccaggagcaagcaatcctcagcggggctgttccggcatcacccagcaccgggaccgccgactttcccagcattctgacttttttacagcctacggaaaaccacgccagtcccagtcccgtacctgaaatgcctactctgccagccgagggctcagatgggtcccctcccgcaactcgagatctactgctgagctctaaggtacctaacctgctgagtaccagctggacctttccaagatggaagaaggattctgtgaccgctatcctaggtaaaaatgaggaggccaatgttacaattcctctccaagcttttcctagaaaggaggtactctcactgcatacagtgaatggatttgtaagcgactttagcactggcagcgtttcctcaccaattattaccgcccctcgaacaaatcctctcccctctgggccacctttgccgtctatcctgtccattcaggccacccagacagtgttccctagtctcggcttttcctctaccaagcccgaggcctatgcagctgctgtcgatcatagtggtcttcccgcttcagcatcaaagcaggttagggcatcaccaagttctatggacgtttatgatagcctgaccataggcgacatgaaaaagccagccaccaccgacgtcttttggtcctctttgtcagcggagactgggtctttgagcaccgagtcaatcatatcaggccttcaacagcaaactaattatgaccttaatggccacacgataagcacgacttcatgggaaacccatctggctcctaccgcccctccaaatggcctgacctcagcagccgatgcaatcaaaagtcaggactttaaggacaccgctgggcattcagtcactgccgaaggtttctcaatccaggacctcgtccttggcacaagcatcgaacagcctgtgcagcagtctgacatgaccatggtgggaagccacatcgatctttggcccaccagcaacaacaatcatagcagggactttcaaaccgctgaagttgcgtactactctccaactactcgtcattccgtatcgcaccctcaactccagcttcccaaccagcccgcacatcccctgcttctaacctcacctggacctacaagcacaggcagtctacaggagatgctgtcagatggaactgacacaggaagtgaaatctcctcagacattaattcttcgccagagcgaaacgccagcacaccgtttcagaatattctcggttaccattccgccgctgaatccagtatcagcaccagcgtattccccaggacatccagtagggtcctgcgagcctctcagcatccaaagaaatggaccggggcagcgaccaacgcggctgataccgtgtcgagcaaggtccagccaaccgccgcagccgcagtaaccttgttcttgaggaagtcttctccccctgcgctttccgcagccctggtggccaaagggacatcctccagtcctctggctgtggcaagtggtccagctaagagcagcagcatgaccaccctggccaaaaacgtcacaaacaaagcagcgtcaggtcccaagcggactcccggagctgtgcacactgcgtttccctttactccaacatacatgtacgccaggacagggcatacaaccagtacacataccgctatgcagggcaacatggacaccgcctcaggcctgctctccaccacgtatcttccgaggaagccccaagccatgcacacaggactaccaaatcctactaacctggaaatgcctagagccagtactccccgtcctttgacagtgacagccgctctcacctctattacggctagtgtgaaagccacacgcctgccccctctgagggcggagaatacagacgcagtgttgcctgctgccagcgcagctgtcgtgactactggaaagatggcgagcaatttggagtgtcaaatgtcatcgaaattactggtcaagacagtcctcttccttactcagcgaagagtgcaaatatccgagtctctgaagttttccattgctaagggtcttacacaggccttaagaaaagccttccatcaaaatgatgtgtccgcccacgtggacatcctggagtacagccacaatgtcacagtgggttattacgcaaccaaaggaaagctggtgtatctccccgcagtggtcatcgagatgttgggtgtatacggagtttctaacgtgaccgccgaccttaagcagcacaccccacatctacagagtgttgcagtgttggcgagcccctggaatccgcaacctgcaggctatttccagctaaagacagtgttgcaatttgtttcgcaggctgacaacattcagtcgtgcaaattcgctcaaaccatggaacaacggctgcagaaagccttccaggacgccgagcgcaaagttctaaacaccaaatcaaacctgacaattcagattgtcagcacgagcaacgcaagccaggcagttacactggtgtacgtggtgggaaatcagtctacatttttgaacggaaccgttgcctcctctctgctcagccagctgagcgccgagctcgtgggattttatctcacatatccacctctgacaatagctgagcccctggagtatcctaatctggatatcagtgagacaaccagagattattgggtaatcaccgtgttgcagggagtggacaacagcttagtcggacttcataaccagagcttcgcacgcgttatggagcaacgcttggcgcagctgtttatgatgagccagcagcagggacgtaggttcaaacgggcaaccacacttgggagctacaccgtgcagatggttaagatgcagcgggtgcccggaccaaaggatcccgctgaacttacctattacaccctgtacaacgggaagcctttgcttggcactgccgcagccaaaatccttagcacgattgacagccagcgcatggctctgactctgcaccacgttgttctcttacaggccgatcccgtggtaaaaaacccgcctaataatctctggatcattgctgccgtactggcgccaatcgcggtggtgactgtgatcatcataataattaccgctgtcctttgcaggaaaaacaagaacgattttaaaccagacacaatgattaacctgccgcagagagccaagcaggtcgcgcagtag

SEQ ID NO: 218372 - DNA, 5549 bp, Artificial Sequence
  Description of Artificial Sequence: Synthetic coding sequence
atggaccacacagccagccagaatgcccaggacctgattggcatcccacaccttggcgtctcagggagctccacgaagtggcactcagaacttagtccaaccgagggaccccactcagcgggaagttcgacccccggtttcctatcaccgatggccgagctgagccaccctagcccacccccacctgccctggggtctctgctccaactgccggacggaagcccctcctggtctatgcttgaagtggccagcggtcccgcatctacccaacaaatcaaggctggtgtacctggcagggttcacaacggggtgagcctgccaaccttcaagaatacagaaaccgctacacatgaggcggaaccccctttgtttcagacagctgagtcaggggcaattgagatgacttcccggaagttggcgtcggccacagccaacgactctgccaacccgctccacctgtccgccgctcccgagaacagtagaggccctgcgctgagcgctgagcacacgtccagcttggtcccaagtctccatattactaccctgggccaggagcaggccattttatctggagccgtccctgcttccccatctacaggcactgcagacttcccctctattcttactttcctgcagcctacggagaaccacgccagtccgtctcccgtgccggagatgccaactctcccggcagagggaagtgacgggagccctccagctacacgcgacctgctgctttcttccaaggtgcccaacttactgtctacgagctggacttttccgaggtggaagaaggactctgtgaccgccatcctcggaaagaacgaggaggccaatgtaacgatcccgctgcaggcttttccacggaaagaggtgctctccctgcacaccgtgaatggttttgtcagcgacttctctaccggctccgtgtcgtcccctatcatcaccgccccaaggaccaatccgctcccatccggccctccacttccatctatcctgagcattcaggcaacgcagacagtgttcccctccctcggctttagctcaaccaaaccagaagcctacgctgctgcggtggaccactcaggacttccggcttcggcgtcaaagcaagtgagggcatctccctccagtatggacgtgtatgattccctgaccataggtgatatgaaaaaacctgccaccaccgacgtgttctggagtagcctgtcagcagaaacagggtcactcagtacggagtcaataattagtgggctccagcagcaaactaactacgatctgaatgggcatacaatctctactacaagctgggagacccatttggcgccaaccgctcctccgaacgggttaacctcagctgctgatgcgatcaaatcgcaggactttaaagacaccgccggacactcagtgaccgcagaggggttttcgattcaagacctcgtgcttggaacttccattgaacagccggtacagcagtcagacatgactatggtgggcagccacatcgacctgtggccaacaagcaataataatcattcgcgcgacttccagacagctgaagtggcttactattcccccacgacgcggcatagcgtatctcatccccaactgcaactgccgaaccaacctgcacacccgcttctgcttacaagccctggcccaaccagcaccgggtcgctgcaggaaatgctttcagatggaacagatacagggtctgagattagcagcgatataaattctagccccgaacggaatgcttctactccttttcaaaacatactggggtatcactcagcagccgagtctagcatttcgaccagcgtttttccccgaaccagctcgcgcgtgctgcgcgcttcccagcaccccaagaagtggacggccgataccgtctcctctaaagtgcaaccaactgcagccgcagcggtgacccttttcctgcgcaaaagcagccctccggcattaagtgcagccctggtggccaaaggcacctcttctagtcctctcgccgtggcctcaggcccagccaagtctagcagcatgacaacactggcgaaaaacgtgaccaacaaagccgcaagcgggcctaagcgtaccccaggggctgtgcatacggcattcccatttacgcctacctatatgtatgccagaaccgggcacacgacaagcacgcacacggctatgcaggggaacatggatacagccagcgggctcctgtcgacaacatacctgccacgcaaaccacaggcgatgcatactgggcttcccaacccaacaaatctggagatgccacgcgcatctaccccccgacccctgaccgtcaccgcggctctgacatccatcactgcttccgttaaggccactcggctaccaccactccgcgctgagaacactgatgccgtgctgccggcagcatctgctgctgtcgtgaccactgggaagatggccagcaatcttgaatgtcagatgtctagtaaacttttggttaagacggtgctgtttctcacacagaggagagtgcagataagcgagtcacttaaatttagtatcgccaagggcttaacccaggctttgcggaaggccttccaccagaacgatgtgtctgcgcatgtggacattctcgagtactctcataacgtgacagtcggttactatgccactaaggggaagctggtctacctgccagctgtcgtcatcgaaatgctcggcgtttacggagtgagtaatgtgaccgctgacctgaagcaacataccccccatctgcagtctgttgcggttctcgcctcaccttggaatccgcagcctgcgggttacttccagctgaagacggtgttgcaatttgtgagtcaggcagataacatccagagctgtaaattcgctcaaaccatggagcagagactgcaaaaggcgttccaggatgctgagcgcaaggtacttaacacaaaatctaacttaacgattcaaattgtgtctacaagcaatgcatcccaagctgttacacttgtatatgtggtgggtaaccagtcgacgttcttgaatggtaccgtggcatcaagtctgctctcccagctgagcgcagagctggtggggttttatctgacctatcctccccttacaatagcagagccactggaatacccgaacctagatatttccgaaacaacacgagattattgggtgattacagtgctacagggcgtggacaatagcctggtgggattgcacaaccagtccttcgcaagagtgatggagcagagactggcacaactgttcatgatgtcacagcagcaaggtaggagattcaagcgagccactaccttaggtagctataccgtgcagatggttaagatgcaaagggtgccaggacctaaggaccctgccgagctcacttattataccctgtacaacggtaagccgctgttgggcaccgcggctgcaaaaattctgtctaccatcgactcgcagaggatggctctgacactgcaccacgttgtactactgcaggccgaccccgtggtaaagaatcccccaaacaacctgtggatcatcgcagcagtcctcgctcctatagccgtcgtgaccgtgataatcattatcataactgccgtgctctgtaggaaaaacaaaaatgattttaagcccgacaccatgatcaatctgccacagcgcgctaagccagtgcaggggttcgactatgctaagcagcacctcggccaacagggggctgatgaagaggtaattcccgtgacacaggaaactgtcgtgctccctctgccaatccgcgacgccccacaggagagagacgtggctcaggacggttccactatcaaaaccgcaaaatctactgagacacgcaagtctagatcaccctcggagaatggctccgttatctccaacgagagtgggaaaccaagtagcggcagaaggtcaccacaaaacgtgatggcccaacagaaagttactaaggaggaagcccgtaaaagaaatgtgcctgcttcggacgaagaagagggggcagtcctctttgataattcttcaaaagtcgcagctgaaccatttgatactagcagcggaagcgtgcaactgatcgcgatcaaaccgactgccttaccgatggtgcctccaacatccgatcgctcccaagagagttctgctgtcttaaacggcgaggttaataaagccctgaaacagaagagcgatattgagcattacagaaataagttgaggttgaaagccaagaggaaggggtattatgatttccccgctgtggagacttcgaaaggcctgactgagcggaagaagatgtatgaaaaggcaccaaaggaaatggagcacgtactcgaccccgacagcgagttgtgtgcgccattcactgagtcaaaaaatcgacagcagatgaagaatagcgtgtatcggagtaggcaaagccttaacagcccttcccctggggagacggaaatggacttgctggtaacccgcgagaggcccaggaggggaattaggaattcaggatatgatacagagccagagattatagaggaaactaatatcgatcgggtgcccgaacctcgcggatatagtcgctcgagacaggttaaagggcacagcgaaacttcaaccctatccagccagccgtctatcgacgaggtacgccagcagatgcatatgctcttggaggaagcgttttctttagcttcggcgggacatgccggacagagcaggcaccaagaagcctacggaagcgcacagcacctgccatactcagaagttgtgacctctgcccctggaaccatgacccggcctagagcgggagttcagtgggtgcctacctacaggccagagatgtatcaatattccctacctcgccctgcctaccgattctcacagctgccggagatggttatgggatcgccacctcctccggttccccctcggaccggcccagtggccgtcgcttcactgcgacgaagtacctccgacataggcagtaaaactagaatggccgagtcaaccgggccagagccagctcaacttcatgatagcgctagttttacccagatgagtcgcggtccggtctctgtcacccagttggaccagagcgccctgaattactccggcaacaccgtgcccgcagtgttcgcaattccagccgctaatagacctgggtttaccggatacttcattcccactcctcccagttcctatcgcaatcaggcctggatgagctatgccggagagaacgaactgccatctcagtgggccgacagcgtgccactgcccggatacatcgaggcttaccctaggagccgctatccccaatcctctccaagcaggctgcccagacagtactctcagcccgctaatttgcatccaagcttggagcaagccccagcaccttccactgctgctagccaacagtctcttgccgagaacgaccctagcgacgcacccctgactaacatctccaccgctgcgctagtcaaggccatacgagaggaggtggctaaacttgccaaaaagcagaccgatatgttcgagttccaggtgta

SEQ ID NO: 218373 - DNA, 5567 bp, Artificial Sequence
  Description of Artificial Sequence: Synthetic coding sequence
atggaccataccgccagtcaaaatgcacaggatctcattggcatcccacacctgggtgtctcgggcagcagtaccaaatggcattccgagctgtcacccacggaggggcctcatagtgcaggctcttcaacgccgggattcctctccccgatggctgagctgagtcacccctctccgccaccacccgctctggggtccctgctacaactgcctgatggatccccttcttggtccatgttggaggtggcttcaggccctgctagtacccagcagattaaggccggtgtgcccggtagagtgcacaacggagtgagcctccctaccttcaagaatacagagaccgcgactcatgaggccgagccacccttgttccaaaccgccgaaagtggtgcaattgagatgacaagccggaagttggcttccgctacagccaacgactccgcaaacccgctacacttatccgcagcaccagaaaacagccggggtcccgctctatccgctgagcacacatcaagtctggtcccgagcctgcatatcaccaccctcggccaggagcaggccattttgtcaggggctgtgccagccagcccttctactgggaccgcagattttcctagcatcctcacatttctgcagcccacagaaaatcatgcctctccgagcccagtaccagagatgcctaccctgcccgctgagggatccgatggatcccctcccgctaccagagatttgctgctgtcctcaaaggtcccaaatctgctgagcaccagctggaccttccccaggtggaagaaagattccgtaactgccattctgggtaagaacgaagaggcgaatgtgacaatcccacttcaggcttttccaaggaaagaggtcttgtcactgcatacagtgaatggattcgtctcagacttttctaccggtagcgtgagttcacccataattactgcccctagaacaaatcctctgccctcagggcctccactgcccagcatcctctcgatccaagccacgcagacagtgttcccatccctgggcttctccagtacaaagcccgaagcctatgccgcagcggtggatcactcgggactgcccgcttctgcgtctaaacaggtaagggccagtccttcttctatggatgtgtatgatagcctcaccatcggagatatgaagaaacctgctaccacagatgtgttttggagttctcttagcgctgagaccgggtctctgtccactgaaagcatcatttcaggcctccagcagcagactaattatgacctgaacggacataccatttccacaacctcatgggaaacccatttagctccgaccgcccctcccaacggcctcacttctgcggctgatgccattaaatcacaggactttaaggacactgcgggacactcagtgacggccgagggtttttctatccaggatttagttcttggaactagcatagagcagccagtccagcagtccgacatgaccatggtcggctcccacatcgatctgtggcccacctcgaataacaatcatagcagggactttcagacagctgaagttgcttactattcccctacaacgcgacattccgttagccacccccagctccaattacccaaccagcccgcacacccactcctactcacctctccaggacccacgtctaccggatcactgcaagaaatgctgagtgatggaactgacacaggaagtgaaatttccagcgatattaattcgtcaccagaacgcaatgcaagcacaccctttcaaaacatactcgggtatcactcagccgcagagagctccatctctacatccgtgttccccagaacatcttcaagagtgctacgcgctagtcaacacccaaaaaaatggaccggtgccgctacaaacgccgcagacaccgtaagctcgaaggtccagcccactgcagcagcagctgtgactttgtttttgaggaagtccagccccccagccctcagcgccgcacttgtggctaagggcaccagtagcagccctttggccgtggcgtcgggcccagctaagagctcatctatgaccaccctcgccaagaatgtgaccaataaagcggctagcgggccaaagcgcaccccaggggcagtgcacactgccttcccctttaccccgacctacatgtatgccagaaccggtcatactacctccacacataccgccatgcagggcaacatggatacagcctcaggtttgcttagcaccacctacttgcctagaaagcctcaagcaatgcacacgggcctgcctaacccgactaatctcgagatgcctagggccagcaccccacgccctctcacagtaacagcagccctcaccagcattacagcctccgttaaagcgacccgattacctccgctgagggcggaaaatactgatgccgtgctccccgcagcctctgccgctgtggtgacgaccggaaaaatggcaagcaacctcgaatgccagatgtcaagtaagcttctagtgaaaaccgtcctcttcctgacacaacgcagagtgcagatttctgagagcctgaagttctccatcgccaaggggctgacacaggctctgcggaaggccttccaccaaaacgacgtgtcggcccacgtggatatcttagaatattcccataatgtgacagtgggctactacgccaccaagggtaagctagtgtaccttccggctgtcgttatcgagatgctcggcgtctatggcgtgtctaacgtaacagccgacctgaagcagcacactccacatttacagagcgtggcggtgttggccagcccttggaaccctcagccggctggatacttccagctgaaaaccgtgctgcaattcgtatcccaagcggacaacatccaatcatgtaagttcgcccagacaatggaacaaaggctgcagaaggcttttcaggatgccgaacgtaaagtgctcaacacaaagtccaacttaaccatacagattgtgagtacatctaacgcgagtcaggcagtgactcttgtgtacgtcgttggaaaccagtcgacctttttgaatggaacagtcgcatcctccctgttgtcccagctgtcagcggagctggtgggattttatttgacttatcccccacttactattgcagaaccgctcgaataccctaacctggacatcagcgagacaacccgggactactgggtgattacggttttgcagggggttgacaatagcctggtgggtctccacaaccagtcattcgcaagggtaatggagcagaggctggcccagctctttatgatgagtcaacaacagggccgaaggttcaagcgagcaacaactttgggctcttacacagtgcaaatggtgaagatgcaacgtgtcccagggccaaaggaccccgctgaactgacatattacacgctgtacaacggtaagcctctgcttggaacagcagcagccaaaatcctgagcactattgacagccagcggatggccctgaccttgcaccacgttgtgctgctgcaggccgatcccgtcgtgaagaaccccccaaataatttatggattatagcagctgtgctggccccaatcgccgtcgtgacagtgattattattattattacagcagtactgtgcagaaagaacaaaaacgatttcaagcccgacaccatgatcaacttgccacagcgtgcaaaacccgtgcaaggtttcgactacgccaaacagcatctcggccagcagggagccgatgaggaagtcatccccgttacacaagagactgtggtcttacccttgcctatacgggacgctcctcaggagagggatgtggctcaggacgggagtacaatcaagaccgccaagagtacggagacgagaaagtctagaagtccgtctgaaaatggctcggtgatctctaatgaatccggcaaaccgtcctccggacgaaggagcccacaaaatgtgatggcacagcaaaaagttacaaaagaggaggccaggaagcggaatgttccggcttccgacgaagaggaaggcgctgtcctgttcgacaatagcagcaaggtcgcagcagaaccttttgacaccagtagcggctcagtgcaactaattgccattaagcctactgccctccctatggttcctcccactagcgaccgctcgcaagagtcctccgccgtgctgaacggtgaggtcaacaaagcactcaagcagaaatccgatatagagcattatagaaataaattgaggcttaaagccaagaggaaggggtactatgactttccagccgtggaaacctccaaaggactgactgagcgaaagaaaatgtatgaaaaggcccctaaagagatggagcatgtcctggatccggactccgagctgtgtgcaccgttcactgaaagcaagaatcgccagcagatgaagaattctgtgtatcgaagccgccaaagtttgaatagtccttcaccaggggagactgagatggatctcctggtgaccagagagcgtccccgaagagggataagaaatagcggttatgacactgagccagaaataatcgaggagacaaatatagaccgagttcctgaaccaagggggtactctcgcagtcggcaggtcaaaggacacagtgagacctctaccctttcctctcagcccagcatcgacgaagtaagacagcagatgcatatgttgttggaagaggctttttctctggcaagtgcgggacatgccggacagtcccggcaccaggaagcgtacggcagcgcccagcacctgccctattctgaggtggtgacctcagcaccgggaaccatgacaagacccagggcaggcgtccagtgggtgcccacctaccggcctgagatgtatcagtactccctgccccgtccagcctacaggttttcacagctgccagagatggtcatgggatcacctcccccacccgtgcctcccaggaccggccctgtggctgtggcttcgctaaggagatcaacctccgacattggctcaaaaacaaggatggcagagtccaccgggcctgaacctgcccagctacacgacagcgcatcttttacccagatgagtcgaggtccagtctcagtgacccaactggatcagagcgccctcaactatagcggtaatactgtgcccgctgtttttgccattcccgctgccaacaggcctggattcacaggctatttcatacccactccgccaagctcttaccggaatcaggcctggatgagctatgccggtgaaaacgagctcccttcccagtgggccgacagtgtccccctcccaggatatattgaggcgtatcctaggtctaggtatccacagagttctcccagtaggctccctcgccagtattcacagccagcgaacttgcaccctagtctggagcaggcccctgccccttccacggcagccagtcagcaaagcctggctgagaatgatccaagcgatgcccctctcacaaatatttccactgcagccttagtgaaggccatccgcgaggaggtggctaaactggctaaaaaacagaccgatatgttcgaatttcaggtgta

SEQ ID NO: 218374 - DNA, 5066 bp, Artificial Sequence
  Description of Artificial Sequence: Synthetic coding sequence
attcccgagggcctgtcggctgaacatacatccagtctcgtccccagtctgcacattacaactctgggtcaggagcaagcgatactttctggtgctgttcccgcatctcctagcactgggaccgcagattttcccagcatcctgacgttcctccagcccactgagaaccacgccagcccctctccagtccctgagatgcctacactccccgctgaggggtcagacggcagtcctcctgctacacgggacttactcctgtcatcaaaggtgccaaatctcctgtctacctcttggactttcccacggtggaaaaaggactctgtaaccgcaatcctgggcaagaatgaagaggcaaacgttaccatacccctgcaggcattccctcggaaagaggtcctgtcgcttcacacagtcaatggctttgtctcggatttctctaccgggtcggtgtcttctccaattattaccgcccctcgcaccaacccactcccgagcggacctcccctgccatctatcttaagtattcaggccacccagaccgtgttccctagcctaggttttagctcgactaagcctgaggcctatgccgcagcggtggatcactcaggcctgccggctagcgcctctaagcaggttcgggctagcccatcctccatggatgtgtacgactcactgaccataggagacatgaaaaagcctgccaccactgacgttttctggagcagcttaagcgctgagacaggatccctgtcaaccgagagtattatatcaggcctgcagcagcagactaattacgatctgaacggacacactatctctactacctcgtgggaaactcatctggcacctaccgcacctccaaatggactaacttcagctgccgacgccatcaagtcacaggacttcaaagacactgcaggccattcagtcactgccgagggcttttcaatccaggacctcgtcctgggtacctctatcgaacagcctgtacagcagtccgacatgaccatggtggggagccacattgacctttggccgaccagcaataataatcacagccgggatttccaaaccgcggaagtggcttattactcccctacgaccaggcactccgtatctcacccccagttgcagctgccgaaccaacccgctcatcccctgcttctcaccagccccggacctacctccactggctcacttcaggagatgttgtcagacgggacagacaccggatccgagatctcatctgatattaactccagtcctgaaaggaatgcttccaccccatttcaaaatatcctcggctatcacagtgccgctgagagttccatcagtaccagtgtgttcccacgcacctcatccagggtgctgagggcgagtcagcaccccaaaaaatggactgcagacaccgttagcagtaaagtgcagcccaccgctgctgctgctgttacactattcttgcgcaagagtagcccacctgctttgtctgccgctctggtcgctaaaggaacatcaagttctccgctcgcagttgcttcaggccctgccaaaagcagttccatgaccactctggcaaagaacgtcactaataaagcagcaagtggtcccaagaggaccccaggggctgtccatactgcctttccatttaccccaacatatatgtacgccaggaccggacacacaaccagtactcatactgctgccaggaagcacgggcactgcctctggcctgtagtctataacctcccccctcgaaagcctcaggccatgcacacaggactacccaatcctacaaacctggaaatgcctcgagcgtcaactcctcgcccactaactgtgactgctgcactgacctctattactgctagtgttaaagcaacacggctgcctccactcagggcagagaacacagacgccgttctgcctgccgctagcgccgctgtcgtaacaaccgggaaaatggctagcaatttggaatgccagatgagctccaagctccttgtcaagacagtccttttcctcacgcaacgcagagtgcagattagcgaaagcctaaaattttctattgcaaaaggcctgactcaggcgctgcggaaggcgtttcaccagaacgacgtgagtgcacacgtggatatcctggaatactctcataatgttacggtgggatactacgcaacgaagggtaagctggtctacctgccggcagtggttatagagatgctgggcgtgtacggcgtgagcaatgtaacggccgacctgaaacagcataccccacatctgcagagtgtggcggtcctggcttccccctggaatccccagcccgcagggtattttcaactcaaaactgtgctgcagtttgtttcacaggccgataacattcaatcgtgtaaatttgcccagacaatggagcagaggctgcagaaggccttccaagacgctgagcgaaaagtcttgaatacaaagtccaacctcaccattcagatcgtgtctaccagcaacgctagtcaggctgtaacactcgtgtacgtggtgggtaaccagagcacttttctgaacggaacagtcgcctcctcattgcttagccagctgagcgcagaactcgtaggattttaccttacttacccacccctgaccatagccgagcctctcgaatatcccaacctggatatctccgagacaactcgcgattactgggtgattacggtcctgcagggcgtcgataatagcttggtcgggctccataaccaatcattcgcaagagttatggaacagcgcctggctcagctcttcatgatgtctcaacagcagggtagaagatttaagcgggcaaccacgttgggttcatatacagtgcagatggttaaaatgcagcgcgtgcccggtcccaaggaccccgctgaactgacttattataccttgtacaacggcaaaccactcctgggaaccgccgctgctaagatcttgtcaacgatcgactcccagaggatggccctcaccctgcaccatgtggtattgctgcaggcagaccccgttgtaaagaaccctccaaacaatctttggattatagccgcagtcctggctcccattgcagtggtgactgtgattattattatcattacggctgtgttatgccggaaaaataagaacgacttcaaacctgatactatgataaacttgcctcagagagctaagcccgtgcagggctttgattacgccaaacagcatctgggccagcagggcgcagatgaggaggttatcccagtgactcaggaaactgtggttctgcctttgcccatacgcgacgcccctcaggaacgagatgtggcccaggatggatctacgatcaagaccgctaaaagtacagagactcggaagtcccgatcaccttccgagaatggctccgtaatttcaaatgaatccggcaagccttcctctggcaggcgctcccctcagaacgtcatggcccagcagaaagtcaccaaagaggaggctcggaagcgcaatgtacccgcatcggatgaggaggaaggagcagttctgttcgataactcgtcaaaggtagccgctgaacccttcgatactagctctggtagcgtacagctcatcgcgatcaaaccaaccgccctcccgatggtacctcccaccagtgatcgcagccaggaaagctccgccgtcctgaacggtgaggttaataaagctttgaaacaaaagtcagatatagaacattaccgcaataagcttcggcttaaagccaagaggaaaggatattacgatttcccagcggtcgagacaagcaagggattgactgagcggaaaaagatgtatgaaaaggcacctaaagaaatggagcatgttctggaccctgactcggaactgtgtgccccatttactgaaagcaaaaatcgccagcagatgaaaaactctgtataccgatctagacagagccttaacagcccgtctccgggagagaccgagatggacctgctcgtgactcgggaacgcccaagacggggtattcgcaacagtggctacgacaccgagcccgagattatcgaagaaacaaacattgacagagtgcccgagcccagaggttactcccgctccagacaggtcaaaggacacagtgaaacctcgaccctcagtagtcagccatccatcgacgaggtgcgccagcagatgcatatgctgctggaggaagcattttccctggcctctgctggccatgcgggacaaagtaggcatcaggaggcctatggatcggcacaacacctcccctatagtgaggtagtgacttctgccccaggcacaatgaccaggccgcgagcaggcgtgcaatgggtgcctacatataggcccgaaatgtatcaatactcactacctcggccagcatatcggttctcccaactccctgagatggtcatgggatccccacccccacctgttccccctcggacgggcccagtcgctgtggccagcttgcgacggagtactagcgatattggctccaaaactagaatggccgagtcgactggccctgaacctgcccaactgcatgattctgcatcgtttacacagatgagtcgcggacctgtgagtgtcactcagctggaccagtctgctctcaattattccgggaatacagtaccggcagtcttcgccatccccgcagccaacagacctggattcaccgggtactttattccaacgccacctagctcttatcggaaccaggcgtggatgtcatatgccggtgaaaacgagctgccttctcaatgggccgattcagtacctcttcccggatatatcgaggcatacccgaggtctcggtatccacagtcatctcctagcagattgccaagacagtacagtcagcccgctaatctgcacccatcgctcgaacaggcaccagccccttctacagccgctagccagcagtccctcgccgagaatgaccccagtgacgcgcctctaactaacatttccactgccgcattggtcaaagctattcgcgaggaagttgcgaagctcgctaaaaaacagacggatatgtttgaatttcaggtgta

SEQ ID NO: 218375 - DNA, 783 bp, Artificial Sequence
  Description of Artificial Sequence: Synthetic coding sequence
atgatggatccttgcagcgtcggcgtgcaattaaggacgactaacgaatgccataagacctactataccagacataccggttttaaaactcttcaggagctttcttctaatgatatgttgctccttcagctgcgtacaggcatgactctaagcggaaacaataccatctgctttcaccatgttaagatatacattgacagatttgaagacttacagaaatcatgttgtgatccattcaacatccataagaaactggccaagaagaacctccatgtgattgacctggacgatgccacatttctgtcggctaagtttggaaggcagctggttcccggttggaagctttgccccaagtgcactcaaattatcaacggaagtgtcgacgtcgatacagaggacagacagaagcgcaaaccagagtccgacggcaggactgccaaggcactgagatctctccagttcaccaatccaggcaggcagacggaattcgctccggaaacgggtaagcgggaaaagaggaggctaaccaagaacgcaaccgcagggagcgaccggcaggtgatccctgccaagagcaaggtgtatgattcacaagggctgcttatattttctggaatggatctctgcgactgtctggacgaggattgtcttggctgcttttacgcctgtccagcatgcgggtccaccaagtgcggggctgagtgccgctgtgatcgtaaatggctttacgaacagatagagattgagggcggagaaatcatccacaataagcacgcagggtag

SEQ ID NO: 218376 - DNA, 507 bp, Artificial Sequence
  Description of Artificial Sequence: Synthetic coding sequence
atgatggacccttgttctgtaggggtgcagttgcgaacaacgaatgaatgccataagacctactatacgcgacacacagggtttaagactttacaggaactgtcctctaacgatatgctgctcttacaattgcggaccgggatgaccctcagcggaaataacaccatctgcttccaccacgtgaagatatacattgaccggttcgaggatttgcagaaatcgtgttgcgacccctttaacattcataaaaagttagccaagaaaaacctacatgtgattgatttggacgatgctactttcctgtccgcaaaattcgggcgtcaattagtgccagggtggaagctctgccccaagtgtacccagattattaacggctctgtggatgtggacaccgaggacaggcagaagcggaaacccgaaagtgacggtcggaccgccaaagccctgcggtcactgcaattcaccaatcccggaaggcaaaccgagttcgccccagagacggggtag

SEQ ID NO: 218377 - DNA, 180 bp, Artificial Sequence
  Description of Artificial Sequence: Synthetic coding sequence
atgagacagcttaagggcaaaccaaagaaagaaacttccaaggataaaaaggaacgtaaacaggctatgcaggaggcacggcagcagatcacaactgtcgtgttgcccaccttagctgtagttgtgctgctgattgtcgttttcgtttacgtggctacgcgccctactataactgaatag

SEQ ID NO: 218378 - DNA, 180 bp, Artificial Sequence
  Description of Artificial Sequence: Synthetic coding sequence
atgagacagctgaagggaaagcctaaaaaagagacttccaaggacaagaaggaacggaaacaagcaatgcaggaagccagacagcagatcactaccgtcgtcctgcctactctggccgtggtggtgctgctgatcgtggtctttgtgtacgtcgccacgaggccgacaataaccgaatag

SEQ ID NO: 218379 - DNA, 144 bp, Artificial Sequence
  Description of Artificial Sequence: Synthetic coding sequence
atgaggcagctgaagggtaaacctaaaaaggagaccagcaaagacaagaaagaacgcaaacaggccatgcaggaagcccgtcagcagattaccactgttgtccttcctacactggctgtcgtcgtcctcctgatagtggtgtag

SEQ ID NO: 218380 - DNA, 180 bp, Artificial Sequence
  Description of Artificial Sequence: Synthetic coding sequence
atgaggcagcttaagggaaaacccaagaaagaaacttcgaaagacaaaaaggagagaaagcaggcaatgcaggaagctagacagcaaattaccaccgtcgtgctgcccacgttagccgtggtggtcctgctgatcgtggtcttcgtatacgtagctacgcggcctaccataacggaatag

SEQ ID NO: 218381 - DNA, 159 bp, Artificial Sequence
  Description of Artificial Sequence: Synthetic coding sequence
atgcgtcagctcaagggtaaacctaaaaaggaaacaagtaaggataagaaggaacgcaagcaagccatgcaggaggcccgtcaacagatcactacagtggtgcttccaactctggctgtggtagttctgctgatcgtagtctttgtctatgtagcctag

SEQ ID NO: 218382 - DNA, 3336 bp, Artificial Sequence
  Description of Artificial Sequence: Synthetic coding sequence
atgcactggctgcccgcaggccatgacattaatggagcgttggagccttcaaacattgacaccagcattctggaagagtacattagcaaagaagacgcctccgacttatgtttccccgacatcagtgccccagctagttcagcttcttactctcacggtcagccggcaatgcccggtagctccggggtgcaccacctgtccccccctggcggaggcccatctccagggcgacatgggcctctcccccctcctggatatggtaccccactgaattgtaataataacaacgggatgggggctgctcctaagcctttcccaggcggaaccggcccacccatcaaagctgaacctaaagcaccgtacgcaccgggaacactgcccgactctccccctgatagcggttctgaggcttacagtcctcaacaggtgaatgaacctcacttgttacgtaccatcactccagagaccctatgccatgtaggagtccccagtcgactcgagcaccctcctcctcctcctgctcatttgccaggccctcctccaccacctcccccacccccacattatccagtcctgcaacgggatctctacatgaaggcagaaccgcctattccccactacgctgcaatgggccagggccttgtccccaccgacctgcatcatacccagcaatcccaaatgctccaccagttgctgcagcagcacggcgctgagctgcctacgcaccctagcaagaaacgcaagcactctgaatccccaccatccacccttaacgcccagatgcttaacggtatgatcaagcaggagccaggcactgtcactgccctccccttgcaccccacaagagcgccttctccaccgtggccacctcagggtcctctctcacctggccctggtagcctgcctttgagcatcgccagggttcaaactccgccatggcatccccctggagccccaagccctggcctgctccaggattctgatagtctgagtgggtcatacctcgaccccaattatcaatccatcaaatggcagccacaccagcagaataaatgggccactctctatgacgctaactataaggagctgcctatgttgacctatagagtcgacgccgacaagggcttcaattttagcgtgggcgatgatgcctttgtgtgtcaaaagaagaaccattttcaggtcaccgtgtacattggtatgcttggggagccgaagtacgtgaaaactcctgaaggattgaaacctttagactgtttctatctcaaacttcatggtgttaagttggaggctttaaatcagagtatcaatattgagcaatcacaaagtgacagaagtaaacgacctttcaatccggtgactgtcaacctgcccccagaacaggtgaccaaggtgaccgtcggacggctccatttctccgagaccaccgctaataatatgcggaaaaaagggaagccaaaccctgatcagcggtacttcatgctggtggtggctctccaggcccatgcccagaaccagaattataccctggccgctcagataagtgagcgtatcatcgtgagggcttcaaatcccggacaattcgagtcagatagcgacgtgctctggcagcgggcacaagttcccgacaccgtcttccaccatggtagagtgggtattaacactgatcgcccagacgaggctctggtcgtccacggtaatgtgaaagttatggggagtctgatgcatccaagcgatcttagagccaaggagcatgtccaggaggtcgatactaccgagcaactgaagcggatcagcagaatgaggttggtgcattatcgctataagcccgagttcgctgcctctgccggaatagaagccaccgctcccgagacaggggtgattgctcaggaggttaaagagatattgccagaagccgtcaaggacaccggagacatggtgtttgcaaacgggaagactatcgagaacttcttggtggtgaataaggaacgcatttttatggaaaatgtgggtgcagtgaaggagctgtgtaaactcactgacaaccttgaaacccgaatcgatgagctggagaggtggagccacaagttggctaaactgcggagactagatagtcttaaatctacagggagcagcggcgcattcagccatgccggatcccagttctctagggccggttcagtgccccataagaagcggccacccaaagtggctagcaagtcttcttccgtggtgccagatcaggcgtgcatttcgcagcggttcctgcaaggaactattattgcccttgtggttgtcatggccttcagtgtggtatctatgagtacactttatgttctttccctccggacggaagaggatttagtggataccgacggaagatcaagccagagctttggcactactcaattaaggcagagtcccctaaccaccggactgccaggaatccagccctcactattactcgtaactacatccttgactagctcagcccctggttcggccgttcggaccctggatatgtgctcatcacatccctgcccggtcatttgctgctcctctcctactacaaacccaacgaccgggccaagtctgggaccttcgttcaacccgggtcacgtactctcgccaagcccatccccgagcactaaccgttcgggaccctcgcagatggccttgctgcccgtgactaatataagagctaagtcatggggcctgtctgttaatggcattggacatagcaagcaccacaagtccctggagccactggcttcccccgcagtgcccttccccggaggacaaggcaaggccaaaaatagcccgtctttgggattccacggacgcgctaggaggggtgctctgcagagctctgtgggacctgctgaacctacctgggcacagggacagtccgagccggtacccagtctgacatccatccaggtgctggaaaattcaatgtctattaccagccagtattgcgcgccaggcgatgcctgtcgccctggaaacttcacttaccacattcccgtgagctcaggaacaccgctccatctttcgctcactctgcagatgaacagtagttctccagtgtccgttgtgctgtgtagcctaaggagcaaagaagaaccgtgcgaggaggggtccctgccacaaagtctacatacccaccaggatacccagggcactagccaccgatggccaattaccatacttagctttagggaattcacataccacttccgagtggcgctgctgggccaagcgaattgcagctcagaagcgcttgcccaaccagccacagactaccacttccacttttaccgtctctgtgattag

SEQ ID NO: 218383 - DNA, 3456 bp, Artificial Sequence
  Description of Artificial Sequence: Synthetic coding sequence
atggaggtggttgatgagacagaagcattgcagagatttttcgaaggccacgatatcaatggagccctggagccttcaaacatcgacacaagcattttagaggaatacatcagtaaagaggatgcctcagacctctgttttcccgatatatctgccccagcctcatcagctagttactctcatgggcaaccagctatgccagggtccagcggagttcaccacctgtcccctcctggaggcggtccaagtccgggaagacacggacccctgcctccccctggttatggcacccctcttaattgtaataataacaatggaatgggggctgcccctaaacctttcccagggggaaccggacccccaatcaaagccgagcccaaggccccatatgctcctggcaccctccctgacagccccccagatagcggaagcgaggcgtatagtccccagcaggtgaacgagccacatctgctgcgcaccatcacacctgagactctatgccatgtgggagtgcccagtagactggaacaccccccacctccacctgcccacctccccggacctccgccacctcctcctccaccccctcattatcctgtactgcaacgagatctgtacatgaaagccgagcccccaattccacactatgccgctatgggacaaggcttggtgcccaccgaccttcaccatacccagcagagccagatgctccatcaactgctgcagcagcatggcgcagagttacccactcatccatcaaaaaaaaggaaacatagcgaaagcccaccatcaaccttgaatgcccagatgttgaatggcatgataaaacaggaacccggtacagttaccgctcttccccttcacccaacccgggctccgagcccaccctggccaccccagggtcctcttagcccaggaccagggagcctgccactctccatcgcccgtgtgcaaacccctccttggcaccccccaggagccccatcccctggcctgcttcaggacagtgacagcttatccgggtcatacctcgaccccaactaccagtctatcaaatggcaaccacaccagcagaacaagtgggctaccctgtacgatgccaattataaggagctgccaatgctgacgtatagagtggatgcagacaaaggatttaattttagcgtgggcgacgacgcctttgtgtgtcagaaaaaaaatcatttccaggtgaccgtctacatcggaatgctgggcgaacccaaatacgtcaagacaccagaggggctgaagcccctggattgcttttacctcaagcttcacggggtaaagttggaagcactgaaccagtcaataaacattgagcaatcacagagtgacaggtcaaaacgaccttttaacccagtgaccgtgaaccttccgcctgagcaagtgactaaagtaacagtagggaggcttcattttagtgagacaaccgccaataatatgaggaagaaaggcaagcctaaccccgaccagagatacttcatgttggtagttgcgctccaggctcacgcccagaaccagaattacacactggcagcccagatttccgaacgaatcatcgtgagagccagcaacccaggtcaattcgagtccgattccgatgttctatggcagcgagctcaggtgccggatactgtctttcaccacggacgtgtcggaatcaacaccgatcgacctgacgaggccctcgtggtccacgggaatgttaaggtgatgggaagccttatgcacccatctgacctgcgggcaaaggagcacgtgcaagaggtggacacgacagagcagcttaaaagaatttctcgtatgaggctggtacattataggtacaaacctgagtttgccgcatccgcaggtattgaagccaccgctccagagactggagtgatcgcacaagaagtcaaagagattctgccggaggccgtgaaggatacgggcgacatggtctttgccaatggcaagaccatagaaaacttcctggtcgtgaataaagaacgaatatttatggagaacgtcggtgccgtgaaagaactatgcaagctgaccgacaatctagagactcgcattgacgagttagagcggtggagccacaagctggccaagttgcgaaggctggactccctaaagtctactggctcatcgggcgctttctcccatgctggcagtcagtttagccgcgctgggtctgtaccccataaaaaacgccctccaaaggtggcttccaaatcatctagtgtggtgcccgaccaggcttgcatctctcaaagattccttcagggtactatcatagcactcgtggtggtcatggccttttccgtagtgagcatgtctactctatatgttctcagccttcgtactgaggaagacctcgtagatacagacgggagtttcgctgtgagcactagctgcctgctggccctcctgcggcctcagcccccaggaggatccgaggcgctctgcccatggtcttcacaatcatttgggactacacagctccgtcagtcccccctgacaaccggcctccctgggatccaaccaagtcttttactggtgacaacatccctaacctcatctgcccctggttcagcggtgcgcacccttgacatgtgttcctcccatccttgtccagttatatgctgctctagtcctacaacaaaccccacaactggaccaagtctcggcccttcgttcaacccagggcacgttctcagccctagtccatccccaagcacgaaccgctcaggacctagtcaaatggcactgttacccgtcactaacataagagcgaaatcgtggggcctaagcgttaatggcataggtcattcaaaacatcacaagtctttggagcccctcgccagtccagctgtgccttttcccggtggacagggcaaagccaagaacagcccctcactgggcttccatggaagagcaaggagaggggctctgcagagcagcgtcggccctgcggaacccacgtgggctcagggccaaagcgcctccctactggccgagccagtacctagtctgactagcattcaagtgttagagaattccatgtctatcacgtctcaatattgtgcccctggcgatgcatgtaggcccggtaacttcacatatcacattcctgtgtccagcggcacccccctccatctttcacttaccttgcaaatgaactcatcatcccctgtgagcgtggtgctttgctctctgcggagcaaggaagagccatgtgaggaaggctccctccctcaaagtctccacacccaccaggacactcaggggacaagccatcgctggcctattacgattctcagtttcagggaatttacctatcatttccgggtcgcgcttctgggacaggcaaattgcagcagcgaagctctcgctcagccagcaactgactaccactttcatttctacaggttgtgtgattag

SEQ ID NO: 218384 - DNA, 1449 bp, Artificial Sequence
  Description of Artificial Sequence: Synthetic coding sequence
atgcttacctaccgcgtcgacgccgataaaggatttaacttttccgttggcgacgatgcctttgtgtgtcaaaagaagaaccattttcaggtcactgtgtacataggtatgttgggcgagcccaagtatgttaaaaccccagaggggctgaaacctctcgactgtttctacctcaaactgcatggcctcgaagctctcaaccaatcaatcaatattgagcagtctcagagcgatcggtccaagaggccttttaaccctgtgactgtgaacttgccacccgaacaagttacaaaagtgaccgtcgggaggctacacttttccgaaacaacagcgaataatatgcgcaaaaaggggaagcccaacccagaccagcgatatttcatgttggttgtggcactgcaagctcatgcacagaaccagaactataccctcgcagcccagatatccgagcgcatcattgtcagagcttcaaatccagggcaattcgagtccgattccgatgtgttgtggcagcgtgcgcaagttcctgataccgtattccaccacggtcgggtggggatcaatacggatcggccagacgaagccctggtggtgcacggaaacgtgaaggtgatggggtccttgatgcatcccagtgatctccgggctaaggagcatgttcaagaggtggataccacagaacaacttaagaggattagtcggatgagacttgttcactaccgttacaagcccgagtttgccgcttcagctggaatcgaggccactgcccctgaaactggggttatcgcccaagaagtaaaggaaatcctgccagaggcggttaaggacacaggggatatggtcttcgccaacggcaagactatcgagaactttctggtcgtaaacaaagtttgcgggctgaagtatgtggtatactgtgaagacgatgtctgtcatctgccagtcctctctctgggcgctaaggaggcttgggctgtgaaagaactttgcaaactcactgacaacttggagacgaggatcgacgagctcgagaggtggtctcacaagctcgcaaaactgagaaggctcgactccctcaaaagcaccggcagcagcggcgcattctcccacgcaggctcccagttctctcgtgccggatcagtgcctcataaaaagcgacccccaaaggtagcctcaaaggtgggctcttcctccgtagtcccagatcaagcctgtatctcccagcgctttctccagggaactatcattgcattagtggtggtgatggcatttcggcaccacttaggtgcccaaccacaggagcagggtccccagccgtgccccagagaaagagctcttgacggaggaagttccagtaatggacaccctttcctgtggctacaacgcggagtgcatgtacataccgtgagggcggagcccgcacaccgagggggtccagggcgacactag

SEQ ID NO: 218385 - DNA, 789 bp, Artificial Sequence
  Description of Artificial Sequence: Synthetic coding sequence
atggccgcaccatcagggacagttagcgacagcgagtctagcaactcaagcagtgatgctgaagagctggagcgctgtcgcgaggcagccatgcccgcatgggggctcgagcagaggcctcacgttgccggtaagcccagggccggagccgctaatagtcagctcagtactagtcagccatctcttcggcacaaggtgaacgagcacgagcaagatggaaacgaactacaaacaacccctgaatttcgggctcacgtcgccaagaaattaggtgcactcctggattcgtttataacgattagcgaagcggcaaaagagcccgcaaaagcaaaggtgcagaaggtagccctggaagatgatggatttcggctcttttttacctcagtgcccggaggccgagagaaggaagaatccccacaaccgcgacgcaaaagacagccgtcgtcctccagcgaggatagcgacgaggaatggcggcgatgtcgggaggcggcagtcagcgcctcagatattctgcaggaatcagccatacactctccaggcaccgtggagaaagaggccaagaaaaaacgtaaacttaagaaaaaggccaagaaggtggcctctgttgattccgctgtggccgcaactacaccaacttcaatggctaccgtccagaaacaaaagtccggcgaattgaacggtgaccaggtgagtctgggtacaaaaaaaaagaagaaggccaaaaaggcttccgaaacctccccctttccccctgcaaagagtgctaccgcaattcctgcaaattag

SEQ ID NO: 218386 - DNA, 666 bp, Artificial Sequence
  Description of Artificial Sequence: Synthetic coding sequence
atgttctgtcaaaaccctggcgcagccaacagccagctcagcacttcgcaaccctcgctgcgacataaggtaaacgaacatgaacaagacggaaacgagctgcaaacaaccccagagtttcgcgcacatgtcgcaaagaaactgggagccctgttggattcttttatcaccatcagcgaagccgctaaggagccagctaaagccaaagtgcagaaagtggccctggaggatgacggcttcaggttattttttacgagcgtgccagggggtcgggagaaagaggagtcgccacagccgcgaagaaagagacagccttctagctcttcctccgaagactctgatgaggaatggcgacggtgtagggaagctgctgtgagcgctagtgatatcttgcaggaaagtgccatccattcccctggaaccgtggaaaaggaggccaagaagaagcgaaaactcaagaaaaaggcaaaaaaagttgcttcagtggacagtgctgtggcagccacaaccccgacctccatggctacagtgcagaaacagaaatccggtgagctcaacggcgaccaggtgtctcttgggactaaaaagaagaaaaaggcaaagaaagcatcggagacaagccccttccctcctgccaaatcagcaactgctattccagccaactag

SEQ ID NO: 218387 - DNA, 699 bp, Artificial Sequence
  Description of Artificial Sequence: Synthetic coding sequence
atgccagcgtggggtttggaacagaggccacacgtggctggaaaacctcgagctggcgcagcaaactcccagttaagtacaagccaaccatcgctcaggcataaagtgaacgagcacgaacaggacggcaatgaacttcaaaccactcctgaattccgcgctcatgtggctaaaaagctgggcgctttattggacagctttattaccattagcgaggcagccaaggagccggcaaaagccaaagtccagaaagtcgccttagaagatgatggcttcaggttgttcttcacctcagttcccggaggcagagagaaagaagagtctccgcagcctcgccgaaagaggcagccgtctagcagctcagaagactctgatgaggagtggaggcgctgtcgggaggctgcagtgtcagcaagcgacattctccaggagagcgccatccacagccccggaacggttgaaaaggaagcgaaaaagaagagaaaactcaagaaaaaagcgaaaaaggtcgcatctgtggatagcgccgtagctgcaaccaccccaacatcgatggccacagttcagaaacaaaaaagcggtgagcttaatggggaccaggtcagcttggggactaaaaagaaaaaaaaggccaaaaaggcctccgagacctccccatttcctcccgctaagtccgccacagccattccagccaactag

SEQ ID NO: 218388 - DNA, 1497 bp, Artificial Sequence
  Description of Artificial Sequence: Synthetic coding sequence
atggacgttacggatcactacgaggacgtccggaagatctacgatgactttctaaaaaatagcaatatgctcgacttaatagacgtttatcagaagtgccgggcactgactagcaactgtgagaactacaataccgtgtcccccagtcaactgctggacttcctttccggcaagcaatatgctgtcggagatgagacggacctgtctatccctaccagcccaaccagtaagtataacagggacaatgaaaaggttcagcttctcgcgcgtaagatcatctttagctacttgaacctgctggtgaactcaaagaatgacttggccgtcgcatacattctcaacatcccagatcgcggtctcggacgagaagccttcactgacctgaagcacgccgctcgagagaagcagatgtcaatcttcctggtggccaccagttttatccggaccatcgagctggggggaaaaggttacgccccacccccaagtgacccactcaggacacatgtcaaaggcttaagcaatttcatcaatttcattgacaagcttgacgagatcctcggagaaattcccaatccctctatagcagggggtcagattctcagtgtgattaagatgcagcttatcaagggacagaactcgcgagaccctttttgtaaagctatcgaggaggtggcacaggatctggaccttcgcattaaaaacataattaactcccaagaaggggtggttgcactgtctacaactgacatttcacccgcacggccaaaatcccatgccatcaaccacggcaccgcttactgcggcagagatacagtgaaggctcttctggttctcctggatgaagaagcagccaacgcacctaccaaaaacaaggccgagttactttatgatgaggagaatactatccatcatcacggaacttctattctgaccctgttccgttcccccacccaggtgaataattcaattaaaccactccgggaacgaatttgcgtgagcatgcaagaaaaaaagattaagatgaaacagacactcattcgcagccaattcgcatgtacgtataaagacgactatatgatttctaaggataattggaataatgtgaacttggcctccaaacccctgtgcgtgctgtacatggagaatgacctgagtgagggagttaaccctagcgtgggaaggagtactattgggacttctttcggaaacgtccatctggatagaagtaagaacgagaaagtgagtaggaagagtactagccaaaccggcaataaatcctctaaacggaagcaggtagacctggatggggaaaatatcctttgcgataataggaacgaaccgcctcaacacaaaaacgctaagatccccaaaaagtccaatgattcccaaaaccggttgtatggcaaactggctaaggtggctaagtccaataagtgcacagcaaaggacaagcttataagcgggcaagctaaactgacccagttctttagactctag

SEQ ID NO: 218389 - DNA, 1740 bp, Artificial Sequence
  Description of Artificial Sequence: Synthetic coding sequence
atggccgtcttcaaccaaaagtctgtatctgacatgattaaagaattccgcaagaattggagggccctctgcaactccgaacggactacactctgcggggcagactcaatgcttttggccctccagctttccatggctgagaacaataagcagcacagtggggaattcactgtctctctgtccgatgtcctactgacatggaaatatctacttcatgagaaactaaatttgcctgttgagaatatggacgtgacagatcattatgaggatgttaggaaaatttatgacgacttcttgaagaacagcaacatgctggatctgatagacgtgtaccagaaatgccgcgctttaacgagcaactgcgagaactataacaccgtctccccctctcagctgctggacttcctgagcgggaagcagtacgcggtgggggacgaaacagatcttagcatccccacatcgccgacatcgaaatataacagggacaacgaaaaagtgcagctgctcgcgaggaaaattatattcagttacctgaacctgctcgtcaatagtaagaacgatttagccgtggcctatatccttaatataccagaccggggtctgggtcgtgaagctttcacggatcttaagcacgcggctcgggagaagcagatgtccatttttttggtggcaacttcctttatccgcactattgaactgggcggaaagggctacgcacctccccctagcgaccctcttagaacccacgtgaaaggactttcaaacttcatcaatttcatcgataaactggatgagatcctgggcgaaatccccaacccgagcatcgctggtgggcagatcttgtctgtaatcaaaatgcagctcatcaaaggccagaatagccgggaccccttttgcaaggcaatagaggaggtggctcaggacctggatctgagaattaagaacattatcaatagccaggagggcgtggtggcccttagcacaaccgacataagccctgcgagaccaaagtcccacgccattaatcacggtaccgcgtactgtggaagagacacagtcaaggccttactggtcttactggacgaggaagccgctaacgcacctaccaagaataaggctgaattgctgtacgatgaggagaacaccatccatcaccatggcacctctattctgacactcttcagatcaccaacccaggtaaataattctatcaagcctttgagggagcgcatatgcgtctcaatgcaggagaaaaagatcaaaatgaagcagacgttaattagatcacagttcgcttgtacgtataaggatgactacatgatatccaaggacaattggaataacgtgaacctggcctcaaaaccactttgcgttttgtacatggagaacgacctgtcggagggtgtcaatccgtcagtgggtagaagcacaatcggtacaagctttggcaatgtgcacctggacagaagtaagaacgagaaagtcagtcggaagagcacgagccagacgggcaacaaatcaagcaaacgtaagcaggtcgatctggatggcgaaaacattttgtgtgacaaccgcaacgagccaccccagcacaaaaacgccaaaatacccaagaagtctaacgattctcaaaatcgtctgtacgggaagctggctaaggttgctaaatcaaacaagtgtactgcaaaggacaagctgattagtggacaggccaaactgacccagttttttcgactgtag

SEQ ID NO: 218390 - DNA, 894 bp, Artificial Sequence
  Description of Artificial Sequence: Synthetic coding sequence
atggccgtgttcaatcagaagtctgtgagcgacatgatcaaggagttcagaaaaaactggcgagctttgtgcaatagcgagcgaaccacactgtgcggtgccgacagtatgctgctagctttgcagctctcgatggcagagaacaataagcagcattccggagaatttacagtctctttgagcgatgtacttctgacctggaagtatttattacatgagaagttgaacctcccagtggaaaacatggacgtgacagatcattacgaggatgtgcggaaaatttatgatgattttctgaagaactcaaacatgctcgatctgatcgacgtttatcaaaagtgccgggctcttacttctaactgcgagaactataatacagtcagcccaagtcaactcctggattttctgagcgggaaacagtacgccgtgggcgacgaaacggatctgtctattccaactagtccaacctccaagtataatcgagacaacgaaaaggtgcagttgctagctagaaagattatcttctcgtaccttaacctgctggtgaattcgaaaaatgatctggccgtggcctacatcttgaacatccctgatagaggcctcggaagggaggcgttcaccgatttgaagcacgctgcacgggaaaagcagatgagcatcttcctcgtggcaactagttttatacgtaccatcgaactaggtggaaagggctacgccccacctccaagtgatccattgcgtacccacgtcaagggactgtccaatttcattaatttcatcgataagctggatgaaattctgggagagatcccaaacccccgtggttgtaagagtatctgttggaaaataaacaattggaatgagttctggaagtgctcatccggccagaagtag

SEQ ID NO: 218391 - DNA, 1497 bp, Artificial Sequence
  Description of Artificial Sequence: Synthetic coding sequence
atggacgttacggaccactatgaggacgtgcgaaagatatatgatgatttcctcaaaaattccaacatgctggacttgattgacgtctaccaaaagtgccgtgctctgaccagcaattgcgaaaactataacacagtcagcccgtcacagctacttgattttctgagcggcaagcaatacgctgtcggagatgaaactgacctgagcattccgaccagtccaacttctaagtataaccgagataacgaaaaggtccagctccttgcaagaaagatcatttttagctatcttaatctactcgtaaattccaaaaatgacctcgccgtggcttatatcctaaacattcccgatcggggactgggccgagaagcatttacagaccttaagcacgccgcacgggaaaaacaaatgagtatttttctggtcgcgaccagcttcatcagaacaatagaactgggtggcaagggatacgcccctccgccaagtgatcctctgaggacccacgtgaagggcctatcgaatttcatcaatttcatagataagctggacgagatcctgggagagatccccaatccatctattgctggcggacaaattctgagcgtcatcaagatgcagttgatcaaaggacaaaactcgcgggatccattctgcaaggccatcgaggaagtggcccaggacctagacctccggataaaaaacataataaactctcaggagggtgtcgtcgccctgtctaccactgacattagcccggctaggccaaagtcacatgccattaatcatgggacagcatactgtggccgagatactgttaaggcactgctcgtgctcttagatgaagaagctgctaacgcgcctactaagaacaaggctgaactcctttacgacgaggaaaatacaatacatcatcacggtaccagcattttaactttattccgcagtcccacgcaggtcaacaactcaattaagccattgagagaaaggatttgcgttagcatgcaggagaaaaagatcaaaatgaagcagaccttgatcagaagtcagtttgcatgcacctacaaagacgactacatgatttcgaaagacaattggaataacgtaaatctggcttcaaagcctctgtgtgtgctgtacatggagaacgacttgagcgagggcgtgaacccatcagtgggtcgatcaacaattggaaccagcttcgggaatgtgcacctggaccggagtaagaatgaaaaagtatcacgtaagtccacaagtcagaccggcaacaagtcgtcaaaacggaagcaagttgacctggacggagaaaacatcttgtgcgacaatcgtaacgagccaccacagcacaaaaacgccaaaattcctaagaagtccaatgactcccagaataggctctacggaaaactggctaaagtggccaaatccaataaatgcaccgcgaaagataagctcatttcaggtcaagccaaactgacacaattcttccgactctag

SEQ ID NO: 218392 - DNA, 813 bp, Artificial Sequence
  Description of Artificial Sequence: Synthetic coding sequence
atggcccgtttcgcgctgacagttgtgagacatggagagacccgatttaacaaagagaaaataattcaaggacagggagtggacgagccgttgagtgagactggattcaaacaggctgccgctgccggaatatttctgaataatgtgaaattcactcatgccttcagctcagacctgatgaggacgaagcagaccatgcatggcatccttgagcgatcgaaattttgcaaagatatgaccgtcaagtatgattctcgactgagggagcggaaatacggagtcgttgaaggcaaagctctgagtgagttgcgagcaatggccaaggccgcacgcgaagaatgtcctgtgttcactccccctggtggtgaaacactcgaccaggtgaaaatgagaggcatcgactttttcgaattcctgtgtcagttgatcctgaaggaagctgatcagaaggaacagttttcccaggggtcaccatcaaactgccttgagacctcgctggctgaaatcttccccttagggaagaaccactcctcaaaggtcaatagcgacagcggcattccaggcctggctgcctcggtgctcgtggtgtctcatggcgcttatatgcgcagcctcttcgactatttcctgaccgacctgaagtgttcattgcccgctactctgtcccggtctgaacttatgagtgtaacacccaacacaggcatgtccttgttcattattaatttcgaagaaggacgggaagtgaaaccaaccgttcaatgtatttgcatgaacctgcaagaccacttaaacgggttaacggaaacgaggtag

SEQ ID NO: 218393 - DNA, 501 bp, Artificial Sequence
  Description of Artificial Sequence: Synthetic coding sequence
atgtcaacagttgggctattccacttccccacacccctcactcgaatctgcccagcaccatgggggctgagactttgggaaaagttaactttgctcagcccagggatagcagttacacccgtacagatggccggtaagaaggactaccctgccctgctgtccctggatgagaatgaattggaggagcagtttgtcaaaggtcacggaccgggtgggcaggcaactaataagacgagcaattgcgttgtgctaaaacatatccctagcgggatcgttgtcaaatgtcatcagaccaggagtgttgatcagaatcggaagttggccaggaagattcttcaggagaaggtggacgtcttttacaatggagagaatagccccgtgcacaaagagaaacgcgaagccgctaaaaagaaacaggagcgaaaaaagagagcaaaggaaacactggaaaaaaaaaagctgctgaaggagttatgggaaagcagcaagaaggtccattag

SEQ ID NO: 218394 - DNA, 501 bp, Artificial Sequence
  Description of Artificial Sequence: Synthetic coding sequence
atgtctaccgttggcctctttcacttccctactcccctgaccaggatttgtcctgcaccctgggggctgagactgtgggaaaagctcacccttctcagcccaggtattgctgtgactccagtgcaaatggccggtaagaaggactatcctgcgctgttgtctctggacgaaaacgagcttgaagaacagttcgtcaaaggccatggcccaggcggacaggcaacgaacaagactagcaactgcgtcgtcctgaagcatattccgtccggcatcgtcgtgaagtgtcaccagacgcgtagcgtggatcagaaccggaaactcgccaggaagattctgcaggaaaaggtcgatgtgttctacaatggggagaacagccctgtgcacaaggaaaagcgggaggcagccaagaagaaacaggagcgtaaaaagcgtgcgaaggagacgctggagaaaaaaaagcttctgaaggaattgtgggagtcctctaaaaaagtacactag

SEQ ID NO: 218395 - DNA, 501 bp, Artificial Sequence
  Description of Artificial Sequence: Synthetic coding sequence
atgtccactgtaggcctcttccattttcccacaccattaactagaatttgcccagcaccctgggggcttcggctgtgggaaaagcttaccctacttagtcccggaatcgcggtcacacccgtacagatggcaggaaaaaaggattaccccgcattgctttccctggatgagaatgagctggaggaacagttcgtcaagggccatggtcccggtggccaggcgactaataaaaccagcaattgcgttgttctcaagcatattcctagtgggatagtggtgaaatgtcaccagacaagatctgttgatcagaatagaaagttggcccgtaaaatcttacaggaaaaggtggatgtgttctataatggggagaacagcccggtacataaagagaagagagaggccgcaaaaaagaagcaagagcggaaaaagcgggctaaggagactttggagaagaagaaactactcaaagagctctgggagtcttccaagaaagtgcattag

SEQ ID NO: 218396 - DNA, 111 bp, Artificial Sequence
  Description of Artificial Sequence: Synthetic coding sequence
atgtcaaccgtgggactgttccatttccccactccgttaacgaggatctgccctgctccttggggactacgcctgtgggaaaaattaacactgctgtcaccaggaatctag

SEQ ID NO: 218397 - DNA, 417 bp, Artificial Sequence
  Description of Artificial Sequence: Synthetic coding sequence
atgagcaccgtcggtctgtttcactttcccacacctctcaccagaatctgtcccgctccgtggggcctgaggctgtgggaaaaactgactctcttatctccaggaatagccgtgacaccagtgcagatggctggaaagaaggactatcccgctctgctgagcttggacgagaatgagcttgaagaacagttcgtcaagggacatggtcctggagggcaggccacaaacaagacgtctaattgtgttgtgctcaaacatattccaagtggcatcgtggtgaaatgtcaccagacacgcagcgtcgatcaaaacagaaagcttgcccgaaagatactgcaggaaaaagtggatgttttctacaacggcgaaaatagtcctgtgcataaggagaaaagggaagctgccaagaaaaaatag

SEQ ID NO: 218398 - DNA, 291 bp, Artificial Sequence
  Description of Artificial Sequence: Synthetic coding sequence
atgtctaccgtgggactgtttcacttccctactcctctgaccaggatttgcccagctccatggggactgagactgtgggaaaagctgaccctactttcacctggcattgctgtgactcctgttcagatggccggaaagaaggactaccccgcacttctgtcactggacgaaaatgaactggaggaacagtttgtgaaaggacacggccctggtgggcaggcaactaataaaacaagtaattgtgtagtgctcaagcatattccaagcggcatcgtggtcaaagtggactag

SEQ ID NO: 218399 - DNA, 423 bp, Artificial Sequence
  Description of Artificial Sequence: Synthetic coding sequence
atgagcagatttctcaacgttttgaggtcgtggttggttatggtgtctattatcgctatgggaaatactctgcagtccttccgcgaccacacctttctatacgagaaactctataccgggaaaccaaatcttgtgaacggcttacaagcccgtacatttggcatttggactctcctcagtagcgtgattcgatgcctttgtgcaatcgacatccacaataaaacactgtatcacatcacgctatggaccttccttcttgccctgggccacttcctttctgaactctttgtgtatggcaccgctgcgccaacaataggagtattagccccattaatggtggcttcatttagcatcctcggcatgcttgttggcctgcgctacttggaggttgaaccagttagtcggcagaagaagcggaactag

SEQ ID NO: 218400 - DNA, 1443 bp, Artificial Sequence
  Description of Artificial Sequence: Synthetic coding sequence
atgaaccggaccaagggagatgaagaagaatactggaactcatccaagtttaaggccttcacctttgacgatgaggacgacgagctgtcacagttaaaagagtccaagcgggctgttaattcactcagagactttgtggatgacgatgacgacgacgacttggaaagggtgagttggagcggggagccagtgggtagcatctcctggtccatacgggagacggcaggaaacagcggtagcactcatgaggggagggagcagctgaagtctagaaactctttttcatcctatgcccagttgccaaagcctacgtcaacctattccctgtcttcctttttccgggcactatccgatacccctgctaaaagttacgctccagaactcgggagacctaaaggcgagtatcgagattactcaaacgactggagtccaagcgacactgttcgcaggctacgcaagggaaaggtgtgctccctggaaagatttagaagcctgcaggacaaactgcagctcctggaggaggcggttagtatgcacgacgggaatgtgattaccgccgtgttaatattcctaaaaaggacactttctaaggaaatcttgttccgtgaactggaagtgaggcaagtggccctcaggcacctgatccatttccttaaagaaatcggggaccagaagcttctgctggacctattccgatttctggatcggacagaagagctagccctctctcattatcgggagcacctgaacatccaggatcccgacaagcgcaaagagtttctcaagacctgcgtaggtctaccgttctccgcagaagatagcgcccacatccaggaccattatactctgttggaacgccagataatcatagaggctaatgatcggcatctggaatccgcaggtcagaccgaaatcttccggaagcaccccaggaaggccagcatcttgaacatgccgctggtgactaccctgttttacagctgtttttaccattatactgaggctgaggggacattctctagtccggttaacctcaagaaaaccttcaagattccagataagcaatatgtactcaccgctctagcagccagggcaaagctgcgggcatggaacgacgtggatgccctgttcacaacgaaaaattggttgggctatacaaagaagcgggctccgatcggttttcaccgcgtagtcgagatcctgcacaagaacaacgctcccgtccagattctgcaggaatacgtgaaccttgttgaagacgtggataccaagctcaatcttgctacgaagttcaaatgccatgatgtcgtgatcgatacctaccgggacttaaaggatcgtcagcagctgctggcttaccggtcaaaagttgataagggcagtgcggaagaggagaaaatcgacgcgcttctaagctcttcccagatccgctggaagaactag

SEQ ID NO: 218401 - DNA, 1482 bp, Artificial Sequence
  Description of Artificial Sequence: Synthetic coding sequence
atgaataggaccaagggagacgaggaggagtactggaactcaagcaagtttaaggcattcacttttgacgacgaagacgatgagctgagccagttaaaagagtcaaaaagggcagtgaacagcctgcgggactttgtggatgatgacgacgacgacgacctggagagagtatcttggtctggtgagcctgtcggctctatatcttggtctattcgagaaacggcaggaaacagcggatccacacatgagggacgcgaacagctcaaatcccgtaattccttcagcagctatgcccagcttccgaagcccactagcacctattccctgagttcattctttcgcggacgaacacgtcctggttccttccagagcctgtccgatgccttgagtgatactcctgcaaagtcctacgctccggaactaggaaggccgaagggagaataccgcgattactcaaatgactggagcccgtctgataccgtcagaagactgagaaagggcaaagtatgttctctggagagatttcggtctctccaggacaaactgcagctgcttgaggaggccgtgtccatgcatgacgggaacgttattaccgcggtcttaatcttccttaagcgaactctcagtaaagagatcctgtttcgtgagcttgaggttcggcaggtggctttgagacacttgatccactttcttaaggagattggcgaccagaaattgttgctggacttatttaggttcctggaccggacggaggagcttgccctgagccactatcgcgagcatctgaatattcaggatcccgacaaacgcaaagagttcctgaaaacttgcgttgggcttcccttcagcgctgaagattctgcacacatccaggaccattacacattgctcgaaaggcaaatcattattgaggctaatgacaggcatctcgagagcgccggtcagactgagatttttagaaagcacccaagaaaggccagcattttgaacatgcctttggtgaccacgctcttttatagctgcttttaccactatactgaggcagagggcaccttcagttcacctgtgaaccttaagaaaaccttcaagatccctgacaagcagtatgtactgaccgcgctggccgcacgcgctaaactgcgggcttggaatgacgtggatgctctattcacgaccaagaattggctgggttacacaaagaaacgcgcaccaatcgggtttcatcgggttgtcgagatcttgcacaagaacaatgcccctgtgcagatcttgcaggagtacgttaatctcgtggaggacgtagacactaaacttaacttggcaaccaagttcaaatgtcacgatgtggttatcgatacttacagagaccttaaggatagacagcagttactcgcttaccgctcaaaggttgacaaaggctctgccgaggaagaaaagattgatgcacttctttcttctagtcagatcaggtggaagaactag

SEQ ID NO: 218402 - DNA, 1335 bp, Artificial Sequence
  Description of Artificial Sequence: Synthetic coding sequence
atgaacaggaccaagggggatgaagaggagtactggaacagcagcaagtttaaagcgttcacgtttgacgatgaagatgatgaattatcccagctcaaggagtcgaagagggctgtgaactccctccgcgatttcgtggatgacgacgatgacgatgatcttgaacgcgtgtcttggagtggagaacccgttggctccaggactcgcccaggcagctttcaatcactgagtgacgccctgtccgatacgcctgcaaaaagctatgccccagaactgggacgtccgaaaggcgaatacagagattactcgaatgactggtcgccttctgatactgtgcggaggttacgaaagggaaaagtctgtagcctagagcgatttagatctcttcaggacaaattgcagttgctggaggaagctgtgagtatgcatgacggcaacgtgataaccgctgtcctcattttcctcaagaggaccttgagtaaggaaatcctatttagagagctggaagtgagacaggtggctctcagacacctgatccatttcctcaaagaaattggggatcagaagctgttattggatctcttcagatttctggaccggacagaagagctcgccctgtcgcattatagggaacatctaaatatccaggatccagacaagaggaaggagttcctgaagacgtgcgttgggttacctttcagcgctgaggactccgcccatatccaggaccattacaccctgctcgagcgccagatcattattgaggccaacgaccgtcacttggaatctgctgggcaaaccgaaatttttagaaagcatcccaggaaggcttcaatactaaacatgcccctggtgaccaccctcttctattcctgtttctaccactacacagaggctgaagggactttcagtagccccgttaatttgaagaaaacattcaaaattccagataagcaatacgtgctcacagctcttgctgccagagccaagctccgtgcttggaacgacgtggatgccctgtttacaactaagaactggttgggatataccaaaaaaagggccccaatcggattccaccgtgtggtggagatcttgcacaaaaataatgccccagtgcagatcctgcaggaatatgtgaacctagtggaggacgtggataccaaattaaatttggctactaaattcaaatgccatgacgttgtaatcgatacctatagagacctgaaggatcggcaacaattactcgcctacagatctaaggttgacaagggtagcgctgaggaggagaagatcgatgccctcctatcgtcctcacagattcgctggaagaattag

SEQ ID NO: 218403 - DNA, 1482 bp, Artificial Sequence
  Description of Artificial Sequence: Synthetic coding sequence
atgaatcgcacaaagggtgacgaagaagaatactggaactcctctaagttcaaagcgttcaccttcgacgacgaagacgacgagctcagtcaacttaaggagagcaaaagagcggtcaactcgctaagagatttcgttgacgacgacgatgacgacgacttagagagggtgagttggagtggggagcccgtgggttctatctcatggtctatccgcgagaccgccggaaatagcggttccacccatgaggggagagagcagctgaagagcagaaacagttttagctcttatgctcagctgcccaaacccacttccacttatagcctctcatcttttttccggggacgaactaggcctggaagcttccagtcactgtcagatgcactttccgatacccctgctaaatcttacgccccagagttgggaagacccaaaggtgagtacagagactacagtaacgattggagcccttccgacacagtccggcgactgagaaaaggaaaagtgtgctcacttgaacgtttcaggtccctccaggataagcttcagctgttagaggaggctgtgtcaatgcacgacggcaacgttataactgccgttctgatcttcctgaaacgtacactgtctaaagaaatcctttttagggagttggaggttcgtcaggtcgcgcttagacacctgatccatttcctcaaggaaatcggcgaccagaaattgttactggacctgtttaggtttcttgaccgtactgaagagctcgccctcagccactaccgcgaacacctcaacatccaggaccccgataaacggaaagaattccttaagacctgtgtcggtctgcctttcagcgcggaggactccgctcacatccaggaccactataccctgttggagaggcagatcattatcgaggccaacgatagacatctggagtccgcagggcagacggaaatcttcagaaaacatcctcgcaaggcttccatcctgaatatgccgctggtgaccacccttttctattcttgcttttaccactacactgaggccgaaggcaccttctcttcacctgtcaatctcaagaagaccttcaaaatccccgacaaacagtacgtgctcacggctttggcggctcgcgctaagttaagagcatggaatgatgtagatgcactgtttactaccaagaactggttaggttatacaaagaagagggcgccaatcggttttcacagagttgtggaaatcctgcacaaaaacaacgcccctgttcagatcctccaggaatacgttaacctggtggaggacgtcgatactaagttgaatttggccacaaaatttaaatgtcacgacgtagtgattgacacttatagagacctgaaagaccgtcaacagctcctggcctatagaagcaaagtggataagggttctgccgaggaggaaaagatcgatgccttgctgtctagctcccagatccgatggaagaactag

SEQ ID NO: 218404 - DNA, 1560 bp, Artificial Sequence
  Description of Artificial Sequence: Synthetic coding sequence
atgactacggggcttatactattcttccaatccgggagaccactcggagctggggttagactgggactcggcctgaggatgaatagaacaaaaggagacgaagaggagtactggaacagtagcaaatttaaagcttttacctttgatgatgaggacgacgagctatcccaactgaaagagtctaaacgggcagttaacagcctgcgcgactttgtcgacgacgacgatgacgatgatcttgagagggtgtcttggtccggcgagcccgttggctccataagttggtccatcagggagactgccggtaactctggttctacgcacgagggtagagagcagctgaaatcaaggaatagcttttctagttatgcacagttaccaaaaccgacttcaacatacagtttatcgtcgttcttccggggtagaacacggccagggagtttccaatccctgagcgacgccctgagcgacacacccgctaagtcttacgcgccagaattgggtaggcccaaaggagaatatagagactattctaacgactggagccctagcgacacagtccgaagacttaggaagggcaaggtgtgttccctggagcggttcaggtctttacaggataagctgcaactcctggaggaagcggtctctatgcacgatggcaacgtcatcactgccgtcctcatcttcctcaaacgaactctgtccaaagagatcctatttagggagctagaagtgcgccaggtcgccctcagacacctgatccactttctgaaggagatcggggatcagaaacttttattggaccttttccggtttttggacagaactgaggaattggccctgtcccactatcgcgagcaccttaacatccaggatccggacaaaaggaaagaatttctgaaaacatgcgtgggactcccattctcggcagaagactctgcgcacattcaggaccactacaccctgttggaacggcagattatcatagaggcaaatgaccgccacttagaatcggcaggtcagaccgagatattccggaagcacccacggaaagcctccatcctgaatatgcccttagtgacaacacttttctacagttgcttctaccactacactgaggccgaagggaccttcagcagccccgtaaatctgaagaaaacttttaaaattccggacaaacagtacgttttaaccgcattggcagctcgagcaaaactaagggcctggaatgatgttgatgccctttttactacgaagaactggttgggctataccaaaaagagagccccaatagggtttcacagggtggtggagatcctccataagaataacgctcccgtacagatactgcaagaatacgtgaacctcgttgaggacgtcgacaccaaactgaacctcgcaactaaatttaaatgtcacgacgtcgtgatcgatacttaccgcgacctaaaagaccggcagcagctacttgcctatcgcagtaaagttgataaggggtctgctgaagaagagaagattgatgccctgctttcctcctcccagataaggtggaagaactag

SEQ ID NO: 218405 - DNA, 138 bp, Artificial Sequence
  Description of Artificial Sequence: Synthetic coding sequence
atgaacagaaccaagggcgacgaggaggaatactggaatagttccaaatttaaggcctttacatttgatgatgaggacgatgagctgtctcagctgaaggagagcaagcgagccgtcaacagtctgagggacttttag

SEQ ID NO: 218406 - DNA, 1482 bp, Artificial Sequence
  Description of Artificial Sequence: Synthetic coding sequence
atgaaccgcacaaaaggcgatgaggaggagtactggaacagtagcaagttcaaagccttcaccttcgatgacgaggatgatgagctgtcacagttaaaggagtcgaagcgcgcagtcaatagcttacgggactttgtggatgatgacgacgatgacgacctggagcgcgtttcttggagtggagagcccgtgggatcaatctcttggtctatcagagaaaccgccggaaactctggtagcacacacgaagggagggagcagttaaagtctcgcaacagcttcagcagctatgcccaactgccaaaaccaactagcacttactcacttagtagcttttttcggggtcggacacggcctgggtcttttcagagtttgtccgatgctttgagcgatactcctgcgaagagttacgcgccagagcttgggcgaccaaaaggcgagtatcgggactactcaaatgattggtctcccagcgacacagtaaggagactcaggaagggcaaggtctgcagccttgagcgctttcgctccctacaagacaagctgcagctgctcgaggaggcagtaagcatgcatgacggcaatgtgataactgccgttctgattttcctgaagagaaccctgtccaaggagatccttttccgggagctcgaggtgagacaggtggctttacggcacctgattcatttccttaaggaaatcggcgatcagaaactacttttggacctgttccgatttctcgacagaaccgaggagctggccctctcacactaccgagaacacctcaacatccaggacccggacaagcgcaaagagttccttaaaacctgcgtcggccttccttttagtgctgaggactccgcacatatccaagatcattacactctgctcgaacggcagataattatagaagccaacgatagacatctcgaatcagcaggacaaacggagatattcaggaagcaccccaggaaagctagtatccttaatatgcctctggtgactactctcttctacagctgcttctatcattacaccgaagcggaagggaccttttcttctcctgtcaaccttaaaaagaccttcaagatcccagataaacagtatgttctcacagcgctagcagcccgtgccaagttgcgggcttggaatgacgttgatgcactgttcacaaccaagaactggctcggctataccaagaagagggcccctataggctttcaccgcgtcgtggagatcctacacaagaacaatgctcccgtccagattctgcaagaatatgtcaatctggttgaagatgtggacacaaagttgaaccttgctaccaagttcaagtgccacgatgtcgtgattgatacgtacagagacctgaaagaccgacagcaactgctggcatacaggtccaaagtggacaagggctcagctgaggaggaaaagatcgatgccctgctcagtagctcacaaatacgatggaaaaactag

SEQ ID NO: 218407 - DNA, 735 bp, Artificial Sequence
  Description of Artificial Sequence: Synthetic coding sequence
atgttccgcagaaaacttacggcccttgattaccataatcctgccggatttaactgcaaggatgagacagagttccggaattttattgtgtggttagaagaccagaagatccggcactataagattgaggatagggggaatttgagaaacatccactctagcgattggcccaaattttttgaaaagtaccttcgcgatgttaactgccctttcaagattcaggacagacaggaggcgattgattggttgctcggtctggctgtgcggctggaatacggtgacaatgcagagaaatacaaggatcttgtacctgataactcaaagacagctgacaatgccacgaaaaatgcagagcctctgattaatctggatgttaataatcctgacttcaaagccggtgtcatggcactcgcgaatttacttcagatacagcggcacgatgactatcttgtaatgctgaaagcaattcgaattttggtgcaagagcgcttaacccaagatgcagtggcgaaggctaaccagacaaaggaagggttgccagtcgcactggacaaacacatcctgggcttcgacacaggtgacgcagtgctgaatgaggcagcccagattcttcggctgctgcatattgaggaactgcgagagctccaaacaaagatcaatgaggccatcgtagccgtgcaagccataatcgcagatccaaaaacagaccatcgcctggggaaagtgggcagatag

SEQ ID NO: 218408 - DNA, 177 bp, Artificial Sequence
  Description of Artificial Sequence: Synthetic coding sequence
atgttgcagagtattataaaaaatatatggatcccgatgaagccctattatactaaggtatatcaggaaatttggattgggatgggcttaatgggttttatcgtatacaagattagagccgctgacaaaaggagtaaagcgctcaaggcctccgccccagcacccggacaccactag

SEQ ID NO: 218409 - DNA, 228 bp, Artificial Sequence
  Description of Artificial Sequence: Synthetic coding sequence
atgaagttgtatgggacgaggggatctgacatctcacacttccagtgccaaatgcttcagtctattatcaagaacatctggatcccaatgaaaccctattacacaaaagtgtaccaggaaatatggatcgggatggggctcatgggcttcatagtttataaaatacgtgccgctgacaagcgctcaaaagctctaaaagccagcgcacctgctcctggtcaccactag

SEQ ID NO: 218410 - DNA, 177 bp, Artificial Sequence
  Description of Artificial Sequence: Synthetic coding sequence
atgctgcagtccatcatcaaaaatatttggatacccatgaagccttactataccaaggtttaccaagaaatttggatcgggatggggttgatgggattcatcgtttataaaatccgggcagccgacaagcggagtaaagcattgaaggcttccgctcccgcacctggacaccattag

SEQ ID NO: 218411 - DNA, 177 bp, Artificial Sequence
  Description of Artificial Sequence: Synthetic coding sequence
atgctgcagagcataatcaagaatatttggattccgatgaaaccttattatacaaaggtgtatcaggaaatatggattggcatgggcttaatggggtttattgtttacaagattcgcgctgctgataaacggagtaaggctttgaaggcatctgccccagcccctggccaccactag

SEQ ID NO: 218412 - DNA, 2928 bp, Artificial Sequence
  Description of Artificial Sequence: Synthetic coding sequence
atgacacagcagcctcaagacgacttcgaccggtcagtcgaagatgcccaggcctggatgaaagcagttcaggatcagcttcaggtcaatgacaacacccaggggcctagagctgccttggaagcaagactgtgggaaaccgaaaagatatgccagttggagcccgagggccgagtcagagtggacctcgtgcttaggatggcagaagccctgctggcttgctgtccaggcgatcaaaagcctggtattttggcacgattaaaagatattaaagcccaatgggaggagaccgtgacttacatgactcactgccacagcagaatagaatgggtgtggttacactggagtgaatatttgctggctagggacgaattctatagatggttccagaagatgatggtgacattggagccacacattgagctccaactcgggttgaaggaaaaacagtggcagctcagtcatgctcaggtgctcctgcacaacgttgataaccaggctgtgctccttgatcggttactggaagaggccgcttccctgttcaaccgcatcggggatccctctgtggatgaggacgctcagaaacgtatgaaagccgagtacgatgcagtgaaagctaaagcccagaagagagtggatctgctcgagcaggtagctcgggaacatgaggagtaccaagcaggagtggatgaattccagctgtggttaaaggctgtggttgaaaaggtgaacggttgcctgggacggaactgtaagctcccgattacccagcggctctctaccctacaagatatcgcaaaggacttcccaagaggagaggaatcactcgagaccctggaggagcaaagcgccggagtcatccggaacacctctccactgggagctgagaaaatcactggagagctcgaagaaatgcggaaggtcctggagaagctgcgagccctctgggaggaagaggaggaacggcttagaggcctcctgagatcgcggggtgcatgggagcagcagataaaacaactcgaagcagagctttccgaattcagaatggtgctgcaaagactggcacaggagggcctgcagcctgccgctaaagcaggaaccgaggatgaattagtggcacactggcggaggtacagcgcgacaagggctgctctggcaagtgaagaacccagggtggaccggctgcaggcccaattgaaagagcttattgtgttcccccataacctgaagccgctgagcgactccgtcatcgccaccattcaggagtatcaatcactgaaagttaagtcggcacgtcttcgaaatgcggcagccgtcgagctctggcagcactttcagcggcctctgcaggatttgcagctgtggaaggctcttgcccagcggctgctcgaagtcacagctagcctgccagatctgcccagtcttcatacatttctgcctcagattgaagctgccctaatggagtcttcaagactgaaggagctgctgactatgctccagcttaagaaagatctgctcatcggcatcttcgggcaagaaagagctactgccctgctggagcaggtggctggcagtatgcgggatcgcgacctgctgcacaactccctcttgcaacggaaaagcaagctccagtcactgctcgcacaacataaggattttggggctgcgttcgaaccgctccagagaaaactcctagatctgcaggttagagttcaggccgaaaaaggactacagcgagacttgcctgggaaacaggcgcagctcagccggttgcagggactccaggaggagggcctcgatctgggggcacaaatggaagccgctaggccccttgttcaagaaaacccaaaccaccagcacaagatggatcagctgagctcagatttccaggctctccaacgcagtctggaagacctggtggacagatgtagacaatcagtgcaggaacactgtacatttagccatcagcttcttgaactcaggcagtggatcgtcgtcactactcagaagctcgaagcccaccggggagaagctgggccaggggacgctgagagccaggaggccgaatttgaacggttggtagctgagttccctgaaaaagaagcacagttatctttggtcgaagcccagggatggctcgtcatggaaaaaagcagcccagaaggggcagccgtcgtgcaggaggaacttcgcgagttagctgaaagctggcgggctcttaggctgctcgaggagagccttctgtcccttatccgcaactggcaccttcagcggatggaggtggactcagggaagaagatggtgtttacaaacaacattcccaagtcaggcttccttattaaccccatggacccaatcccccgacatagaaggagagccaaccttcttcaggaggaggaaggctcacacgaggacttttcccagctcttgaggaacttcggccaatggctccaggttgaaaattcaaagctcgtaagaattattgcaatgcgcacaagcacagccgaagaccttaggacccgcaaatccaagcttcaagaactggaggcacgagtcccggagggacagcatctgtttgagaacctgcttcggctgggcccagcacggggaactagcgatgaattggaagacctccgctatcagtggatgctgtacaaatccaaactcaaggacagtggccatctgctgacacagtcgtccccaggcgaaccaactggcttccaaaagacgcgacgatggagaggcttgggtagcctgtttcggcgagcttgttgcgtggcactgcccctacagctgcttctgctgctgtttctcctgctgctgttccttttgccgattagggaagaagatcgatcatgcacactggccaataacttcgcaaggtcctttaccctcatgctcaggtacaatggcccacctcctacctag

SEQ ID NO: 218413 - DNA, 1791 bp, Artificial Sequence
  Description of Artificial Sequence: Synthetic coding sequence
atgacgcagcaaccccaggatgatttcgatcgttccgtggaggatgcccaggcttggatgaaggctgtgcaagaccaactgcaggtcaacgacaatacccaggggccacgcgctgccctggaagctagactatgggagacagaaaaaatctgccagttagagcccgagggcagggtgagggttgatctcgtgctgcggatggccgaagctctgctcgcctgctgcccgggagaccaaaagcccggtattttggccaggttgaaggacatcaaggcccagtgggaagaaactgttacctatatgacccattgtcacagccgaatcgaatgggtctggctgcattggtcggaatatctccttgctcgggatgagttctaccggtggtttcagaagatgatggtgaccctagagccccatattgaactccagcttggcctgaaagagaaacagtggcaactgtcacacgcccaggtcctactgcacaacgtagacaaccaggccgtgctccttgatcgcctactggaggaggcagcatccctgttcaataggattggggacccttcagttgatgaagacgcccagaagcgcatgaaggccgaatatgatgctgttaaagcaaaggcacagaaaagagtggacctgttggaacaggttgccagagaacatgaagagtaccaggccggtgtggacgagttccagctttggctgaaggcagtagttgagaaagtcaacggctgtctgggcagaaactgcaaactgcccatcacccagcgccttagcacacttcaggacattgccaaggattttccgagaggcgaggaatcacttgagactttggaagaacagtctgcaggcgtaattcggaacacttcccctcttggggcagaaaaaataacaggggaactcgaggagatgagaaaggtgttagagaagctccgcgctctgtgggaggaagaggaggaaaggctgcggggactgttgcgtagccggggagcttgggagcaacaaatcaagcagctggaggcagagctgagtgaatttcggatggtgctgcagagactagcacaggaagggctgcagccagcggcaaaggccggaacagaggatgagcttgtcgcgcactggcggaggtattccgccacaagagcagccctagcaagcgaggagcctcgggtggatagattgcaggcccagctaaaagagttaatcgtgttcccacataatctgaaacctttatcagattcggtcatcgcaacgatacaggagtatcagtcactaaaggtcaagtcagcaaggcttagaaacgccgctgccgtggaactgtggcagcactttcaacgccctctccaggaccttcagctctggaaagccctagctcagcgcctgctcgaggtcacagccagcctccccgatctcccatcccttcacaccttcctgccccagatcgaagccgcactgatggagagctcccgtctgaaggaattgttgacgatgctacaactgaagaaggatctactgataggtatcttcggccaggaacgggctacagctctcctcgaacaggtagctggcagtatgagagatagggatctactccacaattccctactgcagaggaaatctaaactccaaagcctgctggctcagcacaaagatttcggagcagcgtttgaacctctccagcgaaagctgctagacctgcaagtccgcgttcaggccgagaagggcctgcaaagagatctccccggtaagcaggcacaattgagccgccttcaagttagagggctatag

SEQ ID NO: 218414 - DNA, 2913 bp, Artificial Sequence
  Description of Artificial Sequence: Synthetic coding sequence
atgacgcaacagccgcaggacgactttgacagatcagtcgaggatgcccaagcttggatgaaggccgtgcaggaccagctgcaggttaatgacaacacacagggtccacgggctgctctggaggctcggctgtgggaaacagagaagatttgccagctggaaccagaggggagagtgcgcgtggaccttgtcttgaggatggcggaggccctgctcgcgtgctgtccaggtgaccagaagcccggaattcttgcgagacttaaagacatcaaggctcagtgggaagagacagtgacttacatgacccactgtcattctcgaatcgaatgggtttggttgcattggtcggagtatctgctggcaagggacgaattttatcggtggttccaaaaaatgatggtgacactagagccgcacatcgagctgcaactggggctcaaagagaaacaatggcaattgagccacgcccaggttctcctgcataacgtggacaaccaggccgtgctcctcgatcgcctcctggaggaagccgcatccctcttcaacagaatcggtgacccttctgttgatgaagacgcccagaagaggatgaaggcagaatacgacgcagtcaaggcaaaggcacagaagcgcgtggatttgctggaacaggtagcgcgagagcacgaagagtaccaggcaggggtggatgagttccagctttggctaaaagctgtggtggagaaggtcaatgggtgtctgggcagaaattgtaagttgcccattacgcaaagattaagcacactacaagatattgctaaggattttcctaggggcgaggagagcttggagacactcgaagagcagagtgcaggagtgatccgtaatacgtcccctctaggggcagaaaaaataaccggcgaattagaagaaatgagaaaggtgctggaaaaactaagggcactctgggaggaggaggaagaacggctgcgcggtctgctgcgctcaaggggagcttgggagcagcagatcaagcaacttgaggcggagctgtcagagttccgtatggtgttacagcggctagcacaggaaggcctccagcccgctgcaaaggcgggtaccgaagacgaactggtggctcactggaggaggtatagcgcaacccgggcagccctcgcttctgaggaacctcgtgttgatcggctgcaagcacagctaaaggagctgatcgtgttcccacataacctgaaacctctctcggacagtgtgattgcaactatccaggagtaccaaagcctgaaggtgaagagcgccagattgaggaacgctgccgcagtggaactttggcagcacttccagaggcccttgcaggacctgcagctgtggaaggccttagctcaaaggctgcttgaagtaaccgcctcacttcccgatttacccagcctccatacattccttccacaaatcgaggcagctctgatggaatcatccagactaaaggagctactgacaatgctgcaactgaaaaaagacctattgatcggaatctttggccaggagcgagccaccgctcttcttgagcaagtggccggttccatgagggaccgcgatctgttgcataacagcctcttgcagcggaaatcaaaactccagagcctgcttgcccagcataaggactttggggcagcctttgagccccttcagcgaaaactgctcgacctgcaagtccgcgtacaggcggagaaaggccttcaaagggatctgcctggcaaacaggcacaactgagtcggttacagggcttgcaggaggaaggtctggatttgggtgcgcagatggaggctgctaggccactggtgcaggaaaatcctaatcatcagcacaaaatggatcagctgagctccgatttccaggccctccaaagaagcctggaagatctcgtagataggtgtaggcagtccgtgcaggagcattgcacattttcacaccagctgctcgagctgaggcaatggatcgtggtgactacacagaaactggaggcccaccggggagaagccggaccgggagacgcagaatcacaagaggcggaatttgaacgtctggtggcggagttcccagagaaagaggctcagctttctctggtcgaagcccaagggtggcttgttatggagaagtccagtccagagggggcagccgtggtgcaagaggagctgcgcgaattggcagagagttggcgcgcactgcgattgctggaggagtccttattgtcccttatccgcaattggcacttgcagcgaatggaggtggatagtgggaagaagatggtatttacgaataacatccccaagagcggatttctgattaatccgatggaccccatcccacggcacagaagacgggaggaggaaggcagtcatgaggacttctcacaactactgaggaacttcggtcaatggttacaggtcgagaacagtaaactcgtgcgcattatcgcgatgcgaaccagtactgccgaggacctccgcacgcgtaaaagcaagctacaggaactggaggcccgagtgcccgagggtcaacacctcttcgagaacttgctgcgcctcgggcctgccaggggcacctccgacgaacttgaagatctcaggtaccagtggatgctgtataagtctaagctcaaagatagtggtcacctcctgacgcagtctagccctggtgagcctaccggcttccagaaaactagaagatggcggggactgggctcactgttcagaagagcttgttgcgtagcccttcccctgcagcttctgttgttgctcttcctgctgttattatttctgttgccgatacgcgaagaggatcggtcatgcacactcgcaaacaatttcgcgcgatctttcacgcttatgctccgttacaatgggccaccaccaacttag

SEQ ID NO: 218415 - DNA, 3471 bp, Artificial Sequence
  Description of Artificial Sequence: Synthetic coding sequence
atggggaatctcctcagtaagttccggccagggtgtagacggaggcccctccccggacctggaaggggagcacccgctccgttgtcacgggatgccagtcctcctggccgagcccatagtgtgcccacacctagaccgtttcggggactgttcagacggaacgccaggaggcgacccagcgctgcctctatctttgttgccccaaagcgcccttgtccattacctcgcgcagcagccgcaccactcggggttttgcctgccgtggggtggggccttgccatcaggaagacaccgatgttgccagcaagaaaccctcctcgctttggccacccatcatccgtccggatcccgccaccatccaggatgttcaccctgcttctgccctcccctcgggagccagccgtcaaggctcgcaagcctatccccgctacacttctggaagaaaccgaagtgtgggcgcaggaaggacccaggcgggtgaagaaagatgaggaccccgtccagatcgagggcgaggatgacgaaaaacggacacccctgtcctcaggcgaagcctcctccacatcaaggagtcagggcactcagggcgatgtggccagttttcgttgctcgccgggtccgctggaaggaaacgtgtaccacaagttttctgagaactccatgtccgaaaaggcccaggccagtcctgcttcttcctgccttgaaggcccagccatgccatcgacccactcgcaagccggttgcgctcgccatctgggaaagcctgatcctgacgccactgctcctccggagccagccgtgggttgctccctgctgcagcagaagcttgccgctgaggttctcaacgaagaaccccctccctcaagcttaggcctcccgatcccacttatgtctggcaagagaatgcctgacgaaaaacctttctgcatcccaccccgttccgctgctcctcccagggctgccaggaaccgcccttgcaagcgaaagatgtccatacctctactgctgccacttcccccaagtctgcctctattgtgggataggggggaactgccaccacccgctaagttaccttgtctgagtgtcgaaggagacctgcataccctagagaagtcccctgaatataaacgcaactctcgcatattggaagacaagactgagaccatgactaactcttctatcacgcaacctgcaccgagtttctctcaaccagtccagaccaccgacagcttaccgcttaccacctacaccagccaggtctccgcccctctacccattcccgatctagcagaccttgcaaccggaccgctgattttgcctatcccccctctgtcaaccacaccaaaaatggatgagaagatcgcattcaccatcccaaattcacctctggcactgccagccgatcttgtgccgatcctcggagaccaatcgaatgagaaggggggaagttataattctgtggtcggagcggctcctttgacctccgaccctcctactcccccaagtagcacgccatccttcaagccccctgtgacaagagagagccctatctctatgtgcgtggatagccctcctcccctcagtttccttaccctgttgcccgtccctagtaccgggacctcggtgatcacctcaaagcccatgaactctactagcgttatttccacggtcaccactaacgcgtccgcgcaccttacgtctcaaactgcggtcgatcctgaagtggtgaatatggacacaaccgccccatcccaggtggttattttcaccagtagtctgtcctccagggtttcatccctccccaactcccagattcactgctctgctgaacagcggcaccctggaaaaacaagcgtctacacctctccattgccatttatctttcacaacaccactccatccttcaatcagctcttcggcaaggaagctacacctcaacccaagtttgaagcgcctgatggtcaaccacagaaggcctccctgccatcagcctgtgtttttcttagtctacccataatccccccacccgacacaagtacacttgtcaattcagccagcactgcgtcctccagcaaaccacctatcgaaacaaacgccatgcacaccactccccctagcaaggcagtcattctgcagtctgctagcgtgtcaaaaaagtacctacccttttaccttggcttgcccggatctggcaacacccagccgagcggaaatacggccagcgtccagggaagcacaagcctacctgcccagagcgtgagagcacctgctacagcaagtaatcatccactgaaccctggagccacccctcagccgaagttcggcgcacccgatggtccccaacagaagaccagtctgccaagtgcgcatgattttcttagcttgcctatcatggtgcccccagacacatctaccctggtgtcatccgccagcgcggcttcgctgtcaaagcctgctatcgacactagcgatatgaataccacccctccatctaagactgtaatcctgcagtctacttttgtttctcggaaagaggagtacataagattctatatgggacttccaggtagcgggaatactcttcacagtgatagcatagcaagcgcccaggtgtccacatctttcccggcacaggctgaccggagaccaacaactacatcgtcccaccctctgaataccggctcaatatcccatagtaccctgggcgcaactgatggtcagcagaaaagcgatagctcctttatcttggggaacccggcaaccccagctcctgttattgggctgactagtcccagcgtgcagcccctgagcggctcaataataccacccggtttcgcagagctaacatccccctatacggccctgggcacgcccgtgaatgctgagcccgtggaggggcacaacgccagcgcattccccaatgggactgctaagacctccggtttccggattgctacagggatgccaggtacaggcgactccaccctcttggtgggcaatacaattccaggccctcaggtcataatgggcccaggcacgccaatggatgggggatccatcgggttctctatgagcgcccctggcccttcctctacatccggggagttgaatataggacagggccaatctggaacacccagtacgactagcgtgttccccttcgggcaggccgcttgggacccgactgggcattccatggctgccgcaccacaaggagcttcaaacattccagtatttggatatactagcgctgccgcatacataccgggtctggacccgcctacccagaacagctgcagtggtatggggggagatggaacccgaagtatagtcggaggcccttgtgtccccgctttccagcagtgtattctccagcatacatggacagaacggaagttttacaccagctcaacacactactacggccaggaaacatacgtccgaaggcacgtgtgtttccaactgccctag

SEQ ID NO: 218416 - DNA, 5732 bp, Artificial Sequence
  Description of Artificial Sequence: Synthetic coding sequence
atggcttgttgccacaaagtgatgctgttgcttgacactgccggtggcgctgcgaggcattctcgagttaggcgcgcagccctgaggctcctcacttacctctcttgtcgctttggactagcgagagtgcactgggcatttaaatttttcgactctcagggagcccgttcacggccttcacgcgtctcagattttcgcgaactcgggtcacgatcttgggaggatttcgaagaggagctcgaagcccgactggaagaccgcgctcacctccccggaccagcaccccgtgccacccatacgcatggggcactgatggagaccctgctggactaccaatgggacaggcccgaaattacttcccccactaagcctatcctgcgctccagtgggcgtcggctcctggacgtcgagagcgaggctaaggaagccgaagctgctcttgggggactggtgaacgccgttttcctcctggctccttgcccacattcacagcgcgaactccttcagtttgtgagcggctgcgaggcccaggctcagcggttaccgccaactccaaagcaagtgatggagaagctgctgcccaaaagggtgcgcgaggttatggtagccaggaaaattacattctactgggtcgacacaacagaatggtcaaagctgtgggaaagccccgaccacctaggttactggacagtctgtgaactgctgcaccacggaggcggaaccgttctcccaagcgagagcttttcctgggacttcgcccaggcaggcgagatgcttctccggtccggcatcaaactctcttctgaaccacacctctctccctggataagcatgctgcccacagacgctacgctgaataggctgttgtacaattcccctgaatacgaggcttccttcccgcgaatggagggcatgctgtttctgcctgtggaagcaggaaaagagatccaggagacctggaccgtgaccctggaacctctcgctatgcatcagaggcacttccagaaacctgtcaggatctttctgaagggtagcgtggcccaatggtctctgccaacttctagcacactaggcacagattcctggatgcttggatcacctgaagagagtacggccacacaaagattactgtttcagcaattggtcagccggctgacagccgaggaactgcacctcgttgccgacgtagatccaggtgaaggacgccctccaatcaccggtgtgatcagccctctgagtgccagtgcgatgatacttacggtgtgccgtaccaaagaagcagagttccagcggcacgtgttacagacagccgtggccgactctccaagagacaccgcttccttgttttccgacgtcgtggacagcatcctcaaccagacccatgacagcctggctgatactgctagcgctgctagtcctgtccccgaatgggcgcagcaggagcttggccacaccacaccatggtcaccagcagtggtcgagaagtggtttcctttctgcaacatcagcggcgcttccagcgacctaatggagtccttcgggctgctgcaggccgcatccgccaacaaggaggaatcttctaagactgagggagagctgattcactgcctggctgagttataccagagaaagtcccgtgaggagtcaactattgcccatcaggaagattcgaaaaagaaacggggagttcctcgaacacctgtgcgccagaagatgaatacaatgtgcaggagtctgaaaatgctgaatgtggccaggttgaatgttaaggcccagaagctgcatcctgatgggagcccggacgtcgccggagaaaaagggatccagaagatcccttctgggagaacagtcgacaaattggaggaccgaggacgtactcttcggtcaagcaagccaaaggactttaagactgaggaagagctgctctcttatattagggagaactaccagaaaacagtcgccacaggggaaatcatgctgtacgcctgcgctcggaacatgatcagtaccgtgaaaatgttccttaaatctaagggcaccaaagagttggaagtcaattgtctcaatcaggtgaaaagctccctgcttaagaccagtaaaagtctccgccagaacctgggaaaaaaacttgataaagaagacaaggtccgagagtgccagttgcaagtcttcctgagattggagatgtgtctccaatgcccatccattaacgaaagtaccgatgatatggagcaggtcgtggaagaggttacagaccttctgcgtatggtgtgcctcaccgaagacagcgcctacctggccgagtttctggaggaaatcttgagactatacatcgatagtatcccaaaaactctgggcaacctttacaattctctcggctttgttatcccccaaaaacttgccggtgtcctcccaaccgacttcttcagcgatgattctatgacccaagaaaataagtctcctttgctgagcgtgccttttctgagtagcgcccgtaggagcgtcagcgggtccccagagtctgacgagctccaagaactccgaacaagaagtgcaaagaaaagaagaaaaaacgcactgattcgccataagtccatcgccgaggtcagtcagaatttgcgacagatcgaaataccgaaagtttctaagcgcgcaaccaagaaagagaatagtcacccagcaccccaacagccctctcaacccgttaaagatacggtccaggaagttaccaaggttaggcgaaacctgttcaatcaggagctcctttctccgtcgaaacgctcgctgaagcggggacttcccagatcccactctgtttcggctgtggacggactggaggataagttagacaacttcaagaagaacaaaggttaccataagctcctgactaagtctgttgccgagacacccgtgcacaagcaaatctccaaaagactgttgcaccgccagatcaaaggcaggagctccgatccaggccctgacattggggttgtcgaggagtcacccgagaaaggagatgagatctcacttcggcgatccccacggattaaacaattgagttttagcagaacgcactccgctagcttttactcagtctcgcagcccaaatccagaagtgtgcagcgggtgcactctttccagcaagataagagcgaccagagagagaacagccccgtgcagtccattcgttcacctaaatctctgctctttggggctatgtctgagatgatatcaccttcagaaaagggatcagctaggatgaaaaagcggtcgaggaatactctcgactcagaggtaccagccgcataccagactcccaaaaagagtcaccagaaatctttgagcttcagtaagactacaccacgcagaattagtcacaccccacaaacacccctgtatactccagaacgcctgcagaagtctcccgctaagatgactccaacaaagcaggctgccttcaaagagtccttaaaggacagttcctcacccggacatgactctccccttgactccaaaatcactccccaaaagcgccacacacaggccggtgagggtacgagtctcgagacaaagaccccccgtacgcccaaacgccagggaactcagcctcctggatttcttcccaactgtacatggccacattccgtcaatagttctcccgagtccccctcatgccccgctccacctacatctagcacagctcaacccaggcgcgagtgcctaacacccatccgcgacccgctccgcaccccccctcgcgctgctgcatttatggggacacctcagaatcagacccaccaacagccgcatgtattacgtgccgctcgggcagaggagcccgctcagaagttaaaagacaaagctattaagactccaaaacgtccaggaaattctacggtcacaagttctccacccgttactccaaagaaattgttcactagccctctttgcgacgtgagtaagaaaagtccttttcgaaaatccaagatcgagtgccccagcccaggcgagctcgatcaaaaagaacctcagatgtcccccagcgttgctgctagtctctcatgccctgtaccgagcaccccacccgaactaagccagagagccacgctcgacactgttcctccccctccaccatcaaaagtcggtaaacgctgcaggaaaactagtgatccccgtcgcagcatagtcgaatgtcaacctgatgccagcgccactccaggggtgggaaccgctgactcgcctgctgccccaactgacagcagggatgaccaaaagggattgtccctctctcctcagagccccccagagcggagaggttacccaggaccaggactcagaagcgattggcacgcaagctcacccttgctaatcacgagcgataccgagcacgtgactctgctctccgaggcggaacatcacgggatcggcgacctgaagagcaatgtattgtccgtggaggaaggcgaaggcttgcggaccgccgatgcggagaagtctagcttgagccacccagggatcccgcctagtcccccttcctgcggcccaggatcccccttgatgccctcccgggacgtgcattgcaccacagacggcaggcaatgccaggcatctgcccagcttgacaatctccccgcatcggcctggcatagcaccgatagtgcttcacctcagacatatgaagtcgaactcgagatgcaagcctccgggttgcctaagctcaggatcaagaagattgatccttcctctagcctagaggccgagccattgtctaaggaggaatcctcacttggggaggaatccttcctgcctgcactgtctatgcctagggcctcaaggtccctctccaaacctgaacctacctatgtgtctccaccttgtcctaggctcagtcacagtaccccagggaagtcacgcggtcagacttatatctgccaggcctgtaccccaactcatgggccaagtagcaccccatcaccgtttcagactgacggcgtgccgtggaccccctctcctaagcattctggtaaaacaacaccggatattattaaggactggcccaggcgtaagagggctgtgggctgcggcgctggatcctcaagcggacggggtgaggttggagcagacttgcctggctccctctctctgctggaatctgaaggaaaggatcatggtctcgaactgtcaatccatcggacccccattctagaggactttgagctggaaggcgtgtgtcaactgcctgaccaatctccaccccgaaactccatgcccaaggcagaagaagcaagcagctggggacagtttgggctgtcttcacgaaaaagggtattactggcaaaagaagaggccgaccggggtgctaaaaggatctgtgacctgcgtgaagattccgaggtttcaaagtctaaggagggatccccatcctggtcagcctggcagctccccagcactggtgacgaagaagtgttcgtttctggcagcacccctccccctagttgtgccgtacgctcatgtctgagtgccagtgcactacaggccctgacccagagccctctgttgtttcagggaaagaccccatcctcccagtcaaaggacccacgggatgaggatgttgatgtactacctagcaccgtagaagacagccctttcagtcgcgctttctcccggagaaggccaatctcccggacttatactcgaaagaagctgatgggcacctggctggaagatctgta

SEQ ID NO: 218417 - DNA, 354 bp, Artificial Sequence
  Description of Artificial Sequence: Synthetic coding sequence
atgaaactgtcttcagccgctggccaggagtcacctggacacccccacccctctccacccgcttggacgctcaagaagcctagcgagtctgtggctcagcgtgcaatgtgcagtgcacgggcttgtccagtcgcctgcccagtgggctgccccatcgcctgtccggtgtcttgccccgtggcctgcccggtggggtgtccggtgggaagcatggcaactgcccctcagggcttatcaccacaagagtgggaagctgatcgggagactggctccagtagtcacgcaggcactactcaatgttcgatccactctccgtcttcttcaagcaggcacttatcaaggactcagacttag

SEQ ID NO: 218418 - DNA, 627 bp, Artificial Sequence
  Description of Artificial Sequence: Synthetic coding sequence
atgtcatccgagccgcctccaccttaccctggaggtccaacagcccctctcctcgaagagaagtcaggagcccctcctacgcccggtcgctcctccccggctgttatgcagcccccacctggcatgccactccctcctgctgatatcgggccaccaccatacgagcctccaggccacccaatgccacaacctgggttcattccacctcacatgtccgctgatgggacttacatgcctccaggattctacccccctcccggtccacatccccctatgggctactacccccctggtccgtatactcctggaccctaccccggacctggcggtcacacagcaaccgtcctggtcccatctggagccgctacaaccgtcaccgtgctgcagggagagatctttgagggggcacctgtgcagaccgtgtgtcctcattgccagcaggcaatcaccacaaagatttcctatgagataggactgatgaacttcgtgctggggttcttttgttgttttatgggctgtgatctggggtgctgtctgatcccttgcctgatcaacgattttaaagatgtcacacatacttgtccaagctgtaaggcctacatctacacatacaagagactatgttag

SEQ ID NO: 218419 - DNA, 765 bp, Artificial Sequence
  Description of Artificial Sequence: Synthetic coding sequence
atgtctctcgccagaggtcacggggacacagctgccagcacagccgctcccctgtcagaggagggagaggtgactagcggacttcaggccctggccgtggaggacactgggggaccctcagcttctgcaggcaaggcagaggatgagggggaaggcggacgggaagaaactgaacgggaaggaagcgggggagaagaagcccagggagaagtgccttccgccggaggcgaggaacctgcagaggaagacagtgaagactggtgtgtgccatgctctgacgaagaggtggagttgccagccgatggtcagccgtggatgccgccaccatcagagatccagagattatacgaactgttggcagcccacgggacactggagctgcaagcggagattctgccacgaaggcctccaacaccagaggcccagtccgaagaagaacggtctgacgaggagccggaggctaaggaggaggaagaggaaaagccacatatgcccacagaattcgacttcgatgacgaaccagttacccccaaagactccctcatcgatcgccgaagaacgcccggttcctcagctcggtcacagaagcgcgaggctcgactagataaagtccttagcgacatgaagaggcacaagaaattggaagagcagatactgaggactggcagggacctgttttcacttgattctgaggatcccagtcctgcttctcccccactgaggtccagcggatccagcctattcccgaggcagcgcaagtactag

SEQ ID NO: 218420 - DNA, 2010 bp, Artificial Sequence
  Description of Artificial Sequence: Synthetic coding sequence
atggggtcagatccttccgcgcctggaaggccaggctggacaggatccctgctgggtgaccgggaagaagcagcgcgacctaggctgttgcccctgctgctcgtgctgctgggatgtctggggctgggcgtcgccgctgaggacgccgaggtgcatgcggaaaattggttgagactgtacggatatctgccccagccgagcaggcacatgagcacaatgcgctctgcccagatattagcttccgctctggccgagatgcagcgattttatggcattcccgtcaccggggtgttggacgaggaaacaaaagaatggatgaaaaggccaaggtgcggcgtgcctgaccagtttggagtgagggtcaaagctaacctgagacggcgacgaaaaaggtatgctctgaccgggcgaaagtggaataatcatcacctgacctttagcatacagaactacaccgagaagctagggtggtaccattcaatggaagccgtgagaagggcctttcgggtctgggaacaggccactccactggtgttccaggaagttccttatgaagacatccgcctccggaggcaaaaggaggcagatattatggtgctcttcgcttcaggatttcacggagacagttctcctttcgacggcacgggaggatttctagcccatgcttatttccctggacccggactgggaggggatactcattttgatgcagatgagccctggaccttttcctccactgaccttcatggaaacaatctgtttttagtcgcggtgcatgagcttggccacgctctggggctcgagcacagttccaaccccaacgccatcatggcacctttttatcagtggaaggatgtagataactttaagttacccgaggacgatttgcgtggaattcaacagctctacggaacccctgatgggcagcctcaacccacacaacccctgcccacagtaacaccaaggcgcccaggtcgaccggaccaccgtcccccacggccacctcaacccccacctccgggtggaaaacccgaacgtccacctaaaccaggcccaccagttcagccaagagccaccgagagacctgaccaatacggtccaaatatatgcgatggagattttgacaccgttgccatgttgagaggggaaatgttcgtcttcaagggcagatggttttggcgcgtacggcataaccgagtgcttgacaactatcccatgccaatcggtcacttttggcgcggattgcctggggacatttccgcagcttacgagaggcaggatgggcgtttcgttttcttcaaaggcgaccgttactggctgttcagagaagcaaacctggagcctggttatccacagccactgacctcatacggactgggcatcccatatgacagaatagacaccgccatatggtgggaacctactgggcatacgtttttttttcaggaagatagatattggaggttcaatgaggagactcagagaggggaccccggttacccaaagccaatttcagtatggcaggggatccctgcttctccgaagggcgcattcctctcaaacgacgccgcttatacttacttctacaagggcaccaagtactggaaattcgataacgagcgtctcaggatggagcccggataccccaaatccatattaagagactttatgggatgccaggagcacgtggagcctggcccacgttggcctgacgtggcgagacctccatttaatccccacggcggagcagaacccggagcagatagcgcagaaggtgacgttggggatggggacggtgactttggtgcaggcgtgaacaaagatggcggtagtagggtggtggtgcaaatggaagaggtggccaggaccgtcaacgtcgtcatggtgttggtacccctgctccttctcctgtgcgtgctagggttgacatatgctcttgtgcagatgcagcgaaaaggtgcacctcgcgttcttctttactgcaagcgctctctgcaggagtgggtgtag

SEQ ID NO: 218421 - DNA, 561 bp, Artificial Sequence
  Description of Artificial Sequence: Synthetic coding sequence
atgtcagctgctccactggtgggctattcatcgtccggtagcgaggatgaaagcgaagatgggatgagaaccagacctggggatgggagccacaggagaggacaaagtcctctcccaagacagcggttcccagtccccgacagcgtgctgaacatgtttcctggcacagaagaagggccagaggacgattctactaagcacgggggtagagtgcggacctttccacacgaacgcggtaattgggctactcacgtttatgtgccctatgaagctaaagaggagttcctggatctgctagacgtgctgctgcctcacgcgcagacttatgtgcccaggctggtgcgcatgaaggtgtttcatctgagtttgtctcagagcgttgtgttgcgacatcattggattctccccttcgtccaggcgctgaaagcgcgaatgacaagcttccattctccccacccagggccacactgcctgataggaaccaaggacgcccctgtgacacaggaaatcccaaaagaccttggtgcccttcgccaagagccaggatcccagacacggtag

SEQ ID NO: 218422 - DNA, 744 bp, Artificial Sequence
  Description of Artificial Sequence: Synthetic coding sequence
atgtccgccgcacccctggtgggatacagttcctcaggctctgaagatgaatctgaggacgggatgcggacacgtccgggagacgggagccaccggagaggtcagtcccccctccccagacagcgatttcctgttcccgatagtgtactgaacatgttcccgggaaccgaggaggggccagaggatgattccaccaagcatggcggtagagttcggacctttccgcacgaaaggggaaattgggccacccacgtatacgtgccctacgaggcaaaagaagagtttctcgatttgctggatgttcttttacctcacgcacagacatacgtgcccagactggtccgcatgaaagtgttccatctttcattatcccaaagtgtggtcctcaggcatcactggatcttaccatttgtgcaggcactcaaggcacgcatgaccagctttcataggacttttatcggtctggaagtgacaagcggccacgcgcaatttctcgatctagtctctgaggttgatcgcgtgatggaagaatttaacctgacaacattctaccaagaccctagtttccacctcagcttggcttggtgtgtgggcgacgccaggctgcagttggaggggcagtgcttgcaggaactgcaggccatcgtcgacggattcgaagacgccgaagtgcttctcagagtccacacagaacaagtcaggtgtaagtctggtaacaaatttttcagcatgccactcaagtag

SEQ ID NO: 218423 - DNA, 642 bp, Artificial Sequence
  Description of Artificial Sequence: Synthetic coding sequence
atgtctcccctgcccaggcagaggttcccggtgcccgattctgttctgaatatgtttccgggaactgaagaggggcctgaggatgacagtacaaaacacggcggaagggtcagaacctttccacatgaaaggggtaattgggccacccatgtttatgtgccatacgaagcgaaggaagagtttttagacctattggatgtgcttctgcctcatgcacaaagcgtcgtgttaagacatcactggatcttgccatttgtgcaggcattgaaggctcggatgacgagcttccaccggtttttcttcactgcaaatcaagttaagatctacaccaatcaggaaaagaccagaacctttatagggctagaggtcacctcgggccacgcgcagtttctcgatttggttagcgaagtggatagggtgatggaggagttcaatctgactaccttttaccaggacccaagtttccatctctcgctcgcgtggtgtgtgggggacgccaggctgcaactcgaggggcagtgcctgcaagagctccaggcaatcgttgatgggtttgaggatgcagaggtcctccttcgggtccacacagaacaggttagatgtaaaagtggcaacaagttcttttctatgcccctgaagtag

SEQ ID NO: 218424 - DNA, 1683 bp, Artificial Sequence
  Description of Artificial Sequence: Synthetic coding sequence
atgggctccactgattccaaattaaatttccgcaaagcagtgattcaactgacaaccaagacccagcctgtggaggcaaccgatgacgcatacgatccagttgggtatggaattccatacaaccatttgctcttctccgattatcgcgagcccctggtcgaagaggccgctcaggttctgatcgtaactttggaccacgactccgcaagctcagcaagtcctaccgttgacgggactaccactgggaccgcaatggatgacgcagacccaccaggtccagagaatctgttcgtgaattacctttctcgcattcatagggaagaagacttccagttcatactgaaggggattgccaggctactgagtaaccccttgctgcagacgtacctgccgaattcaaccaagaagatccagttccatcaggagctcctcgtgctgttctggaagctctgtgactttaacaagaaatttctattctttgtgctaaaatccagcgacgtgctggatatactcgtcccgattctgttctttttgaatgacgcacgtgctgaccaaagcagggtgggtttgatgcatattggggtttttatcttattgctgttaagcggagagcggaactttggagtgcgacttaataagccatatagcatccgcgtcccaatggacattcctgtgttcaccgggactcatgcagacctgctgatcgtggtgtttcataaaatcataacaagtggccaccagagactccaacccctgttcgactgcctgctaacgatagtggtcaacgtctccccttacctgaaatccctgagtatggtgacagcgaacaaattacttcacctcctggaagcattctctacaacatggttcctgttcagtgcagcacagaaccaccacctggtgttcttcttgctggaagtgttcaacaacatcatccagtaccagtttgatggaaattccaacctggtatatgcgatcattaggaaaagatctatctttcatcagctcgccaatctgccaaccgatccccctacaattcataaggctctgcagaggcgtcgcagaacccccgagcctctgtcaagaacgggatcacaagagggaaccagtatggagggctcccggccagcagcgccagcagagccgggaacattgaaaacttcactcgtggcaacacctgggatagataagctcactgagaaatcgcaggtctccgaggacggcaccctgcgctcactcgagcctgagcctcagcagagccttgaagacggaagccccgctaagggggaaccttcccaggcatggcgggagcaacgccgtccttcgacgtcctccgcctccggccagtggagccccactcccgagtgggtactgagttggaagagcaagttaccactccaaacgatcatgcggttgttacaagtcttggttcctcaagtggaaaaaatctgcatcgataaaggcttgactgatgaaagcgaaattctcaggtttctccaacatggaaccctggtgggccttctccccgtgcctcaccccatcctcatacgtaaataccaggcgaatagcgggacagcaatgtggttccggacttatatgtggggggtgatatatctaaggaatgtggaccctcctgtgtggtatgacactgacgtgaaactgttcgagattcagagagtctag

SEQ ID NO: 218425 - DNA, 2367 bp, Artificial Sequence
  Description of Artificial Sequence: Synthetic coding sequence
atgggttcgaccgacagcaagctaaactttagaaaagcggtcatacagctaactactaagacccagcccgtcgaagcaaccgatgacgctttttgggatcagttctgggcagataccgcgacgagcgtacaggatgtgttcgccctggtacctgccgctgaaattcgggctgtacgggaggagagtccctcaaacttggctaccttgtgttataaagccgttgagaagcttgtgcagggtgccgaaagtggctgccactctgagaaggagaagcagatagtgctgaattgtagcaggcttctaactcgggtgcttccttacatctttgaagatcccgattggaggggatttttctggagtacagtcccaggggctggcagagggggacagggggaagaagacgatgagcatgcaagacctctcgctgagtctttactactcgccatcgctgatctcctcttttgtcccgatttcactgtgcagtcacaccgccgaagtacagtcgattcagcggaagacgtgcattcccttgactcatgtgaatacatttgggaggcgggagttggatttgcccacagtccacagcctaattatatacacgatatgaaccgaatggaactattaaagctactgctgacctgcttttctgaagccatgtacttgcctccggctccagagagcggcagcacaaatccttgggtgcaattcttctgtagtacagaaaataggcacgctcttcctctgttcacgagcttattgaacaccgtttgcgcctacgatccggtgggttacgggatcccttacaaccatttactttttagcgattacagggagcccctcgtagaggaggcagcccaggtcctgatcgtaactctggaccacgattccgcttccagcgcttcacctacggtagatggtaccaccaccggtacagcaatggacgacgccgatccacccggtccagaaaatctgtttgtgaattacctgtcccgcatacaccgtgaggaagacttccaatttatcctgaagggtattgccaggctgcttagtaatccactcttacagacttaccttccaaattccaccaagaagattcaatttcatcaggagctgcttgtcttgttttggaaactctgtgatttcaacaaaaagtttttattctttgtactgaagagctccgacgtactggatattttagtgccaatcttgttcttcctcaatgatgctcgcgcagaccagtccagagtggggcttatgcacattggagtctttatcttactacttcttagcggtgaacgtaattttggagtgcggttaaacaaaccttacagtatccgagtgcccatggacattccagtgttcacaggaactcacgccgacctactgattgtggtcttccacaagataatcacctccgggcatcagcggctccagcccctctttgactgtctgctgaccattgtagtgaacgtctccccttacctgaagtcgctgtctatggtgaccgcgaacaaactgctccacctcctcgaggccttttctaccacttggtttctgtttagtgccgcacaaaatcaccatttggtgttttttctcctggaagtctttaacaatatcatacagtatcaatttgacggaaacagtaacctggtttatgccattataaggaaaaggtccattttccatcagctggccaatctacctactgaccccccaacaattcataaggccctgcagcggcgtaggcgtacaccagagcctttgtcaaggacagggtctcaagaaggcaccagcatggagggaagcaggcctgctgccccagcagaacccggtaccttaaagaccagtctggtcgcaactcctggaatcgataagctgacagagaagagccaagttagtgaggacgggacgctccgcagccttgaaccagaacctcagcagtccctcgaagacggcagcccagccaaaggagagccaagccaggcttggagggaacagaggaggccctcaacgagttccgcatcagggcaatggagtcccacgcctgaatgggttctgagttggaagagcaagcttccgctccaaacgattatgcgactgctgcaggtcctggtgccacaggtggaaaagatttgcatagataaaggattgacagatgagtctgaaatcttgaggtttcttcagcacggaaccctggttggcctcttaccagtgccccaccctattttaatccggaagtatcaggctaatagcggcaccgccatgtggttccggacctatatgtggggggtaatctaccttcgtaacgtggatccaccggtctggtatgacactgacgtcaagctttttgaaatccagagggtgtag

SEQ ID NO: 218426 - DNA, 810 bp, Artificial Sequence
  Description of Artificial Sequence: Synthetic coding sequence
atgtcttctgaccacctgaacaactctactctgaaagaagctcagtttaaggatctgttcctgaagaaagcagaactggaattcgcacaaatcatcattattgtcgtggtggtcacagtcatggtggtggttattgtatgtctgctgaaccactacaaggtctcaaccaggtcattcattaacaggcctaaccaaagccggcgtagagaggacgggcttccacaagaggggtgcctgtggcccagcgactcagcagcgcctagacttggagcgtcagaaatcatgcacgcacccagatctagagaccgcttcaccgctcccagctttattcagcgggatagattcagcaggttccagccgacatacccctacgtgcagcacgaaatcgatctgccacctactatctccctcagcgacggcgaggaaccccctccgtaccaaggaccctgtacactgcagttacgtgatcccgagcaacagatggagcttaacagggaatcagtaagggcgcctccgaaccgtacaatattcgacagtgatctgatcgacatcgctatgtattctggtggaccgtgtccaccaagttccaatagtggaatctctgcctccacgtgtagcagcaacgggaggatggaggggcctccacccacttacagtgaagtgatgggccatcatccaggcgcttcttttctgcatcaccagcgctccaacgctcacagaggcagccggctccaattccagcaaaataacgcagaatctaccatcgtgccaattaaaggcaaggaccggaaacctggaaacctggtgtag

SEQ ID NO: 218427 - DNA, 921 bp, Artificial Sequence
  Description of Artificial Sequence: Synthetic coding sequence
atgccagaggccggtttccaggcaacgaacgcgttcactgagtgcaaatttacgtgcacttcgggaaagtgtttgtacctggggagcctggtgtgtaatcagcagaatgactgcggcgacaactctgacgaggaaaactgtctgcttgtcaccgaacatcctccccctggtatcttcaactcagagctcgaattcgcacagatcattatcatcgtcgtggtggttactgttatggttgtcgtgatcgtatgcctcttgaaccactacaaagttagcactagaagcttcatcaaccgtcctaatcagtcaaggaggcgagaagatggtctcccccaggaaggctgcctgtggccctctgattcagctgctcccaggctcggggctagcgagatcatgcatgctcctaggagtcgcgatcgatttacagctcctagcttcatccagagagatcggttctcgaggttccagcccacatatccctacgtgcagcacgaaatcgatttacctcccacgatatctctgagtgacggtgaggagccccctccctaccaggggccttgcacgctgcagctgcgcgatcccgaacagcagatggaactaaacagggaatccgttcgggcaccacccaataggaccattttcgattccgacctcatcgatatcgccatgtacagcggcggtccctgccctccatcatccaactccggaatttccgctagcacatgttcctcgaatgggagaatggaaggtccacctcccacctactcggaggttatgggccatcaccctggcgcaagtttcttgcaccatcagcggtccaatgcccataggggttcacggctccagttccagcaaaataatgccgagagtacaattgtgcccatcaaggggaaagatagaaaacctggtaacttagtttag

SEQ ID NO: 218428 - DNA, 747 bp, Artificial Sequence
  Description of Artificial Sequence: Synthetic coding sequence
atggccgctgaactggaatttgcccagataattatcattgtggtggtcgtcacagttatggtcgtggtaatcgtttgccttctcaaccactacaaggtgtccaccagaagctttataaatcggcctaaccaatctcgaagaagagaagatgggctaccccaggaaggctgcctgtggccgtcggacagtgccgctcccaggctaggggcttcggagataatgcacgccccaagatctagggataggtttactgctcccagttttatccaacgcgaccgattttctcgtttccagcctacatatccctatgtccagcacgaaattgatttgccaccgacgatatctctgagtgacggcgaagagccacccccttaccaaggcccttgcaccttgcaacttagggaccccgagcagcagatggagctgaacagagaatccgtgagagcacctccaaaccgaaccatcttcgatagcgatctgatcgatattgcaatgtactctgggggaccatgccctccttcaagcaactcaggcatttctgctagcacttgctccagtaacggtagaatggaaggacccccacccacgtattctgaagtgatgggccatcatccaggagccagttttctgcaccatcagcgatcgaacgcacatcgcggaagtagactgcagtttcaacagaataacgccgagagcaccatagtcccaattaagggcaaagatcgcaagcctggaaacctggtgtag

SEQ ID NO: 218429 - DNA, 756 bp, Artificial Sequence
  Description of Artificial Sequence: Synthetic coding sequence
atgtctagtgaccatctgaataattcaactttgaaggaagcccagtttaaagacttgtttctgaaaaaagctgaactggaatttgcacaaatcattataatcgtggtcgtcgtgacagttatggtggtggtgatcgtttgtctactgaaccactacaaagtgagcacgcgtagttttatcaacagaccgaatcagagtcgtaggcgggaagacggattgcctcagatcatgcacgcgcctcgttctcgagaccggtttacggcaccttcgttcattcaaagagatcgctttagccgctttcagccgacctatccatacgtgcagcacgagatcgacctgccaccaactatctctctctccgacggggaggagccaccaccataccaaggaccatgcaccctccagctcagggatcctgaacagcagatggagctgaacagagagagtgtgcgggcacctccaaacaggaccattttcgacagcgatttgattgacatcgccatgtacagcgggggaccctgccccccatcgagcaactctgggatctccgcctcaacgtgctcgagcaacggtcgaatggaagggcctccccctacctatagtgaagtaatgggacatcaccccggagcaagctttcttcaccaccagagatccaacgcccacaggggctcgagattacagtttcaacaaaacaatgcagagtcaacaattgtgcccattaagggcaaagaccgtaaaccaggtaatttagtctag

SEQ ID NO: 218430 - DNA, 867 bp, Artificial Sequence
  Description of Artificial Sequence: Synthetic coding sequence
atgcctgaagccggattccaagctaccaatgcctttactgaatgcaagttcacttgtacctctgggaagtgcctgtacctcgggtccctggtgtgtaaccaacagaacgactgtggagacaattccgacgaagagaactgcctgcttgtcacggagcaccccccaccagggatcttcaatagtgagctcgagttcgcacagattatcatcatcgttgtggtggtgactgtgatggttgtcgtgatcgtctgtctgctgaaccactacaaagtctctaccagaagctttattaatcgacctaaccaatcgcgacgccgtgaggatggcttgccccagataatgcacgcacctagaagtcgggaccgattcaccgccccttccttcatccagcgagacaggttttcccggtttcagcccacatacccttacgtgcagcacgaaatagatctcccccctacaatatcgctgtccgatggggaggaaccacccccataccaaggtccctgtaccctccagctgcgcgaccctgagcagcaaatggaactgaaccgcgagtctgtccgcgcaccccctaaccgtaccatcttcgattccgacctgatcgatattgctatgtattctggaggaccctgccccccttcgagtaactcgggcatttctgcttcaacctgcagtagcaacggccgaatggaggggcctcccccaacttattccgaggtgatggggcatcaccctggcgcaagttttcttcatcatcagagaagtaatgcccacagaggcagtcgcttacaatttcagcagaacaacgctgaatctacaattgttccaatcaagggaaaagataggaagcccggaaaccttgtgtag

SEQ ID NO: 218431 - DNA, 693 bp, Artificial Sequence
  Description of Artificial Sequence: Synthetic coding sequence
atggctgcagaactcgaattcgcacaaatcattatcattgtagtggtggtaacggtgatggtcgtcgttattgtttgtttgttgaatcattataaggtatcaacccgatccttcattaaccggccaaatcagtcgaggaggcgcgaagacggcctgccacaaattatgcacgctcccagatcaagagacagattcaccgctccaagtttcatccagcgcgatcgattttctcgcttccagccaacttacccttacgtccagcacgaaattgatttgcccccaaccatctctctgagcgacggggaggagcccccaccctatcagggaccttgtaccctccagctgcgtgaccccgaacagcaaatggaacttaatcgcgagtccgtgagggcccctcctaacaggactatcttcgactcggatttgattgacattgccatgtacagtgggggtccatgtccccctagttccaacagcggtataagcgcctccacttgttctagcaatggtagaatggagggcccacccccaacctatagcgaggtaatgggacatcatcctggagcaagctttctccatcaccaacgctcaaatgcacatagggggtcgagattgcagtttcaacagaataacgcagagagtacaatcgtcccgataaaggggaaggacaggaagcccggaaacttggtgtag

SEQ ID NO: 218432 - DNA, 1119 bp, Artificial Sequence
  Description of Artificial Sequence: Synthetic coding sequence
atggcaaagagcaagacaaagcatagactctgctcacaagaaagtagtgtgagcgccttactggcatcctgtacgctttcagggtcaaatagtagcaactcagacggctcatttcactacaaggacaaactgtatcggtccgcatctcaggccctgcaggcctacatcgacgattttgacctcggccagatctaccctggtgcttcaaccggcaagattaacatcgatgaggactttacaaacatgagtcagttttgcaactacatatacaagcccaataacgcatttgagaacctcgaccacaaaaaacattccaacttcattagttgcaggagacatacagtgaacgatatagatagcatgtccctcacgaccgatgacctgctgcggttgccggcagatgggtccttcagttatacctatgtggggccaagccatagaacatccaagaagaacaaaaaatgcaggggtcgtctgggctccttggacattgaaaagaacccgcattttcagggcccttacacgtctatgggtaaagataattttgtgacaccggtcatcaggagcaacatcaacggaaagcagtgcggtgacaagatcgagctgttaatactgaaggccaagcggaacctcgaacagtgtactgaagaacttcctaaaagtatgaagaaggatgactccccatgcagcctggacaaattggaggcggacagatcctgggagaatattccagtcaccttcaagtctccagtgcctgttaattcagatgactctcctcagcaaactagccgcgctaaaagcgccaagggagtcctcgaggacttcctaaataacgataaccagtcctgcactttgtccggcggtaaacaccacggtccggttgaggccctcaaacagatgctgtttaacctgcaggcggtgcaggaacggttcaatcagaataagaccacggaccctaaagaggaaattaaacaggtgagcgaggatgattttagcaaacttcagcttaaagaaagcatgattcccataacaagatcactgcaaaaagccctgcaccacttgtcacgcctccgggacctggttgacgataccaatggcgagcgtagcccaaaaatgtag

SEQ ID NO: 218433 - DNA, 1602 bp, Artificial Sequence
  Description of Artificial Sequence: Synthetic coding sequence
atggccaaatccaaaaccaagcaccgtttgtgcagtcaggaaagctccgtttccgccttgttggcctcatgtacattatcaggctcaaactcttcaaacagtgacggttcctttcattacaaagataagctgtaccggtctgcctcccaggccctccaggcttatattgacgatttcgacctcggacagatctatccaggggctagcacggggaagatcaatatagatgaggactttaccaatatgagtcagttctgcaattacatttataagccgaacaacgccttcgaaaatctggatcacaaaaagcactctaactttatcagttgcagaagacacactgtgaacgatattgattcaatgagtttgaccacagacgacctgctccgcttgcctgcagacgggagcttctcttacacttacgtggggccaagtcacaggaccagcaaaaaaaataaaaaatgccgaggcagactgggttcactggatattgagaagaacccccacttccaaggaccgtacacttccatgggaaaggacaattttgtgaccccagtaatccggtctaatataaatggtaagcaatgtggacggctcaaaaatccaaagctgatgaatagaactaataattgcatctcagaatccagcctgagcttccccaaaaaatcctctttcaaggatagctccgaacatagcttggagaaaaattacccgaggtggttgacaagccagaaatcggacctgaatgtaagcgggatcacttccatacctgatttcaagtacccagtatggctgcacaatcaggatcttcttcccgacgctaactcacagcgggtctatcaaattttcaaagatgatcagtgctcccccaggcactctcaccaggcccaaggcactagtcggctgattaacaagctggactgctttgaatacgccttcgagcccagtaatttttctaacagcctgtcagacgacaaagaactggtgaacgaatacaaatgcgacttcgaacatagccagtgccaatgcgaaaatcccctcctgccgggacagtccactaagccctttagcggagacaaaatcgagctattgatcttgaaagctaaacgcaacctggagcagtgcacagaagagctccccaaaagcatgaagaaagacgattccccatgcagcctggataagttagaagccgatcgctcatgggagaatataccggtgactttcaagagccccgtacctgttaactcagacgattccccacagcagacctccagggccaagagcgccaaaggggtgctggaggacttcctaaacaatgacaatcagagctgtactcttagtggcggtaagcatcacggcccagtggaggccttaaaacaaatgctgttcaatcttcaggccgtccaggaaaggtttaatcagaataaaaccaccgacccaaaagaggagattaaacaggtgagcgaggacgacttttctaagctgcagttgaaagaatctatgatacctattacgcggagcctgcaaaaggctcttcaccaccttagtagactgagggacttggtcgacgacactaatggtgaaagatccccaaaaatgtag

SEQ ID NO: 218434 - DNA, 522 bp, Artificial Sequence
  Description of Artificial Sequence: Synthetic coding sequence
atggctgcaccctcaggcggatggaacggggtcggggcttcactatgggcagccctgcttctgggggctgtagcactgcggcctgcggaagccgtgtccgagcctacaaccgtagccttcgacgttcgaccaggaggggtcgtgcacagttttagccataatgtgggacccggagacaaatacacctgcatgttcacatatgcttcccagggcggtactaacgaacagtggcagatgtccctaggcacctcggaggaccatcagcattttacgtgcacaatatggagaccccaaggcaagtcctatttatactttacccaattcaaggctgaggtgcggggagcggagattgagtatgccatggcttactcgaaggcggcttttgagcgggaatcagacgtccccctgaagacggaagagttcgaagtaacaaagacggctgttgctcaccgccctggcgctttcaaggcagagctgagcaagctggtaatagtggctaaagcctctcgaaccgagctatag

SEQ ID NO: 218435 - DNA, 426 bp, Artificial Sequence
  Description of Artificial Sequence: Synthetic coding sequence
atgacaatcatggtggaagatattatgaagctgttgtgttccttgagtggggaacggaaaatgaaggcagccgtgaagcacagcggcaagggtgcgctagttacaggggctatggcatttgtgggaggcctagtggggggtcctccgggactggctgttggaggcgcagtggggggtttacttggggcatggatgacctcaggccagttcaagccagtaccgcagattctcatggaattgcccccagccgagcagcagagactcttcaacgaggcagctgcaataatacgccacctcgaatggacggacgcagtacagcttacagctctcgtgatgggtagcgaggcgctgcagcaacagcttttagccatgctggtgaattatgtcacaaaggaactgagagccgagatccagtatgatgattag

SEQ ID NO: 218436 - DNA, 324 bp, Artificial Sequence
  Description of Artificial Sequence: Synthetic coding sequence
atgacaattatggtagaggacattatgaaacttctgtgtagtctcagcggcgagcgcaaaatgaaggcagcggtgaagcactcaggaaagggggctctggttacaggggctatggcctttgtggggggactggtagggggacccccaggattggctgtggggggtgcagtcgggggactcctgggtgcctggatgacgagcggacagtttaagccagtaccacagattctgatggaactgcccccagccgaacagcaacggttgtttaacgaggccgctgctattacaagaccatgctctagttcttgctggccctgctggtag

SEQ ID NO: 218437 - DNA, 459 bp, Artificial Sequence
  Description of Artificial Sequence: Synthetic coding sequence
atggagaggctcaaaagccataagcctgccaccatgacaatcatggtggaggacattatgaaattgctttgttccctttcgggcgaaagaaaaatgaaggcagctgtaaagcactctggcaagggagccctggtgacgggagccatggcttttgtgggtggcttggtcggcggacctccgggactggctgttggcggagcagtaggcggattgctaggcgcatggatgacaagtggccagttcaagcccgtgccccagatcctgatggaactaccccctgccgagcagcagcgcctgtttaacgaggcagccgcaataattcggcacctggaatggacagatgcagtccagttgaccgcactggtcatgggttcagaagctcttcaacaacaactactagccatgctcgtgaactatgtcaccaaggaactaagggctgaaattcaatacgacgactag

SEQ ID NO: 218438 - DNA, 648 bp, Artificial Sequence
  Description of Artificial Sequence: Synthetic coding sequence
atggaaaaaaaccctcctgacgacactggccctgtccacgtgccccttgggcacattgtcgccaacgaaaagtggagaggcagtcagctggcccaagagatgcaaggaaagataaaactcattttcgaagatgggctcacacctgatttctatctgtccaaccgctgttgtattctctacgtgaccgaagccgacctggttgctggtaacggttatcgaaaacgactcgtgcgcgttaggaactccaataatctcaaaggcattgtcgtagtcgaaaagacccgtatgtccgagcagtattttcccgctcttcagaaattcacagtgctcgatcttggtatggtcttgcttcctgtcgcatctcaaatggaggccagttgcttggtgatacagctggtgcaggagcaaacaaaagagccttcgaagaacccactgttaggaaagaaacgggctcttctgctttcagaaccgtccctgctgcgcaccgtccagcaaattcctggcgtcggaaaagtaaaggccccacttctgctgcaaaaattccccagcattcagcagttgagcaatgccagtattggcgagctggaacaggttgtgggccaggctgtcgctcaacaaatccatgccttcttcacgcagcctcggtag

SEQ ID NO: 218439 - DNA, 648 bp, Artificial Sequence
  Description of Artificial Sequence: Synthetic coding sequence
atggagaagaatcctccagatgacacagggccagtgcacgtcccactcggacacattgtagctaacgagaagtggcgtggatctcaactggcccaggagatgcagggaaaaataaagctgatttttgaggacggactaaccccagacttctacctctccaaccgttgttgtattctttatgtcacagaggccgacttggtcgccggtaatggatatcgtaagcgtctagtcagagtaagaaattcaaataacctaaaaggcatcgtcgtcgtggagaaaacacgcatgagcgagcagtactttccagctcttcagaagttcactgtcttggacctgggcatggtgctgctcccagtcgcgtctcagatggaagcatcttgtctggtcattcagctagtgcaggagcagacaaaagagccaagcaagaaccctctactgggtaaaaagagagcccttcttctgagcgaaccaagtctcctgaggactgtgcagcaaatacccggagtgggaaaagtgaaagcgccactgcttttgcagaagtttccttctattcaacagctgtccaatgcaagcatcggagaactggagcaggtcgtggggcaagcagtggctcagcagatccacgccttctttacacagcctagatag

SEQ ID NO: 218440 - DNA, 1227 bp, Artificial Sequence
  Description of Artificial Sequence: Synthetic coding sequence
atgtccgagcacgttgagcccgcagcccctggacccggacctaatgggggaggtggcggtcctgccccagctcggggaccaagaacacccaatctgaatcctaaccctctcatcaatgtgcgcgaccgactctttcatgcccttttcttcaaaatggctgtcacctactcgcgcttatttcctcccgcattccgtcgcctgttcgagttctttgtcctactgaaggccttgttcgtgctttttgttttggcgtacatacacattgtcttttcacggtccccgattaactgtctcgagcacgtgcgcgataagtggcccagggagggaatactccgtgtcgaggtgcgccacaactcatctcgagcaccagtctttctgcagttctgcgactctggcggacgcggatctttccccggtctggctgtggagccgggttctaacctcgacatggaggacgaggaagaggaggaactaacaatggagatgtttgggaactccagcataaagtttgagcttgatatcgaacccaaggtctttaagcccccaagcagtacggaggcactgaatgacagccaggagtttccatttcccgaaacaccgacgaaagtctggccccaagatgaatacattgtggaatactccctggagtacggcttccttagactgagccaggctacacgccagcggctctccattccggtaatggtggtgacactcgaccccacaagagaccagtgtttcggagatcgattctctaggctgctgctcgacgagtttctgggttatgacgacattcttatgtcatcagtaaaggggcttgctgagaacgaggagaacaagggctttctgcgtaatgtcgtttccggcgagcattacagatttgtgagcatgtggatggcgcgaacaagctacctcgcagccttcgccatcatggttatcttcactctgtctgtcagtatgcttctgcgctatagccaccatcagatttttgtgttcatagtcgacctgctgcagatgctggagatgaatatggcgatcgccttccccgctgcgcctttgctgacagttatactcgccctggtgggtatggaggctattatgtctgagttcttcaatgacacaacgactgcattttatataatcctgattgtctggctcgccgatcagtatgatgccatatgctgccacacgtcaacttctaagagacactggctccggattccatag

SEQ ID NO: 218441 - DNA, 1863 bp, Artificial Sequence
  Description of Artificial Sequence: Synthetic coding sequence
atgagcgaacatgtcgagccagcagctcctggccctggacctaacggaggaggaggcggaccagcccctgctagaggacctcgcactcctaatctaaaccccaacccccttatcaacgtgcgagaccgcctgtttcatgccctcttcttcaagatggccgtgacatacagcagactgttcccgccagcctttaggcggctgttcgaattctttgtcctgctgaaagcattattcgttctctttgttctcgcgtatatccacattgtctttagccgatcacccataaactgtctcgagcacgtgcgagataaatggccacgggagggaattcttcgtgtagaggtgcgccacaattccagtagagccccagtatttctgcagttctgtgacagcggtggcaggggatctttccctgggctggcggtagaacccggtagtaatctcgacatggaagatgaagaggaagaagaactgacaatggaaatgtttggaaattccagcattaaatttgagctggacattgagccgaaggtattcaaaccacctagctccactgaagcgctcaacgactctcaagaattccccttccctgagacccctacaaaggtatggcctcaagacgaatatatcgtcgagtattccctggagtacggcttcctacggctatcgcaagccacaaggcaacggcttagtatcccggtaatggtggtgaccttagacccaactagggaccagtgtttcggggacaggttcagcagactgctgttagacgagttccttggctacgatgacattcttatgagcagtgtcaagggcctggctgagaacgaggaaaacaaagggttcttaaggaatgtggtatccggcgagcattacaggtttgtatcgatgtggatggccaggacctcttatctcgccgcatttgccatcatggtcatcttcacattgtcagtgtcgatgctgctgaggtattcccatcaccagatcttcgtgttcatagtggacttattgcagatgctggaaatgaacatggctatcgcattccccgcagcacccctgcttaccgtcatactggccttggtgggaatggaagccattatgagcgaatttttcaacgacactactactgccttctatatcattctcattgtgtggctggccgatcagtacgacgcaatatgctgccacacatctacctctaagcgtcactggctgaggtttttctacctgtatcatttcgccttttatgcctatcactacagattcaacgggcagtattcttctctggcgctggtcacatcatggctctttatacaacattccatgatttactttttccatcactacgagctccccgcaatcctgcaacaggttaggattcaggaaatgcttctgcaagcccctccgcttggtccaggcaccccaaccgcgttgcctgatgacatgaataataactctggtgccccagctaccgcccctgactctgccggtcaacctcctgccctagggccagtgtctccaggcgcaagcgggagtccaggtccagttgccgctgctccttcctccctggtggccgcagccgcttccgtggccgctgctgctggcggagacctcggttggatggccgagaccgccgctatcatcaccgatgcatcctttttgtccggcctatctgcttcgcttctggaacggagacccgctagccctctcggccctgcgggaggactcccccatgcccctcaggatagtgtgccaccaagcgattcagcagcctctgacactacaccccttggagctgccgtgggtggcccttccccagctagtatggcccctactgaggccccatctgaggtcggaagttag

SEQ ID NO: 218442 - DNA, 447 bp, Artificial Sequence
  Description of Artificial Sequence: Synthetic coding sequence
atggccgcttcccctgccaggccagccgtgctggcactgactggattggcactgctactcctgctctgctggggacctggcggaatatcaggaaataagctgaaattgatgttgcagaaaagggaagcaccagtgcctaccaagactaaggttgcagtagacgagaacaaggccaaggagttcctggggagcctgaaacggcaaaaacgtcagctgtgggatcgcactcgccctgaggtacagcagtggtatcagcaattcttgtacatgggctttgacgaggccaagttcgaggatgatataacgtattggctcaacagggataggaacggacacgagtattacggcgattactaccagcgccattacgacgaggacagcgcgatcggcccacgctcaccatatggctttcgccacggggcaagcgttaactatgacgactactag

SEQ ID NO: 218443 - DNA, 2964 bp, Artificial Sequence
  Description of Artificial Sequence: Synthetic coding sequence
atgacaccggctctgcgagaagcgaccgcaaagggcatcagtttctcctcacttcccagcacaatggaatctgataaaatgctctatatggaaagcccacggaccgtggatgagaaattaaaaggggacacattctctcaaatgctggggtttccgacacccgagcccacattgaataccaatttcgtgaacctgaaacactttggctcccctcagagttcaaaacactatcaaactgtttttcttatgcgctccaacagcacactgaacaagcataatgaaaattataagcaaaaaaaattgggcgagccttcatgtaataagctaaaaaacatattgtataacggctctaatatccagctatctaagatttgcctatcccatagcgaggaatttattaaaaaagagcccttgtcagataccaccagtcaatgcatgaaagacgtgcagatcattcttgatagtaacatcactaaagacacaaacgtagataaagtccagctacagaattgtaagtggtaccaggaaaacgccttgctggataaggtaacagacgccgaaattaagaaaggactgttgcactgcactcagaagaaaatcgtgccaggacatagtaatgtgcctgtttccagctccgcagccgagaaggaagaggaggtgcatgctcgcctgctgcattgcgtgagcaagcagaagattttactctctcaggccaggaggactcagaagcatctgcagatgctcttggcgaagcacgtcgtcaagcactatggccagcagatgaaactgtccatgaagcaccagttacctaaaatgaagacattccacgagcccactaccatcctcgggaactccctgcccaaatgtaccgagatcaagcctgaggtgaataccctaaccgccgaaaataaactgtgggatgacgccaaaaacggtttcgctcgctgtactgctgccgaaatacagcgctttgctttctcagctactgggctcctgagccatgtagaagaggggttggattctgatgcaacagattctagctccgacgatgacctggatgaatacactctgaggaagaacgtcgcggtgaattgctcaacagagtggaaatggcttgtcgacagggccagggtagggtccagatggacatggctgcaggcccaaataagcgatctggagtgcaagatccagcagttaactgatattcacaggcagattagagcctctaagggaattgtggttctcgaggagtgccagcttcctaaagacatcctcaaaaaacaaatgcagtttgccgatcaggctgcttctttgaatatcctgggaaacccccaggttccacaggagtgtcaggatccagtgccagaacaggatttcgagatgtccccatcctctcctaccctgctcttgcgtaatatagagaagcagtctgcgcagctgaccgagattattaactctctcatcgctccgctgaacctgagccctaccagctcacccctgtcttcaaagagctgtagtcataaatgcctggcaaacggcatttaccgtagcgcttccgaaaatctcgatgaattaagcagtagtagcagctggctacttaatcagaaacactccaaaaagaagaggaaagatcgcactaggttaaaatccagcagcctgacattcatgtccacatcagctcgtaccagaccccttcagtccttccataagcggaagctgtaccgcctttcacccactttctattggacccctcagacattaccttccaaagagaccgcattcctgaataccacccagatgccctgtttgcagagcgcctccacctggagtagttacgagcataattccgaatcgtacctccttagagagcacgtgtcagaattggactcctccttccattctgttctctccctaccctctgacgtacccctgcatttccatttcgagactctgctgaaaaaaacagagattaaggggaacctggccgagaataagtttgtggacgagtatattattagtccctctcctgtccatagcacccttaaccagtggaggaacggatattcacccatctgcaagcctcagattcgatctgaaagcagcgcccagctcctgcaagggagaaaaaaacgccatctttcagaaactgcactgggcgagcgcaccaagttggaagagagcgacttccagcacacagaaagcggatcgcacagcaatttcacagctgtgagtaacgtgaacgtgctctcacgcatccagaacagctcccgaaacaccgccagacgacgactccgttccgaatcatcctacgacattgacaacatcgtcattcctatgagcctggtggcgcctgctaaactggagaagctgcagtataaggaaattctgaccccgagttggaggatggtagtcttgcagccactggatgagtacaatcttggaaaagaggagatagaggatctgtccgacgaagttttttccctgagacataaaaaatatgaagagcgcgagcaggctagatggagcctgtgggagcaaagcaaatggcaccgcagaaattctagagcttattcaaaaaatgtggagggccaggacctcctgttgaaggagtatcctaacaacttctcatcatcacagcaatgcgccgctgcaagtccacctgggctgcctagcgaaaatcaggatctttgtgcctatggcctgccttctttaaaccagtctcaagaaacaaagagcctatggtgggagcggcgtgctttccctcttaagggggaagacatggcagctctattgtgccaggatgagaagaaggaccaggtggagcgcagttccaccgcttttcacggagaaatattcggaacatcagtgccagaaaatggccaccaccccaagaaacaatccgacgggatggaagaatacaaaaccttcggtctgggcctgactaacgtgaaaaagaatcgttag

SEQ ID NO: 218444 - DNA, 687 bp, Artificial Sequence
  Description of Artificial Sequence: Synthetic coding sequence
atgtcctacgcagagaagcctgatgaaatcactaaggatgaatggatggagaagctcaacaacttacacgtgcagcgagctgacatgaatcgcctgatcatgaactaccttgtgactgagggcttcaaggaggccgcagaaaagttcagaatggaatcgggaatcgagccgagtgttgatctggaaacacttgatgaaaggatcaaaattcgcgagatgattttaaaaggccaaatccaagaggcaattgccctgataaactccctccacccggagttgttggatacaaacagatacttatacttccacctccaacagcaacatcttatcgaacttattcggcagagggagacagaagccgctctggagttcgcacagacccaacttgccgagcagggagaagagagcagggagtgtttaacagaaatggagaggacacttgcattactggcctttgattctcccgaagaatccccattcggcgacctgctccatacaatgcagaggcagaaggtatggagtgaggtcaaccaggccgtgctggattacgaaaatcgagaatccactccaaagctggctaaactgctcaaacttctactgtgggcccagaacgaactcgaccagaagaaggttaagtatcctaaaatgacagacctctctaaaggcgtcattgaagagcctaagtag

SEQ ID NO: 218445 - DNA, 468 bp, Artificial Sequence
  Description of Artificial Sequence: Synthetic coding sequence
atgtcctatgccgagaagcctgacgagattaccaaagacgaatggatggagaagttaaataatttgcacgtgcaaagggctgacatgaaccggctgatcatgaattatctcgtgacggaagggttcaaagaggcagccgagaagttccggatggagtccggtatagaacctagcgtggatctggagacgctggacgagaggattaagatcagggagatgatcctgaagggacaaatccagcaggtggtgcacgactgttggcggaaggagagggtgttcatcctatccgatctgcccagcagcatttctgctgcgagccaccctccttccagcgctggctctgctgatgtgctcctcttatttacacataggaccgtgccttgctcagtcgttggcagaagggaggtggttcaaggctgcgtgcactgcctaagagtaggtacagttgacggccacatggccctgtag

SEQ ID NO: 218446 - DNA, 3534 bp, Artificial Sequence
  Description of Artificial Sequence: Synthetic coding sequence
atggacgtttaccctccacgaagacaagggctgccacgcgctcgatctcccggaggttctagtaggggtagtccaagcgtctcgtgtagccggcttaggcaagtccagtctatacttactcagtcctcaaagtctcgtcccgatgggattctgtgcatcttgggaattgatagcaggtacaatgagggctgtcgtgaactggcaaattacctgttgttcggcttatataaccagaacacatccgactttgagaaaaccggcttttctgaggaagttctggacgatgtgattattctgataaaatcggacagtgtacatctatactgcaaccctgtgaactttcggtatcttttgccctatgtggcccattggaggaacttacactttcactgtatgaccgagaatgaatacgaggatgaggaggcggcagaagaattcaaaatcaccagtttcgtggacatggttcgggactgctccaggatcggaatcccatatagttctcaaggccacctgcagatcttcgacatgttcgtggtggagaagtggcccattgtacaggctttcgccctggaagggattggaggtgatggattctttaccatgaagtacgagctgcaagatgtgagccttaatctgtggaatgtgtactctaaaatggacccaatgtcactggaaagcttgttgagtgatgatcttgtggccttcgagcaccagtggacatccttcttcgctaattttgacaccgagattccgttcctgctggaacttagcgaaagccaggccggagaacctttcaggagttacttttcccacggcatgatctcatctcacataacagagaattcaccaaatcggcaaccttttgtacttttcggtaaccactctacgagagagaacctgaacgcaggcaatttcaattttccttccgaaggccatttagtgagaagcactggcccaggtgggtcattcgcaaagcacatggtcgctcagtgcgtatctcctaaagggccactggcatgctctagaacctactttttcggggctacccacgtgccatacctaggaggtgactcaaagttgcctaaaaagaccgaacagataaggttgctaagtcagatatacgccgctgtcatcgaagccgtgcttgctggcatcgcctgctacgcaaagacctcaagtcttacaaaggcgaaggaagttgccgagcagaccctgggctctggcctggattcatttgagctgatcccatttaaggctgcactgcgcagtaagatgacatttcatattcacgccgtcaacaaccagggcaggatagttccccttgacagtgaagatagtttatccttcgttaaaacagcttgcatggccgtgtacgacattcctgatttactcggcggaaacggctgcctcggcagcgtggtatttagcgaaagcttcctcacttctcaaatcctggtgaaagaaaaagatgggaccgtaactaccgagacgtcaagtgtggttctgaccgccgcagtgcccagattctgcagctggcttgtcgaagataatgaagtaaagctgagcgagaaaactcagcaggccgtcaggggtgatgaatccttcctgggaacctatctgactgggggagagggggcatacctgtacagctctaatctccagtcctggccagaggaaggaaacgtccacttttttagcagtgggctgctattttcccactgcaggcacagaagcataataatttcaaaagatcatatgaattccatatcattctacgacggcgacagtactagcactgtcgctgcgctcttgattgactttaagtcctccctgctaccccatctgcctgtgcattttcatggctcctctaactttctgatgattgcccttttcccaaaaagcaagatctaccaggccttctactctgaagtgttttccctctggaagcagcaggataatagtgggatctcacttaaagtgatccaagaagatgggctgtctgttgagcagaagcgcctgcatagcagtgcccagaaactgttttccgccctgtcccaacccgctggggagaaacgatcctctctgaagttgctgtcggccaagctgcctgaattagattggttccttcaacacttcgcaatctcaagtattagtcaggaacccgtcatgcggacgcatttaccagtgctgctgcagcaggcagagatcaacacaacgcacagaattgaaagcgataaggtgattattagcatcgttaccggcttgcctgggtgccacgcctccgagctttgtgctttcctcgtgacgctccacaaagagtgcggccgttggatggtctacagacagattatggactcatctgagtgcttccatgcagcccactttcagaggtatcttagcagcgcgctggaggctcagcagaatcgatctgccagacagagcgcctacattagaaagaagaccagattattggttgtgctacaggggtatacagatgttatcgatgtcgttcaagctctacaaacccatccagattccaacgtgaaggcttcttttacgatcggcgcaattaccgcttgcgtggagccaatgtcctgctatatggaacataggttcctgtttcctaagtgcctggaccagtgtagccagggcctagtgtccaatgtggttttcacaagccacactaccgaacagaggcacccactcttggttcagctgcagagcctgatccgtgccgcaaaccccgctgccgcatttatcctggccgaaaatggaattgtgacccggaacgaggacattgagttgatcctgtctgagaatagcttctccagccccgaaatgctgcgtagcaggtacctaatgtaccctggttggtatgaaggtaagttgaatgccggtagtgtctatcctcttatggtgcaaatttgcgtatggtttgggaggcctctggaaaaaacccggttcgtcgccaagtgcaaggctatacagtcttcaattaaaccatcgcctttctccggtaatatttaccacatactgggtaaggttaagtttagcgactctgaacgaacaatggaggtgtgttacaacactctggctaactcactgagcatcatgccggtgcttgagggtccaaccccccctcccgacagcaagagcgtctcccaggactctagcggccagcaggagtgttatctggtctttatcggttgctcactgaaggaggatagtataaaagattggctgagacagtctgccaaacagaagcctcagcgaaaggctcttaaaacgagagggatgcttacccagcaggagataaggtccatccacgtcaaacggcacctcgagccgcttcctgcgggatatttctacaacggaacccaatttgtaaacttctttggggacaagacggatttccacccactgatggaccagtttatgaacgattatgtggaggaggctaacagagagatcgaaaagtacaatcaggagttagagcaacaggaataccatgacttattcgaactgaagccatag

SEQ ID NO: 218447 - DNA, 1488 bp, Artificial Sequence
  Description of Artificial Sequence: Synthetic coding sequence
atggaagggtgtctgggtcaggagctgtttagcaatcacatgtttcttacaagcctctcttcccccaatcggcagccgtttgtgctgtttgggaaccattctactcgggaaaatctgaacgctggtaacttcaactttccttcagaaggacatcttgtgcgaagcaccggtccaggcggaagcttcgctaaacacatggtggcccaatgcgtctctcccaaaggaccgctagcatgctcccgcacctacttcttcggagccacacacgtgccctacttaggaggagatagcaagttgcctaagaaaacggagcagatgcttctgagccagatttacgcagccgtaattgaggcggtgcttgccggaattgcttgctacgccaagaccagtagtctgacaaaggctaaggaggtcgccgaacagaccttaggttccgggctggactcttttgaactaataccattcaaagccgctctgcgctcaaagatgacctttcatatccacgcggtgaataaccaagggcgtattgtaccattggattccgaggattctttgtccttcgtgaagactgcttgtatggccgtctatgacattcctgatctcttgggcggaaatggctgcttaggctccgtggtgttcagcgagtcttttttaacttcacagattctggtgaaagagaaggatggcactgtgacgaccgaaaccagtagcgttgtgctcaccgctgctgtccctaggttctgcagctggctcgtcgaagataatgaggttaagttaagcgaaaagacccagcaggccgtgagaggagacgagagcttcttgggaacatatctgacgggcggagaaggagcttatttgtattcttctaacctccagagctggcccgaggaaggcaacgtccattttttcagttcagggcttctcttctcacattgtcgacatagatcaattattattagcaaagatcacatgaactcaattagcttttatgatggagactcaacctcaactgtggccgcactgcttatagattttaagagctctttgcttccccacctcccggtgcacttccacggaagcagtaatttcttgatgatcgcactgttcccgaagtcaaaaatctaccaggcattctattccgaagtattttcactgtggaagcagcaggacaattcaggaatcagtctgaaagtgatacaggaagacgggcttagcgtcgagcagaaaagactccactcttccgcccagaaactcttcagtgctctgtcccaacctgcaggggagaagagatccagcctgaagctgttatctgcaaaactgccggagcttgactggtttctacagcacttcgctatttcctccattagccaggagccagtgatgagaactcatctgccggtgctcttacagcaagccgaaatcaacacgacgcataggatagaatctgacaagatggatggagtctccccaaaccatggccagctttag

SEQ ID NO: 218448 - DNA, 615 bp, Artificial Sequence
  Description of Artificial Sequence: Synthetic coding sequence
atgggggaagcggaagtgggtggcggaggagctgccggagataagggcccaggggaggcagctacttctccagctgaagagaccgtggtgtggtctcctgaagtggaggtctgtttgttccacgctatgttgggtcataagcctgtgggagtgaaccgacatttccatatgatatgtatcagggacaagttcagccagaacataggtcgccaggtcccttcgaaagtgatctgggaccatctgagtacgatgtatgatatgcaagcactgcatgagagtgagatccttcccttccccaatcccgaacgcaacttcgttctgcccgaagaaataattcaggaagtgcgggagggcaaagttatgatagaggaagagatgaaggaggaaatgaaggaagatgtggacccacacaacggggctgatgacgtcttcagcagcagtggctccctcggaaaggcgagcgaaaagtcctccaaggacaaagagaagaattcaagcgacctcggatgtaaggagggagcagacaaacgtaagcggagtcgcgttaccgacaaggtgctcaccgcgaatagtaatccatcctccccctctgcagcaaaaagaagaaggacatag

SEQ ID NO: 218449 - DNA, 1278 bp, Artificial Sequence
  Description of Artificial Sequence: Synthetic coding sequence
atgtacccatctaataagaagaaaaaagtgtggcgcgaggagaaggaaagactgttgaagatgactctcgaggaacgacggaaggagtatctacgggactatattccacttaatagcatcctgtcttggaaagaggagatgaaaggaaaaggccagaacgatgaggagaacacccaggagaccagtcaggtgaagaaatcgcttacagagaaggtctccctctatcggggagacatcaccctgctggaagtagatgccattgtgaacgccgcaaatgcaagcctgttaggcggtggcggtgtggacgggtgcattcatcgagcggcaggaccctgcttgctggccgagtgccgaaacttgaacggttgtgacaccggccacgctaaaattacctgcggttacgacctgcccgcaaaatatgtgatacacaccgtgggccctattgccaggggacacattaacggatcccacaaggaggacctggccaactgttacaaatctagcctgaagctcgtaaaagaaaataacatccgatctgtagctttcccctgtatctccacggggatctacggcttcccaaatgagcccgcagccgtcatcgctctaaacacaatcaaggaatggctcgccaagaaccaccatgaggtcgaccgcatcatcttctgtgtctttctggaggtggacttcaaaatatataaaaaaaagatgaatgagtttttttcagtcgatgataacaacgaggaggaagaagatgtggagatgaaagaggactctgacgagaacggccctgaagaaaagcagagcgtcgaagaaatggaggagcagtcccaggacgctgacggcgttaacacagtaacagtccctgggcctgcctccgaggaggccgtggaggactgcaaggacgaagactttgcaaaggacgaaaacatcactaagggtggtgaggttaccgatcactcagtccgcgatcaggaccaccctgacggccaggagaatgatagcaccaagaatgaaataaagatcgaaaccgagtcacaatctagctatatggaaacagaggagctctccagcaaccaggaggatgccgtaatcgtggagcagccggaggtgatacccctgactgaggaccaggaagaaaaagaaggcgagaaagctcccggagaagacacaccacggatgcctggaaagtctgagggaagtagtgaccttgagaacactcctgggcctgacgccggagcacaggacgaggcaaaggagcagaggaatggtacaaaatag

SEQ ID NO: 218450 - DNA, 1248 bp, Artificial Sequence
  Description of Artificial Sequence: Synthetic coding sequence
atggcatttctgatgcaccttctggtgtgtgtgtttgggatgggatcttgggtgaccatcaacgggctgtgggtcgaactacccttacttgtgatggaattaccggagggatggtacctgccttcttacctgaccgtagtaatacaacttgctaacatagggcctctcctcgttacacttttgcaccacttcaggccctcctgtctgagcgaagtgcctattatttttaccctactgggcgtcggcacggtgacatgtataatcttcgcgtttctttggaacatgacttcctgggtgttagacgggcatcacagtatagccttcctggtcctgacgttctttttggcgttggtggattgcacctccagcgtgactttcctcccatttatgtcccggctgcccacatactaccttaccacctttttcgttggagaggggttgtctggtcttctgcccgctctggtggcccttgcacaggggtccggccttactacatgtgtgaacgtgaccgagatttcagactccgtgccgtctcctgtcccaactcgtgagaccgatatagctcaaggtgtgccccgagccttggtctctgcacttcctggcatggaagcaccactgtcccatctagaaagccggtacctgccggcacacttttcccctcttgtgttttttctgttattgagcatcatgatggcctgctgcctggtggctttctttgtactgcagcggcagcccagatgctgggaggcatccgtggaggacctccttaacgaccaagttaccctgcatagcatcagacccagggaggagaacgacttgggccctgcagggactgtggacagtagtcagggccaggggtacttagaggagaaggcggcaccctgttgtccggcacacctggcgtttatatacaccctggtcgcattcgtgaacgccctgaccaatggtatgctgcctagtgtccagacatactcctgtctctcttatggaccagtggcctaccatctggccgcaacactgtcaatcgtagccaaccccctggccagtttagtgtctatgtttctcccgaatcggagcctgctctttttgggcgtgctttctgtgctcggaacatgtttcggtggctacaacatggcaatggccgtgatgagcccctgtcctcttctgcagggccattggggcggtgaggtgctgatcgtctccattcgacctgttggtctcttgccgctgaggactccccacccatag

SEQ ID NO: 218451 - DNA, 1038 bp, Artificial Sequence
  Description of Artificial Sequence: Synthetic coding sequence
atgctccggcctgcaggcttgtggagactgtgtcggcgaccttgggccgctcgggttccggctgaaaacctgggccgacgggaggtcacctccggggttagtccgagaggtagcacttcacctagaactctgaatatctttgatcgggatctgaaaagaaagcaaaaaaactgggccgcacggcagccagaaccgacaaagtttgactatttgaaggaagaggtaggatctcgcatcgccgatcgagtgtacgatatcccccgtaactttccgctggctctcgatctcggctgtggacgcggttacattgctcagtaccttaataaggagacgatcggcaagttcttccaggcagatatcgctgagaatgccttgaaaaattcaagcgaaactgagattcctacggtgagtgtgctggctgacgaagagtttcttccgttcaaagaaaacacattcgacctcgtcgtatcatctctctcactccactgggtgaatgatctgccccgtgccttagaacagattcattacatactgaaacccgacggggtctttatcggggcaatgtttggaggggatactctgtacgagctgcgatgtagtctccaactggcagaaacagagcgggaagggggattctccccgcacattagcccttttacggctgttaatgatttgggacacctccttggtcgggctggatttaatacccttactgtcgatacagatgaaatccaggtgaattacccagggatgtttgaactcatggaagatttacaggggatgggtgaaagcaattgcgcttggaataggaaagctctgctgcatcgcgatacaatgttggccgctgctgccgtttaccgggagatgtataggaacgaggacggtagtgtccccgcaacgtaccagatttattacatgatcgggtggaaataccacgagtcccaggcgaggcccgctgaacgcggttctgctaccgtttctttcggagagttgggtaagatcaataatctcatgcccccaggcaaaaagtcccaatag

SEQ ID NO: 218452 - DNA, 954 bp, Artificial Sequence
  Description of Artificial Sequence: Synthetic coding sequence
atgttgcggccagcaggactatggcgactctgccggcgtccgtgggcagcccgagttccagctgagaatttaggaaggagagaagtgacctccggcgtttccccccgaggttcaactagcccacgcactctgaacattttcgacagggacctgaagcggaagcaaaaaaactgggccgcaaggcaaccagagcctaccaaattcgactaccttaaagaagaggtgggctctaggatagccgatagggtgtacgatattcccagaaattttccattggccctagatttgggatgtggtcggggatatatcgctcagtatctcaacaagctgcagctctttcactgtcgtaagttactagagagcttttcaaagctgacactccagaagatgctgtgcctgcactgggttaatgacctgccccgagccttggagcagatccactacatactgaagcccgatggggtctttattggggctatgttcggtggtgacactctgtacgagctcagatgctcactgcaactggcagagaccgaacgagagggaggattcagtccccatataagtccttttacggcagtgaatgacctgggccacctgctgggcagagcgggattcaatactctcacagtcgataccgatgagatccaggtcaactacccaggcatgttcgaactcatggaggacctgcaagggatgggagaaagtaactgcgcttggaaccgaaaggctctgctgcacagggacaccatgctggcagcggctgccgtgtatagggaaatgtatcggaacgaagatggaagtgtgccagcgacgtaccagatctattatatgatcgggtggaaataccatgagtcacaggcacggccagcagaaagaggcagcgccactgtttctttcggggagctcggcaagatcaataacctcatgccccctggcaaaaaaagccagtag

SEQ ID NO: 218453 - DNA, 804 bp, Artificial Sequence
  Description of Artificial Sequence: Synthetic coding sequence
atgttaaggcccgcaggtctgtggaggctttgccggaggccatgggctgcaagagtgcccgctgagaacctcggaaggcgagaagtgacgtccggggttagccctagggggagcacatctccgaggacattaaatattttcgaccgcgatctgaagcgtaagcagaagaactgggccgctcgccaaccggagcctaccaagttcgattatcttaaagaggaggtgggcagtcggatcgccgatcgggtgtatgacatcccacgcaattttccactggccttggatctgggctgtgggagaggctacattgcccagtatctgaacaaggagacgattggcaaatttttccaggccgatattgcagagaacgccttaaagaactctagcgaaaccgaaatccccacagtttcggttctcgctgacgaagaatttctgcccttcaaagagaatacctttgatcttgtcgtatctagtttgtcgctgcattgggtgaacgaccttccacgggcactggagcagattcattacatcctaaagccagatggtgtctttatcggcgcaatgttcggaggggacaccctctacgaactgcgctgctccctccagctggcagagacagagcgggaaggcggattttcacctcatatctcgccgttcacagccgtgaatgacttaggccacctcctcggcagagcagggttcaacacattgaccgtagacaccgatgagatccaggtaaactatcccggaatgttcgagctcatggaagacctgcaggaacagaagagtaggatgctgacctag

SEQ ID NO: 218454 - DNA, 771 bp, Artificial Sequence
  Description of Artificial Sequence: Synthetic coding sequence
atgaaacttactcggaaaatggtgctgacaagggctaaagcctctgagctccattcagttcgcaaactgaactgctggggatcccgcctcactgacattagcatctgtcaggagatgccttcgctagaggtgataacgctgtcggtgaacagtataagcacactggagcctgtatcgcgctgccagcgactgtccgagctttacttacgcagaaacaggatcccaagcctggcagaactcttctatctgaaagggctgccaagactgcgtgtgttatggttagccgaaaatccatgctgcggaaccagcccacacagatacaggatgacagtgctaagaactctgcctcgcctccaaaagctcgataatcaggccgttactgaggaggagctaagcagagctttgagtgagggcgaggaaattacggcagcaccagaacgggaaggcactggtcacggcggacctaagttgtgctgcacattatcatctctatctagcgccgcagagacggggcgtgatcccctcgactcagaagaggaggctacctccggcgctcaggacgaacggggtctgaaaccaccaagcagaggccaatttcccagcctcagtgcgagagacgcgtctagcagccatcggggaagaaacgttttgactgccatactgttactcctgcgagagctagatgccgaagggcttgaggccgtacagcagactgtcggctcaagactccaggcactgcggggagaggaagtgcaagagcacgcagagtag

SEQ ID NO: 218455 - DNA, 654 bp, Artificial Sequence
  Description of Artificial Sequence: Synthetic coding sequence
gtgacacaggggcctcaggggttacgggcaagtggcaggagctgcgttgggcctttcctgagccacctaggacgcgatcggacaccaggtgtgctcacagagttgagatgcgtggtccccgcacggcttacagcgcttgagcggtcgagaaagcccagaggcagggggcgtggcaggtacattactctccttccagtgccggaagccgaccctatcctggagagagtccctcagcccgagttttgctcctgtgtaaattccatcagcaccctcgaacccgtgagcaggtgtcaaaggctgtctgagctgtaccttcgcagaaatagaatcccttcattggcagagctgttctatctgaaggggctaccacgtttgagggtgctatggcttgccgaaaacccatgctgtggcactagcccccataggtaccggatgaccgtgctccgtacgctccctagattacagaaactggataatcaggccgtgaccgaggaggaactctcccgtgccctgagtgagggggaagagattactgccgctccagagcgtgagggaactggtcatgggggaccaaaactctgttgtacactgtcctccctttcctcggcagctgagacagggcgtgacccactggatagtgaagaggaggcatag

SEQ ID NO: 218456 - DNA, 1128 bp, Artificial Sequence
  Description of Artificial Sequence: Synthetic coding sequence
atgaaactgacgagaaagatggtcctgaccagagcgaaagcttctgagctccacagtgtccgcaaactgaactgctgggggtctaggcttaccgatatatctatctgccaagaaatgcccagcctggaggtgatcaccttaagcgttaattcaataagtactcttgaaccagttagccgctgccagaggttgagcgagctgtacctgagaaggaatcgtattccctccctggctgagctgttttacctgaagggtctccccaggctgcgcgtgctgtggctggccgagaacccctgctgtggtactagtcctcacagataccgaatgaccgtgctgcgaaccctgccccgactgcagaaactcgataaccaggcagtgacagaggaggaactttcgagagccttgagcgaaggcgaggaaataactgcggctcctgagagggagggcactgggcacggcggtcctaagctgtgttgcactctctcatcgctcagttctgccgcagaaacagggagggaccccctcgattccgaagaggaagcgaccggggctcaggacgagcgtgggttaaaacctccttccagaggacagtttccttccctctccgcgcgtgacgcaagcagtagtcacaggggccgagtatccggtggccctctcggcgctgccgctgcctctgctcactgcacccactgcaccgagactgtaggcagagaacacggagcctctcaaggccctgtggggagggagcacggtgcctcgcaaggcttggaagaactgtgtccccgtggttcctgtgtgtgtggcagtgtgaacgctcatacaagggtgactcgagcgccacacggggcagtcctggcacctcagcccctcctgctgtcctggtctgtggagtgcgggccaggcccatgctgggctgagggcaatcgctcacacgtcgaagaggtgccccacacgcgtcctcaggcgggactgttatgtagtgactcccccagcgtgccgaacgtgctgaccgcaatcctccttttgctcagggagttggatgctgaaggactcgaggcggtccagcagaccgtcggtagtagactccaggcgctgaggggcgaagaggtccaggagcacgcagaatag

SEQ ID NO: 218457 - DNA, 807 bp, Artificial Sequence
  Description of Artificial Sequence: Synthetic coding sequence
atggcagccgttagagtcctggtagcttcccgcctcgccgctgcgtctgctttcacgagcctctctcctgggggaagaacaccatcacagagagctgccctccacctctccgtccctaggcccgcagctcgggtggctctggtgttgtcaggttgtggagtgtatgatgggacagagattcacgaagcgtctgctattttagtgcatctcagccgcggtggggctgaggtgcagattttcgcacccgatgtcccacagatgcacgtgatcgaccacaccaagggccagccatcagagggcgagagtcgtaatgtgctcacggagagcgcacgcatcgccaggggcaagatcactgatctggctaacctctccgccgctaatcacgacgcagccatcttccctggcggttttggtgcagctaagaatctgagcacattcgcagtggatggaaaggactgtaaagtcaacaaagaggtcgaacgggttcttaaggagtttcaccaggccggtaagccgatagggctttgctgtatcgcacccgtgttggctgccaaggtgctcagaggagttgaggtcacagttggacatgaacaggaggaagggggtaagtggccctacgccggaaccgctgaggccattaaagccctcggagccaagcactgtgtcaaagaagtcgtggaggctcatgtggatcaaaagaacaaggtcgtgacgacaccagcttttatgtgtgaaactgcactgcattacatccacgatgggatcggcgctatggtgagaaaagtcctcgagcttactggcaagtag

SEQ ID NO: 218458 - DNA, 714 bp, Artificial Sequence
  Description of Artificial Sequence: Synthetic coding sequence
atggcggctgtaagagtactggtggcctcccgcctggcggctgcgagcgcctttacgtcactgtcaccagggggaaggactccctcccagcgtgccgctttgcatctgagtgtgcctcgtccggctgcgagagttgccctggttttatctggttgcggagtttatgacggtactgagattcacgaagctagcgccattttggtgcacctatccaggggcggtgcggaggttcaaatattcgccccagacgtaccacagatgcatgtcatagaccacacaaaaggacagccttcagagggcgaatcgcgaaatgtcttgaccgaaagtgcgaggattgccaggggaaagatcacagacctcgcaaacttaagcgcagcaaaccatgatgccgctatctttcccggaggcttcggggcagccaagaatctcctgtgctgcatagctccagtattggctgccaaggtcctgaggggagtcgaggtcaccgttggtcatgaacaggaagaggggggtaaatggccgtacgctgggaccgcagaagccattaaggctctcggcgctaaacattgcgtcaaagaagtcgtcgaggctcatgtagatcagaagaacaaagtcgtgacaacacccgcttttatgtgtgaaaccgccctgcattacattcatgatggaatcggtgctatggtccgaaaggttctggaactgacgggaaagtag

SEQ ID NO: 218459 - DNA, 1023 bp, Artificial Sequence
  Description of Artificial Sequence: Synthetic coding sequence
atggctgaaggcggagaacttatgtcaaggctcctgagtgaaaacgccgatctgaaaaagcaggtcagattactcaaagaaaaccaaatgctccggagattactctcccagtcatgccaggagggaggcggacacgatctcctgccgcctagggcacatgcttatcccgaagcaggaagccccggaagtggagtacccgatttcgggaggttcacaagtgtcgcagacacgccttcacaattgcagaccagcagcctcgaggatcttttgtgttctcatgctccgctgtcctccgaagatgatacttcccctggatgcgcagcccctagtcaagccccattcaaggcattcctgagcccccctgagcctcattcacacagaggcactgaccgaaagctgagccccctattgagtcctcttcaggatagcctcgtggataagaccctgctggagcctagggaaatggtgcggcctaaaaaagtgtgcttcagcgagagctctctccctaccggcgaccggactaggaggtcctactacctgaacgagatccaatcattcgcgggtgccgagaaagacgcgagggtcgtcggggagatagctttccagctggataggcgcattcttgcctatgtcttccctggcgtgacacggctgtacggctttacggtggccaatattcctgagaagatagaacaaacttcaacaaagtcactggacggatccgttgatgaaaggaagctccgggagttgactcaacgatacctggctctgtcggcaagactggagaaacttgggtatagcagggacgtgcaccctgcattcagtgaatttctgatcaatacatacggcattctgaaacaacggccagatctgagggccaaccccctgcactctagccccgctgctttaaggaaactagtcatcgatgtcgtacccccaaagttccttggagattccctcttactacttaattgcctgtgtgagctgtccaaggaggacggaaagcccctcttcgcttggtag

SEQ ID NO: 218460 - DNA, 561 bp, Artificial Sequence
  Description of Artificial Sequence: Synthetic coding sequence
atggtgcggccaaagaaagtgtgcttcagtgagtctagccttcctaccggggaccggacccgacggtcttactacctgaacgagatacaatcctttgccggagcggaaaaggacgcaagggtggtgggggagattgcattccagctggaccggcgtatcctggcctacgtgtttccaggcgtgactcggctatacggttttacggtcgctaacatccctgaaaagatcgaacagacctccacgaagtccctggacggatctgtggacgaacggaagctgcgagaactcactcagaggtatttagccctgtccgcacggttggagaagcttggctattccagggacgttcaccctgccttctcagagtttttgataaatacctacggcatcctgaaacagcgccctgatttgcgtgccaaccccttgcacagcagccccgcagccttacgcaagcttgtaattgatgtggtgcctcccaaattcctgggggactctcttcttctcctgaactgtctctgcgagttatcaaaagaagacggtaaacccctgttcgcatggtag

SEQ ID NO: 218461 - DNA, 438 bp, Artificial Sequence
  Description of Artificial Sequence: Synthetic coding sequence
atggtccaactcatagctccactcgaggtgatgtggaatgaagccgctgacctcaaaccccttgcactgtcccggaggcttgagtgcagtggcggaatcatggcccactactcgcccgatctacttggaccagagatggagtctagatactttgcccaggtgggccttgagcatctggcctccagttcacctcctgcttttgggttcctcaagtgtttggactactctatctcggtgctatgttccgccacctccctcgcaatgctggaggataaccctaaggtatctaagctggctacaggcgactggatgctgacactcaaaccgaagagtatcaccgtgcctgttgagatccctagttcaccccttgctggcaggcccagaagacgccgacgattgaggtgcccccatgaccagcactctcagggcacgtgctag

SEQ ID NO: 218462 - DNA, 429 bp, Artificial Sequence
  Description of Artificial Sequence: Synthetic coding sequence
atgatttcgactgccagggtgcccgctgacaaaccggttcgtatcgctttctccttgaatgatgcgagtgatgacaccccgcctgaagatagcatcccactggtcttccccgagttggatcagcagctacagcccctgcctccttgtcacgactcagaagagagcatggaggtattcaagcagcattgtcaaatcgctgaagagtaccatgaagtgaaaaaggagattaccttgctcgagcagaggaagaaggagctgattgctaaactcgaccaagccgagaaagaaaaagttgatgctgccgagctcgtacgggagtttgaagccctgaccgaagaaaataggacattgcgcctggcccagagccagtgtgtagagcagttagagaagctgagaattcagtaccagaaacgtcagggctcctcttag

SEQ ID NO: 218463 - DNA, 729 bp, Artificial Sequence
  Description of Artificial Sequence: Synthetic coding sequence
atggttcagttgatagcccctttggaggttatgtggaacgaggcagccgaccttaagcccttggcactcagccgtaggctggaatgctccggtggtatcatggcacactactcccctgacctgttgggaccggaaatggagtcacgatacttcgctcaagtaggactcgagcatctcgcatcctcaagtcctccagccttcggattcctaaagtgtctggattacagtatctctgtgctgtgctcagccacgagcctggctatgcttgaggacaatccaaaagtctcgaagcttgccaccggtgactggatgcttaccctgaaacctaagtctattaccgtgcctgtcgaaatcccatcctctcccctggatgacactccaccggaagattcaatcccactcgtgtttccagaactggatcagcagctccagcccctcccaccttgccatgatagtgaggagtcaatggaggttttcaaacaacactgccagattgccgaggaataccatgaggtaaagaaagagattactctcctggagcagcggaagaaagagttgatagcaaagctggatcaggccgaaaaagagaaagttgacgcagccgagctcgttcgggagttcgaggctttgacagaggagaatcgcactctcagactcgcccaatcacagtgcgtcgagcagctcgagaagttacggattcagtaccagaagagacaaggcagttcctag

SEQ ID NO: 218464 - DNA, 429 bp, Artificial Sequence
  Description of Artificial Sequence: Synthetic coding sequence
atgatctcaaccgccagggtcccagcagataagcctgtgagaatcgctttctccctcaacgacgcgtcagacgatacacctcctgaagattcaattccgctggtctttccagaattagaccaacagctgcaacctctccccccttgtcatgattccgaggagtctatggaagtttttaagcagcactgccagatcgccgaggaataccacgaggtcaaaaaagagatcacattgctggaacagagaaaaaaagaactaattgcgaagttggatcaagccgagaaagagaaagtagacgccgctgagctcgtgcgagaattcgaggccctcacagaagaaaaccggactctgcgactggctcagagccagtgcgtggagcaactagagaaacttcgcatccagtaccagaagagacagggcagctcctag

SEQ ID NO: 218465 - DNA, 429 bp, Artificial Sequence
  Description of Artificial Sequence: Synthetic coding sequence
atgatttctacagccagagtacctgctgacaagccagttaggattgccttcagcctgaacgacgcaagcgacgatacaccgccagaggattcaatcccactggtctttcccgaattagatcagcagttgcagcctctaccgccttgtcatgactcagaggaaagtatggaggtctttaagcagcattgtcagatagccgaggaataccatgaggtaaagaaggagatcacgctgctcgagcaacggaagaaggagctcatagccaaactggatcaagccgaaaaggagaaagtggacgctgcagaactggttcgggaatttgaggcgttgaccgaagaaaatagaacactgaggctcgctcagagccaatgcgtggagcaacttgagaaactgagaatccagtaccagaagcgccaaggttcatcctag

SEQ ID NO: 218466 - DNA, 429 bp, Artificial Sequence
  Description of Artificial Sequence: Synthetic coding sequence
atgatttccacagctagggtgcctgcagataaacccgtgcgtattgcattctctttgaatgacgcctctgacgacactcccccagaagattcaatcccattggtattcccagaattagaccagcagctgcagcctttgcccccttgccatgatagcgaggagtccatggaagttttcaagcagcactgtcagatagcagaagagtaccatgaggtaaaaaaggaaatcacactcctcgagcagagaaaaaaggaactgattgccaaactcgatcaggccgaaaaggagaaggtcgatgctgcagagctcgtgagagaatttgaggcgcttacagaggaaaaccgcacactgcggcttgctcaatcccaatgcgttgaacagctagaaaagctccgcatccagtaccagaaaaggcagggcagctcttag

SEQ ID NO: 218467 - DNA, 429 bp, Artificial Sequence
  Description of Artificial Sequence: Synthetic coding sequence
atgatctctaccgcacgggttcctgcggacaaacccgtacgcatcgcattttctctcaacgatgcttccgacgacacacctcccgaggacagcatccctctagtgttcccagagctggatcagcagttacagcccctgcccccttgccacgattctgaagagtccatggaggtctttaaacagcattgtcagatcgcggaagagtatcatgaggtgaagaaggagattactctgctggagcagcgtaagaaggaattgattgctaagctcgaccaggctgaaaaggaaaaagttgatgccgctgagctggtgcgcgaattcgaggcccttacagaggaaaatcggaccctacgtctggctcagagccaatgtgtcgaacaactcgaaaagctcagaattcagtatcagaagcgacagggttctagttag

SEQ ID NO: 218468 - DNA, 429 bp, Artificial Sequence
  Description of Artificial Sequence: Synthetic coding sequence
atgatcagcacggcccgtgttccagctgataagcccgtccggattgcctttagtctgaatgatgcctctgacgatacccctcctgaggactcgatacccctagtcttccccgaactcgatcagcagttacagccattgccgccttgccatgactcagaggaatccatggaggtgtttaaacagcattgccagatcgcagaggagtaccatgaagtcaagaaagagatcacgttgctggagcagagaaagaaggaattaattgctaaactggaccaggccgagaaggagaaagtggacgcagcagagctggtgagagaatttgaggctctcacggaggagaatcgaacactgcggctggctcaaagccagtgtgtggagcagctggagaagctaaggattcagtaccaaaaacgacagggctcctcttag

SEQ ID NO: 218469 - DNA, 729 bp, Artificial Sequence
  Description of Artificial Sequence: Synthetic coding sequence
atggttcagttaatcgcccctttagaagtcatgtggaatgaagcggcagacctgaaaccattagccctctcaagacgactggagtgttccggcggtatcatggcccattacagcccggacctcctgggcccagaaatggagtcacgatacttcgcccaagtcggactagaacatctggcctcatcgtctcctccagctttcggtttcctcaagtgcttggactactcaatcagtgtactctgctccgccacctccctggcaatgctggaagataatcctaaggtgtcaaagctggccactggcgattggatgttgacattaaaaccaaaaagcatcactgtcccagtggagataccttcatcgccactcgacgacactccacccgaggattccatccccctggtcttccctgaactggatcagcaactgcagcccctgcccccttgccatgactccgaggagagcatggaagtgttcaagcagcactgccagattgctgaagagtatcacgaggtgaaaaaggaaattaccctgttggaacagaggaaaaaggagctgatcgcgaaactcgatcaggccgaaaaagagaaggtagacgccgcagagttggtcagagagttcgaggcacttacggaagagaaccgcacactgaggttggcccagagtcagtgtgttgaacagttggagaagctcaggatacagtaccagaagcgccagggctcctcttag

SEQ ID NO: 218470 - DNA, 135 bp, Artificial Sequence
  Description of Artificial Sequence: Synthetic coding sequence
atggtgcagctgatagcccctcttgaagtcatgtggaacgaggctgctgacctcaaaccactcgctctctccaggagactcgaatgttctgggggtattatggcccactattctccagatctcctgggaccttag

SEQ ID NO: 218471 - DNA, 285 bp, Artificial Sequence
  Description of Artificial Sequence: Synthetic coding sequence
atgataagcactgcacgagtcccagctgacaagcctgtgaggattgccttcagtctcaacgatgcaagcgacgacactccccctgaggattcaatccctttggtctttcccgaactggatcagcaactgcaaccgctgcccccatgtcacgattctgaagaaagcatggaagtcttcaagcagcactgccaaatcgccgaggaataccatgaggttaagaaggagattaccctgcttgagcagcgcaagaaggagctgatagctaaactggaccaggccgaatag

SEQ ID NO: 218472 - DNA, 411 bp, Artificial Sequence
  Description of Artificial Sequence: Synthetic coding sequence
atgctggtgagctcaagtagcctcacgccattccccccagtccggaccgccgatgacacccctccggaagacagcatcccactggtctttccggaactagatcagcagttgcagcctctccccccatgtcacgactctgaggaaagcatggaggtcttcaagcagcattgccagatagccgaggagtaccacgaagtgaaaaaagagatcactctcctggaacaacggaagaaagaactaattgctaaacttgatcaggccgagaaggaaaaggtggatgctgccgaactcgtgagggagttcgaggccctcacggaagaaaacagaacactgcgtctggcccagtcacagtgcgtggaacagttggagaagctccgtatccagtaccagaaacggcagggtagctcttag

SEQ ID NO: 218473 - DNA, 786 bp, Artificial Sequence
  Description of Artificial Sequence: Synthetic coding sequence
atggtggtagtagccgctgctcccaaccctgctgacggaacccctaaggtcctcctgttgtcaggacagccagcatccgctgcaggagcccctgcaggccaggcactcccccttatggtgcctgcacagcgcggtgcttctccagaagcggcttccggaggcctccctcaagcacgcaagaggcagcggctgacccacctcagcccagaggaaaaggccctgcgcagaaagctaaaaaatagagtcgccgcacagaccgctcgggatcggaaaaaggctaggatgagcgagttggaacagcaagtggtggacctcgaagaggagaaccaaaagctcctcctggaaaaccagcttcttcgtgagaagacgcacggcttggtagtagagaatcaagagctgcgccaaaggctgggcatggacgccttggtggccgaggaggaagcggaagctaaaggtaatgaggttaggccagttgccggaagcgcagaaagtgccgcactcagactgcgggctccactccagcaagtgcaagcccaactttcgcccctgcagaatatctccccctggatcttggcagtcctgactctccagattcaatccctaatttcatgctgggccttctggacgacctggactcagagttgtagctcaaatgcactgccccaatccctgcccgcttggaggagttcccagagatctacgcagaaagatcctgttccatatcagccaccattcctgtgccaatgggggcgacaccagcctagctggaagcccttaatgaattag

SEQ ID NO: 218474 - DNA, 528 bp, Artificial Sequence
  Description of Artificial Sequence: Synthetic coding sequence
atgtcgaggagctacaatgacgagctgcagtttcttgagaaaatcaacaagaactgctggcggatcaaaaaaggattcgtgccaaacatgcaagtcgagggagtgttttatgtgaacgacgctctggagaaactcatgtttgaagaactgcggaatgcctgtcggggaggaggtgtggggggatttctgccagccatgaagcaaattggtaacgtggcggcactgccaggcattgtccaccgaagcataggactgcccgacgttcactcgggctacggttttgcgataggtaacatggctgccttcgatatgaacgatcctgaggcagtcgttagtccaggaggagtgggcttcgacatcaactgcggtgtgagacttctgcgtaccaatttagacgaaagcgacgttcagccagtcaaagagcaactcgcccaggcgatgtttgaccatattcctgtaggggttggaagcaagggggacatgatgagggcagtgcactgtcccgaacagaacttggatgtgatatag

SEQ ID NO: 218475 - DNA, 2304 bp, Artificial Sequence
  Description of Artificial Sequence: Synthetic coding sequence
atgagccatgccgtgacaatcgaagagccacaagcccaacctcaggtcagccagacgagatacagagagagaagccgagccggatcccatatatcttctaatagagcgtacgacttcctctacgaccccttgtttatcgtatcctccgagaaagatcatacgcaggccaacatccaagcaaccctgattagatcacgcttaaggaaggtgccacgattcaaaaccatgttctcgaatttaatccattatcccagatatagcctatattggtccaagtccgatcccgtcccccctttcatctcccgagagtggaaggggcacaaggagaagcatagggaagcgctgcgccagttgacaaccactgatgccagcttccagatgcctaaagaagtatatgaagatcccgaggttacagggaagaaccgctataagtacttcgaacggccattcctcccttttttccagcagatgccctttaacgtagtttacgcagtgtcaaaagcagagccttacactttccccccaacatcaacaaagcacctgtcaattcccagcaagtccactgtgggcacccaaactgattaccgagatgccgacgttcagacggacccatattccgccgagtatgtggtctgccaggattctatcccagaactcttgacgctagccacactcacctggggtagagggttacctgcaggccaggccgaggtggaaatgatcgaacgtgccagggagaaacgagcctgggaagcttccctgccggcactctccgacacgtctcagttcgagaagcgccgaaaaatgatgaatgagatggaacggaaggagtgggccttccgcgagcaggagatcgagaaactacaagagatcaggctggaagtgctcaaggaactgcttaggaaacgtgaggaaaaccagaatgaggtgaatatgaaacatttaaacgcaagatggagtaaactgcaagagggcaaagaagctaagatggccaaaattcagaggacacacgtcagcacaattcgaaagctggtgggcaaacgcaagaacatcgaaggaaaactggagaggcggaacataatcaaagattactccgattatgcaagccaggtatatgggcctctaagccggttaggatgctttcctgataacaactctgaagatttcgtggtgaagaattactatctaaacacttacgagggcctggtcgagctggagagctgtctacccgacttcgtgacccagccccaaatacgggcacctaagccaaaagttattactaccaaggcaggattcctgaaacgagccgcacgtctcgactatgaactggccgaggtacataaagctttgctggataaaaaaaataaggtcctggaagtgaagaagcctccaaggttcttgcagcggaatccgataccacagccgcgactgccgacgcctaccctagagatgacgtccaacgaagaagaagagatggagatggctgtgatatatctgcagaagctcctacggggtagggtggtacagaatatgatgtttgagggcaaggagaagcgtctcgagctgatccaggagttacgcacttgccacgctctccaggaagacgaaaagctggtcaagaaagcagaaaagcaggtgaccctcgcactgcagcgtcagagaaatctgcatgaacacaaagtaagtctcgttgagaatcacttagccggactggagggtagagcgctcgcagatatgttcgactttctgtccaaggaactcgtgagactgcaggaggagagacgcatccacgcttttgtcatgttagctgaaaggcagagaagagtgagagaggccgaggagagcggcaggaggcaggtggaaaagcagaggctgcgggaggaagatgaaatcttcaaggaagtggtgaaggtacaccattctacaatatcctcatatttagaagacattattttaaatacagaggcaaacactgccgaggagcaggcccgagcagagattgaaaagatggctgagaagattaacgacattgcctacgaaatggagagtaggcgaacctacttgcagagcgaagaaatagtggctgagctggtctacagcttcctaatcccagaggtacagaagtacttcgtgaaagaaaaagttcgaaacgctcagaggaaacatatcctcgcggctcaccagattatacatagttacacagagagtatggtacaaaaaaaattgacggaaggcgaacaagatgaggccagcaatgccgctatgttactcgagaaggagacacagaatgagaataattcttag

SEQ ID NO: 218476 - DNA, 564 bp, Artificial Sequence
  Description of Artificial Sequence: Synthetic coding sequence
atgagccatgcggtgaccattgaggagccccaggcgcagcctcaggtcagccagacccgatacagagaacgaagtcgggctggctcgcatatttcaagtaatagagcctacgatttcctgtacgatccactcttcatcgtgagttcagaaaaggaccacactcaagcaaacatccaggctacgctgatccgcagccgactcagaaaagttcctaggttcaaaacaatgttttccaacttaattcattaccctaggtatagcctctattggtcaaaaagtgatccagtgcccccatttatcagccgggaatggaagggccataaagagaaacatagggaagccttgcgtcagcttaccacaactgatgcaagttttcaaatgccaaaagaagtctacgaggatcctgaggtaactggcaaaaaccgctacaaaggccagaaccacacactctttctgctgcttctgttgagtacctacccatccctccagagcctgctgtgggcgctccgcctgatcattggtatgctgaccttcaagcagatccacacattacaaaacatgtag

SEQ ID NO: 218477 - DNA, 717 bp, Artificial Sequence
  Description of Artificial Sequence: Synthetic coding sequence
atgagccacgccgtcaccatcgaagaaccacaggctcagccacaggttagtcagacccggtatcgagagcgcagcagggcaggcagtcatattagctccaaccgggcatatgacttcctgtatgacccgctgtttattgtcagcagcgagaaagaccacacgcaagcaaacattcaagcaaccctgatcagatccaggcttcgtaaagtgcccaggttcaaaacaatgtttagcaacctaattcattatccccgttacagcttgtactggtccaagtctgacccagttccccctttcatcagtcgggagtggaaggggcacaaggagaaacaccgggaagcactgagacagctaaccaccactgacgcaagcttccagatgccgaaggaggtatacgaagatcccgaggtgacaggaaaaaataggtataaatactttgagcgtccttttctgccttttttccagcagatgcccttcaacgtcgtctatgctgtgagtaaagctgagccgtacacatttcctcctacctctacaaagcatctgtccattccttccaagagcaccgtgggaacccagaccgactatcgggatgcagacgtccaaaccgacccctactctgcagagtatgtggtctgtcaagatagcatcccagaactgctgacactggcaaccctgacttggggagaactggttaacttactgaccattggacggtag

SEQ ID NO: 218478 - DNA, 654 bp, Artificial Sequence
  Description of Artificial Sequence: Synthetic coding sequence
atggacctggcccagccctcccagcctgtggacgaattggaactgagtgtcttggaacgacaaccggaggaaaacaccccattaaatggggctgataaggttttcccatcgctggatgaagaagtgcctcctgctgaggcaaataaagagagcccgtggtcgtcctgcaacaagaatgtggtgggccgttgcaaactctggatgatcattactagtatttttcttggagtgattaccgtcattatcatcggcttatgtctggctgccgtgacctacgttgacgaggatgaaaacgaaattctagaattgagtagcaataagaccttcttcattatgctgaaaatccccgaagagtgcgtggccgaggaagagctccctcatctgctgacagagaggctcaccgatgtctatagtacgtcaccttcactggggagatatttcacgtcggtggagattgtcgactttagcggtgaaaatgccacggtgacatatgaccttcagtttggtgtgccttctgatgacgagaacttcatgaagtacatgatgtctgaagagctggtactcgggattttgctgcaagactttagagatcagaacattccgggatgcgagtcactgggcttagaccccacctctctgctcttgtacgagtag

SEQ ID NO: 218479 - DNA, 444 bp, Artificial Sequence
  Description of Artificial Sequence: Synthetic coding sequence
atggatctcgcacagcctagccagcccgtggatgaacttgagttgagcgtgctggaacggcagcctgaagaaaatacacccctaaacggtgcagacaaggtgtttccaagtctcgacgaggaagtgcccccagccgaggctaataaggagtctccttggagcagctgcaataagaacgtcgtcggaaggtgcaagctgtggatgatcataacatcaatctttctgggcgtaataaccgtgatcatcattggcctctgcctggcagctgtgacctacgtggacgaggacgaaaacgagatacttgagcttagctctaataagactttctttattatgctcaagattcccgaggagtgtgtggccgaggaggaacttccgcatctcttgacagagagagaagttggactgaaacccaacccagaggccctggttgggttcgaatag

SEQ ID NO: 218480 - DNA, 753 bp, Artificial Sequence
  Description of Artificial Sequence: Synthetic coding sequence
atggaccttgctcagccttcccagccagtggatgagttagagctgagcgttttggagagacagccagaagaaaacacccccttgaatggtgccgacaaggttttccctagtttagacgaagaagtcccccctgctgaggccaataaggaaagtccctggagttcttgtaataagaacgtcgtgggcaggtgtaagctgtggatgatcatcacctctatcttccttggggtgattacagtgattatcattggtctgtgccttgctgccgtgacctacgtggatgaggatgaaaacgagatcctcgagcttagttcaaataaaacctttttcataatgcttaagattccagaagagtgtgttgccgaggaggaattaccccacctgctgactgaacggaatgaggtgatggaggctgggttgtgtctgaaggccgttctttaccaggtcttagagatgaaaggcatccacagcgttctccaaaagaggttctgcggcctcatccaaaagcatcaacagcaccagcgaggaggcgattcgtttttgagcaggttctactccctcgcattgtctccggtcaagcaactgccatctaccgctagtgcaggtagcagcctggataagggacgcaagcccgctcgcgtgggagcaataggcagtgccggtatgagccactgttggcgctctttggtgttttgtctgtttctcttctgtttcgtccttttctttgaaactggatccaggtccgtcgcctag

SEQ ID NO: 218481 - DNA, 1293 bp, Artificial Sequence
  Description of Artificial Sequence: Synthetic coding sequence
atgtggcggctcgttcccccaaagttgggccgactttctcggagtttaaagctagctgccctcggttccctgttggtactcatggtgctgcacagtcctagtctgttggccagttggcagaggaatgagctgacagataggcgttttctgcagctgaacaaatgccccgcttgtttcgggacaagctggtgtcgcagatttttgaatggacaggtggtttttgaggcctggggcaggttacggttactggatttcctcaatgtaaagaacgtctatttcgcccagtacggagaaccaagggagggtggtcggagacgcgtggtactgaaaagactcggcagccagcgcgagctcgctcaactagaccagagcatctgtaagagggccactggcaggccaagatgtgacctgctacaagccatgccccgaacggaatttgcgaggttgaacggggatgttcgcttgcttacgcccgaagcggttgagggctggtctgatctggttcactgcccttctcagagattgctggacagactggtccgaaggtatgccgaaaccaaagatagtggatcctttctgctgaggaacttgaaggactctgagagaatgcagcttctcttgaccctcgcctttaacccagaacctctcgtgctacaatcttttcctagcgatgagggttggccctttgccaaatatctgggggcatgtggacgcatggtggccgtgaattacgtgggcgaagaactctggtcttactttaacgctccatgggagaaaagagtggacctggcctggcaacttatggaaattgccgagcagctgacaaataacgactttgaatttgccctctatctcctggacgtgtccttcgacaattttgccgtgggccctagggatgggaaggtaatcatcgtggatgctgaaaacgtgcttgtggccgacaagcgtctgattcgacaaaacaagcccgagaactgggatgtttggtatgaatccaagttcgacgattgcgataaagaggcatgtctcagcttttctaaagaaatcctttgcgcccgtgccaccgtcgaccacaactactatgcagtatgtcagaatctcctgtctcggcatgccacctggaggggaacaagcggcggtcttctgcatgatcccccatctgaaatcgccaaagacggcagactggaagcactcctcgatgagtgtgccaacccgaagaagagatacggcagatttcaggcagcgaaagagctgagggagtatttggcccagctgtctaacaatgtccgttag

SEQ ID NO: 218482 - DNA, 666 bp, Artificial Sequence
  Description of Artificial Sequence: Synthetic coding sequence
atgaagagcgagaatggaactgtggtcggatcatttccttcagacgagggctggccctttgccaaatacctgggggcttgtggcaggatggtggctgtaaattacgtcggagaggagctctggtcttactttaacgctccgtgggagaagcgggtggacctcgcatggcagctgatggagattgccgagcagctaaccaacaatgatttcgaattcgctctgtatttgctggacgtgagcttcgacaattttgctgtgggccctcgcgatggcaaggtgatcatcgttgacgccgaaaacgtgctggtggcagataagcgattgatacgccagaataagcctgagaactgggatgtctggtatgaatcaaagttcgatgactgcgacaaagaggcctgcctgtcattcagcaaggagatcctctgcgcaagagcaacagtcgaccacaattattacgctgtgtgtcagaatctcctcagccgtcatgctacatggaggggtactagtggtggcctactgcatgaccccccatcagaaatagccaaggatggtagactggaggccttacttgacgaatgtgccaatccaaagaagaggtacggacgatttcaagccgctaaggagctccgtgagtacctagcacagctatctaacaacgtgcgctag

SEQ ID NO: 218483 - DNA, 5079 bp, Artificial Sequence
  Description of Artificial Sequence: Synthetic coding sequence
atgcgacgacccccaccactcgggcctacaaccgcctctgggccagagggaaatgttaggaatcttcaaaaaaggcaggcccctggtcctggtgccgcaggaggctgcggtccagaggctggcggttgcagggaaaacaagcaaaagcgtaggatggtcgccagagccacgcccggaagaggagaggtggagtcagataagtccgtggccgcaagcggcgcaggtaaagctgcaaggagacaggttgagggacgcaggggccctgtgtcacccagcgactcctcagatccgaggggcttagaggcagcgaaggaggccgagctgccactgcagactgagcgccatacaaaagagaaacgtaaagtaacggaggcatcatccgatgaccctcaaccaggactggacctcgtccgtaaagagagcctgaccagctcagaaagttttcaaaccgtcgagtgtttgcagagcctgggcaaggaatcaattatcgagggtattaagaggcggatccgcaacaaaaagttgaagagcctagagaatccccctctcaagatcacggagaacgaggccacgcagaatatcaaggtggagtttcaagatgagctctataagaataccccaaagtacagttgcaacatactctcccctgaggtggagaacaactccgttctcaaattgagagattgtaattgtttcccacactctaaaggctgtaacgacgagaacaacctgccatataaacctgacggcggatgtatgcatgttgctgagaacttttcaaaaaaggagaatttgcggagcctggccgagaaatccgacaccaacagcataccgcagctactccaaacggaagagaatgtcatgggggtcaacaagctcttgcctgaagaatccgacctttatcagagcaagacaaacggcctcctgtcttgtctgcaacacgagaaaaacaaatatagtatcgaggagagttctgtgggccgaaaacccagaaagcgcatgaaactgagtgagaaggccgatgagacggtgacggaaatgaacttttcaaacgaatacaacaagagtgagctgatgctccaggaaaatcagatgatcgccgacggaaaagaggctgagaccaaatccccgctgaacgtgctgagaaaggtgtcccacaacaccgtgagcctgatggaccacctgctttccgttcctgagactgtggaaaaggagaccagcagtgagcaccacgttaatgctgtatttcagaaaaccatcgagcccctcctcaaagaggagaccgagaacgctagcgaaccattaggttacgagagtatggctagcaaggaagacttcaagtccatgaagtccttcatcgggaagtcacccaacgaataccacatagagagaaggtctagccgcgaggacctgcggagtgcctcagaagagctgaaactgtcttgtcagcggaccatacctatgacaggcaagcgaacctggccatactacagttgcgccaggatctccgcctggtgctggaagaaggcttcacttccggagtcaagctactttttgcggggatcccaggagagttgccggcaggttgacgtgcctaagcaccagactaaccagacccatctgacagattctaagcttctgctgcagtcttctttgaccgagactaatacagaaagttcaagcaaggagaagctcgactcaaattccaattgcttatccagcgtaagcgctgtggagccaactctgatggtgatcaaagagccaataatcaaggacgataagaagatcaagtcagaggaactgagcaggaggggtagtgaggtcatatcaaacacaaccgaggacacacaattaacttctgaaacgcagtcccttactggtaataagaagaaagcgcgtggcaatttaacaaagttgaatctaaccgctacaagcaaggatggccaggaggccaacaactctgccggaaagacaatacacagaaaggcttgcatcgctcagcagacctttattgtgcctgatctagtgaaaatcctgaataccggaaggctgactaacttcaagatccccctgcttaagaacaaatcggagaagcgcaaagaggtcaatgcaaagtcttctgaacgagaggcgtatagccccctcgaactgttagataatttatccggcgctgatgtgaggcagaaccggtctaaggaaaatgtctcaatgatgatgctgggtccacaaacactgtccataaggaatagcgttacacccgtgcaggcttcttcagactctttctacaataagaaaagctactccataagccccagctttaccaagcagggcaataatagcaagccatctaaccatgtgtcggaaccaggcaatatcgtgagtaacaaggaagttgcatcacttaccgtcgaaaataacgccttctcttgcgacccagggtatgttgaaaagtcccctagcttctgttgtaacgagcaggaaacctttcgtcctgtgtcaagcgaggtccggggacggaaaattaccaagaacttttcggaagtggggttccctgacattctcaaagcctatgaggacgatgtactcttgattgacgtgatccaggacgatccagatttgtttggagtgagtaacgagggggagctatcatttactagcgaggtgccaaagattagtcaagagcccaatgtagccggtgagcatcagtccacagattcgaagtatatggaaacccctgttaagaaggagccctccgatgatcttcgggagttgcctgttctagattgcggctggattaaacccgacatttgcgcctcaaattcagcagagtcagagattaagcgtgaccccaaggatgtgaacacctctctgggcgaggtggccaatgagacctccgagaacgagactctgggcgatttctctgagcagatcaagggttcagacttggatgagaagcatcggtttactgataaagtgatcaccaaagaggagaaggaaaatatttacgaagtctgtaaatccaaagatagcagaaacgctgacttcatggttggcgaatgccagttcgctgtgcctgtaccaaagcctctgtgcctgctcgttcctccccttaatttatcgggacggcaggaggacaccattctcaatacttggatgaatgatttccgtttccttgggaagcactctgtccttaagcttcagaatccagagacttgcgagatttttaagcgggagaagaatgttggggttttccaaaagagcctcggattaatgattccctataagtattgcaaattccactttaatacattgcgcggatgcgagcggcctctctgcaaatttgcccatgtgcccgagcaaggagacgaaaaagtgtgtatggacgtatttaagaagtacatcaatattaatgagctttgtctgctgcaaagagccgttaacatctttatggagtattacagaaaattccctccaggagtgtactttgatctgcaggttctgaacgaccttctgaattctctgcttaagcactgcctgctgaaagaggtttttcagatagtcaacctgtccatcatggttaagatgctgccttcactcaagatactgctcaatattttcgagtatgtggcgactatgaagctccgaaacgctgttcctgcccttatcgacattttctgcaagctggtggaggcgggaatggtgctagatcccgaacacttcaattacatcgtgaaattgctttatcaggttcaggcgtccaaacaagaaattactgccgtgcttgaaatgaagtcccgactgcagatgcgcagattcaaaaagaactggaaatgtgacctagattcggctcttaacaaactcgaacactgcaaggagaagggggattggaccaagctgggaaagctttacattaacgtgaaaatggggtgcgaaaagttcgcagatttccaaacattttgtgcatgtattgcagagactctcaccaaaaactatgaggatgagaggcctgacatcccgttctgcgaatttgccgaaactgtgtctaaagacccccagaacagtaaggtggataaaggggtgctcggacgtatcggtatctctgcaatgtacttttaccacaaactgttgcaatggagtaagggacggaaagtccttgaaaaactgtatgagctgaagatacacttcacctccctcaagggactcattggaccagaaaagttagcatcacgttgtcagatcgtcaatgtggctgcagagatatttctgaaatctggttcactggatggagctatatgggtcatgagagaaagcgagtggattatcaacaccccactatggccttgcgatcgccttgacgttctgaacaggcacaacctcttgtgcactatcgcacacgagatcctggccaagagcttatataggcagacttttgaggtgttacagaatctgcccggattccagaatagccaagagacagtagaggtctctcaatattctttgttattcaataagctgctgggctcttgcatagagtctagctctttaggtatgtctagctccgtggctgagttcatgatctcaaaatctatacctatagacttctctttcctaaggcggctgatcacaagtctcggcagatctagactttggttaaaagcaagggctcattacaagtccgctctctcccttggctgctacccccctctggaagggaacctatatagaaaacttctcctgattcctagttatctgtcggagatcgaaatgttgttagcgattgaaatctttatggtgtctaacgctagttctatccaatctcctggaacatcaacacagattctacagatcgttcttaagcgctgtgaagacaatcagtcacggagcaacgacgactaccaggctgcagtcgaacgactgatcatggccgctagaattagcgacccaaagctgttcgttaagcatatgactgtgaacgtgaacaaggaacaagtgtacagtcttgagcactgttctgcactcaagtggctgaaagagaatatgaaatgggcaggaaaggtgtggttgttctccaaccactag

SEQ ID NO: 218484 - DNA, 207 bp, Artificial Sequence
  Description of Artificial Sequence: Synthetic coding sequence
atggtgtactatcctgaactgtttgtgtgggttagtcaggagccgtttcccaacaaagacatggagggcagattacccaagggccgactgcctgtgcctaaagaagtgaatcgcaaaaaaaatgacgagaccaatgctgccagcctcactcctttaggctcaagtgaactcagatcaccaaggatcagttacttacatttcttctag

SEQ ID NO: 218485 - DNA, 207 bp, Artificial Sequence
  Description of Artificial Sequence: Synthetic coding sequence
atggtgtattatcccgagctgtttgtgtgggtgtcccaagagccattccctaacaaggacatggaagggaggctgcccaaaggtcgtctacccgtgcccaaagaggtcaatcgaaagaaaaacgatgagactaatgctgcatcactgacaccattaggctcttccgaactccgcagcccacgcatcagttatctgcacttcttttag

SEQ ID NO: 218486 - DNA, 339 bp, Artificial Sequence
  Description of Artificial Sequence: Synthetic coding sequence
atgaaaggcgtttggaactattccgctctgagccgcagagaagacgagacacggacacaacggtctagaatgacagaccgggtgccttgtagcaaatgcttccaggtccactgtcaaatctctgtcctgaattgcgtttactatcccgagctgttcgtgtgggtgagccaagaacccttccccaacaaggatatggagggacggttgcctaaaggcaggctcccagtcccgaaggaggtcaataggaaaaaaaatgacgaaaccaatgctgcatctttaacccctctgggctcctccgaactcagaagcccacggatctcatatcttcattttttttag

SEQ ID NO: 218487 - DNA, 207 bp, Artificial Sequence
  Description of Artificial Sequence: Synthetic coding sequence
atggtgtactacccagaattgtttgtctgggtctcacaagagccgtttccaaacaaagacatggagggtagactccccaagggtcgcctcccagttcccaaagaggttaacaggaaaaagaacgacgaaacgaatgccgcttctctgacaccactcggcagtagtgaactgcgtagtcccagaatctcctatttgcatttcttttag

SEQ ID NO: 218488 - DNA, 207 bp, Artificial Sequence
  Description of Artificial Sequence: Synthetic coding sequence
atggtttactacccagagctgtttgtatgggtttctcaggagccgtttcccaataaggacatggaagggagactgccaaagggtcgccttcccgttcctaaggaggtgaaccggaagaagaatgacgagacaaacgctgctagtttgactcctcttggctcttccgagctgcggagccctagaatcagttacctccactttttctag

SEQ ID NO: 218489 - DNA, 207 bp, Artificial Sequence
  Description of Artificial Sequence: Synthetic coding sequence
atggtatattaccccgagctgtttgtgtgggtatcgcaggagccatttcccaataaggacatggaaggtagacttcccaagggaaggctgcccgtgccgaaggaagtgaaccggaaaaaaaacgatgaaacaaacgctgcctcacttactccactaggcagttccgaacttcgatcacctcggatcagctatctccactttttttag

SEQ ID NO: 218490 - DNA, 207 bp, Artificial Sequence
  Description of Artificial Sequence: Synthetic coding sequence
atggtgtattatccagaactattcgtgtgggtgtcgcaggaaccgtttccaaacaaagacatggaaggacgtctgcctaagggacgcctaccggttcctaaagaagtgaatcggaagaaaaacgatgaaaccaatgccgcaagtctaacgccgctcggctccagcgagttgcgctcgcctaggatctcatatttgcacttcttctag

SEQ ID NO: 218491 - DNA, 207 bp, Artificial Sequence
  Description of Artificial Sequence: Synthetic coding sequence
atggtttactacccagaattgttcgtctgggtctctcaggaaccattccctaacaaggacatggaaggtaggctgcccaaaggtcggctacccgtccctaaagaggtgaatcgcaagaagaacgacgaaactaacgccgcatccctgacccctctgggttccagtgagcttcggtccccgaggatcagctatttacactttttctag

SEQ ID NO: 218492 - DNA, 207 bp, Artificial Sequence
  Description of Artificial Sequence: Synthetic coding sequence
atggtctactaccccgaactcttcgtgtgggttagtcaagagccattccctaacaaggatatggaaggccgactccctaagggcagacttcccgtcccgaaggaagtgaatcgcaagaaaaacgacgagactaatgctgcaagcctgaccccgctcggtagtagcgaactccggagtcccagaatcagctacctccactttttctag

SEQ ID NO: 218493 - DNA, 18 bp, Artificial Sequence
  Description of Artificial Sequence: Synthetic coding sequence
atggtgtattatccctag

SEQ ID NO: 218494 - DNA, 102 bp, Artificial Sequence
  Description of Artificial Sequence: Synthetic coding sequence
atggtgtactaccctgaattgtttgtctgggtatcccaggaaccatttcctaataaagatatggagggccgtttacccaaggggcgactgcccgtaccatag

SEQ ID NO: 218495 - DNA, 207 bp, Artificial Sequence
  Description of Artificial Sequence: Synthetic coding sequence
atggtttattaccctgaactgtttgtgtgggttagccaagaaccctttccgaacaaggacatggaaggccgtctgcctaaggggcgtctccctgttcctaaggaggtcaatcgtaagaagaacgatgaaacaaatgccgcttcccttaccccacttggctcttctgagctccgatcccccagaatcagctatctacatttcttttag

SEQ ID NO: 218496 - DNA, 207 bp, Artificial Sequence
  Description of Artificial Sequence: Synthetic coding sequence
atggtgtactaccctgagctctttgtttgggtctcccaggaaccctttcccaataaggacatggagggcaggcttccaaaggggaggctgcctgtcccaaaggaggtcaatcggaaaaaaaatgacgaaactaacgctgcgtctctgacccccctgggttctagtgagctccgctcccccagaatatcatatctccacttcttttag

SEQ ID NO: 218497 - DNA, 198 bp, Artificial Sequence
  Description of Artificial Sequence: Synthetic coding sequence
atggtctattatcctgagctcttcgtttgggttagtcaggaaccttttcctaataaagacatggaaggacgtctgccaaagggtcggctgcccgtgccgaaggaagttaaccgtaagaagaacgacgaaaccaacgcagctagcttgaccccccttgggtcctccgagctgcgctccccgagaatcagctatttgtag

SEQ ID NO: 218498 - DNA, 735 bp, Artificial Sequence
  Description of Artificial Sequence: Synthetic coding sequence
atgcactacggggctgcgacgcacatccagaacagtcgcagccacggtcttgagacggtgcccggtcatcaacgtttggagcgaggagccggtggcgagactccagagtttcctggctgtcatagccccgcaccacctgaaaactttggcaacgagcttctgcctctcagtgcaccccttcagggtctgtcagaaggcctttacccgcctggacggaacaaaacactccccgctggcgtcctcagggagggtgcagtgcaattcttgcaccggggtctatgcaacagcaatctcagttccgaggcaagcgccagaccttcaggtacccaggacgagttgcattccagcaggcgaaaaacgggccagactcgtcgcgaaggagcgcgtaagcacttggtgtgctcctttagactgtacccctttacagtgcacacagtgtcacctggcaattcccatttagctctctaccaggtgtttaaggccgtgaaactctgccctagtgaaacaagcttttttctctcacggaagtcattaaaaagtagcgacccatggcacccaccgagtttgtcccccaactcctggaatcgccaggctgggttccgcgcttggagctctcatctgataagcctgtccctcacctgctcagacagtcagtccaggcgggtgagctcttcccaacagcctccgcttcactcactgtcatctcatcgcagagcggcacacgttcctgagtag

SEQ ID NO: 218499 - DNA, 480 bp, Artificial Sequence
  Description of Artificial Sequence: Synthetic coding sequence
atgtatcggaggaagtccgggtggactgggtgcgcgattacctgttccccctgcactgccatgacacagctgcggaattgcatgcgcctaagccgcagctgttctctgacctgggagaccccccgatggtatatggctggccgagtggcaacgtccaccagcggatgccactgttggatgtcaaggcgggatcttacgccactgccccacccctctgagccaggagtcttggattgtctgggaccctgtcacctcttgcccctgctgtcccccggtagtccttgttgggtgctggggctgcatttctcactgcatcctccatctgcagcttccgcttcccacgcgttgactatcacttccttgcccccaggcttgctgccatttgtcggcgtggagctgactgctcacccacaagcactgatgggcagaggctttccatccggaatgggagctgcaggcaggcatctctgttttctgtag

SEQ ID NO: 218500 - DNA, 480 bp, Artificial Sequence
  Description of Artificial Sequence: Synthetic coding sequence
atgtaccgcagaaagagcggttggaccgggtgtgccatcacatgctcaccatgtaccgccatgacccagctaaggaactgtatgcgactgtctcgatcctgctcactcacctgggagacaccacgctggtacatggccggtagggtggcaacctcaacctcagggtgccattgctggatgagtcggagggacttgaccccactgcctcatccttccgagcctggggtgttggactgtttagggccttgccacttactgcccctcctgagtccgggaagcccttgctgggtgctggggctgcacttcagccttcatccgcctagcgccgctagtgcctcccacgccctgaccattacttctttaccaccaggcttattgccttttgtaggagtggaattaacggctcatccacaggcactcatgggacggggttttcccagtggaatgggggcagcgggaaggcacctgtgcttcctgtag

SEQ ID NO: 218501 - DNA, 480 bp, Artificial Sequence
  Description of Artificial Sequence: Synthetic coding sequence
atgtataggcggaaaagtgggtggactgggtgcgcgatcacctgctccccatgcactgccatgactcaactcaggaattgtatgcgactgagccggtcatgctctctcacctgggaaacacccagatggtatatggccggaagggttgccaccagcacatcaggatgtcactgctggatgagtagacgggatttgacgcctctaccccaccctagcgaaccaggcgttctcgactgtttgggcccatgccacctgctccccctcctaagtcccggatcaccctgctgggttctaggactgcattttagtctgcacccccctagcgccgcttcagcgagccacgccctcactatcacttcgttaccccctgggctgctgcctttcgtcggggtggagttgaccgctcacccgcaggcactgatggggagaggtttccccagcgggatgggtgcagccggaaggcatctatgcttcctgtag

SEQ ID NO: 218502 - DNA, 480 bp, Artificial Sequence
  Description of Artificial Sequence: Synthetic coding sequence
atgtatcggaggaagtcaggctggaccgggtgcgcaatcacgtgcagtccctgtacggcgatgacacagcttaggaattgcatgagactatcccgctcttgcagcttgacatgggagactcccaggtggtacatggctggtcgcgtggccacaagcaccagcgggtgccactgctggatgagccggagggacctgaccccccttccccatcccagtgagcccggtgtcttggattgtctggggccttgccacctccttcccttgctttctcccggttctccctgttgggtgttagggctgcatttcagcctccatcctccatcagccgctagcgcaagccacgctttaacaatcactagccttcctccaggactgctaccattcgtgggagttgaactgaccgcccacccccaggccctgatgggacgtggcttcccatccggaatgggggctgccggaaggcacctgtgtttcctgtag

SEQ ID NO: 218503 - DNA, 294 bp, Artificial Sequence
  Description of Artificial Sequence: Synthetic coding sequence
atgtcttcagccccagaacctcccacatttaaaaaagagccccctaaagagaaggaatttcagtctcccggtcttagaggcgttcgaaccactacactgtttcgggctgtcaaccctgaactgttcataaagcccaataagccagttatggcattcggattagtcacgctgtcactgtgcgttgcatatattggctacctccacgccattcaggagaacaagaaagacctgtatgaagcaatcgatagcgaagggcactcatacatgaggcgtaagactagcaagtgggattag

SEQ ID NO: 218504 - DNA, 768 bp, Artificial Sequence
  Description of Artificial Sequence: Synthetic coding sequence
atgacaaaaacctccacttgcatctatcatttcctggtgctcagctggtatacatttctgaattactatataagtcaagagggcaaggatgaggtgaaaccgaaaattttggccaatggggctcgttggaaatacatgacactactcaaccttctgctccagacaattttttacggagtcacatgcctcgatgacgtgcttaaacgcacgaaggggggtaaggatattaaatttcttactgcttttcgcgatttactctttactacgcttgcgttccccgtgtccaccttcgtttttctcgccttctggattctgtttctgtataaccgcgatctgatttatccgaaggtgctggacactgtcatccccgtgtggctgaatcacgcaatgcataccttcatattcccgattacacttgcagaggttgtgctacgaccgcacagctatccgtctaagaaaactggcctgactctgttagctgctgctagtatcgcttatatctcaagaattctgtggctctacttcgaaaccggtacctgggtgtatcctgtctttgccaaactgagtctcctgggactcgctgctttcttctctctgtcgtatgtgtttatcgcatccatttatttgctcggagagaaactgaatcactggaaatgggtgagcgttcagattctgcagagatggcgccttgagagcgtgggaatttgctttcagtggcctgactggaagagtccagcgaagcaccagctcgttaaaaatatcagatag

SEQ ID NO: 218505 - DNA, 510 bp, Artificial Sequence
  Description of Artificial Sequence: Synthetic coding sequence
atgacaaagacttcaacctgtatctatcactttctcgtgctgtcctggtacacctttttgaactattatatctcccaggaaggcaaggatgaggttaagcccaagatcctggcaaacggcgcaaggtggaaatatatgaccctgcttaacctgttgctgcaaactattttctacggcgtcacatgcctcgacgacgtgctgaaacggaccaaaggcggaaaggatataaaatttctaactgccttcagagaccttctctttaccactcttgcctttcccgtgagtacctttgtgtttctggctttctggatattgttcctgtacaatagggatctgatctaccccaaagtactggataccgtgattccggtgtggctgaaccacgccatgcacacgtttatctttcccataaccctggctgaagtggtactccggccacactcatatccctccaaaaagactggactgacactgctcgcagcagcttctatagcctacatctcccggtag

SEQ ID NO: 218506 - DNA, 693 bp, Artificial Sequence
  Description of Artificial Sequence: Synthetic coding sequence
atgacgaagacttctacttgtatctaccactttttagttctatcatggtacaccttcttgaactactacatcagccaggaggggaaggatgaagtgaaacctaagatcctggcaaacggggcacgctggaagtatatgacactattaaatctccttttacagactatcttctatggagttacgtgtcttgatgacgtgcttaagcgtaccaaaggtggtaaagatatcaaattccttacagccttccgggacctgttgttcaccacgctcgccttccccgtttcaaccttcgtcttccttgctttttggattctgttcttgtacaaccgcgacttaatatatccaaaggtgctggatactgtcatacctgtctggcttaatcatgccatgcacacgttcatattccctatcacactggctgaggtcgtgctacgacctcactcctacccctcaaagaaaactggtctgactctcctggcagccgcttccatcgcctatatttcaaggatactctggctgtactttgagacagggacatgggtctacccagtatttgctaaactgagcctgctcggactagccgctttcttcagtcttagttacgtcttcatcgccagcatctacctgctaggagagaaattgaaccattggaaatggggggatatgagacagccacgcaagaaaagaaagtag

SEQ ID NO: 218507 - DNA, 507 bp, Artificial Sequence
  Description of Artificial Sequence: Synthetic coding sequence
atgactaagacctctacatgcatctaccactttctggtactgagctggtacacttttctcaattattatatcagccaggagggaaaagatgaagtgaaacctaagatattggccaatggagcccgatggaagtacatgacccttttgaacctcctgttgcaaacgatcttctatggagtgacctgcttggacgacgtactgaagcgcacaaaggggggaaaggacatcaagtttcttactgcattccgcgatttgttatttacgaccctggcttttcctgtctccaccttcgtgttcctggcgttctggatccttttcttgtataaccgggacttaatttaccccaaggtgctggatacggtcatcccagtttggttgaaccacgctatgcatactttcattttccccatcacacttgctgaagttgtcttacggcctcactcttatcctagcaagaagacaggcctgaccctcttggcggcagcctccatagcctacatttcatag

SEQ ID NO: 218508 - DNA, 675 bp, Artificial Sequence
  Description of Artificial Sequence: Synthetic coding sequence
atgtccttcgtggaggatgtgaccattggggagggcgaaagcatcccgccagacacacaattcgtgaaaacttggaggatccagaattctggcgcagaggcgtggccaccaggtgtctgcctgaaatacgttgggggagaccagtttggtcatgtcaatatggtaatggtgaggtccctggaaccccaggaaattgccgacgtcagcgtgcagatgtgtagcccctctcgggctggaatgtaccagggccagtggcggatgtgtactgccacaggcctttactatggggacgtcatatgggtcatcctctcagtggaagtagggggactgctcggtgtgacgcagcagctaagctcgttcgagactgagttcaatacccagccgcatcggaaagtagagggaaacttcaatccattcgcatctcctcagaagaacagacagtccgacgagaacaatctaaaggaccccggtggctccgagtttgattcaatctctaaaaacacgtgggctccagctccagacacatgggccccagccccagatcagactgagcaggatcagaatcgactgagccagaacagcgttaacttgagtccgtccagccacgcaaataacctgagcgtagttacctatagcaaaggcctgcatggcccttatcccttcggacagtcttag

SEQ ID NO: 218509 - DNA, 897 bp, Artificial Sequence
  Description of Artificial Sequence: Synthetic coding sequence
atggagggaatggatgtcgacctggaccctgagctgatgcagaagtttagttgtcttggaacaactgataaggatgttctcatttctgagttccagaggctcctaggatttcagttgaatcctgccggatgcgccttcttcttagatatgaccaactggaatctacaggccgctattggtgcgtactacgattttgaatcccccaatatatcagtgcccagtatgtccttcgtggaagacgtgactataggcgagggggagagtatacctcccgacactcagtttgttaagacctggagaatacagaactctggggctgaggcgtggcctccaggggtgtgtttaaagtacgtggggggtgatcagttcggacacgtcaacatggtgatggttcggtctcttgaacctcaggagattgctgatgtgagtgttcagatgtgttcgccttccagggcgggaatgtatcagggccagtggagaatgtgtacagccactgggctgtactacggcgacgtgatttgggtgatcctgtcagtggaagtggggggactgctgggagtgactcagcagcttagctcgtttgagactgagttcaatacgcagccccatcggaaagtggaaggaaacttcaatccctttgcttcgcctcagaaaaatcgccaaagcgatgagaacaacctcaaggatcccggaggcagtgaatttgacagcatttcgaaaaacacttgggcccctgctcccgatacatgggcacctgccccagaccagacagaacaagaccagaatcggctatcacaaaactccgtgaatctgagcccttcttctcatgccaacaacctttcggttgtgacttactcaaagggcctgcacgggccatatcccttcgggcaatcatag

SEQ ID NO: 218510 - DNA, 699 bp, Artificial Sequence
  Description of Artificial Sequence: Synthetic coding sequence
atggaggggatggacgtggatttggatcccgagctcatgcaaaagtttagttgtctcggcacaacggataaagacgtgttgatatcagaattccagcggctgctcggattccaactcaaccccgctgggtgcgccttctttctggacatgactaattggaacctccaagctgcaataggagcctactatgacttcgagtccccgaatatcagcgtcccctcgatgtccttcgtggaggatgttaccatcggagagggggagagcatacccccagacacccaattcgtaaagacatggagaatccagaacagcgacgtaatctgggttatcctgtccgtggaagtgggagggttactgggggtcacccagcagctttcctcctttgagaccgagtttaatactcagccccaccgtaaagttgagggaaatttcaatcctttcgccagtcctcagaaaaaccggcaatccgatgagaacaatctgaaggaccctggcggaagcgagttcgattcaatctccaagaatacctgggctcctgctccagatacttgggccccagctcccgatcaaaccgagcaggatcagaatcggctatcacagaactcagtgaatctcagccctagttcacatgcaaataatctgtctgttgtgacttattcaaaaggactgcatggcccttatccatttggacagtcctag

SEQ ID NO: 218511 - DNA, 126 bp, Artificial Sequence
  Description of Artificial Sequence: Synthetic coding sequence
atgggtgatatatacatcacttggattggatgtggtctagatcgcctccagtgggagaatgtatccgctatgattgaggaagtctttgaggcaacagacatcaagatcactgtgtataccttgtag

SEQ ID NO: 218512 - DNA, 459 bp, Artificial Sequence
  Description of Artificial Sequence: Synthetic coding sequence
atggcgagttccctgaatgaggatccagagggttctcgcattacgtatgtaaagggagacttgttcgcctgccctaaaaccgatagcctggcccattgcatttcagaggattgtcgaatgggagccggtatcgcggtgctctttaagaaaaagtttggaggagttcaagaattactgaaccagcagaaaaagtccggcgaagtggccgtgctgaaaagagatggccgatatatttactacctaattaccaagaagagggcctcccataagccaacttatgagaatctgcagaagtcgttggaggcaatgaaatctcattgcctcaagaatggtgtaacggacctgtccatgcctaggattgggtgcggcttggaccggctccaatgggagaatgtgagcgctatgattgaggaggtcttcgaagccacagacatcaaaatcaccgtgtataccttatag

SEQ ID NO: 218513 - DNA, 459 bp, Artificial Sequence
  Description of Artificial Sequence: Synthetic coding sequence
atggcctcctccctcaatgaggacccagaagggtccaggatcacctatgtcaaaggcgatttgttcgcgtgcccaaagactgattccctcgcccactgcatctcagaggactgtagaatgggtgctggtatagccgtacttttcaaaaagaaattcgggggagtgcaggagttactcaaccaacagaagaagagtggtgaggtggccgtccttaagcgggacgggaggtacatttactaccttattacgaagaagagagcatctcacaagcctacctacgagaatctccagaagtccttagaagcaatgaaaagccattgtctcaagaatggagtgacagatctgagtatgcctcgtatcggttgtggattagacagactgcagtgggagaatgtgtcagccatgattgaagaggtgttcgaagcaactgacattaagatcaccgtgtataccttgtag

SEQ ID NO: 218514 - DNA, 459 bp, Artificial Sequence
  Description of Artificial Sequence: Synthetic coding sequence
atggcctctagcctgaacgaagatcctgagggcagcaggatcacgtatgtgaagggcgacctgttcgcttgccccaagacggactccctggcacattgcattagcgaggattgtcggatgggtgcagggattgccgtgctgttcaagaagaaatttgggggtgtgcaagaactcctgaatcagcagaaaaaaagcggggaggttgccgttctcaaacgtgatgggagatacatctactacctgataacgaaaaagcgggcaagtcataagcctacttacgaaaatctgcaaaagagcctcgaagcaatgaagtcacactgcctgaaaaacggcgttacagatctgtccatgccaagaattggctgcggattagaccggctgcagtgggaaaatgtgagcgcaatgatagaggaagtgttcgaggcaaccgacatcaaaattacagtgtacacactttag

SEQ ID NO: 218515 - DNA, 459 bp, Artificial Sequence
  Description of Artificial Sequence: Synthetic coding sequence
atggctagcagcctgaacgaagatccagagggatcacgcattacttacgtaaaaggggatttgtttgcatgtccaaagaccgactcccttgcccactgcatatccgaggactgtcgaatgggcgcagggatcgcagtcctgttcaaaaaaaaatttggcggtgtgcaggagctgctgaaccagcagaaaaaatctggcgaggtggcggttctcaagcgcgatgggaggtacatctactatcttattaccaaaaagagagcttcacacaaacccacatacgagaatctgcagaagtcattagaagcgatgaagtcccattgcctgaaaaatggagtaactgatttatccatgccaaggattgggtgtggactggatcggctccagtgggaaaacgtgtctgccatgatagaggaggtgttcgaagccaccgatattaaaattaccgtgtatacactatag

SEQ ID NO: 218516 - DNA, 396 bp, Artificial Sequence
  Description of Artificial Sequence: Synthetic coding sequence
atggcatcaagcttgaacgaggacccagaagggtctagaattacctacgtcaaaggggacctgtttgcttgtcccaagaccgactccctcgcccactgtatctcagaagattgtaggatgggtgccggaatcgctgtgctgtttaaaaagaagtttggcggtgtgcaggagcttctgaaccagcagaagaaaagcggagaggtggcggtcttgaagcgcgatgggaggtacatttactatctgatcactaagaagcgggcaagtcacaaacctacctatgaaaaccttcagaaatccctcgaagcaatgaagtcgcactgcctgaagaatggagtcactgatctgtccatgcctagaattggctgcggcctagaccgtctgcagtgggaaaattag

SEQ ID NO: 218517 - DNA, 1371 bp, Artificial Sequence
  Description of Artificial Sequence: Synthetic coding sequence
atggaggcgctgggggatcttgaggggcctcgggctcccggtggagatgaccccgctggctctgcaggggagacacccggttggctttcacgagaacaggtctttgtccttatttcggcggcatctgtgaacctgggctcgatgatgtgttatagcattctcggtccgttttttcccaaggaagccgagaagaagggggcatctaataccatcatcggcatgatatttggttgtttcgctctttttgagttattggcctcgctggtgttcggaaattatctggttcacatcggagcaaaattcatgttcgtagctggcatgttcgtcagcggcggagtgactatattgtttggcgtgcttgacagggtacccgatgggcctgtttttattgctatgtgcttcttggtccgcgtgatggacgcagtgtcgttcgccgctgccatgaccgccagttccagcatcttggccaaggcatttcccaacaatgtggcaacagtcctgggatcgctcgagactttctccggcctggggctaattttagggcctcctgtcggcggatttctgtaccaatcttttggctatgaagtgccttttattgtcctgggttgtgtggtcttacttatggttcctcttaacatgtacattttacccaattacgagtcggatccaggggagcactctttttggaagcttatagctctgccgaaggtgggcctcatcgcctttgtaattaactcactttcgtcttgttttgggttcctggatcccaccctttccttatttgtgcttgaaaagttcaatctgccggctggttacgtgggcctcgtattcctcggcatggctttatcatatgccatcagcagtcctctctttgggttgctgtcggacaaaaggccacctctccggaaatggctgctggtgttcggaaacctgataactgcagggtgctatatgctgctgggacctgtccccatcttacatatcaaatcccagctctggctgctcgtgctcattctagtggtatccgggctctctgcagggatgtcgatcattcccaccttccctgagattctaagctgcgctcacgaaaacggatttgaagaaggtcttagtaccctgggtctggttagcgggcttttctccgcaatgtggtcaatcggcgctttcatgggcccaacactgggaggctttctttacgagaaaatagggtttgagtgggcagcagcaattcaggggctgtgggccctgatcagcggcctggctatgggtctcttctatctgctcgaatactctcgcagaaagcgttccaaatcccagaacatattgagcacagaggaggaaagaaccactctgttgcccaacgaaacctag

SEQ ID NO: 218518 - DNA, 324 bp, Artificial Sequence
  Description of Artificial Sequence: Synthetic coding sequence
atggaggccctgggcgatctcgaagggccaagggcccctggaggtgacgatccagctggttccgctggagagacccctggctggctcagcagggagcaagttttcgttctgatcagtgcggcatctgtgaatctagggtccatgatgtgttatagcatattaggtccgttttttccaaaagaggcagagaaaaagggcgcttctaacaccattatcggaatgatatttggattccagttcactagttggatttgcgggacttccatacccggatacggaaccgtgctgtgtcaccttttcaccacaatctggagtccgaaatag

SEQ ID NO: 218519 - DNA, 324 bp, Artificial Sequence
  Description of Artificial Sequence: Synthetic coding sequence
atggaggctctgggcgacctcgaagggcctcgggcaccaggcggagacgacccagccggttctgccggtgagactcccggatggctaagcagggagcaagtgttcgtcctgatttcagcagcctctgtgaatctgggttctatgatgtgttattccatcctcgggccattttttcctaaagaagctgagaaaaaaggagcctctaataccattatcggaatgatcttcggattccagttcacttcctggatatgcggcacgagcatcccaggctatggcaccgtgctgtgtcaccttttcaccaccatttggtcccctaagtag

SEQ ID NO: 218520 - DNA, 711 bp, Artificial Sequence
  Description of Artificial Sequence: Synthetic coding sequence
atgttctgttttgtgagagtggcaggtatactgggtatctggaaattgtcttgtacctactggagcaagatctacgtatgttccaggaacgtgtgtctaagacgctcgtacaatagcctgtggggcagcttggaaacgttctctggacttggactaattcttggcccaccagtggggggatttctctatcagtcctttgggtacgaggtcccttttatcgtcttaggctgcgtggtactgcttatggttccactgaacatgtacatcctgccaaattacgagagtgacccaggcgagcattcattttggaaacttattgcgttaccaaaggtggggctgatcgctttcgtaatcaatagcctgtccagttgcttcggatttctcgacccaaccctgagtttatttgtcctagagaaattcaacctgccagctggttacgtcgggctggtgttcctgggaatggctttgagttacgccatcagtagtccactgttcggcctcctgtcagacaagcggcctccgctgcggaagtggttattggtgtttggcaatctgatcacagctgggtgctatatgctgctgggacccgtgccaattctacacattaagagccagttatggctgctggtgctcatcctggtggtgtccgggttgtcagcaggaatgtccatcattcccacatttcccgagatcctctcttgcgcccagtag

SEQ ID NO: 218521 - DNA, 654 bp, Artificial Sequence
  Description of Artificial Sequence: Synthetic coding sequence
atggatgctccgaggcgctttccaactctggtacaactaatgcagcccaaggctatgcctgtggaagtgctgggccacttacccaagcggttttcttggttccatagtgaattcctgaaaaatcccaaagtcgtgagattagaagtttggttggtagagaagatcttcggcagggggggagaaaggatccctcacgtccagggtatgtcccagattttgattcacgtaaacaggcttgatccaaatggggaggccgaaatactcgtgtttggaagacccagttatcaagaagacaccattaaaatgattatgaaccttgccgactatcaccgccagcttcaggctaaggggtccgggaaggccttggctcaggacgtcgctacccagaaggctgaaacacagcggtcctcaatcgaggtcagagaggcaggtacccagcgtagtgtcgaggtgagagaagccggaactcaacggtccgtggaggtccaggaggtcggtacacagggctcacctgttgaagttcaggaagccggaactcaacaaagcctgcaagcagctaataagagtggcacacagaggagtccagaagccgcatccaaagctgtgacccagaggtttagagaggacgcacgggatcccgtgacaagactatag

SEQ ID NO: 218522 - DNA, 1416 bp, Artificial Sequence
  Description of Artificial Sequence: Synthetic coding sequence
atgccttcagagacccatgcaatgctcgctacgctagccagggttgctgccctcagacggacctgccttttctctggtcgtggaggtggacgagggttgtggactggaagacctcagtctgacatgaataatatcaaaccactggaaggcgtaaaaattctcgatctgacgagggtgcttgctggcccatttgccaccatgaacttaggggacctgggagccgaagtgataaaagtggagcggccaggcgctggggacgatactcgtacgtggggccctcctttcgtgggaaccgagagcacttattacctgagtgtaaatagaaacaaaaagtccattgccgtgaatatcaaggatccaaagggagtgaagataattaaggagctggcagcagtgtgtgacgtcttcgtggagaattatgtgccagggaaactttctgctatgggcctgggttatgaagatatagacgagattgctccccacataatctactgctccatcaccggctacggacagactgggcctatcagccagagagctggatacgatgctgtggcctcggcagtatctgggttaatgcacatcaccggcccagagaacggcgacccagtccgaccaggtgtggcaatgaccgatctggccacaggactgtatgcttatggtgccatcatggcagggctgatccagaaatataaaacgggtaaaggcctgttcatcgattgcaatctgttgagtagccaggtagcctgtctgtcccatattgccgctaactatctgatcgggcagaaagaggccaaacgatggggtaccgcccacggatcaatcgtcccctatcaagcattcaagaccaaagatggctacatcgtagtgggcgcaggcaataaccagcagtttgcaaccgtgtgtaaaattctggacctgccagagttgatcgataactcaaagtacaagacgaatcacctaagagtgcacaaccgtaaggaactgatcaagattctttctgagcgtttcgaagaagaactgaccagcaagtggctgtatctcttcgaggggtccggggttccctatggccctattaacaacatgaagaatgtttttgccgaaccgcaaaatgctgtgtcaggctttcagtccctcctgcatagcctggctcacggccctttcctgcacctgcagggatctgccagagtactccacaacggacttgttatggaaatggaacatccaaccgttggaaagataagtgtgcccggaccggctgtccggtattcaaagtttaagatgagtgaggcccgtccacctcccctactgggccaacataccacacacatcctgaaagaagtgctgcggtatgacgacagagccatcggcgagctcctgtcagcaggagttgtggatcaacacgagacacactag

SEQ ID NO: 218523 - DNA, 1338 bp, Artificial Sequence
  Description of Artificial Sequence: Synthetic coding sequence
atgccaagcgagacccacgccatgctggctacgctggcccgagtcgccgctttgcgtagaacatgtcttttcagcggtcgtggcggtggccgaggcctgtggactgggaggccacagtctgacatgaacaatataaagccactggaaggtgtgaagatactggatttgactcgagttctcgccggtccgtttgctaccatgaatctaggcgacctgggagccgaagtgataaaggttgagcgtcctggtgctggtgatgacacacgcacgtggggacccccttttgtgggaaccgagagtacatactacctcagcgtgaaccgaaacaagaaaagcatcgctgtcaatattaaggatccaaaaggagtcaagatcattaaagagctggccgctgtctgtgacgtctttgttgagaattacgtgcccggaaaactcagtgccatgggtctcggctacgaagatatagacgagatcgccccacacattatttattgtagtatcaccggttacggccaaacaggccctatcagccagcgggcaggctatgatgccgtggctagtgctgtgagcggactcatgcacattaccggtcccgagaatggcgacccggtccgccctggagtcgccatgacagaccttgccactggactctatgcatacggcgctataatggcagggctgatacaaaaatacaagaccggtaagggactttttatcgactgtaatctgctgagtagccaagttgcgtgcttgtctcatattgcagcaaactatttaatcggacagaaggaagctaagaggtggggaaccgcccacggaagcatcgtgccttaccaggcctttaagacgaaggacgggtatatagtggtgggggctggtaacaaccagcagttcgctaccgtctgtaaaatcctcgaccttcctgagttgatcgacaactccaagtataagaccaaccatttaagagtgcacaatcgaaaggagctgatcaagatcttgtccgagaggtttgaagaggagctcacgtctaagtggttgtatctgttcgaggggtctggggtgccatacgggcctataaataatatgaagaacgtttttgcagaaccccaagtcctacataacggccttgttatggagatggagcacccaacggtcggcaagatttcggtgccagggcctgccgtgaggtacagcaaattcaaaatgagcgaggcccgtccccctccactgttgggccagcacaccactcatattctcaaggaagtgctacgctatgatgatcgagctattggtgaattgctgtcagcaggggtggttgaccagcacgaaacacattag

SEQ ID NO: 218524 - DNA, 609 bp, Artificial Sequence
  Description of Artificial Sequence: Synthetic coding sequence
atgctggcaaccctcgccagagtggctgcactcagaagaacatgccttttttcgggtagagggggaggcagaggtctctggacaggcaggccacagagcgacatgaataacatcaaacccttagagggcgtgaaaatactggatttgaccagagtcttggccggaccctttgccactatgaatctgggcgacttgggtgcagaagtcattaaagtggagcggccaggcgcaggagacgatacgcgcacctggggacccccattcgtcgggactgagtctacatattatctgagtgtgaacagaaacaagaaatccatcgccgttaatattaaggacccaaaaggcgtgaagatcattaaagagttggccgctgtctgcgatgtctttgtggaaaactatgtgcccggaaaactctccgcaatgggccttggctatgaagatattgacgaaattgctccacacattatatattgcagtattacagaaaaggggtttagccatgtagcccaggatgggctggacctccagacgtcttctaacctgcctgccctggtgtcccagtcagcaggaatcacaggtatgtcacacagagcatggcctacttcatag

SEQ ID NO: 218525 - DNA, 1194 bp, Artificial Sequence
  Description of Artificial Sequence: Synthetic coding sequence
atgcctagcgaaactcatgcgatgctggccaccctggccagagtggctgctctcaggagaacctgtctgttctctgggagaggcggaggaagaggactgtggactggccgaccccagtctgacatgaacaatattaagccattggagggtgtcaaaatcctggatctaaccagagtgcttgcgggaccattcgccaccatgaacctaggggatttaggcgctgaggtgatcaaggtggaaagaccaggggcaggcgatgacacccgcacttgggggcctcctttcgtgggaaccgagagcacttactatttatcagtgaatcgaaacaagaaatccattgcagtaaatattaaggatcccaaaggagtgaaaattatcaaggagctagctgccgtttgtgatgtatttgtggagaattatgtccctgggaagctttctgcgatgggacttggatacgaagacattgatgagatcgcccctcacatcatctactgcagcatcactgggtacgggcaaaccggcccaatcagccaacgcgctggctacgacgccgtcgcctcagcggtctcaggcctcatgcatatcacaggacccgaggtcgcttgtctgagccacatagccgctaactacttgataggccagaaggaggcaaaaagatggggaaccgctcatggcagcatcgttccatatcaggcattcaagactaaggatgggtacatcgtggtgggcgcagggaataaccaacaattcgccactgtatgcaagattttggacctacccgagctcatagacaacagtaagtataaaactaaccatttacgtgttcataataggaaggaactcatcaaaatccttagcgagcgttttgaggaggagttaacctcgaaatggctgtacttgtttgaaggcagtggtgtaccctatggtcctatcaataacatgaagaatgtgtttgccgagccacaggtccttcacaacggcctcgttatggagatggagcatcctaccgtcgggaaaatctccgtgcctgggcctgctgtgagatacagcaagttcaaaatgagcgaagctcggccaccacccctcttgggccaacacactacccacattctgaaagaggtgctgcgatatgatgaccgcgcaatcggcgaactgctatccgctggcgtcgtggatcaacacgaaacccattag

SEQ ID NO: 218526 - DNA, 540 bp, Artificial Sequence
  Description of Artificial Sequence: Synthetic coding sequence
atgcagaggcagaattttcgccctccgacccccccttatccaggaccaggcggtggagggtggggttcaggatcttctttcagaggtactcctgggggtggcggtcctaggccccctagtccaagggatggatatggcagcccgcaccacaccccaccttacggcccaagatccagaccatatggctcttctcattccccaaggcatggcggttcgtttccaggagggcgttttgggtcccctagtcctggaggatatccagggagctatagtcgatcccccgctggcagccagcagcaatttggctattccccaggacaacagcaaacccacccacaaggatccccaaggacatcaacacccttcgggtcaggccgagtccgggagaagagaatgtccaacgaactagaaaactactttaaaccatcaatgctggaggatccgtgggccggtttggaacctgtgagcgtcgttgatatctctcagcagtactccaatacccagactttcacgggcaaaaagggacggtatttctgttag

SEQ ID NO: 218527 - DNA, 480 bp, Artificial Sequence
  Description of Artificial Sequence: Synthetic coding sequence
atgaaaatagtcgacgagagagaaaaaaatttagacgataaagcataccggaacatcaaggaacttgaaaactacgcagaaaatacacaatccagtcttttgtatttaaccttagagattctcgggatcaaggatctgcatgctgatcacgccgctagtcatattggcaaagcccaggggattgtgacatgtttacgagccacgccctaccacggttcccgcagaaaggtttttctgcctatggacatttgcatgctgcacggtgtaagccaggaggattttcttagaaggaatcaggacaaaaatgtaagagatgtgatctacgatattgcctcacaggcccatctgcacctcaagcatgcacgctccttccacaagaccgtgccagtcaaagctttccccgctttcctgcagacagagatcaaggatgccgatacccagggcgtctgtttagcacagcccgcatctctggggaaatag

SEQ ID NO: 218528 - DNA, 1002 bp, Artificial Sequence
  Description of Artificial Sequence: Synthetic coding sequence
atggcggcaagcgcgcacggaagtgtctgggggcctttgcggttgggcatacctggtctctgttgcaggcggcctccgctgggactgtacgcacgcatgaggaggcttcctggcccagaggtgtctggccgatcagtggccgcagcctccggacccggagcatggggcacggatcactactgccttgaacttctgcggaaaagagactatgaagggtacttgtgttcactgctactgcccgctgagagtagaagttccgtctttgctctgcgcgctttcaatgtggaactcgcccaggtaaaggactctgtatcagagaaaacgataggattaatgcgaatgcagttttggaaaaaaacagtggaggacatctactgcgataaccctccccaccaacctgtggccatagaactgtggaaagctgtcaaacgtcataatctcactaagcgctggctgatgaaaattgtagacgagagagagaagaatctcgacgataaggcttaccgcaatataaaggaactagaaaactatgctgaaaacacccagagcagtctgctgtatttgaccctcgaaatcctcgggattaaagacctccatgcggatcatgcagcatctcatatcggcaaagcacaaggcattgtgacatgtctcagggctacaccgtatcatggaagtaggcggaaagtctttttaccgatggatatctgtatgttacacggcgtgtcccaggaagacttcctgagaagaaatcaagataaaaatgtgagggatgtaatatatgatattgcgagccaggcgcatcttcacttaaaacacgccagaagcttccataaaaccgtgcccgtaaaagcctttccggcttttcttcagacagtgtcgctggaggacttcctgaaaaaaatacagagagtcgatttcgacatcttccacccctctctgcaacagaagaacaccctgctccccctgtacctgtacattcagagctggaggaagacgtactag

SEQ ID NO: 218529 - DNA, 846 bp, Artificial Sequence
  Description of Artificial Sequence: Synthetic coding sequence
atgccgatctccattagccacagctcctggctggtacaacgaaagcgcgactacgagggttatttgtgttcgttactgcttccagccgagagtagatcatctgtcttcgcactgagggcctttaatgttgaactagcgcaggtcaaagacagcgtcagcgaaaagaccatcggtctgatgaggatgcaattttggaagaaaaccgtggaagatatctactgtgacaatccgccacaccaacctgtcgccatcgagctctggaaggctgtcaagcggcataacctcaccaagagatggctgatgaaaatcgttgacgaacgggaaaaaaacctagatgataaagcatacaggaacatcaaagagctggaaaactacgcggagaatactcaatcatccttgctgtatcttaccctggagatactcggcatcaaggatctgcatgctgaccacgccgcttctcatataggcaaggcccaggggatcgtgacttgtctccgagccactccataccacgggtcgcgacggaaggtcttcttgccaatggatatctgtatgctgcacggagtgtcccaagaagattttttgcgcagaaatcaagataagaatgtgcgggatgtgatttatgatatcgcctcgcaggcccatttgcatctcaaacatgcacgatctttccacaagacagttcctgtgaaagcctttccagcattcctccagaccgtaagcctggaagatttcttgaagaagattcagcgcgtggactttgatatcttccatccgagcctgcagcaaaagaacaccctgttaccattgtacttgtacattcagtcttggcgcaagacatattag

SEQ ID NO: 218530 - DNA, 321 bp, Artificial Sequence
  Description of Artificial Sequence: Synthetic coding sequence
atgaaggcaaagagaagccaccaggccgttattatgagtacctctcttcgcgtgagcccaagcatccacggctaccacttcgatacagcgtcgagaaaaaaagccgtcggcaatatttttgagaacacagatcaggagagcctggaaaggctgttccgtaactcaggcgacaagaaggcggaagagagagcgaagattatcttcgctattgatcaagatgtggaggaaaaaacaagggcactgatggcgctgaagaagcggacgaaggacaagttgttccagttccttaaactgcgaaaatattccataaaagttcattag

SEQ ID NO: 218531 - DNA, 1185 bp, Artificial Sequence
  Description of Artificial Sequence: Synthetic coding sequence
atggcgggagctgcaatggcggagaggggacgcgtgcccccacctgcacctgccccttccacagagggtttacctagggccttcttgcagtcacttaggacactgttcgacattctggacgatcgcagaagagggtgcgtccacctgagagaaattgagagtaggtggcaagggaccgacgctcgggaattaccacggggagtcttagaaggacttcgccaggtggcgccagccagtggatacctgacctttgagagattcgtagctggcctcaggacctccttgttgagcgcagatgggggacccagggatcccactagggcaccagcacgcccaggcgatcaaccgcctccaccaccacaaagattggtgttcgctcccgctgacgaaccacgcacagtgctggagagaaagccactgccactgggagttagagctcccctcgctggaccaagtgcagcagcgcgttcccccgaacagctctgtgcgccagccgaggccgcaccatgtcccgctgaaccggagcgttcccagagtgccgctctggagcccagctcctcagccgatgctggggctgtggcctgtcgagccctggaggcagactcaggcgacgccaggcgagcacctcgtgcaagaggggagagacggagacacacaatcgcaagcggggtggattgcggcttgcttaagcaaatgaaggaactcgagcaggaaaaagaagtgctcttacaaggcctggagatgatggcccgaggaagagattggtaccagcagcaactccagcgagtgcaggaacgacagcgcagacttggtcagtccagggcatcagctgacttcggagctgctggctcacctagaccgctagggaggctgctacctaaagtgcaggaagttgcccgttgccttggtgaactcttggcagcagcttgtgcgagcagggccctgcccccttccagcagcggtcccccttgcccagccttaacctccacttctccaccggtgtggcaacaacagacaatactaatgctaaaggagcagaataggctcctgactcaggaagtcactgaaaagagcgaaagaattacccagctcgaacaggaaaagagtgctctgataaaacagctgttcgaagcacgcgctctctctcaacaagacggagggccactcgactcgactttcatttag

SEQ ID NO: 218532 - DNA, 1035 bp, Artificial Sequence
  Description of Artificial Sequence: Synthetic coding sequence
atgagacgacccaggcagggaggcggtggggctggaggctccgccgcagcacgcgctcgcgcagggggtctggggggaggctctgtgcctgcgagggccagaggcgctccagctgctgctagggctgcatggctccgcgatctgtgcgcgagaatggcgcgtcctcccaggcagcacccaggggtatgggctagcctactcctgctgctactgacaggcccagccgcatgcgccgcatcacccgcagatgatggagccggtcctggtggacgcggacctcgaggacgtgcacgtggggacaccggagccgacgaagccgtacccaggcatgattcatcgtacggcaccttcgccggagagttttacgatctgcgttatttgagcgaggaggggtacccctttcccacagctccgcctgtagatccattcgccaagattaaagtcgacgactgcgggaagacaaaaggttgtttccgctatggaaagcccggatgtaatgctgagacgtgcgactactttctctcatatcgtatgattggcgctgatgtggaattcgagctatctgcggacactgatggttgggtggccgtgggttttagctccgacaaaaaaatggggggagatgatgtaatggcttgcgtgcacgacgacaatggtagagtgcgaattcagcatttctacaacgttgggcaatgggcaaaggaaatacagcgaaatcccgctcgtgacgaggagggcgtatttgaaaataatcgagtgacgtgtcggttcaagcggcctgtcaacgtgcccagggacgaaacaatcgtggatctgcacttgtcgtggtactatctcttcgcctgggggccagccattcagggctccataacacgacacgatattgattcacccccagcgtcagaacgggtggtctccatatacaagtacgaggatatctttatgcctagcgccgcttaccagaccttctcttctcctttctgtctgctcctgattgttgcgttgacattctaccttttgatgggaaccccgtag

SEQ ID NO: 218533 - DNA, 393 bp, Artificial Sequence
  Description of Artificial Sequence: Synthetic coding sequence
atgtcttcatccgggggtgcccctggtgcttcagcgagctccgcccctcctgcccaggaggagggcatgacctggtggtaccgttggttgtgccgcctaagtggtgttttaggagctgtatcgtgcgcaatctcaggactgtttaactgcatcaccatacacccactaaatattgccgctggcgtctggatgatgatggccgtcgttccaattgtcatctccctgacccttacgaccttgctggggaatgcgatcgctttcgctacaggcgtcttatatgggctcagcgctcttggcaagaaaggggatgctatctcctacgccaggattcaacaacaaaggcaacaggcagacgaggagaaactggccgaaacgctcgaaggagagctatag

SEQ ID NO: 218534 - DNA, 519 bp, Artificial Sequence
  Description of Artificial Sequence: Synthetic coding sequence
atgtcctcatcaggaggggctcccggtgccagcgcgtccagcgcaccccctgctcaggaagagggcatgacatggtggtataggtggctctgtcgactgtctggagtccttggtgctgtgtcttgcgcaatatcagggctgtttaactgtattactatacaccccttgaacatagctgcaggagtatggatgatcatgaacgcatttattctgttactgtgcgaggcaccattctgctgccagtttattgagtttgctaacactgtggccgaaaaggttgatcggctccgctcctggcagaaggcagttttctactgcggaatggctgtggtcccaatcgtcatttcgctgacgctgactaccctattaggaaacgcaatcgcattcgccacaggagtgctctatgggctctcagcattgggcaagaagggagacgcaatcagttacgcacggatccagcagcaacggcagcaggctgacgaggaaaaattagccgaaactctcgagggggagctttag

SEQ ID NO: 218535 - DNA, 345 bp, Artificial Sequence
  Description of Artificial Sequence: Synthetic coding sequence
atgctcacagctgcaggttcaacagccgaactctctgcgtgtgccatctccggactgtttaattgcatcacaattcatcctctaaacatagcggctggtgtgtggatgataatgaatgcctttatactgctgttatgtgaggcacccttttgttgtcagtttatcgagtttgcaaacaccgttgctgagaaggtggatagacttcgctcctggcagaaggccgtcttttattgtggaatggcggtcgtcccgattgttatctcattgactctgacaaccctgctcggcaatgctattgcttttgcaaccggggtgctctacggcctttctgctctcggcaaatag

SEQ ID NO: 218536 - DNA, 489 bp, Artificial Sequence
  Description of Artificial Sequence: Synthetic coding sequence
atgagctccagcgctccacccgcacaggaagagggtatgacttggtggtatagatggctttgtagattaagtggagtgctgggggctgtcagctgcgctattagcggactcttcaattgcataactatacacccacttaacattgcagcaggggtttggatgataatgaatgctttcatcctcctgctgtgtgaggcccctttctgctgccaattcattgaatttgccaacacagtagccgagaaggtcgacagactccgttcctggcagaaggctgtgttttattgcggaatggccgttgtgccaatcgtaatttccttgactctgaccacactcctgggcaatgctatagcctttgcaaccggtgtgctttacggcctctctgctctgggaaaaaagggggacgcaatatcctatgcaagaatccagcagcagcgccagcaggctgatgaggaaaagttggccgagaccttagagggcgaactgtag

SEQ ID NO: 218537 - DNA, 702 bp, Artificial Sequence
  Description of Artificial Sequence: Synthetic coding sequence
atgagttcttccggcggagctccaggggcttcagctagctcggccccacctgcccaggaagagggaatgacttggtggtaccggtggctttgcaggttatccggcgtcctgggcgcagtatcctgcgccatcagtgggctgtttaattgcatcaccatccatcccctgaatatcgctgccggagtgtggatgatcatgaacgcatttatcctcttgttatgcgaggcccctttttgctgtcaattcatcgagttcgcaaatacggtcgcagaaaaagtggataggctgcggagctggcagaaggctgtgttctactgtggaatggcagtggtccccattgtaattagtttaacgttgaccaccttattgggcaacgccattgccttcgccacaggtgtcctgtacggtctgagtgcgctaggcaagaaagcacaaactgaggccggttccttcgccgcacagcatccccgagagccaggccctttcagtgagggcactcgacaggcctttgcgacacccgctgtcgtctcaggtgagatcagaatgcctgcaggcgcaatgaggagccctatgccgggatcctcatctcgtggttcgaggaggatgagaaggagcagtaggcggccatggcggggtagctgcgaagggttgggagcaccgccaagtctctctccgctcctggccctgtgcggtagcaaatag

SEQ ID NO: 218538 - DNA, 576 bp, Artificial Sequence
  Description of Artificial Sequence: Synthetic coding sequence
atgagctccagcggaggcgcaccaggcgcttccgcttcaagcgccccacccgcacaggaagaggggatgacatggtggtaccggtggctttgtagactctctggtgtcctcggagcagtgagctgcgcgattagtggattatttaattgtattaccatccatcccctgaacattgctgctggcgtgtggatgatgatggcagtggtgcccatcgtgatcagcctgacgctgaccaccctgctcggcaacgcaattgcctttgccaccggggtgttatacggcctgtcagcgctagggaagaaagcacagaccgaggcaggcagctttgccgctcagcaccccagggaaccgggaccattcagcgagggcacgcgtcaggcctttgccactcccgctgtcgtgagcggcgaaatcaggatgcctgctggtgcaatgagaagccctatgcccggttcctcttcccgagggagtcgtcgcatgcggaggtcttctagacgaccttggcgcggaagctgcgaaggcctgggagcacccccttccctgagccctctcctggccctctgcgggagcaagtag

SEQ ID NO: 218539 - DNA, 669 bp, Artificial Sequence
  Description of Artificial Sequence: Synthetic coding sequence
atgtcaacactatgcccccctccaagccctgctgtagccaagacagaaattgcgttaagcggaaagagccccctgctggctgctacttttgcctattgggacaatattttaggccctagagtccggcatatttgggcaccaaaaactgagcaagtcctgttgtcagatggggagattacttttctggctaatcacacgctcaacggcgagatccttcgcaatgcggaaagtggagccatagatgtgaagttctttgttctttcagagaaaggcgtcatcattgtgtccctgatcttcgacggcaactggaacggcgataggagcacgtatgggttgtctatcatcctcccccagaccgaactgagtttctacctgcccctgcatcgggtatgtgtcgaccgcctgacacacatcatccgcaagggacgcatttggatgcacaaggaacgccaggagaacgtgcagaagattatcctggagggaacagagcggatggaggatcaaggacaatccatcattcctatgctgaccggggaggtcattccagtgatggaactgctgagctccatgaagtcgcactctgtgcccgaagaaatcgatatcgctgatactgtcctgaatgacgacgacatcggagattcgtgccacgaggggtttctgcttaaatag

SEQ ID NO: 218540 - DNA, 669 bp, Artificial Sequence
  Description of Artificial Sequence: Synthetic coding sequence
atgtcaacgctctgcccacctccaagcccagccgtcgcaaagactgagatcgccctctcaggcaaaagtccattactggcagctacgttcgcctattgggacaacatcttggggccacgcgtgcgtcatatttgggcaccgaagactgagcaggtgttgctttctgatggagagatcacgttcctcgcgaaccacaccctgaatggggagatcctgcggaacgccgaatccggggctattgatgttaagtttttcgtgcttagcgagaagggagtcatcattgtgagtctcatctttgatgggaattggaacggcgataggagcacttatggattatcaattatcctacctcagacagagctgagcttctacttgccgcttcacagagtttgtgtggaccggctgactcatatcatccgcaaggggaggatatggatgcataaagaaagacaggagaacgtacagaaaataatccttgagggtacggagagaatggaggatcagggacagtcgatcatccccatgttgacgggggaggtcatcccagttatggaactcctgtcttctatgaaaagtcactctgtgccagaggagattgacattgcggatacggtgcttaatgatgatgacataggggacagttgtcatgaggggtttctgctcaagtag

SEQ ID NO: 218541 - DNA, 1446 bp, Artificial Sequence
  Description of Artificial Sequence: Synthetic coding sequence
atgtccactctgtgtccacctccaagccccgctgttgccaaaaccgaaatcgcgttatccggcaagtcacctctattagccgcaacatttgcttactgggacaacattctgggtcccagagtcaggcatatctgggcccctaaaacagagcaggtgctgctctcagacggagagataaccttcctggccaatcacacattgaacggcgagatcttgcgcaatgccgagtcaggggctatcgatgtgaagttctttgtgctgtccgagaagggcgtcatcattgtgtctctcattttcgacggcaattggaatggagataggtctacttatgggctcagtattattctgcctcaaacggagctctccttttacctacctctgcatcgcgtctgtgtggataggcttacccacatcatcaggaagggacgcatttggatgcacaaggagcgacaggagaacgtgcagaaaataatccttgaaggaacagagcggatggaagatcagggtcagtcaatcattcctatgctgacgggtgaagtcatcccagtaatggagttgctctcatctatgaaatcccacagcgtccccgaagaaatcgacattgctgataccgtcctgaacgatgacgacataggcgatagctgtcacgagggattcttactcaatgctatttcatcgcatttgcagacttgcggatgtagcgttgttgtaggctcctctgccgagaaggtaaacaagatcgtgcgaaccctctgtttattcctcacaccagccgaaaggaagtgcagcagactctgcgaggcagaaagttcgttcaagtacgaaagcggtctgttcgtacaaggcctgctgaaggactctactggctccttcgtactgccctttcgccaggtaatgtacgcgccttaccccaccactcatattgatgtggacgtgaataccgtgaagcagatgcctccatgtcacgagcacatctacaatcagaggcgctatatgcggtccgagctgaccgctttctggagggcgactagtgaggaggacatggcccaagataccatcatttacaccgatgagtcctttaccccagacctgaatatattccaggacgtgctgcacagggatacgctcgtaaaggcttttctggaccaggtatttcagttaaaaccaggcctctccctccgttccaccttcttggcacagttcttactcgtactgcacaggaaggccttgaccctgattaagtacatagaggacgacacacaaaagggtaaaaaaccgtttaagtcccttcggaatctgaaaatcgacctggatctcaccgctgaaggtgatctgaacatcattatggccctggccgagaaaatcaaacccggactgcacagctttatttttggccgtccgttttatacttccgttcaggagcgtgatgtgctgatgactttttag

SEQ ID NO: 218542 - DNA, 168 bp, Artificial Sequence
  Description of Artificial Sequence: Synthetic coding sequence
atgcaaaaccagtcctctactaatcatcctggcgctagcatgctgatgcacatacatctcgacacttccagtctgaaaaccctccatctgggaacactctttttcctgttttatctggccctgacccaaaatgaagaaaacatatgcgatggcaaagtgacgctctag

SEQ ID NO: 218543 - DNA, 225 bp, Artificial Sequence
  Description of Artificial Sequence: Synthetic coding sequence
atgcagaatcaatcgagcacgaaccaccccggagcctccattgccctttctcggccaagcctcaacaaggattttagggaccacgctgagcaacagcacatcgctgcccagcagaaagctgcactgcagcacgcccacgcccatagctccggctactttattacccaggattctgctttcggtaacctgatattaccagtcctccctagactcgaccctgagtag

SEQ ID NO: 218544 - DNA, 168 bp, Artificial Sequence
  Description of Artificial Sequence: Synthetic coding sequence
atgcagaaccagagttccaccaaccacccgggtgccagcatgctgatgcacatccatcttgacacaagcagcctcaaaaccctacatctcggtacgctcttctttctgttctatctggcgctgacacagaatgaggaaaacatttgcgatgggaaagtgaccttatag

SEQ ID NO: 218545 - DNA, 315 bp, Artificial Sequence
  Description of Artificial Sequence: Synthetic coding sequence
atggcggcaaactctagcgggcaggggttccaaaacaagaacagggtggccatacttgccgaattagacaaggaaaagaggaagctcttaatgcagaatcaaagcagcaccaatcaccccggagccagtatcgccctctcccgcccttcactgaacaaagattttcgcgaccacgccgaacaacagcacatcgccgcacagcaaaaagccgcactgcagcacgcccacgctcacagctctggatattttattacccaggatagcgccttcggcaacttgatcctgcccgtgttgcccagactcgacccagaatag

SEQ ID NO: 218546 - DNA, 2190 bp, Artificial Sequence
  Description of Artificial Sequence: Synthetic coding sequence
atgttcagcgccctcaagaagctggtcgggtctgaccaagcacctggaagagataagaatatccctgctggtttacaatcgatgaaccaggccctgcaacgcagattcgctaagggtgtgcagtacaatatgaaaatcgttatccgaggcgaccggaacactggcaagacagctctctggcaccgcctgcaaggcaggcccttcgtggaagagtacatacccacccaggagatccaagtgaccagcattcattggagctacaaaactacggatgacatcgtcaaggtcgaagtgtgggatgtggtcgacaagggtaagtgcaagaagaggggcgacggcttgaaaatggaaaatgatccacaggaagccgaatccgaaatggccctcgacgcggagtttctcgatgtgtataagaattgcaacggcgttgtgatgatgttcgatatcacaaaacagtggactttcaactatattctgcgagagctccccaaggtgcctacccatgtgcctgtgtgcgtgctcggcaactatagggacatgggagagcatcgggtgatcctccctgatgatgtgagagattttatcgacaacctggacagacctcctggctcctcctactttcggtatgcagagtcttccatgaaaaactcattcgggctgaaatatctacacaaattcttcaacatccctttcctgcaacttcagagagagaccttactgcgtcagctggagactaaccagctggatatggatgctaccctcgaagagctgagcgtgcaacaagagactgaagaccagaattacgggatcttcctggaaatgatggaagccaggagtcgtggccatgccagccccctagccgctaacggtcagagtccttctcctggtagtcagagccccgtcgtgcccgcaggcgctgtgtctaccggttctagttcacccggaacaccccagccagcaccgcagttaccactgaacgcagcaccgccttcttccgtgcctcctgtgccaccgtctgaggcccttccaccgcctgcctgtccatcagcacccgctcctcggagaagtatcatctccaggctctttggcacgtctccagcaactgaggccgcacccccacctccggaacctgtgcccgcagccgagggtcccgcaacagtgcaatctgtcgaagatttcgtgcctgatgaccggttggacagaagttttttggaggataccacaccagctagagatgaaaaaaaggttggtgccaaggccgctcagcaggacagcgactctgatggggaagccctagggggtaacccaatggtggcgggtttccaggatgatgtggacttagaagatcagcctcgaggcagtccacctctgcctgccggaccagtgccctcacaggacatcaccctgtccagcgaggaggaggctgaagtcgccgctcccacaaagggcccagcgcctgcaccgcagcagtgcagcgaacctgagaccaaatggagctcaatacccgcaagcaaaccaaggcgcggaacggcacccacccgcaccgctgctccgccttggcccggaggtgtcagtgtgcgcacaggacctgagaaaaggagctccacacgaccgccagccgagatggagccgggtaaaggggaacaggcctccagcagcgaatccgatcccgagggcccaatcgctgcccagatgttgtcatttgtcatggatgacccagatttcgagagtgaaggctctgacacccagcggagggccgatgactttcctgttcgtgacgatcccagcgacgtgaccgatgaagatgaaggacccgcagaaccgccaccccctccaaagctacctcttcctgcttttagattaaaaaatgactctgacctttttgggctgggcctagaggaggctggcccaaaggagtcttccgaggaaggcaaagaaggaaagaccccctctaaggagaagaagaaaaaaaaaaaaaaaggaaaagaagaagaagaaaaggccgcaaagaaaaagtcaaagcacaaaaagagcaaagataaggaagaggggaaagaggaaagaaggaggaggcagcagagacctccacgcagcagagagcggacagcagccgacgagttggaggcgtttctaggaggcggagctcccggaggtcgccatcccggtggcggtgactatgaggagctgtag

SEQ ID NO: 218547 - DNA, 1563 bp, Artificial Sequence
  Description of Artificial Sequence: Synthetic coding sequence
atgttctccgcgctgaagaaacttgtaggctccgatcaagcccctggtcgggataagaacattccagctggactgcagtcaatgaatcaggctctacagcggaggtttgccaagggcgttcaatacaacatgaagatcgtgattcggggtgacaggaacactggcaaaaccgcactctggcaccggctgcaggggagaccctttgtagaggaatacatccctacacaggagattcaggtgaccagtatccactggtcatacaaaaccaccgatgatatcgtgaaggtggaggtttgggatgtcgtagataagggcaaatgtaaaaaaaggggagatgggctgaagatggagaatgatccccaagaggcagagagtgagatggcgctggatgcggagtttctcgacgtttacaagaattgcaacggtgttgtgatgatgttcgacattactaaacagtggacattcaactatattttaagggagttaccgaaggtaccaacccacgttccagtttgtgtgctgggcaactatagggatatgggagagcatcgggtgattttgcctgacgacgtgcgggatttcattgacaacttggacagacccccaggtagctcctattttaggtacgcagagtctagcatgaaaaactcttttggtctaaaatatttacataagttcttcaatatacccttcctccaattacagagagagacgttacttaggcagctcgagacaaatcagctggacatggacgccaccttagaggagctgagcgtacagcaagagaccgaagatcaaaattacgggatctttttagagatgatggaggctagaagcagggggcacgcctctccactggcagctaatggacagtccccaagccccggttcccagagccccgtggtaccggctggtgcagtttccaccggcagtagctctcctggtaccccccagccggctccacagctgccactaaacgctgccccaccatcgtcagtgccgcctgtcccgccatcagaagctttgcccccacctgcgtgtcctagtgcgcctgcaccacgtagaagtataatatctcgtccgccaccatggggctggaggcttaggggcgctctaggccgaaggggacagtggccaccctggggtggcggacgcgcttgtcactgcctgggaagacacctcccgctgtaccacagactgtgcagatgtcccgtggcggcagtgtgcgcctcggagctcgaagaggccggtcattggtggtcccccggttgggcgttgcaggttctcggtcttcaggcccaatgcgagccggctctacaggagggccgtggacagctggcgagcgctcgcctgggcggacaccccggtccgctgggggcagaaccacccgtgtttttaagggacgtaaccgaggcgcaggagggtccggtgagggtctgtctgcagagacttgggagaggcagattagcagtcggctgcgctctccctcggcatctgttggcattacgcgctcacctgggacctcagcatgcctatgggtccgcgtcagggagagaaccctag

SEQ ID NO: 218548 - DNA, 2193 bp, Artificial Sequence
  Description of Artificial Sequence: Synthetic coding sequence
atgttcagcgccctgaagaagttagtgggcagcgaccaggcgcctggacgcgataagaatataccagccggattacagtcaatgaatcaggctctccagcgccgtttcgccaagggtgttcagtataatatgaagattgtgatccggggagacagaaatactggcaagacagctctgtggcacaggctgcagggccgtccatttgtggaggaatacatcccaacccaagagattcaagtcacgagcattcactggtcatacaagaccaccgacgacatcgtcaaggttgaagtgtgggacgtggtggacaaagggaagtgcaagaaacgtggagacggtctgaagatggagaatgatcctcaagaggcagaatctgaaatggcccttgatgcagagttcctggacgtatacaagaattgcaacggtgtcgtcatgatgttcgatataacaaagcagtggacgttcaactatattctccgcgagctacctaaggtgcctacacacgtgcccgtatgcgtgctgggaaactatcgcgatatgggtgagcacagagtgatcctccctgatgatgttcgagattttatcgacaacctggattcaaggcctccaggttccagctactttcggtatgcggagtcttcaatgaaaaatagcttcggcttaaagtacctccacaagttcttcaacatcccattccttcaattacagagggagaccctgctgcgacagctggaaactaaccagttagatatggacgccactctggaagaattatcagtgcagcaggagacagaagatcagaattacggcatcttcttggaaatgatggaagccaggtcccgcggtcatgctagccccctggccgctaatggacagtcgccctcacctggctctcagtctcctgtggtacccgcaggggcagtatctactggttccagctcacccggaaccccccaacccgcacctcagcttcctctgaacgccgctcctcccagctctgtcccccctgtgcctccaagcgaagctctgcctcccccagcttgcccttctgcacccgctccacggaggtcaatcatttccaggttatttggcacttcacccgcaaccgaggccgcaccccctccgccagagcccgtacctgctgcagagggcccagcaaccgtgcaatctgtggaggattttgttccggatgacaggctagatcgtagcttcctggaggacaccacccctgctcgtgacgagaagaaggtgggggctaaagccgctcaacaggactccgactcggatggggaagccctaggcggaaatccgatggtcgcaggcttccaggatgacgttgaccttgaagatcagcctcgtggatccccgcctctgcctgctggcccagtacctagccaggacatcaccctgtccagcgaagaggaagctgaggtggccgctcccacaaaaggccctgcccctgcgcctcagcagtgcagcgaaccagaaaccaaatggagttctatccccgcatcgaagcccagacgaggcacggcaccaactcgcactgctgccccaccatggcccggtggcgtcagcgtccgcaccgggccagaaaaaagatccagtacacgcccaccagcagaaatggagcccggaaaaggggaacaggccagttcgtcggaaagtgatccagaaggcccaattgcagcacagatgctatccttcgtgatggacgaccccgacttcgaatccgaaggctcggatacacagagaagagccgacgattttccagtgagagacgacccgagcgatgttactgacgaagatgaagggccagcggaacctcccccacccccaaagctacccctccctgcgttcaggctgaagaatgacagcgatctgttcggtttgggccttgaggaagccggacccaaggaatcttccgaagaaggaaaggagggaaagaccccttccaaggaaaaaaagaagaagaagaagaaagggaaggaggaagaggagaaagctgctaagaagaaatccaagcataaaaagtccaaggataaagaggaaggaaaggaggagcgcagacggcgtcaacaaaggcccccaagaagcagagaacgcacagccgctgatgagctggaagctttccttggcggaggtgctcccggagggagacatccaggcggtggagactatgaggaactctag

SEQ ID NO: 218549 - DNA, 945 bp, Artificial Sequence
  Description of Artificial Sequence: Synthetic coding sequence
atgttcagtgccctaaaaaagctcgtgggaagtgaccaagcaccaggcagagacaagaatatacctgccggattacaatcaatgaatcaggccttgcagcggcgattcgctaagggcgtccaatacaacatgaaaatagttattcggggtgaccgcaatacaggaaagaccgctctgtggcatagacttcaggggcgaccctttgttgaggagtacatcccaacccaggagatccaggtcacctcaatccactggtcttacaaaacaaccgatgatatcgtgaaggtcgaagtatgggacgtggtcgataaaggcaagtgcaagaaacggggtgacgggctgaagatggaaaatgacccacaggaagccgagagcgagatggcgctcgacgcagagtttctggacgtctataagaactgcaatggggtagtgatgatgttcgacatcactaagcagtggacgttcaattatattctgagagagctgcctaaggtgccaacccatgtgcccgtgtgcgtccttggcaactaccgagacatgggcgagcacagggtgatccttcccgacgacgtgagggattttattgacaatctggaccgtcctcctggctctagctactttcgctacgccgagagttctatgaagaacagctttgggctgaagtatttacacaaatttttcaatatccccttcctccaactgcagaaagatgtgcgtctggcccaggaacggggatgcgccgtggtgctagtctcagaggaagtgcgaatgccagctgggtgggattgttgttggggaaggctgggctggaaagagggcggttcccaaacctgccctgtgcctgcccttctggggaggcctttactccccgcagaaccttctccccaccattgggtggactacagtctcgagtcgagccccctgctgagttgttccataccctag

SEQ ID NO: 218550 - DNA, 1566 bp, Artificial Sequence
  Description of Artificial Sequence: Synthetic coding sequence
atgttctctgccctcaagaaactcgtgggttcggatcaagcacctggccgtgacaagaacatccctgccggtctgcagtctatgaaccaggcgctccaacggaggttcgccaagggggtccagtataacatgaaaattgtgattaggggcgaccgcaacacggggaaaactgctctctggcaccgactgcaggggaggccatttgtcgaagagtacattcctacacaggaaattcaggtgaccagtatacattggtcctacaaaaccactgatgatatcgtgaaagtggaagtgtgggacgttgtggacaaaggcaaatgcaagaagcgcggagacggtctgaaaatggaaaatgaccctcaggaagcagagtccgagatggcacttgacgccgagttcctggacgtgtacaaaaactgtaatggcgtagttatgatgttcgatattactaagcaatggaccttcaattatattctccgtgagctgcccaaagtccccacccacgtgcccgtctgcgtgctcggtaattaccgggacatgggtgaacaccgtgttatactgcccgacgatgtgcgtgatttcatcgataatctcgactctcgccctcctggctccagctatttccgttacgccgaaagtagcatgaagaattctttcggcctgaagtacctgcacaaatttttcaatattcctttcctgcaacttcagagggagacacttctgaggcagctggaaacaaaccaactggatatggatgcaacattggaggaattgagtgttcagcaggagaccgaggaccagaactatgggatttttttggaaatgatggaagctcgatcgagggggcacgcttcacccctggcagccaatggacaaagcccgagccctgggtcccagtcaccggtcgtgcctgccggagctgtttcaacaggaagctccagtcctggcacaccacagcctgcccctcagctgcccctcaacgcagctccccctagctccgttcctcctgtcccgccatcggaggccttgccaccgccagcatgtccttctgctcccgctcccaggagatctatcatttctagaccgccaccttggggctggagattgcgtggcgcacttggacggagagggcagtggcccccatgggggggaggcagggcttgccattgtttgggaagacaccttcctctgtatcaccggctgtgccgttgcccagtggcagcagtgtgtgcctccgagctggaagaagccggtcactggtggagtcccggttgggccctccaggtgctcggcctccaggcacagtgtgagcctgctctgcaggaaggacggggacaactcgcctctgcccgtcttggcggacacccaggccctctcggcgcagagcctcccgtttttttacgggatgtgaccgaggctcaagaggggccagtgcgcgtatgcctgcaacggctaggcaggggtcgattagccgtcggctgcgccttgccaagacacctgcttgccctgagggctcacctaggacctcagcatgcctacggtagcgcctccgggagagaaccatag

SEQ ID NO: 218551 - DNA, 1845 bp, Artificial Sequence
  Description of Artificial Sequence: Synthetic coding sequence
atggaaaatgatcctcaggaggctgaatctgagatggccctggatgcagagttcctcgatgtttataaaaactgcaacggggtagtgatgatgtttgacataacaaaacagtggacatttaattacatcctccgggaattgccgaaggtgcccacacatgtacctgtttgtgttcttgggaattacagagatatgggcgagcacagagttatactgccagacgatgtacgagacttcattgacaacttggatagaccccctggatcctcctacttcagatatgcggaatcctccatgaagaactcctttgggctcaaatacctgcacaagttcttcaatataccttttctgcaattgcagcgggagacactccttcggcagctggagaccaaccagttggatatggatgctacactggaggaactctcagttcaacaagaaactgaggaccaaaattacgggattttcctggaaatgatggaagcgaggagccgtgggcatgctagtcccctggccgcaaacggacagtccccctctccgggttctcagagccccgtggtccctgccggtgccgtgagtactggctcttctagccccggtactccgcaacctgctccccagctgccccttaatgcggcacccccttcctctgtgccacccgtgccaccctccgaggccctgcccccacctgcctgcccctctgctcccgctccgcgtcgaagcatcatcagcaggttatttggcaccagtcccgcaactgaggccgctccacccccacctgaacctgtgcccgctgccgaaggtccagcaaccgtgcagagcgtggaggattttgtaccagacgatcggctggaccggtctttcctggaggacaccacaccggctagggatgagaagaaagtgggtgccaaggctgcgcagcaggactcagactctgacggcgaagctctcgggggtaacccgatggttgcagggtttcaggatgacgtggatctcgaggaccaaccaagagggtctccacctctacctgcgggacccgtgccatcgcaggacatcaccttatcttcagaggaggaagccgaagttgcagcacctacaaagggcccagcgcctgcccctcagcaatgcagtgaacctgaaactaaatggagcagcatacctgcttctaagcccaggcgtgggacagcaccaacgcgcaccgcagcaccgccttggcccggaggcgtatctgtaagaacaggcccagagaaacggtctagcacaaggcctcccgctgaaatggaacctgggaaaggggaacaggcctctagctctgagagtgatcccgaggggccaatcgcagcacagatgttgagcttcgtaatggatgatccggactttgaatcggaaggttccgatacccaacggagggctgatgacttccccgtgagagacgacccttctgacgtgacggatgaggatgaaggcccagctgaacctccacctcccccaaagctgcctcttcctgcctttaggctgaaaaacgactctgatctttttggtcttggtcttgaggaggcgggtccaaaggagtcatctgaggaagggaaggagggaaaaacaccctcgaaagaaaagaaaaaaaaaaagaagaaaggcaaggaagaggaagagaaagcagcgaagaagaagtctaagcataaaaagagcaaggataaggaggaaggcaaagaagaacgcagaaggagacaacagaggccccctagatctagggagcgaaccgcggctgacgaactggaggccttcctggggggaggcgcacccggaggtagacaccccggtggcggagactacgaggagttgtag

SEQ ID NO: 218552 - DNA, 678 bp, Artificial Sequence
  Description of Artificial Sequence: Synthetic coding sequence
tgagacgatattgtgaaggtcgaggtgtgggatgtggtggataaaggtaaatgcaaaaaacgaggagatggactgaagatggagaacgacccacaggaggcggagtcagagatggccttagatgctgagttcctggacgtctacaagaactgcaacggagtagtcatgatgttcgacattaccaagcagtggacttttaactacattcttagagagttgccgaaggtgccaacacatgttcctgtctgtgtgctcggcaattacagagatatgggagagcaccgggtgatactgcctgacgatgttcgagacttcatcgacaacttagaccgacctccgggaagctcttacttccgttatgctgaaagctcaatgaagaattcctttggactgaagtacctgcacaagttttttaatattcctttcctgcagctgcaaaaagacgtgcggctggctcaggagcggggttgcgcagtcgttctggtcagtgaggaagtcagaatgccggctggctgggattgctgctggggtagactgggctggaaagagggtggcagccagacatgtccagtaccggctctattgggacgtcctctgctccccgctgaaccgtccccccaccactgggtggattactctctggagagttctcctctcctatcctgcagcattccgtag

SEQ ID NO: 218553 - DNA, 1416 bp, Artificial Sequence
  Description of Artificial Sequence: Synthetic coding sequence
atgaccgtgggcactgtgaagattgtcataaggggcgaccgaaacacaggcaaaacggcattgtggcatcggcttcagggaaggccgttcgtcgaggagtacataccaacacaggagatacaggtgacctccattcattggtcatataaaacaacagatgacattgtaaaagtcgaggtgtgggacgtagttgacaaaggcaagtgtaagaaacgaggcgacggtctcaagatggaaaacgatccccaagaggccgagtccgagatggctttggacgccgagttcttagacgtatacaagaactgtaacggagtggtcatgatgttcgacatcacaaagcaatggactttcaactatattctgagggaactgccaaaggtcccaacacatgtgcccgtgtgcgtcttgggcaactacagggatatgggcgagcaccgagttattctccccgatgacgtgcgggactttatcgacaacctagaccgtcccccaggaagttcatattttcggtatgcagaaagttccatgaagaactccttcggactaaagtatctccataagttcttcaatataccctttcttcaattgcagcgagaaactttgctccggcagctggagacaaatcaactcgatatggacgcaactctggaggaactgtccgtgcaacaggagactgaagatcaaaactatggaatcttccttgagatgatggaggcgagaagcagggggcatgcctcaccactggccgcaaacggacaatccccgagcccaggatcccagagccccgtcgtacccgcaggcgctgttagcacagggtcctcgtccccaggcacgccacaacccgcaccccagctgccacttaacgctgccccaccctcaagtgttccgcctgtgcctccttccgaggccctgccaccccctgcctgcccttctgctccggcacctcgaagatccatcatctcacggttattcggaacaagcccggctaccgaggctgccccaccccctccagagcccgtgcctgcagcagaggggcctgccaccgtccagtcggtggaggatttcgtgcccgatgacagactcgatagatcctttctcgaggacacaactccagcacgcgacgaaaaaaaagtcggggcaaaggccgctcagcaggattcggatagtgacggcgaggccctaggaggcaacccaatggtggccggtttccaggacgacgtggatctggaagatcagcccagaggcagtcctcctctgcccgctggccctgttccctcacaagatattactctatcatctgaggaggaagcagaagtcgcagcccctaccaaggggcctgctccagcaccccagcaatgcagcgaacctgaaacgaaatggtccggagaagcccaacagcatcaggccccttgttag

SEQ ID NO: 218554 - DNA, 1347 bp, Artificial Sequence
  Description of Artificial Sequence: Synthetic coding sequence
atgtctcacagggcatggctggcccttctgccactggaggtggacggcgatgatggactctgtggcgctggcggacccgaacactcaggttcttcccagccacagcagcagcaacagagggccccttgccacttaagggcctccgggagaggccgaggtgcacgccttctcaccagactccttcctttcagttttttagagatgatggaggcccgttcccgtggacatgcctctccgttggctgcaaacggacagtccccatcccccggatctcagtcccctgtggtacccgcaggcgctgtttcaaccggctcctcctctccaggcacccctcagccagccccacagttacccttgaatgccgcaccgcctagttccgtgccccctgtgcctccttcagaagccttgcctccccctgcatgtccatccgccccagcgcctagaagatcaatcatatcacggctctttggaacctcgcctgccacagaagccgctcctcctccccctgagccagtacctgctgccgaaggcccagcaacagtccagtccgtggaggactttgtccccgacgaccgactcgaccgctccttcctcgaagataccacccctgctcgggatgaaaagaaggtcggagccaaggctgctcagcaggattcagatagcgacggcgaggcccttggaggtaatccaatggtggctgggttccaggacgacgttgacctggaggatcagcctcggggatcgccccctttgccggcagggccagtcccaagccaggacatcacgctcagctccgaagaagaagcagaggtggctgctccaacaaagggtccagctcctgctccacagcaatgctctgaaccggagaccaagtggtcctcaataccagcatctaagcctagacgcggtaccgccccaaccaggaccgctgccccaccatggcctggcggagtcagcgttcgcacggggcctgagaaaaggtcttctacgcgtccaccagcagagatggagccagggaaaggcgagcaagcttcttccagcgaatcagatccggaaggcccaattgccgctcagatgctatcattcgtcatggacgaccctgatttcgaatccgaagggtcagacacacaacgaagggccgatgattttccagtcagagatgatccatccgacgtgacagatgaagatgaagggcctgcagagcccccaccacctcccaagttgcccttacctgcgttccgactgaaaaacgactccgacctcttcggactgggactggaggaggccggacctaaggaatcttctgaagaagggaaagaggggaaaaccccctcaaaagaaaagtag

SEQ ID NO: 218555 - DNA, 648 bp, Artificial Sequence
  Description of Artificial Sequence: Synthetic coding sequence
tagaagatcgttattagaggtgatagaaacactggcaaaactgctctttggcatagactgcaaggacgcccattcgtggaggagtacatcccgacacaggaaatccaggtgacttccattcactggtcatataagaccactgatgacatcgtgaaagtcgaggtgtgggacgtcgtagataaggggaagtgtaaaaaaagaggcgatggtctgaagatggagaacgacccccaagaagccgaaagcgagatggcgttggacgccgagtttctcgacgtatacaagaactgtaatggagtggttatgatgttcgatattacaaaacagtggaccttcaactacatcctccgagaactgccaaaagtccctacacacgtgcctgtgtgtgtcctcgggaactatcgcgacatgggcgagcaccgagttatattacccgatgacgtgcgggatttcatcgataacctggactctcgtccaccagggagctcttacttcagatatgccgagtcctccatgaaaaattcctttgggctgaagtaccttcataagttctttaacattccgttcctacagctccaagtgtccacacatcatgtagggtggtctggttgctggtcgctcacctcattccaagtgtcaccggtgtag

SEQ ID NO: 218556 - DNA, 336 bp, Artificial Sequence
  Description of Artificial Sequence: Synthetic coding sequence
atgtattctagactcttctacctcaagtcctcctacattatttatttcgaacccctcttttctaacgcaattatcaacattctatctttcatcaacagcctagctagccctctcactattttttgcttcgccctgtctgcccaagcgctgagcacaattttttactttagaatctttattttcatattccactcctggatcctcctgtttcatttctattttacctgttcgttcaagacctacgaacaccagcacagcaaaatggtgcctgcgtaccgcatgcagtccccacgggcattgccacggacgtacctttacgtctggccatataagtag

SEQ ID NO: 218557 - DNA, 342 bp, Artificial Sequence
  Description of Artificial Sequence: Synthetic coding sequence
atgaatttttacctgctcctggcaagtagtattctatgcgccctgatcgtgttttggaaatatagacgcttccaacggaacacgggcgaaatgagttccaattcaacagcattagcattagtgcgaccgtccagctctgggctgattaactccaataccgacaataatctggccgtgtatgatctgagcagggacatcctgaataactttccccacagcatcgcacgccagaaaagaattcttgtaaatctaagtatggttgagaacaagctggttgaactcgagcacacgctactttccaagggattcaggggcgcttctccacacaggaaatctacatag

SEQ ID NO: 218558 - DNA, 2853 bp, Artificial Sequence
  Description of Artificial Sequence: Synthetic coding sequence
atgacctggcgcatgggcccacgctttaccatgctcctcgccatgtggctcgtgtgtgggagcgagccacaccctcacgctactatcagaggttcccatggaggtagaaaggtgccgctcgtgagtcctgatagttctagaccagccaggttcttgcggcataccgggcgttctcgcggtatagaacgatccactttagaggagcctaacctgcaaccactgcagcgaagaaggtccgtacccgtgcttagacttgcaagaccgaccgagccgccagcccgttcagatattaacggcgcagccgtcagacctgagcagaggcctgcagccagaggcagccctagagagatgatacgggacgagggtagctctgccaggtctcggatgttgcgatttccctcgggatcatcctccccaaacattttagctagcttcgccggtaaaaaccgagtctgggtgatatcagcccctcacgcatctgagggatactataggctgatgatgtcactattgaaggacgatgtctattgcgagctcgcggaaagacacatacagcagatcgtgctgtttcatcaggccggagaagagggcggtaaagttagaagaattacctctgagggacaaattctcgagcagccactggatccaagcttgatacccaaactgatgagctttttgaagcttgagaaggggaagttcggcatggtattgctcaagaagactttgcaggtagaagaacgatacccataccccgttcggttggaggcaatgtacgaagtgatcgatcagggcccaataaggaggatcgagaagattcgacagaaaggcttcgtacagaagtgcaaggcgagtggggtcgaggggcaggtggtggcagagggaaacgatgggggaggcggagccggacgaccatcgctgggttctgagaaaaagaaggaagatccacgaagagctcaggttcccccaacaagagaaagtcgtgtcaaagtcttgaggaagttggccgcaaccgctcccgctctacctcaacccccttcaactccccgtgcaactaccctgccgcctgcacctgccactacagtgacccgctctacctcgagagccgtcaccgtggcagccagaccaatgacgacaacagcttttcccacgactcaacggccttggacaccatccccatcccaccgtcctccaactacaaccgaagttattaccgctcgcagacccagcgtatctgagaacctttatccacctagtcgcaaagatcaacatagagagcggcctcagacaacccggaggccatctaaagcaacgtctttggagtccttcaccaacgcccctccaacaaccatctcagaaccaagcacgagggccgctggaccaggcaggtttcgtgacaaccgcatggatcggcgtgaacacggccaccgggatcctaatgtggtgcctggtccccctaagccagccaaagaaaagccacctaaaaagaaggcacaggataagatcttatcaaacgagtatgaggaaaagtacgacctgagtaggcccacagcctcacaactggaggatgagctgcaagtagggaatgtgcccttaaagaaggccaaagaaagtaaaaagcacgaaaagttggaaaagccggagaaagaaaagaagaaaaaaatgaagaatgaaaatgccgacaagctgctcaaatccgaaaagcaaatgaagaaaagcgagaaaaagtcgaagcaggaaaaggaaaaaagcaaaaagaaaaaggggggtaagacggagcaagacggataccaaaaaccgacaaataagcattttacccagtctcctaaaaaaagcgtagccgatctgttaggatctttcgaaggaaaaagacgcctgctcttgattacagctccaaaagctgaaaacaatatgtacgtgcagcagagagatgaatacctagagtccttttgcaaaatggctactcgaaaaatcagcgtgatcaccatttttggtccagtgaataattcaacgatgaagatcgaccactttcagctggacaacgaaaagcctatgagggtggtggacgacgaggatctcgtggatcagaggttgatctcagagctacgcaaggagtatgggatgacatacaacgacttctttatggtgttgacggatgttgatctgcgggttaagcagtattacgaagtgccaataacaatgaaatcagtgttcgacctgatcgacacctttcagtcaaggataaaggatatggagaagcagaaaaaggagggcatcgtgtgcaaagaggataaaaaacagtccctggaaaacttcctcagcagattccggtggcggagaaggctgctggtgatctctgctcccaacgacgaggactgggcttattctcagcagctgtctgcgttgtctggccaggcttgtaacttcgggctgagacacattaccatactgaagctcctaggagttggcgaggaagtcggcggtgtgttggaattgttcccgattaatgggagctccgtggttgaaagggaggatgtgccagcacatttagtgaaagatatccggaattattttcaggttagccctgagtatttctccatgctcctcgtcggcaaggatggcaatgtgaaatcatggtacccctcaccgatgtggtccatggtcatcgtgtacgacctcattgatagtatgcagctacgcaggcaggagatggccatccaacaatcattagggatgcgttgcccagaggatgagtatgcagggtatggataccactcttatcaccaagggtaccaggacgggtaccaggacgactaccggcatcacgaatcctaccaccacggatacccttattag

SEQ ID NO: 218559 - DNA, 744 bp, Artificial Sequence
  Description of Artificial Sequence: Synthetic coding sequence
atgttgctcctcccgctgccattactgctctttctgctgtgcagtagagcggaggcgggagaaatcataggcggaaccgaatgtaagcctcactcacgcccttacatggcatacttggaaatcgtcactagcaatggacctagtaaattctgcggaggattcctaattcgcaggaattttgtcctgaccgcagctcattgcgccggaaggtctatcactgtaaccctcggggctcataatattactgaggaagaggatacctggcagaagttggaggtgattaagcaattcagacaccccaagtataacactagcactttacaccacgatataatgctgctaaagctaaaggaaaaggcatcacttacccttgctgtgggcaccctgccttttcctagccaatttaatttcgtccccccaggaagaatgtgtcgggtggccggatggggtagaacaggtgtcctgaagcctggatctgatacactgcaggaagtgaaacttaggctcatggacccacaggcctgttctcattttcgcgacttcgaccacaatcttcagctgtgcgtgggaaacccgcgtaaaaccaaatcagcctttaagggggacagtgggggtccattgctgtgcgcaggcgtggcccagggtattgtttcctacgggaggagtgacgcgaagcctcccgctgtcttcaccagaatcagccattatcgaccctggatcaaccagatcctccaggctaattag

SEQ ID NO: 218560 - DNA, 210 bp, Artificial Sequence
  Description of Artificial Sequence: Synthetic coding sequence
atgctgggaataaccgtcctggccgctctcttggcctgtgctacaccaggcccaaccgtatggccatgggagcgcaccacatggcgttggaaaaccaagaaggacccatgcttgtgggtgtggactccatccacctcgaccagagacggcatgccttcttgttgtgccatgattttaccttccagcagtctccagagcatgtggagctag

SEQ ID NO: 218561 - DNA, 807 bp, Artificial Sequence
  Description of Artificial Sequence: Synthetic coding sequence
atgttgggcattaccgttttggcggcactgctagcatgcgcctcctcgtgcggcgttccaagcttccccccaaacctgagcgcaagggtggtcgggggtgaagacgctcggcctcactcttggccatggcagattagtcttcagtatctcaagaacgatacatggcgacacacatgcggcggaacattgatcgcctcaaatttcgtcttaactgctgcacattgtatcagtaatactaggacctatcgggtggcagtagggaagaacaacctggaagtggaagatgaagaggggtcccttttcgtgggggtcgacaccatccacgttcacaaaagatggaacgccctcctcctgcggaatgatatcgccctaatcaaactcgctgagcacgtcgagctctctgacaccatccaggtcgcctgtcttcctgagaaagacagcctgctgcctaaagattatccctgttacgtgaccgggtggggtagactctggaccaatggaccaatcgcagacaagcttcagcagggattgcagcccgtggtagatcatgccacatgcagcagaatagattggtggggatttcgggtgaagaagaccatggtttgtgcaggaggagatggcgtgatttcggcctgcaatggcgattccggtggacctctgaattgccaactcgaaaacgggagctgggaggtgttcggcatagttagcttcggatcccgccgtggctgtaacactcggaagaaacctgttgtatacacaagggtgtcggcctacatcgattggatcaatgaaaaaatgcaactatag

SEQ ID NO: 218562 - DNA, 795 bp, Artificial Sequence
  Description of Artificial Sequence: Synthetic coding sequence
atgttacttctgagcctgaccctatcgctggtgctcctggggtcttcgtgggggtgcggtattcccgctattaagcctgcactttcattcagtcaacgcatcgtgaatggggaaaatgccgtcctcggctcatggccttggcaggtgagcctgcaggatagtagcgggtttcatttttgcggcggtagcctgatttcacagagctgggtagtaactgccgctcactgcaacgtgtcgccagggagacatttcgtggtgctgggggagtacgaccgatcaagcaatgccgagcccctccaggtgctcagtgtttcccgcgctattacccacccatcctggaactcaactaccatgaacaacgatgttaccctccttaaattagccagccctgctcagtacacaactcggataagcccggtttgtctggctagctccaacgaagctctgacggaaggcctgacatgcgtgacaacaggttggggtcggctcagcggcgtcggcaacgtcacaccggcacatctgcagcaagtggctctgcccctggtcacagtgaatcagtgcaggcaatactggggctcctccattactgactccatgatatgtgccggtggagctggtgcttcctcctgccagggtgacagcggtggcccattggtttgccagaaaggaaacacttgggtgctgatagggattgtgtcatggggcacaaagaactgcaacgtccgagctcctgcagtgtacactcgcgtttcaaaattttcaacatggattaatcaggttatagcttacaattag

SEQ ID NO: 218563 - DNA, 795 bp, Artificial Sequence
  Description of Artificial Sequence: Synthetic coding sequence
atgcttctcctctccctgacattaagcctggtgctgcttggcagttcctggggctgcggtattcctgccattaagccagctctcagcttttcacagaggatcgttaacggggagaacgctgttttgggctcatggccttggcaggtgtctctccaggactcatccggatttcatttctgtggaggcagcctgatttcccagtcctgggtggtgacagccgctcactgcaacgtgagtccaggcaggcattttgttgtgctgggcgaatacgatcggtcatctaacgccgagccccttcaagtcctatctgtgagtagagcgattacccacccatcttggaattccaccacaatgaacaacgacgtgactctcctgaagcttgctagtcctgcacagtatacaacgcgcataagtccagtttgtctcgcttcatctaatgaggccttgacagagggcctcacatgcgttaccaccgggtgggggcgactgtctggagtgggcaacgtgacgcctgctcatctgcagcaggtggccctcccattggtgactgtgaatcaatgccggcaatattggggcagcagcattaccgacagtatgatctgcgccggaggggctggagcctccagttgccaaggagactctggcggacctcttgtgtgccaaaagggcaacacttgggtcctgatcgggattgtgtcttggggtaccaagaattgcaatgtccgggcacctgccgtttacacgcgcgtgtctaagttttccacctggatcaatcaggtgatcgcctataactag

SEQ ID NO: 218564 - DNA, 792 bp, Artificial Sequence
  Description of Artificial Sequence: Synthetic coding sequence
atggcgagcctgtggttgttgtcatgcttctctttggtgggtgccgcatttggatgtggcgtgcctgctattcaccccgtgctgagtggactctctagaattgttaacggcgaggacgccgtgccagggtcctggccgtggcaggtgtctcttcaagacaagactggattccatttctgcgggggatcactcatctctgaggattgggtggttactgccgctcattgtggtgtgcggacatctgatgtagtagtggcaggggaattcgatcagggttccgacgaggagaatattcaggtcctcaagatcgccaaggtgtttaagaatcccaaattttccatattgacagtgaataatgacattacactgctgaaattagcaacgccggctagattctcccagactgtctctgcggtgtgtcttccatccgctgatgacgacttcccggctggcactctgtgtgctacaaccggttggggcaagaccaaatataacgctaataaaactcccgataagttacagcaggccgcactgcctctcctttctaacgcagaatgtaagaaatcatggggaaggaggatcacggacgtcatgatctgtgccggtgcttcaggtgtaagcagctgtatgggcgacagtggcggacccctggtctgccagaaagacggagcctggacattagtggggattgtgagctggggctctgacacatgtagcacaagttctccaggcgtgtacgctagagtgaccaaactaatcccttgggtccagaagattctcgcagctaactag

SEQ ID NO: 218565 - DNA, 1119 bp, Artificial Sequence
  Description of Artificial Sequence: Synthetic coding sequence
atggccgctccagtaccttgggcatgttgcgcagttctggctgcagcagccgcagtggtgtacgctcagcggcactcccctcaggaagccccacacgtgcagtacgagcggctgggatccgatgtcaccctgccgtgcggtaccgccaattgggacgccgcagtgacatggcgcgttaatggaacagacctcgcgcctgacttgttaaatgggtctcagctcgtgctgcatggattagagctaggccattccggcctttacgcctgctttcaccgggacagctggcaccttagacatcaggtgctgttacatgtaggtctccccccaagggaaccggtgctgagctgtcgcagcaacacctatccaaaggggttctattgttcttggcatctgcccaccccaacatatatccccaacacgttcaacgttaccgtcctacatggaagtaagatcatggtctgtgagaaggatccagcactgaagaatcggtgccatatcagatatatgcacctcttctcgactatcaaatacaaggtgagtattagcgtctctaacgctctgggccataatgcaacagccatcactttcgacgagttcaccatagtgaagccagatcccccagagaatgtcgttgcacgcccagtgccgagcaatccaaggcggctagaggtgacctggcagacaccctcaacatggccggacccagagtccttccctcttaaattctttctacgttatcggccactgatcctggaccagtggcagcacgtggaactatccgatgggaccgcccacaccatcactgatgcttatgcgggaaaggagtacattattcaggtggcggcaaaggataacgagatcggtacgtggtctgactggtcggtggccgctcatgccactccttggacggaggaaccaagacatctgaccaccgaggcgcaagctgccgaaactacaacatccaccaccagcagtttggcaccaccgccaactactaagatctgcgaccccggagagttaggctccggcggaggcccaagcgccccatttctggtctcagtcccaatcactttagccctggccgcagctgcggctaccgcgagcagtttattgatttag

SEQ ID NO: 218566 - DNA, 1119 bp, Artificial Sequence
  Description of Artificial Sequence: Synthetic coding sequence
atggcagcccctgtcccttgggcgtgctgcgcagtgttagctgctgctgcggctgtggtttacgcccagcgccactcaccccaggaggcccctcatgtacagtacgagcgactcggaagcgacgtcacactgccctgtggcactgccaattgggatgcagccgtcacatggagggtgaacgggaccgatctggccccagatctcctgaatggatcccagttagtcctgcatggcctcgaattagggcactccgggctttacgcctgcttccatcgcgactcctggcatctaaggcaccaagtcctgctgcacgtagggctgcccccacgggaacctgtgctttcctgcaggtctaacacataccctaaaggcttctactgttcctggcacttgcccacgccaacctatatccccaacacctttaacgtcaccgtcctgcacggcagcaaaatcatggtttgcgaaaaagatcccgctctcaagaacaggtgtcacatcagatatatgcatctgttttccactataaagtacaaggtgagtatctctgtatccaacgccttggggcataatgccacagccatcacttttgacgaatttactatcgttaagccagacccacccgaaaatgtggtggcaagacccgtaccttctaaccctaggagactggaggtgacctggcagacccccagcacttggcccgacccagagtctttccccttaaagttcttccttcgctacaggccactgattctcgaccagtggcagcatgtagaactttctgacgggactgctcacaccataacagatgcgtatgctggcaaggagtacatcatccaagtagctgcaaaagacaacgagatcggcacctggagtgactggagcgtggcagcccacgccaccccctggaccgaggaacccagacatctcacgacggaggcacaggcggctgaaaccaccacctcgactacctcctctctggcaccaccaccaacgactaagatatgcgacccaggagaattagggtctggcggaggcccatcagccccattcctagtatcagtccctatcacactggccttagccgcagctgccgctacagcctcttcactgttgatctag

SEQ ID NO: 218567 - DNA, 771 bp, Artificial Sequence
  Description of Artificial Sequence: Synthetic coding sequence
atggccgctcctgttccctgggcctgttgcgctgttctagcagcggcagctgctgtggtgtacgcgcagcgccattcacctcaggaagctccacatgtacagtacgagcgactggggagtgatgtcaccctcccttgtgggactgcaaattgggacgccgcagtgacgtggcgggtcaatggaactgacctagcgccagacctgctaaacgggagtcagctggtattacatggccttgaactcgggcacagcgggctgtatgcctgtttccacagagatagctggcacctgcggcaccaggtgctcctgcatgtcggattgccaccacgcgaacccgttctgtcttgccgttccaacacgtacccgaaaggcttttactgctcctggcatctgcctacacccacatacatccctaataccttcaacgtgactgttctgcacggtagcaaaatcatggtgtgcgaaaaagaccccgcactcaagaatcgctgccacatcagatacatgcatctattctctacgatcaagtacaaggtgtctatttcggtgtccaacgccttaggacataatgcaacagccatcacctttgacgaatttactatcgtcaaaccagacccacccgaaaacgtggtggcaaggcctgttcctagcaaccctcgcaggcttgaggtgacttggcagaccccctctacctggcccgatcctgaaagctttccactcaaattcttcctgcgataccgacctctcatcctggatcagtggcagcattag

SEQ ID NO: 218568 - DNA, 3909 bp, Artificial Sequence
  Description of Artificial Sequence: Synthetic coding sequence
atggagttgtacttcggggaatatcagcatgtgcagcaggaatatggagtgcatctcagactggcttctgacgacacgcagaagagccggagcagccagaactctaaagcaggctcctatggggtatcgatcagagtccaggggattgatggtcatccctacatcgtgctgaacaacaccgagaggtgccttgctggtaccagcttttcggagaatgggcctccctttccccctccagtaattaataacctaccactccattcctccaacggtagcgtccctaaggaaaactcagaggagctccagctgccggaaaacccttatgcccagccatccccaatccgtaacctgaaacagccactgcttcacgagggcaaaaatggagtcctcgaccggaaggacggcagcgttaaacccagccatctcctgaatttccagaggcatccagaactgctgcagccctatgaccctgagaagaatgagctcaacctccaaaaccaccagccgagcgaaagtaattggcttaaaactctgaccgaggagggcattaataataagaagccatggacgtgtttccccaaacccagcaacagccagcccacatcaccctcacttgaagatcccgctaagtctggggtgactgcgatccggctatgtagttcggtggtgatcgaggatcctaagaagcagacctccgtttgcgtaaatgtgcagtcttgcactaaggagcgagtgggcgaagaagccctgttcacctccggcaggcctctgaccgctcatagccctcacgcccatcccgaaacaaaaaaaacccggcctgacgtgctaccttttcggaggcaggactcagctggcccagttctggatggggctcggagccgcagatcctcgagcagcagtacaactccaacatccgccaattcactgtaccgcttcctgcttgacgatcaggagtgtgcgatccacgccgacaacgtgaacagacatgaaaacaggagatacattcccttcctcccaggaaccggaagagacatagataccggctccattcccggtgtggaccagcttatcgaaaagtttgaccaaaaaccaggattgcaaaggagagggagatccggcaaaagaaaccgaattaacactgatgatagaaagcgcagcagatcggtggactcggcgtttcccttcggactgcagggcaacagcgagtatctcatcgagtttagccggaatctaggaaaatcctcagaacacctgttgcgaccttctcaggtgtgtccgcaacggccacttagccaggagagacgtggcaagcagtccgtgggaagaacatttgccaagctgcagggcgctgcccacggcgctagctgcgcacattccaggccaccgcagcccaacatcgatggcaaggtcctggagaccgaaggatcacaggaaagtacagtcattagagctccttcgctgggtgcacagtctaaaaaggaggaagaagttaaaactgcgacagctaccctgatgcttcagaacagggcaaccgccacctcaccagactccggcgctaagaagattagcgttaaaacctttcctagtgcgtctaacacacaggccacacccgacctcttgaagggccagcaagagctgacacagcagacaaatgaggaaacagctaagcaaattttatacaattaccttaaggaagggtccacagataatgacgacgctaccaaaagaaaggtaaatctggtgtttgagaaaatacagacacttaagtctcgtgccgctggctctgcccaaggcaataaccaggcatgtaactctacctccgaggtgaaagatctgctcgaacagaagagtaagttgacgatagaggttgcggaattacagcgccaattacagctggaggtcaagaatcagcagaatatcaaggaggagagagagcgcatgcgggctaatctagaagagctgcgaagtcagcataatgaaaaagtggaagagaatagcactctccaacagcgccttgaggagtctgagggggagctgagaaaaaacctcgaggagctatttcaagtgaagatggaacgtgagcaacatcaaaccgaaatcagggacctgcaagaccagctatcagagatgcatgacgagttagacagcgcgaaaagatccgaggacagggagaaaggtgccctcatcgaggagctgctgcaggccaagcaggacctgcaagacctgctaatcgcaaaagaggagcaggaagacctgcttcgcaaaagagagagggaacttactgctctgaagggcgcattgaaggaagaagtctcaagtcatgaccaggagatggacaagctgaaagagcaatacgatgctgagctgcaggccctccgtgaaagcgttgaagaagctaccaagaatgttgaggtgttggcgtcccgcagcaatacctcagagcaggatcaggccggtactgagatgagagtgaaattgctgcaggaagaaaatgagaaattacagggacgatctgaggagctggagcgacgagtagcgcaactgcagcggcagatagaggatttaaagggcgatgaagctaaagcaaaagagactctaaaaaagtacgagggtgagattcgtcagctcgaagaggccctcgtccatgcaaggaaagaggagaaagaggctgtaagtgctcgcagggctctcgagaatgaattggaggcagcccagggaaacttgtctcaaaccacacaggagcaaaagcaactcagcgaaaaactgaaagaggaaagcgagcaaaaagagcagctcaggaggctaaagaacgagatggagaacgagagatggcacctaggtaagacgattgagaagctgcaaaaggagatggccgacatcgtggaggctagcagaacgagtacactagaactgcagaatcagctggacgagtacaaggagaagaaccggagagagttggccgagatgcagcgccagctaaaggagaagactctagaggctgagaaaagccgccttaccgccatgaagatgcaggacgagatgagactaatggaagaggagctgcgcgattaccagcgggcacaggacgaagcactgacaaagcggcagcttcttgagcaaaccctcaaagatttggagtacgaactcgaggccaaatcccacttgaaggacgatcgaagccggctcgtcaaacaaatggaagataaagtcagtcagctcgagatggaactggaggaggaacgtaataactccgatcttctgagcgagcggatctcacgcagtagagaacaaatggaacagctgcgcaatgagctgctccaggagcgagccgcacgccaggatctcgaatgtgataaaataagcctcgaacggcaaaacaaagatctgaagagtcgcattatccacctcgaggggtcttacagatcgagtaaggaagggctcgtagtgcaaatggaagctaggatcgcagaactcgaggataggttagagtccgaggagagagacagagccaacctgcagctttccaatcgcaggctggagagaaaagtaaaggaattggtcatgcaagttgacgacgagcatttatctcttactgaccaaaaagatcagttgagccttaggctgaaagctatgaagaggcaggtggaggaggccgaggaagaaatcgatagactcgagagttcaaagaaaaaactacaacgagagctcgaagagcagatggatatgaacgagcacctacagggccaacttaacagcatgaagaaggacctccgcctcaaaaaactgccttcgaaggtcctggacgatatggatgatgatgacgatctgtcaacagacgggggttctctgtatgaggcgcctgtctcttacacgttcagcaaggacagtaccgtcgctagccagatttag

SEQ ID NO: 218569 - DNA, 2061 bp, Artificial Sequence
  Description of Artificial Sequence: Synthetic coding sequence
atgggagagttcaaggttcacagagtgcgcttcttcaattacgtgcctagcgggatccggtgtgttgcctataacaaccagtctaatcgtttagccgtgtctcgcacggacggtaccgtcgagatatataatctgagcgcgaattacttccaggagaaattttttcccggtcacgagtcacgcgctacggaagctctgtgctgggccgagggacagcgccttttttcggccggtctaaacggggaaatcatggagtacgatctccaggccttgaacattaaatatgcgatggatgcattcggaggccctatttggtcgatggccgcaagtccctctggcagtcagctccttgttggctgcgaggatggctctgtgaagctgttccaaattactcccgacaaaatccagttcgagcgcaacttcgatagacaaaagagtcgaatcctgtccctgagttggcatcccagtggcacacatattgccgcaggtagtatagattacatcagtgtctttgatgtgaaaagcggttccgccgtgcacaaaatgattgtagatcgccagtatatgggcgttagcaagcgcaaatgcatagtgtggggcgtcgccttcttgtccgatggtaccataattagcgtggattccgccggtaaggtgcaattttgggatagcgccactgggactttagtgaagagccacctgatcgccaacgccgacgtgcagagcatcgctgtggccgaccaggaggatagcttcgtggtcggtaccgccgagggcacggtgtttcactttcaactggtacccgtgaccagtaactcttctgaaaagcagtgggtccggacgaagccgtttcaacaccacacccatgatgtcagaacggtggctcatagccccacagccctgatctccggcggaaccgacacccatctggtgttccgcccattgatggaaaaggtggaggtgaagaactacgacgcagctctgcgaaagatcactttcccgcaccgctgcctgattagttgcagcaaaaagaggcaactgcttctgtttcaattcgcccaccacctggagctatggaggctcgggagcaccgttgctaccggcaagaacggcgatactctgccactgtcaaagaatgccgaccatctgttgcatttaaaaaccaaaggtccagagaacatcatctgctcctgcatttcaccgtgtggcagttggatcgcgtatagcacagtctcccggttcttcctgtatcgcctgaactacgagcatgataatataagtctgaagcgggtttcgaagatgccagcctttctgcgctcagccctgcagatactattttctgaagatagtaccaagttattcgttgcctcgaaccagggcgctttacacattgtgcaactgagcggaggctcctttaaacatctccatgcatttcagccccagtcaggtacagtggaggccatgtgtttattggccgtgtctcctgacgggaactggctggcggcttccggcactagcgcaggcgtgcatgtgtataacgttaagcaattgaaactccactgtactgtgcctgcttataactttcctgtgacggctatggcgatagccccaaacactaacaacttagtaattgcgcactctgatcaacaggtgttcgagtactcgattcccgacaagcagtacactgattggtctcggacggtgcagaaacaaggctttcatcacttgtggctacagagggacaccccaattacgcatatcagcttccatcccaaaaggcccatgcatatactactgcacgacgcttatatgttctgcataattgacaaatcactgcctttaccaaatgataaaacactcctgtacaaccctttccctcccaccaacgaatccgatgttatccgtaggagaacagcgcacgcatttaagatatcaaaaatctacaaacccttgctcttcatggatctcctggacgaaaggacactagtggcagttgagaggccgctggatgacattattgctcagctgcctccgccaatcaaaaagaaaaaattcggaacctag

SEQ ID NO: 218570 - DNA, 1716 bp, Artificial Sequence
  Description of Artificial Sequence: Synthetic coding sequence
atgggtgaatttaaagtccaccgggtcagattcttcaattacgtgcctagcggaataaggtgcgtagcttacaataatcagtcgaacaggttggctgtatcaagaacggacgggacggtcgaaatatacaatctgagcgcaaactacttccaggagaaattttttcctggccacgagtccagggccacagaggcactgtgttgggccgaaggccagcgactatttagcgcgggactgaatggcgaaattatggagtacgacctgcaggccctgaacattaagtacgctatggacgccttcgggggacctatctggtcaatggccgcatcaccaagcggttcacaattgctcgtgggctgcgaggacgggtccgtgaagttgttccaaattaccccagacaagatccagtttgagaggaatttcgacaggcagaagagccgcatacttagtttaagttggcaccctagtggaactcatatcgccgcaggctcaatagactatattagcgtgttcgacgtaaaatccggcagcgccgtccacaagatgattgttgatcggcaatatatgggggtgtccaaaaggaagtgtattgtgtggggcgtggctttcctgtccgatggtactataatttccgtagactcagccggtaaagtacagttttgggattccgccaccggtactctcgtcaagtcccacttaattgccaacgctgacgtgcagtcaattgctgtggccgatcaagaggacagcttcgttgtcggaacggcagaagggacagtttttcatttccagttggtccctgtgactagtaatagttctgaaaaacagtgggtgcggaccaagccattccagcaccacacgcatgacgttcggacggtggcccactcacctacggcgctgatttccggagggactgatacgcacctcgttttccggcctttaatggagaaggttgaagtaaaaaattacgacgctgccttacggaagattacattcccccatcggtgcctgatttcctgctcaaagaaacgccaactgctgctcttccagtttgcccaccatttagagctgtggcggctcgggtcaactgtagccaccggaaccgttgaggccatgtgcctgttagccgtcagtccagacggaaattggctggcagccagcgggacatcggccggtgtgcatgtatataacgtgaaacagctgaagctccattgcaccgtcccagcttataactttccagtgacagcaatggccatcgccccaaacaccaacaatctggtaatcgctcactctgatcaacaggtatttgagtactccatcccagacaagcaatacactgattggtcccgcaccgtccagaagcaaggttttcaccatctttggctgcaaagggacacccccattacacacatctctttccatcctaagcggccaatgcatattctgctacacgacgcctacatgttttgcataatcgataaatctctgcccttgcctaacgataagacactactgtataaccccttcccaccaacgaatgaatccgatgtgatccggagacggaccgcccatgctttcaaaatttcaaaaatttacaagcctttgctgttcatggacttgctggatgagcggaccctcgtggccgtcgagaggccattagatgacatcattgcccaactcccacctccgatcaagaagaagaagtttggcacttag

SEQ ID NO: 218571 - DNA, 1023 bp, Artificial Sequence
  Description of Artificial Sequence: Synthetic coding sequence
atggccctcaggttgctgaggagagcagcgagaggagctgctgccgctgcattactcagacttaaggccagtctggccgcagatatccctcggctagggtatagttcaagctcacatcataagtatatccccaggcgcgctgtgctttatgtacctggaaacgatgagaagaagattaagaaaatccctagcctcaatgttgattgtgccgtattggattgcgaagatggagttgccgctaataagaagaacgaagcgcgacttagaatcgtgaaaaccctggaagatatcgacctgggtccaaccgaaaagtgcgtacgggtaaactcagtgtcatcggggcttgctgaggaagatttagagaccctgcttcaatcccgcgttctccccagcagtctcatgctgccaaaggtggagtcccccgaggaaatccagtggttcgctgacaaattttcctttcatttgaaaggtcgcaagcttgagcagccaatgaatttaattcccttcgttgaaactgccatgggactccttaatttcaaggctgtctgtgaggaaactctgaaggtgggcccacaggttggcctcttcctggatgctgtggtatttggaggagaagatttcagggccagcataggagcaacctcctctaaagagaccctggacatcctctacgctcgacagaagatcgtggtgatcgcaaaagcctttggactgcaagccatcgacctggtgtacatcgacttcagggacggggctggcctcctgcggcagagccgcgagggcgctgccatggggtttaccgggaagcaagttatccaccccaaccagattgctgtcgtgcaggaacagttctccccttccccagaaaagatcaagtgggcggaggagttaatcgccgctttcaaagagcatcagcagttgggaaagggcgctttcactttccagggcagtatgatcgacatgcccctgctgaaacaggctcagaacaccgtcaccctcgcgaccagcataaaagaaaagtag

SEQ ID NO: 218572 - DNA, 921 bp, Artificial Sequence
  Description of Artificial Sequence: Synthetic coding sequence
atggcactgcggctattgcgaagagccgctcgcggagctgccgcagctgctctgttaagactgaaagcttctcttgccgcagatattccacgactgggctactcatcgtccagtcatcacaaatacattcctagacgagcagtgctgtacgtccccggaaacgacgagaagaagattaagaaaatcccctccctgaacgtcgactgcgccgtcttggactgtgaggacggggtggccgctaataaaaaaaacgaggcaaggcttcgtattgtaaaaaccctggaagacatcgatcttgggccaactgaaaagtgtgtccgggtcaattccgtgtcctccggattagctgaggaggacctggaaactcttctccagtcacgagtgctgccctctagtctcatgctccccaaggttgagagccccgaggagatccagtgggccgtctgtgaagagacattgaaagtcgggcctcaggtgggactgttcctggatgcggtggtatttggaggagaagacttccgcgcatctattggagccacctcttcgaaagagacgttagacatcctttatgctcggcagaagattgtggttatagcgaaggcattcggattgcaggccatagatctcgtgtacatcgacttccgggacggcgctggtctgctgaggcagtcccgggagggagctgcaatggggttcacaggaaaacaggtgattcacccgaaccaaatagccgtggtccaggagcagtttagcccaagcccagagaaaataaaatgggcggaagaactgatagccgctttcaaggagcaccaacagcttgggaaaggcgcattcacatttcagggaagtatgattgacatgccactgctgaagcaggcacagaacacggtgaccctggccacctctatcaaagaaaagtag

SEQ ID NO: 218573 - DNA, 921 bp, Artificial Sequence
  Description of Artificial Sequence: Synthetic coding sequence
atggctctgaggttgttgcgcagggccgctcggggtgccgctgctgccgcacttttaaggctaaaggctagtcttgccgcagatattcctcggctgggttatagttcatctagccaccacaagtacatacccagacgtgccgtgttgtacgtgcccggaaacgacgagaagaagataaaaaagatccccagtctgaacgtggactgcgcagtgctagattgtgaagatggcgttgcagccaacaaaaagaacgaggcaagactgcggatcgtcaaaaccctagaggacatcgaccttggacctactgagaaatgcgtccgcgttaacagcgtgtcgagcggcctcgccgaggaggacctggaaaccctcctacagagtagggtgttgccaagctcactgatgctgcccaaggtcgagagccctgaagagatccagtgggccgtgtgcgaggagactctgaaagtgggccctcaggtgggtctatttctcgacgccgtggtattcggaggagaggactttcgcgcttcaattggggcaacatcgagcaaggagactcttgatattctttacgctagacagaaaatcgtggttattgctaaggcattcggtcttcaggccatcgatctggtgtatattgattttcgggatggagctggactgctgcgtcagtccagggaaggagcagcgatgggattcacaggaaagcaggtgatacaccctaaccagattgctgtcgtccaggaacagtttagtcctagcccggagaaaattaagtgggcagaggagctaatcgccgcatttaaggaacaccagcagctgggtaagggtgcctttacgtttcaaggctcgatgattgatatgcccctgctaaaacaggcccaaaacactgtcactcttgcaacttcaatcaaggaaaaatag

SEQ ID NO: 218574 - DNA, 1023 bp, Artificial Sequence
  Description of Artificial Sequence: Synthetic coding sequence
atggccctaaggctcttgagacgggctgctagaggggctgcagctgccgcactactgcgcctcaaggcttctttagccgcagacattccgcgattaggttactcttcttctagtcaccataaatatatcccccgacgggcagtactttatgtacccggaaatgacgagaagaagataaaaaaaattcctagccttaatgtggattgcgctgttctggactgtgaggatggggttgcggcaaacaagaagaacgaagcccgactccgcatcgtgaagactctagaagatatcgatctgggaccaacagaaaagtgtgtgagggttaatagcgtgtcctccgggctggccgaagaggacctggagaccctgttacagtctcgggtgttacccagcagtctaatgcttcccaaagtagagtcccctgaggaaatccaatggtttgcggacaagttttcattccacctcaaaggcagaaagctggagcagcccatgaacctcattccctttgtcgaaactgctatgggcttactgaatttcaaggctgtatgtgaggagacactgaaggtagggccacaggtcggactcttcctggacgcagtcgtcttcgggggagaagacttccgcgcttccatcggggcaacatcctcaaaggaaacgttagatatcctgtacgcccgacagaagatagtggtgatcgccaaggcattcgggcttcaggcgatcgatctggtgtacattgactttagagatggggctggcctgttgagacagagtcgcgaaggagccgcaatggggttcacaggaaagcaagtaatccaccccaatcagattgccgttgttcaggagcaattttcgccatcacctgagaaaataaagtgggccgaagagttgatagccgctttcaaggaacaccagcagctcggcaagggcgcatttaccttccagggaagcatgattgacatgcccttactcaagcaggcccagaatacggtgaccttggcgacctcaatcaaggagaagtag

SEQ ID NO: 218575 - DNA, 546 bp, Artificial Sequence
  Description of Artificial Sequence: Synthetic coding sequence
aacgaggcgagactgcgcatcgtgaagaccctcgaggacatagatttaggtccgaccgaaaagtgcgtgagagtaaatagcgtgagtagtgggctggcggaggaagacctagagaccctcctgcagtcccgggtcctcccttcatccctgatgctgccaaaagtggagtcacccgaggagatccaatggttcgccgacaaattttcttttcatctgaaaggaagaaaactggagcagccaatgaatctaattcccttcgtcgagacagccatgggcctactgaatttcaaagccgtgtgtgaagaaacgttaaaggtcgggcctcaggtcggcctgtttctcgatgccgtggtgttcggtggggaagatttccgggcatccatcggggtgaaggatatcagtctcagcctgttcctgtgtgtttgcgtttatatgtgcgtatacatctttagtttaccattaaaggatggccatctacacaacaacgtgtatctccccactatgaccatggtgttccatgataacggaatggatacaacttcctag

SEQ ID NO: 218576 - DNA, 312 bp, Artificial Sequence
  Description of Artificial Sequence: Synthetic coding sequence
ctgcaggccattgacctggtctacatcgatttcagggatggggcaggactgctgcgccagagtcgcgaaggggctgccatggggtttacaggaaaacaggtgatacaccctaatcagatcgcggttgttcaagaacaattttcccctagccctgaaaaaataaagtgggcagaagagcttattgcggcttttaaggaacaccagcagctgggtaaaggcgcatttacttttcagggttcaatgatcgacatgccactattgaaacaggcacaaaatacggtaacactcgccacctcgatcaaggagaaatag

SEQ ID NO: 218577 - DNA, 270 bp, Artificial Sequence
  Description of Artificial Sequence: Synthetic coding sequence
gaggaactgatcgcggctttcaaggagcaccagcaactgggaaaagtggggcgatattgctgcagctggctgtgtattcagcctttcccaagcagcccaggccaaagatctcagagcatttccagggtgcccggtcgctactgggtccttggggctaggtcctgggagtccaagggagcctttacctttcagggatccatgatcgacatgcctctgttgaagcaggctcagaatactgtgactctggccactagcatcaaggagaagtag

SEQ ID NO: 218578 - DNA, 444 bp, Artificial Sequence
  Description of Artificial Sequence: Synthetic coding sequence
aatgaggcacggctccggatcgttaagacgctcgaggacatagatctcggcccaaccgagaaatgtgtgagagtaaattcggtgagttctggcctggccgaagaggacttagaaacgttgctgcaatctagggtgcttccgtcgtctctgatgttgcctaaggtggagtcgccggaggagatacagtgggcagtctgcgaggaaacgctgaaagtcgggccacaggtgggtctgttcctggacgctgttgtgtttggaggtgaggactttagggcttccattggggtaaaggacatttcattaagtctgttcctgtgcgtttgcgtgtacatgtgcgtgtatattttttcacttcctttgaaggacggccacttgcataacaatgtgtatcttcctacaatgacaatggtgtttcacgataatgggatggacaccacgtcgtag

SEQ ID NO: 218579 - DNA, 909 bp, Artificial Sequence
  Description of Artificial Sequence: Synthetic coding sequence
atggcgctgcgactgctcaggagagctgccagaggcgctgccgcagccgctctgttgaggctcaaggcgtccttagcagctgatattccaagactgggctattccagctctagtcaccacaaatacattcctcgccgagctgtattatacgtgccaggcaacgacgagaaaaagattaagaagatcccgagcctgaacgtggactgtgccgttctggattgcgaagacggcgttgccgcaaacaaaaagaacgaagcacgccttagaattgtcaaaaccctcgaagatattgacttgggaccaacagagaaatgtgtgcgtgttaactccgtgagctcaggactcgctgaggaagatttagagactttactgcagtcgagggtcctgcccagttcccttatgctgccgaaagtggagtcacctgaagagattcagtgggccgtgtgcgaggagaccctcaaggtgggaccacaggtgggtcttttcttggacgccgtcgtattcgggggagaagattttagggccagcattggggcaactagttccaaggaaactcttgatatactatatgcccgacaaaaaatcgtggtgatagccaaggccttcggtctgcaggctattgatcttgtttatattgatttccgggatggggctggtctcttgcgccaatcgcgggaaggggctgctatgggattcacgggaaaacaagttattcacccaaatcagatcgccgtggtccaggagcagttttccccttcccccgaaaaaattaaatgggccgaggaattaattgccgctttcaaagagcaccagcagttgggaaagacagtttcttgctccgcgtcccaagctggggtgcagtggagagacctcggaagtcttcagcccccaccaccgggattcaaatag

SEQ ID NO: 218580 - DNA, 1401 bp, Artificial Sequence
  Description of Artificial Sequence: Synthetic coding sequence
atggcgctgctcaccgctgctgcgaggctgctaggaactaaaaacgctagttgcctggtcctcgctgcacggcatgcctctgctagttctaccaacctgaaggatatcctggccgacctcataccaaaagaacaagccagaatcaaaacctttagacagcagcatgggaaaacggtggtagggcaaattacggtggatatgatgtatggcggaatgaggggcatgaaaggtctggtatatgaaacttctgtgcttgaccctgatgagggaatacgcttccggggattcagcatacccgagtgtcagaagcttttgccaaaggctaaaggcggtgaggaacctctccccgagggattgttttggctgcttgttacaggtcacattcctactgaagaacaggtgtcctggctctcaaaggagtgggccaagagagccgctctcccaagccatgttgtgaccatgctggacaacttccctaccaatttgcacccaatgtcacagctgagcgccgctgtgaccgcccttaatagtgagtcaaattttgcaagagcctatgcacagggtatatcccggacaaagtattgggagcttatttacgaagattctatggatctcattgctaaattaccttgcgtggcagccaagatctacagaaacctgtatagagagggcagtgggattggcgctatcgactcaaatctcgactggtcccataattttaccaatatgcttggctacaccgatcatcagtttacagaacttacaaggctatatctgactatccactcagatcacgaagggggaaacgtctcagctcatacatcccaccttgtaggcagtgccctcagcgacccgtacctgtcattcgccgcagcgatgaacggattggcgggacccttacacggtctcgcaaaccaggaggtcctggtctggctgacccaactgcagaaagaggtggggaaggatgtttcagacgagaaactgagagattatatttggaatacccttaactctggacgtgttgtgccaggatatggacacgcagtgttaaggaaaactgatcccagatacacgtgccagagggagtttgctctcaaacacctgccgaacgaccctatgttcaagctcgttgcgcagctctataagatcgtgcccaacgtcctcctggagcaggggaaagccaaaaatccgtggcccaatgtcgatgcccactctggggtgctgttgcagtattacgggatgacagagatgaactactatactgtgctcttcggcgtgagtcgggcactgggtgtgctggcccagctgatttggagtcgcgcactgggctttccattagagcggccaaaatcgatgtcaaccgagggcctgatgaagttcgtcgacagcaagtccggctag

SEQ ID NO: 218581 - DNA, 537 bp, Artificial Sequence
  Description of Artificial Sequence: Synthetic coding sequence
atggcactgctcaccgctgcagcgcgacttctcgggactaagaacgctagctgtcttgtgctggcagcgcgtcatgcctcagcttctagtacaaatcttaaagatatcttggcagatctcatccctaaagaacaagcccgaatcaaaacatttagacagcagcatggtaagacagtggtggggcagattacagtggatatgatgtacggtggtatgaggggtatgaagggcctcgtgtacgaaacctctgtcttggatcccgacgagggcatccggtttaggggattttctattcccgagtgccagaaacttctgccgaaggcaaaaggaggtgaggagccactgcccgagggacttttctggttactggtcacaggccacataccgacagaagaacaggtaagctggctgtccaaggagtgggccaagcgtgctgcactccccagtcacgtcgtgaccatgctcgacaacttccccactaacctgcacccgatgtcacagctttccgccgctgttaccgccttgaactccgaatag

SEQ ID NO: 218582 - DNA, 6084 bp, Artificial Sequence
  Description of Artificial Sequence: Synthetic coding sequence
atgctgaaattcaagtacggagctcggaatccactggatgcaggtgcagcagaaccgattgccagtagggcatctcgcctgaatctgttttttcaggggaagcccccatttatgacccagcagcagatgtcgccactgtctagggagggaatactcgatgctctgtttgtactattcgaggagtgcagccagcccgctctgatgaagattaaacacgttagtaatttcgtgcgaaagtactccgatacaattgccgagctccaggaactgcaaccgtctgcgaaagactttgaagtgagatctctggtaggatgtgggcattttgcagaagtccaggttgtaagggaaaaggctaccggtgacatctacgcgatgaaggtgatgaaaaaaaaagcgctgctcgcacaggaacaggtcagtttcttcgaggaggagagaaacattctgagccggtctacttccccttggatcccccagctacagtatgctttccaggacaagaaccatctatacctagtgatggagtatcagcctggtggggatctcctgtcgctgttaaacaggtacgaggatcagctagacgaaaacctgattcagttctacttggcagagttaattctggccgtgcattcagtccatctgatgggttatgtacatcgagatataaagcctgaaaacattcttgtggatcgcacaggtcacataaaactggtggatttcgggtcagcagccaaaatgaattctaacaaaatggtgaacgcgaagcttcctatcggcacccctgattatatggcacccgaggtcctgactgttatgaacggagacggcaaggggacgtatggtctcgactgtgactggtggtcggtgggagtaatcgcctacgagatgatctacgggagatctcccttcgctgaggggacttccgcacgcaccttcaataacatcatgaattttcagcggttcttgaaattccccgatgaccccaaggtttcctctgatttcctggacctcattcagtccctgctgtgcgggcagaaagaaaggctcaagttcgaaggcttatgttgccacccgtttttctctaaaatcgactggaacaacattcgaaactctccccctccattcgtgcctacactaaaatctgacgatgatacttctaacttcgatgagccggaaaaaaactcttgggtctcctccagcccctgccagctttccccttccgggttctccggggaggagctgccttttgttgggttctcttatagtaaagccctggggattcttgggaggtccgaatctgtggtatccggattggactctccagcaaagaccagttccatggagaaaaaactgctgatcaaatctaaagagctgcaggactctcaggacaagtgccataagatggaacaggaaatgacgcggctgcaccggagagttagcgaagtcgaagccgtgctgtcacagaaggaggtcgagctgaaggctagcgaaacacagaggagcctgcttgagcaggacctggctacatacattacagagtgctcatcacttaaacggtcactggagcaggcgagaatggaggtttcgcaagaggatgataaggccctgcagttattgcacgacattcgagagcagtctcgcaagttacaggaaattaaagaacaggagtatcaggcacaggtggaggagatgagacttatgatgaaccagctggaagaggatcttgtgtctgcacgtaggcggagtgatctctatgaatccgagcttagagagagcaggctggccgcagaggagtttaagcgcaaggcaacagaatgccagcacaaacttctcaaagcaaaagatcagggcaagcctgaagtaggagagtatgcaaagctggagaagatcaatgctgagcagcagctcaaaatccaggagttgcaagagaaattggagaaagcagttaaggcctccacggaggcaacagaactcttgcagaatataaggcaggctaaggagcgggctgagcgcgagctggagaagttgcaaaatcgtgaggattcgtcagaagggataagaaagaagctagtcgaagcagaggagttggaagagaaacaccgggaggcccaggttagcgctcagcatcttgaggtgcacctcaaacagaaagagcagcactacgaagagaaaatcaaagtgctggataaccagattaagaaggacctggccgataaggaaacgctggagaacatgatgcagcggcacgaagaagaggctcacgagaagggaaagattctgagtgaacagaaggcgatgattaatgcaatggattccaaaattagatccctggagcagcgcatcgtggagttgtcagaagcaaataagctcgcagctaatagcagcctgttcacccagcgtaatatgaaggcccaggaagagatgatttctgaactcagacagcagaaattttatctggaaacccaagcaggtaaactggaggctcaaaatcgaaaattggaggaacaactagagaagattagccaccaagatcactcagataaaaacagactgctcgaactggaaacacgtttacgcgaagtgtcactcgaacacgaagagcagaaactggagcttaaaagacagctgacggagctgcagctgagtctccaggagagggaatcacagcttaccgctcttcaggccgcacgcgctgctctggaatctcagctgagacaggcgaaaaccgaacttgaagagactacagccgaggctgaggaggagatccaggccctcaccgcgcacagggatgaaatccaacggaagtttgacgccctcaggaattcctgtactgtgatcacagacctcgaggaacaacttaatcaactgactgaagacaatgcagagcttaataatcaaaatttctacctttctaagcagcttgatgaggcctccggtgccaatgatgagatcgtacagcttcgatctgaggtggaccatttgaggagagaaatcaccgagagggagatgcagctgacctctcagaaacagacaatggaggctctgaaaacgacatgtacaatgcttgaagaacaggtgatggacctcgaagcactgaacgacgagctgctagagaaagagcgtcagtgggaagcctggcgatcagtcttaggagacgaaaaatcccagttcgaatgccgtgtcagagaattgcagcgcatgttagatactgagaagcagtcccgagcccgagccgatcagcgaattactgagtcacggcaagtcgtcgaactggccgtaaaggaacataaagccgagattttagccctacagcaggccctgaaagagcagaaactgaaggcagaatctctgtctgataaactgaatgacctggaaaagaagcatgccatgctagagatgaacgcaagaagcctgcaacagaaactggagaccgagagagagctgaagcagagactgttggaagagcaggcaaagttgcagcagcagatggacctccagaaaaatcacatcttccgactgactcagggcctgcaggaagccctcgatcgggcagatctgctgaagacagagcggtccgatctggagtaccagctcgaaaatatacaagttctgtactcccacgaaaaggttaaaatggagggaacaatcagtcagcaaaccaaactgatcgattttctgcaggcaaaaatggaccaacctgccaaaaagaagaagggcctgttttctaggcgcaaggaagacccggcattaccaacccaggtgccactgcagtataatgaactgaagctggccctggaaaaagagaaggcccgatgtgctgagctagaggaagcgctccagaagactcgaatcgagctacgctccgcccgtgaagaggctgcccatagaaaggcgactgatcacccacacccatcgacacctgccactgccaggcaacaaattgcaatgagcgctatcgtgcggtcgcccgagcaccagccctcagccatgtccctcctggctcccccttcatccaggcggaaggaatcctctacccctgaggagttcagcaggcgactcaaggaacgcatgcaccacaatatccctcaccgtttcaatgtgggtctgaatatgagagccactaagtgcgccgtttgcctcgacaccgttcatttcgggagacaggcctctaaatgccttgagtgccaggtgatgtgtcatcccaaatgctctacatgtctgcccgcaacctgcggactgcccgcagagtatgctactcattttaccgaggcgttctgtagagataaaatgaactcccctggcctgcagacaaaagagccatcttcttcactacacttagagggatggatgaaagtcccgaggaataacaaaagaggccagcaagggtgggatagaaaatatattgtcttggagggtagtaaagtattgatctacgacaatgaggcccgagaggccggacaacggccagtggaggaatttgagctctgtctgccagacggtgatgtatcaatccacggggctgtaggcgcaagcgaactcgccaataccgcaaaagccgatgtgccctacatactgaaaatggaaagtcatcctcacaccacatgctggccaggtcggacactctatcttctggcaccctcattcccagataaacagaggtgggtgaccgctctagagtcggtggtggccggaggaagagtgtcgagggaaaaagcagaggccgatgctaagcttttggggaattcactcctgaagctggagggtgacgataggctggatatgaactgtactctaccattcagtgaccaggtggtactggtgggtacggaagaaggcctatacgctctgaatgttctgaaaaatagtcttacacatgtccccggtataggtgcggtgttccagatctacatcatcaaagatttagaaaaattgcttatgatcgctggcgaggagagggccctctgtctggtggacgttaaaaaggtgaaacagtccctggcacaatcacatctgcctgcccagccagatatctctccgaacatcttcgaagctgtgaagggctgtcacctgtttggcgcagggaaaattgagaacggcctgtgtatctgcgcagccatgccaagcaaagtggtaatcctcaggtataacgagaacctgtccaaatattgcatccgaaaggaaatcgaaacgtctgagccctgttcttgtattcacttcaccaattacagcattttgattggcacgaataaattctatgagatcgacatgaagcagtacaccttagaggagttcctcgacaaaaatgaccactctcttgccccagcagtgttcgccgcaagcagtaatagcttccctgtttccattgtacaagttaacagcgctggccagcgtgaagaatacctactctgtttccacgagttcggagtctttgtggattcctatggtcgcaggtcccgtactgacgaccttaaatggagcaggctgcctctagctttcgcttacagggagccttacctttttgtaacacattttaattctctcgaggtgattgaaatccaggccaggtcaagtgcgggtacgcctgcccgagcatacctggatatcccaaaccctagatacctcggcccagctatcagctcaggagctatctacctcgcatccagctatcaagacaaactccgcgtgatttgttgcaagggcaatttggtaaaagaaagtggaaccgaacaccacaggggaccttccacatcgaggagttcccctaataaacggggtcccccaacatacaacgagcatatcacaaaacgcgtcgctagcagtcctgccccaccagagggtccaagccatcccagagaaccgagcactcctcacaggtatagggagggccgaacagaactgcgcagagacaagagtccaggtcggccactggagcgcgaaaagagccctggcaggatgctgagtaccagacgagagagaagtccaggacggctgtttgaagactcctcacggggacgcctgcctgcaggtgctgtccggaccccacttagtcaagtcaacaaagtgtgggaccagtccagtgtttaa

SEQ ID NO: 218583 - DNA, 6209 bp, Artificial Sequence
  Description of Artificial Sequence: Synthetic coding sequence
atgctgaagtttaaatatggggctcgaaatcccctggatgccggtgcggcagagccaatcgcaagcagagcatcacggctgaatctgttcttccagggaaaaccaccctttatgacacaacagcagatgagtcccctgtcccgcgaaggtatacttgatgcactgtttgtgctgtttgaggagtgtagccagccagctctgatgaaaattaaacacgtcagcaactttgtgcgaaaatactccgacactatcgcagagctacaggagctgcagccttccgcgaaagactttgaagtccgcagtctggtcgggtgcggacactttgcagaggtgcaggttgtacgcgaaaaggcaactggtgacatttatgccatgaaggtgatgaaaaagaaggcgctcctggctcaggaacaagtgagtttttttgaggaggaacgaaacattctgagccgctctacctccccctggattccccagttgcagtacgcctttcaagataagaatcacctatacttggttatggaatatcagccaggaggtgacctgctgtcactcctgaatcgctatgaggaccagcttgatgagaacctgattcaattctatctcgccgaactgattctggcagtccattctgtgcatttgatgggatacgttcacagggatatcaaacccgagaatattctggtggatcgcacggggcacatcaagcttgtcgactttgggtctgcagccaagatgaactctaacaaaatggtaaatgccaagctaccgatcggcacccccgactatatggccccagaggtccttacggtcatgaacggcgacgggaaggggacgtatggtctggattgcgactggtggtctgtgggggtaattgcctacgagatgatctatggacgatcaccttttgccgaaggaacatccgccagaacgttcaacaatattatgaatttccagcggttcttgaagtttcctgatgacccgaaggtcagttccgatttcctagacctgatccaatctctcttgtgtgggcagaaggaaagactgaaattcgagggcttatgttgtcaccccttcttcagcaagatcgactggaacaatatccgcaacagccccccacctttcgtgccaacgctcaaaagtgacgatgatacttctaattttgatgagcccgaaaaaaacagttgggtgagttcttcaccgtgccaacttagtccgtctggcttttccggcgaagagctcccttttgtggggttttcctatagtaaggcactgggaatccttggcaggtccgagtccgtagtgtccgggctggactcacctgccaagactagctccatggagaagaagttactgatcaaatccaaggagctgcaagacagccaggataaatgtcataaaatggagcaggagatgacacggctgcacaggagggtttcagaagtggaagctgtgctgagccaaaaagaggtcgaactgaaagcctctgagactcaaaggagcctcctggagcaggatctagccacatatattactgagtgctctagtctgaagcgcagtctcgaacaggcacgaatggaggtgtcacaggaagacgataaggccttgcagctgctacacgatatccgggagcagagtaggaagctgcaggaaattaaggagcaggaatatcaggcgcaggtggaagaaatgagacttatgatgaatcagcttgaggaggatctcgtgtccgcaaggagaagaagtgatctatacgagtctgagctgcgggaatcccgactggcagccgaggagtttaaaagaaaagcgaccgaatgccagcacaaactgctcaaagctaaggaccaagggaagccggaagtgggcgaatatgccaagcttgaaaaaattaatgccgaacaacagctcaaaatccaggaattgcaagagaagctagaaaaggccgtgaaggcttcaaccgaggccacagagctgctccagaatattcgccaagccaaggaacgcgcagagcgggagcttgaaaaactccagaaccgggaagactcgtctgaggggatcaggaagaaactcgtggaggctgaggaacgaagacattccctggagaacaaggtcaagaggctcgagacaatggagagacgcgaaaaccgccttaaagacgatatacaaaccaaatcccagcagatacaacaaatggctgacaaaatcctggagctagaggaaaaacacagagaggctcaggtctccgcacagcacctcgaagtccacttgaaacaaaaggagcagcattacgaagagaaaattaaagtgcttgacaaccaaatcaagaaggatttggccgataaggaaaccttagagaacatgatgcagcgtcatgaggaagaagctcacgaaaaaggaaagattcttagtgagcagaaagccatgatcaatgccatggactccaaaatcagatctttggaacagaggatagtggaactatctgaggcgaacaaactggctgcaaactcctccctattcacacagcggaacatgaaagcccaggaggagatgatcagcgaactccgccagcagaaattctatctcgaaactcaggccggaaaactggaagctcagaaccgcaagttggaagaacaactggagaaaatctcccatcaagaccattcggacaagaaccgactccttgaacttgaaacccggctgagggaagttagtctggagcacgaggaacagaaattagagttaaagaggcagttgactgaactccagttaagcctgcaggaaagagaaagccaattaacagcactgcaggctgctcgtgcagctctggagagccagttgcgccaggccaaaactgagctggaagaaactacagccgaggctgaggaagagattcaagctctgaccgcgcacagagacgagatccagagaaaatttgacgctctaaggaactcctgtacagttattaccgacctggaagagcagctgaaccaactgaccgaagataacgctgaactgaataatcagaacttctacttgtcaaaacagcttgatgaggcctctggcgcaaatgatgaaatcgtgcagcttagaagtgaagtggaccacctgcgacgagaaatcactgagcgagaaatgcaacttaccagccagaagcagacaatggaggctctcaagacaacttgcaccatgcttgaggagcaggttatggacctggaggccctaaatgacgagttactggaaaaagagaggcagtgggaggcttggagaagtgtccttggcgacgaaaagtcccagttcgagtgcagagttcgcgaattgcagcgtatgctggacaccgagaagcagagtagggccagggccgatcaacggatcactgagagtcgacaggttgtggagctggccgtgaaagagcacaaggccgagattcttgcactgcaacaggctttaaaagaacaaaagctaaaggcagaatcattgtcggataagctgaatgacctggagaagaaacatgccatgctcgagatgaacgctcggagtctccagcagaagcttgagaccgagagagaactgaaacagcgtttactggaggagcaggctaagttgcagcagcagatggacctccaaaagaaccacatcttccgcctgacacagggccttcaggaagctctggacagggccgatttactcaaaaccgagcggtcagatctggagtatcaactagagaacatccaggtactgtattcccatgaaaaggttaaaatggaggggaccatctcacagcagactaagctgattgactttttacaggccaagatggaccagccggcaaagaaaaagaaagggttgttctcacggagaaaagaggatcccgctttaccaacccaggttcctctgcaatataacgaattgaaactggcactagaaaaagagaaagccaggtgcgcagagctggaggaggctcttcaaaagactcgtatagaactgcggagtgctagagaagaagcagcccacagaaaggctaccgaccacccacatcctagtacgcctgctacagcgaggcagcagatcgccatgtcggccatcgtgagaagcccagaacaccagcctagcgccatgtccttgctggcaccaccaagcagccgcagaaaggaaagctctacgccagaggaatttagcaggagactcaaagagagaatgcaccacaacattccacaccggtttaatgtgggcctgaatatgcgagctaccaaatgcgcagtgtgtttggacacggtccacttcgggagacaggcgtcaaagtgtctggaatgccaggttatgtgtcatcctaaatgttctacctgccttccagccacgtgtgggttaccagcagagtatgccacacacttcaccgaggcgttctgtagagataagatgaattctcctggccttcagactaaagagccgagctcgagtctgcacctcgaaggctggatgaaagtgcccaggaataataaacgcggtcagcagggctgggaccgcaaatatatcgtgcttgagggctcaaaagtcctaatttacgataatgaggcacgggaggctggccaaagacctgttgaagaatttgagctgtgcttgcccgacggcgacgtgagcattcacggcgctgtgggcgctagcgagttggctaataccgcaaaggccgacgtgccatatatactgaagatggagagtcatccacatacaacgtgttggcctgggaggactctgtatcttctagctcctagtttcccagataagcagcggtgggtgaccgcactggaatctgttgttgccggtggccgtgtgtccagggagaaagcggaggccgatgccaagttacttgggaacagtttactgaagctggaaggcgatgacagactggacatgaactgcacgctcccatttagcgaccaggtggtgctggttggcaccgaggagggactctacgctctgaacgtgctgaaaaactcacttacacacgtcccaggaattggggcagtctttcagatctatatcataaaggacctagagaaattacttatgattgcaggagaagaaagagccctatgcctagttgacgttaaaaaggttaaacaaagccttgctcagtcgcacctgcccgcacagcccgatatatctccaaacattttcgaggcagttaaaggctgccacctattcggcgctggcaagattgagaatggtctatgcatctgtgccgctatgccctccaaggtggttattctgaggtataatgagaatttgagcaagtactgcatccgtaaggagatcgaaaccagcgaaccctgttcatgcattcatttcaccaactactcgattctgatcgggaccaataagttttatgaaattgatatgaagcaatacacgctggaagaatttctagataagaatgatcactctctcgcgccagctgttttcgctgcctcttcaaattcgttcccagtgagtattgtgcaggtgaacagtgcaggacagagagaagaatatttgctctgcttccatgaatttggggtgttcgttgattcttatgggcgaaggagtagaaccgatgacctcaaatggagccggctccccctggcgtttgcttaccgcgagccatacctcttcgtcacccacttcaacagccttgaggtgatcgagatccaggctagaagctctgccggaacgccagctagagcctacctcgacatcccaaatccccgatacttaggacccgcaatctcgtcgggagctatctatctggctagtagttaccaagataagcttagggtcatctgctgcaaggggaatttggtcaaggaaagcggcacagagcatcaccggggtccgagcaccagtcggtcgagccccaataaaaggggccctcccacatacaatgagcatattaccaaacgagtggcatccagccccgcacctccagagggaccctcacatcctcgggaaccctccacaccccaccgttatagagaagggagaacagagctgcgcagggataaaagcccagggaggcctttagaaagagaaaaatctccaggacgaatgctgtccactagacgggagcgatctccagggcgactgttcgaggatagtagcaggggccgattgcctgccggagcggtgagaacacccctaagtcaggtgaacaaggtgtgggatcagagctccgtcta

SEQ ID NO: 218584 - DNA, 696 bp, Artificial Sequence
  Description of Artificial Sequence: Synthetic coding sequence
atggacccagaacatgcgaaaccagagtcctcagaggctccctccggaaatttgaagcagccagagaccgcagccgctctggcttcttcgggttctgtggttagttctgtgccaaaggcgcagcgcaacatttctgctaagacagcgcctagaaaacacccggctgtaagcattagatctgctcaatctgcagccgctgcaagaccccagggtagtgagggtactgcaccttcacggaaggctacaaccaggcccccaccaaaaccgacgctgccaccacccacccctagcgctcataccgagtctaaactgctgaacgagatggccattaaagagagggttgaaggaagggccaaggtgccatacaagtttcgggacagcctcaagcggttttctttttcccctaccggcatgttgaagatcctccggctgagcttaattctgggggcactggcctgcttcattattacccaggcgaacgagtcctttatcacaatcaccagtctggagatctgtatcgttgttttttttattctcatttacgtattaacactacatcacctgcttacctatctccattggcccctattggatctaaccaactctatcatcacagccgtttttctgagcgtggtagcgatacttgctatgcaggaaaagaagcgacggcatttactctacgtaggcggacgttag

SEQ ID NO: 218585 - DNA, 369 bp, Artificial Sequence
  Description of Artificial Sequence: Synthetic coding sequence
atggatccggagcacgccaagccagaatcatcagaagcacccagtgggaacctgaagcagccagagacagccgctgccttagcctctagcgggagtgtggatctcactaattccattatcaccgcggtctttttgtcggttgtggctattctcgccatgcaggaaaagaaacgcaggcacctcttgtacgtggggggtagtctctgcctgaccgcggtaatcgtctgctgcattgacgcgtttgttgtgacaaccaagatgcggactaacttaaagagattcttaggtgtggaggtggagcggaagctgtcccccgcaaaggatgcctatccagaaacaggacctgacgcccctcagcgtccagcctag

SEQ ID NO: 218586 - DNA, 351 bp, Artificial Sequence
  Description of Artificial Sequence: Synthetic coding sequence
atggatcctgagcacgcaaagcccgaaagtagtgaggccccatcaggcaacttgaagcagcccgagacagcagccgctcttgatcttacaaattccattataactgcagtgtttttgtcagtcgtcgccatcctggccatgcaagaaaaaaagagaaggcaccttctgtatgtgggcggatctctctgcctgacagcagtcattgtctgctgtatagatgccttcgtggtgacaaccaagatgcggaccaatctcaagcgtttcctgggagtcgaggtagagagaaaactcagtccagccaaggacgcttacccagagactggcccagacgcaccccagagacccgcttag

SEQ ID NO: 218587 - DNA, 279 bp, Artificial Sequence
  Description of Artificial Sequence: Synthetic coding sequence
atggatcctgagcatgccaaaccagagtcctcagaggctccttcaggaaacctgaaacaacctgagaccgccgctgctctcgcatccagtggctccgtcgtttcatccgtgccaaaagctcagcgcaatattagcgctaagaccgccccaaggaaacacccagccgtgtcgataaggtctgcccaaagtgctgccgctgcgcgaccccagggttctgaggggaccgcaccatccaggatacttcccacagtttctctccagctatgctcgtttcaatag

SEQ ID NO: 218588 - DNA, 861 bp, Artificial Sequence
  Description of Artificial Sequence: Synthetic coding sequence
atggaccccgaacacgctaaacctgaaagttcggaagcgcctagcgggaacttgaagcagcccgaaaccgccgctgcactagcttcaagtgggagcgtggttagtagcgtgcctaaggcgcagagaaatattagcgcaaaaaccgctccaaggaaacatcccgcagtgagtatcagaagtgcacagtctgccgcagccgcacgcccacaaggtagtgagggaacagcgccatcacggaaagcaaccacacggccaccaccaaaaccgactctgcccccaccaacccccagtgcccacaccgagtccaaactcttaaatgaaatggctattaaggagcgggtggaggggcgagccaaggtgccgtacaagtttcgggactctttaaaacggtttagtttttcacctaccgggatgctgaagattttgcggctaagcttgattctgggagctctggcctgcttcatcatcacacaggccaatgagagctttatcacaataaccagcctcgaaatttgcatcgtggtgttcttcattctcatttatgtgctgaccctgcaccatctgctgacatacctccattggcccctactagatcttacgaattctattatcaccgccgtttttctgtctgtggtcgccatcctggccatgcaggagaaaaagaggcggcacctactttatgtgggaggttctttgtgcttaacagcagtgatcgtgtgttgtatagacgcattcgtggtgacgacgaagatgaggacaaacctgaaaagattcctcggtgttgaggtggagaggaagctttctcctgcgaaagacgcatacccagaaacggggcctgacgcccctcaaagaccagcttag

SEQ ID NO: 218589 - DNA, 510 bp, Artificial Sequence
  Description of Artificial Sequence: Synthetic coding sequence
atggatccagagcacgcaaaaccagaatcctcagaggcaccaagcggtaatctcaagcagccagagactgcggctgccctgtctttgatcctcggcgctctggcttgcttcataatcacacaagccaacgagtcgttcatcactattactagtctagagatctgcatcgtggtctttttcatactgatctatgtgctgaccctccaccatcttttgacctacctgcactggccccttctggatctcacaaacagcatcatcactgctgtgttcctttctgtggtcgctattctggccatgcaggagaagaagaggaggcatctgttgtatgtgggcggttccttgtgccttacagcagtgattgtttgctgtatcgacgcctttgtggtgactaccaaaatgcgcactaacctaaagagattcttaggggtggaggtggagcggaagctgtctccagctaaagacgcttatcctgaaacgggtcctgacgcccctcagagacctgcttag

SEQ ID NO: 218590 - DNA, 345 bp, Artificial Sequence
  Description of Artificial Sequence: Synthetic coding sequence
atggatccagaacatgctaaaccagagagctccgaggcgccatccgggaatctcaagcagccagaaacagccgcagctctgagtttgatcttaggcgctctggcatgctttattattacccaggccaatgagtccttcattaccataacatccttagaaatctgtattgtggtgttttttatcttaatctatgtgcttaccctgcatcatctgttgacttacctgcactggccccttttggatctaaccaactctatcatcactgcggtcttcttgtcagtggtggcaatcttggctatgcaggaaaagaagcgcaggcatctactgtacgtggggggtcgttag

SEQ ID NO: 218591 - DNA, 117 bp, Artificial Sequence
  Description of Artificial Sequence: Synthetic coding sequence
atggaccccgaacatgctaaaccagaatccagcgaagcccctagcggaaacctgaagcagccagagaccgctgccgctctcgaggcagacaaagccaacatgtcaaatttcaactag

SEQ ID NO: 218592 - DNA, 87 bp, Artificial Sequence
  Description of Artificial Sequence: Synthetic coding sequence
atggatcccgaacacgccaagccagagtcatctgaggcacccagtggcaatcttaagcagccggaaactgcagccgcactcagatag

SEQ ID NO: 218593 - DNA, 747 bp, Artificial Sequence
  Description of Artificial Sequence: Synthetic coding sequence
atggcacccaaggccgctaagggcgcaaagcccgagcccgctcccgctcctccgccacctggtgccaagccagaggaggataaaaaagacggcaaagaacctagtgataaaccacaaaaagcagttcaggaccacaaggaaccgtcagacaaacctcagaaggccgttcagccaaaacatgaggtgggtactagacgaggctgccggagataccgctgggagttgaaagacagcaataaggaattttggctgctggggcatgccgaaataaagatccggtctttagggtgcctcattgctgcaatgattttgctgagcagcttaactgtccatcccatcctccgcctgattatcacaatggagataagtttttttagcttctttatcctactgtatagctttgccattcaccgctatatcccttttatactgtggcccatttcagatctgtttaacgatctcatcgcatgtgcctttctggtgggagcagtcgtgtttgcagtacgaagccgcagaagtatgaatctgcactacctcctggcagtgatcctgatcggcgctgccggtgtgtttgccttcattgatgtatgccttcagcgtaatcactttaggggcaaaaaggcgaagaagcacatgctcgtgccaccccctgggaaggaaaagggtccccagcagggcaagggacctgagcccgcaaagcctcctgaaccaggaaagccccctgggccagccaagggtaagaaatag

SEQ ID NO: 218594 - DNA, 588 bp, Artificial Sequence
  Description of Artificial Sequence: Synthetic coding sequence
atggctccaaaggccgctaaaggcgctaagcccgaaccagcgccagcaccacccccaccaggcgcaaagcctgaggaggacaagaaggacggcaaggaaccgtcggacaaaccccagaaggccgtgcaggaccataaggagcccagcgacaagcctcagaaggcagtgcagccaaagcacgaggtgggaacacggagaggctgccgcagatatcgctgggagctcaaagacagcaataaagagttttggctcctcggacatgctgaaatcaaaatacggagtctcgacctgtttaacgatctcattgcctgcgctttcctcgtgggtgcagtcgtcttcgcagtcagaagcagaagatctatgaacctgcattatctgctggcagtgatactgatcggagcagccggtgtcttcgcttttatcgacgtgtgcctgcagcgcaatcactttcgtggaaagaaggcaaagaagcacatgctcgttccccctcctgggaaggaaaaggggccacagcagggtaaaggcccagaacctgcaaagccacctgaaccaggcaagcctccagggcctgccaaaggtaagaagtag

SEQ ID NO: 218595 - DNA, 180 bp, Artificial Sequence
  Description of Artificial Sequence: Synthetic coding sequence
atgtggcccccagacccagaccccgatcctgatcctgagccagccggaggatcgcgacccggtcctgccgtgcctggcctcagggccctcctgccagccagggcatttctgtgctcactcaagggacccggaggctttgtgtgcacctggtgcagttgcccacatcagcctctctggtag

SEQ ID NO: 218596 - DNA, 549 bp, Artificial Sequence
  Description of Artificial Sequence: Synthetic coding sequence
atgtggcctcctgaccccgatcccgaccccgatcctgaacctgctggcggatccagacctggccctgccgtgcccggactgcgcgcactgttgcccgcacgcgctttcctgtgttctctgaaaggtagactgctgttggctgaatcaggcctctcctttatcacattcatttgttacgtggcgagcagtgcctctgctttcctaaccgcaccgctcctagagttcctgctggcactgtactttctcttcgccgacgctatgcaactgaatgacaagtggcagggcctctgctggcctatgatggacttcctccgatgcgtgacagctgctctaatctactttgctatttccataaccgccattgccaaatatagtgacggcgcatcaaaagctgctggtgtgttcgggttttttgccactattgtattcgctactgatttctatctgatttttaacgatgttgccaagtttctcaagcagggggattctgccgacgagacgactgcacacaaaacggaggaagagaatagtgattccgactccgattag

SEQ ID NO: 218597 - DNA, 549 bp, Artificial Sequence
  Description of Artificial Sequence: Synthetic coding sequence
atgtggcccccagaccccgaccccgacccagatcctgaacccgctgggggtagccgaccaggccctgccgttcctggcctgcgggctctcttgccggctagggcattcctctgtagcttgaaaggacgactgctcttggcagaatcagggttaagctttatcacctttatttgttacgttgcatcttctgcctcagccttcctgacagctcctctgctcgagttcctactcgctctgtacttcctgtttgccgatgcaatgcaactcaacgacaagtggcagggcctttgttggccaatgatggactttcttaggtgtgtcaccgccgctttgatctactttgccatctccattacagcgatcgccaaatattctgacggagctagcaaagccgctggagtattcgggttcttcgccaccattgtgttcgcgacagacttttatctgatcttcaacgatgtggcaaagttcctcaagcaaggcgactctgccgatgaaaccacggctcacaaaacagaagaggagaatagtgatagcgatagcgactag

SEQ ID NO: 218598 - DNA, 549 bp, Artificial Sequence
  Description of Artificial Sequence: Synthetic coding sequence
atgtggccccctgacccagatccagatccggatcctgagccagctggtggatcccgccctggaccagccgtgcccggtctgagggcccttctgcccgctcgcgcatttctgtgcagcctgaagggacggctcctgcttgctgagagcggactgagctttatcaccttcatttgttacgtcgcgtcaagtgccagcgcatttctgaccgctccgctgctggagttcctgttggctctctatttcttatttgcagatgcgatgcaattaaacgataagtggcaggggctgtgttggcccatgatggatttcctgcgctgtgtaaccgccgcattaatctacttcgccatatctattacagccattgctaagtacagcgatggtgcctccaaagccgcaggtgtttttggttttttcgctaccatagtgtttgccacagacttctaccttatttttaacgatgtggccaagttccttaagcagggagactcagctgatgaaacaaccgcccataagaccgaggaggagaactctgactcagactctgactag

SEQ ID NO: 218599 - DNA, 705 bp, Artificial Sequence
  Description of Artificial Sequence: Synthetic coding sequence
atgcggtccggggaggagctggatgggttcgaaggcgaggcctcaagtacaagcatgattagtggcgcttcatcaccttaccagcctactacagaacctgtatcccaacggagaggcctggcaggactccgctgtgatcctgattatctgagaggagctctcggcagactgaaagtagcccaggtcatcttggccttgatcgcattcatctgtatcgagaccatcatggcttgttccccttgtgagggactgtacttctttgagtttgtgagttgctcagcattcgtggtgaccggtgtgctgctgataatgttttctctgaatctccacatgcgtatcccacagattaattggaatttgaccgaccttgtgaatacaggcctgagcgccttcctcttcttcatcgctagtatcgtgctggccgctcttaaccatagagctggcgctgaaattgctgcggtcatcttcggcttccttgctactgctgcatacgcagtcaacacctttctcgccgtccagaaatggagagtctcagtaaggcagcaatccaccaatgattatatccgcgctagaacagagtcacgtgacgtcgacagtcgccctgagatccagagacttgacactttctcttatagcaccaatgtaaccgtgcgcaaaaagtctcctactaaccttctctccttaaaccattggcaattagcgtag

SEQ ID NO: 218600 - DNA, 627 bp, Artificial Sequence
  Description of Artificial Sequence: Synthetic coding sequence
atgagatcgggcgaagaactggacggctttgagggcgaggcctcctcaaccagcatgatcagcggggcttcctctccttatcaacccaccactgagcctgtatcccagcgcagggggcttgctggcttgcgttgcgatcctgactatttgcgaggtgccctggggagattaaaagtagcgcaagtgatcctggccctgatcgcatttatctgtattgaaacaattatggcctgttcaccctgtgaaggactatactttttcgagtttgtgtcctgttcggcctttgtagtgactggggttctgctaattatgtttagcctgaacctgcacatgaggattccccagatcaattggaatctgacagacctggtcaacaccgggctgtcagctttcttgtttttcattgcttcaattgtgctcgccgcactcaatcaccgcgctggagcagaaattgccgctgtcatcttcggcttcttagcgacggctgcctatgcagtcaacacctttttggccgtccagaaatggcgcgtctccgtcaggcagcagtccaccaacgactacatccgtgcccgtacagagtcacgcgacgtggatagccggcctgaaatccagaggcttgatacctag

SEQ ID NO: 218601 - DNA, 672 bp, Artificial Sequence
  Description of Artificial Sequence: Synthetic coding sequence
atgctgtcggcacgtgataggcgcgatcggcaccccgaagagggggtggttgcggagttacagggatttgcggtggacaaggcttttctgactagtcataagggcattctgctggaaaccgagctggccttgacactgattatcttcatctgcttcacagcaagtatatctgcctacatggcagctgccctgttggagttttttattactctggccttcttattcctctacgccactcagtattaccagcgcttcgacagaatcaattggccctgtcttctgcagggacatggccaaagtggagggccacaccctctggatctgttgtctcactccgccaaggtgcagccccaaccctggccgggactgacccccccagggtggcatacccccgcagcagtgccctgggtacccgctcctgcaccaggattttggtcctggctgctctggttcatttgcttccattcactgggttcatcagacttccttcggtgcgttagtgctataatcattttcctcgtggtgtcattcgccgctgtgaccagtcgggacggggctgctattgccgctttcgtcttcggtattatcctcgtcagcatctttgcctatgacgctttcaaaatataccggaccgagatggctccgggagccagccagggtgaccaacaatag

SEQ ID NO: 218602 - DNA, 225 bp, Artificial Sequence
  Description of Artificial Sequence: Synthetic coding sequence
atgttatcagcccgtgacaggcgggacagacatccagaagaaggcgtggtcgccgaacttcaaggttttgcagtcgataaagcattcctgacatcacataaggggatccttctggagacagagcttgtgttcggtattattctggtgagtatatttgcttacgatgcgtttaaaatttacaggaccgagatggcacccggagcctcacagggagatcagcaatag

SEQ ID NO: 218603 - DNA, 471 bp, Artificial Sequence
  Description of Artificial Sequence: Synthetic coding sequence
atgctgagtgctcgcgacaggcgagatcgacacccagaagagggagtggtcgcggaacttcaggggtttgcagtggacaaagcctttttaacttcacacaagggaattctcttagagaccgagctagcactcacgttaatcatatttatatgttttacagcaagcatcagcgcctacatggccgctgcgctgctggaattctttatcactttggctttcctcttcctgtatgccactcagtactaccagagatttgacagaattaattggccatgccttgatttcctgcgctgcgtgtcggctatcattattttcctcgtggtgtcctttgcggcagtaactagtcgagatggcgcagccatcgccgcattcgtcttcggcatcattctggtatctattttcgcatacgacgcattcaaaatttaccggactgaaatggcacctggcgcatcccagggggaccagcagtag

SEQ ID NO: 218604 - DNA, 378 bp, Artificial Sequence
  Description of Artificial Sequence: Synthetic coding sequence
atgttaagcgcacgggatagaagagaccggcatcctgaagagggcgttgtcgccgagttacaggggtttgcggtagacaaggccttcttaacgtcccataagggcattctgctcgagaccgagcttgcactgacattaattatcttcatctgttttaccgcctccatatccgcctacatggccgctgccttgctggaattttttattaccttagctttcttgtttttatacgccactcaatactaccagaggttcgatcggattaactggccctgcctggtgttcggcatcattctcgtctctatttttgcctatgacgcctttaagatttacaggacagaaatggctcccggagctagccagggggaccagcagtag

SEQ ID NO: 218605 - DNA, 318 bp, Artificial Sequence
  Description of Artificial Sequence: Synthetic coding sequence
atgctgtctgcacgggaccggcgagatcgtcatccagaggagggagttgtggcagagctgcagggatttgctgttgacaaggcttttctgacttcacacaagggaatcctgcttgagactgagcttgatttcttacggtgcgtgtctgctattataatcttccttgtggtctccttcgctgccgtgactagtagggatggggcagccattgcagctttcgtttttgggattatcctcgtgtcgattttcgcttacgatgcatttaaaatttataggaccgaaatggcccctggcgcttctcaaggggatcagcagtag

SEQ ID NO: 218606 - DNA, 1326 bp, Artificial Sequence
  Description of Artificial Sequence: Synthetic coding sequence
cctagtcctgctatcggcttgtttgcctctatggctgccgtcctgttaggcggtgccagagcctcccggctcctgtttcagagactgctctgggacgtcgtccgctccccgattagcttcttcgagcgcacaccaatcggccatctgctcaatcggttttccaaagagacggatacagtagatgtagatatccctgacaagctccggtcgctgctgatgtatgccttcggccttctggaagtgagcctcgtggttgccgttgctacccccttacctctatggccaagttgccattgctttagttccacgcttggcttccgctggctggctgcaaacgtggaattgctggggaatggacttgtctttgctgctgccacatgtgccgtgctgagcaaagcccatctgtctgctgggctagtcggtttctccgtgtcggccgctctgcaggtgactcagaccttgcaatgggtagtccgtaattggactgatctcgagaactcaattgtgagcgtggaacgtatgcaggactatgcctggacacccaaggaggccccttggcggctccctacctgcgcagcgcagcccccatggccccagggcggtcaaattgaattcagagacttcggtctgcggtaccggccagagcttccactcgctgtacagggcgtgtcatttaaaatccacgctggagaaaaggttggtattgtcggccgtactggcgctggcaagtccagcctggccagcggtctgctgcgtctccaagaggccgctgagggaggcatctggatcgacggcgtaccgattgcacacgttggcctccacacacttaggtctcggatctccattatcccccaagatcctatcttgttccccggaagcttgcggatgaatctggatctcctccaggagcatagcgacgaggccatctgggccgctctggagactgtgcagctcaaagccctggtggcctccctacccggacagctgcagtataaatgtgcagatcggggtgaggatctgagcgtgggtcagaagcagctgttgtgcctcgccagagctctcttaaggaagactcagatattgattcttgacgaggcaactgccgctgtcgacccaggaactgaactccagatgcaggcgatgctgggttcatggttcgcccagtgtacggtgctactcatcgcacaccggctccgctcagtgatggactgcgcaagggtcctagtgatggataaaggccaggtcgccgaatccggcagtcccgcacagctgcttgcccagaaagggttgttctatcggttggcccaggagtctggactggtgtag

SEQ ID NO: 218607 - DNA, 528 bp, Artificial Sequence
  Description of Artificial Sequence: Synthetic coding sequence
atgagccacggtgctggcctggttagaacaacatgctcttcaggcagcgctctgggacccggagctggtgctgcccagccgtcagcctctcctctggaggggttgctcgacctgtcgtacccaaggacgcatgctgcactgctcaaagtggcacagatggtgacactgttgattgcattcatctgtgtacggtcatccctttggacgaactactcagcatactcctatttcgaggtggtgacaatctgtgacctcatcatgatcctggctttctatctggtgcacctattccggttctaccgagtgctcacttgcatcagctggccactgagtgagctactccattatctgattggcactctactgctgttaatagcctccatcgtggcagcatcaaaaagctataatcagtccgggctggtggccggagccatcttcggttttatggcgaccttcctgtgcatggctagcatttggctttcgtacaaaatcagctgcgttactcagtccaccgacgcagctgtttag

SEQ ID NO: 218608 - DNA, 429 bp, Artificial Sequence
  Description of Artificial Sequence: Synthetic coding sequence
atgagccacggtgccggactggtaaggaccacatgcagttcagggagtgctctgggccctggtgcaggcgcagcccagccctctgctagtccgctagagggactgttggacctgagttaccctcgtacccatgcagccctgttaaaagtcgctcagatggtaacactgttgatcgcctttatatgcgtacggtcttccctatggacaaactattcagcctactcatactttgaagtggtgactatttgtgatcttattatgatcctggccttctacctggtccacctgttcagattctacagggtgctgacttgtatatcctggccactatctatctttggattcatggccactttcctctgtatggcgagtatttggctgtcgtataaaataagctgcgtaactcaaagcacagatgcggcagtgtag

SEQ ID NO: 218609 - DNA, 522 bp, Artificial Sequence
  Description of Artificial Sequence: Synthetic coding sequence
atggaggaaccgcagagggccagatctcacactgtcacgaccaccgcttcttctttcgccgaaaatttctcaactagttcgagctcctttgcttatgatcgggaattccttagaaccctcccaggatttctgatcgtggcagaaattgtcctgggtctcctggtgtggacactgatcgcaggcacagagtactttagagtaccagccttcggctgggtgatgttcgtcgcagtcttttattgggttctcaccgtgttctttctgattatttacatcactatgacctacacaagaattccgcaggtgccatggacaacagtgggattgtgcttcaatggctctgcttttgtcttgtatctgagcgctgcagtggtagacgcctccagtgtgtctcccgagcgtgactcccacaatttcaactcatgggccgctagctcatttttcgcctttttggtcaccatctgctatgcaggcaacacctactttagttttatagcctggagatcccgtacaattcaatag

SEQ ID NO: 218610 - DNA, 363 bp, Artificial Sequence
  Description of Artificial Sequence: Synthetic coding sequence
atgcaggccctgcagcagcagccggtttttcccgatttgcttaaagcgatccccgtcagcatccacgtgaatgtcatactgtttagcgccatactgattgttctgaccatggttggaacagccttcttcatgtacaacgccttcggaaaaccctttgagactctgcacgggcctctcggattgtacctcctctccttcatcagtgggagctgcgggtgtcttgtgatgatcctatttgctagtgaggtgaagatccaccatctaagcgagaagatcgccaattataaagagggaacatacgtatacaagacccagtctgagaaatacactacatccttctggttgacaaaaggacacagttag

SEQ ID NO: 218611 - DNA, 699 bp, Artificial Sequence
  Description of Artificial Sequence: Synthetic coding sequence
atgcccagtcagcagaagaaaattattttctgcatggcaggtgtgttctcctttgcatgcgcccttggcgttgtgaccgcccttgggacccctctgtggattaaggccaccgttctgtgtaaaacaggcgctttactcgtgaatgccagcggacaggagttggataaattcatgggtgaaatgcagtatggcctttttcacggcgaaggcgtgcgacagtgtggtcttggcgcaaggccctttcggttctctttttttccggatctgcttaaagctatccctgtctcaatccacgtcaacgtcatcctgttttcagcgatcctgatcgtgctgacgatggtggggacagcatttttcatgtataatgcattcgggaaacccttcgagacgctccacggtcccctcggcctgtacctgctttccttcatcagcggttcttgcgggtgtctggtgatgattttattcgctagcgaggtgaaaatccaccacctgagcgaaaaaatagcaaactataaggagggtacatacgtgtacaagactcaaagcgagaaatacactacaagtttttgggtgattttcttctgtttcttcgtgcatttcttgaacgggctccttatccggctcgccggtttccagttccctttcgccaaaagcaaagatgccgagacgacaaatgtggccgctgacctgatgtattag

SEQ ID NO: 218612 - DNA, 738 bp, Artificial Sequence
  Description of Artificial Sequence: Synthetic coding sequence
atgccttcccagcagaagaagatcatcttttgtatggccggtgtctttagcttcgcttgcgcgctgggtgtggtgaccgccctcgggactccactctggatcaaagctactgtgttgtgtaaaacaggcgctcttctggtgaatgcctcagggcaggaattagataagttcatgggtgagatgcagtatgggctgttccacggagagggggtccgtcagtgtgggttaggggcacgcccattccggttctctttcttcccagacctccttaaggctatcccggtgagtatacatgttaacgttatcctgttcagtgctatcctcatcgtgttaaccatggtggggactgcgttttttatgtacaatgcctttggaaagccctttgagacactccacggccctttggggctttatctgttgagcttcatctctgtggctctctggcttccagctacgcggcaccaggcccaaggatcctgcggatgcctcgttatgatcctcttcgcctctgaagttaagattcaccacctatccgaaaaaattgccaattacaaagaagggacgtatgtatataagacccagagcgagaagtacaccactagcttttgggtcatcttcttctgcttttttgtccattttctcaacgggctgctgatacggctcgcgggatttcagtttcccttcgcgaaaagtaaggatgcagagacgaccaacgtcgctgctgatttgatgtactag

SEQ ID NO: 218613 - DNA, 348 bp, Artificial Sequence
  Description of Artificial Sequence: Synthetic coding sequence
atgcaagcgctgcagcagcagccggtgttccctgaccttcttaaagccatccctgtttccattcatgtaaacgttatactcttcagtgccattctaatcgtactcactatggtgggaacggctttttttatgtataatgccttcggtaaaccgttcgagacactacatggcccacttggtctatacttgctctcgttcattagcgggtcctgcgggtgcttggtcatgatattgttcgcctcagaggtgaaaatccatcatctaagcgagaaaattgccaactacaaggagggtacctatgtgtacaaaacacagtctgagaagtacactacatctttctgggtctag

SEQ ID NO: 218614 - DNA, 1878 bp, Artificial Sequence
  Description of Artificial Sequence: Synthetic coding sequence
atgaattactctgaaattgagtcgaaagtgcgcgaagctaccaacgacgatccctggggaccctccggacagcttatgggggaaatcgctaaggcaacctttatgtatgaacaattcccagaactgatgaacatgctatggtcgaggatgctgaaggataacaaaaagaactggaggcgagtgtataaatccctactcctgttggcctacctgatcagaaatggctcagaacgcgtggtcacgtccgcccgtgagcatatttatgaccttcgctctctcgagaattaccacttcgtggacgagcacggaaaagaccagggtatcaacatccggcagaaggtgaaggagctggtggagtttgcacaagatgatgacagactgagagaggagaggaagaaagctaaaaagaataaagataagtacgtgggtgtgtccagtgacagcgtgggcggtttcagatatagcgagcgttatgatcccgaacctaaatccaaatgggatgaggagtgggataaaaacaaaagcgcctttccctttagcgacaaacttggggaactgagcgacaagattggcagcaccattgacgacaccatctccaaattcaggcgaaaggaccgcgaagattcacccgaacgatgcagcgactcagacgaggaaaagaaggctcgtagaggccgatctcctaagggtgaattcaaggacgaagaagagactgtcacaaccaaacatatccatataacccaagcaacggagactaccacgacgcgccataagcgtaccgctaacccgagcaaaactatcgatctgggcgctgctgcccattatactggcgacaaggcttcacctgaccagaacgcgtccacccatacacctcagtcctcagtgaagacatcagtacctagtagcaagtcctccggagacctagtagatctttttgacggtacttcgcagagcactggcggatccgctgatctcttcggtgggttcgccgacttcggatctgccgctgcgagtggctctttcccaagccaggtgacggccacttccggcaacggagacttcggtgactggtctgcttttaaccaagctccctcggggcctgtagcctcttctggcgagttcttcggcagtgcctctcagcccgctgtggagctggtatcgggatcgcagtccgctctcggcccaccaccagccgcatctaacagttcagatctgttcgatctaatgggctccagccaggcgacaatgactagtagccaaagcatgaattttagtatgatgtctactaacaccgtcggactaggcttgcccatgagtcgatctcagcctctgcaaaacgtgtcaactgtgttgcagaaacccaacccattgtacaaccagaataccgatatggttcagaagtcagtctccaaaacgctgccaagtacctggtctgatcccagcgtgaatatttcccttgataacctacttcctggcatgcagccctccaaaccgcaacagccctcattgaacacaatgatacaacagcagaacatgcagcagcctatgaacgttatgactcagtcatttggggcagttaatttatcatccccatccaacatgctgccagttcgaccccagacgaatgctctgatagggggacccatgccaatgtccatgcccaacgtcatgactggaaccatggggatggcacctctcggcaacacacccatgatgaatcagtctatgatgggtatgaatatgaacatcggcatgtctgcagcgggaatgggcctgacaggcactatgggaatgggtatgcccaacatcgctatgacatccggcacagtgcagccaaagcaggacgccttcgcaaacttcgccaatttctcaaaatag

SEQ ID NO: 218615 - DNA, 1878 bp, Artificial Sequence
  Description of Artificial Sequence: Synthetic coding sequence
atgcttaacatgtggaaagtgcgggagctcgtggacaaggctaccaacgtcgtgatgaattactccgagattgagagcaaagttcgagaggccaccaacgacgacccttgggggcctagcggacagctgatgggtgaaattgctaaagccaccttcatgtatgagcaattcccagagctgatgaacatgctttggagtagaatgctgaaggataataagaaaaactggcggagagtgtataagtctctgctcttgttagcttaccttatcaggaacgggagcgagcgcgtggtgacatccgccagagaacacatctacgatctgcgcagtttagagaattatcactttgtagatgagcacggcaaggaccaggggatcaatattcggcagaaggtaaaggagctcgtggagtttgcccaagacgatgaccgtctgcgggaagagaggaaaaaagctaagaagaacaaggacaagtacgtgggtgtttcctccgattcagttggaggatttcgatacagtgaacggtacgatcctgagcccaaatccaaatgggacgaggagtgggacaaaaacaagtctgcctttccatttagtgacaaacttggggagctctctgataaaatcggctcgacaattgatgataccatctccaaatttcggcgtaaagatcgggaagatagtccggagcgatgtagcgatagcgatgaagaaaagaaggccaggcggggacgctcgcccaagggtgagtttaaagacgaagaggaaacagtgaccactaagcatatccacatcacacaagcgacagaaaccacaacaacccgccataaacgcactgccaacccctctaagactattgatctgggggctgcagcacactacacaggtgacaaagcaagtcccgaccaaaacgcctccacacatactccgcagtcgtccgtcaagacgtcagtgccttcctcgaagagtagtggcgatctagttgacctgttcgacggcacaagccagtctacaggcggttctgccgatttgttcgggggattcgccgatttcgggtccgccgcagccagcggtagttttccttcacaggtgactgccacaagcggaaacggggacttcggcgactggtctgcgtttaatcaggcgccatccggtcctgtcgcaagcagcggcgagttttttggatctgctagtcagcctgccgtagaactcgtgtcaggctctcagtctgcactgggtccgcctcccgctgcgagcaactcatcagacttgtttgacctcatggggtctagtcaagccacaatgacgtctagtcagtccatgaacttttccatgatgtccacaaataccgtgggcctgggtttacctatgagccgcagtcagaacaccgacatggttcagaagtccgtttctaagacactgccaagcacgtggtctgatccaagtgtgaatatcagccttgataatctgttgcctgggatgcagccaagtaaacctcagcagccatctctcaacactatgatccaacagcagaacatgcagcaacctatgaacgttatgacgcagtcgtttggagccgtcaacctgtcgagtcccagcaacatgttaccagtgcgccctcagactaacgcactcattggcggtcccatgccgatgtcgatgccgaacgtgatgaccggcaccatgggaatggcacctctgggaaatactccaatgatgaaccagagcatgatgggcatgaacatgaatatcggaatgtctgcagccggtatggggcttactggaaccatgggcatggggatgcctaacatcgccatgaccagtggcacagtgcaacccaagcaggacgcttttgcaaattttgcaaacttcagtaagtag

SEQ ID NO: 218616 - DNA, 1878 bp, Artificial Sequence
  Description of Artificial Sequence: Synthetic coding sequence
atgaactactctgagatagagagtaaggttcgagaggcaacaaatgacgatccatgggggccatctggacagctgatgggcgaaatcgctaaagccaccttcatgtacgagcagtttcccgagctcatgaacatgctttggtcgaggatgttgaaggacaacaagaaaaactggagaagggtgtataagagcttgctgcttctggcttacttgatcagaaacggttccgaaagagtggtaaccagtgccagggagcacatatatgaccttcggtccctggagaactatcactttgtcgatgaacatgggaaggatcagggcattaacattcgacagaaagtgaaagagctggtggaatttgctcaggatgacgaccgtctacgagaagagagaaagaaagcgaagaagaacaaggataaatacgtcggtgtctccagtgacagcgtcggagggtttagatatagcgaacgttacgatccagagccgaagtctaagtgggatgaagagtgggacaagaataagagcgccttccctttcagtgataagttgggagaactcagcgacaagatcgggtcaacaatcgacgacaccatctccaagtttaggagaaaagatagggaagatagccccgaaaggtgctcagatagcgatgaggaaaagaaagctcgaaggggacggagccccaagggcgagtttaaggatgaggaagagaccgtcaccactaaacacatccacatcacacaggccaccgagacaaccacgactagacataagaggacagcaaatccttctaagaccatagacttaggcgcagccgcacactacactggtgacaaggcaagtcctgaccagaacgcctctacccacaccccccaatcttccgtgaaaacgtccgttccatcctcaaaaagttctggggatctcgtcgatctgttcgatggcacctcccaaagcaccggtggctccgcggacttgtttgggggttttgccgatttcggcagtgcggcagccagcggaagtttcccctcccaggtaacggcaacatctgggaacggagatttcggagactggtcagctttcaaccaagcgccatctggtcccgtggctagttccggcgagttttttggcagtgcctcccaacctgccgtggaactcgtgagtggctctcagagcgctctgggcccaccccctgcagccagcaattcaagcgacctgttcgatctaatgggatcaagccaggccacaatgacatctagtcagtctatgaatttctctatgatgtcaaccaataccgttgggctggggctcccaatgtcgagaagccagcctcttcagaatgtttctacagtgctgcagaagcctaacccgctgtataatcagaacaccgatatggtgcagaagtctgtgtccaagacactaccttcaacttggtccgacccaagtgtcaatatttcactggacaatctgttacccggaatgcagccaagcaaacctcagcaaccgtctttaaatactatgatacaacagcagaacatgcagcagcctatgaatgtgatgacacagtcctttggcgcagtaaatctgagctctccttccaacatgcttccagttaggcctcaaacaaatgccctgatcgggggtcctatgcctatgtcaatgcccaatgtgatgaccggcacaatgggtatggctccactggggaacactccaatgatgaaccagagcatgatgggcatgaacatgaatatcggcatgtcagctgcaggcatgggattaaccggcaccatgggaatgggcatgcctaatatcgccatgacgagcggaacggtccagcccaagcaggacgcctttgccaattttgccaattttagtaagtag

SEQ ID NO: 218617 - DNA, 1878 bp, Artificial Sequence
  Description of Artificial Sequence: Synthetic coding sequence
atgaactatagtgaaatcgagtccaaagttagagaagcaacaaacgacgacccatgggggccttctggccagctgatgggagagattgccaaggccacctttatgtatgagcaatttccagaactgatgaatatgctgtggagcagaatgttgaaggataataagaagaactggcgacgggtgtacaagtccctgctcctgctcgcttatctcattcgaaacggaagcgagcgggtcgtgacaagtgccagggaacatatatatgatctacggagcctggagaattaccatttcgtggacgaacatggcaaggaccagggtatcaacatcaggcagaaagtcaaggagctcgtggagttcgctcaggatgacgataggctgcgagaggaacggaaaaaggccaaaaagaacaaggacaagtatgtgggtgtctcttccgactctgtcggcggttttaggtattcggaacggtacgaccctgagcccaagtccaaatgggacgaggaatgggacaagaacaagagtgctttcccattctctgacaagttaggcgagttatctgataagatcgggtctactatcgacgacaccatttctaagtttcggagaaaagaccgtgaggactcccccgaaagatgtagcgattccgacgaggagaagaaagccagacgcggacggtctcccaagggggagtttaaggacgaagaggaaactgtgacaactaaacacatacacatcacccaggctacggagaccacaaccacaaggcacaagcgaaccgcgaacccctcaaaaacaattgatcttggcgcagctgcccattacacaggggacaaggctagtccggatcagaatgcctccacccacaccccccaaagttctgtcaaaaccagcgttccatcttcaaagtccagcggagacctggtcgacttgttcgatgggaccagtcaatcaacaggcggaagcgcggacttatttggtggctttgctgactttggtagcgcggcagccagcggcagcttcccatcccaggtcaccgctaccagtggcaacggcgacttcggggactggtccgccttcaatcaggcccctagcggaccagtggccagcagcggcgagttttttggatcagcctcacagcctgcagtcgaactcgtctccggctcccaatcagcgcttggaccccctccagcagccagcaattcgtcagacctcttcgacctaatggggagctctcaggccacgatgacatcttcccagtccatgaatttcagcatgatgagcacaaacactgtcggcttgggcttacccatgagtcgcagtcaaccactccaaaacgttagcactgttctacaaaagcctaacccactttacaatcagaatacagatatggtgcagaagagcgtcagcaagactctcccgtccacatggtccgatcccagcgtgaatatctcgttggacaacctgctgccaggaatgcagccctctaaaccgcagcaaccctcattgaacactatgattcagcaacagaatatgcagcagccaatgaacgtgatgacccagagcttcggggctgttaacctgtcctcccccagtaatatgctccccgtgaggccacaaacgaatgcgcttatcggcggacccatgccaatgtccatgccaaacgtgatgacgggaacgatggggatggccccactgggcaacacaccaatgatgaatcagagcatgatgggtatgaacatgaacatcggaatgtctgccgctggcatgggactgaccggcacaatggggatgggcatgcctaacattgccatgaccagtggaacagtgcaacccaagcaagacgcattcgctaatttcgcaaacttctctaaatag

SEQ ID NO: 218618 - DNA, 1932 bp, Artificial Sequence
  Description of Artificial Sequence: Synthetic coding sequence
atgttaaatatgtggaaagtcagagagctggtggataaggcaactaacgtggtgatgaactacagcgaaatcgaatccaaggtgcgagaagccactaatgacgatccatggggacctagtggacagttgatgggagaaattgccaaggccactttcatgtatgagcaattccctgagctgatgaatatgttgtggagtaggatgctcaaagacaataaaaagaactggcgaagggtgtacaaaagcctcctgcttctagcatatctcattcgcaacgggtcagaacgcgttgttactagcgctagggaacacatctacgatcttcgcagcctcgaaaactaccactttgtggacgaacacggaaaggatcaaggaatcaacataagacagaaggttaaagagctggtggagtttgctcaggacgacgaccgactgcgggaagaacgcaaaaaagccaagaaaaataaagacaagtacgtgggggtcagttcggactctgtgggcggtttccggtatagtgaaaggtatgatcccgagcctaagtcaaaatgggatgaagaatgggataaaaacaagtcagcttttccattctcagataagcttggtgaattaagcgataagatcgggagtactatcgacgacactatttctaaatttagacgcaaggatcgtgaagatagtcctgagcggtgcagcgattccgacgaagagaaaaaggccagaagagggagatctccgaagggggaatttaaggatgaggaagagacagttacaaccaagcacatccacatcacccaggcaaccgagaccactacgaccaggcacaagcgtacagcaaatccatctaagactatcgacttgggggctgccgcacattataccggcgataaggccagccctgaccagaatgcgagcacacacacccctcaaagctcagtgaagaccagcgtgccttctagcaagagtagtggggatctggtggacctcttcgatggtacatctcagtccaccgggggatccgctgacttgttcggaggctttgccgacttcgggagtgctgctgcttccgggtcatttccatcacaggtcacagctactagcgggaacggcgatttcggtgactggtcagcattcaaccaggccccatccgggccagtagccagttcaggcgagttttttgggtcagcctcccagcctgcagtggaacttgtcagtggcagccaatccgcattagggcctcccccagctgccagcaacagcagtgatctgttcgatcttatgggctcctcccaggccaccatgacaagcagtcaatcaatgaattttagcatgatgtcaacgaatacagttggactgggactgcccatgtcccgtagccagccactgcagaatgtgtctacagtcctccaaaagcccaatcccttatataaccaaaacacagacatggtgcagaaaagtgtatcaaagacgctgccttcaacctggagcgatccttcagtaaacattagcctcgacaatcttctccccggaatgcaaccttcaaagccacagcaaccttccctcaataccatgatacagcagcaaaatatgcaacagcccatgaatgtaatgacccaatccttcggggctgtgaacctcagctcaccttcaaacatgttacctgtgcggccacaaacgaacgcattgatcgggggtccgatgccaatgtctatgcccaacgttatgactgggaccatgggaatggccccactgggtaacacccccatgatgaaccagagcatgatgggaatgaatatgaatatcggaatgtccgccgctggcatgggtctgaccgggactatgggaatgggcatgccgaacatcgctatgactagcggtaccgtgcagcccaagcaggacgcctttgctaacttcgcaaacttctccaaatag

SEQ ID NO: 218619 - DNA, 5027 bp, Artificial Sequence
  Description of Artificial Sequence: Synthetic coding sequence
atggcccaaatcctgcccatccgatttcaggaacacctgcagttgcagaacctgggtatcaatcctgcgaacatagggttctccacccttacaatggaaagtgacaagttcatatgtattagggagaaggttggggaacaggcacaggttgtgattattgacatgaacgaccctagtaaccccatcagacgcccaattagtgctgatagtgccatcatgaatcctgcaagtaaagtgatcgctctaaaagctggaaaaacactgcagatcttcaatatagaaatgaaaagcaagatgaaggcccatacaatgactgatgatgtcactttctggaagtggatcagtttgaataccgttgccctggtgacagataacgcagtgtaccattggtctatggagggagagtcccagcccgtcaagatgttcgacagacatagttccctggcgggttgccagattattaattacagaaccgacgctaagcaaaagtggctcttgctcacaggtattagcgcacagcaaaaccgggttgtgggagccatgcagttgtattcagttgacagaaaagtctcacagcccatcgaggggcatgctgcctctttcgcccagttcaagatggaaggaaacgctgaggagagcaccctcttctgttttgccgttcggggacaggccggaggtaagttacacatcatcgaagtcggcactccccctactgggaaccagccatttccaaagaaggctgtggacgtgttctttccacctgaagcccagaatgatttcccggtggctatgcagatctcagaaaagcatgatgtggtgttcctcataaccaaatacggttatatacatctgtatgatttggaaactgggacctgtatctacatgaaccgcatttccggagaaacgatctttgtgaccgcccctcacgaggccactgccggtatcattggagtgaaccggaaaggccaggtgctttccgtgtgcgtagaagaggagaacattataccctacatcaccaatgttttgcagaaccctgacctggctcttaggatggccgtgagaaacaatctggctggggcagaggaactgtttgctcgaaagtttaacgctctcttcgcccaaggcaactactctgaggcggctaaggtcgcagctaacgcaccgaaaggcattctgaggacaccagataccattcgcagattccagagcgtgccagctcagccaggacaaacctctcccttgttgcagtatttcgggattctccttgaccaaggccagctgaacaagtacgagtcattggaactttgccggcctgttttgcagcaggggcgaaagcaactgctcgaaaagtggctgaaggaggacaagttggagtgctccgaagagctgggcgatctggttaagtccgttgaccccactctggccttgtccgtctatctccgagcaaacgtgccaaacaaagtgatccagtgctttgctgagaccggtcaggtgcagaagatcgtactgtatgcaaagaaggttggatacacgcccgactggatctttttacttcgaaacgtaatgcgtatttctcccgatcagggacagcagttcgcccagatgctagtgcaggacgaggaacctctcgctgatatcacacaaatcgtggatgtgtttatggaatacaacctcattcagcagtgcacagctttcctgctcgatgcgctaaaaaataaccggcctagcgaagggccactgcagacccgtcttcttgagatgaacttgatgcatgcaccccaggtagctgatgcgatattgggcaatcagatgttcactcattatgatcgggctcacatcgcgcaactctgcgagaaagccggattgctccaaagagctctcgagcattttacggacctctacgacatcaagcgagctgtagtccatacgcatctgttgaatcctgaatggttggtgaattatttcggtagtctcagtgtagaagatagcctcgaatgcctgcgtgctatgctgagcgcgaatatacgtcaaaacctgcagatatgcgtgcaggtagctagcaagtatcatgagcagctttccactcagtcactgattgagctgtttgagtccttcaagagctttgagggcttgttctattttctgggatccattgtcaattttagccaggaccctgatgtccacttcaaatatatccaggcagcctgtaagaccggacagatcaaggaagttgaaaggatttgccgcgagtcaaattgttacgacccggagagggttaaaaattttctgaaagaggccaagctgaccgatcagctcccattaattatcgtctgtgacagattcgattttgtccatgacttggtgctttacctttaccgcaacaatttacaaaagtatatcgaaatctatgtgcagaaggttaatccctccaggcttccagtggtgatcgggggactgctggacgtggactgctccgaagatgtcataaagaatctgatattggtggtcagaggccagttctctacagatgaactggtcgcagaggtggagaagcgaaaccgcctgaaactgttactcccatggttggaggcaaggattcacgaaggctgtgaggagccagcgacacacaacgctctggccaagatatacatagactcgaacaacaatccagaacgctttttaagggaaaacccatattatgactcacgcgttgtaggcaagtactgcgagaagagggatcctcacctcgcctgcgtcgcatatgaaaggggccagtgcgacttggaacttatcaatgtctgtaacgagaatagcctgtttaagagcctcagcaggtacctggtgcggagaaaggaccccgagctgtgggggtctgtgctgttggagtctaatccgtatcgaagacccttaatcgatcaggtggttcagacagccctcagcgagacacaagacccagaagaggtaagtgtgacagtgaaggcctttatgacagcagacttacctaacgagctgatagaacttttggaaaaaatcgtgctggacaattcggtattctcagagcaccgaaatcttcaaaacttgctgatcctcactgcaattaaagccgaccggacccgcgttatggaatatattaatcggcttgataattacgatgcccctgatatcgccaacattgcaatcagtaacgagctttttgaagaggcattcgctatattccggaaatttgacgtcaacaccagcgccgtgcaggtcttgatcgagcacattgggaacctcgatcgggcatatgaattcgccgagagatgtaacgagcccgctgtgtggtcccagctagccaaagcccaactgcagaagggcatggtaaaagaggccatcgactcatatattaaagcggacgacccctcttcttacatggaggtggttcaggcagccaacaccagcggcaattgggaggagcttgtcaagtaccttcagatggcacgcaagaaagctagagagagttacgtggagactgaactcatctttgcactggccaagacaaatcgtttggcagagctcgaggagtttattaatggacctaacaatgcacatattcagcaggtaggggatagatgttacgacgaaaagatgtatgatgccgcaaaacttttgtataataacgtcagcaactttggacgcctggcttcaacactggtccacctcggggagtaccaggcagcggttgacggtgccaggaaggcgaacagtacaagaacctggaaagaggtgtgcttcgcctgcgtggatggaaaggagtttcgactcgcacaaatgtgtggtctccacattgtcgttcatgctgatgagctcgaagaactaataaactactaccaggatagaggatattttgaagaattgataaccatgcttgaagcggcactcggcttggagcgcgctcacatgggcatgttcactgaactggcgatcctttattctaagttcaagccccagaagatgcgagaacatctcgagcttttttggtcccgagtgaacattcccaaagtgttgcgagcagctgaacaggctcatctgtgggccgaactagtgttcctgtacgataaatacgaagaatacgacaatgccatcattacaatgatgaatcacccgacagacgcttggaaggagggccaattcaaagatatcattaccaaggtcgccaatgtcgaactgtactaccgcgcaattcagttttacctggagtttaaacctctccttctgaacgacttgctgatggttctctccccaaggttagatcataccagggcagtgaattacttctctaaagtgaaacaactccccctcgtgaaaccctacctccggtccgtgcagaatcacaataacaagagcgtcaacgaatcccttaacaaccttttcattacggaggaagactatcaggctcttagaactagcatcgatgcgtacgataattttgacaacatctccttagcacaacggctggaaaagcacgagttaatagagtttagacgcattgccgcttatctcttcaaggggaataacagatggaagcagagtgtagaactttgtaaaaaggacagtttatacaaggacgctatgcagtacgccagcgaatccaaagatacagagctggctgaagaactgcttcagtggttccttcaggaagaaaagagagagtgctttggcgcatgtctcttcacttgctatgatctcctgcggcctgacgtggtgcttgaaacggcctggagacacaacataatggacttcgccatgccttatttcatacaagtcatgaaagagtacttaacgaaagtagataagctcgacgcctctgagtccctgagaaaggaagaagagcaggctaccgagacccagccaatagtttacgggcagccccagctgatgctcaccgctggtccctcagtcgctgtgcctccacaggccccattcggttatggctacactgcacccccatatggacaacctcagccaggcttcggatactctatgta

SEQ ID NO: 218620 - DNA, 4923 bp, Artificial Sequence
  Description of Artificial Sequence: Synthetic coding sequence
atggcccagattctgcctgttagattccaggaacactttcagctgcagaaccttggcataaatcctgccaatattggcttctctacccttacaatggaaagtgacaagttcatttgtattagggagaaggtgggcgaacaagcccaagtgaccataattgatatgtctgatcctatggcacctatccgcagacctatcagcgccgaatccgccattatgaacccggcttccaaggtgattgccctgaaagccggaaaaactctgcagatcttcaatatagagatgaaatctaagatgaaagctcatactatggcggaggaggtgatcttttggaagtgggtgtctgtcaacaccgtcgccttggttacggagaccgctgtctaccattggagtatggagggtgattcacagcctatgaaaatgttcgaccgccacacaagcctggtcggttgtcaggtgattcactatcgaaccgacgagtaccaaaagtggttactccttgttggaatcagtgctcaacaaaacagagtggttggagccatgcagttgtactcagtggatcggaaggtgagccagcctattgagggccacgcagcagctttcgcggaatttaagatggaaggcaatgctaaacccgcaaccctgttctgttttgccgtgagaaatccgacgggaggaaagctgcatatcattgaggtggggcaacccgctgctggcaatcaacccttcgtcaaaaaggctgttgacgtgttttttccacctgaggcccagaacgacttcccagtcgcaatgcagatcggggcaaagcacggagtgatctacctaattacaaaatatggctacctgcacctgtatgatcttgaatctggagtctgcatctgtatgaaccgcatcagtgcagatacgatcttcgtcaccgccccacataaacccacttctggtatcatcggcgtaaacaagaaggggcaggtcctctcggtatgtgtcgaggaagacaacatcgtgaactacgccacaaatgttctccaaaatcccgacctcgggctgagactggccgtgcggtctaatcttgccggagcggagaagcttttcgtgagaaaattcaacaccttgttcgcacaaggcagttatgctgaagctgccaaagtggccgcttccgctcctaagggcatactccgcactagagagaccgttcagaagtttcaatcaattccagcccagtcaggccaggccagtcctttacttcaatactttggcattcttctcgaccagggccaacttaataagctcgagtccctagaactctgtcacttagttctgcagcaagggcgtaagcagcttctggaaaaatggctaaaggaagacaagctggaatgtagtgaagagttaggagatctggtcaaaaccactgacccgatgttggccctctcggtctacctgagggcaaatgtcccatctaaggttatccaatgctttgccgaaaccggtcagtttcagaaaatcgtgctgtacgccaagaaggtgggctatactcccgactggatcttcttacttaggggagttatgaagataagcccagagcagggtctgcagttctctagaatgttggtgcaggacgaggaaccgctagccaacatcagccagatcgtcgacatcttcatggaaaattcactaatccagcaatgcacttctttcctgctggatgcacttaaaaataaccggcctgctgagggcctcctgcagacttggcttctcgagatgaacctcgtgcatgccccacaagtcgctgacgccatattaggcaacaaaatgtttacacattacgatagggctcacattgctcagttatgcgaaaaggctggtctcctgcaacaggctcttgagcactacaccgatctgtatgatataaaacgggctgtagtccacacccacctcctgaatccggagtggctggtgaacttttttggttctctgtctgtcgaggatagcgtggagtgtctgcacgctatgctgtctgcaaatatccgtcaaaacctgcagctttgcgtgcaggtggcctctaagtatcacgaacaactgggcacacaggcacttgtggaactttttgaatcgttcaaatcttacaaagggctcttctatttcctgggctctatcgtgaattttagccaagatcctgacgtgcacttgaagtacattcaggccgcatgcaaaaccgggcagatcaaagaggttgaaaggatctgccgcgaatcttcctgctacaatcctgaacgcgtgaagaacttcctgaaagaagcgaagctgacggaccagctcccattgattatcgtgtgtgatcgtttcggcttcgtccatgacctggtcctgtatctgtacaggaataacctgcagcggtacattgagatctatgtccagaaagtcaaccccagccgaacccccgctgttatcggtggattgttggatgtggattgctcggaggaagttattaagcacctcatcatggccgtgcgaggacaattttcaactgacgaactcgtggctgaggtcgaaaaaagaaacaggctcaagctcctgcttccctggctagaatctcagattcaggaaggctgtgaggagccagccactcacaacgcactggcaaagatttacatcgactcaaataattccccagagtgttttctgagagagaatgcatactacgactcttctgtcgtaggtcggtactgcgaaaaacgcgatccccaccttgcctgcgtagcttatgaacgaggccagtgcgatcttgagttaatcaaagtgtgtaacgagaatagcttgtttaagtcagaggcgcgttacctggtatgtcgaaaggatcccgagctgtgggcccacgtactggaagaaaccaacccctccaggaggcagttgatagatcaggtcgttcagaccgctctctcagagacccgggatccagaggagatctcggtgaccgtgaaggcattcatgaccgcagacttaccaaacgaacttattgaactactggaaaagatagtcctagataattccgtatttagtgagcatcgaaacctgcagaatttgctaatcctcaccgctattaaggctgatagaacacgtgtcatggagtatatctccagactcgataactacgacgcactcgatatagccagtattgctgtctctagcgctctgtatgaggaagctttcacagtgttccacaaatttgacatgaatgcaagtgcaattcaggtcctgatcgagcatatcggcaacttggatcgcgcttacgagttcgctgagaggtgcaacgagccagctgtttggtcgcagctggcacaggcccagcttcagaaagacctggtgaaagaagcaattaacagctacatcaggggcgacgatccaagcagctatctcgaggtggtacagagcgcctctagaagtaacaactgggaggacttggttaaatttctgcaaatggctcgaaagaagggtcgtgagtcctacatcgaaacagagcttatcttcgcgctagcgaagacttctagagtcagcgagcttgaggattttattaatggtcccaataacgcgcacatccagcaggtcggagataggtgctatgaagaggggatgtatgaagccgcaaagctgttgtactccaacgtcagtaattttgccaggctggcctctacactggtgcatttaggagaataccaggcagccgttgacaatagcaggaaggcatccagcacacggacctggaaagaagtgtgttttgcttgtatggacggtcaggagttcagattcgcccagttatgtggactgcacatcgtgattcacgccgacgaactcgaggaactgatgtgctactatcaggatcgcggatatttcgaagaactgattttgctccttgaagctgctttaggcctcgagagggcgcacatgggaatgttcaccgagttagctatcctctacagtaaattcaagcctcagaagatgcttgagcatttggagctgttttggagtcgcgtgaatattcccaaagttttgcgcgctgctgagcaggctcatctgtgggctgagctggtgtttctgtacgacaaatatgaggagtacgataacgcagttctgactatgatgtcccatcctaccgaagcatggaaggagggccagtttaaggatattatcaccaaagtagcaaatgtggagctgtgctaccgagcattgcaattttatttagactacaagccattgttaattaatgacctgcttcttgtattatccccgaggctggaccacacgtggaccgtgtccttctttagcaaggcagggcagctcccacttgtcaagccgtacctaaggagtgttcagtcacataacaataagtccgtcaacgaggcattgaaccatctcctgacagaggaggaagattaccaggggttacgggcatccatcgacgcttacgataactttgacaatatctctctggcccagcagctggagaagcaccaactaatggagttccggtgtattgctgcctacctgtataagggcaataattggtgggcccagagtgtagagctgtgtaagaaagatcatctgtacaaggatgcgatgcagcacgcggctgaatctagggatgccgaacttgcacagaagctgctccaatggtttctggaagaaggaaaacgcgaatgtttcgccgcttgtctgtttacctgttatgatttgctgcggccagatatggtgctggaactggcgtggcggcacaacctggtcgatctagccatgccgtacttcatccaagtgatgcgagaatatctaagtaaagtggataagctggacgccctggagtcgctgcggaagcaggaggaacacgtgaccgagcctgcaccacttgtgtttgatttcgacggacatgagtag

SEQ ID NO: 218621 - DNA, 4752 bp, Artificial Sequence
  Description of Artificial Sequence: Synthetic coding sequence
atggctcaaattctgccggtcaggttccaggagcacttccagctccaaaatttaggcattaatcccgcaaatatcggcttttcgacgctgaccatggagtccgataagttcatctgcatccgggaaaaagtaggggaacaagctcaggtgactattatcgatatgtccgatccaatggcacccattagaagacccattagcgccgaatccgccattatgaatccagccagcaaagtaatcgccttgaaagccggaaaaacactgcaaatctttaacatcgagatgaagagtaaaatgaaagcccacacaatggcagaggaagtgatcttctggaagtgggtaagtgtaaacacagtggcgcttgtaacagagactgcggtctatcactggagtatggaaggcgactcccagcccatgaaaatgtttgatcgacatacatcactcgtgggttgccaagtcatacactatcgaaccgacgagtaccagaaatggctattgctggttggcatctctgctcagcaaaacagggtagtgggcgctatgcaactgtattctgtggataggaaagtgtcacagcccatcgagggccatgccgctgcgtttgctgagtttaaaatggagggtaacgctaagcctgctacattgttctgcttcgccgtgcgcaaccctactggtggcaagctccatattatagaggttggtcaacctgcagctggtaaccagccatttgtcaaaaaagccgtagacgtgttctttccccctgaggcacagaatgatttccccgtggctatgcaaatcggcgctaagcacggcgtcatctacttaattacgaaatacgggtatctgcatctgtacgacctggaatctggcgtctgtatctgtatgaacaggatcagcgccgacaccatattcgtgacggctccgcataaaccaacttccggtattattggtgttaacaagaagggccaagtattatccgtgtgcgtggaggaagataatatcgtcaactacgcaacaaacgtgctgcagaatcccgacctaggcctaaggctagcagtcagatcaaacctggccggtgcagaaaagctcttcgtgcggaagttcaataccttgtttgcacagggcagctacgccgaggcagcaaaggtggcagcaagtgcgcctaagggaattctgagaaccagggagaccgtccagaagttccagagtattccagcccagtctggccaggccagtcccctactccagtattttggtattctccttgaccagggccagctgaataagctggagtcactggagttatgccacctcgttctgcagcagggccgtaaacagctgttggaaaaatggctgaaggaagataaactggagtgtagcgaagagttgggcgacctggtgaagactactgacccaatgcttgccctgagcgtttatttgagggctaatgtgccttccaaggtgatccagtgcttcgcagagactggccagtttcagaagattgtcctgtatgcaaagaaagtgggctatacacccgactggattttcttgctcagaggtgtgatgaaaatatctcctgagcaggggctccaattctccaggatgttggttcaggatgaggaacccctcgcaaacatatcacaaattgtagatatttttatggagaacagcctcattcagcagtgtaccagtttcctgcttgacgccttaaaaaataacaggcctgccgaggggttactgcaaacatggctgctggaaatgaatctggtacatgcccctcaagtggccgatgctatactgggaaataaaatgtttacccactacgatcgggctcacattgcacaattgtgtgagaaggccggattgctgcagcaggcactggagcattacactgacctctatgatattaaacgtgctgtagtacatactcaccttctcaatccggagtggctggtcaacttcttcggttcactgagcgtggaggattcagtggaatgtctccacgccatgttgtcagccaatattcgccaaaatctccaactttgtgtacaggttgccagcaagtatcatgagcaactggggacacaagcactggttgaactgttcgagtcttttaaatcatacaaggggttgttttatttcctgggatcaattgtgaacttctctcaggaccctgatgtccacctgaaatatattcaagctgcctgtaaaaccggccagatcaaggaggtggaaagaatatgcagggagagctcttgttacaacccagaaagggtaaagaacttcctcaaggaagctaagctaaccgatcagcttccgctgataatagtctgtgatagattcggcttcgttcatgatctggtactctatctgtatcggaataacctccagaggtacatcgagatatatgttcagaaagttaatccatccagaacacctgcggttataggcggactgctggatgttgattgcagtgaggaagtgatcaaacatctgattatggctgtgaggggtcagtttagcacggacgagctagtcgccgaggtggaaaagagaaaccggctgaagcttttactgccatggctggagagtcagattcaggagggctgtgaggagccagcaacacataacgccctggccaaaatttatatagattccaataattccccagagtgctttctgagggagaatgcatactatgacagcagcgttgttggccgttactgcgaaaaacgggatcctcatctggcttgtgttgcttatgaacgcggacagtgcgatttagagctgattaaggtctgtaacgagaactccctgtttaagtcagaggctagatacctggtctgtcggaaagatcctgagttatgggcgcatgttttagaggagactaatccgagccggaggcagttaatcgatcaggtggttcagactgccttatccgagacacgagacccagaagagatatcagttaccgtaaaagcttttatgacagcagaccttccaaacgagctgatcgagctgctggagaaaattgtccttgacaactctgtcttctccgagcaccgtaatttacaaaacctgctgatccttactgcaatcaaagcagaccggacccgagtgatggaatacatcagcagattagataactatgacgctcttgacatcgcctccatcgctgttagcagcgccctatatgaagaggccttcacagtttttcataagtttgatatgaacgcttccgccattcaggtgctcattgaacatatcggcaatttggaccgggcatacgagtttgctgagcgctgcaacgagcccgcagtctggtcccagctggctcaagcacaattgcagaaggacctcgtcaaagaggcaattaattcgtacattcgcggtgatgatccctcatcctacctggaagtggtgcagtcagcaagtagaagtaacaactgggaggatttagtgaaattcctgcaaatggcaaggaagaaaggcagggagagctatatcgagacagaactcatatttgcactggcaaaaacttctcgagtttctgagttggaggacttcatcaatggtcccaacaacgctcatatccagcaagtcggtgatagatgctacgaggagggtatgtatgaggcagcaaagttgttatattccaacgtctccaatttcgcacgactggcatctaccctggtacacctcggagaatatcaagcggcagtggacaattctcgtaaggccagcagcacacggacctggaaagaggtgtgctttgcctgcatggacggccaggaatttcggttcgctcaactatgtggacttcacattgtcatccacgccgatgagcttgaagagctgatgtgttactaccaggaccgaggctactttgaagaactgatcctgctattggaagccgctttggggttggaaagagcgcacatggggatgtttactgagctggcaattctctattccaagttcaaacctcagaagatgctggagcacttagagctcttctggtcccgagtcaatatcccgaaggtgttacgcgctgctgaacaggctcatctttgggctgaactggtgtttctctacgataagtacgaggaatacgacaacgccgtcttaaccatgatgtctcatcctactgaggcttggaaggagggccagtttaaggatatcattacaaaggtggcgaatgtggagctatgctatagggctctgcagttctacctggactacaaacctcttctgattaatgaccttctgttggtcctgtcacctaggctcgatcacacatggacagtgtccttcttttccaaagcagggcaattacctcttgtgaagccctatctacggagcgtacaatcgcataacaataagagcgtcaacgaagccttaaatcatctgctgacagaggaagaggactatcaggatgccatgcagcacgcagccgagtcaagagatgcagagttagcccaaaaactgctgcaatggttcctggaggaaggcaagagggagtgctttgccgcatgcctattcacctgctacgaccttcttcggcctgatatggtgctcgagttggcgtggcgccacaatcttgtggacctggccatgccatacttcattcaagtgatgcgggaatatctgtcaaaggttgataagctggatgcgcttgaaagccttaggaaacaggaagagcacgtgacagaacctgctcctcttgttttcgatttcgatggccacgagtag

SEQ ID NO: 218622 - DNA, 4923 bp, Artificial Sequence
  Description of Artificial Sequence: Synthetic coding sequence
atggctcaaatactccctgtgcggtttcaagaacactttcagctacaaaacttagggatcaaccctgccaatattggcttttcgaccctgacaatggaaagcgacaagtttatctgcattcgagagaaggtgggagagcaagcccaggttacaatcatagacatgtcagaccctatggcccctatccggagaccaatcagcgccgagtctgctattatgaatcctgcatccaaagttatcgctctaaaagcaggcaaaaccctccagatatttaatatcgaaatgaaaagcaaaatgaaagcgcacactatggcagaggaagtcattttctggaaatgggttagcgtgaacaccgttgcactggtgacagaaacagccgtttaccattggagtatggaaggtgattctcagcccatgaagatgttcgatcggcacacgagcctggttggatgccaggtaattcattaccgcaccgacgagtaccagaaatggttgctgctcgtcgggatatccgcccagcaaaatcgtgtagtcggcgcaatgcagttgtactctgtggatcggaaagtttctcagcctattgaggggcatgctgccgcattcgctgagttcaagatggaagggaatgccaagcctgcaaccctgttctgcttcgccgtcagaaaccccaccgggggaaagttgcacattattgaagtgggccaacccgcagccggtaatcagccatttgtgaaaaaggcagtcgacgtgttcttccctccggaagcccaaaatgattttcctgtcgctatgcagataggagctaaacacggagtaatctacctaattacaaagtacgggtaccttcacttgtatgatctagaaagcggagtgtgcatctgtatgaataggatatccgccgatactatttttgtcaccgcaccacacaagccgacatcaggcataataggcgtcaacaaaaaagggcaagtcctcagcgtctgcgttgaagaggataacattgttaattacgctaccaacgtgctgcagaaccctgatctcgggttaagactcgccgtgcggagcaacctcgcaggcgctgaaaagctgtttgtgaggaagttcaacactctttttgcccagggcagttacgccgaggcggcaaaagtcgcagcatcggcccctaagggaattttacgcactcgagagactgtgcagaagttccagagtatccccgctcaatccggacaagcttcccctctcctgcagtacttcgggattctgttagatcagggacagttgaataaactagagagccttgagctttgtcacttggtcctgcagcaaggtagaaagcagctgttggaaaaatggttgaaagaggataagctggagtgctccgaggaactaggtgatttagtaaagacaaccgacccgatgctggccctttcagtctaccttagggcgaatgtcccttcaaaagtcatccagtgcttcgccgaaactgggcagtttcagaagatagtgctttatgcaaagaaagtgggttacactccggactggatcttcctgcttcgaggggtgatgaaaatttcgcctgagcagggattacagttctcacggatgctggttcaagatgaagagcctctggccaatatctctcaaattgttgatattttcatggaaaactccctaattcaacaatgcacttccttcctgctcgacgcactcaagaacaaccggccagccgaaggcctgctccaaacatggctgttggagatgaaccttgtgcacgccccacaggtggccgacgcaatcttgggcaataaaatgtttacacactatgaccgtgcacatatcgctcagctttgcgaaaaggctgggctcctccaacaggccctagagcattacaccgatctctatgacatcaagagggccgtagtacatactcacttgctgaaccccgagtggctggtcaacttttttgggagcctcagcgtggaggattcagtcgagtgcctgcatgccatgctgtctgctaacattagacagaatctccagctgtgcgtgcaggttgccagcaagtaccacgagcagttgggaacacaggccctcgtggagctgttcgagagctttaagagttataagggactgttctacttcctgggctccattgtcaactttagtcaagaccccgacgttcatctgaaatacattcaggcagcctgtaagaccgggcagatcaaagaagtggagcgcatttgccgggaatctagctgctacaaccctgagagagtgaagaactttctcaaagaagccaaactcaccgatcaactgccactgattattgtgtgcgatcgctttggcttcgtgcacgatcttgtcttatatctatacagaaataacttacaaaggtatatagagatctatgtacagaaggtgaatccgagccggacaccagcagtcatcgggggactgttggacgttgactgttccgaggaggtcattaaacatctgattatggctgtgaggggacagttctccaccgatgagctggtcgctgaagttgagaaaagaaacaggcttaagcttttgttaccttggctcgagagtcagatccaggaaggctgcgaggagccagccacccacaacgccttagcaaagatctacattgatagcaacaactctccagaatgctttttgcgcgagaatgcctattatgacagctctgttgtgggcagatattgcgagaagagggacccccacctggcatgtgttgcgtatgagcggggtcagtgcgaccttgaactaataaaggtatgcaacgaaaattctttatttaaatccgaggcaaggtacttggtgtgccgcaaagatcctgaactctgggcgcatgtgctagaagaaactaacccttcacgccgtcagttgattgaccaggtggtgcagaccgctctatccgaaacccgggaccctgaggaaatcagcgtgacagtgaaagctttcatgacagcggacctcccgaatgaattaatcgaactgctcgagaagatagtgttggataactccgtgttctcagaacatcgaaacctccagaatctcttaatactcacagcgattaaggcagatcgaactagggtgatggagtatatcagcaggctggataattatgatgctttagatattgcgagcatcgctgtctcctcggccctgtacgaagaggcctttaccgttttccacaaattcgatatgaacgccagcgcaatccaggtgctgatagagcatatcggcaacctcgacagagcttatgaattcgccgagcggtgcaacgagcctgctgtgtggagccaactggcacaggcgcagctacaaaaggatcttgtaaaggaggccattaacagctatattaggggggatgacccgtcgtcataccttgaagtggtccagagcgcttcacgatccaataattgggaagaccttgttaagtttttgcagatggctaggaaaaagggaagggagagctacatcgaaacagagttaatctttgctcttgccaagacgtctcgtgtgagtgagttagaagactttattaacggcccaaataacgctcacatacagcaagtcggggataggtgctatgaagagggcatgtatgaagccgcaaagttattgtatagtaatgtctccaacttcgccagactggccagtacactggtacatctgggtgagtaccaagctgcagtagacaacagcagaaaagcttcttcgacccggacttggaaggaagtgtgttttgcttgcatggatggacaggagtttcgtttcgcccaattgtgcggactccatattgtcatccatgccgacgaactcgaggagctcatgtgctactaccaagatcggggatactttgaagagctcatcctcctgctagaggctgcccttggtctggaaagggctcatatggggatgttcactgagctggccatcctgtattccaagttcaagccacaaaagatgctggagcacctagaactcttctggagtcgggtgaacatccctaaggtcctcagagcagccgagcaagctcatctctgggccgaacttgtcttcctatatgacaagtacgaggaatatgacaatgcggtccttactatgatgagccaccctaccgaggcgtggaaagaaggtcagttcaaggacatcatcacaaaggttgctaatgtcgaattgtgctaccgggctctgcaattttacctggattacaagcctcttctcatcaatgacttgctactcgtgttgtcacccagactggatcacacatggaccgtgagcttctttagcaaagccggacagctgcccctggtgaaaccgtacctgcgctctgtgcagtcacataataacaaatccgtgaatgaagcattaaaccatttactcaccgaagaggaggattatcaaggtcttcgagcttctatcgatgcatacgataactttgataacatatcccttgctcaacagcttgagaaacaccaactgatggaatttcgctgtattgccgcttacttgtataagggcaataactggtgggctcagtcggtcgaactgtgcaagaaagaccacctgtataaggatgccatgcagcacgccgcagaaagtcgcgatgcagaactggcacaaaagttattgcagtggttcctggaggagggcaaacgcgaatgctttgctgcctgcctcttcacttgctacgaccttttgaggccggatatggtgttagagctcgcgtggaggcataacctggtggacctggccatgccatactttatccaggtgatgcgcgagtacctctccaaagttgataagcttgatgcccttgagagtttgaggaagcaggaggagcatgttactgagcccgctcctctggtcttcgatttcgacggtcatgagtag

SEQ ID NO: 218623 - DNA, 747 bp, Artificial Sequence
  Description of Artificial Sequence: Synthetic coding sequence
atggccgaactggacccattcggtgcccctgccggagctcccggtgggcctgctctgggaaatggcgtagcaggcgctggagaagaggaccccgctgccgctttcctggcacagcaggagagcgaaatagccggaattgaaaacgacgaggcctttgctatcctggacggcggagcgcctggaccccaaccccacggagagcctcctgggggtccagacgccgtggacggagtcatgaatggtgagtactaccaagaatccaatgggccaaccgacagttacgctgccataagccaggtggaccggcttcagagcgagccagaatctattcggaagtggcgcgaggaacagatggagcgactggaagcattggatgctaactcacgcaaacaggaggctgagtggaaagaaaaagcaatcaaggagcttgaggagtggtatgccaggcaagacgagcagttacaaaagacgaaggcaaacaacagggtggcagacgaagcgttctacaagcaaccgtttgccgacgtgattggctatgtcaccaacattaatcatccgtgttactcactggagcaagctgctgaagaagcttttgtgaatgatattgacgagtcctcaccaggaactgagtgggaacgcgttgccagactctgcgatttcaatccgaaatcatcaaaacaagccaaggacgtgtctcgaatgcgttctgtcctaatctccctgaagcaggccccactggttcattag

SEQ ID NO: 218624 - DNA, 657 bp, Artificial Sequence
  Description of Artificial Sequence: Synthetic coding sequence
atggccgaactggatcctttcggcgcaccagcaggcgcacccggaggccctgctctcggcaatggcgtcgccggagctggagaagaagatcccgctgctgccttcttagctcagcaggagtctgagattgccggaatcgagaacgacgaggccttcgccatcctggatggcggtgcacccggacctcaaccacatggagagcccccaggaggacccgacgccgtcgatggagtaatgaatggggagtactaccaggaaagcaatggtcccactgacagctatgccgcaatcagccaggtggaccggcttcagagcgagccggagtcgatacggaagtggagagaggagcagatggaacggctggaggctttggacgctaacagccggaagcaagaggctgaatggaaggagaaagctattaaagaactggaagagtggtacgcgaggcaggatgaacaactgcaaaagactaaggccaataatcgtgccgctgaggaagcttttgttaacgatattgacgaatcctccccaggtacggaatgggagcgtgtagctcgattgtgtgatttcaacccaaaaagctctaagcaggcaaaagatgtcagccgaatgagatcagttctcatttccctaaaacaggcaccactcgttcattag

SEQ ID NO: 218625 - DNA, 711 bp, Artificial Sequence
  Description of Artificial Sequence: Synthetic coding sequence
atggccgagctggacccttttggcgctccagcaggagcccctgggggacccgcattgggaaacggagtggctggagcaggggaggaggacccagctgcggcattcctcgctcaacaggagtcagagatcgctggcatcgagaacgacgaagcatttgctattctggatgggggagctccaggccctcagccccatggggagccaccagggggacctgatgctgtggacggcgtaatgaacggcgagtactaccaggagagcaatggcccaaccgattcctatgcagctatttcccaagtcgatcggctgcaatctgagccagaaagcatccgaaagtggagggaagagcaaatggagcggctcgaagccctggacgctaactcccggaaacaggaagctgagtggaaagaaaaagccattaaggagttggaggagtggtacgcacgccaggacgagcaactccagaagaccaaggccaataatagggttgcagatgaagccttttataagcagccgtttgccgacgtgatcgggtatgtggccgcagaagaggctttcgttaacgacatagacgagtctagtcccggtacggagtgggagagagtagcaagactctgcgattttaacccaaagtcctcaaaacaagccaaggacgtaagcagaatgcgctctgtcctgatctctctaaagcaggctcccctcgtgcattag

SEQ ID NO: 218626 - DNA, 747 bp, Artificial Sequence
  Description of Artificial Sequence: Synthetic coding sequence
atggccgagttggacccctttggtgcccctgctggcgcaccaggagggcctgccttagggaatggagtcgcgggagccggtgaagaggacccagctgccgctttcctggctcagcaagaatccgaaattgccggaattgagaatgatgaagccttcgccattctggacggtggggctcccggaccacaaccccacggtgagccccctggcggacctgatgctgtggatggggttatgaacggagaatactatcaggagtctaacgggccaactgacagctacgctgccatcagtcaggtcgaccgactgcagagcgagccagagtcaatcagaaagtggcgggaggaacaaatggaaagactggaggcgctggacgctaatagccgaaaacaggaagccgagtggaaggaaaaagcgatcaaggagcttgaggaatggtacgccagacaggatgagcagctgcagaaaactaaggccaataacagggtagcggatgaagccttttacaagcagccatttgcggatgtcataggatatgtcactaacattaatcatccatgctactccctggagcaggctgcagaagaggcattcgtcaatgatatcgacgaaagctctccagggaccgagtgggagcgtgtggcacggctgtgtgatttcaaccccaaatcatcaaaacaggccaaggacgtcagtaggatgagaagcgtgctcattagcctaaagcaggcccctctggtccactag

SEQ ID NO: 218627 - DNA, 693 bp, Artificial Sequence
  Description of Artificial Sequence: Synthetic coding sequence
atggcagagctcgatccttttggggctccggcaggtgccccaggcggtcccgctttagggaacggagtggcaggcgcaggggaagaagatccagctgctgcttttctcgcccagcaggagagcgagatcgctggtattgagaacgatgaagcgtttgctatcctggatggtggagcacccggtcctcaacctcatggcgagcctcctggcggtccggatgccgtcgacggggtaatgaacggcgaatactaccaggagagcaacgggccaactgactcatatgctgcaatatctcaggttgacaggctgcagtctgaaccggagagcattcgcaagtggcgcgaggagcagatggagcgcttggaggcactcgacgctaatagccgaaaacaagaagcagagtggaaagaaaaagccattaaggagctcgaagaatggtacgcaaggcaggatgagcagcttcaaaaaactaaagccaacaactcaacgaatattaaccacccttgctatagcctagagcaggccgcagaagaggcctttgtgaatgacatcgatgaaagtagtcccggaaccgagtgggagagggttgctcgcctgtgcgatttcaacccaaaaagtagcaagcaggctaaagacgtaagtcgcatgcggagcgtattgatctccttgaagcaggccccactcgtccactag

SEQ ID NO: 218628 - DNA, 693 bp, Artificial Sequence
  Description of Artificial Sequence: Synthetic coding sequence
atggccgaactggacccttttggagcccctgccggagccccagggggtccggcattgggaaatggggtggcaggcgctggagaggaagaccctgccgctgcattcctggcccaacaagaatcagagatcgccggtatcgagaatgatgaggcatttgcaattctggacggtggggctcctggaccccaaccgcacggggagcccccagggggtccagatgccgtggacggggtaatgaacggagagtattatcaagaatccaatggcccaacggatagctatgccgctatcagccaggtggatagactgcagtctgagccagaatctatcaggaaatggagggaagagcagatggaacgcctggaagccctagacgccaactcacgcaaacaagaagctgagtggaaagagaaggccataaaagagctagaagaatggtacgctcggcaagacgagcagctgcagaagactaaagccaataactccaccaatattaaccatccgtgctattcactggagcaagccgctgaagaagctttcgtaaacgatatcgacgaatcatcaccaggtaccgagtgggaacgggtggctcgcctgtgcgatttcaatcctaagagctctaaacaagccaaagatgtgtctcgcatgcgtagcgtattgatcagtctgaaacaggcccctctcgtgcactag

SEQ ID NO: 218629 - DNA, 501 bp, Artificial Sequence
  Description of Artificial Sequence: Synthetic coding sequence
atggccgagctggacccttttggggcacccgctggggctccaggcggtccagccctgggcaacggtgtggcaggtgccggagaggaggatcccgctgccgctttcctggcccaacaagagtccgagattgccggaattgagaatgatgaggcctttgccatcctggacgggggagcccctgggccacagccgcacggcgagccacctggtggacctgacgccaacagcaggaagcaggaagctgagtggaaggaaaaggctataaaggagctcgaggaatggtacgcccgtcaggacgaacagctgcagaaaaccaaggcgaataaccgggctgctgaggaggcttttgtgaacgacatcgacgaatcctcccccggtaccgagtgggaaagggtggctagactgtgtgacttcaatcccaagagttcaaagcaggcgaaggatgtcagcaggatgagatccgtgctgatcagtctcaaacaggcccctctggtgcactag

SEQ ID NO: 218630 - DNA, 690 bp, Artificial Sequence
  Description of Artificial Sequence: Synthetic coding sequence
atggccgatgactttggttttttctccagctccgagagcggagcgcctgaagccgcagaagaagatcctgctgccgcatttctggcccaacaggagagcgagatcgctgggatagagaatgacgaagggttcggtgcaccagccggatcccatgctgcgccagctcaaccaggtcctacaagtggcgctggttctgaggatatggggacaaccgtaaatggtgacgttttccaggaagcaaatgggcctgctgacgggtacgccgcaatagctcaggccgatagacttactcaagagcctgagtctatccgcaaatggcgggaggaacagcgtaaacggttgcaagagctcgatgccgcatccaaggtcacagagcaggagtggagggaaaaggctaaaaaagatctcgaggaatggaaccaaagacagtctgaacaggttgagaagaacaaaattaacaaccggatcgcagacaaggctttctatcagcagcctgacgccgacatcatcggatacgtcgccagcgaagaggcattcgttaaggagtccaaggaggaaactcccggtacagaatgggagaaagtggcccaactttgcgactttaatcccaaaagctcaaaacagtgcaaagatgtgagtaggctccggagtgtgctgatgtccttaaagcagactcccttgtcacggtag

SEQ ID NO: 218631 - DNA, 636 bp, Artificial Sequence
  Description of Artificial Sequence: Synthetic coding sequence
atggcagacgactttggctttttttcctcctctgaaagcggagcgcctgaagctgcggaggaggatcccgctgccgcttttttggcccaacaagaatctgagattgccggaatcgagaacgatgaaggattcggcgcacccgctgggtctcatgctgctccagctcagcctgggcctacctccggggcagggtccgaagatatgggcacgactgtaaatggggacgttttccaggaggcaaatgggcctgcagacggctatgctgccatcgcccaggcagatcggctgacccaggaaccagaatcaatacggaaatggcgagaggagcagaggaagaggttacaggaactggacgccgctagcaaggtaaccgagcaggaatggagggagaaagcgaagaaggaccttgaagagtggaaccagaggcagagcgaacaagtagagaagaacaaaatcaacaatagggcaagtgaggaggcattcgtgaaagagtcgaaagaagaaacccccggaacagaatgggagaaagtcgcacagctttgcgacttcaatcccaagagcagtaagcagtgcaaggatgtgtcaaggctacgctcggtattaatgagcttgaagcagacccctttgagtcgctag

SEQ ID NO: 218632 - DNA, 405 bp, Artificial Sequence
  Description of Artificial Sequence: Synthetic coding sequence
atggccgacgactttgggttttttagttcaagcgagtcaggcgctccagaggccgctgaggaggaccctgcagctgcctttctagcccaacaagaatctgagatcgctggaatagagaacgacgagggtttcggcgcacctgccggatctcacgctgcgcctgctcagccagggccaacgtcgggggctggctctgaggatatgggcaccacagtgaatggcgacgttttccagcctgtgcaccatcagcgagtacaattacagacgcagctgcctatccaaccaaaagacgagccagctcacaactacagcagcagtatctggcactctcaggggcagggacagaaaggacctgcgggactgagactgcctacatctgcccagatcttgagtccatttccatag

SEQ ID NO: 218633 - DNA, 636 bp, Artificial Sequence
  Description of Artificial Sequence: Synthetic coding sequence
atggccaacgccggattgcagctgctaggctttattctagcattcttgggttggatcggagcaatcgtttccacagccctgccgcagtggcgcatttacagctacgccggtgacaacattgtcacagcccaggccatgtatgaaggactatggatgtcctgcgtgagtcaatcaacgggccaaattcagtgtaaggtgttcgattctctgctgaatctgtccagcaccttgcaggctaccagagcactaatggtggtcggaatcttactcggtgtgattgcaatcttcgtggctactgtaggcatgaagtgtatgaaatgccttgaggatgatgaggttcagaagatgcgaatggctgttatcggcggtgccattttcctgcttgctggtctggctatccttgtcgctactgcttggtatggaaacaggatcgtgcaggagttttatgacccgatgacgcccgtaaacgctcgctacgaattcgggcaagcgctgtttacagggtgggcagccgcatcactttgccttcttggtggtgccttattgtgttgctcctgtccccgaaagactaccagttaccctactcctcgtccctacccaaaacctgcaccctcctccggcaaagattacgtctag

SEQ ID NO: 218634 - DNA, 501 bp, Artificial Sequence
  Description of Artificial Sequence: Synthetic coding sequence
atgtacgaaggactgtggatgtcatgtgtttcccagagtactggtcagatccagtgcaaggtgtttgactcccttctgaaccttagcagtaccttacaggccacaagagcactaatggtggtggggatactccttggagtgatagccatctttgtggccacagtgggtatgaaatgtatgaagtgcttggaagatgatgaagtgcaaaagatgcgcatggctgtgatcggcggagctatttttctgcttgctggtctggcaatactcgttgccactgcctggtatggcaaccggattgtgcaggaattttatgatccaatgactcctgtgaatgcccgatacgaatttgggcaggctctattcactggttgggcagcagcaagcttatgcctgctcggaggcgcacttctgtgctgtagctgcccacgtaagactacaagttatccaacccccaggccctacccgaaaccagctccctcctcggggaaggactacgtgtag

SEQ ID NO: 218635 - DNA, 624 bp, Artificial Sequence
  Description of Artificial Sequence: Synthetic coding sequence
atggtcgcaacttgtctgcaagtggtggggttcgtgacctcctttgtggggtggattggggtcatagtcacgactagtaccaacgactgggtggtgacatgcgggtatactatccctacctgccgaaagttggacgaactgggttcgaagggcctatgggctgactgtgttatggccactggcctttaccactgcaaacccttggtggacatcttaattctgcctgggtacgtgcaggcatgccgggctttgatgatcgctgctagcgtgctaggtttaccagccatccttcttctcctgactgttcttccttgtatcagaatgggtcaggaaccgggagtagctaaatatcggagggcacagctcgccggtgtgctgctgatccttctcgctctgtgtgctctggtagccactatttggtttcctgtgtgtgcccacagagaaacgaccatcgtgtcattcgggtattcactttacgcgggttggatcggtgcagtgctgtgcctggtgggaggctgcgttatcctgtgctgcgcaggtgatgcccaggcctttggtgagaatcgcttttattacaccgccggttcgtccagccctacgcacgctaagagcgcacacgtctag

SEQ ID NO: 218636 - DNA, 498 bp, Artificial Sequence
  Description of Artificial Sequence: Synthetic coding sequence
atggtggcaacatgcctacaagtggtggggtttgtgactagcttcgtgggctggatcggggtaatcgtaacaacaagtacaaacgattgggtcgtaacatgtggatatactatccccacctgccggaagctagatgagcttgggtcaaaaggcctctgggcagattgcgttatggcaaccgggctttaccattgcaaaccactggttgacatccttatcttaccaggctacgtgcaggcgtgcagggccctgatgatagccgcttccgtcttgggactaccggctatactgctcttgctgaccgtgctcccctgcattcgcatgggccaggagcccggagttgccaagtaccgcagggcgcagttggctggagtgcttctgattctgttgggatgtcagctcctgtgggcaaagacagagagtagcctgcactcacagcacctggtccaatttaagcaaaaatacttggaagatttcagttacctgcaaggggactag

SEQ ID NO: 218637 - DNA, 498 bp, Artificial Sequence
  Description of Artificial Sequence: Synthetic coding sequence
atggtggccacttgtttacaagttgtgggcttcgtgaccagctttgtgggttggatcggtgtgatcgtgacaacgtcgactaatgattgggtggtaacatgtgggtatacaatccctacctgtcgcaagctggacgagcttggaagtaaaggactgtgggcggactgcgtcatggctacaggcctgtatcactgcaaaccgctggtggacattctgatactaccgggatacgttcaggcatgtcgcgctctgatgatcgccgcttcggtattgggtctccccgctatactgctattactgacagtcctcccttgtattcgaatgggacaagagcccggagtggcgaagtatcgtcgggcacagctggccggtgttctgctcatacttctgggctgtcaactcctgtgggccaaaactgagtcttctctccatagccagcacttagttcagtttaagcagaagtatctagaggacttttcttatctgcagggcgattag

SEQ ID NO: 218638 - DNA, 720 bp, Artificial Sequence
  Description of Artificial Sequence: Synthetic coding sequence
atggcgagcacggccgtccagctgctggggttcttgttatcctttcttgggatggttgggaccctcattaccaccatacttcctcattggcgcagaactgcccatgtgggcaccaatattctgacagctgtcagctatctgaaaggtctgtggatggaatgtgtttggcatagcacgggaatctaccagtgtcagatctaccggagcctgctggctcttccacaggacctgcaggctgctcgtgccctcatggtgattagctgtctcctgagcggaattgcttgtgcttgtgctgtgattgggatgaagtgtacgagatgtgcaaaagggacaccagctaaaaccacgtttgcaatactcggcggaacgttattcattctcgccggtttgttgtgtatggtggctgtcagttggaccacaaacgatgtagtccagaacttctataaccctttacttcctagtgggatgaaatttgaaattggccaggccctctatctgggcttcatctcgagctccctgagcctgattggcggaacccttttgtgtctttcttgtcaggatgaggcgccatataggccttatcaggcaccccctcgggctacgaccaccactgccaacactgcccctgcttaccaacccccagcagcatataaggacaaccgcgcaccatctgtgacatctgccacccactccgggtatcgccttaacgattatgtttag

SEQ ID NO: 218639 - DNA, 720 bp, Artificial Sequence
  Description of Artificial Sequence: Synthetic coding sequence
atggcaagcaccgcagttcaactgttaggcttcctgttgagctttcttggtatggtaggaacactgatcaccaccatcctgccgcattggagaaggactgctcatgtcggtacaaacatcttgaccgcagtttcctacctaaaaggactatggatggagtgcgtgtggcattctaccggcatctatcagtgccagatctatcgctccctcttggccctaccgcaggacctgcaggcggcacgcgcactgatggtgatctcatgcctgcttagcggtattgcgtgcgcctgcgcggtgattgggatgaaatgtacccgctgtgcaaagggtacccccgctaagacgacatttgccatcttgggcggtaccctcttcatcctggcgggactgttatgtatggtcgctgttagctggacgaccaacgacgtggtgcagaatttctataaccctttgctgccttccgggatgaaatttgaaattggacaggctctgtacctgggattcatttcctcctccctgagtctcatcgggggtacccttttatgtttgagctgtcaggacgaggcaccgtaccgcccttatcaggcacctcctagggctaccacaacaacggctaacacagcgcctgcctatcagccgccagctgcatacaaggataacagggccccaagtgtcacctctgccacacattccgggtacaggctgaacgattacgtttag

SEQ ID NO: 218640 - DNA, 720 bp, Artificial Sequence
  Description of Artificial Sequence: Synthetic coding sequence
atggcaagcacggctgtgcagctgctgggttttcttctgagcttcctgggcatggtgggaaccctcatcaccacgatcctacctcattggcgccgaaccgcccacgtgggcactaacatacttactgcggtgagctatctgaagggtctctggatggagtgtgtctggcactcaacaggaatttatcagtgtcaaatatatcgttcactgctggccctgccacaggacctccaagctgcacgcgcactcatggttatctcctgtctgctctccggcatcgcctgtgcctgtgcagtgattgggatgaaatgcacccgctgcgcaaaggggactccagctaagaccacatttgcgatcctggggggtacactgtttatcctggcagggctgctctgcatggtagctgtgtcctggactaccaatgatgttgtccagaatttctataaccccctcctcccaagcggtatgaagttcgagattggccaggccctgtacctcgggttcatttcatcttcattatctctaatcggcggaactctgctttgcttgagctgtcaggacgaagcgccatacaggccctaccaggcaccgcctcgcgcaaccacaaccaccgccaacacagcgccagcctatcagccccctgcggcttacaaggataatagggccccttcagtgactagtgccactcactcaggctaccgactgaacgactatgtgtag

SEQ ID NO: 218641 - DNA, 720 bp, Artificial Sequence
  Description of Artificial Sequence: Synthetic coding sequence
atggccagcaccgccgtccagctgttgggattcctgctgagcttccttggcatggtgggcacgctaattaccactatcctcccccactggagacgcaccgcccacgttggaacaaacatcctgacagcagtgagctacttgaagggcctgtggatggagtgcgtctggcattcaacaggcatataccagtgtcagatctatcgaagtttactggctcttccccaggatcttcaggcagccagagccttaatggtcatctcgtgcctgctgtcaggcatcgcctgcgcctgtgccgtgattggtatgaagtgcacccgctgtgctaagggcactcctgcaaagaccaccttcgctattctaggcggaactctcttcattctggctggcctgttgtgcatggtcgcagtgagttggacgacaaatgatgtggtgcagaacttttacaatcctctcttacccagtggcatgaaattcgagatcggtcaagctctttacctgggcttcatcagttcttccttaagtctgattggcggaacactgctgtgcctcagttgccaagatgaggctccctacaggccctaccaagcaccgccacgggcaactacgactactgctaacaccgccccagcgtatcagcccccagccgcatataaagacaacagggccccttccgtcacatccgcaacgcacagcggttaccgtctaaacgattatgtctag

SEQ ID NO: 218642 - DNA, 720 bp, Artificial Sequence
  Description of Artificial Sequence: Synthetic coding sequence
atggcctctactgcggtgcagctcttgggtttcctgttgagcttccttggcatggtgggaactctgatcacaacaattctccctcactggaggagaactgcccatgtgggcacgaatatactcacggccgtgtcttacctcaagggcttgtggatggagtgtgtttggcattctactggcatctatcagtgccagatctaccggagcctgctcgccctgccccaggacttgcaagctgctcgggcactgatggtcatcagctgcctgctgtccggtattgcttgtgcttgtgctgttatcggcatgaagtgcacacgctgtgccaagggcacccctgccaagaccacttttgccatcctgggtggcactctctttatacttgccggattactgtgtatggtagctgtgagctggaccactaatgatgtggtgcagaacttttataatcccctgttacccagtggaatgaagttcgaaattggtcaagcactgtatttgggcttcatctcctcttccctctccctgattggcggaacactgttatgtctgtcttgccaagacgaagccccttaccgcccttaccaggcgcctccccgtgccaccacaactactgccaacactgctccagcttaccaacccccagccgcttacaaagataatcgggctccatctgtgacctccgcaacccactccggatacagactgaacgattacgtatag

SEQ ID NO: 218643 - DNA, 918 bp, Artificial Sequence
  Description of Artificial Sequence: Synthetic coding sequence
atgacgtcccgcacaccccttctggtgactgcctgtctgtactattcctattgcaactccagacatctgcagcagggcgtaaggaaatctaaacgtcccgtgtttagccattgtcaagtcccagaaacgcagaagactgacacccgacacttaagcggcgctagagcaggagtctgtccatgttgccatcccgacggcttgctggctactatgcgcgacctgctacagtatatcgcctgcttctttgccttcttctcagcgggttttcttatcgtggccacatggaccgactgttggatggtcaatgcggatgattccctggaagtgtcaaccaaatgcaggggcctttggtgggaatgtgtgactaacgcattcgacggtataagaacctgcgatgagtatgatagcatcctggcggaacaccctttaaaactggtggtgacgagggccctcatgatcaccgcagatatactggcgggatttgggtttctcacactgctcctaggtctagactgcgtgaagttcctgcccgatgagccatatatcaaggtgcgcatctgttttgtggccggagcgacgcttctgatcgccggaacaccaggcattataggcagcgtgtggtacgcggtcgatgtctatgtggaaagaagcacattggtactgcacaatatcttcctgggcatccagtataagttcggctggagctgttggttggggatggctggctctctgggatgtttcctcgctggggctgtcctcacctgttgtctctatttgttcaaggatgtcggtcccgaacggaactacccgtactctctccgcaaggcttattccgcagccggagtctccatggccaaatcctactccgccccacgtacagaaactgcaaagatgtatgccgtggatacacgtgtgtag

SEQ ID NO: 218644 - DNA, 360 bp, Artificial Sequence
  Description of Artificial Sequence: Synthetic coding sequence
atgacctctcgtactcctttgctggtgacagcttgtctctactatagttattgcaatagcagacacctccagcagggagtgcgtaaatccaaacgtcccgtgttctcccactgccaggttcctgagacgcagaaaaccgacacccgacacctctccggggctcgtgccggtgtttgcccatgctgccacccagatgggctcttagctacgatgcgcgatctgcttcagtacattgcctgtttttttgctttcttttcagccggattcctgatcgttgcgacttggaccgactgctggatggtgaatgcagacgattcccttgagatgctcgacctcagggagaccatcctgatcccatag

SEQ ID NO: 218645 - DNA, 675 bp, Artificial Sequence
  Description of Artificial Sequence: Synthetic coding sequence
atggcaaattccggcctccagctcctgggctacttccttgctctgggagggtgggtcggtatcatcgcctctaccgccctaccccagtggaaacaaagtagctatgctggagatgcaattatcaccgctgtcggattgtatgaaggcctctggatgtcctgcgccagccaatccaccggacaggttcagtgcaagctttatgattcattattggcacttgacgggcacattcagagcgcgcgagctttgatggtcgtggccgtgctgctcggttttgtggccatggtactttccgtcgtgggtatgaaatgtactcgcgtgggcgattcaaatccaatcgccaagggtagagtggcaattgccggaggcgcactgttcatcctggccggtctgtgcaccttgaccgcagtcagctggtatgctacattggttacacaggaattcttcaacccatcaacccccgtgaacgcacgatatgaatttggccctgccctgttcgtggggtgggcctctgctggattggccgtgctgggcggatcctttctgtgctgcacatgcccagagccagaacgaccgaacagttcgcctcagccataccgacccggtccgagcgcagcagcgagagaaccagttgtgaaactgccggcttccgccaagggcccactaggagtgtag

SEQ ID NO: 218646 - DNA, 636 bp, Artificial Sequence
  Description of Artificial Sequence: Synthetic coding sequence
atggcgaacagcggacttcagttgctgggctactttctcgccctgggcggttgggtgggcataattgctagtactgccctccctcagtggaagcagtcatcctacgctggagacgccatcattactgccgtcggcctgtacgagggtctgtggatgtcttgtgccagccagtctacaggccaggttcagtgtaagctctatgatagcttgttagccttggacggtcacattcagagtgccagggctttgatggtcgtcgctgtgctgttagggtttgtggccatggtgctcagcgtggtgggcatgaaatgtacacgggttggcgacagtaatccaatcgcgaaaggcagggttgcaatcgccggaggcgcactattcatacttgctggcctgtgcactttgacagcggtcagttggtacgccaccttggtaactcaggaatttttcaaccccagtacgccggtgaacgccagatacgaattcggaccggcactgtttgtgggatgggccagcgccggactcgccgtgttgggcggttcttttttatgctgcacctgccctgagcctgaacggccaaattcttctcctcagccgtaccgccctgggccatctgccgcagccagggaatacgtgtag

SEQ ID NO: 218647 - DNA, 657 bp, Artificial Sequence
  Description of Artificial Sequence: Synthetic coding sequence
atggcaaacagcggcttacagcttttaggctatttcctggctttgggagggtgggtggggataatcgcttcaaccgccctcccacagtggaaacagagctcctatgctggcgacgcaataatcacagctgttggcctatatgaagggctttggatgtcttgcgcaagccagtcaacaggtcaggtacagtgtaaactctatgacagcctgctggccctagacgggcacatccagtcagcaagagccctcatggtggttgcagtgctgctgggcttcgtcgccatggtcctcagcgtggtgggcatgaagtgcactcgtgtaggcgatagtaatcctattgccaaggggagggtggctatcgctgggggagctctctttatcctggcgggaatgaacctggcacagccctgttcttgggccggacctcaactggcatggccttgctgggctgctccgagctcggctgcacacgccaggagtcaacgggatccaaccgccgctcacagccccatcggactcgaccctcttctgctaccagaatccacctccgaacttaggctgccctggccggctcctcatccagtggcgccactgccctccatccagcctgcctcacagcaccctggacagggccactggggcatagggtgggcttag

SEQ ID NO: 218648 - DNA, 663 bp, Artificial Sequence
  Description of Artificial Sequence: Synthetic coding sequence
atgagcatgggtttagagatcacaggcactgcactcgccgttttgggttggcttggcactattgtgtgctgtgccttgcccatgtggagagtctccgctttcatcgggagcaacatcattacgagtcaaaatatttgggagggactctggatgaactgcgtggtgcaatccaccggccaaatgcagtgtaaggtgtacgactctctcctggcccttccgcaggatcttcaggccgctcgcgcactcattgtagtcgctattttactcgctgctttcgggctgctggtcgctctggttggcgctcagtgcactaactgtgttcaggacgataccgccaaggcaaagattaccattgtggcaggagtattgttcctcctggctgccctgctcacgctcgttccagtttcgtggtccgcgaataccatcattagggacttctataatcccgttgtgccggaggcccagaaaagggagatgggcgctggactttatgtcggatgggccgcagcagccttgcagctgcttggaggtgcgctcctctgctgctcctgtcccccacgcgaaaagaaatacacagctacgaaagttgtgtacagcgcacccagaagcaccggtccaggtgccagcctgggcacaggctacgatcggaaggactacgtctag

SEQ ID NO: 218649 - DNA, 630 bp, Artificial Sequence
  Description of Artificial Sequence: Synthetic coding sequence
atggcatccatgggccttcaggtgatgggcatcgctctggctgtgctggggtggctggccgtcatgctttgctgcgccctgcccatgtggcgcgtgacagcctttataggcagcaacattgttacttcccagaccatttgggagggattatggatgaactgtgttgtgcagagcaccggtcagatgcagtgtaaagtgtacgacagtcttctggccctaccacaggatcttcaggcagcgcgtgcactagtcataatcagcatcatcgtggcggcacttggggtcttgctgtcggtcgttggcggtaagtgcactaattgcctcgaagacgaatccgccaaagctaaaacaatgatcgtggccggagttgtgttcttactggccggactcatggtcatcgtgcctgtgagttggactgcccacaacattattcaggacttttacaaccctctcgtcgccagtggtcaaaaacgggagatgggagctagtctgtatgtgggttgggctgcctccggccttcttctgctgggaggcggattgctttgttgtaattgtcctccccgtaccgataaaccttatagcgctaaatattccgcggctaggtccgccgctgcttccaattatgtgtag

SEQ ID NO: 218650 - DNA, 630 bp, Artificial Sequence
  Description of Artificial Sequence: Synthetic coding sequence
atggctagtatgggcctgcaagtgatgggcatagccctggcagttctagggtggcttgccgtaatgttatgttgcgccctgcccatgtggcgcgtgacggccttcatcggctcaaacattgttacgagtcagacaatctgggaaggtctgtggatgaattgtgtggtgcagtccacaggccagatgcagtgtaaggtgtatgattcgctgcttgctttgccgcaggacttgcaggcagcgcgtgctctggtcattatctctatcatagtggccgctttaggggtgcttttatctgtggtaggcggaaagtgtacaaactgtttggaagatgagagcgctaaggctaaaaccatgattgtggctggtgtggtttttctcctcgccggtcttatggttatcgtgccagtcagctggactgcccataacatcatacaggatttctataaccccctcgtcgcgtccgggcagaagagagagatgggtgcctcactttatgtgggctgggcggcttctggtttgctcttgcttggcggtggcctcctgtgttgcaactgcccaccgagaaccgataagccctactccgccaaatattcagcagcacgcagtgccgctgcaagcaattacgtgtag

SEQ ID NO: 218651 - DNA, 630 bp, Artificial Sequence
  Description of Artificial Sequence: Synthetic coding sequence
atggccagtatgggactacaggtaatggggatagccctggctgtgctcggctggctggcagtaatgctgtgctgtgctttgcctatgtggagagtgactgcgtttattggatccaatattgtgacttcacagactatctgggaagggctgtggatgaactgtgtggtgcagtctactggccagatgcaatgcaaagtctacgatagtttgctcgccctgccacaagatctacaggcggctcgggctcttgttattatatccataatcgtggctgccctaggtgtgctgctgtctgtagtcggaggaaagtgtacaaactgcctggaggacgaatcagctaaggccaagaccatgattgtggctggggttgtattcctgctggcaggactgatggtgatagttcctgttagctggactgctcacaacattatccaggacttctacaaccccctcgttgccagcgggcaaaagcgggagatgggggcatccctctacgtgggatgggctgcgtcaggattgctgctgttggggggagggctgttgtgctgtaactgccctccaaggaccgacaagccctactcagccaagtacagcgccgctcgttcagcagccgctagcaattacgtgtag

SEQ ID NO: 218652 - DNA, 591 bp, Artificial Sequence
  Description of Artificial Sequence: Synthetic coding sequence
atggctagcatgggcttgcaggtcatgggcatcgcactggccgtgctgggctggcttgctgtgatgttgtgttgtgcgctcccaatgtggagggtcactgccttcattggatcaaacatcgtgacatctcagagcaccggccaaatgcaatgtaaggtgtacgactccttacttgcactcccccaagacctacaggctgcccgtgccttagtgattattagcatcatcgtggccgctctgggcgttctattgtccgtcgtcggcggaaagtgcactaattgcctggaggatgagagcgccaaagcaaagactatgatcgtggccggtgtagtgttcctactcgcgggactgatggtcatcgtccccgtgagctggaccgctcataatataattcaagatttctacaatcctctggtggctagcgggcagaagcgcgagatgggagccagtctgtacgttggctgggcagccagtggtctcctgttgctcgggggaggcttattgtgctgcaactgcccgccaaggacggataagccctactcagccaagtactcagcagctcgcagcgccgcagcgagtaattacgtttag

SEQ ID NO: 218653 - DNA, 912 bp, Artificial Sequence
  Description of Artificial Sequence: Synthetic coding sequence
atgacgcgggcaaggataggatgtttcggacccggtggcagggctaggggaacagagtccgccccagagcctagcaagcgagtaccacctggacggtcatggcagacccaggaagtgcggcaaacccggggagctaacgggcttggacctcgcgcaggaagcgctggcgctaaggcacccggtcccgctcagggggcagctcagcatggactggggggaagcgcgggattgagagtccgcgtgtcccctttggctatgggtagcgccgctctcgaaattttgggcctcgtgctgtgtttggtggggtgggggggactgatcctggcttgcggactgcctatgtggcaggtcacagcgttcctagaccacaatatcgtcacggcacagaccacgtggaaggggctatggatgagctgcgtcgtgcagtcgacagggcacatgcagtgtaaggtatacgattctgtgcttgctctatctaccgaggttcaggctgccagggccctcacagtaagtgcagtgctactcgcctttgtggctctgtttgtaactctggcaggggctcagtgtacaacatgcgtcgctcccggtcccgcaaaagcacgtgtggctctgacgggtggggtcttgtatctcttttgcggcctcttagcgctggtccctttgtgttggtttgccaatatagttgtgagggaattctatgatccgagtgtccccgtctcccagaaatatgagctcggcgcagcactttatatagggtgggccgcaactgccctgctgatggtagggggatgtttactttgttgcggcgcttgggtgtgcacgggcaggcctgacttaagtttccctgtaaagtatagcgctccccgtaggcctacagccaccggcgattatgacaagaagaattacgtgtag

SEQ ID NO: 218654 - DNA, 912 bp, Artificial Sequence
  Description of Artificial Sequence: Synthetic coding sequence
atgaccagggcacgcattggctgcttcgggcctgggggtcgagcccgaggcacggaatctgcacctgagccatctaaacgcgtgccacctggcagatcttggcaaacccaggaggttaggcagaccagaggcgcaaatggcctagggccaagggccggttccgcaggcgctaaggcacctggcccagcgcagggagctgcccagcacggcctgggagggtcagccggactccgcgtgcgtgtgtccccactggccatgggttccgctgcgctggagattctcggcctggtcctgtgtctggtggggtggggcggtctgattctggcttgcggcttgcccatgtggcaggtcaccgccttcctggatcacaacatcgtgactgcccagaccacctggaagggcttatggatgtcctgtgtcgtgcagagcacaggacacatgcagtgcaaggtttacgacagcgtgctcgctctgtcaaccgaggttcaagcagcccgagccttaacagtttccgccgtactgctggcgtttgtcgctctgtttgtcacgctggctggcgctcaatgcacaacctgtgtcgcacctggcccagccaaggcgagggttgctttaaccggtggggtcctgtatctgttctgcgggcttctcgctctcgttccactctgctggtttgcaaatatcgtagtccgcgagttttacgatccgtctgtgccggtatcacaaaagtacgagctgggggctgccttgtatatcgggtgggccgcaaccgccctcttaatggtaggaggctgtcttctgtgttgcggcgcttgggtatgcactgggcgaccagacctctcttttcctgtgaagtatagtgcccctaggagacccactgccactggtgattatgataaaaaaaactatgtgtag

SEQ ID NO: 218655 - DNA, 912 bp, Artificial Sequence
  Description of Artificial Sequence: Synthetic coding sequence
atgacacgggcacgcattggatgctttggtcccggtggccgtgctcgtggcaccgaaagtgcccctgagccttcgaagcgcgtgccccctggcagaagttggcagacccaggaagttcgacagacccggggagcaaatgggcttggacctcgcgcaggctcggccggtgccaaagcaccgggaccggcacaaggagccgcacaacatggcctgggcggaagtgccggacttagagtgagagtttccccattggccatgggatccgcagcgcttgaaatactgggactggttctctgtttggttgggtggggcggattaatcctggcctgcggacttcctatgtggcaagtgaccgcctttttggatcacaatattgtaactgcccagactacctggaaaggcttgtggatgagctgcgtcgtgcaaagcaccggacacatgcaatgcaaggtgtatgatagcgtgcttgctctctcaaccgaagtccaagcagcccgagctttgaccgtcagtgcagtattgctggctttcgtggctcttttcgtgactttggccggagcgcaatgcaccacctgcgttgcacccggtcccgctaaggctagagttgccctcactgggggagtgttataccttttttgtgggcttctggctctggtgcccctgtgctggttcgccaacatagtggtcagggagttctacgacccctcagtcccagtctctcaaaagtatgagctcggcgctgcgctctacatcgggtgggcggctactgccctgctgatggtgggtggctgcctgctgtgctgcggcgcatgggtttgtactgggagaccagatttgtcttttcctgtgaagtacagtgcacctcgtcgccctaccgcaaccggagactatgataagaagaattacgtatag

SEQ ID NO: 218656 - DNA, 1086 bp, Artificial Sequence
  Description of Artificial Sequence: Synthetic coding sequence
atgggggaagaggcaaacgatgacaaaaaaccaactacaaaattcgagctggagcgggagaccgagctccgcttcgaggtggaagcctcccagagcgtccagctagaacttctgacgggcatggctgagatctttggaacagagctcacccgtaataaaaagttcacatttgacgcgggagccaaggtggcggtgttcacatggcatggctgtagcgtgcagctgagcggcagaaccgaggtggcttatgtgtcaaaagatacgccgatgctcctgtatttgaacactcacactgccctcgaacagatgaggagacaggccgagaaagaggaggagcgcggaccccgtgtcatggtggtaggccctacagatgtcggaaaatcaaccgtttgccgtctgctgctgaactacgcgatcacaagcagactagctgatgtgttcaatcagcggtgcgaggtgaataggcgcgctagtgtgtccggttgcgtcatcaatacctgcggatgggttaagggatctggttatcaggcactggtacacgccgcaagcgctttcgaagtggacgtggtggttgtgcttgatcaggaacgcttgtataatgaactcaaaagggacctccctcactttgttcgcactgtacttctaccaaagagcggtggggtcgtggaacgctccaaagactttcgtcgcgagtgcagggatgagcgcatccgcgagtacttttacggtttccggggttgtttctaccctcacgctttcaacgtgaaattctcggatgtcaagatctataaggtgggcgcacccacaatcccagattcctgtcttcctctaggaatgtctcaggaggacaatcagttaaaattggttccggttacccctggacgcgacatggtgcaccatctgttgagtgtcagcacagctgaagggactgaggagaacctttcagagactagcgtggcaggatttattgtggtgacaagtgttgacttggaacaccaagtctttaccgtgttatctccagccccacggcctctccctaagaacttcctcttgatcatggacatccgctttatggacctcaagtag

SEQ ID NO: 218657 - DNA, 810 bp, Artificial Sequence
  Description of Artificial Sequence: Synthetic coding sequence
atgcaggaaataattgccagtgtggatcatataaaatttgatttagagattgccgtggaacagcaactgggggctcaaccccttccatttccaggaatggacaaaagcggagctgccgtgtgcgaatttttcctgaaggcagcatgcggaaaagggggtatgtgcccttttagacacatttctggagaaaaaactgtggtgtgcaagcattggctgagagggctgtgcaagaagggtgaccagtgcgagtttctgcatgaatacgacatgactaagatgccagagtgttacttctactctaagttcggagagtgcagcaacaaagaatgccctttcctgcacattgatcctgaatcaaagattaaagattgtccctggtacgacagaggcttttgtaaacacggacctctgtgcagacatcggcatacccgccgtgtgatttgcgtgaattatttagtagggttttgtccggaggggccttcttgcaagtttatgcaccccaggtttgagctgcccatgggtaccactgagcaaccacccctacctcagcagacccagccaccagccaagcagagcaacaaccctccgctgcaaaggtccagctcactgatccagctaacctctcagaacagttctccaaatcagcagaggaccccacaagtgatcggggtaatgcagagccagaatagcagcgctggcaaccgagggcctagacccctggagcaggtgacgtgctataagtgtggtgagaaaggacattacgccaataggtgtactaaaggccacttagcctttttgagtggccagtag

SEQ ID NO: 218658 - DNA, 735 bp, Artificial Sequence
  Description of Artificial Sequence: Synthetic coding sequence
atgcaggagatcatagcctctgtggatcacattaagtttgatcttgagatagccgtggagcagcagttgggggcacagccactgccgtttccaggcatggataagtcaggcgcagcggtgtgtgagttcttcctaaaggccgcatgtggcaagggcggaatgtgcccctttcgtcatatcagcggagagaaaaccgtcgtctgtaagcattggctgagaggtttgtgtaagaagggcgaccagtgcgagttcctgcacgaatacgacatgaccaagatgccagagtgttacttctattccaaattcggcgagtgttccaacaaggaatgtccgtttctgcatatcgacccagagagcaaaatcaaagactgcccttggtatgatcgaggtttctgcaaacacggacccctgtgccgacataggcacactagaagagtgatatgcgtgaactaccttgtaggattttgcccagagggtccttcctgtaaatttatgcacccaaggttcgagctgccaatgggtacaacggaacaaccacctctgcctcagcagacccagccccctgcaaagcagaggaccccccaagtgatcggggtgatgcagtcacagaacagcagcgctggaaaccggggtccaagacccctagagcaggtcacttgctacaaatgcggcgagaagggacactacgcgaatcgctgcacaaaaggacatctggcctttctgtcagggcagtag

SEQ ID NO: 218659 - DNA, 636 bp, Artificial Sequence
  Description of Artificial Sequence: Synthetic coding sequence
atgcaggagatcatcgcctccgttgaccacataaaatttgatctcgagatagcggttgaacagcagctcggtgcacagcctcttcccttccctggaatggacaagagcggcgctgctgtgtgcgagttctttcttaaagctgcatgtggcaaagggggaatgtgtccctttaggcacataagtggcgagaaaacagttgtctgcaaacactggttacgcggattgtgcaagaagggtgatcaatgcgagttcctgcacgaatatgacatgaccaaaatgccggaatgctacttttattccaagttcggcccattgtgccggcacaggcatactagacgggtgatttgcgtgaactacttggtggggttctgccccgaaggaccgagctgcaagttcatgcacccaaggttcgagcttcctatgggcactacagagcagccccctctgccccagcagacccaacccccagcaaaaaggacaccccaagtcatcggtgttatgcagtcccaaaactcctcagctggaaatcgagggcctcggccacttgaacaggtgacatgctacaagtgcggtgagaagggacactatgccaatcgatgtacgaaggggcatcttgctttcctgagcggccaatag

SEQ ID NO: 218660 - DNA, 1767 bp, Artificial Sequence
  Description of Artificial Sequence: Synthetic coding sequence
atggcggatggcgttgatcatatcgatatctacgcagatgttggcgaagagttcaaccaagaggctgaatacggcggtcacgatcaaatcgacctgtacgatgacgtcatatccccgagtgccaataatggagatgctcccgaagacagagactacatggacactctgccgcctaccgtaggagacgacgttggaaaaggggcagccccaaacgtggtctatacctatacaggaaaaagaattgcgctgtatatcggaaatctgacctggtggacaaccgacgaagacttgaccgaggcagtgcatagcctaggggtcaacgatatactagagataaaatttttcgaaaatcgtgccaatggacagtctaagggtttcgcgctagtcggcgtcggatccgaggcctccagcaagaaattaatggacttgctgcctaagagggagttgcatggacagaatcctgtggtcactccatgcaacaaacagtttttatcccaatttgaaatgcagtcacgcaaaactacacagtcgggccaaatgtctggagagggcaaagctgggcctcctgggggttctagtagagcggcattccctcagggcggacgcggacggggacgattccctggagccgttccaggcggagaccgcttccccggaccagcaggaccgggtgggcctcccccacccttcccagggaaccttattaagcatctagtaaagggtactcgcccactgtttctggaaacgcggataccatggcacatgggccactctattgaggaaatccctatctttgggctcaaagcagggcagacacctccaaggccccctctcggccctcccggtcctccgggacccccaggacccccaccacctggacaggtcctgcctccgcctctagccggtcctcctaacagaggagaccgcccaccacccccagtgctttttcctgggcagccgtttggccagccacctctgggccctctcccacctggtccgccacctccggttcctgggtacgggccacccccaggcccaccgcctccccaacaggggcctccgcctcccccagggcctttccctcctaggccaccagggcctctaggtccacctctgaccctggcacctccgccacatctgccaggtccaccacctggagccccaccaccagctccccacgtcaatcctgctttttttcctccaccaactaatagcggcatgcccacctctgattcccggggtccgccacctaccgatccttatggtagacctccaccttacgacagaggggactatgggcctccaggacgagaaatggataccgcacgcactcctttaagtgaggcagagttcgaggaaatcatgaatcgtaatagggcgatatcaagcagcgccataagtcgtgctgtttcagacgccagtgccggagactatgggagtgccattgaaaccctagtgaccgccatctctcttataaaacagtctaaagtttccgccgatgataggtgcaaagtcctgatttcttcgttgcaggactgccttcatggcatcgagagcaaatcatacgggagtggaagccgacgtgaacgctcccgggagcgcgatcacagtcgatctcgggaaaagagtcgaagacacaagagtcgctctagggaccgacacgacgattactatagggagcgttccagggaaagagaacgccacagggatagagaccgggatcgtgacagagaacgtgacagggaacgagagtacagacacaggtag

SEQ ID NO: 218661 - DNA, 1656 bp, Artificial Sequence
  Description of Artificial Sequence: Synthetic coding sequence
atggccgatggtgtggaccacatagacatctatgcagatgttggggaagagtttaaccaagaagctgaatacggcggacacgaccagattgatctgtatgacgatgtgatcagtcccagtgccaataacggcgatgcaccggaagaccgcgactatatggataccttaccaccaaccgtgggtgatgatgtcggcaagggcgctgcgccaaatgtcgtttacacatataccggtaagcgcatcgccttgtatatcgggaatctcacttggtggacaactgatgaggacctcaccgaagccgtgcatagcctgggagtcaacgatatcttggaaatcaaattcttcgagaatagggctaacggacagagcaaaggcttcgcattggttggcgtagggagtgaagcatcgtctaagaaattaatggatctgctgccaaaaagggagcttcatggacagaatcccgtggttacaccttgtaataaacaatttctgtcccagtttgaaatgcagtctcgcaagaccacacagtccggccaaatgtcaggcgaaggcaaggcaggtcccccaggaggtagcagccgcgctgcattccctcagggcggaagaggaagaggaagattccctggcgcagtcccgggaggcgatcggttccccggacccgctggaccaggtggaccccctcccccttttccggctgggcagacacctccaagacccccactcgggcctccaggaccacccggtccgccagggccaccacccccaggccaggtgctaccccctccgctggccggtccaccgaataggggcgatcgtcctcctccacccgttctgtttcctggccaaccctttgggcaacctccgttgggtcccttaccacctggcccaccccctcctgtgcccggttatggaccccctcctggccctcctccccctcagcaaggcccaccgccaccgcctggtccattccccccaagaccgcctggcccactcggtcctcccctgactctcgcccctccaccacatctaccgggtccccctcctggcgcacctcctccagccccacatgtgaaccccgcatttttcccacccccaacaaattcagggatgcccacttccgacagccggggtccccctcctactgacccgtacggtaggcctcctccttatgaccgaggagactacggccctcccggacgtgaaatggatactgcacgcacaccgttgtctgaggctgaatttgaggaaatcatgaatcgaaaccgcgcaatctctagctccgccatcagtagggccgtttccgatgcctccgcgggagattatggctcagctattgaaactctggtgacggccataagcctgataaaacagtccaaagtgtccgcagacgatcgttgtaaagtgcttattagcagtcttcaagactgtctccatggcatcgagagtaagtcatatggatccggctctcgaagagaacggtctagagagagagatcatagtcgatctagagaaaaaagtaggcgccacaagtctcggagcagggacaggcatgacgattactaccgagagcgcagtcgggaacgtgagcgccacagagacagagatcgggacagggacagagagagggatagagagcgggaatacaggcatcggtag

SEQ ID NO: 218662 - DNA, 1437 bp, Artificial Sequence
  Description of Artificial Sequence: Synthetic coding sequence
atggctgacggagttgaccatattgacatatatgctgatgtgggcgaggagttcaaccaggaggccgagtacggcggacatgaccagattgacttgtatgatgacgtgatttctccttctgctaacaacggcgatgcaccagaggatagagattatatggacactctcccacctactgttggagacgatgttggaaaaggagccgcacccaatgttgtctatacctatactggcaaacggatcgctctgtatatcgggaatctaacgtggtggaccaccgacgaggaccttactgaggctgtgcactccctaggagtgaatgatatacttgaaataaagtttttcgagaacagagccaatggacaaagtaagggcttcgcactggtgggtgtgggttctgaagctagctcaaagaagttaatggatctgctgcctaagcgcgagctgcacggccagaatcccgttgtcacgccatgcaataaacaatttctcagtcagtttgagatgcagtctcgcaagaccacccagtccggtcagatgtcgggggaggggaaagccggaccacctggagccggaccccctaataggggtgacaggccgccacctccagttctgttccctggccagcccttcggacaacccccactgggccctttacccccaggccctccaccacccgtcccaggatatggccctcctcccggtccaccaccacctcagcaggggcctcccccaccacctggtcctttcccgcctcggcctcctggtccattaggccctccactcaccctcgcccctcctccacatttgccaggaccccctcctggcgcacctccccctgccccacacgtgaatccagccttttttccgcctcccacaaactccggaatgcccacgagcgactcacggggacccccacctactgacccatacggcagacctcccccttatgataggggggactacggtccccctgggagagaaatggatactgcaaggacgccactgtccgaggcagaatttgaggagataatgaatcgaaacagagctatcagcagtagcgcaatatctcgggcagtgtctgacgcttctgcaggagattacggctccgccatcgagaccctggtgactgctatcagcctgattaagcagagcaaggtgagcgcagatgacagatgcaaggtactgatttcctccttacaggattgcttgcatggaattgagtccaagagttatggctccgggtccagacgcgagcgaagcagagagcgggaccactcccgttcaagggaaaaatccaggcggcacaagagccgcagccgggatcgtcacgacgattactatcgagagcggtctcgggaacgggagcgacatagggatcgggatcgcgaccgagaccgcgagagggaccgagaacgagaataccggcacaggtag

SEQ ID NO: 218663 - DNA, 1851 bp, Artificial Sequence
  Description of Artificial Sequence: Synthetic coding sequence
atgagcagcctggccgtgcgggatcccgctatggatcgcagcctgagatcagtgttcgtggggaatattccatacgaggccactgaagagcagctgaaagatattttcagtgaagtcggcagtgtggtgagtttccgccttgtgtacgacagagagaccgggaagccaaaagggtacggattttgcgagtaccaagatcaggaaactgctttatcagccatgcgcaacctcaatgggcgtgagttctctggacgggctctacgcgtggacaatgccgcatccgaaaagaataaagaagaactgaaatccctggggccagctgctccgatcatagattcaccatacggcgacccaatcgacccagaagacgcccctgaaagcataacccgcgcagtggcaagtctgccgcctgaacaaatgttcgaactaatgaagcagatgaaactatgtgtgcagaacagccatcaggaggctcgcaacatgttgttacaaaatccccagctggcctacgccctccttcaagcccaggtggttatgcgaataatggaccctgaaatagcgctcaagatcctacacagaaagatccatgtgacaccactgatccctggcaaatcgcaatctgtgtcagtgtcaggacctggccctggccctggtcccggattgtgccctggccctaacgttctgctcaaccagcagaatccacctgcccctcagccccaacacctagctcgtaggcccgttaaggacatcccccctctaatgcaaacccccattcagggcggaatccctgcccctgggccaattcccgcagcggtgcccggagcaggacccggttccttgacgcccggaggagccatgcaaccccagctggggatgcccggtgtgggacccgttcctttggaacgtggtcaggtgcaaatgtctgacccgagggctccaatccctaggggcccagtgaccccgggtggccttcctccaagaggtctcctgggcgatgcccctaacgaccctaggggaggcacacttctgtcagtgacaggcgaggttgagccaaggggctacttaggtcctccccatcaggggcctcccatgcaccacgcatccggtcacgatactcgaggccctagcagccacgaaatgagggggggtcccctgggcgacccgagacttttgatcggtgagccgaggggcccaatgattgatcaacgcggactgcccatggatggcagggggggtcgagactcccgcgcaatggaaaccagggccatggagaccgaggtgttagagacccgagtaatggagcgcagagggatggagacttgcgccatggagactagaggtatggaagccagaggcatggatgctcgcggactggagatgcgtggccctgtaccttcatctcggggtccaatgaccgggggaatacagggccctggccctattaacatcggggctggtggccctcctcagggccctcgccaagtccccggaatctccggggtgggaaaccccggagccggaatgcagggcacaggaatccagggcacagggatgcagggggctggcatccaggggggtgggatgcagggggctggcatccagggcgtcagcattcaggggggtgggatacagggaggcggtattcagggggcttcaaaacaaggcggaagccaaccttcgagctttagtcccggacaatcccaggttacaccacaggaccaggagaaagccgcactgataatgcaagtcctgcagctgactgccgaccaaatcgccatgttgccaccagaacagaggcaaagtattctgattctgaaggagcaaatccaaaaatccaccggggcatcatag

SEQ ID NO: 218664 - DNA, 2541 bp, Artificial Sequence
  Description of Artificial Sequence: Synthetic coding sequence
atgttgttcaccgtgtcttgtagtaaaatgtcctccattgtggaccgggatgactccagcatcttcgatggactggtggaagaggacgacaaagacaaagccaaaagagtgtctaggaataaatccgaaaagaagcggcgtgaccagtttaatgtgctgataaaggaactcggctccatgctgccgggaaacgctcgcaagatggacaaaagcacagtccttcagaagtctattgatttcctcagaaagcacaaggagattacagcacagtccgacgcaagcgaaattagacaggattggaagcccacttttcttagtaatgaggagttcacacagttgatgctggaggctcttgatggtttcttcctggccatcatgaccgatggctcaatcatttatgtgtcggagtcagtgacctccctactggagcatctgccctcagatctggttgatcaatctatcttcaactttatccccgaaggggagcactccgaagtttacaaaatcttaagcacccacctgctggagagtgactctctcacccccgagtacctcaaaagtaaaaatcagttggagttttgctgtcatatgctcagggggacgattgatccaaaagagccatcaacatacgagtacgtaaagtttatagggaactttaagtctctcaacagtgtctcaagcagcgcgcacaacggcttcgaaggaactattcagcggacacatcgaccttcctacgaggatagggtgtgctttgtggctactgtgaggttagccactccccagttcatcaaagagatgtgcaccgtcgaggaacctaatgaggagtttactagtcggcactccctggagtggaagtttctgttccttgatcaccgggctcccccaatcattggctacctgccgttcgaggtgctgggcacaagcgggtacgattattatcatgtggatgacctagagaatctggccaagtgccacgagcatcttatgcagtatggcaagggtaaaagttgttactatagattcctgacaaaaggccagcagtggatttggctgcagacacactattacatcacttatcatcagtggaattctaggccagaattcatcgtatgtacacacacagtggtttcttatgcagaggtgcgggctgagaggcggcgagaactgggcattgaggaaagcttgcctgaaactgctgctgataagtcacaggattcagggtctgataaccgaatcaataccgtatctctgaaagaagctctggaacgcttcgatcactcgcccacacccagcgcctctagccgatcatcgcggaagtcctcgcatactgcggtcagcgacccaagtagcacccccactaaaattcccaccgatactagcacacctcctcgacaacacctgccagcccacgaaaagatggtgcagagacgaagttcattttcttcacagagcatcaatagtcagtctgtgggtagcagcctaacccaaccagtgatgtcccaggcaactaatctcccaattccccaggggatgagtcagtttcaattcagcgcccagttgggtgccatgcagcatctcaaggaccagttagaacaacgaacaagaatgattgaagcaaacattcatagacagcaggaagagctgcggaagatacaggaacagctccagatggtgcatgggcaaggcctgcagatgtttctccagcagtctaatccgggactgaatttcggatctgtgcagctgtccagcggaaacagcagtaacattcaacaactcgcccctatcaacatgcagggccaagtcgtgccaactaaccagatccagtcaggcatgaacaccggacacattggcacaacccagcacatgatccaacagcagacactccaatcaacttcaacccaatcccagcagaacgtgctttccggtcattctcaacagacctcactcccaagtcagacccaatccactttaacagcccctctttataatacaatggttatcagtcagccagcagcaggatctatggtccaaataccctctagcatgccacagaatagcacacaatccgcagccgtgacaaccttcacccaagaccgacagattcggttcagccagggccagcaattagtgaccaagctggttaccgcacccgtggcctgcggggctgtaatggtgccgtccacaatgctgatgggccaggtggtgactgcctatcccacgtttgcgacccagcaacaacaaagccagacactgagcgtaacccagcaacagcagcagcagagctctcaggagcaacagttgacatccgtgcagcagccatcccaggctcagttaactcagcctccacagcagtttttgcagacgtccagactgctccacggcaatcctagcacacaactgattctaagcgcagccttccccctgcagcagtcgaccttcccccagagtcaccaccagcagcaccaaagccagcagcagcagcagctgagccgtcacagaaccgactcactacctgatccatccaaggtccaaccccagtag

SEQ ID NO: 218665 - DNA, 1278 bp, Artificial Sequence
  Description of Artificial Sequence: Synthetic coding sequence
atgggtgaggaggcaaatgatgacaagaagccgacgaccaaatttgagctcgagcgggagacagaactgcgcttcgaagtggaagcttctcaatccgtgcaattggagctgttgaccggcatggccgaaatctttggtaccgagctcacccggaataaaaaatttaccttcgacgcgggtgcaaaggtggctgtgtttacctggcatggttgttctgtccagcttagcggaaggactgaagtggcttatgtcagcaaggatacgccaatgctactgtatctgaacacccataccgcactagaacaaatgcgcagacaggcagaaaaagaagaggagcgagggccaagggtaatggtggttggtcccactgatgtcgggaaatccaccgtatgcagactcctcctgaattatgcggtccgactgggcaggaggcctacctatgtcgagctagatgtcgggcagggaagcgtgagtatacccggaaccatgggcgctctgtatatcgagcgacctgctgacgtggaggagggatttagtatccaggctccactggtctatcactttggttccacgacaccaggcaccaacatcaaactatataataaaatcacttcccggctggctgatgtgtttaaccagagatgcgaggtgaaccgacgagcgtccgtcagcggatgcgtgatcaatacctgtgggtgggtcaaagggtccgggtatcaggcgttggtccatgccgcatcagcattcgaagtggacgtggtggtcgttcttgaccaggagaggctttacaatgagctaaagagagacctgccgcatttcgttcgtaccgtgctcttgcctaagtccggaggggttgtcgagcgctcaaaggacttcagacgagagtgtcgcgatgagagaatccgggagtatttctacggttttcggggttgcttttatccgcacgccttcaatgtgaagttctcagacgttaagatctataaggtgggtgctcccacgatccctgatagctgtcttccccttggcatgagccaggaagacaatcaattgaagctggttccggtgacacccggacgggacatggtgcatcaccttttgtcagtttccactgccgagggcaccgaggaaaacctgagtgaaacctcagtggccggattcattgtagttacatccgtggacctggagcatcaggtgttcaccgtgcttagccccgctcctcggccacttccaaagaattttttgctaatcatggacatcagattcatggacctgaagtag

SEQ ID NO: 218666 - DNA, 1311 bp, Artificial Sequence
  Description of Artificial Sequence: Synthetic coding sequence
atgacagacctgcactcatcctacacagaggaaatgggagaggaagctaacgatgacaagaagcccaccactaagttcgagttggagcgcgagaccgaactgcggtttgaggtcgaggcttctcagtccgtccaactcgagctgctgacgggcatggcagaaattttcgggactgaactcacgaggaataaaaaattcacctttgacgccggagctaaagtggctgtgttcacttggcacggatgtagcgtccaactgtcgggcagaactgaggtggcttacgtttcaaaagatacaccaatgctattatacctgaatacacacacagcacttgagcagatgcggaggcaggccgagaaagaagaggagaggggacctagagttatggtggtcggacccaccgacgtgggtaagtccacagtctgcagacttctgctgaactacgccgtccggctgggcagaaggccaacatatgtcgaactggatgtgggacaggggtcagtgagtattccaggaacaatgggagccctgtacatagagagacccgcagatgtggaagaaggatttagtattcaggccccactggtgtaccattttggtagcactactcccggaactaacattaagctctacaataaaatcacctctcggttagccgacgtctttaatcaacgttgtgaagtgaataggagggcctccgtgagcggatgtgtaatcaacacttgtggatgggtaaagggttccggttaccaggccctggtgcacgcggcaagcgcctttgaagtcgacgtggtcgtggttctggatcaggaacgactgtacaatgaattgaaaagagacctaccccattttgtgcggaccgtgcttctcccgaagtcgggaggggtcgtcgagagatctaaggattttaggagggagtgtagggatgaacggatcagagagtatttctatggattccggggatgcttctatccacatgccttcaacgtgaaattcagtgacgtcaagatttacaaggtgggcgctcctactatcccagattcttgcttaccactgggcatgtcccaggaggacaatcagttgaagttggttccagttacgccagggagggatatggtgcatcatctgctgtccgtgtccacagctgagggcactgaagaaaatctctctgaaactagtgtcgcaggattcattgttgtgacttccgtggacctggaacaccaggtgtttactgtcctctctcctgcccctcggcctctgccaaagaacttccttctgatcatggatattcggtttatggacttgaagtag

SEQ ID NO: 218667 - DNA, 279 bp, Artificial Sequence
  Description of Artificial Sequence: Synthetic coding sequence
atgggcgaagaggcaaatgacgataagaagcctactacgaagttcgagctggaaagagaaacggagttaaggtttgaggtggaggcgtcacaaagtgtccagctagagcttcttaccggaatggcggagatcttcggcacggagctgaccaggaataagaagttcactttcgacgctggggcaaaagtggcggttttcacctggcatggctgttcagtccaactctcagggcgtacggaagtggcttacgtctccaaggacacacccatgttgttatag

SEQ ID NO: 218668 - DNA, 1278 bp, Artificial Sequence
  Description of Artificial Sequence: Synthetic coding sequence
atgggtgaagaggccaacgatgataagaaacctaccacaaagtttgagctggaaagagaaacagaattacggttcgaagttgaggcctcacagagtgtgcagctggagttgctgaccggcatggccgaaattttcggtaccgaattaactcgcaacaaaaagtttactttcgacgcaggcgctaaagtcgctgtattcacgtggcacgggtgctccgtccaattatcaggcagaaccgaagtagcttatgtgagcaaggatactcccatgctgttatatctgaacacccacacagcgctggaacaaatgcgacggcaggccgaaaaagaggaggagagaggccctcgcgtgatggtagtcggcccaacggacgtgggtaaatccactgtctgtaggctcctgcttaattacgccgtaaggttggggcgaaggcccacgtacgtagaactggatgtgggtcagggatctgtgtccattccaggcactatgggagccctctacattgagcgccctgcggacgtggaggaaggatttagcatacaggcccctctcgtgtaccatttcggctctactactccaggcaccaatattaagttgtacaacaagattacttccaggctcgcagatgtatttaaccaacgctgcgaggtgaatagacgggctagcgtgtctggatgcgtgatcaacacttgtggttgggtaaaaggcagcggttaccaggcactcgtgcacgctgcttccgccttcgaagtggatgttgtcgtagtcttggaccaggagcggctgtacaacgaactcaaacgagacctgccccattttgtgagaactgtgctgctacctaaatccggcggagttgtggagcgatccaaagactttcgtcgcgagtgcagagatgagagaatccgagaatacttctacgggttcaggggatgtttctacccccacgccttcaatgtaaaattctctgacgtcaagatatacaaagttggggcacctactatacctgattcctgtttgccactgggaatgtctcaggaggataaccagcttaagctggtgccagtgacacccggaagggatatggtgcatcacctcctgtccgttagcactgccgaaggaacagaagagaacctgagcgaaacatcggtggctggcttcatcgtggtcacgtctgtggatctggaacaccaggttttcacagtcctgtcgccggcaccacggcctctccctaagaactttctcttgataatggacataagatttatggatctgaagtag

SEQ ID NO: 218669 - DNA, 399 bp, Artificial Sequence
  Description of Artificial Sequence: Synthetic coding sequence
atgggtgaagaagccaatgacgataaaaaacctactacgaagttcgaactcgagagggagactgaactacgtttcgaggtggaagcttcccagagcgtgcagcttgagttacttactggcatggccgaaatttttgggacagagctcactcgtaacaagaagtttacttttgacgcaggtgctaaagtagcagtgtttacctggcatggatgctccgtccagctctcgggccgtacagaggtagcctatgttagcaaagatactccaatgcttctataccttaatacccacacggctttagagcagatgagaagacaagctgagaaggaggaagaaagaggacccagggttatggtagttggacccaccgacgtagggaaatcgaccgtgtgtcgatag

SEQ ID NO: 218670 - DNA, 834 bp, Artificial Sequence
  Description of Artificial Sequence: Synthetic coding sequence
atgtggcctgggatactggtgggtggagctcgcgtggcctcttgcaggtacccggctctcgggccaagattagccgctcacttccccgcacagcgccctccacagcgcacactgcagaacgggctggccctgcaaaggtgccttcacgctacagccacacgggctttaccgttaatcccaatagtggtagagcaaaccggacggggagagcgcgcttacgatatttactctcgcctgttgcgggaaagaatcgtttgtgtgatgggacccatcgacgactccgttgcgagcctggtcattgcccagctcctttttctacagagtgaaagtaataaaaagccgatccacatgtacattaactcgcccggtggcgtcgtgaccgctggcttggccatctatgacactatgcaatacatactgaaccccatttgcacgtggtgcgtggggcaggccgcttctatgggcagcttgctgctcgctgccggtactccgggaatgcgccatagccttcctaattcaaggataatgattcaccaacctagcggtggtgctcgtgggcaggccacagatattgcgatccaagcagaagagatcatgaagctgaagaagcaactgtacaacatttacgccaaacacacaaagcagagcctccaagtaatcgagtccgccatggaacgggacagatatatgtcacctatggaggcccaagaatttggcatactagacaaagtgcttgtacatcctccgcaggatggcgaggacgaacccaccctggtgcagaaagaaccagtggaagctgcacctgcagccgaaccggtccccgcaagcacatag

SEQ ID NO: 218671 - DNA, 1617 bp, Artificial Sequence
  Description of Artificial Sequence: Synthetic coding sequence
atgtggtccgggaggtcaagctttaccagcctcgtggttggcgtatttgttgtatacgtggtgcatacatgctgggtcatgtatggaatcgtttacacacggccttgcagcggggacgcaaattgtattcagccttatctggcccgacgcccaaagctacagttgtccgtgtacaccaccaccaggtcccatttgggagccgagaataatatagacttagtactgaatgtggaggactttgacgtagaaagcaagttcgaacgaaccgtaaacgtttcagtgccgaaaaaaacacgcaataacggaacactctacgcctatatcttcctgcaccatgctggggtgctcccgtggcacgacgggaagcaggtgcacctggtttcaccactcactacatatatggttcccaaacctgaggagatcaatctgctgacaggggaaagcgacactcaacaaattgaagctgaaaaaaagcctacatctgcactcgacgaaccagttagccactggcgcccaagacttgccctcaacgtgatggccgacaacttcgtttttgacggctcatccctcccagccgacgtgcatcgctacatgaagatgatccagcttgggaaaaccgttcattatctgcctatactgttcatagatcagctttctaacagggtgaaagatctgatggtaataaacaggtctaccacagagttgcccttgacagtgtcctacgacaaggtctcgttaggccgtctgagattctggattcatatgcaggatgccgtgtacagcttgcagcagttcgggttttccgagaaagatgcagatgaggtaaaaggtatcttcgtcgacacaaatttatatttccttgccttaaccttctttgtggctgcatttcacctcctgttcgacttcctagcatttaaaaatgacatatctttctggaaaaaaaagaagtccatgattggcatgagcacaaaggcagttctgtggcgttgtttcagcactgtggtgattttcctcttcctgctggacgagcaaacttccttgttagtgctggtgcccgcaggcgtgggggctgccattgaactgtggaaagttaagaaggccctaaagatgaccatattttggaggggcttgatgcctgaattccaatttggcacctattctgagtccgaacgaaaaacagaagaatatgatactcaggcaatgaagtatctctcttacctgctctacccgctctgcgtagggggagccgtgtacagcctgctgaatattaagtacaagtcgtggtactcctggctgataaactcttttgtgaacggggtctatgctttcggattcttatttatgttaccacagctgtttgtcaattataagctgaaaagtgtcgcccatctgccctggaaggcattcacttataaagcatttaatacgttcattgacgacgtctttgcatttatcattaccatgccgacctcccatagactggcctgcttcagagatgacgtcgtttttttggtgtatctctaccagagatggctttaccccgtcgacaagaggcgggtcaacgagttcggagagtcctacgaagagaaggccacaagggcgccacacaccgactag

SEQ ID NO: 218672 - DNA, 1509 bp, Artificial Sequence
  Description of Artificial Sequence: Synthetic coding sequence
atgtggagcggaaggagctctttcacctctttggtcgtgggcgtatttgtagtttatgtggtccatacctgttgggtaatgtatggaattgtctatacgaggccatgttcgggagatgcaaactgcatccagccttacttagctcgacgccctaagctgcagcttagcgtgtacaccacaactcgaagtcacttgggcgctgaaaacaacattgatttggtcctcaacgtggaggacttcgacgttgaatctaagtttgagagaactgtaaacgtgtcggtccccaaaaagacacggaataacggaactctgtacgcatatatttttctccaccacgccggtgtgctgccttggcatgacgggaagcaggtgcacctggtctcccccctcactacatacatggtgcccaaacccgaggagattaatttgttaaccggagagagtgatacgcagcaaattgaggccgagaaaaagcccacctccgcattggatgaaccagtctctcactggaggccacggctcgcacttaacgtcatggctgataattttgtttttgatggaagttcccttcccgctgatgtgcaccgctacatgaagatgattcagctaggaaaaactgtccactacttgccgatactgtttatcgatcaactgtctaaccgtgtcaaggatttgatggtgatcaatcgttccacaactgagctcccactgaccgtatcatacgataaggttagcctcggtagactgcgattctggattcatatgcaggacgcagtgtacagtctgcaacagtttggattttctgaaaaagatgccgatgaagtgaagggtattttcgtggataccaacctctacttcttggccctgacattcttcgtggctgctttccacttactatttgacttcctggccttcaaaaacgatatcagcttctggaaaaagaaaaagtcaatgatcgggatgagcaccaaactctggaaagtcaagaaggccctcaagatgactatcttttggagagggcttatgcctgaattccagtttgggacgtactccgagagcgaacgcaaaacagaggagtacgatacacaagccatgaaatacctgagctacctattgtaccctttgtgcgtcggtggggctgtgtatagcttacttaatataaagtataagtcttggtacagttggttaattaattcattcgtcaacggagtctatgcattcgggtttttgttcatgttgccccagctgttcgtgaactacaagctgaagtcagtcgcccacctcccctggaaggcttttacatataaggcctttaataccttcattgatgatgtgtttgcttttatcattactatgccaactagccatcgcctggcctgtttccgtgatgatgtggtgttcctcgtttatctgtatcagcgctggctgtatcccgtggataaaaggcgagttaatgaatttggggagtcatacgaggagaaggccacacgcgcaccacatacagactag

SEQ ID NO: 218673 - DNA, 1350 bp, Artificial Sequence
  Description of Artificial Sequence: Synthetic coding sequence
atgatgaagacacttctgcttttcgtgggactcttgctgacctgggaatccggacaagtactcggtgatcaaacggtcagcgacaacgaattacaagagatgtcaaatcaagggagcaagtatgtcaataaggagatacagaacgccgtgaatggcgttaagcagataaaaaccttgattgaaaaaacaaacgaggaacgcaaaacattgctgtccaatctggaggaagcgaaaaagaagaaagaggatgcactgaatgagacccgggaatcagaaactaaactcaaggagttacctggtgtatgtaacgagactatgatggccttgtgggaggaatgtaaaccctgccttaaacagacctgcatgaaattttatgcgcgagtctgtcggtcaggatctggcctcgtagggcgtcaactcgaagagttcttgaatcagagtagtccgttctatttctggatgaatggcgatcgtattgactcccttttagagaatgaccgccagcagactcatatgctggatgttatgcaagatcacttctccagagcctctagcataatagacgaactatttcaagatagattcttcactcgggaaccccaggatacgtatcattacctgccattttccctgccacatcggaggcctcatttcttttttccaaaatctcgtatcgtgcgcagcctcatgccattctccccttacgagccacttaattttcatgcgatgttccaaccattccttgagatgatccatgaggcccagcaagccatggacatccactttcattcccctgcttttcagcacccccctacggagtttattcgagagggagacgacgacaggacagtgtgtcgggagattagacacaattccaccgggtgtctgagaatgaaagatcaatgtgacaagtgccgcgagatactgtctgtcgattgtagtactaacaatccctcacaggccaagttacgtagagaacttgatgagtcgctccaggtcgctgagagactgacaagaaagtacaacgaactcttaaagagctatcagtggaaaatgctgaatacctcttcgttactggaacagttgaatgagcaattcaattgggtaagtcggctcgcaaatttaactcagggcgaggaccaatattacttgcgagtcaccactgtcgctagccacacctcagattccgatgtgccatctggagtgactgaggtagtggtgaaactttttgactctgatccgattactgtaactgtcccagtggaggtcagccgcaagaatcccaagtttatggagactgtggctgaaaaggctctgcaggaataccgcaagaagcacagggaagagtag

SEQ ID NO: 218674 - DNA, 825 bp, Artificial Sequence
  Description of Artificial Sequence: Synthetic coding sequence
atgcaggaccatttctctcgggcttctagtatcattgacgagctttttcaggaccgtttctttacacgggaacctcaggatacataccactacctaccattctctcttccccatagacgtccccacttttttttccctaagtcacggatcgtgcggtcactgatgcccttttctccctatgagcctttgaattttcatgccatgtttcaaccctttctagaaatgatccacgaggcccagcaggccatggacattcacttccacagcccagcattccagcacccccctaccgaattcattcgcgaaggtgacgacgataggaccgtttgtagggaaattcgacacaattcgaccggttgtctcaggatgaaggatcagtgtgacaagtgcagggagatacttagtgtggattgttcaacaaataaccccagtcaagctaaacttagaagggaactcgacgaaagcctgcaggttgcagagagactgacacgcaagtacaacgagctgctgaaatcctaccagtggaaaatgcttaacactagcagcctgctcgagcagctcaacgagcagtttaattgggtatcaaggctcgcaaatttgactcagggggaggatcaatactatctgagggtgaccactgtggcttcacacacctctgattccgacgtgccaagtggagtgacagaggtggtagtcaagttgtttgattcagatccaataacagtaaccgtccctgtagaagtctcaaggaagaatccgaaatttatggagactgtcgcagagaaagctctgcaggaataccgtaagaagcatagggaagaatag

SEQ ID NO: 218675 - DNA, 1350 bp, Artificial Sequence
  Description of Artificial Sequence: Synthetic coding sequence
atgatgaaaacgctcctgctgttcgttggcttactgctcacctgggagagcgggcaagtgctgggcgatcagactgtgtctgacaacgagcttcaagaaatgtcaaatcagggatctaagtacgtcaataaagagattcagaatgcagtaaacggggtgaagcagattaagacactcattgagaagaccaacgaagaacgcaaaacactactgtccaatctagaagaagctaagaaaaagaaagaagacgcgctcaacgagacacgagaaagcgaaaccaagcttaaagaattgcctggcgtgtgcaacgagactatgatggccctgtgggaggaatgcaaaccttgtcttaaacagacctgtatgaagttttatgccagggtgtgccggtccgggtccggactcgtggggagacagctagaggaattcctgaaccagtcttctcccttttacttttggatgaatggagaccgtatagattcactgctggaaaacgaccggcaacagacccatatgctggacgtgatgcaggatcatttctcccgggcaagtagtataatcgatgagctgtttcaggaccgatttttcacacgcgaaccccaggacacttatcattacttgcctttttctttgcctcataggcggccacatttcttctttcccaaatcaaggatcgtgcggtctcttatgccttttagtccttatgaacctctgaatttccacgctatgttccagccatttctggaaatgatccacgaagcccaacaggctatggatattcacttccattcccctgcctttcagcacccgcctaccgagtttatccgcgagggtgacgatgataggactgtttgcagggagattcgccacaactcaacgggttgcctacgcatgaaggatcagtgtgataagtgccgggaaattctcagtgtggactgcagtaccaacaatccctcacaggccaagttacgacgcgaacttgacgagtcacttcaggtggccgagcgcctgacacgaaaatacaatgaactgctcaagtcttatcagtggaaaatgctgaatacctcctccctgctcgagcaactgaacgaacagtttaattgggtgagccgcttagccaacctcacccagggggaggaccagtattatctcagagttactactgtggcatcccacaccagcgatagcgatgtgccttctggtgtgacagaggttgtggtgaagctgttcgactctgacccgatcaccgtgacagttcctgtggaggtgagtagaaaaaaccctaagtttatggaaacagtggcagaaaaggcgctgcaggaatacaggaaaaagcacagagaggaatag

SEQ ID NO: 218676 - DNA, 615 bp, Artificial Sequence
  Description of Artificial Sequence: Synthetic coding sequence
atgatgaaaacacttcttttgtttgtgggacttctcctgacgtgggagtctggacaggtcctgggcgaccaaacagtgagcgacaacgaactgcaggaaatgagtaaccagggttccaaatacgttaacaaagaaattcagaacgccgtgaacggggtgaaacagattaaaacgctcatagagaagaccaacgaggaacgaaagactctcctgagcaatctggaggaggcgaagaaaaagaaggaggatgcccttaacgaaacaagggaatccgaaactaagctgaaggaactgcctggggtttgcaatgaaaccatgatggccctgtgggaggagtgtaagccctgcctaaagcagacctgtatgaagttttacgccagggtttgcaggagcggttccggcctagtgggcagacagctcgaagaattccttaatcaatcttctcctttttacttctggatgaatggagaccgtattgatagcttactggaaaacgaccggcagcagacacacatgctggatgtgatgcaagaccactttagtagagcttctagcattatagacgagttgtttcaagatcggttcttcacacgcgaaccacaggacacttactag

SEQ ID NO: 218677 - DNA, 1350 bp, Artificial Sequence
  Description of Artificial Sequence: Synthetic coding sequence
atgatgaagactctccttctgttcgtgggtctcctgcttacatgggagagcggacaggtgctaggcgaccagacggtttccgacaacgagctgcaggagatgtcaaaccaagggtccaagtatgtcaataaggaaatacagaatgcggtaaatggcgttaagcagataaaaactctcattgagaaaacaaacgaggaaagaaaaactctcttgtccaacttggaagaagcgaagaaaaagaaggaggacgctctgaatgagactagggaatccgaaacaaaattgaaggaactccctggcgtgtgtaacgagaccatgatggccctatgggaggaatgtaagccatgcctcaaacagacctgtatgaagttctacgccagggtgtgtagatctggatccgggcttgtggggaggcagttggaggagttccttaaccagtccagtcccttttacttttggatgaacggggatcgcattgattctcttctggagaacgacagacagcagacccacatgctggacgtgatgcaagaccatttttcccgcgcatcttctatcatcgatgagctgttccaggatagattcttcactcgagaacctcaggacacctaccactacctgcccttctccctgcctcaccgacggccacactttttttttccgaaaagccggatcgtgaggtctctaatgcccttcagtccctacgaacccctaaatttccacgctatgtttcagccatttctcgagatgatccacgaggcccaacaggctatggacatccactttcatagtccagcctttcagcatccacccaccgagtttattagagaaggagacgatgaccgtacagtctgtcgagagatacgccacaattctacagggtgtctgagaatgaaggaccagtgcgataagtgcagggagatactgagtgtcgattgttcaaccaacaatccatcccaggctaagctgcggcgagaacttgatgagtccctgcaagttgccgaacggttgaccaggaagtacaacgagctgcttaagagttatcagtggaaaatgttaaacacatccagtttactggaacagctgaacgaacagtttaattgggtcagtcgcctggcaaacctgacacagggagaggatcagtactacctgcgcgtgaccacagtcgcctcccacacttccgattcggacgtgccctcaggggtgacggaggttgtcgttaaattgtttgattctgatcctattaccgttactgtgcccgttgaagtatctcgtaaaaaccctaaattcatggagactgttgccgaaaaagctctccaggagtatcggaaaaaacacagagaagagtag

SEQ ID NO: 218678 - DNA, 816 bp, Artificial Sequence
  Description of Artificial Sequence: Synthetic coding sequence
atgatgaagaccctattgctctttgtgggcctgttactcacctgggagtcagggcaagtgttaggcgaccagaccgtttcagacaatgagctccaggagatgagcaatcaggggtcgaaatatgtgaataaagagatccaaaatgccgtaaacggtgtaaagcagatcaaaacattaatcgaaaaaactaatgaggaacgcaaaacactccttagcaatctggaggaggccaaaaaaaaaaaagaggatgcattgaacgagactagggagtctgaaaccaagctaaaggagctcccaggcgtctgtaacgaaacgatgatggcactttgggaggaatgcaagccttgcttgaagcaaacctgcatgaaattttatgctagagtctgccggtcaggatccggtttagttggacgccagctggaagaattcttgaaccagagctcacctttctatttctggatgaatggcgatcgtatagacagcctactggaaaatgatagacagcaaacacacatgttggatgtgatgcaggatcacttttcccgcgcttcaagcatcattgatgaacttttccaggattcactgatgccattcagtccttatgagcccttgaatttccacgctatgtttcaaccctttctggagatgattcatgaggcccagcaagctatggatatccattttcattcacccgcatttcaacatccacctaccgagtttattcgagagggcgacgacgaccggacagtgtgccgggagatccgtcacaattcaacaggctgccttagaatgaaggaccagtgcgataaatgctag

SEQ ID NO: 218679 - DNA, 1383 bp, Artificial Sequence
  Description of Artificial Sequence: Synthetic coding sequence
atggaagcctgcaaggattcccggatcgggggtatgatgaaaaccttactgctgttcgtagggctgctcctcacatgggagtccgggcaggtcttgggagaccagaccgtgagtgataatgaactgcaagagatgtccaatcaggggtccaagtatgtaaataaggagatccaaaatgctgttaatggcgtgaagcaaatcaaaacacttattgagaagaccaacgaggaacgaaaaacactcctttccaacctggaggaggcaaaaaaaaaaaaggaggacgccctgaacgagacacgcgagtctgagaccaagctgaaggagttacctggggtatgtaacgagactatgatggccctgtgggaggagtgtaaaccttgcctcaagcaaacctgcatgaagttctacgccagagtgtgtagatccggttctggcctggtgggacgtcaactggaagaatttttgaatcagtcttcccccttttacttctggatgaacggggacagaattgactctctcttggagaacgataggcaacagactcacatgttggatgttatgcaggaccacttctccagagccagtagtattatcgatgagctgtttcaagaccggttttttactcgggaacctcaggatacctatcactatctcccattttccctgcctcatagacgacctcactttttttttccaaagtcacggattgtgaggagtctcatgccgttctcaccatatgagccgctgaactttcatgcaatgttccaaccgtttctagaaatgatccacgaggcccagcaggccatggatatccacttccattccccagcttttcagcacccccctactgagttcattagggaaggagacgacgaccgcactgtgtgtcgcgaaatcaggcataatagcactgggtgtctccgcatgaaggatcagtgtgacaagtgccgtgagatactcagcgtggactgttctacaaacaatcccagtcaagccaaactgagacgcgaactagacgagtccctgcaggtggccgagaggctaactcggaagtacaacgagctccttaagtcttatcagtggaagatgctgaacacaagtagccttttagagcagctgaacgagcagttcaattgggtaagccgactcgctaacctaacccaaggtgaagaccagtactacctccgggttacaacggttgcctctcatacaagcgacagtgatgtaccctctggggtgacagaggtggttgtcaagttattcgatagcgacccaatcactgtaacagtgcccgtcgaagtgtcacggaagaaccctaaatttatggagactgttgctgaaaaggcactccaagaatacaggaaaaagcacagggaggaatag

SEQ ID NO: 218680 - DNA, 1506 bp, Artificial Sequence
  Description of Artificial Sequence: Synthetic coding sequence
atgcaagtctgtagccagccccaaagaggatgcgtgcgcgaacagagcgccattaacaccgctcctccatctgcacacaatgccgcttctcctggcggagcgagaggccaccgagtccccctgaccgaggcatgtaaagactcaaggataggaggcatgatgaagactcttctcctgttcgtcgggctcctgctcacatgggaatctggtcaggtcttgggtgaccaaactgtgtctgacaacgagctgcaggagatgagcaaccaggggtccaaatatgtaaataaggagatccagaatgccgtaaacggagttaagcagattaagaccctgatcgaaaagactaatgaggagagaaaaaccctgctttctaatctcgaagaggcaaagaaaaagaaagaagacgctttaaatgaaacgagagagtctgaaaccaagcttaaggaactgccaggagtctgcaacgagaccatgatggccctctgggaagagtgcaaaccttgcctaaagcagacatgcatgaaattttacgcaagggtttgcagatcaggttccgggttagtaggacggcagcttgaggaatttcttaaccagagctcacctttctacttttggatgaacggcgaccgaatcgattcattactggaaaatgaccgtcagcagactcatatgctcgacgtcatgcaagatcacttctctcgcgcatcttcaattatcgacgaattatttcaggacagatttttcacccgcgagcctcaagacacctaccactacctgccattctcccttccccatcggaggccacatttttttttccctaagtctcgcattgttcggtcactcatgccattttcgccatacgaacctcttaattttcacgccatgttccagccattcctggaaatgatacatgaagcccagcaagccatggacatccactttcattcccctgcttttcaacaccctccaactgaattcattcgcgaaggagatgacgatcggacagtgtgtagagagattcggcacaattccactggatgtcttaggatgaaagaccagtgcgacaagtgccgcgagattcttagtgttgactgctcgaccaacaatcccagccaagccaaactgaggcgggagctcgacgagtccctgcaggtagccgaacgtctcacccggaagtataatgaactgctgaagagctaccaatggaagatgctgaatacatcttcactgctggaacagttgaatgaacagttcaattgggtctcaagactggccaacctcacacagggtgaagaccagtattacctgcgcgtgaccactgtagccagtcataccagcgatagtgatgtgccctccggggtcaccgaggtcgtggtgaaactctttgactccgatcctataaccgttacggtgccagtagaagtctcccgtaaaaatccaaaatttatggagacagtggcagagaaggccctacaagaatataggaagaagcaccgggaagagtag

SEQ ID NO: 218681 - DNA, 894 bp, Artificial Sequence
  Description of Artificial Sequence: Synthetic coding sequence
atggaggcctgcaaagatagccggattggtgggatgatgaaaaccctcctgctgttcgtggggttactccttacctgggaatccggccaagtgctcggggatcagaccgtgagtgataacgagctgcaggaaatgtccaatcaggggtctaaatatgtcaacaaagaaatacagaacgctgtgaacggtgtgaaacaaatcaagactctgatcgagaagacaaacgaagaacgtaaaacgctgctgtctaacctcgaggaggctaagaagaagaaggaggatgccttaaacgaaacacgcgaatctgagacaaaactcaaagaacttcctggcgtctgcaatgaaacaatgatggcactctgggaagaatgcaaaccatgtctcaagcagacttgtatgaaattctatgccagagtctgcagaagtggcagtggactggtgggacggcaactggaggaattcctcaaccagtcaagtcctttctacttttggatgaatggcgacagaatagacagcctcctcgaaaacgatcgacagcagacccacatgctggacgtgatgcaagatcatttcagccgagcctcaagtatcattgacgagttatttcaagaccgattcttcacacgggagccacaggacacttaccattatcttccattcagtctcccccacagaaggccgcacttttttttccctaagtcgcgtattgttagaagcctaatgccctttagcccatatgaaccccttaattttcatgccatgttccagcccttcttggagatgatccacgaggctcaacaggctatggacatccattttcattcgcccgcatttcagcatcccccaactgagtttatcagggaaggcgacgacgaccgcaccgtctgcagatag

SEQ ID NO: 218682 - DNA, 2040 bp, Artificial Sequence
  Description of Artificial Sequence: Synthetic coding sequence
ctgggccaatttgagcagcctactggatacatggagaactctgtctcttactccgccatcgaagatgtgcaactgctctcatgggaaaatgcacctaagtactgtttgcagctgacgatccccggtggaaccgtgcttctacaggccgctaattcttacctccgggatcagtggttccactctctgcagtggaaaaaaaaaatatataagtacaagaaggtcctttcgaatccaagccgttgggaggtcgtgttgaaggaaatacgtacccttgtggatatggctcttactagtccccttcaagacgactcaatcaaccaagcccctttagagattgtaagcaagctcctcagcgagaatacgaacttgacgacacaggagcacgagaatattattgttgccatcgctccacttcttgagaacaaccatccacctccagacttgtgcgagtttttttgtaaacattgccgggagagaccaagaagcatggtggttatagaagtgtttactccagttgttcagaggattctcaaacacaacatggattttggaaagtgtccacgcctccgacttttcacccaagagtatattctcgccctaaatgagcttaatgccggaatggaagtggtgaaaaagtttattcaaagtatgcacggaccaaccggtcactgccctcatccccgagtacttcccaatctggttgcagtgtgtctagctgccatctactcatgttacgaagagtttatcaatagtcgggacaattccccatccttgaaagagattaggaacggctgccaacaaccctgcgaccggaagccaaccctgccgttgcggctgcttcacccgagccccgaccttgtgagccaagaagcgacgctgtctgaggctaggctcaagtctgtcgtggtggcgagttccgagatccacgtggaagtagagcgtacgtcaacagccaagcctgcgctcactgcatcagccggtaacgacagcgagccgaatctgattgattgtctgatggtcagccctgcctgttcaacaatgagcattgagctgggccctcaagccgaccggacactcggttgttacgtggaaattctgaagcttctgtcagattacgacgattggcggccatctcttgcctccctgctacaacccataccttttcccaaggaggcactagcacatgaaaagttcacaaaggaattaaagtacgttatccagcggttcgcagaggacccgcgtcaggaggtgcattcgtgcctcctgtccgtccgcgctggcaaagatgggtggttccagctgtacagcccgggaggggtcgcatgcgatgatgatggagaactctttgcttccatggtgcatattctgatgggcagctgttacaaaactaaaaaattcttgctgtcgctcgctgagaacaaactggggccttgtatgctgcttgcactcagaggcaaccagacaatggttgagattctgtgtctgatgctcgagtacaacattatcgacaacaacgacacccaacttcagataatcagcactttagagtctactgacgtggggaaacggatgtatgaacagctttgcgacagacaacgggaactgaaggagcttcagcgtaaaggtggacccacccgcctgactctaccgtctaagagtactgatgcagatctggcaagactgctgtcctctggctccttcgggaacttggagaacctcagtttggcattcaccaacgttacatccgcgtgcgcagagcaccttattaagctgccttctctcaagcagctgaatctgtggagtacacagttcggtgatgctgggcttagactcctgagcgagcatttgaccatgttgcaggtgctaaacctgtgcgaaacaccagtgacagacgccggactgctagccctgagctctatgaaatctctgtgttctttgaatatgaattctaccaaattgtcagctgatacctacgaagatctcaaagctaagttgccaaatctaaaggaagtggacgtgcgttatactgaggcttggtag

SEQ ID NO: 218683 - DNA, 2322 bp, Artificial Sequence
  Description of Artificial Sequence: Synthetic coding sequence
atggacgtcacctcctcgtctgggggaggcggtgatcctcgtcaaatagaagagaccaagccattgctggggggtgatgtctcggctcctgaggggaccaaaatgggggcagtgccatgccggcgtgcactattgctctgcaatggcatgaggtataagcttctacaagaaggagacatccaagtttgcgtaattcgtcacccaaggacgttcctttcaaagatattgacaagcaaattcctgcgtagatgggaaccccaccacttaaccctagcagacaacagcctcgcatccgcaacccctacaggatacatggaaaattctgtctcatactccgcaatcgaagacgtgcagctgctgtcctgggagaacgcaccaaaatactgcctgcaactgaccattccaggaggcactgtgctgcttcaagccgctaattcctatctgcgtgaccaatggttccactcattgcagtggaaaaaaaagatatataaatacaaaaaggtgctttccaaccccagccgctgggaggttgttctgaaggaaatccgtaccctggtcgacatggccctcactagccccctgcaggacgacagcattaaccaagcacctctcgagattgtctcgaagctcctgagcgagaacaccaatctgacaacccaggaacacgaaaatatcatcgttgccattgctccattgctggagaacaaccatcctccccctgatctgtgtgaatttttttgcaaacattgccgcgagcgccctcgcagcatggtggtgattgaggtgttcacccccgtagtgcagcgcatcctcaaacataatatggatttcgggaaatgtccgagacttaggctgttcacccaggagtatattctcgcacttaacgagctcaatgccggaatggaagtcgtgaagaaatttatccagagcatgcatggccctaccgggcactgccctcatcccagagtgctcccaaacttagtagccgtctgtttggccgctatctacagttgctatgaagagtttatcaattcaagggacaacagcccaagcctcaaggaaatcagaaacggatgccagcagccttgcgatcgtaagcccacacttccattaagactgctccacccctcacctgatctggtaagtcaggaagccacgctgagcgaagcccgtctaaaatccgtggtggtggcctcctctgagatccatgttgaggttgagagaaccagtacagccaaacccgctttgacagcttccgctggcaatgatagcgagcctaatctgatcgactgtctgatggtgagcccggcttgcagcaccatgagtatagagttaggtcctcaagcagaccggacactggggtgttatgtggaaatcctgaaactgctgtccgattacgacgattggcgtccctccctggcctcccttttacagccgatccccttccctaaggaggccctggctcatgaaaagttcaccaaggaacttaagtacgtgattcaaaggttcgctgaagatccacgccaggaagtacacagttgtctattgagtgtgagagcaggtaaagatggctggttccaactctactctcccggaggagtagcttgcgacgatgatggggagctttttgccagtatggtccatatcttgatggggtcctgctacaaaacgaagaaattcctgctaagtcttgcagagaataaattggggccatgcatgctcctggccctgagaggtaaccagactatggtagagatcctatgcctgatgctggaatacaacatcatagacaacaacgacacacagctccagatcataagtacgcttgagtcaacggacgtgggtaagcgcatgtatgagcaattatgtgacagacagagggagctgaaggagctgcagcgcaaaggagggccaacacggctaacgctacccagcaagagcactgacgccgatttggcccgtctgctcagttctggcagttttggcaatctcgaaaacttaagtctggctttcaccaacgtgactagtgcttgtgcagaacatcttatcaagctaccctctttgaagcaactgaatttatggagcacccagtttggcgatgcgggtctgcgcttgctgagcgaacacttaactatgctgcaggtattgaatctttgcgagacgcccgtcaccgacgctggtctactcgccctgagttcaatgaagtctctgtgttctttgaacatgaactccactaagctgtccgccgatacatacgaggacctcaaagcaaagctaccgaacctgaaggaagtggatgtacggtataccgaagcttggtag

SEQ ID NO: 218684 - DNA, 2040 bp, Artificial Sequence
  Description of Artificial Sequence: Synthetic coding sequence
atgggacaagcagccgaacccactggctacatggaaaactctgtgtcatactcagccatcgaggatgtacagttactgtcctgggagaacgctcctaagtactgtctgcaactgactatccctggcggtacagtcttgctccaagcggcaaactcatacctcagggatcagtggtttcatagcctccagtggaagaaaaaaatatacaagtataagaaggtccttagcaatccctcccgatgggaggtggtactgaaagagatacgcacactggtggatatggctctcacctcccctctccaggacgacagtataaaccaggccccacttgaaatcgtttccaagctactgtccgagaacaccaatctgactacacaggaacacgaaaatatcatagttgctatcgcgcctctgttggagaataatcaccctccaccagacctatgcgagtttttttgtaaacactgcagagagaggccccgatccatggtggtcattgaggtctttaccccagtcgtccagcgcatcctcaaacacaacatggacttcgggaaatgccctaggctgcgcttatttacccaggagtacatcctggccctgaacgaactgaacgccggaatggaggtggttaaaaaatttattcagtccatgcacggaccaactggccattgcccacaccctagggtgctgcccaatttagtcgcagtgtgcctcgctgccatctactcctgttatgaggagttcattaacagcagggataactctccaagtctaaaggagattcgaaatggctgccagcaaccgtgtgacagaaagccaacactgcctctgaggcttctgcatccctctccggacctcgtgagccaggaggcaaccctcagtgaggctagactgaaaagcgtagtcgtggcctcttccgagatacatgtcgaggtggagcgtacgagcacagccaagcccgctttaacagccagcgccggaaacgattccgaacccaatctcattgattgtctcatggtctcaccggcatgcagcaccatgagcatcgagctcggaccacaggctgatcgcaccttggggtgttacgttgagatcctaaaattgctctccgactatgatgattggcgaccctcccttgcttccctactgcagccaatccccttccctaaggaggctctggcgcatgagaagtttaccaaagaactcaaatatgtcatccagcggttcgcagaggatcccagacaagaggtccactcctgtcttctatccgttcgtgcagggaaagacggctggtttcaactgtacagccccggtggagtagcctgtgacgacgacggggaactctttgcttccatggtgcatatcctgatggggagttgctataaaaccaaaaaatttttgttaagcctcgcggagaataagttggggccatgtatgctacttgcattaagaggtaatcaaacaatggttgagatcttgtgtctcatgctcgaatacaatattatcgacaacaatgacactcaattgcagatcatatctaccctggaatcaaccgacgttggtaaacggatgtatgagcagttgtgcgacagacagagggagctgaaggaactgcagagaaagggcggacctactaggctaactctaccaagcaagtccaccgatgccgacctggctcgcttgttgagcagcgggtcttttgggaatcttgaaaacctgtctttagccttcacaaatgtcactagtgcctgcgccgagcatctgattaaacttccctccctcaagcaattgaacctgtggagtacacagtttggggatgcaggattgcgcttgttatctgagcacctgacgatgctgcaggttttgaatttatgcgaaactccagtaaccgatgccggtctgttggcattgtcgagtatgaagagtctctgctccttaaatatgaactcaacaaagctgtctgctgacacatacgaggatcttaaggccaagctccccaacctgaaagaggtggatgtgcgatacacagaagcatggtag

SEQ ID NO: 218685 - DNA, 1761 bp, Artificial Sequence
  Description of Artificial Sequence: Synthetic coding sequence
atggctctgacatctccacttcaggatgactctatcaaccaggcccctctggagattgtatcaaagctgttgagcgagaacaccaatttaaccacgcaagaacatgagaatatcattgtggctatagctcctctcttggaaaacaaccatccacccccagatctgtgtgaattcttctgcaagcactgcagggaacgcccaagatcaatggtcgtcattgaagtgtttactcccgtggttcagcgcatcctaaagcataacatggactttgggaagtgccccaggctgagactcttcacccaagagtacattctggctcttaacgaactcaatgccggaatggaagtggttaagaaatttatacagtctatgcacgggccaacaggccattgccctcacccgagggtcctgccaaacctggtcgccgtgtgtcttgccgcaatctactcctgctatgaggagtttattaacagtagggataactcaccgtccctgaaagagatccgtaatggctgtcagcagccctgcgatcggaagccaactttacccctccggctgctgcaccccagccccgatctcgtgtcacaggaggcaaccctttcggaagcaaggctcaaaagtgtagtcgtggctagctctgagatccatgttgaggttgagcggacgagcaccgccaaacctgcgctgacagcaagcgcgggtaatgactcagaacctaacttaatagattgtttgatggttagcccagcttgctcaactatgagcatcgaactcggaccccaggctgatcgcacgctcggctgctacgtcgaaatcctgaagcttttaagcgattatgacgactggcggccaagtctcgctagcctgctgcaaccaattccattccctaaggaggcgctagcgcatgaaaaattcaccaaggaactcaaatacgtgattcaacgctttgcagaggacccccgacaggaggtacactcctgtctgttgagcgtcagagctggaaaggacggctggttccagctgtattcccccggtggcgttgcatgtgacgacgacggtgaactattcgcctctatggtgcatattctcatgggatcttgttacaaaactaaaaagttcttactttccctggcggagaataaactgggaccatgtatgctccttgcgcttagaggtaaccagactatggttgaaatactgtgcctcatgctggagtacaatatcattgacaacaatgatacacaacttcagattatcagcacacttgagtctaccgacgtgggcaagaggatgtatgagcagctgtgcgatcggcagcgggagctgaaggaactgcagcgtaaaggcggacccacacgtctgactctcccctcaaaaagtacagatgccgatctggccagactcctctctagtggctcttttggcaatctagaaaatctgtccctcgccttcacaaatgtgacgtccgcatgcgcagagcacctgatcaaactcccctcactgaagcagctgaacctatggagtacacagttcggcgacgccggactccggctcctgagcgaacaccttaccatgttgcaggtcctcaacctttgcgaaacacctgttaccgatgcaggtcttttagccctttcaagcatgaagagcttatgttctttgaacatgaatagcaccaagctgtctgccgacacttatgaggatctgaaggcaaagctgcccaatctaaaagaggttgatgtcaggtatactgaagcttggtag

SEQ ID NO: 218686 - DNA, 312 bp, Artificial Sequence
  Description of Artificial Sequence: Synthetic coding sequence
atggcccactataaggcagcggactccaagagggagcagtttcggcgatacttagaaaaaagcggcgtgctggatacgctgacaaaagtcttggtggcactgtatgaggagcctgaaaaacccaactctgccctggacttcctgaaacaccaccttggagccgctacgcccgaaaatcccgaaatagagctgctccgacttgagctggccgaaatgaaggaaaaatatgaggccatcgtcgaagagaacaagaagctgaaagccaaacttgcgcagtatgaacctccccaggaggagaagagggctgaatag

SEQ ID NO: 218687 - DNA, 1695 bp, Artificial Sequence
  Description of Artificial Sequence: Synthetic coding sequence
atggccgtttttaggtctggcttattagtacttactacaccacttgccagccttgcgcctcgactcgccagcatcctgacatctgccgctaggctcgtgaatcacacactgtatgtgcatctccagcccggaatgtctctagaagggcctgcccagcctcagtcttcccctgtccaggctactttcgaagttctcgacttcattacccacttgtacgccggagctgacgttcataggcacctggatgtgcggatattgctgaccaacatcagaactaagagcaccttccttccacccctgcctacaagcgtccaaaatctggctcacccgcctgaggttgtgttgaccgactttcagacccttgacggatcccagtacaaccctgtaaaacagcagttggtacgctacgctacctcttgctacagctgttgtcctcggctggcgtctgtcctgttatactctgactacgggatcggcgaggtcccagtagagccccttgacgtccccctgccaagtaccatcagaccagccagtccggtggcgggatcccctaaacagccggttcgcggatattaccgaggagcagttggtggaacgtttgaccgcctgcataacgcccataaggtgcttctttctgtggcttgtatcctggcccaggaacaactggtggtaggagtggccgacaaagatctgcttaagtccaagcttctccccgaactgctgcagccttacacagagagggtggagcacttaagcgagttccttgtggacatcaagccctccctgaccttcgacgttatccctcttctggacccctacgggccagcaggcagcgacccatcactcgagttcttggtggtgagcgaggaaacttatcgtggaggcatggccattaacagattccgtctcgagaatgacctagaagagctagccctgtaccaaatccagttgctgaaagacctgcgtcatacggaaaacgaagaagataaagtgtcatcctcatcgtttaggcagaggatgctgggcaatctcctgcgacctccttacgagcgtccggagcttcccacctgtttatacgtaattggtcttactggcatttccggctccgggaagagctcaattgctcagcgcctaaaaggcctgggggcttttgtcattgactccgaccatttgggccaccgggcttacgctcccggagggccagcctaccagcctgttgtggaagctttcggtactgatatcctacataaggacgggattattaacagaaaggtcctgggaagccgggttttcggaaacaagaagcagctgaagattttgaccgacattatgtggcctatcattgccaagctggcccgagaggaaatggaccgcgctgtggccgaggggaaacgggtgtgcgtcatcgacgctgctgtccttctcgaagcaggctggcagaacctggtgcatgaggtttggaccgcagttataccggagactgaagcagtgaggcgcatcgtcgaacgggatggactgtctgaggctgccgctcaatctcgcttacagtcacaaatgtccgggcaacaactcgttgagcaaagtcacgtggtactctccactctctgggaacctcatataacccagagacaggtggagaaagcctgggcgctactacaaaaaaggatccccaagacccaccaggctctggattag

SEQ ID NO: 218688 - DNA, 1695 bp, Artificial Sequence
  Description of Artificial Sequence: Synthetic coding sequence
atggctgtatttagatctggactgctcgtcctcaccactcctttagcttctctggctcctcgactagcctccattttaacatctgcagctcgcctggtgaatcacacactgtacgtgcacctgcagccaggaatgtcgctagaagggccagcccaaccgcaatcatctcctgtacaagccacctttgaagtgctcgatttcatcacgcacctgtacgccggagctgacgtgcaccgtcatctggatgtgcgcatcttgctgacaaacattcgtactaagagcactttcttgcccccacttcccacctccgtgcaaaatctagctcaccctcccgaggtggtgttgacggattttcagacactcgacgggagccagtataaccccgtcaaacaacagctcgtccgatacgcaactagttgttattcttgttgtcccaggctagcttcagttctgctgtattcagattacggcatcggggaggtgcccgtggagcctctggatgtacctttaccgagtacgatcagacctgccagtcctgttgctggctcccctaagcaacccgtgaggggatattacaggggggctgtaggcggaacctttgaccgcctccataatgcccacaaggtcctgctgtcagtggcttgtattctcgcacaggagcaacttgtagtcggcgtggctgacaaggaccttctgaaatctaaattattaccggaattactgcaaccatataccgagcgtgtcgaacatctgagtgaattcctcgttgacattaagccgtccctgacctttgatgtgatcccacttctggatccttacggcccagctggatcggacccatccctagagtttctcgtggtgagcgaggaaacttatcgcggtggaatggcaatcaacaggtttcgcctagaaaacgatcttgaggagttagcgctttaccagatacagctgctcaaagacctgagacacactgagaacgaagaggataaggtctcatcttccagcttcagacaacgaatgctggggaacctcctgcgccctccatacgagaggcctgagctacctacgtgtctgtatgtcataggcctgactggaattagcggcagcggaaagtcttctatcgcccagagactgaagggcctgggagcatttgttatcgactcagatcatctgggccatcgggcttacgcccctgggggtcctgcctaccaaccagtcgtagaagccttcggtaccgatattctgcacaaggatgggattataaataggaaagtcctcgggtcacgggtgttcggcaacaagaagcaattaaaaatcttgactgacatcatgtggcccatcatcgctaaactggcgagagaggaaatggacagggcagtcgccgaaggcaagagggtttgtgtcattgacgccgctgtgttacttgaggccggttggcagaaccttgtgcacgaggtgtggaccgctgttatccccgagaccgaggctgtgaggcgcattgttgaacgagatgggctgtctgaggctgctgcccagtcacggcttcaatcacagatgtctggacagcagctggtcgaacaatcacacgtcgtgttgtcaaccttgtgggaacctcacatcacacagagacaagtggagaaagcctgggccctcctccagaaacgaattccgaagacacatcaagcccttgattag

SEQ ID NO: 218689 - DNA, 1782 bp, Artificial Sequence
  Description of Artificial Sequence: Synthetic coding sequence
atgagaactccaaggcttcgtgcccagccacgcggagcagtgtaccaagccccaagccctcctcctgctcccgtgggcttgggatccatggccgtgtttcgcagtggacttctggtcttaactactccactggcttctctggcacctcgcctcgcatcaattctcacctcagctgctcgactggttaaccacacattatacgtgcacttgcaacccggaatgtccctggagggaccagcccaaccacagagttctcccgtgcaggccactttcgaggtgctggattttattactcacctgtacgcaggcgcagacgtgcataggcacctggatgttaggatcctcctgaccaacatccggaccaaatccaccttcctaccccctctacccacctctgttcagaacctggcccaccctcccgaggtcgtattgaccgactttcagacccttgatgggtctcaatataatccagttaagcaacaactcgtacggtacgcaacatcttgctactcctgctgtccacggctggcgtccgttctgttatacagtgactatggaattggagaggtgcctgtagagcccctggatgtgccactcccttctacaatccgcccagcctctccggtggcaggcagtcctaagcagcccgttcggggatactacagaggtgccgtagggggaacattcgataggctccataacgcacacaaagtgctgctttccgtagcctgcatactcgcgcaggaacagctagtcgtgggtgtggccgacaaggatctgctaaagtcaaagctgctgcccgagcttctgcagccctacacagaacgggtcgaacacttatcagaatttctggtagacattaaaccatcgcttacctttgatgtgatacccctgctggatccatatggccctgctgggtctgaccctagtttggaattccttgtggtgagcgaggagacataccgcggagggatggccataaaccggttccgtctggaaaacgatttggaggaactcgctctctatcagatccagctgcttaaggatctccgccataccgagaacgaggaggataaggtctccagcagctcctttagacagcggatgttgggcaacctcctgagaccaccctacgagaggcccgagctccccacatgtctctacgttatcggtctgaccggaatctctggatctggcaaaagttccatcgcccaaaggctcaagggattaggagcgttcgttatcgactccgaccacctggggcatagggcctacgctcccggagggccagcttaccagcctgtcgtggaggcgtttggtactgatatcctgcataaggacgggattatcaaccgcaaggtgctgggatcacgggtgttcggcaataagaagcaactgaaaatcctgactgatattatgtggcccattatagctaaactggcaagggaagaaatggatagggctgtagctgaagggaaaagggtctgtgttatcgatgccgctgtcttgctagaagccggatggcaaaacttggttcacgaggtctggacggcggtgatccctgagacagaggctgtgcgcaggattgttgagcgtgacggactgtctgaggccgcagctcagtctagacttcagtctcagatgtccgggcaacaactggttgagcaaagccatgtggttctttccacactgtgggaaccccacatcactcaacggcaggtggaaaaagcttgggccctgctgcagaagaggatacccaagacgcatcaggcccttgattag

SEQ ID NO: 218690 - DNA, 528 bp, Artificial Sequence
  Description of Artificial Sequence: Synthetic coding sequence
atggctgtgttcagatcaggactgctggtcctcaccactccgctggctagcctagccccacggcttgccagcatcctcacctcagccgctcgtttggtaaatcacacgctgtatgtccacctgcagccaggaatgtctctggagggtcctgcccagccgcaatcttcacccgtgcaggctacatttgaggtgttagattttatcacacatctgagcccatcccctgcccacctatctcctgaaagtaggcctcccgcaagaagtcgtgtggaccggtttccagatcccggttggaagcccgtgcagccagggcagacagccgcttcagccctacggcatcagctgctccagcttttgtccgccaccggcctgggtgccgcaattttgcggctgtgggaccgtcggtccgccagaggcgctccagggtgcccattaactctgcatgaccaggcctccttccccaggggacgggtgtccaaagctgcgggagcatggctgctcccatggagatgcagatggcatgtttag

SEQ ID NO: 218691 - DNA, 810 bp, Artificial Sequence
  Description of Artificial Sequence: Synthetic coding sequence
atggccatcaatcgttttcgactggagaacgatctggaggaattagctctgtaccagattcagctgcttaaagacctgcggcatacagagaatgaggaagacaaggtatcctcatcatcgttccggcagaggatgttagggaacctgcttcgccctccctacgagaggcctgaattgccaacctgtctttatgttattggcctgaccggtatctctggctccggaaagagtagcattgctcagaggctgaagggtctgggcgctttcgtgatcgattctgaccacctcggccatcgtgcttatgctcccggtggcccagcctatcagcctgtggtcgaagcattcgggacggacatcctccacaaggacggaataatcaacagaaaggtcctgggatcacgagtcttcggaaacaagaaacagctcaaaatcctgacagatattatgtggccaatcatagccaagttggccagggaggagatggatcgggcagttgcagaaggaaaacgcgtttgtgttattgatgctgccgtgttactggaagcaggatggcagaatttggttcacgaagtatggacagcggtgatacccgagaccgaagccgtgcgcaggatagtggagcgcgatgggctctcggaagcagcagctcaaagccgccttcagagccagatgtctggtcaacagctcgtggaacagtctcatgtggttctgagtaccctgtgggaaccacacatcacacagcggcaagtggaaaaagcttgggcattattgcaaaaaagaatacctaaaacccaccaggctctggactag

SEQ ID NO: 218692 - DNA, 1782 bp, Artificial Sequence
  Description of Artificial Sequence: Synthetic coding sequence
atgcgaacaccacgcttgagagctcagccgcgaggggcagtctatcaggccccttcaccaccacccgcacccgttggattaggatctatggcagtgtttagaagcggcctgcttgtcctgaccacccctcttgctagtcttgctcctaggctggcgtcaatcctaaccagcgcagctaggcttgtcaatcacaccctgtacgtccacctgcagcctggaatgtcacttgaaggacctgcacagcctcagtcctcccccgtccaggccacctttgaggttctcgattttataacgcacttgtatgctggggcagacgtccaccggcatctggacgtgaggattctgctcacaaatatcagaacaaaaagcacctttcttccacctctgcccacttctgtacagaacctggctcatcctcccgaagtcgtactcacagactttcagaccctggacggctcgcaatacaatccggtgaaacagcagttggtacgctacgctacctcttgctactcctgctgcccacggctggccagcgtgttactgtatagtgattatgggattggggaagttccagtggaaccactggatgtgcctctgccatccactattagacctgccagtcctgtggctggtagccctaaacagcccgtgagagggtactatcggggagcggtcggaggcacattcgaccggctgcacaacgcccataaggtcctcctgtccgtcgcttgcatactggcgcaggaacagttagtcgtgggcgtggcggacaaagacctgctgaagagcaagcttcttcccgaacttctacagccctatacagagagggttgagcatctttctgaatttctggtggacatcaaaccatccttgacatttgacgtgatccccttgctcgatccatacggtcccgctggaagcgaccctagtttagagtttctcgttgtctcggaagagacctatcgaggtggtatggccatcaatcgatttagactggaaaatgatcttgaggagctggccctctaccagatccaactcctcaaggatctaagacataccgagaatgaagaagataaagtgtcctcgagctcctttcgacaaagaatgttaggtaatctacttaggccaccttatgagcgacccgaactgcccacctgcctatacgttattggcctaacagggatttctgggagtggcaaatcctccatcgcccagagactgaaagggctgggggcatttgtgatcgacagcgatcacctgggtcaccgcgcatacgctccaggtgggccagcatatcagcccgtggtggaggcttttggaactgacatcctgcacaaggacgggatcattaacaggaaggtcctgggttctcgcgtgttcgggaacaaaaagcagctgaaaattctgaccgatatcatgtggcctatcatagcaaagctggcacgcgaggaaatggatcgcgcagtggccgaggggaaacgggtgtgcgtgatcgacgccgcagtcctcctagaggctgggtggcagaatctggtgcacgaggtgtggaccgcagttatacccgagaccgaggctgttagaagaatcgtggagcgggacggcctgtctgaagctgctgctcagtccaggctccagagtcagatgagcggacagcagctcgtggagcagtctcatgtggtgctgtcgacactttgggaaccccatatcacccaaagacaagtagagaaggcctgggcgctcctgcagaagcggattcccaagacacaccaggcgctggattag

SEQ ID NO: 218693 - DNA, 429 bp, Artificial Sequence
  Description of Artificial Sequence: Synthetic coding sequence
atggccacaaagatcgacaaggaggcctgtagagcagcatacaaccttgtgagagatgatggaagtgccgtgatttgggtgacttttaagtatgacggaagtaccattgttccgggagaacagggcgcagaataccagcactttattcagcagtgcactgatgatgtccggctgtttgctttcgtgaggttcacaacaggagatgctatgagtaagaggtcgaagttcgcccttatcacctggataggtgaaaatgtctctggcttgcagcgcgctaagacaggaactgataaaaccctggtgaaagaagtcgtccaaaactttgcaaaagagtttgttatttctgacagaaaggagctcgaggaagacttcattaagtccgaattgaaaaaagccggaggggctaactacgacgctcaaaccgagtag

SEQ ID NO: 218694 - DNA, 1731 bp, Artificial Sequence
  Description of Artificial Sequence: Synthetic coding sequence
atgcgtggtcctaattctggaaccgaaaaggggagacttgtgattccagagaagcagggatttgatttcttgtgcatgccagtctttcatccacgctttaagagagagttcattcaggaacctgccaagaaccggcctgggcctcagacacgatctgatctcctgctgtctggccgtgcttttctcctccccctcaaccaggaggataacacaaatctggcgcgtgttctcacaaaccacattcataccggccaccatagtagtatgttttggatgcgagtaccactggtggccccagaagatctgagagacgacataatagaaaacgcccctacgacacacactgaagaatatagcggcgaggagaagacgtggatgtggtggcataactttcggactctgtgtgactactccaaacgaattgccgttgctctagagataggcgcagatctaccttctaaccatgtaatcgatcgatggctcggggagccaattaaagccgctatcttacccacttctatttttctgacaaataagaaggggttccctgttctctccaagatgcatcagcgcctgatcttccgtctcctgaaactggaggtgcaattcatcatcacggggactaatcaccatagcgagaaggaattctgttcatacttgcagtacctggaatacctgagccagaaccgccctccccctaatgcttatgagctgttcgcaaaaggttacgaagactatttgcaatctcccttacagcctctcatggataacctagagtcccagacttacgaagtatttgagaaagatccgataaagtactctcaataccagcaggcaatatataaatgcctgttggatcgcgtgcctgaggaggagaaagacaccaatgtgcaggtcctcatggtactgggcgcaggccgaggacccctggttaatgccagccttagagcggctaagcaggccgacaggcgcatcaagctgtatgctgtcgagaaaaaccccaacgcagtagtgactctcgaaaactggcagtttgaagaatggggaagccaggtcacagtggtctcatcggatatgcgagagtgggtcgctccggagaaggctgatatcattgtcagcgaattgctgggttcattcgcagataatgagctcagtcctgaatgcctcgacggagcccagcatttcttaaaggacgatggagtgtctatccctggggaatataccagctttctggccccaatttccagtagcaagctgtacaatgaagtgagggcatgccgcgagaaggatagagatcccgaagctcagtttgagatgccttatgtggtgagactgcacaatttccaccaactttcggccccacagccctgtttcacttttagtcatcccaatagggatcctatgatcgataataatagatactgtacgctcgagtttcccgtggaagtcaatactgtgctgcacggcttcgcagggtatttcgagaccgtgctgtaccaggatataacgctgagtattcggccagaaactcattctcctggtatgttttcctggttccctatcctgttcccaatcaaacagccaatcaccgtccgagagggtcagacaatttgtgtgaggttttggcggtgtagcaactctaaaaaggtgtggtacgagtgggcggtgaccgcccctgtgtgctctgctattcacaaccccactgggaggtcctacacaatcggcttgtag

SEQ ID NO: 218695 - DNA, 1206 bp, Artificial Sequence
  Description of Artificial Sequence: Synthetic coding sequence
atgcttggcattggcacggaaggacctcacgttggcctagtacaggccagtgagcaccccaagatcgaattctatctaaagaactttacatctgccaaggatgtcttattcgcgatcaaagaggtaggattcaggggcggaaatagtaatacagatataacacttgaaaaatacctattcgtgatgctcaaaaggtcagagaatcagcagacatacctcatgaacgccgatgtcgctgagcgcatgagctccacaactgtagacagcgaggagcgcctactccgagggaaggctctgaagcatacagcacaaaagttttttacagtggatgccggagtgcggaagggcattccgaaggtcgtggtggtgttcattgatggatggcctagcgacgacatagaggaagccggaatcgttgcgagagagttcggtgttaatgtgttcatcgtgtccgtggcaaagccaatccccgaggaattaggcatggtgcaagacgtcactttcgtggacaaggccgtttgccgtaataatggctttttcagttaccacatgccgaactggtttggtaccaccaagtacgttaagcctctcgtgcagaaactctgtacccacgagcagatgatgtgttcaaagacatgttataatagcgtaaatatcgcctttctcatagatgggtcctcaagcgtaggagattccaacttcaggctaatgctcgagttcgtgtcaaatatagccaagaccttcgagatcagcgatataggcgctaaaatcgctgctgtgcagtttacatacgaccagcggaccgaatttagctttacagattactccaccaaggagaacgttttagcggtcattaggaacatccgctacatgagtgggggtacagcaacaggggatgcaatcagctttactgtgcgtaacgtcttcgggccaattagagaatccccaaataaaaattttttggtcatcgtgacagatggacagtcctatgacgatgtgcaggggccagccgctgctgctcacgacgccggtatcaccattttctccgttggggtggcatgggcgcctctggacgatctcaaggacatggcttcaaaacccaaggagtctcacgccttcttcacacgcgaatttacggggttggagcccatcgttagtgacgtgatccgcggaatttgtagagacttcctcgaaagccagcagtag

SEQ ID NO: 218696 - DNA, 1653 bp, Artificial Sequence
  Description of Artificial Sequence: Synthetic coding sequence
atgtctgccgcttggatcccagctcttggactcggcgtttgccttctgctgcttcccggtcctgccggatccgaaggagctgccccaattgcaatcacctgttttaccaggggccttgatattcggaaagagaaagcagacgtgctgtgccccggtggctgcccgttggaagagttttcagtgtacggcaatatagtgtacgcttctgtctctagtatatgtggagcggctgttcatcgcggagtcatatctaattcaggtggtcccgtgcgcgtgtacagtctgccgggacgcgagaattactcaagcgtcgatgccaacgggatccagtcacaaatgctgtctcggtggagcgcctcctttaccgtcactaaggggaagtccagtacccaggaggcaacaggccaggccgtgtctacagcccatccacccacaggcaagagattaaaaaaaaccccagagaagaaaaccggcaacaaagattgtaaagccgacattgctttcctgatcgacggtagttttaatattggccagcgcaggttcaacttacagaagaacttcgttggcaaagtcgcgcttatgctaggaatcgggaccgaagggccacacgtggggctggtgcaagctagtgagcatccaaagatagagttctatcttaaaaactttaccagtgccaaggacgtactgttcgcgataaaggaagtagggtttagagggggtaattcgaataccggaaaagctttgaaacacacagcgcagaaattctttactgtggatgcaggggttaggaaggggattcccaaggtcgtcgtggtgtttatcgacggatggccaagcgatgatatcgaggaagctggcatcgtcgccagagagttcggcgtcaacgtcttcatcgtcagcgtcgctaagccaatccccgaggagctgggaatggtgcaggatgtgaccttcgtagataaggctgtgtgccggaacaacggctttttttcatatcacatgcccaactggtttgggactaccaagtatgtaaagcctctggtgcagaaactgtgtacacatgagcaaatgatgtgctctaagacgtgttacaactcggttaacattgccttccttatcgatggttcttcttcagtcggcgactcgaacttccggttaatgctggagttcgtcagcaatatcgccaagactttcgaaatctcagatataggagctaagatagccgctgttcagttcacatacgaccagagaactgaattttccttcaccgattattctacgaaagagaacgtcctagctgtcataagaaatatccggtacatgagtggcggtaccgctactggcgatgcgatttcttttacagtgagaaacgtgtttggccctatacgcgagtcaccaaacaagaatttcctggtgatcgtgaccgacggccagtcctacgacgacgtgcagggccctgccgcagcagctcacgatgccggtattacaattttttcagtcggagttgcctgggccccattggacgacttgaaggacatggcctctaagcctaaggagtcgcatgccttctttacaagggagtttaccggactcgagcctatcgtgtccgatgtgattaggggcatctgccgggatttcctcgagtcccagcagtag

SEQ ID NO: 218697 - DNA, 732 bp, Artificial Sequence
  Description of Artificial Sequence: Synthetic coding sequence
atgctcagtaggtggagcgccagtttcactgtgactaaaggcaagagttccactcaggaagctacaggccaggctgtgagcacagctcacccaccaacaggaaagaggctgaaaaagacacctgaaaagaagacaggaaacaaggattgtaaagcggacattgcctttcttatagacggttcctttaacatcggccagagacgtttcaatctacaaaagaactttgtgggcaaagttgcgctaatgttaggaatcggtactgaggggccacacgtcggcctggtccaggcctcagaacatcctaagattgagttctacctgaagaacttcaccagtgctaaggacgtgctctttgcaattaaagaagtgggcttcagggggggtaattctaacacaggaaaagcactcaaacatacagcacagaaatttttcacagtcgatgccggagtgagaaaggggattcctaaggtggttgttgtcttcattgacgggtggccttccgatgatattgaggaggcaggcattgtcgctagagagtttggagtgaatgtgtttatagtgtccgtcgcaaagcctataccagaggagctcggaatggttcaagatgtgactttcgtggacaaggccgtttgtaggaataatggcttctttagttaccatatgccaaactggttcgggactactaagtacgtcagcttgtggtaccgttcctgcgcgctcatgaataaatag

SEQ ID NO: 218698 - DNA, 1278 bp, Artificial Sequence
  Description of Artificial Sequence: Synthetic coding sequence
atggggccaaggagacttctgctggtggccgcatgtttctctctttgtgggccactactgagcgcgagaactagggccagaaggccagaatctaaagccaccaatgcgacccttgaccctaggtccttcctgcttaggaatccgaatgacaaatacgaacccttttgggaggatgaggaaaagaacgagtcaggactcaccgaataccgcttggtatccattaacaagtcttcacctctgcaaaaacagttgcctgcgtttatttcagaagacgcaagcggctacctgacctcctcatggctgaccctttttgtgccctccgtatacacaggcgtcttcgtggtgtctctgcctctcaacatcatggctattgtggtattcattctgaagatgaaagtgaaaaaacccgcagtcgtgtacatgcttcacttggccacggcagacgtgcttttcgtcagcgtcttgcccttcaagatctcctactacttcagtgggagcgactggcagtttggatcagagctctgtagattcgtaacagcagcattttactgcaatatgtacgcttctattctgctgatgaccgttatcagcatcgacaggttcctggctgtcgtctacccaatgcaatccctctcttggcgcactcttggcagggcctccttcacctgccttgctatttgggcgctggccattgcaggggtggtgcctcttttactcaaggaacagaccattcaggtgccagggctgaatatcactacctgccacgacgtcctgaatgagacattactggaaggatattatgcctattatttctctgctttttcagccgtctttttcttcgtgccattgatcatatctacagtgtgctacgtgtccatcatacgctgcctgtccagctccgcagtggccaacaggtctaagaaaagcagggcattgttcctcagcgcggcagttttctgcatatttataatttgttttggcccaaccaatgtactactcatcgcccactacagcttcctttcacacacttcaactactgaagctgcttactttgcctacctcctttgtgtctgtgtgtcttctatctcctgttgcatcgacccgctgatctactattatgcctcatctgagtgccagcgctacgtctattctatcttgtgctgtaaggagtctagtgacccttccagctacaatagcagcggccagctgatggcttctaagatggacacttgctcatcaaatcttaacaatagcatatacaaaaagctgcttacatag

SEQ ID NO: 218699 - DNA, 1194 bp, Artificial Sequence
  Description of Artificial Sequence: Synthetic coding sequence
atgcgctccccttcagcagcttggctgcttggggctgccatcctgctggctgctagcctgtcatgttctggaaccattcagggtaccagccgcagcagcaaaggcaggtctttaatcggaaaagttgacgggaccagccacgtgacaggtaagggagtaacggttgagacagtctttagcgtggacgaattcagtgccagcgtgttgacagggaagctcaccacggtgtttctccctattgtgtacaccatcgtctttgtggtggggctgcctagcaatggcatggcgctgtgggtctttttatttcgcacaaaaaaaaagcaccccgcagtaatatatatggccaacttggccttagccgatctactgtccgtcatatggttcccgctcaaaatcgcctatcacatacatgggaataattggatctatggcgaggctctatgtaatgtcctgatagggttcttttatggcaacatgtactgttccatcctatttatgacatgtctttctgtccaacggtattgggttatagtaaatcccatggggcactcaagaaaaaaggccaatatcgctataggaataagtctggccatatggctgcttatactattagttacaattcccctgtatgttgttaagcagactatctttattcccgcactgaacatcaccacctgccatgacgtgttgcccgagcagcttctggtgggagatatgttcaactattttttgtccctggctattggggtattcctttttcctgcgtttctgaccgccagcgcctacgtgcttatgatccgcatgctgagatcgagtgctatggatgagaatagtgaaaagaagcggaagagggccattaaacttattgtcacagtcctggctatgtacctaatctgttttaccccatctaacctcctcctggtcgtgcactattttctcatcaaaagtcagggccaatctcacgtgtacgccctttacatcgtggccctgtgtctgtctactcttaacagctgcattgatccatttgtctattatttcgtgtctcatgattttagagatcatgcgaaaaatgcgctgttgtgtcggagcgtgcgcactgtgaagcagatgcaggtcagccttacgtccaagaagcactcacggaaatccagctcctattcctcatccagcaccacagtgaagaccagttactag

SEQ ID NO: 218700 - DNA, 1125 bp, Artificial Sequence
  Description of Artificial Sequence: Synthetic coding sequence
atgaaggctcttatttttgcggcagcagggttgcttcttctgctacccactttttgccagtctgggatggaaaatgatacaaataatttagctaaacctacactgccaattaagactttccggggagccccaccgaatagctttgaggaattccctttcagcgccctggaggggtggaccggagcaactatcactgttaagattaagtgtccagaggaatccgcgtctcacctccatgttaagaatgctacaatgggatacctaactagcagtctttctaccaaactgataccagcgatttatctgcttgtgttcgtggttggagtccccgcaaatgctgtgacactgtggatgctctttttcaggacacggtctatctgcaccacagtgttctacaccaatttggccatcgccgactttcttttttgcgtgaccctgccctttaaaatagcttatcatctgaacggaaataattgggtgtttggcgaagtgctttgtagagccacaactgtcattttttacggcaacatgtattgctctattctgctgctagcttgcatatctatcaacaggtatcttgcaatcgtccacccttttacttataggggactgcctaagcacacctatgcactagttacttgcgggcttgtgtgggctaccgtttttctttacatgctgccattcttcatactgaagcaagagtattatctggtccagccggacatcaccacatgccatgacgtgcacaatacctgtgaaagctccagcccgttccagttgtattactttatcagcctggctttcttcggtttcctgattccctttgtgctcatcatctactgctatgcggcaataataagaacacttaacgcgtacgatcaccgctggctgtggtacgttaaagcctcacttttaattcttgtgatttttacaatttgctttgccccatccaatatcatacttatcatacatcacgctaattactattacaataacaccgacggcctttacttcatttacctcattgctttgtgcctaggcagtctgaattcctgcctggacccattcctgtactttttgatgtccaaaacaaggaatcactcaactgcctacctcactaaatag

SEQ ID NO: 218701 - DNA, 1059 bp, Artificial Sequence
  Description of Artificial Sequence: Synthetic coding sequence
atggagaatgataccaataatctcgccaagccaacactccccataaagacattccgcggagcaccccctaactcattcgaggaattccctttttcagcgttggaagggtggaccggcgcaacaattacagtgaaaatcaaatgcccggaagaaagcgcaagccacctccacgtgaaaaatgcaactatgggctatctgacctcctccctttctactaagcttataccggctatctacttgcttgtgttcgtcgtcggggttcccgctaacgctgtcacgctctggatgctgtttttccggaccaggtccatctgcacaaccgtattttacaccaaccttgccattgcagactttcttttctgcgtcactttacctttcaaaattgcgtaccacctaaacggaaataactgggttttcggggaggtcctctgtcgagccaccacagtgattttctacggcaatatgtactgttccatccttctgctggcttgcattagtatcaatagatacctcgcaattgttcatccatttacatatcggggtctgcctaaacacacttatgctttggtgacctgcggcctggtgtgggccactgttttcctgtacatgttgcccttctttatcctgaagcaggagtattacctggtgcagccggacatcacaacttgtcacgacgtccacaacacgtgcgagagttctagccccttccagctgtattatttcatctctctagcctttttcggcttcctgatacctttcgtgctgataatttattgctacgctgctattatcagaaccctaaatgcctacgaccaccgctggttatggtatgtgaaggcttcactcctgatcttagtgatcttcaccatatgctttgccccatccaacataatcctcatcatccatcacgcaaactactattacaataataccgacggcctgtacttcatttatttgatcgcgttgtgtctcggttcccttaacagttgtttggatcccttcctgtacttcttgatgagcaaaacccggaatcacagcactgcctacctgactaagtag

SEQ ID NO: 218702 - DNA, 1158 bp, Artificial Sequence
  Description of Artificial Sequence: Synthetic coding sequence
atgtgggggcgtttgttgctttggcccttggtcctgggattctccttgtcggggggaacccagacaccatcagtttatgacgaatctgggtctacgggaggaggcgatgatagtacccctagcatcttgcctgcccctagaggataccctggccaggtatgcgccaacgacagcgacacactcgaacttcctgattcctcacgcgcactcctgctggggtgggttcctactaggctagtgcctgcgctgtacggcctggtacttgttgtcggcctgcccgcaaacgggctggctctgtgggtgctggccacacaagcgcctcgactcccctctacaatgttacttatgaacttggctgcagccgacttgctgttggcgttggcgttaccccctagaattgcttatcacttgagaggccagagatggccttttggcgaggcggcttgcaggctggcgacagcagcactgtatggacatatgtacggctcagtgctcctgcttgccgcagtatccctcgaccggtaccttgctttggtgcaccctcttagggccagagccctacggggtcgcagattggccctgggactttgtatggctgcatggttaatggccgctgcactggctctgcccctcaccttacagcgccagacctttcggctagccaggtctgaccgcgtgctgtgccacgacgctttgccgctggatgctcaggcatctcactggcagcccgcttttacatgtcttgcgttactgggttgcttcctaccactgctcgccatgcttttatgttatggggcaactctgcataccctcgctgcctcaggacgacgctatggacacgctctgcggctaacggccgtagtgctcgcgtctgccgttgcctttttcgtaccctccaacctgctgctgctattgcactattccgatccatcaccatctgcctggggcaacctgtatggagcctacgttccgtccctggccttgtccacactgaattcttgcgtagaccccttcatctattactatgtttccgctgaattcagagacaaagttcgagccggtctgtttcagcgcagtcccggagacaccgtcgcctcaaaggcctccgctgagggtggaagccggggaatgggaacacactctagcctcctgcagtag

SEQ ID NO: 218703 - DNA, 1848 bp, Artificial Sequence
  Description of Artificial Sequence: Synthetic coding sequence
atgagggcactgctgctgctcggcttcttgctcgtctcgttggaatctacattgtctattccaccatgggaagcccctaaggagcacaagtataaggccgaggagcacactgtcgtcctgaccgtgactggcgagccctgccactttccatttcagtaccatcgccagctgtaccataagtgtacgcacaaaggcaggcccggtcctcaaccttggtgtgcgactactcccaattttgatcaggatcagcgctggggctattgtttagagcccaagaaggttaaagatcactgcagtaagcattcaccttgccagaagggcggaacctgcgttaatatgccaagcggccctcattgcctttgcccccagcacctgactggcaatcactgtcagaaggagaagtgttttgaaccacagctacttagattctttcacaagaacgaaatatggtataggactgaacaggccgctgtagccaggtgccagtgcaagggacccgatgcccattgtcagagactggcttctcaggcatgtcgaaccaacccgtgcctacacggtggacgttgtcttgaagttgaaggccataggttgtgccattgccccgtggggtacactggcgcattctgcgatgttgacaccaaagcaagctgctacgatggacgcggtctatcctaccgcggtctagctaggacgacgctctccggagcgccatgccaaccttgggcgtccgaggccacatatcgcaacgttacagctgaacaggctaggaactggggcctgggaggccacgccttttgccgcaacccagacaacgatatccgcccatggtgctttgtactgaatagggatcgtctctcatgggaatattgtgacctagcacagtgccagactccgacccaagctgcccctccgaccccagtctcccctaggctgcatgttccactcatgcctgcccaaccagcaccccctaagcctcaaccgaccactagaactccacctcaatctcaaacccctggggctcttcccgctaaacgcgagcaaccaccttccttgacccggaacggaccactgagctgtggacagcgcctgaggaagtctcttagcagcatgacccgggtggtgggcggactggttgccttgcgaggcgctcacccatacatcgcagcgctttactggggtcactctttctgtgcgggtagtctgatcgccccttgttgggtcttgaccgctgcccactgtttgcaggacaggcctgcacctgaagaccttactgtggtactggggcaggaaagaaggaatcacagctgtgagccttgccagaccctggccgtgaggagttatagactgcatgaggccttctccccggttagttatcagcatgacctggccctgctgagactgcaggaagatgctgacggctcttgcgcattgctgtccccctacgtacaacccgtttgtctcccatcgggcgcagctcgccctagcgagaccacattatgccaagtggctggttggggtcatcagtttgaaggggctgaggagtacgcttcatttcttcaggaggctcaggtgccgttcctgtctctcgaaagatgctccgctccagacgtgcatgggagttcaatcctccccggaatgctgtgcgccggatttcttgaaggagggaccgatgcctgccagggagatagtggaggccctcttgtttgtgaggatcaggccgcagagcgacggctgacgctccaaggcattatatcctggggtagcggatgtggggaccgcaacaaacccggagtgtatactgacgtagcctactacctagcctggatacgggagcacaccgttagttag

SEQ ID NO: 218704 - DNA, 1986 bp, Artificial Sequence
  Description of Artificial Sequence: Synthetic coding sequence
atgcggcttaagaatctgacgttcatcatcatcctgataatttcaggagagttgtatgccgaagagaaaccttgcggcttcccacacgtggaaaatgggagaatcgctcagtactactatacattcaaatctttctattttccaatgagcattgataaaaagctgtctttcttttgccttgccggatataccaccgagagtggcagacaggaagagcaaacgacttgtacaaccgaaggctggtcaccagaacccagatgttttaagaagtgtactaagcccgacctctcaaacggctacatatctgatgtcaaactcctgtacaagatccaggagaatatgcgctatgggtgcgcaagcgggtacaaaacaacaggcggtaaggatgaggaggttgtccagtgcctaagtgatgggtggtcctcccagcctacctgccgcaaggagcacgagacctgtttagcccctgagctgtacaacggaaattactccactacccagaagacttttaaagtcaaggacaaagtgcagtacgaatgcgcgaccggctactataccgctgggggtaagaagactgaggaggtcgaatgtctgacttatggctggagcctcacgccaaagtgcacaaagctgaagtgtagctcactcagattgattgagaatggctacttccatcccgtgaagcagacgtacgaagaaggtgatgttgtgcagttcttctgtcatgaaaattattatctgagtggctcagatctgatacagtgctataacttcggatggtatccagagagccctgtgtgtgagggtcgcaggaacaggtgtccaccaccccctttgccaattaacagcaagattcagacacatagcactacttatcgccacggagaaattgttcacatcgaatgcgagttgaatttcgaaattcacggatcggctgagatccgttgcgaggacggaaagtggacagagccgccaaaatgcatcgaaggccaagagaaggtcgcgtgcgaggagccacctttcatcgagaatggtgcggctaatctccactcaaagatctattacaacggtgacaaagtgacatacgcttgcaagtcaggctatctgctgcatggtagcaatgagatcacgtgtaacaggggtaagtggaccctgccgcctgagtgcgtagaaaacaatgaaaactgcaagcacccacctgtcgtcatgaacggtgccgtggcagatggaattctggcctcttacgctactgggtcctccgtggaatataggtgtaatgaatactacctcttgcgaggaagcaaaatctccagatgcgaacaaggaaaatggagcagcccaccagtatgcctggagccctgcaccgttaacgtggattacatgaaccggaataatatcgagatgaaatggaagtatgagggcaaggtattacatggagacctcatcgatttcgtatgtaaacagggctacgatctgagtccactgacacccctgtctgagctgagcgttcagtgcaatcggggtgaagtgaaataccccctgtgcacgcgcaaggaaagtaagggtatgtgcacatcacctccccttatcaagcatggcgttataatctcttccaccgtagatacctacgagaatggctcttcagtcgagtaccggtgtttcgaccaccacttcctggaaggctcaagggaagcatattgcctggatggaatgtggaccacaccacccctgtgtctggagccctgtaccttatcattcaccgaaatggagaaaaacaacctgctgctcaaatgggattttgataacagacctcacatcctgcacggagagtacatcgagtttatctgtaggggagatacgtaccccgcagaactgtacattacaggatctatcttaaggatgcaatgcgataggggccagctcaagtaccctcggtgcatccctcgccagagcaccttgtcctaccaggaacccctcaggacatag

SEQ ID NO: 218705 - DNA, 3675 bp, Artificial Sequence
  Description of Artificial Sequence: Synthetic coding sequence
atgttaaccaagtttgaaaccaagagcgctcgcgtcaagggtctgagctttcatcccaagcgaccctggatccttacttcgttacataacggggtgatccagctatgggactatagaatgtgtaccctgatcgacaagttcgacgaacatgacgggcctgtcagggggatcgattttcacaaacaacagccactgttcgtgtccggtggcgacgattataagataaaagtgtggaactataaactgagacgatgcctgttcacgctgctaggacacctggactatattcgcaccactttttttcaccacgagtacccctggattctgtcggctagcgatgatcagacgatccgggtctggaactggcagagccgcacctgtgtgtgcgttctgacgggccacaaccactacgtcatgtgcgcgcagtttcaccccacggaagaccttgttgtgtccgctagcctggatcaaacagtgcgggtctgggacatctctggcttgagaaagaaaaacctgtcccctggggcagtcgagagtgatgtcaggggcattacaggggtcgatttgttcgggaccacggatgccgtcgtcaagcacgtcctcgagggacatgataggggcgttaactgggccgcatttcacccaacgatgcccctgatagtctccggtgctgacgaccgccaggttaaaatctggcgaatgaacgagtctaaggcgtgggaagttgacacatgccgcggacactacaataatgtgtcgtgcgcagtctttcaccccagacaggagttgatattaagcaatagcgaggataagtccatacgagtctgggatatgtccaaaagaaccggagtgcagaccttcaggcgagaccatgaccggttttgggtgctggctgcgcaccctaacctgaatctcttcgctgccggtcacgacggcggaatgatcgtcttcaaactggagagggagcggccagcatatgcagtgcatggcaacatgttgcattacgttaaggatagatttctcagacagttggactttaatagcagcaaggatgtggcagttatgcagctacgtagcggttctaaattcccagtttttaacatgagttacaaccccgcagaaaatgcagtactgctgtgtacccgggctagtaacctagaaaactccacttacgacttgtatacaatccctaaggacgccgattcacaaaatccggacgcacccgagggaaagcgctcctcggggctaactgctgtctgggtggcaaggaacagatttgccgttcttgatcgaatgcactcactcctcattaagaatcttaagaacgagattacaaaaaaggtgcaggttccaaactgtgacgagattttctacgcaggcaccgggaatttgttgctcagggacgctgactctatcactctgttcgacgttcagcagaaaaggacgctggcctctgtgaaaatttcgaaggtgaaatatgtgatctggagcgccgacatgtcccacgtagccctcctcgctaagcatgctatagtaatatgcaatcggaaactggatgccctttgcaatatacatgagaacatcagagtgaaatccggcgcatgggacgagtctggtgtattcatctatactacaagcaaccacatcaagtatgccgtcacgaccggcgaccatggaatcatcaggaccctggatttgccaatatacgtgacccgggtcaaggggaataacgtctactgtctggacagggagtgtagaccaagagtgttgactatcgacccgaccgaattcaaatttaaactggccctgatcaacaggaagtatgatgaagttctgcatatggttcggaatgccaaacttgtgggtcagtccatcatagcctatttgcagaaaaaagggtatccggaggtggctctgcatttcgtcaaggatgagaagacacgcttttccctggctctggaatgcggtaatatcgagatcgcactggaagctgcgaaagccctggatgacaagaactgttgggagaaactcggagaggtcgcacttctgcagggcaaccaccagatcgtggaaatgtgttaccaacgcactaaaaatttcgacaagttaagttttctttatctgatcactggaaacctggaaaagctcagaaagatgatgaagattgccgaaatacgtaaagacatgtctggccactaccagaacgccctatacctgggcgatgtgagtgaacgagtgcgcatcctcaagaactgtggccagaagtcgctggcatatctcactgcggctacgcatggcctagacgaggaagcggagagtctgaaggaaacgtttgacccagagaaggagaccatccccgatatcgaccccaacgcaaaactgctccagccaccagccccaataatgccactcgataccaattggccactgctgaccgtcagtaaaggatttttcgaaggaacaattgcttccaagggcaagggaggcgctttggcagcggatattgatattgataccgttggtacggaggggtggggggaagacgctgagttgcagttggatgaggacggattcgtggaggccacagagggacttggggacgatgcccttggcaagggtcaagaggagggcggtggctgggacgtagaagaggatctagaactgccgccagagctggacatatctcccggagccgctggcggtgccgaagatggattcttcgttccccctactaaggggacaagccccacacagatttggtgcaataattcccagctgcctgtggaccacattctggccggatctttcgagaccgcaatgcgcttgctgcacgaccaagtaggagtgatccaatttggtccctacaagcagctgttcttgcaaacatacgcaagaggcaggacaacgtatcaggcactgccttgtctgccctctatgtatggatatcctaatcggaactggaaggacgctggcctgaagaatggtgtcccagccgtcggacttaagttgaatgatcttatccagagactgcaattatgttatcagttgaccactgttgggaaattcgaagaggccgtagagaaatttaggagcatcttgttgtccgtgccgctcctggtggtggacaataaacaggagatcgccgaggctcagcaattgattactatttgtagggaatatattgtgggactgtctgtggagaccgagcggaaaaaactccccaaagaaacactggagcagcagaagcgcatctgcgaaatggccgcttactttacccactcaaacctgcagcccgttcacatgattctcgtgctacgaaccgcactgaatttgttttttaagttgaaaaatttcaaaactgcagccacctttgcccgaaggcttcttgaactggggcctaaaccggaagtcgcccagcaaacccgcaagatcctctccgcctgtgagaagaaccccactgacgcgtaccagctgaattacgatatgcacaacccgtttgatatctgcgctgcttcttaccgcccaatctataggggtaagcccgtggagaagtgccccttaagtggagcctgctattcaccggaatttaaaggccagatctgccgagtgacaacagttacagagatcggaaaggatgtgatcggcttgcggattagtcccttgcagtttcgctag

SEQ ID NO: 218706 - DNA, 3702 bp, Artificial Sequence
  Description of Artificial Sequence: Synthetic coding sequence
atgttaaccaaattcgaaactaagagtgcacgcgttaagggactgagctttcaccctaagcggccttggatcttgacgtccctgcacaatggggtgatacaactgtgggactatcggatgtgtactttgatagacaagttcgacgagcatgatggacctgtgagggggattgactttcacaaacaacagccactattcgtgagtggaggcgatgattacaagattaaggtctggaattacaaactgaggagatgtttgtttactttgctgggacacctggattatattaggacaacgtttttccaccacgagtacccatggatcctaagcgcttccgacgaccagaccattagggtctggaattggcaatcgcggacttgtgtatgcgtgctcaccggccataaccactacgtgatgtgtgcccagttccatcctactgaagacctggtggtctccgcatctcttgatcagacggttcgggtatgggacataagtggacttcgtaaaaagaacttatcacccggtgcggtggagtctgacgtcagaggcattacaggagtagacctctttggcaccaccgatgcagttgtcaagcacgtgctggaaggccacgatcggggtgtcaattgggccgcttttcacccaactatgcctcttatcgtgtctggggctgacgatcggcaggtcaaaatatggcgcatgaatgaaagtaaggcctgggaggttgacacttgccgcggacattataataatgtaagctgtgcagtgttccacccgcgtcaggagttgattttgtctaacagcgaagacaagtccatccgggtgtgggatatgagtaagcggactggggtgcagaccttccgaagagatcatgatcgattctgggtgctcgctgcccaccctaacctgaatctgttcgcggctggccacgatggtggtatgatcgtgtttaagctcgaacgcgaaagaccagcttacgccgtgcacgggaacatgctgcactacgtaaaggatcgtttcctcaggcagctggattttaattcaagcaaagatgtggccgttatgcaactacgttcggggtcaaagtttccagtgttcaatatgtcttataaccctgccgaaaacgcggttctgctgtgtactcgggcatccaaccttgagaatagcacttatgacttgtacacgatacctaaggatgccgacagccagaatcccgacgcgccagagggaaaacgttcaagcggcctgaccgccgtttgggtggctcggaacagattcgccgtgttggataggatgcattccctgctgatcaagaatttgaagaatgaaatcaccaagaaggttcaggtgcccaattgtgacgaaatcttttatgctgggacaggaaatttactcctccgagacgcagattccatcaccctgtttgatgtgcagcagaagcgcacattagcttcagtgaagattagcaaagtgaaatacgtcatttggagtgccgacatgtcccatgtagcattgcttgcgaagcacgagcatagctgccccttacccctcactgccattgtcatctgcaacagaaagctcgatgccctgtgcaacatccacgaaaacattagagtgaagagtggcgcttgggatgagagcggtgttttcatctacactacaagtaaccatatcaaatacgccgtcaccacaggagaccatggtataatacgcacactggacctccccatctatgtgaccagagtaaaaggaaacaacgtttactgcttggatcgagaatgccgacccagagttctcaccatcgaccccactgaattcaaattcaaacttgccttgatcaaccgtaaatacgatgaggtgcttcacatggtgcgcaatgctaagctcgtcggccagagtattatcgcctatctgcagaaaaagggttatcccgaagtggcattgcatttcgttaaggacgagaaaactagatttagcctggccttggagtgcgggaatattgagattgctttggaagccgcaaaagcgcttgatgacaagaactgttgggagaagctcggcgaggttgccctcctgcagggcaaccaccagatagtggagatgtgttatcaaaggacgaaaaactttgataagctgtctttcttgtacttgatcaccggaaacctggagaaattacgcaagatgatgaagatcgctgaaataaggaaagatatgtccggacactatcaaaatgccctgtatctgggggacgttagcgagcgggtccgaattctgaagaattgcggccaaaagtccctggcttacctaacagccgcaactcacggtctcgatgaggaggcggagtctctgaaagaaaccttcgatccggaaaaggagacgatacctgacatcgaccctaatgccaagctcctccagcctcccgctcccattatgccgttggatactaattggccacttctgacagtgtctaaggggttctttgagggaactattgcctcgaaaggaaaaggaggcgcactcgccgcagacatcgacattgatactgttggcaccgaaggctggggagaagatgccgagctccagctggacgaagacggtttcgtggaggctactgagggcctgggagatgacgcgttggggaagggccaggaggagggcggtggatgggatgtcgaggaagatctggagctccctcccgagctcgatattagccctggcgctgctggcggtgctgaagatggatttttcgtgccccctacgaagggaacatctccaactcaaatctggtgcaacaactcccagctgcccgtggatcacatcctggcgggaagcttcgagacggcaatgaggctactacatgatcaagtgggcgtaatacagtttggtccgtataaacagctgtttctacagacctatgcacgcggaaggactacttaccaggcactgccctgcctgccgtccatgtatggttacccaaacagaaattggaaggacgcaggcctgaagaatggcgttccagcggtagggctgaagttgaacgacctcatccagcggcttcaactgtgttatcaactgactacggtggggaagttcgaagaggcagttgaaaaattccgttctattctcctgtccgtacctctgttggtggtcgataacaagcaggaaatcgctgaggctcagcagctcatcactatctgtcgagaatacatcgtgggcctgagtgtggagacagagcgcaaaaagttgcctaaggagacactggagcagcagaaaagaatttgcgaaatggccgcatactttacacattctaatttgcagccagtgcacatgatcctagtcctccggaccgctctgaacctttttttcaagttaaagaattttaagaccgctgccactttcgccagacgactgctggagctgggacccaagccagaagttgctcaacagactagaaagatcctatcggcatgcgaaaaaaatcctactgacgcctaccagttaaattacgatatgcacaacccctttgacatttgtgcagcctcatacagaccgatttatcgcggaaaaccagtggaaaaatgtcccctctctggggcttgctattccccggaatttaaggggcagatttgtcgggtcactacagtgacagaaattggcaaggatgtgatcggcctgagaattagccccctgcagttccggtag

SEQ ID NO: 218707 - DNA, 2862 bp, Artificial Sequence
  Description of Artificial Sequence: Synthetic coding sequence
atgacagccgcagagaacgtttgctacacacttataaacgtgcccatggactctgagccccctagcgaaatctcgctgaaaaatgatctggaaaaaggggacgtgaagtcaaaaaccgaggccctcaagaaagtaatcatcatgatcctcaatggtgagaagctgcccggtctacttatgaccatcatcaggtttgttctcccactgcaggaccacactatcaagaaactgctcttggttttctgggagatagtacccaagactacgccagatgggcgactgctccacgagatgatacttgtgtgcgacgcctaccgaaaagacctacagcaccccaacgaattcatacggggaagcactctacgctttctttgtaagcttaaagaggcagaactgctggagcccttaatgcctgctatccgcgcatgcctggaacaccgacactcctacgtacgtaggaacgcagtcctagccatctatacaatctacagaaacttcgagcacctcatacccgatgctcctgagctgattcatgatttcctggtcaacgaaaaagatgcatcttgcaagcgaaacgcgtttatgatgctcatccacgccgaccaggacagagccctggattatctttcaacgtgcatagatcaggtacagaccttcggagacatcttgcaactcgtgatagtggaacttatttataaagtttgccacgccaatcccagcgaacgtgcccgttttattagatgtatttacaacctgcttcagagctctagtccagcggtgaagtacgaagcggctggcacacttgtgacattaagcagtgctccaacggcaataaaagccgctgcgcagtgctatattgatcttattatcaaggaatccgacaacaacgtaaagctgatagtcctcgaccgactcattgagctgaaagaacaccccgctcacgagagagtgctgcaggaccttgttatggatattttgcgagtcctgagtacccccgacctagaggtgagaaaaaaaacgcttcagctcgctctggatctggtatccagtcgcaatgtggaagagcttgtcattgttctgaagaaagaggtaatcaagaccaacaatgtgtccgaacacgaggacacagacaaatacaggcagctgctggttcgcaccctgcatagctgtagtgtgcggttcccagacatggccgctaatgtcatcccggttctcatggagttcctctctgacaataatgaagcagccgctgctgacgtcctggagttcgtccgtgaggctatacagcggttcgacaacttgagaatgctcatcgtcgagaaaatgctggaagtcttccacgcaatcaaaagtgttaagatctacagaggagccctgtggattctcggtgagtattgttccactaaggaggatattcaatccgttatgacagagattagaagaagtctcggcgagattccgatagtggaatccgagatcaagaaagaggccggagaacttaagcccgaggaggagattaccgttggaccagtacagaagctggtcacagagatggggacatatgctacgcaatcagctttgagttcttcaagacctacgaagaaggaggaggaccgacccccactgcgaggttttctcctggacggcgactttttcgtggctgccagtctggctacaacccttactaaaatcgcactgagatacgtcgccttggtccaggagaaaaaaaagcagaacagctttgtggccgaagctatgctgctgatggcgacgattttacatcttggtaagagtagtttgcctaagaagcctatcactgatgacgatgtggaccgaataagcctgtgtcttaaggtcctgtctgagtgtagcccccttatgaatgacatcttcaacaaggaatgcagacagtctctttctcacatgctgagtgccaaattggaagaggagaagctgtctcaaaaaaaggaatctgagaagaggaatgtgacagtacaacccgatgatcccatatcgttcatgcagctgacagccaaaaatgagatgaactgtaaggaggaccaatttcagctaagcttgcttgccgctatggggaacacccaacgaaaggaagccgctgatcccctcgccagcaagctcaataaggtgacacagctgacaggattcagcgacccagtttacgccgaggcttacgtgcacgtgaaccagtatgacatcgtactggacgtgctcgttgtcaatcagacatctgatactctccagaattgcactcttgaattggctacactgggagatctgaagcttgtggaaaagcccagccccctgaccctcgctccgcacgacttcgccaacatcaaagccaacgtgaaagttgcctctaccgagaatggcattatcttcggcaacatcgtttacgatgtgagcggcgcagcctctgatcgaaactgtgttgttctcagtgatattcacatcgacatcatggattatattcagccagccacttgcacagacgccgaattccggcaaatgtgggccgagtttgaatgggagaacaaggtgacagtaaataccaacatggtggacctgaatgactaccttcagcacatcctgaaatcaacgaatatgaaatgcctgacgcccgaaaaagccctgtccggctactgcggattcatggccgctaatctgtacgccaggtccatctttggcgaggatgctcttgccaacgtaagcattgagaagcctatacatcagggacccgacgccgctgtgactggacatattcgcattcgagctaagtcacaggggatggccctgagcctcggagataaaattaatctctctcagaaaaagacctctatatag

SEQ ID NO: 218708 - DNA, 2862 bp, Artificial Sequence
  Description of Artificial Sequence: Synthetic coding sequence
atgactgcagcggagaacgtgtgttatacgctgatcaatgtgccaatggattccgaacccccaagtgagatctccctcaagaacgacctggaaaagggtgatgtgaaatccaaaaccgaggcccttaagaaagttataatcatgatcctcaacggcgagaaactaccaggactcttgatgactatcatccgcttcgtcctcccccttcaggatcacaccatcaagaagctgctccttgtgttttgggaaatcgttccgaaaaccacaccagacggccgtcttctgcacgagatgatcctcgtatgcgatgcctatcgcaaggaccttcagcatcctaatgaattcatccggggaagcaccctgagattcctgtgtaagctaaaagaggcggagttactggaacctctaatgccagccatccgggcatgccttgagcacaggcactcctacgtccgacgaaacgcggtgcttgccatctacacaatatatcggaatttcgagcacctgatacctgatgcaccagagctgattcatgattttctggtaaatgaaaaagatgcaagctgtaaacggaatgcctttatgatgctgattcacgccgaccaggacagagcactcgactacctgagcacatgtattgaccaggtacagaccttcggcgacattctgcagctggtgatcgtcgagctgatctacaaggtatgtcatgccaatcccagtgagcgcgcaagattcattcggtgtatctacaatctgcttcagtccagctctccagctgttaagtacgaagccgctgggactctggtgaccctgagttccgcccctaccgcgattaaagctgcagctcagtgttatattgatctgatcatcaaggaatccgataataatgttaagctcatagtgctggataggctgattgagttgaaagagcatcctgcacatgaaagagtgctccaggatcttgtcatggatattctgcgggtgttgtctacccccgacctcgaggtgcgcaaaaagacacttcaactggcactggacctggtctcctctcgcaacgtcgaggagctggtgattgtattgaaaaaggaggtgattaaaactaacaatgtgagtgagcatgaggacactgataagtacagacagctccttgtgcggacactgcattcttgcagcgtgcgcttccctgatatggctgctaacgtgatacctgtgctcatggaatttctcagcgataacaacgaggcagccgctgccgatgtgctggaattcgttagggaagcaattcaaaggtttgacaatttaaggatgctgattgttgagaagatgctggaagtgttccatgcaattaagtctgtaaagatttatcggggtgcactctggattctgggggaatattgctctaccaaagaggatatccagtccgttatgacagagattcgtcgttccctaggcgagattccaattgtggaatctgaaatcaagaaggaggctggagagctgaaaccagaagaggagatcaccgtagggccagttcagaagttagtaaccgagatgggtacctatgctacgcaaagcgcactctcctcctctcgcccaaccaagaaagaggaagaccggcctccgctacggggttttctgctggatggcgattttttcgttgctgcctctttggctacaacactgacaaaaatcgcactgcggtacgtggcgctggtgcaggagaagaaaaagcagaatagtttcgtcgcagaggcgatgttattgatggccactatacttcacctgggcaaatcatccctgccaaagaagccaatcacagatgacgacgtggacaggatatcgttatgtcttaaagtgttgtcagagtgctcccccctaatgaatgacatttttaacaaggaatgccggcagagcttatcacacatgctctcggctaaattagaagaagaaaagctatcccagaagaaagagtctgagaagcggaacgtcacggtccagccggatgaccctatttcctttatgcagttaaccgcaaagaatgagatgaattgcaaggaggatcagtttcagctgtccctgctggcggctatggggaatacacagcgcaaggaagccgcagacccactcgcctccaaattgaataaagtgactcagttgaccggattcagcgaccctgtgtatgctgaggcctatgtccacgtgaatcaatacgacatcgtcctggatgtgttggtcgtgaaccaaacaagtgacacgttgcagaattgcaccttggagttagcaactctgggtgatttgaagttagtggaaaaaccatctccccttacactggccccacatgactttgccaatataaaggcaaacgtcaaggtggccagcaccgagaatggcatcatctttgggaacatagtctatgacgtatcaggagctgcatcggataggaactgtgtggtcctctctgacatccacatcgatattatggactacatacaaccggcaacttgcacagatgcagaatttaggcaaatgtgggcagaatttgaatgggagaacaaagtgactgtcaatacaaatatggtggacctgaacgactacctgcagcacatactcaagtccacaaacatgaagtgcctaaccccagaaaaggccctatctggttactgtgggtttatggcggctaacttatatgcccgttctattttcggggaagatgcccttgcaaatgtctccattgagaaacccattcaccagggaccggacgccgctgtaaccggacatatcagaataagagcaaaaagccagggcatggctctatctttgggagacaagattaacttgtctcagaagaaaacgtccatttag

SEQ ID NO: 218709 - DNA, 2721 bp, Artificial Sequence
  Description of Artificial Sequence: Synthetic coding sequence
atgccactacggctcgacatcaagcgaaagttaactgcacgctctgatcgtgtgaagagcgtggatctgcatccgactgaaccttggatgctcgcctcactttataatggctctgtctgcgtgtggaatcacgagacacagacattggtgaaaactttcgaggtgtgtgacctgcccgtgagagctgctaagttcgtcgcacgcaagaattgggtggtgactggtgctgatgacatgcagatcagggtgttcaattacaatacgctagaaagggtccatatgtttgaagctcacagcgactacatccgatgcatagctgtccatccgacgcagccctttattctcacctcaagtgacgacatgctgatcaaactgtgggattgggataagaagtggtcgtgctctcaggtctttgagggccacacgcattacgtgatgcagatagtgattaatccgaaagataacaatcagttcgcctctgcctctctggacaggaccattaaagtgtggcagctcggatcatcaagtccaaatttcacgttagagggccacgagaagggcgtgaactgtatcgactactactcgggcggagacaagccctatctaatttctggcgcagatgacaggcttgtgaaaatttgggactaccagaataagacatgcgttcagaccttggaaggccacgcccagaacgtgtcatgtgcttcttttcacccggagttgccgatcatcatcaccggttccgaggatgggacagtacgcatttggcacagctccacttaccggttagagtcaactctgaactatgggatggagagggtgtggtgcgtggccagtctccgaggaagcaacaacgtggctctgggttacgacgagggctctataattgtgaagctcggcagagaggagcctgcaatgtccatggatgccaatggtaagatcatctgggctaaacattctgaggtgcagcaggccaacctcaaggctatgggggacgcagagatcaaagacggcgaacggctgcccttagctgtgaaagacatggggtcgtgcgagatctatcctcagacaatccagcataatccgaatggcagatttgtcgtagtgtgcggagatggggagtacatcatctataccgccatggcgctaaggaacaaatccttcggatcagctcaggaattcgcttgggcacacgactccagcgaatatgcaatcagggaatcaaacagcatagttaaaatctttaaaaattttaaggagaagaagtctttcaagcccgacttcggagccgaaagcatttacgggggttttttgctaggagtcagatctgtgaatgggctcgctttctacgactgggacaacactgagttgattcgtcggattgagattcagccaaaacacattttctggtccgatagcggagagttagtctgtatcgccacagaggagagcttttttattctgaaatatctctccgagaaagttctggctgctcaggagactcatgagggggtgacggaagatggcatcgaagatgcttttgaagtcctgggggaaatccaagagatcgttaagactgggctgtgggtgggcgattgctttatttacacatctagtgttaataggcttaactattacgtaggaggcgagatcgtgaccatcgctcaccttgaccggactatgtatctgctgggatatattcccaaggacaatcgtctctatctgggggataaggagcttaacatcatctcctatagtctccttgtgagcgtgctggagtatcaaactgccgtaatgcggcgagattttagcatggcagacaaagtcctacccactattcctaaagagcaacggacgagagttgcacacttcctcgagaaacaagggttcaaacagcaggcactgaccgtctccaccgatcctgagcaccggtttgagctcgcactgcagctgggcgaattaaaaattgcatatcaattggccgtcgaggccgagtcagaacagaagtggaagcagttggctgagctagcaatctctaagtgtcagtttggactagcccaagagtgcctccatcatgctcaggactacggcggtctgctgctgttggcaacggccagtggcaatgctaatatggttaacaagctggctgagggcgctgagcgagatggcaagaataacgttgccttcatgtcttactttctgcagggtaaggtcgacgcctgcttggagctgcttattagaaccggacgacttccggaggccgctttcctggccagaacgtacttgccctctcaggtctcccgggtcgtaaagttgtggcgggagaacttatctaaagttaatcaaaaagcagctgaatcactggcagatcctaccgaatatgagaacttgttcccaggactcaaggaagcatttgttgtggaggagtgggtgaaggaaacacacgctgatctgtggcccgctaaacagtaccccctggtaactccaaatgaggaacggaacgtcatggaggaggggaaagacttccagccctcccgctcaactgcccagcaagaattagacggtaaacccgcaagtcccacacctgtcatcgtggcctcacatacagccaacaaggaagaaaagtccctcctggagttagaggtggacctcgataacctggagctggaggacatcgacacgacagatattaacttagatgaagacattctcgatgattag

SEQ ID NO: 218710 - DNA, 2634 bp, Artificial Sequence
  Description of Artificial Sequence: Synthetic coding sequence
atgttagcttcactgtataacggaagtgtatgtgtgtggaaccacgagactcagactctggtgaaaaccttcgaggtttgtgatctcccagtgagagctgccaagtttgttgccagaaaaaactgggttgtgacaggtgcagacgacatgcaaatacgcgtgttcaactacaatacattggaacgggtgcacatgtttgaagcccactctgactacattcgctgcatcgccgtgcacccaacacagccatttatactaacaagctctgatgacatgcttattaaactgtgggactgggacaaaaagtggtcttgcagccaggtgtttgagggacatacacactatgtaatgcagatcgttatcaaccccaaggacaacaaccagttcgcttcagctagcttggatcggactataaaagtgtggcagctgggttcatcctcacctaacttcaccctggaggggcatgagaaaggcgttaactgcatcgattactattccggaggggacaaaccttatctcatcagcggagccgacgatagactcgtgaagatttgggattatcagaacaaaacatgcgttcagaccctggagggtcacgcccagaacgtgtcctgcgcttcattccaccctgagctgcctattattattacagggtccgaggatggcactgtaaggatctggcatagctcgacttataggttagagagcaccctgaactacgggatggaaagggtgtggtgcgttgccagcctgcggggatcaaataacgtcgccctgggatacgacgagggcagtatcatagtgaaactcgggagagaggagcccgctatgtcaatggacgctaatggcaaaatcatttgggccaagcattcggaagtccagcaggccaatcttaaggctatgggagacgcggagatcaaggacggggagaggctccccctagccgtcaaggatatgggcagctgcgagatctatccacagactatacaacacaaccccaacggcaggtttgtggtggtctgcggagacggcgagtacatcatctatacagcgatggcgttgagaaacaagagctttgggtccgcccaggaatttgcttgggcgcatgacagcagtgaatatgccatacgcgaaagtaactcaatcgtaaagatcttcaagaactttaaagagaagaagtcattcaaacctgattttggagcggaatctatctacggtggctttctcctcggggtcaggtctgtcaacggtctagctttctacgactgggataatacagagctaattaggcgtattgagatccagccgaagcatatcttctggtctgattccggggagctggtatgcatagcaactgaggagtcatttttcatcctgaagtatctttctgagaaggtgttggccgcacaggaaactcacgaaggtgtcaccgaggatggcattgaggacgctttcgaagtgctgggggagatccaggagatagtcaaaaccggcttgtgggtgggagattgtttcatctatacctccagcgtgaaccgtctgaattactacgtaggaggcgaaatagtcaccatcgcccatcttgaccgaaccatgtaccttctgggttatattccaaaggacaatcggctgtatctcggggacaaggaacttaacattatctcatacagcctgctggtgagtgtactcgaataccagaccgcagtaatgaggagagatttctctatggcggataaggtgctgcccaccattcccaaggaacaacgtacgcgggtggcgcattttttggaaaagcagggatttaaacagcaggctctgaccgtatcaaccgatcccgaacacagattcgagctcgctcttcagctgggtgagcttaagatagcttaccaactcgctgtggaagctgaaagcgagcaaaagtggaagcagcttgcagagcttgcaataagcaaatgtcaattcggtctcgcccaggaatgcctccatcacgcccaggattatggcggtctgttgcttctggctaccgcctccggcaacgccaatatggtgaacaagctcgccgagggtgcggaacgggacggtaaaaataatgtggcattcatgtcgtactttctgcagggcaaagttgatgcatgcctcgaactgctaattcgaaccggcagactgccagaagccgcttttttggcaaggacctacctcccatcccaagtttcccgggttgtgaagctttggagggagaacctgagcaaagttaaccagaaggcggctgaatctctcgccgacccaaccgagtacgaaaatctgttcccaggtctcaaagaagcatttgtagttgaagaatgggtaaaggaaacccatgcagatctgtggcccgcaaagcagtatccactggtgaccccaaacgaggaacgcaacgtcatggaagaaggtaaggacttccagcctagcaggtccacagcacagcaagagctcgacgggaaaccagcctcacccacacccgtgattgttgcttcccacaccgcaaacaaagaggaaaagtccctgctggaactggaggtggatcttgacaatttggaactggaggatatcgataccaccgatataaacctggatgaagatattttagatgactag

SEQ ID NO: 218711 - DNA, 927 bp, Artificial Sequence
  Description of Artificial Sequence: Synthetic coding sequence
atggccccaccagctcctggcccagccagcggtggatctggggaggtggacgaactgttcgatgtcaagaatgccttctatatcggttcttaccagcaatgcattaacgaagctcagcgcgtcaagctttcctctcctgagagagatgttgaacgcgacgtattcctctatcgcgcttatcttgcacagaggaagtttggggtggtgcttgatgagattaaaccctcttcagcccctgaactgcaggccgtcaggatgtttgctgactacctggcgcacgagagcagaagagactctattgtggcggagctggatcgagagatgtctaggtcagtggacgtgacgaacaccacttttctgctgatggctgcgtcgatctatttgcacgaccaaaatcccgacgcagccctgcgggcacttcaccagggtgattccttagagtgcacagcaatgacagttcagatcctgctgaagctggatagacttgacctcgcgaggaaggaacttaagcgcatgcaagacctggatgaagatgcaacgctgacacagctggctacagcttgggtttcgttggctaccggaggcgaaaaactccaggatgcatactacatcttccaggagatggcagataagtgtagccctactctgttgctcctcaatggccaggcggcttgtcatatggctcagggcaggtgggaggctgcggagggcttgcttcaggaggccctggataaggatagtggatatccagagactctggtgaatttgattgtgcttagtcagcacttagggaagcctcccgaggttacaaaccgatacttgagtcagttgaaggacgcacaccggtcccatccctttattaaggagtatcaggcaaaggagaacgatttcgatcggctggttctccaatatgcgccaagcgcttag

SEQ ID NO: 218712 - DNA, 771 bp, Artificial Sequence
  Description of Artificial Sequence: Synthetic coding sequence
atggctcctcccgcacctgggccagcatcaggaggttccggtgaggtagacgagttgttcgatgtgaaaaatgctttttacattggaagctatcagcagtgcataaatgaggcacagagagtgaagctgtcctctccagaacgggacgtggaacgggatgtattcctctatagggcctatctcgctcagcggaaatttggtgtcgtgttggacgaaatcaagcccagctctgcccctgaacttcaggctgtccggatgtttgctgattatctggcccacgagagtaggagagattccatagtggctgaactagatcgtgagatgtcccgctctgttgatgtcacaaatacaactttcttattgatggccgcttctatttatctgcatgaccaaaaccctgatgcagctcttcgagccctgcaccagggcgattccctggagtgtactgccatgacagtccaaatactcctgaaactggatagactcgacttggccaggaaagagttgaaaagaatgcaggacctggatgaggacgcgacacttactcagcttgccacggcctgggtaagtttagctacggactcaggctaccctgagacactggtgaatctgattgtgttgagccagcacctaggcaagcctcctgaggtgacaaatcggtatctttctcagctcaaggatgctcaccgatcccacccctttatcaaggagtatcaggccaaggaaaacgattttgaccgtctcgtgttacagtacgccccaagtgcgtag

SEQ ID NO: 218713 - DNA, 774 bp, Artificial Sequence
  Description of Artificial Sequence: Synthetic coding sequence
atggcgcctcccgcacccggacctgcctccggagggagcggagaggtggatgaacttttcgatgttaagaatgccttctacattggcagttatcagcaatgcatcaatgaggcccagcgtgtaaaactttcaagtcctgagagagatgtagaacgtgatgtgttcctatacagggcttacttagctcaacgtaagttcggagtcgtgctggatgagatcaagccttcctctgctccagaactgcaggccgtgcgcatgttcgccgactatttagcccatgagagcaggagtaccgcaatgaccgtccagattctgctcaagctagacaggcttgacctagcacggaaagagctcaaaagaatgcaggaccttgatgaagacgcgacacttacccagctcgctacagcgtgggtgtcactggcaacgggaggagagaaactccaggatgcgtattacatttttcaggaaatggcagacaaatgcagccctacactgttactccttaatggacaggcggcatgtcatatggctcaggggcgttgggaggctgccgagggattactgcaggaagcccttgataaagactccggctatcccgaaaccctggtgaacctcattgtactttctcaacatcttgggaaacccccagaggttacgaatcgctatctgtctcaattaaaggacgcgcaccggtctcatccatttattaaggagtaccaggcaaaagaaaatgatttcgatcgcctcgtgttgcaatatgctccctccgcgtag

SEQ ID NO: 218714 - DNA, 924 bp, Artificial Sequence
  Description of Artificial Sequence: Synthetic coding sequence
atggctccgccagcccctgcgggtcttcgaggcagtggggaggtggatgagctgttcgacgtgaagaacgccttttatattgggtcctatcagcaatgcatcaatgaagcacaacgggttaagttgagctcccccgaacgcgacgttgaaagggacgtattcctgtatcgggcatacctggctcaacgaaaattcggtgtggtcctagacgagataaagccctcaagcgcccctgagctgcaggctgtgcggatgtttgctgattacctggcacacgaatcgaggcgtgattctatcgtggcagagctcgatcgcgaaatgagtcgctcagtggacgtgaccaatacaactttcctcctcatggcagcgagtatttacttgcacgaccagaatcccgacgccgctcttagagccctacatcagggcgattctctcgagtgtacagccatgacagttcagatcctgcttaaacttgacaggctggatctggctagaaaggagcttaagcgaatgcaggatctggacgaagacgcgacattaacccaattggcgacagcttgggtgagcttggcgaccggaggcgaaaaactacaagacgcttattacatctttcaggaaatggctgataagtgcagcccgaccttactattactgaatggtcaggccgcttgccacatggctcagggtcggtgggaggcagctgagggtctactccaagaggccctcgataaggattcaggatatccagagaccctcgtaaatctcattgtgctgtcccagcacttaggcaaaccacctgaggtcactaacagatatctgtcccagcttaaggacgcacaccgctctcaccctttcatcaaggagtaccaggcaaaggaaaacgacttcgataggctcgtgctgcaatacgcaccttccgcctag

SEQ ID NO: 218715 - DNA, 741 bp, Artificial Sequence
  Description of Artificial Sequence: Synthetic coding sequence
atgattaagaagttcgataagaaggacgaggagtcagggagtggatctaatcccttccagcatttggagaagtccgcagtgctgcaggaagcacgcattttcaatgaaacacccatcaaccctcgcaggtgtcttcacatcttaacaaagattctgtatctcctgaaccagggcgagcatttcggcaccactgaggccacagaagctttctttgccatgacgaggctcttccagtcaaacgaccagacccttagaaggatgtgttatttaactatcaaagaaatggccactatatccgaggatgtgatcattgttactagctcattaactaaagatatgacaggcaaggaggatgtgtacaggggccctgctatcagggcgctctgtagaattaccgacggtacaatgctgcaggctatagaacgctacatgaagcaggcgatagtggataaggttagctccgtttcgtcatcagcactggtgtcatctctgcacatgatgaaaatctcctacgatgttgtcaaacgctggataaacgaggctcaagaagccgctagctccgataatatcatggtgcagtatcatgcccttggcgtactgtatcatctccggaagaatgataggctggccgttagcaagatgctcaataagtttactaagtctggtctgaagagtcaattcgcctattgcatgcttattaggattgccagtaggctactgaaagaaactgaagatgggtag

SEQ ID NO: 218716 - DNA, 468 bp, Artificial Sequence
  Description of Artificial Sequence: Synthetic coding sequence
tgagcaggaagttttagttgcactatgaagttcacggttcgagactgtgacccgaataccggtgttcctgatgaggacggatacgacgacgagtatgtgctcgaggatctcgaagtcacggtgagtgaccacatccagaaagttctcaagcctaacttcgccgcagcctgggaagaggtcggcgacaccttcgagaaagaggagacattcgctctgtcatcgaccaaaaccctggaggaggctgtaaacaatatcatcacatttcttggaatgcagccatgtgaaagatcagacaaggtaccagaaaataagaattcccatagcctatatctggcgggaatctttcgagggggttatgatttgcttgtcaggtcacgcctagctcttgccgatggtgtcacaatgcaggtcacggtgcgcagcaaggagaggactccggtggacgtcattttggcgagtgttggctag

SEQ ID NO: 218717 - DNA, 741 bp, Artificial Sequence
  Description of Artificial Sequence: Synthetic coding sequence
atgattaagaagttcgataaaaaggatgaggagtcaggatccgggtcaaatccgtttcagcatctcgaaaagagcgcggtcttacaggaagctcgcatctttaacgagaccccaattaatccacgcaggtgcctccacatcttaaccaagattctctatttgctgaaccaaggcgaacacttcggaacgaccgaagccacagaggcattttttgctatgacgcgcctgttccagtcaaatgatcaaacgctgaggagaatgtgttacctgacaatcaaggaaatggctaccatttccgaagacgtgatcatcgtgacatcatctctaactaaggacatgactggtaaggaggatgtctaccggggtcccgctatacgtgcactgtgtcgaataaccgacggcacaatgcttcaggccatagagcgctacatgaagcaggccatcgtcgacaaggtgagttccgtgagtagctctgcccttgtttcttctctccacatgatgaaaattagttatgatgtggtgaagaggtggataaacgaggctcaggaggcagcttcctccgacaacataatggtgcagtatcacgccctgggggtgctgtatcacctgagaaagaacgaccgcctggcagtgtccaagatgctgaataaatttacaaagtccggcctaaagtcccagttcgcttactgtatgttaataaggatcgcttcacgcctgttgaaggagacagaggatggttag

SEQ ID NO: 218718 - DNA, 1080 bp, Artificial Sequence
  Description of Artificial Sequence: Synthetic coding sequence
atgtacttcaaacgagctgcaagagcctttccagtactgctgaccggtgccggtaagaccaccttgttgaactacatcctgaccgagcaacacagcaaacgggtcgccgtcatattaaacgaatttggcgaagggagcgccctcgagaaatccctcgcggtgagccagggcggagaattgtacgaagagtggttggagctccgcaacggctgtctatgttgctctgtgaaggacagtgggctgagggcgatcgaaaatttaatgcagaaaaaaggcaagtttgactacatcctgctcgaaaccactggactggctgatcccggagccgtggcttctatgttctgggttgatgccgagctaggtagtgacatttatttagacggtatcatcaccatcgtggactcgaagtacggactgaagcaccttaccgaggaaaaacccgatgggttgattaatgaagcaactcgccaggttgctttggccgatgcaattttgatcaacaagaccgatctggtgccggaagaggacgtgaagaagttgaggaccactattagatctatcaatggtctgggtcagattctggaaactcagagatctagagtagacttgagcaacgtactcgacctgcacgcttttgacagtttatctggcatatcactacaaaaaaagctgcagcatgtgcccggaactcagccccacttggatcagtcgattgtcacaattacatttgaagtccccggtaacgcaaaggaagaacatctgaatatgttcatacagaacctgctctgggaaaaaaatgtcagaaataaggataatcactgtatggaggtgatccggcttaaaggcctggtgtcgattaaagataaaagccagcaagtcattgtgcagggtgtccatgaattgtacgacctggaggagaccccagtatcctggaaagatgacaccgagcgaacgaataggttagtactgctgggacgcaatcttgacaaagatatcttgaaacagctgtttatagccaccgtaactgagaccgagaaacagtggaccactcggttccaggaggatcaggtgtgcacgtag

SEQ ID NO: 218719 - DNA, 1188 bp, Artificial Sequence
  Description of Artificial Sequence: Synthetic coding sequence
atgctccctgccgtggggtccgcagatgaagaggaagatcccgcagaagaggattgtcctgagctggttcctatagaaacaacccagagcgaagaggaagagaagtcaggacttggagcaaaaatccctgttacaataataacagggtatctaggcgcagggaaaactacccttctgaattacatccttactgagcagcacagcaagcgtgtggctgtaatcctcaacgagttcggtgaaggaagtgccctagagaagagcctagccgtcagtcagggtggagaactgtatgaggagtggcttgagctgagaaacggctgtctgtgctgctccgtgaaggactccgggctgcgcgctatagaaaacttgatgcaaaagaaaggcaagttcgattacattttactcgaaacgaccggactggctgacccgggagcagtggcttcgatgttctgggtggatgcagagctcggaagcgacatctatctggacgggataatcacaatcgtcgacagtaaatacgggctgaagcacctcaccgaagaaaaacccgacggactgataaatgaggccacacggcaagtcgccttagctgacgcaatccttataaataagaccgacctcgttcccgaggaagatgttaagaaactgaggacaaccataaggtcgattaacggtttgggccagatactcgagacccagcggtcccgtgtagatctctcaaatgtactggaccttcacgcctttgattctttgagcggcattagcctgcaaaaaaagctccagcacgttcccggaacacaaccacacttagatcagagcatcgttactattaccttcgaagtgcccggaaacgccaaggaggaacatctgaatatgttcatccagaatctgctttgggagaagaatgttcgaaacaaagacaaccattgcatggaagtgatccgcttgaaaggcctcgtgtctatcaaagataaaagccagcaggtcatcgtgcagggagtacatgagttgtatgaccttgaagaaaccccagtcagctggaaagacgacactgagcgcacaaaccggctagtgttgcttgggaggaacttagataaagacatactgaagcagctcttcatagccacggtgaccgagacagagaaacagtggaccacacgtttccaggaagaccaagtctgcacttag

SEQ ID NO: 218720 - DNA, 543 bp, Artificial Sequence
  Description of Artificial Sequence: Synthetic coding sequence
atgctgccggctgtgggatctgctgatgaagaggaagaccccgctgaggaggactgccccgagctggtccccatcgaaacaactcagtcagaggaagaggagaaatccggcctcggggctaagatccctgtgactatcattaccggctacctgggtgccggtaagactacactgctcaactatatactgaccgagcagcattcaaagcgggtggccgtgatccttaacgaatttggcgaagggtcagccctggagaagagtcttgcggtttcccagggaggcgagctgtatgaggaatggcttgagttgaggaacgggtgcttgtgctgttctgttaaagattctggtttgcgtgcgatagagaatctgatgcaaaaaaaggggaaatttgactatattttgttagaaaccacggggttggccgatccgggagccgtcgcctccatgttctgggtggacgccgagctgggatcagatatttacctggatggcataataactatcgtagactctaaatacggacttaaagtgaaataccactag

SEQ ID NO: 218721 - DNA, 1044 bp, Artificial Sequence
  Description of Artificial Sequence: Synthetic coding sequence
atgctccccgcagtgggaagtgccgacgaagaagaggatcctgcggaggaagattgtcctgaactggttcctattgaaaccacccagtcagaggaggaagagaaaagcggcctgggcgctaagataccagtgacaattatcaccggctacctgggcgctgggaagacaactttattgaactatattctgacagaacaacattccaaacgcgtggcggtgatcttgaatgagttcggcgaaggatctgcgctcgaaaagagtctggctgttagccagggcggtgagctgtatgaagaatggttagagctccggaacggctgcctctgttgttcggtgaaagattccggactgagagcaatcgagaacctgatgcaaaagaaaggtaagtttgattatatccttctcgagaccaccggcctcgccgaccctggcgctgtagcaagcatgttctgggtggacgccgagctgggaagtgacatctacttagatggtataatcaccattgtggacagtaagtatggtctgaaacacctgacggaagagaagccagatggcctgatcaatgaagcaacgcgaagcattaacgggctcggtcagatcctggaaacacagagatcatctcttcagaaaaaacttcaacatgtgccgggtacacagccacatctcgaccagagcattgttacaattacatttgaagtgcctggtaacgctaaggaggaacatctaaatatgttcatccaaaatctgctttgggagaagaacgtcaggaacaaggacaaccattgcatggaggtgattcgactgaagggactcgtgtccatcaaggacaaatcacagcaagtgatcgttcaaggcgtgcacgagctgtacgatttagaagagacccctgtgagttggaaggatgacacagaacggacgaatagactcgtcctactgggcaggaatctggacaaggacatcctgaaacagttgttcattgcaacagttaccgaaaccgagaaacaatggaccactcgcttccaggaggaccaggtttgtacctag

SEQ ID NO: 218722 - DNA, 753 bp, Artificial Sequence
  Description of Artificial Sequence: Synthetic coding sequence
atgctaccagcagtaggcagcgctgacgaagaggaagatcctgctgaggaagactgtcccgagttggtgcccattgaaacaacccagtcagaggaggaggagaagagcggcttaggcgctaagattccagtgaccattatcaccgggtatttgggcgcaggtaagactacactgctgaactacatattgaccgaacagcattctaagagagttgccgtgattctgaacgagtttggggaagggagtgccttagagaaaagtcttgctgtcagccagggcggagagctgtacgaggagtggctggagctgcgaaatggatgtctttgctgtagtgtgaaggattcgggcctacgtgcgattgaaaacctgatgcagaagaagggaaagttcgattatattctccttgaaacaaccgggctggccgaccctggggcagtggcatcaatgttctgggtagatgctgagctgggctcagacatttacctggacggaatcattactattgtggattccaaatacggcctcaaacatctgaccgaggaaaagcctgatggccttattaatgaggccaccagacaagtggcactcgcggatgctatcctgattaacaaaactgatctcgtgcctgaggaagatgtcaagaagttacgtacgacaattaggtatgaaatgatctctgtgttgtccgcctacaggtccatgctgtatacgcaaaacatattctactcagattgctgccccgttgagacctag

SEQ ID NO: 218723 - DNA, 234 bp, Artificial Sequence
  Description of Artificial Sequence: Synthetic coding sequence
atgtatttcaaacgcgctgctagagcatttcccgtgctgttaacaggggctggtaagaccaccttgctgaactatattcttactgagcagcactcgaaacgggttgccgttattcttaacgaattcggcgagggctccgctctcgaaaagtcactagccgtgagccaagggggagaactatatgaggaatggctggagctcagaaacggttgtctgtgctgctccgtcaagtag

SEQ ID NO: 218724 - DNA, 342 bp, Artificial Sequence
  Description of Artificial Sequence: Synthetic coding sequence
atgctgcctgctgttggaagtgccgacgaagaagaggatccggcagaagaggattgtccagaactggtacccatagagaccacccagtctgaggaagaggagaagtccgggctcggagctaaaattcccgtgacgatcatcacgggctatctgggtgccggaaaaacgactctcctgaattatatcttgaccgagcaacactccaagagagtggccgtgattctaaacgagttcggcgagggatctgccctcgaaaaatcactggcagtaagtcagggcggagagctatatgaggagtggctggagctgaggaatggctgcttgtgttgctctgtgaaatag

SEQ ID NO: 218725 - DNA, 1131 bp, Artificial Sequence
  Description of Artificial Sequence: Synthetic coding sequence
atgctacccgcagtgggaagcgcagatgaggaagaagatccagcagaggaggactgtcccgaactggtgcccattgagactacccagagcgaggaggaagagaagtctgggctgggggctaagatccccgtgacaatcattacaggatacctcggggcaggtaaaactaccctccttaattatatcctgaccgagcaacactcaaagagggttgcagtgatactgaacgagttcggagagggatccgcactggagaaaagcctcgcggtatcccagggcggagagctctacgaagaatggctcgaactccgtaacgggtgtctgtgctgctccgtgaaagatagcggcctgcgagcaatcgagaatctgatgcagaagaagggcaagttcgattacattcttcttgaaacaaccggtttggctgacccaggcgcagtggcgtctatgttctgggtggacgccgagctgggttccgatatttacctagacgggatcattacgatcgtggactctaaatacggattgaaacaccttactgaagaaaaaccagacgggttgatcaacgaggccacacggcaggtggctcttgcggatgctatcctcattaataagactgatctggttccggaggaggatgtaaagaaactgcggacaacaatccgaagcataaacgggctcgggcagatcctcgagacgcaacggtcctcactgcagaaaaagcttcagcacgtaccaggtacacagccacacctggatcagtccatcgttaccattacctttgaagtgcccggtaacgctaaagaggagcacctcaatatgttcattcagaatcttctgtgggagaagaacgttcggaataaggacaatcactgcatggaagtgatccggcttaaggggctagtgtctatcaaagacaagagtcagcaggtgatcgtgcagggagtacatgagttgtacgacctcgaagagactcccgtgagttggaaagatgacacagaaagaaccaaccgcctcgtgcttttgggcagaaatctagacaaggatatcctgaaacagctctttatcgctacagtaactgagacagaaaaacagtggactacgcgatttcaggaagaccaggtttgcacctag

SEQ ID NO: 218726 - DNA, 483 bp, Artificial Sequence
  Description of Artificial Sequence: Synthetic coding sequence
atgcttcccgctgttggaagtgcagatgaggaggaagacccagccgaggaggactgccctgagttagtccctatcgagacaacccagtctgaggaagaggaaaagagcggcctgggagcaaaaatccctgtgacaataattacaggttaccttggagctggcaagacgaccctgctgaattacatcctgaccgaacaacactcaaagcgagtcgccgtgatcctgaatgagtttggagaaggctcagcccttgaaaagtccctggccgtgagtcaaggtggcgaactttatgaagagtggttagagcttcgcaacggatgtctgtgctgctctgtgaaagatagcggcctgagggctattgagaatttaatgcagaaaaagggtaagtttgactatatcctgctggaaactacaggcctggccgacccgggaataatcacaattgtggatagtaaatatggcttaaaagtgaaataccactag

SEQ ID NO: 218727 - DNA, 441 bp, Artificial Sequence
  Description of Artificial Sequence: Synthetic coding sequence
atgtattttaaaagagctgcgagggctttcccagtactcctcacaggagctgggaaaacaaccctcctgaactatatccttaccgagcaacacagcaagcgcgtggccgtgatacttaacgaatttggcgagggctccgccttagaaaagtctttggctgtgtcccagggaggagagctgtatgaggaatggctcgagcttagaaatggatgtttatgttgttccgtaaaggattccgggcttcgcgcaatagaaaatctcatgcaaaagaagggcaagtttgactacattctgctggagaccacagggcttgctgacccaggagctgtagcctccatgttttgggttgatgcggaactcggctcagacatctacttggacggaatcattactattgtggacagtaaatatggactaaaggctaagaattggactacatag

SEQ ID NO: 218728 - DNA, 1188 bp, Artificial Sequence
  Description of Artificial Sequence: Synthetic coding sequence
atgctgcccgcagttggctctgctgatgaggaagaggatcctgcagaggaggattgcccggagttggtgcctatggagaccacgcaatcggaggaggaggagaagtctgggctgggggcaaaaatccctgtgactataatcaccgggtatctcggtgccggtaagaccactttgcttaactacattttgaccgaacagcactctaaacgcgttgctgtgattttgaacgagttcggggagggcagcgccctggagaagtcactggccgtttcccagggcggtgagctgtatgaggagtggctcgaactgcgtaacgggtgcctctgttgttcagtgaaggataacggtctgcgcgctatcgaaaaccttatgcagaaaaagggtaagttcgactacattctgctggagaccaccggtctcgcagatccgggagcagtggcttccatgttctgggtggatgccgagctcggctccgatatctatctggacggcattataacaatcgtggactctaaatacggtcttaaacatctggccgaagagaagccggatggacttataaacgaggcaacacggcaagttgccctggcagacgcaatccttatcaacaagactgatctggtccccgaagaagacgtaaagaagcttcgggctacgataaggtcaataaacggtctggggcagatcctggagacccagcgaagccgagtggacctctccaacgtgcttgacctgcacgcattcgactctctgtcaggtattagcctgcaaaaaaaactgcagcatgttccagggactcaacctcacttagaccagagcatagtaactattacatttgaagtgcctggcaacgccaaggaggaacacctgaacatgtttatccagaacctgctgtgggagaagaatgtgagaaataaggataaccactgtatggaagtcatccgcctgaaaggtttggtgagcattaaggacaagtcccagcaggtgattgttcaaggggtgcacgaactctacgacttagaggagacaccagtttcctggaaggacgacaccgaacggactaatagactagtgctgttgggccgtaacctggacaaggacattcttaagcagctctttatagcaaccgtgactgagaccgagaaacaatggaccactcactttaaagaggaccaggtgtgtacttag

SEQ ID NO: 218729 - DNA, 543 bp, Artificial Sequence
  Description of Artificial Sequence: Synthetic coding sequence
atgctcccggcagtcggtagcgccgacgaggaggaggatcctgccgaagaggactgccctgagctggtgccaatggagaccacacagtccgaagaagaagaaaaatctggactgggggcaaaaattccggtaacgataattaccggctacctcggtgcgggaaaaactacattactaaattatatcttgacggaacagcactctaaaagggttgccgttatcctgaacgaatttggggaaggatcagcactggaaaaaagcttggccgtcagtcagggcggtgagctgtatgaggaatggctggagctccgaaacggctgtctgtgctgcagtgttaaggacaacggtctccgggctatcgaaaacctcatgcaaaagaaaggcaaatttgattatattttgctcgagaccacagggttggccgaccccggtgccgtggcctcgatgttctgggtggacgccgagctcggatccgacatttatctcgatggcataatcacaatagtggactctaaatacgggctgaaggtcaaataccactag

SEQ ID NO: 218730 - DNA, 1131 bp, Artificial Sequence
  Description of Artificial Sequence: Synthetic coding sequence
atgctgcccgcagtcggctcagctgacgaagaggaagacccagcggaagaagactgtcccgaactcgtgcccatggaaacgacgcagagcgaggaagaagagaaatcaggcctgggcgctaaaattcccgttactataattacaggatacctcggagccggaaagaccacccttctcaactacatacttaccgagcagcattctaaaagagtggcagtgatcttaaatgagttcggggagggctccgcacttgaaaagagcctcgcggtctctcaaggtggtgagctgtacgaagagtggctggagttaaggaatggttgtctgtgctgtagcgtgaaggataacgggcttcgcgctattgagaatcttatgcagaagaaggggaagtttgactacattttgttggaaaccacaggcctagccgatcccggtgccgtggcctcaatgttctgggtggacgccgaactgggttctgacatatacctggatggtatcattaccatagttgattccaaatatggtctgaagcatctggcagaggaaaagccagacggactgattaacgaggctacccgacaggtggctttggcagacgccatcttgatcaacaaaactgacctggtaccagaggaggatgttaagaaactgcgcgcaacaatcaggagtatcaatggcctcggccagatcctcgagactcagcggagctcactgcagaaaaagttgcagcacgtgcctggcacacagccccatctggaccagagcattgtgacgattaccttcgaggtgccgggtaacgctaaagaggagcatctgaatatgttcattcaaaacctgttgtgggagaaaaatgtccggaataaggataatcattgcatggaggtcatccggctgaaagggctggtttctattaaggacaagtcacagcaggtgatagtgcagggcgtacacgaactgtatgacctggaagaaacacccgtgagctggaaggatgacactgagcggaccaaccggctggtccttctgggcagaaacctcgataaggacatcctgaagcagttgtttatcgctaccgtgactgaaactgaaaagcagtggaccacgcatttcaaagaagaccaggtgtgcacctag

SEQ ID NO: 218731 - DNA, 1080 bp, Artificial Sequence
  Description of Artificial Sequence: Synthetic coding sequence
atgtatttcaagcgcgcagcgagggcattcccagtgctgttgacaggggcaggcaaaacaactctgctcaattatatacttacggagcagcactccaagagggtggcagttattctgaatgagttcggcgaaggaagcgccctcgagaagtccctagcagtttctcagggcggtgagctgtacgaggaatggctggaattgaggaatggttgcttatgttgttcagtgaaggataacggattgcgtgccatcgaaaatctgatgcagaaaaagggtaagttcgattacattctgttagagacgactggtcttgcagatccaggcgcagttgcatctatgttctgggtggatgccgagctcggctctgacatctatttagacggaatcataacaatcgtagattccaaatacggactgaaacacctcgccgaggagaaacctgatgggttgatcaacgaagccactcgccaggtggccttggctgacgccatcctcatcaacaagaccgacctcgtgcccgaggaggacgtgaagaaactgagagctactattcgcagcatcaatggcctgggccagatcctagagacccaacggagcagagtcgacctctcaaatgtgcttgacctccacgcattcgatagtctctctggtatcagcctgcaaaaaaaactgcaacatgtgcccggaacacagccccacctcgatcagtctatagtgacaattactttcgaggttcccggtaacgcgaaggaggaacatcttaatatgtttatacaaaacctgctctgggagaaaaacgtaagaaacaaggacaaccattgtatggaggtgatccgacttaaggggctggtttcaattaaagacaaatcccagcaggtaatcgtccaaggggtccacgagctgtatgaccttgaagaaacccccgttagttggaaggacgacaccgagcggactaacaggctcgtgctgctaggccgaaaccttgataaggacattctgaaacagttgttcatagcgactgtaaccgagacagaaaagcagtggactacacacttcaaggaagaccaggtgtgcacctag

SEQ ID NO: 218732 - DNA, 483 bp, Artificial Sequence
  Description of Artificial Sequence: Synthetic coding sequence
atgctgcctgcggtcggcagcgcagatgaagaggaagatccggcagaggaggactgcccagagctggttcctatggaaaccacacagtcagaagaggaggaaaaatccgggctcggagcaaagatccccgttaccattataactggttacctgggagctggaaagacaacactcctcaattacattctcactgagcaacattccaaacgggtcgccgtcatactaaacgagtttggcgaggggagcgcactggagaagtcgctcgctgtctcacaggggggagagctatatgaagaatggctggagctgcgtaacgggtgcctgtgctgttctgtgaaagacaatgggttgagagccattgagaatttgatgcaaaagaagggcaagttcgactatattctacttgaaaccacgggactagcagatcctggaataattaccatagtagacagcaaatatggcctgaaggtcaagtaccactag

SEQ ID NO: 218733 - DNA, 1188 bp, Artificial Sequence
  Description of Artificial Sequence: Synthetic coding sequence
atgctgcctgccgtcgggagcgtggacgaggaagaggacccagccgaggaggactgccccgaactcgtacccattgagacgacacagtcagaggaagaggagaaaagtgggcttggcgctaagattccagtcacgattataaccggctatctcggggcaggcaaaacaacccttcttaattacattttgacagaacagcactccaaaagggttgctgtgatcctgaatgaatccggggagggaagcgctctcgaaaagtcgctggctgtttcacagggcggagagctgtatgaggaatggcttgagttacgtaacgggtgtttgtgttgttctgtcaaggataacggactgcgggctatcgagaacctaatgcagaaaaagggcaagttcgacgatatcctcctggaaacaacaggccttgctgaccccggtgctgtagcctctatgttctgggtagacgccgagctcggttcagatatctatctggacggtattatcactatagtggattcgaaatacggtctgaagcacctaacagaagagaagccagatggattgattaacgaagctacacggcaggtggcattggccgacattatcctgatcaataagaccgacctcgtccctgaggaggatgttaagaaactgcgaactactatccgcagtatcaacggtctcggccaaatcctggagacacagcgctcccgagtggacctgtccaatgttctcgatctacatgccttcgacagtctgtcgggcattagcctgcaaaagaaactacagcatgtccccggaacccagcctcatctggaccagtcgatagttactattacattcgaagttccgggaaatgccaaggaagaacatctcaacatgttcattcagaacttgctttgggaaaagaatgttaggaacaaggataaccactgtatggaggtgatccgactaaaaggcctcgtgagcattaaagataagagtcagcaggtgatagtccagggggttcacgaattgtacgacttggaagagacccccgtgtcctggaaggacgatacggagcgtaccaatcggctagtgcttataggtaggaaccttgacaaggacattcttaaacagttatttatagcaactgtcacagaaacagaaaagcagtggactactcatttcaaggaagatcaagtttgtacctag

SEQ ID NO: 218734 - DNA, 258 bp, Artificial Sequence
  Description of Artificial Sequence: Synthetic coding sequence
atggaggtaattcggctcaaagggttagtgagcatcaaggataagtctcagcaagtgatcgtgcaaggcgtgcacgaattgtatgatcttgaggaaacacctgtaagctggaaagatgataccgagagaacaaaccgcctggtgcttatcggaaggaacctggataaggatattcttaaacagctgttcattgccaccgtgaccgaaacagaaaaacagtggaccacccacttcaaagaggatcaggtctgcacctag

SEQ ID NO: 218735 - DNA, 258 bp, Artificial Sequence
  Description of Artificial Sequence: Synthetic coding sequence
atggaggttatcaggttgaaggggttggtgtccatcaaggataagagccagcaggtgatcgtgcaaggagtgcacgaactttatgatttggaggaaacccctgtttcttggaaagacgatactgaacggacaaaccggttagtgttaattgggcgaaatctcgataaggatatactgaaacagcttttcattgctaccgtaaccgagacagaaaagcaatggaccactcattttaaggaagaccaggtttgcacctag

SEQ ID NO: 218736 - DNA, 132 bp, Artificial Sequence
  Description of Artificial Sequence: Synthetic coding sequence
atgttcatccagaacctcctctgggagaagaatgtacggaataaagacaaccattgcatggaggtcatccggttaaaagtccaattcaccgtggccgatttctggacaaagtcttttagttggctcctgtag

SEQ ID NO: 218737 - DNA, 1128 bp, Artificial Sequence
  Description of Artificial Sequence: Synthetic coding sequence
atgcttcctgccgtcggatctgttgacgaagaagaggatccagcagaagaggactgtcctgaactggtccctatcgagactacccagtctgaggaggaagaaaaatctggcctgggcgctaagatcccagtgacgattataacgggatacttgggcgctggaaaaaccacactcctgaactacattctgactgaacagcacagcaaacgggtagcagtcattctgaacgaaagcggtgagggctctgctctcgagaagtctctggcggtctcacagggcggtgaactgtacgaagagtggctggaactgagaaatggttgcctttgctgctccgtgaaggacaacggactgcgcgctatcgagaacctgatgcagaaaaaaggaaagttcgacgacattctattagaaaccaccggcctggccgacccagggatcatcacgattgtggattcaaaatacggccttaaacatttgaccgaggagaagcccgacggattgattaatgaggcaaccaggcaggttgcactggcagacatcattctgatcaacaaaactgatttggtacccgaagaggacgtaaagaaattgaggactacaatcaggagtataaacgggctgggtcagattctcgagacacagcgtagccgcgttgatctctctaatgttctggatctacacgccttcgactctctgtccgggattagcctgcaaaaaaagcttcagcatgtgcccggtacacaaccccaccttgaccagtctatcgttaccattacctttgaagtcccgggtaatgctaaagaggagcaccttaacatgttcatacaaaatctactttgggaaaaaaacgttcgaaataaagataatcactgcatggaagttattcgactgaaagggctggtgtctatcaaggacaaatcccagcaggttatcgtccaaggagttcatgaactgtatgatctggaagaaacacccgtgtcatggaaagacgataccgagcgaacaaatcgccttgtactcatcggccgtaaccttgacaaggacatcttaaagcagctctttattgccaccgtcaccgaaacagagaaacaatggacaacccatttcaaagaagatcaggtgtgcacttag

SEQ ID NO: 218738 - DNA, 1080 bp, Artificial Sequence
  Description of Artificial Sequence: Synthetic coding sequence
atgtacttcaagagggcaccccgagcttttcctgtgttgctcactggggctggcaagacaacattactcaattacatcctgacagagcagcactctaaaagggtggctgtgatcctgaatgagagcggagaggggtcggcgctggaaaaatctctcgctgtgagccagggtggggaactgtacgaggagtggctggagctgcgtaatggctgcctctgctgtagcgtgaaggataatggactgagggctattgagaacctcatgcagaagaaagggaaattcgacgatattctgctggaaaccacagggctggccgaccccggagctgtggcgtcaatgttttgggtggacgcagaactggggtctgacatttacctggatgggatcatcacaattgttgattccaaatatggattaaagcacctgacagaggagaagccggatggcctcatcaacgaagccactaggcaggtcgcacttgcagatattattctcatcaacaagacagatctggtccccgaggaagatgtaaagaagttgcggacaacgatccgcagcattaacggccttgggcagatcctggaaacacagcgaagcagagtcgatctgtctaacgtacttgatttgcacgcattcgatagcttgtccgggatctctcttcagaaaaagctgcagcacgtgcccggaacccagccccacctggatcagtcaattgtgactatcacttttgaggtgccaggcaacgccaaggaggagcacctgaatatgtttattcagaacctgctttgggagaagaacgtgcggaacaaagataaccactgtatggaggtgataaggctgaaagggctcgtctctataaaggacaaaagtcagcaggtgatcgtccagggcgtgcacgaactgtatgacctagaggagacccccgtcagctggaaagacgataccgaaagaactaatcggttagttctcattggtcgcaatctggataaagatattttgaagcaactgttcatcgccaccgtaacggagacagaaaaacagtggaccacccattttaaagaggatcaggtgtgcacctag

SEQ ID NO: 218739 - DNA, 234 bp, Artificial Sequence
  Description of Artificial Sequence: Synthetic coding sequence
atgtattttaagagagccccacgcgcattcccagttctgctgacaggcgcaggcaaaactaccctgctgaattacatccttactgaacagcactccaagcgggtcgccgtcatattgaacgagtccggcgaaggaagcgcactggagaagagtctcgcagtatcccagggcggtgaactgtacgaagagtggttagaactgaggaacggatgtctgtgctgttccgtgaaatag

SEQ ID NO: 218740 - DNA, 1131 bp, Artificial Sequence
  Description of Artificial Sequence: Synthetic coding sequence
atgctccctgcagtgggatccgtcgatgaagaggaggatcccgcagaagaagattgccccgaattggttcctatcgaaactacacagtccgaggaagaggagaagtccggtctgggggcaaaaatccctgtgaccatcattaccggatacctcggcgctggaaagaccaccctgctgaactatatcctaactgagcagcattctaaaagagtcgctgttatcctcaatgagagcggcgaaggctctgcactagaaaagtccctggctgtgagccaggggggtgagctttatgaggaatggcttgaactgcggaacggttgtctgtgttgctctgtgaaggacaatggcctgcgggctattgaaaatctcatgcaaaagaagggaaaatttgatgacatcctcttggaaacaactggcctagcggacccaggcgcagttgcgagcatgttttgggtcgatgctgaactgggtagcgatatatatctggatggcattattacgatcgttgactccaagtacggccttaagcacctgactgaagaaaagcccgatgggctgattaacgaagctacacgccaggttgccctggcggacattatccttatcaacaaaacagacctagttcctgaggaagatgtgaagaagctacggaccacgattcggagcattaacggtcttgggcagattctcgaaacccagcggagtagtctccaaaagaagctgcagcacgtccccggaacccagccgcacctggatcaatcaatcgtgacaatcactttcgaagtcccaggcaacgccaaggaagagcaccttaacatgtttatccagaacctcctttgggagaagaatgtgcgtaacaaggacaaccattgcatggaggtaatccgcctgaaaggcctggtgagtattaaggataagagccagcaggttattgtgcagggagtgcatgagctctacgatttggaagaaacccccgtctcatggaaggatgacaccgagagaacaaataggctggtcctgattgggagaaatctcgacaaagacattctgaagcaactattcatcgccactgtcactgaaacagagaagcaatggaccactcactttaaagaggatcaagtctgtacctag

SEQ ID NO: 218741 - DNA, 225 bp, Artificial Sequence
  Description of Artificial Sequence: Synthetic coding sequence
atgtactttaaacgcgcaccacgggcttttcccgtcctcctgacaggggcaggtaagaccactctactcaattatatccttacagagcagcattctaagcgagtggccgtgatcctgaacgaaagcggtgagggaagcgctttagagaagtcactggctgtgagtcagggcggtgagctttatgaagaatggcttgagctgcgtaacgggtgtctctgttgctag

SEQ ID NO: 218742 - DNA, 543 bp, Artificial Sequence
  Description of Artificial Sequence: Synthetic coding sequence
atgctgccagcagtgggttctgtggatgaagaggaagacccggcagaagaagattgtcccgagctcgttcctattgagaccactcaatccgaggaggaggaaaaaagcggtttgggggcaaagattcctgtcactattattaccggttatctgggggctggtaaaacaacgctgctgaactatatcctgacagaacagcactctaagcgggttgctgtaatactcaacgaatccggcgaggggtccgctctcgaaaaaagtttagcggtgtcccaaggcggtgagctctatgaggaatggttggaactccgaaacggatgcctgtgctgttccgtcaaagacaacggccttagagcaatcgagaatttaatgcagaaaaaaggaaaattcgacgacatactccttgagactaccggtctcgctgatcccggtgccgtcgcgagtatgttctgggttgatgcggagctgggaagtgatatctacctggatgggattattactatagttgacagtaaatacggcctgaaggtgaagtatcactag

SEQ ID NO: 218743 - DNA, 1044 bp, Artificial Sequence
  Description of Artificial Sequence: Synthetic coding sequence
atgcttcctgccgtgggaagcgtcgacgaagaggaggatccggctgaagaggattgccctgagctggtgcccattgagactactcaatctgaagaagaggagaaatccggcctcggtgctaagattcctgtgacgattattacgggatacctgggagccggtaaaaccacactcctgaactatatcttgacagagcagcattctaaacgggtggctgtcatcctgaatgagtcaggggaaggatctgctctggaaaagagccttgcagtgtctcagggaggggagttatatgaggagtggctggaactgcgcaatgggtgcctttgttgcagcgttaaggacaatgggctcagagccatagagaacctgatgcagaagaagggaaaatttgatgacatcttgctggaaacaaccggactggcggacccaggcgctgtagcctctatgttttgggtggatgccgaactagggagcgatatttatctcgatggcatcatcacaattgtggactcgaaatacggattgaagcatctcacagaggaaaagccagatggactgatcaacgaagcaacaagaagcattaacggcctgggtcaaatcctagaaacacagcggtcctccctgcaaaagaaactgcaacatgtgcctggaacccagccccacttggaccagtcgattgtaacgatcacttttgaggttcctggtaatgccaaggaagagcacttaaacatgttcatacaaaatctgctctgggagaaaaacgtacgcaacaaagacaatcactgtatggaggttattcgtctgaaagggctggtcagtatcaaagataagtcgcagcaggtcattgtgcaaggggtacacgagctgtacgatctcgaagaaactcctgtctcatggaaggatgatactgagcgtactaacagacttgtcctgatagggaggaatctcgataaagacattttgaagcagctgttcattgcaacagtcacggagacagagaagcagtggaccacccactttaaagaagatcaggtttgtacatag

SEQ ID NO: 218744 - DNA, 987 bp, Artificial Sequence
  Description of Artificial Sequence: Synthetic coding sequence
atgctgggttcccgcgcagctggctttgcacgtggtttgagggccgtggctctggcttggcttccaggttggcggggacgatcctttgcgctggcccgtgccgcaggcgctccacacggcggagatctgcagccacctgcctgccctgagcccaggggccgacagctgtcactatccgccgcagccgtcgtggactcagcgccacggcctctgcaaccctatctgagattgatgagactggataaacccatcggcacctggctcctctatctgccctgtacatggagcatcggactggcagccgagcctggatgcttccccgattggtatatgctgtcactgttcggcactggtgccattcttatgcgcggtgcagggtgtacaataaatgacatgtgggatcaggactatgataagaaggtgactcggactgcgaatagaccaatcgcggcaggcgacatctccacattccagagcttcgtttttctgggtgggcagctgacactggctctgggcgttctactctgccttaactattattcaattgcgctgggggctggatccctcctgttagtaattacgtaccccctcatgaaaagaatctcttattggcctcagctcgccctgggcttgacctttaactggggtgccctcctcggatggtcagccattaaggggagctgtgacccgtccgtgtgcctgcctctgtatttctcaggagtaatgtggacattgatatacgacaccatatacgcacaccaggacaagagagatgacgtgttaattggtctgaaatccacggcattaaggtttggcgagaacacgaaaccttggctctccggattctctgtggctatgctcggggcattgagcctggttggtgttaactctgggcaaactgctccctattatgctgcattgggagcggtgggcgctcatctgacccatcagaagtgggggttggaaattcttccaagactagtttag

SEQ ID NO: 218745 - DNA, 1266 bp, Artificial Sequence
  Description of Artificial Sequence: Synthetic coding sequence
atgactccgatctcccaagtccggatgcggaaaggcagcgcgcatacagcagcccagcctggaaggctgggattgcacccagccggtgctaccgcccacgcttgcaggggcatgacaagtataagagctcgacccggtttgaccagtgctatgctcggcagccgcgctgccggatttgcccgagggttgagagccgttgcgttggcatggctgccagggtggcgcggacggtcttttgctttagcgcgtgccgctggtgcccctcatggaggggacctgcaacctccagcatgtcccgagccgcgagggagacaattgagcctgagtgccgctgctgtagtcgactccgctcctagaccactgcagccatatctgaggctaatgcgccttgataaaccaattgggacctggctgctgtacttaccatgtacttggtccattggactggccgcagagcctgggtgttttcccgattggtatatgttaagtctgtttggaaccggcgcaatactgatgcgaggagcgggttgtacaatcaatgacatgtgggaccaagactacgataagaaggtaacaagaacagcgaaccgcccaattgcagccggagatataagtacctttcagtcatttgtgtttttgggtggccagcttaccctcgcgctgggcgtactactgtgcctgaattattactctattgcactcggcgcagggagtctgctgttggtgatcacataccctcttatgaagagaatcagctattggcctcaacttgcgctgggacttaccttcaattggggagcactgttggggtggagtgcaataaaaggctcatgcgatccgtccgtttgcctgccgttgtattttagcggcgtgatgtggacactgatttatgacacaatctacgcacaccaggacaaaagggacgatgtgctcatcggcctcaagtctacagccctgaggttcggagagaacaccaaaccctggctgtccggcttttcggtcgccatgctgggcgcactcagcttggttggcgtcaactctggtcagaccgccccatattatgcggctctgggcgcagtcggcgcacacctgacccaccagatatataccctggacatacatcggcctgaagactgttggaacaagttcatcagtaacaggactcttgggctaattgtgttcttggggatcgtgctgggcaatctgtggaaggaaaaaaagacggataagaccaaaaaaggcatcgagaacaagattgaaaactag

SEQ ID NO: 218746 - DNA, 1155 bp, Artificial Sequence
  Description of Artificial Sequence: Synthetic coding sequence
atgaccagcattcgcgcacgacccggattgacttcggctatgctcgggtcaagagctgccggatttgcaaggggcttgcgggctgtcgctctggcttggctccccggatggcgaggcaggtctttcgctttagctagggctgccggtgctccacatggtggggaccttcagccccctgcctgtcccgaacctagagggcgacagttgtcgctgtcagctgcagcagtggttgactcagcgccacgtccccttcagccctacttgcggctcatgaggctcgataagcccattggaacctggcttctgtacctcccttgcacttggagtattgggttggctgcagagccaggttgttttcccgattggtatatgctatccctgtttggaaccggggctattctcatgagaggtgccggttgcacaatcaacgacatgtgggaccaggattatgacaagaaggtcaccagaactgcaaaccgccctatcgcagctggagacatatctacatttcagtccttcgtttttttaggaggacagctaacactggccctgggcgtgcttctttgtctgaattattactcaatcgctctgggggctggttctctactcctggtgatcacatacccactgatgaaaaggatcagctactggccacaactcgcactcgggttgacgttcaactggggggctctgctagggtggtctgctattaagggatcctgcgatccaagtgtgtgcctccctttatacttttctggcgttatgtggacactaatctacgataccatctacgctcaccaggataaacgagacgatgtccttataggcctgaagtctactgcattgaggttcggggaaaatactaaaccgtggctcagcggtttctccgtcgccatgctgggcgcactcagtcttgtgggggtcaattctgggcagacagcaccttattacgcagctttaggtgccgtgggagcccatctgacccatcagatttataccttggacatccatcggcctgaagattgttggaacaaattcatttcgaatcgcacactcgggctgattgtgtttcttggtattgtccttggtaatctttggaaagagaagaaaactgataagacaaagaaggggattgaaaataagatcgagaattag

SEQ ID NO: 218747 - DNA, 798 bp, Artificial Sequence
  Description of Artificial Sequence: Synthetic coding sequence
atggctacactgctgagacccgttctacggcgactctgcggcctcccaggcctccagagaccagcagccgaaatgccactgcgtgccaggtcagatggggcaggtcccttgtactcccaccacctgcctacctctccccttcagaaaggcctcttagcagcgggaagcgcagcgatggcactgtacaatccatatcgtcacgatatggtggccgtcttgggggaaacaacagggcaccgtaccctcaaagtcctcagggaccagatgcgaagggacccagaaggcgctcagatcctacaagagcggcctcggatttctacttctacactagatctaggaaaactacagtcactcccagagggctcgctcggaagagagtacctgagattcctggatgtcaaccgggtgagccccgatactcgagcacccactaggttcgtcgatgatgaggaactagcttatgtaattcagcggtatcgtgaggtacacgatatgttgcacactttgctcgggatgccaaccaacatcctcggggaaattgtcgtcaagtggttcgaagccgtgcagactgggctgccaatgtgcatccttggggcatttttcggaccgatacgactgggcgctcaatctttacaggttttagtgagcgaactgatcccttgggccgtgcaaaacggtagaagagctccttgcgttttgaacctctactacgaaagaagatgggaacagagcctaagagctttaagagaggagttgggaatcaccgcgcctcctatgcacgtgcagggtcttgcctag

SEQ ID NO: 218748 - DNA, 456 bp, Artificial Sequence
  Description of Artificial Sequence: Synthetic coding sequence
atggcaacactgctccgcccagtgctccgcaggctgtgtgggcttcccggactccaaagaccagcagctgagatgccactgagggcccgttcggacggggcaggcccactgtactcacatcacctgcccacctcccccctgcagaagggcctcctggccgcaggttccgccgcaatggccctctacaacccctatagacacgatatggttgccgtactcggcgagacaacaggacatcgaacactcaaagtcctgcgggaccagatgcgacgcgatccagagggagcacagattttgcaggagagacccagaatctctacatcgactctggatcttgggaagcttcagtccctgccagagggctcactgggcagagaataccttcgcttcttggacgtcaatgtcagcttccagttgttatgcatctggcagtcacctgatcgcacggaagagtag

SEQ ID NO: 218749 - DNA, 654 bp, Artificial Sequence
  Description of Artificial Sequence: Synthetic coding sequence
atgtcatgtgcaggcgctgctgcagcgcctaggctgtggagactgcgtcctggtgctagacggagtctgagcgcgtatggcaggcgaacttcggttcgcttcagatcttccggaatgacattggacaacattagtcgcgctgcggtagatcggatcatacgcgtcgaccacgcaggagagtacggagccaaccgaatttatgccggacagatggctgtacttggcagaacctctgtgggcccagttatccagaagatgtgggatcaggagaaggatcacttaaagaaatttaatgaacttatggtgacctttcgcgttcgcccaactgtcctgatgcccttatggaacgtgctgggcttcgcactaggtgccggaaccgcactgctgggaaaggagggcgcaatggcctgcactgtggctgtggaggagtctattgcccaccattacaataaccagatcaggacactcatggaagaggatcccgaaaaatatgaagaactactgcagctgataaagaaattccgggatgaggagcttgagcaccatgacatcgggctggatcacgacgcagaacttgctccagcttacgctgttctcaaatcgatcatccaggcaggatgccgagtggctatctatctcagcgagaggttgtag

SEQ ID NO: 218750 - DNA, 540 bp, Artificial Sequence
  Description of Artificial Sequence: Synthetic coding sequence
atgacactcgacaacattagtagagccgctgtcgaccgaataattcgggttgaccacgctggcgaatacggtgcaaataggatctatgccggtcagatggcggtgctcgggagaacatccgtgggccctgtgatacaaaaaatgtgggatcaggagaaggatcacctcaagaagttcaatgaactcatggtaaccttcagagtgagacccacagtccttatgcctctctggaacgtccttggattcgcgcttggggctggaacagctcttctgggtaaagaaggggcaatggcctgcacggtcgcagtcgaagaaagcattgcccaccactacaacaatcagattaggactctgatggaagaagatcccgagaagtatgaagaactgttacagttgataaaaaagttccgcgacgaagaattggagcaccacgacatcggactggatcacgatgcagaactagcacctgcttacgccgtcctgaaaagcattatccaggccggatgtagggtcgctatctacctttctgagaggctttag

SEQ ID NO: 218751 - DNA, 957 bp, Artificial Sequence
  Description of Artificial Sequence: Synthetic coding sequence
atggccgctgctgcagtctccggggcactaggccgagcaggatggcggctcctgcagctgcgctgtctacctgtggctagatgccggcaggctctggtgccacgggcatttcacgccagcgccgtcgggttacgaagctccgacgaacagaagcagcagccacctaactcattcagtcagcagcactccgagacccagggcgcagaaaagcccgaccctgaatcttcccattcccctcctaggtatactgaccagggaggggaggaagaagaagactatgaaagcgaggaacagttgcaacacagaattcttacagcagctttggagttcgtacccgctcacggatggacagcagaagccattgcggaaggcgctcaatctttgggcctgtctagtgcagctgcttccatgttcggaaaggatggctctgagcttattctgcactttgtcacgcagtgcaacacgaggctaacgcgggtgctggaagaggaacagaagctagtacaactcggacaggctgaaaagagaaagaccgaccaattcttgagagatgccgttgaaaccagactgcggatgttgattccgtacatcgagcattggccacgggctctctctatactcatgctgccacacaatattccttcttcgctgtctttactcaccagcatggttgatgacatgtggcactatgccggtgatcaatccactgacttcaactggtacactaggcgggcaatgctggcggcaatctataatactacagaactggtcatgatgcaagactcctctcctgactttgaagacacatggaggtttctggagaatcgcgtaaatgacgcaatgaacatgggccacacagccaaacaggtgaaatccacaggggaagctctggtccaaggactaatgggagccgcagtgaccctgaagaatttaaccgggctgaaccagcgcagatag

SEQ ID NO: 218752 - DNA, 1743 bp, Artificial Sequence
  Description of Artificial Sequence: Synthetic coding sequence
atgttcgcaggcttgcaggatttgggagtggcaaatggtgaggatctgaaagagacattgactaactgcactgagcccttgaaagccatcgaacagttccagacagaaaacggagtcttgctgccttcgcttcagtccgctttgccatttctggatctgcatggaacaccgaggttggagttccaccagagtgtgttcgatgagctgagagataaactgttggagcgggtgagcgcaattgcatccgagggcaaagccgaagaaagatataagaagctggaggatcttctcgaaaagtctttctccctggtgaaaatgccctcattacagcccgtcgttatgtgcgtgatgaagcatcttccaaaagtgcccgagaaaaagttgaaactggttatggcagacaaggaactataccgcgcatgtgccgtggaagtaaaaagacaaatttggcaagacaatcaagccctctttggcgatgaggtttcccccctattaaagcagtacatcctggaaaaggagagcgccttgttttccacagaactgagcgtcctccataactttttctctccctcacctaaaactaggaggcagggagaagtggtacagagactgacccggatggttgggaagaatgtcaagttatatgacatggtgctacagtttctgagaactctgttcctgcggactaggaatgtacactattgcaccctgcgcgctgaattgctgatgtcattgcatgatttggacgtcggggagatatgcacagtagacccatgccacaaatttacatggtgtctcgatgcttgcatacgagaaaggtttgtggactctaagcgtgcacgcgaacttcaaggtttccttgatggggtgaagaaaggccaagaacaggttctcggcgatctttctatgatactttgtgatccttttgccattaacactctagctttgtccacagtgcgccacttgcaggagctggttggacaagagaccttgcctcgcgactcaccagatctccttcttttgctgcgtctcctggccctcgggcagggagcgtgggacatgattgattcccaggtttttaaagagccgaaaatggaagtggagttgattaccagatttctgcctatgctcatgtcttttctggttgacgactacacctttaatgtggaccagaagttgcccgcagaggagaaggcccctgtgagctatccaaacaccttacccgaaagttttacgaagttcctgcaggagcagcgcatggcctgcgaggtgggcttatattacgtgctacacatcaccaagcaacgcaataaaaatgccctgctaaggctcctgcccggtttggtggaaacgtttggtgatctcgcatttggagatatcttcttgcacctattaacgggaaatcttgcactgcttgctgacgaatttgccctggaagatttctgttctagcctattcgatggttttttcctgactgcttccccacggaaagaaaatgtgcacagacatgctctcaggctgctgatacatttacatcctagggtggccccttctaagctggaagccctgcagaaagctcttgagcccactggccaaagtggagaagctgttaaggaactgtatagccaattaggggagaagctggagcagttggaccatcggaaaccatcccccgctcaggcagccgagacaccagccctagaactgcctcttccttctgtgcctgctccagctccgctctag

SEQ ID NO: 218753 - DNA, 501 bp, Artificial Sequence
  Description of Artificial Sequence: Synthetic coding sequence
atggcttccggggtgacggtgaatgacgaggtgatcaaagtgttcaacgatatgaaggtacgaaaaagttccacacaggaggagatcaaaaaacgaaagaaagccgtcctcttctgcctgtctgatgataagcggcagatcatagtcgaagaagccaaacaaatcctggtaggtgacatcggcgacaccgttgaagatccttataccagcttcgtcaagttgctcccacttaatgattgccgctatgccttgtacgatgccacctacgagaccaaggagtccaaaaaggaagatctcgttttcatcttttgggccccagagtctgcgcctttgaagagtaagatgatttacgccagtagcaaggacgcaatcaagaagaagtttaccgggatcaaacacgaatggcaggtgaacggccttgatgatatcaaagacagatctaccctcggagaaaagcttgggggaaacgtggtggtttccctcgagggcaagcctctgtag

SEQ ID NO: 218754 - DNA, 501 bp, Artificial Sequence
  Description of Artificial Sequence: Synthetic coding sequence
atggctagcggtgttacggttaacgatgaggtcatcaaggtatttaatgacatgaaagtgaggaagagtagtacacaggaggagatcaagaagagaaaaaaagccgttctgttttgcctctcagatgacaaacggcaaattatcgtggaagaagcgaaacagattttggtgggggatatcggggacactgtcgaggacccgtacacctcattcgtgaaactgctgccccttaatgattgtaggtacgccctttacgatgcaacatatgagacaaaggaaagcaaaaaagaggacctcgtatttatcttttgggcacccgagtctgctcctttaaagtctaagatgatatacgcctcttccaaggatgcgatcaagaagaagttcacagggatcaagcacgaatggcaagtgaacggccttgacgatatcaaagatcggagcaccctgggcgagaagctaggtggcaacgtcgtagtcagcttggagggaaagcctttgtag

SEQ ID NO: 218755 - DNA, 1722 bp, Artificial Sequence
  Description of Artificial Sequence: Synthetic coding sequence
atgaggcgctatgacaggggcctgaagactctcgaaaacctgctggcttcgatccggaaagggaacgccattgatgaagccgacatcccacctcccgtggccatcgggaaaggccctgcatccaccccgacttacagcccagcccctactcagcccgcaccacgcattgcttctgctccggagcccagagtcaccctcgagggaccctccgccacagccccagccagctctccaggattagccaaacctcaaatgcccccagggccatgcagccctgggccattggcccagctgcagtcccgccagagagactacaaactcgcggcactgcacgcaaagcaacagcaactcgcattcttggagggacggaagaaacagcttctgcaggctgctctgcgagccaaacagaaaaacgatgtggaaggcgctaagatgcacctccggcaggccaagggactcgagcccatgttggaggcttcccggaatggcctgccagtggacatcactaaagttccacctgctcccgtcaacaaggatgacttcgctctggtccagcggccaggacctggtctgtctcaagaagccgctcgcagatatggggagctaaccaagttgatccggcagcagcacgagatgtgccttaatcatagcaaccagttcacccagttaggcaatatcactgaaacgaccaaatttgaaaagctagccgaagattgtaagcgttctatggatatcctgaagcaggcgtttgttcgaggcctgcccacgcccactgctcgcttcgaacagcgcacattctcggtaattaagatatttcctgatctctcttctaatgatatgttgctgttcatcgttaaagggattaacctgcctacccccccagggctgtcacccggagacctggacgtgtttgttagatttgacttcccctaccctaatgtggaggaggcccaaaaagataaaaccagcgtgattaagaacaccgactcacccgagttcaaggagcaatttaaactctgtatcaatcgcagccatcgaggttttcgcagagctatccagacaaaagggatcaaattcgaggtcgtacataagggtgggctcttcaaaaccgatagggtactgggcaccgcgcagctgaagttggacgcgcttgagatcgcctgtgaggttagggagattctggaagtattggacggtcgacgccctacgggaggcaggctggaggttatggtgagaatccgagagccactgacagctcagcagcttgaaaccaccacagagcgttggttagttattgatcctgtgcctgcagcagtgccaaccgtggcaggacccaagggaaaggcccctccagtcccggctccagccagagaatctggaaatcgatccgccagaccgctgcattccctgagcgtgctggctttcgatcaggagaggttggaacggaaaatcctcgccctccggcaggccagaaggccggttccccctgaggtcgcacagcagtatcaggatatcatgcaacgcagtcagtggcagagagcacagttagaacaaggaggggtggggattaggagggagtacgcggctcagctggagaggcagcttcagttctataccgaggccgctagacgactgggcaatgacggctcacgggacgccgctaaagaggccctatatcggagaaatttggtcgagtccgaactgcagaggctaaggcgatag

SEQ ID NO: 218756 - DNA, 2856 bp, Artificial Sequence
  Description of Artificial Sequence: Synthetic coding sequence
atgcacaaaagaaagggcccacctggaccacctgggaggggagcagctgccgcaagacaattaggtttactagttgacttatcccccgacggtctcatgatccccgaagacggcgctaatgatgaggagctggaagcagaatttctggccctggtcggagggcagccccctgccctagaaaagttgaaagggaaggggcctttgcccatggaagccatcgaaaagatggcgagtttatgtatgagggacccagacgaggatgaggaagaagggacagatgaggacgatttagaagccgatgacgaccttttggccgagttaaatgaagtcctcggcgaagagcagaaggcctctgaaaccccacccccagtcgctcagccaaagcccgaagcgcctcatcccggtctggagaccacccttcaagagcgtctcgccctgtaccagactgccatcgaatctgctcggcaggccggtgactccgcaaaaatgcgcaggtacgataggggactaaagaccctggagaacctgctcgcttctattagaaaaggcaacgccatagatgaagcagatatccctcccccagttgctattggtaaggggcctgccagcaccccgacctactcccctgcccctacccagcccgcaccccgtatagcttctgccccagagccccgtgtcaccctggaggggccatcggcaaccgcgcctgctagctcacccggactggctaaacctcagatgccacctgggccttgttcacctggacctctggcccaattgcagtcgcgccaacgcgattacaaacttgccgcactgcatgccaaacagcagggcgataccaccgccgcagccagacatttccgtgtagcaaaatcgtttgatgccgtgttagaagccctttcccgcggtgaacccgtggacctaagctgtcttccaccaccaccagaccaactccctccggatcctcccagtccaccctctcaaccgcctacgccagcaacggctccctcaacaacagaggtccctcctccaccacgaacactactggaagcactggagcagcggatggaacggtatcaggttgcggcagcgcaggccaagtcgaaaggcgatcaacgcaaagcacgaatgcatgaacgtatagttaaacagtatcaggatgcaatcagggctcataaggctggacgcgcagtggacgttgcagaattaccagtcccacctgggtttcccccaattcaggggcttgaggccacaaagccaacccaacaatctttggtcggcgtacttgaaacggccatgaaactggcaaatcaagatgagggtccagaggacgaagaggatgaggtaccaaaaaaacaaaatagccctgtggctccgaccgctcagccaaaagcccctccatcccgtactccccagtccggcagtgccccaactgcgaaagcacccccaaaggccaccagcacccgcgctcaacagcagttagcattcctggaggggaggaagaagcagctactgcaagcggcattaagggccaagcaaaagaacgacgtggaaggggcaaagatgcacctgcgacaggcaaaaggcctagagccaatgctcgaggcctctcgaaatggcctcccagtggatattactaaggtacctccagcaccagttaacaaagatgactttgctctggttcagcgacctgggccaggtctctctcaggaggccgctcgtagatatggggagctgacgaaacttatccgacagcaacacgaaatgtgtctgaatcattcaaatcaattcacccaactcggaaatatcaccgaaacaaccaaatttgaaaagcttgcagaggactgtaagcgctctatggatatcctgaagcaggcgtttgtgaggggcttgccgacaccaacggcgcgattcgaacagcgcacctttagtgtgataaagatcttccccgatctatccagcaacgatatgcttcttttcattgttaagggcatcaatctacctaccccccctggtctctctcccggtgacctggatgtgtttgtgcgattcgacttcccttaccctaacgttgaagaagcccaaaaggataaaacctccgtcatcaagaatacagatagcccggagttcaaggagcagtttaaattgtgtataaatcgatctcatcgtggcttccgtagagcgatccagactaagggaattaagttcgaggttgttcacaaaggaggtttgtttaagacggaccgtgtgctgggcacagctcagcttaagctcgacgccctggaaatcgcatgtgaggttagggagatcctcgaggtgctggatgggaggcgaccaactggaggacgcttagaagtgatggttaggatcagagaacctcttaccgcgcagcaactggagaccactaccgagagatggctcgtgattgaccccgttcctgccgcagtgccaactcaggtagccggtccaaagggaaaagctcccccagtccctgctcctgcacgcgagtccggaaaccgtagtgctaggcctctccattctttgagtgtacttgcctttgaccaagagcgcctcgaacgaaaaatcctggctcttagacaggcacgacgcccagtgcctcctgaggtagcccagcagtatcaagacattatgcagcgaagccagtggcagcgcgcacagttggagcagggcggagttgggatccggagggaatacgccgctcagctcgagcgccagcttcagttctataccgaggctgccagacgtctgggcaacgatggttccagagacgcagccaaggaagccctctatcgccgtaacctggtcgagtccgagttgcagcgcctccggagatag

SEQ ID NO: 218757 - DNA, 711 bp, Artificial Sequence
  Description of Artificial Sequence: Synthetic coding sequence
tggcatagtcccgacggcttaatgatcccagaggacggagctaatgacgaagaactcgaagccgaattcctagccttagtcggcggacagcctccggctctggaaaagctaaaggggaagggaccgttgcccatggaggcaatcgaaaaaatggctagcctctgtatgcgagaccctgatgaggatgaggaggaggggacagatgaggacgaccttgaggccgacgatgatctcctagcggaattaaacgaggtgcttggcgaggaacagaaggcctccgagactccccctccagtcgcacagccaaagccagaggcccctcaccctgggctggaaaccaccttgcaggagcgacttgccctgtatcagactgctatcgagagcgcgcgacaagccggagactccgccaaaatgcgacgatacgaccggggactcaaaacgttagagaatctgctagctagtattcgcaagggcaacgccatagacgaggcagatattccccctcccgtcgcaattggaaaagggccagcctctactccaacctacagtcctgcaccgacacagcctgctccaaggattgcttccgctcccgagcccagagttacactcgaaggcccatcggctactgcccctgcgagttctccaggactggcaaagccacagatgccacctgggccttgttccccaggtcctctggctcaactccagtag

SEQ ID NO: 218758 - DNA, 1116 bp, Artificial Sequence
  Description of Artificial Sequence: Synthetic coding sequence
atgcctcccggaccctgctctccgggaccattggcccagctccagagtcgccagcgtgattacaagctggccgctctacatgccaaacagcagggtgacaccaccgccgctgcacggcacttcagggtggctaaaagctttgatgccgtactggaggcactctccagaggagaacctgttgatctgtcctgcttgccgccaccccctgaccaacttcccccagatccaccttcacccccaagtcagcctccaactcctgccactgcaccctctacaaccgaagttcctcctccacccaggaccttactcgaggccctcgagcagcggatggagcgctatcaggtggccgcagctcaggctaaatccaagggcgaccagcgtaaagccagaatgcatgagcgaatcgtcaagcagtatcaggacgccatcagggctcacaaggcaggaagggcagtggacgttgcggaactgcccgtgcctccaggctttcccccaatccagggtttggaagcaaccaaacccacccagcaatctctcgtgggggtgctcgagaccgctatgaaactggctaaccaagatgagggtcccgaagatgaagaagacgaggtgccaaaaaagcaaaattctcccgtcgcccctacagcacaaccaaaggcaccccctagtcggactcctcagtcaggttcagctcccaccgcgaaggcgccacctaaggccacttccacgagagctcagcagcagctggcttttttagaggggcgtaagaagcagctcttgcaggcagctctgagagctaagcaaaagaacgatgtggagggtgcaaaaatgcaccttcgccaggctaaaggcctggaacccatgctcgaagcttcaagaaacgggcttcccgtggacattaccaaagttccaccagccccagtgaacaaagatgatttcgcactagtgcaaagacccggtcccggtctctcccaagaggcagctcgtaggtacggcgagcttaccaagctgattagacagcagcacgagatgtgcctgaaccattcaaaccagtttacccagctggggaatattaccgaaactacgaaagccaacatggtgaagccctgcttctactag

SEQ ID NO: 218759 - DNA, 4539 bp, Artificial Sequence
  Description of Artificial Sequence: Synthetic coding sequence
atggtttccgaaaaatcccaccttggcaacccccaggaacccgtccaggaggaacccaaaactagactgctttctatgacagttagacgagggcctagatcactccctccaatacccagcacgtctcggactggctttgcagaatttagcatgcgtggcagaatgagggaaaagttgcaggccgcacgaagtaaggctgagtccgcactcctgcaggaaatccctaccccgagaccacggcgattacgatctccaagcaaaaaggaactggagactgagtttggtacagagcccggaaaagaggtggagagaactcagcaagaggtggactcccaatcgtatagccgggtcaagtttcacgactccgctaggaaaattaaacccaagccccaggttcccccagggtttccatccgccgaggaggcatacaacttctttacttttaacttcgaccctgaaccagagggcagcgaggaaaagcctaaagcaagacacagggccggaaccaatcaggaggaggaggagggggaggaagaggagccaccggcacagggtggtggtaaggagatggacgaggaagaacttttgaatggcgatgatgctgaagactttttgctgggcctggatcacgtggccgacgacttcgtcgccgtaagaccagccgattacgagtccatccacgacagattgcaaatggagcgagagatgttatttataccaagcaggcaaaccgtgccgacctataagaagcttcctgaaaatgtgcagccaagattcttagaagatgaagggctgtataccggcgtgagaccggaggtggccaggaccaatcaaaatattatggaaaatcggttgttgatgcaagatcctgagcggagatggttcggggatgacggccgtatcctggccctcccaaaccccatcaaacctttcccatcccgccctccagttcttacacaggaacagagcatcaaagccgagctcgagacactctataaaaaagccgtcaagtacgtgcatagctcccagcacgtgataagatcaggagatccccctggcaacttccagcttgacatagatatatctgggttaatattcacccatcacccgtgcttctcacgggagcatgtgctggccgcaaagctggcccagctgtatgatcagtacctggcgcgtcatcagcgtaacaaagccaagtttctgacggataagctacaggcattgcgtaacgccgttcagacagggctggaccctgagaagccacaccaatctttggatactatacagaaaaccatcaacgagtataagtcggagatccgccaaacccgtaagttccgtgatgcagagcaggagaaggatagaaccttgttgaagactataattaaagtgtggaaggaaatgaaaagcctacgggagttccagcgatttacaaatacccctttgaaactggtgctccgtaaggagaaagctgaccagaaggccgacgaagaagcatacgaggcagagattcaggcagagatctccgaactccttgaagaacacactgaagagtatgcgcagaagatggaagagtacagaaccagtttacagcagtggaaggcgtggcggaaagtgcaaagagcaaagaagaaaaagagaaagcaggcagccgaggagcatccaggcgacgaaattgctgagccatatcctgaagaggacctagtgaaaccctcgccccctgagccaaccgacagggcagtgatagagcaggaagtcagggagcgcgcagcacagtcacggcgaaggccctgggagccaacacttgttccagagcttagcttggcagggtcagttacaccaaatgatcagtgcccacgggcagaagtcagtagacgggaagatgtcaaaaagcgctccgtgtatttgaaggttctcttcaataataaagaggttagcagaaccgtgtccaggcccctcggcgctgactttcgcgtacactttgggcaaattttcaacttgcagattgtgaactggccggagagtctgactttacaggtctatgagacagtgggacattccagccctacactgctggccgaggtctttctgccaattccagagaccacggtggtgacgggaagggctcctacagaggaggtagagttcagctccaaccagcatgtgactctggaccacgaaggcgtgggttcgggcgtgccattttcgttcgaggctgatggttctaatcagctcacactgatgacatctggcaaggtatctcactctgtcgcgtgggccatcggggagaatggaatcccccttattccccctctgagtcagcagaacatcggtttcagatccgctctgaaaaaagcagacgccatttcctcaataggtacaagcggcctgaccgacatgaagaagttagcaaaatgggccgcagagagtaaacttgatcccaacgatccgaataatgctccgctcatgcaattaattagtgtggccacttcaggcgagagctatgtacccgattttttccgccttgaacaactacagcaagaattcaatttcgtcagtgaccaggagttaaatcgtagcaaacgctttcggttattgcacctgagatctcaggaagtgcccgaattccgtaattacaaacaggtgccagtctacgatagagaaatcatggaaaaggtgttccaggactacgaaaaacgtctacgggacagaaatgtgattgaaactaaggagcatatcgatacccaccgcgcaattgtcgccaagtatttgcaacaagtgagggaatcggtgataaacagatttctcatcgcaaaacagtactttcttttggctgatatgatcgtggaggaagaggtacctaacattagcattctgggactgtctcttttcaaactcgctgaacagaagaggcctctgcgccctcggaggaaggggcgaaaaaaagtgacagcacagaacctgagcgatggagatattaaattactggtgaacatcgttcgggcatacgacatccctgttagaaagcccgctgtgagcaagttccagcagccctccaggagcagccgaatgttttccgaaaagcacgccgctagtcccagcacatatagtcctactcataatgcagactaccctctgggtcaggtcctcgtgaggccttttgtggaggtgagttttcagcgcacagtgtgccacacaaccaccgctgaaggccctaaccccagttggaacgaagagctggaactgccgtttagagctcccaacggggattactccactgccagcctgcagagtgtgaaagatgttgtgttcatcaatatctttgacgaagtgctgcacgacgtgctcgaagacgaccgagagagggggtcaggaattcacacgcggatcgagaggcattggttagggtgcgtcaaaatgcccttttccacaatctatttccaggcgaggttcgagagtcaggaagatgagaagcttctgcaggctacagaaaagttccaggcagagtgcgctctgaaattccctaacaggcagtgcctgactaccgtcattgacattagtggcaagacagtctttatcactagatatctaaagccccttaacccccctcaggaactgctcaacgtctaccctaacaatctgcaggcgaccgcggaactggtcgccaggtacgtctccctgatcccctttctgccagatacagtgtcatttggcggtatctgcgacctgtggtcaactagtgaccagttccttgacttgctggccggagacgaagaggagcacgccgtcctgctctgtaactattttctgagtctcggcaagaaagcctggctcctcatggggaatgcaatacccgaagggcctacagcctatgtgctgacgtgggaacaggggcgatatttaatttggaacccctgcagcggacatttctacggtcaattcgataccttctgtcctctgaaaaatgtaggctgtctcatcggcccagacaacatctggttcaacatacagcggtacgaatcccctctcagaattaacttcgatgtcacccgtcccaagctttggaagagctttttctcacgttcgctgccataccctggcctgtcaagtgtgcaaccggaggagctgatttatcagcgctccgataaggctgctgctgctgagctgcaggaccgcatagagaaaatccttaaagaaaaaattatggactggagaccacgccaccttactcgctggaatagatattgtacctccacgctgcgtcacttcttaccactcctggaaaagtcccagggtgaggacgtggaagacgaccacagggccgagctcctgaagcagctgggggactatagattctctgggttccctttgcacatgccttattctgaggtaaaaccacttattgacgcagtatacagtaccggagtgcataacatcgacgttccaaatgtcgagtttgctctagccgtctacattcacccctaccctaaaaacgttctgagcgtatggatctacgtagcctcgctgattagaaataggtag

SEQ ID NO: 218760 - DNA, 4863 bp, Artificial Sequence
  Description of Artificial Sequence: Synthetic coding sequence
atgaatccacgagaagagaaagtgaaaatcatcaccgaagagtttattgagaacgatgaggatgctgatatgggccgtcaaaacaagaactctaaagtccgccgtcaaccaaggaagaagcagcccccaaccgcggtgcccaaagagatggttagcgagaagagtcatttgggcaatccccaggagcccgtgcaggaagaacccaaaactaggttgcttagtatgactgtccggaggggaccccgaagccttccgcctatcccctctacatcacggaccgggtttgcggagtttagtatgcgcggacgaatgagagagaagctgcaggcagccaggagcaaggctgaatccgcgttacttcaggaaattccaacacccaggccaagaaggctgcgctccccgagcaaaaaggagctggaaacagagttcgggactgagcccggtaaggaggtggaaaggactcaacaggaggtggacagccagtcatacagtcgggttaaatttcacgattcagcaagaaagattaagcctaagccgcaagttccccctggtttcccctcagccgaggaggcctataatttttttacatttaactttgatcccgaacctgagggctctgaggagaagcccaaagccaggcatagggccggaactaatcaggaagaagaggagggggaggaggaggagccccctgcccagggaggcggaaaagagatggatgaggaggagctcctgaatggagacgacgctgaggactttctacttggtttagatcatgtcgccgacgacttcgtggcggtgaggcccgctgattacgagagtatccacgaccgactgcagatggaaagagaaatgctgttcatcccctcccggcaaactgttccgacgtacaagaaactgccagaaaatgtccagcctaggttcttggaggatgagggcctttacactggtgtcagacccgaggtcgcccgtactaaccagaacatcatggagaatcgactcctcatgcaggaccctgagcgcagatggttcggcgatgatggacggatcttggctctccccaatcctattaagcccttcccgagtaggccgccagttctaactcaggagcagtccatcaaagcagaacttgaaaccctctacaagaaagcggtgaaatacgtccactcaagtcagcatgtgattcgatccggagacccaccagggaacttccagctggacattgacatatcaggactcatattcacccaccatccctgctttagccgagagcacgtgctcgcagcaaaattggcgcagctgtacgatcagtatctggctcggcaccagcgaaacaaggcaaaatttctcacagataaactccaggccctgagaaatgctgtccagaccggcctcgaccctgaaaaaccccatcagtcacttgacaccattcagaaaacaatcaacgaatataaatccgagattagacagacacggaagttcagggacgctgagcaggaaaaggaccggacgttgctgaagaccattatcaaggtgtggaaggagatgaaatccctgagggagtttcaacgattcacaaacaccccgctgaaactggtcttgagaaaggagaaagcggatcaaaaagctgacgaagaagcgtatgaagctgagattcaagctgaaatctccgagctcctcgaagaacatactgaagagtacgcgcagaaaatggaagaatatcgaacaagtcttcaacagtggaaagcgtggcgtaaggtgcagagagccaaaaaaaaaaaaaggaaacaggccgcagaagaacaccccggagacgaaatcgccgagccctaccctgaggaggacctcgttaagccttcaccgccagaacccaccgatagggccgtgatcgagcaggaggtgcgggaaagggccgcacagtctagacgcaggccctgggagcctactctggttccagagctgtcattggcgggatctgtcactcccaacgaccagtgcccccgagcagaggtcagtcggcgagaagatgtcaagaagcggagcgtgtatctcaaggtcctattcaacaataaggaggttagtcggaccgtttcccgaccgctgggagcagatttccgagttcatttcggccaaattttcaacctgcagatagtcaattggccagagtccctcactctgcaagtgtatgagaccgttgggcactcatccccaacgctgctggccgaggtcttcctgccaatccccgaaactacagttgtaactgggagggctcctaccgaggaggtggagttttctagcaatcagcatgttacactcgaccatgagggtgtggggagcggggtccccttcagttttgaagccgatggctcaaaccagctcaccctgatgacctctgggaaggtttcccattccgttgcatgggccattggggaaaacgggatccctttaattccaccattgtcacagcagaatattgggttccgatccgccctcaagaaggctgatgcaatttccagcattggcacaagcggcctaacggacatgaaaaagcttgccaaatgggctgctgagagtaaactagaccccaacgacccaaataatgctccattgatgcagttgatctctgtggccacatcgggcgagagctatgttcccgacttttttcggctggagcaattgcaacaggagtttaattttgtctcagaccaggaactgaataggagcaagagatttagattgctccacctgagaagtcaggaggtgcccgaattccgaaactataagcaggtgccggtgtatgatcgcgagattatggagaaagtgtttcaggattacgaaaagcggttacgagaccgcaacgtcatcgagaccaaagagcacatcgatactcatcgagctatagtggcgaaatatctgcagcaggtccgcgagtccgtgatcaatcgatttctgatcgccaagcagtattttctgctcgctgacatgattgtggaggaggaagtgcccaatatatccattctgggtttgtccctatttaagctggctgaacagaaacgaccgcttcggcctcgcagaaaaggcagaaaaaaagtcaccgcacaaaacctgtccgatggagacattaaacttcttgtgaacattgtgcgcgcatatgacataccagtgcggaagccagctgtgagcaaattccagcagccgtcccgctcttcacgtatgttttccgaaaagcatgctgctagccccagtacatactcaccaacgcacaacgcagactatcctctgggccaggtcttagtgaggccattcgtggaggtctccttccagaggaccgtatgtcataccacaactgcagaaggccctaatccctcatggaacgaagagttggaactacctttcagagctccgaatggcgactatagcactgcgagcctgcaaagcgttaaggacgtggtgtttattaacattttcgacgaggtcctacacgacgtcctagaagacgatcgagagagaggctcgggcattcacactagaattgaaagacactggctgggctgcgtgaagatgccttttagcaccatctattttcaggcacgaatagacggcaccttcaagattgacatccctcccgtcctgttgggctatagtaaggagaggaatatgatcctggagagaggttttgactctgtgaggagcctgtcagaaggctcttatattaccctgtttataacaatcgagccgcagcttgtgcctggggagtcaattcgggagaagtttgaatcacaggaggacgagaaactgctgcaggctactgagaagttccaggctgagtgtgcactgaaatttcctaacaggcagtgcctgaccacagtaattgatatctctggaaaaacagtgtttattaccagatatctgaaacccctcaatccacctcaggagttgctgaatgtataccccaataatctgcaggctacagcagagctagtcgcacgatacgtctcactgatccccttcttaccggacaccgtcagcttcggaggcatctgtgacctgtggagtacaagcgaccagttcctcgatctactcgctggtgatgaagaggagcacgccgtcctattgtgcaattacttcctgagcctcggaaaaaaggcatggctgctgatgggcaacgctattcccgagggccctaccgcatacgtgctcacgtgggagcaggggaggtacctcatctggaacccctgctcgggccacttctatgggcaattcgatactttctgtcccctcaaaaacgtcggttgtttaattgggccagacaacatatggtttaacatacaacgatatgagagcccccttcggataaacttcgatgttacacggccaaagttgtggaaaagttttttttcacgctcgctcccctatcccggtctgagctcggtgcaacccgaggagctcatttaccagaggtctgacaaagcggctgctgccgagcttcaagacagaatcgagaaaatcttaaaagagaaaatcatggattggaggcccagacacctgacccggtggaatcgatactgcaccagcaccttaagacatttcctccctctcctggaaaaatcacaaggagaggacgtggaagatgaccacagagccgaattgcttaagcagttaggggactaccgctttagcggcttcccactgcacatgccctattccgaagtcaagccgttaatcgatgccgtatatagcaccggggtgcataatatagacgtacccaatgtggagtttgcattggctgtgtacatccacccctacccaaagaatgtgctcagcgtgtggatctacgtggccagcctgattcgcaataggtag

SEQ ID NO: 218761 - DNA, 4863 bp, Artificial Sequence
  Description of Artificial Sequence: Synthetic coding sequence
atgaatccacgagaggagaaggtcaagattattaccgaggaattcatagagaatgacgaggatgccgacatggggcgtcagaataaaaatagcaaggtgcgtaggcagccacgcaaaaagcagcctcctacggctgtacccaaagagatggtttctgagaaaagtcacctgggcaacccccaggaacccgtccaggaagagccgaagacccggttactcagcatgactgtccggagaggcccaaggagcctacctcctatcccatctacaagtagaacgggtttcgcggaattctctatgagaggacgcatgcgcgaaaagctacaggcagcaaggtcaaaggccgaatcagctctcctgcaagagatccctactcctcggcctaggcggctgagatccccatctaaaaaagagctcgagacggagttcggaacagaacccggaaaggaagtggaacggacccagcaagaggtggactctcagagctatagtcgcgtaaaattccacgacagtgctcgcaagataaagcccaaacctcaggtccccccagggttcccttctgctgaggaagcttataatttcttcacctttaactttgatccggaaccagagggctcagaggagaagccgaaggctagacaccgcgcaggaaccaatcaggaggaggaggaaggcgaggaggaggagcccccagcccaaggcggaggaaaagaaatggacgaggaggaactgctgaacggagatgacgcagaggactttctgctgggactggaccacgtggcagacgacttcgtggcggtgaggcccgcagattatgaaagtatccatgatcgtcttcaaatggagagggaaatgctgtttatcccgtctagacagacagtgccaacctacaagaagttacctgaaaatgtgcagccacgatttctagaggacgagggcctgtacaccggagtccggccagaggtggcacgtaccaaccagaacatcatggagaaccggctgcttatgcaggatcctgagaggcgatggttcggggacgatgggaggatcttagccctgccaaatccgataaagcctttcccctcccggccacccgtgttaacacaggagcagtcaataaaagcggaactggagaccttatacaaaaaggcagtgaaatatgtgcacagttcacagcatgtaattcggtcaggggatcccccagggaactttcagctcgacatcgatatctctggattgatctttacccaccacccttgtttcagtagagagcatgttctggcagccaagttggcgcagttgtatgaccagtaccttgcacggcatcagcgtaacaaggcgaagttccttacagataaactacaggctctccgcaatgcagtgcagacagggctcgatcctgaaaaaccacaccaaagtctggacaccatccagaagacgatcaacgagtataagtccgaaattcgacagactcggaagtttcgcgatgctgaacaagagaaagaccggactctcttaaaaaccattataaaggtgtggaaagaaatgaagtctcttagggagtttcagaggtttaccaatactcctctcaagctagtactgaggaaagagaaagccgatcaaaaggcggatgaggaggcatacgaggccgagatacaagcagaaattagtgagcttctcgaagagcacacagaggaatacgcccaaaagatggaggagtatcgcacaagtctccagcaatggaaagcatggcgcaaagttcagcgcgctaagaagaaaaaaaggaagcaagccgctgaagagcacccaggcgacgaaatagctgagccttaccccgaagaggatctggttaaaccatcccccccagagcctacagatcgcgctgtgattgaacaggaagttagggaacgggcagcacagtctaggaggcgaccctgggagcccaccctggttcccgagctcagtctcgctggctccgtcacccctaatgaccagtgtccgagagccgaagtgtctaggcgcgaggatgttaagaagaggagtgtctacctgaaagtgctcttcaacaataaagaggtgagcaggacagttagccgaccactaggagctgactttcgtgtacacttcggacagattttcaacttacagatagtcaactggccggaatcactgacccttcaggtgtatgaaacagtaggacactcgtctcctaccttactcgcagaagtgttcctccctattccagaaacaaccgtggtgacaggccgtgcaccaacagaagaagtcgagtttagttcaaatcaacatgtgacactggaccacgaaggtgttgggtcgggagtgcctttctccttcgaggccgacgggtctaaccaactgactttaatgacttccgggaaggtgtcccactctgtggcttgggctatcggagagaacggcatccccctcataccgcctctgagccagcagaatatagggttcaggagtgccctgaagaaggcggatgctataagctcgattggcactagcggcttgacagacatgaagaagttggccaagtgggctgccgagagcaagttggacccaaacgaccctaacaacgccccactgatgcagctgattagcgtcgctacttccggcgagtcttatgtgcccgattttttcagactagagcagctccaacaggaatttaattttgtgtcagaccaggaacttaataggagtaagaggtttagacttttacacttaaggagccaggaggttcctgaatttcggaattacaagcaggtgcctgtgtatgatcgtgagatcatggagaaggtgttccaggactacgaaaagcgcctgcgcgaccgcaacgtgatcgagaccaaagagcacattgacacccatagagccatcgtcgctaaatacctacagcaggttagagagtctgtcataaatagatttctgattgctaaacagtatttcctcctggcagatatgatcgtggaggaagaggtccctaacatctcgattttggggctaagcctgtttaagctcgccgagcagaagcggccacttcggcctagacggaagggcagaaagaaagtgacagcacagaatttgtctgacggagacatcaagctgctggtgaatatagtcagggcgtacgatattcccgtccgtaaaccagcagtgtctaaattccagcaacctagtagatcatcacggatgttctctgagaaacatgcagccagtcccagcacctacagcccaacccacaatgctgattatcctctaggtcaggtgctggtgcgcccatttgtcgaggtgtcatttcaaaggacagtgtgccacaccacgactgcagaaggccctaatccatcttggaatgaagaactggagctgccctttcgtgcaccaaacggcgattactccaccgcgtcacttcagtccgtgaaagacgtggtctttatcaatattttcgacgaggtcctccacgacgtgctggaggacgatcgtgagagaggatctgggattcatactaggattgagaggcactggttaggctgcgttaaaatgccgtttagcacgatttacttccaggctagaattgatggcacatttaaaattgatatcccgcctgttctcctgggctactcaaaggagcggaatatgatcctggagaggggtttcgattccgttaggtccttgtctgagggaagctacattaccctattcataaccatcgaacctcagttggtgcctggtgagtcgattagagagaagttcgagtcgcaggaggatgaaaaacttctgcaggcaacagagaagttccaggctgagtgcgccctcaagtttcccaatcgacagtgcttgaccactgtgatcgacatttccggcaagaccgtattcatcactcggtacctgaagcctctcaaccctccacaagaattgctgaacgtgtacccgaacaatctacaagccacagctgaactggtggcacggtacgtgagcctgataccattcctgccagacaccgtgtcttttggcggaatttgtgacttatggtcaacatcagaccaatttttggaccttctggccggtgacgaggaagagcacgccgtgctgctctgcaactacttcctgagtctcggcaagaaagcttggctcttgatgggaaatgctatccctgagggtcctactgcctacgtgttaacttgggagcaggggagatacttgatctggaatccttgttccggacacttttacgggcagtttgataccttttgtccgctgaaaaacgttgggtgtctcatcggtccagataacatctggtttaatattcaacgttatgagagccctttacgaatcaacttcgacgtgacccgaccaaaactatggaaaagcttttttagtcgatcactgccataccctggcctctctagcgtccagccagaggagctgatttaccaacgcagtgacaaggcggctgctgctgagttgcaggaccggatagagaaaatactgaaagaaaagataatggattggcgccctcgtcatttaactcggtggaatcggtattgtacttctacactgagacactttctgcccctccttgaaaagtcacagggagaggatgtagaggacgatcatcgagcggaactgctgaagcagctcggggactaccgtttttcagggtttcccctacacatgccctactccgaggttaaacctctgatagacgcagtgtatagtactggtgtccacaacatcgacgtcccaaacgtggagtttgcactggcagtgtacattcatccttacccaaaaaacgtgctgtccgtttggatatacgtggcctcactgattagaaatcgatag

SEQ ID NO: 218762 - DNA, 4539 bp, Artificial Sequence
  Description of Artificial Sequence: Synthetic coding sequence
atggtttccgagaagtcgcatttggggaatccccaggagcccgtgcaggaagaacctaagaccaggctattaagtatgacagttagacgcggaccacggagcctgcctcccattccttcaacatcccgaacaggctttgccgagttcagtatgaggggccgaatgagggaaaaactgcaggctgcgagatccaaagccgagtcagctttgctacaggagattcccaccccccgacctaggcggttgaggtctccatccaagaaggagttggagacagagttcggtactgagcccggaaaggaggtggaaaggactcagcaggaggtggactctcagtcgtattccagagtgaagtttcacgacagcgcaagaaaaatcaaaccaaaacctcaggtaccgcctggcttcccttccgcagaggaggcgtacaacttctttacatttaattttgatcccgagcccgaaggatcggaggaaaaacctaaggcaagacaccgtgcaggcaccaaccaggaagaagaggaaggtgaggaggaggagccacctgcccagggcggtggaaaggaaatggatgaggaagaacttttgaacggggatgacgccgaagacttcttgctggggctggaccacgtggccgatgacttcgtcgcagtcagaccggctgattatgagtcgattcatgatcggttgcagatggagagagaaatgctgttcatcccatcccgccaaacggtacccacctataagaaactgccagagaatgtgcaaccccgttttttggaggacgagggactctacacaggtgttcgccctgaagttgctaggacaaaccaaaacatcatggaaaatcggctgctgatgcaggacccggagcgccgttggtttggcgatgacggacgtattctcgcccttcccaatcctattaagccctttcctagcagacctccagtcctgacccaagagcagagcatcaaggcagagctcgagaccctgtataaaaaggcggtgaaatacgtgcattcgtctcaacatgtaatccggagcggtgatcccccagggaatttccaattagatatcgacatcagtggcctgatcttcacccatcatccttgtttctcaagggagcatgtgctagccgctaaactggcccagctgtatgatcagtacttggcccgacaccaaaggaacaaggcgaagttcctcaccgacaagctgcaggcgctgcgaaacgctgtgcagactgggctagaccccgaaaaacctcatcagtcccttgatacgatccagaaaaccataaatgagtacaagagcgagatccgccagactagaaaattccgagatgctgagcaggagaaagatagaacactgttgaaaacaattatcaaggtgtggaaagagatgaaaagtctgagagaattccagcgatttactaatacaccactgaaactcgttctccggaaagaaaaggccgaccagaaagcggacgaggaggcttacgaagctgaaatccaggctgagattagcgaactgctggaggagcacactgaggagtacgcacaaaagatggaggaatataggacctccctccagcagtggaaagcatggcggaaggttcaacgcgctaagaaaaaaaagcgaaaacaggccgctgaggagcaccctggcgacgaaatcgctgaaccctatccggaggaggacctggtaaagccttcacctccagagcccactgaccgggctgtgatcgaacaggaggtacgggaacgcgctgcgcagtctaggagacgtccttgggagccaactctcgtgccggaactttctctggcgggaagcgtgacgcctaacgatcagtgtccgagagcagaagtgtcccgcagggaggacgtgaagaaacgcagtgtctacctaaaagtccttttcaataacaaggaagtgtctcgcaccgtcagccggccattaggcgcagattttcgcgttcacttcggacagatctttaacctgcagatcgtgaattggcctgaaagtttgactttacaggtctatgaaacagtcggccactccagcccaaccttgctcgccgaggtctttttgccaatacctgagacgacagtggtgactggtcgggctccaaccgaagaagtcgagttctctagtaaccagcacgtgactctggaccatgagggtgtgggaagtggcgtaccctttagctttgaggccgatggatcgaaccagctcaccctaatgacttccgggaaggtgagccactcagttgcctgggctattggtgagaacggtatccccctgattcctcctttgtctcagcagaatattggcttcaggtctgccctgaagaaggctgatgcgatatcgtcaatcggtactagtggccttacagatatgaagaagctggccaagtgggcagctgagtcaaaacttgatccaaacgatccaaataatgccccactgatgcaacttatctcagtggccactagtggagaatcatacgtgccagatttctttcggttggagcagctgcaacaagaattcaattttgttagcgatcaggagctgaatcgtagtaagcgatttcgattgctgcacctgcgttcccaggaggttcctgagttccggaattacaagcaagtccccgtttacgacagggagattatggagaaagtatttcaggactatgagaaaaggctgcgtgataggaacgttatcgaaacaaaagagcacatcgacacccatagagctatcgtggctaaatacctgcaacaggtgcgggagagcgtgataaacagatttcttattgctaagcaatacttcctgctggcggatatgatcgtagaggaggaggtgccaaacatttccatcctggggctgtcactattcaagttagctgagcagaaaagaccattgcgccctagacggaaggggcgaaagaaggttacggcacagaatcttagtgatggtgatattaagctgctagttaatatcgtgcgggcttatgacatcccggtgagaaagccagccgtgagcaagttccagcagccctcccgatcttctcggatgttctccgagaaacacgccgcatcaccaagtacatacagtcccacccacaacgccgactatcctcttgggcaggtccttgttcggcctttcgtcgaagtgagcttccagcggaccgtatgtcatacaacaacagccgaagggccaaatccaagttggaacgaggagttggaactgccatttcgagcccctaacggggactactcaacagcatcccttcagagcgtgaaagatgtcgtgtttataaatatttttgacgaagtcctgcacgacgtactggaagacgatagagagcgtggatcaggcatccatacaagaattgagcgccactggttaggttgcgtaaaaatgccattctccaccatttactttcaagctcgattcgaaagccaagaagatgagaagcttcttcaagcaacggaaaaatttcaggctgagtgtgctctgaaatttccaaaccggcagtgccttactacagtaattgatatctccggaaagacggtgttcatcactcgatacctcaaaccgctgaaccctccacaggagctgctaaacgtctaccctaataacctacaagcgacagccgaactcgttgcaagatacgttagtctgatcccgtttctgccagatacagtgtcttttggaggtatctgcgacctatggtccacgtctgaccagtttctagacttactggccggtgacgaagaagagcacgccgttctcctgtgtaactacttcctatcgttgggcaagaaggcttggctcctgatggggaacgcgatacccgagggaccaactgcctatgtcctaacatgggagcaggggagatatttaatctggaacccatgttccggacacttctacggccagttcgacacgttctgtccgctcaagaacgtgggatgtctgatcgggcctgataacatatggtttaatattcagaggtacgaaagccctttgcgcatcaacttcgatgttacacggcctaagctctggaagagttttttttctaggtctctcccctaccctggcttgagctcagttcagcctgaagaactgatttatcaaaggagcgacaaagctgccgcagctgagctgcaggaccgcatcgagaagatactcaaggaaaaaattatggattggcggccacggcatctgaccaggtggaatagatactgtactagcactctcaggcacttcctgccactcctggagaagagccagggagaggacgtggaagacgaccacagggcagagctgctgaagcagctcggggactacaggtttagtggcttccctctgcatatgccctactccgaggtgaagcctttaatagatgcagtgtatagcactggtgtgcacaacatcgatgttcccaatgtggagttcgcattagccgtgtacattcacccatatcctaaaaacgtccttagtgtgtggatctacgtggcctcactgatcaggaataggtag

SEQ ID NO: 218763 - DNA, 369 bp, Artificial Sequence
  Description of Artificial Sequence: Synthetic coding sequence
atgaaccccagggaggaaaaagtgaagataatcacagaagagttcatcgaaaacgacgaagatgccgacatgggccgacagaacaagaatagcaaggtacgaagacagcctaggaagaagcagaagccgacgcccttctccagagcctgctggcagatcttgccacatctctctgctggcgttcctcttctcggttgggaacatcccgtgcagggcaaaagctttcaagctacaaactgctgtccccagggcaatggagtgcgaaagattcccccatggcagcccccaggggcatgtgccggaggcgcacaggatccaccccctgagtacgacagccccgagaggcctaccgagcgggctggctgttag

SEQ ID NO: 218764 - DNA, 4863 bp, Artificial Sequence
  Description of Artificial Sequence: Synthetic coding sequence
atgaacccaagggaggaaaaagtgaagatcataaccgaggagtttattgaaaatgacgaggacgccgacatgggtagacagaataaaaatagcaaagttcggagacagccaaggaagaaacagcctcctactgctgttcctaaggagatggtgtccgagaagtctcatctaggcaatcctcaggaacctgtccaggaggaacccaagactcgccttctctcaatgaccgtgaggagaggccctcgtagcctgcctcctataccgagtaccagtcgcacaggctttgctgagtttagcatgaggggacgaatgcgagaaaaacttcaagccgcacggtccaaggctgaaagtgcgctgttgcaggaaatacccaccccaagaccacgtaggttgagaagcccctcgaagaaagagctggaaacagaatttggcactgaacccggaaaagaggtggagcgcacccagcaggaggtggattcccagagctacagtagggttaaatttcacgactctgcccgaaaaatcaaacctaagccacaagtgccaccgggatttcctagtgctgaagaggcctataattttttcactttcaactttgacccggagcctgaagggtctgaggagaaacccaaggcgaggcaccgggcagggacgaaccaagaggaggaagagggtgaggaggaagaacctcctgctcaaggcggagggaaggaaatggatgaagaggagctgctcaatggggatgacgcagaagactttcttctgggtctggatcacgtggcggacgattttgtggccgtacgtccagctgactacgagtcaatccacgatcgcctgcaaatggaacgcgaaatgctttttattcctagccggcagaccgtccctacttacaaaaagcttccggaaaacgtgcaacccagatttctcgaagatgaggggctgtacaccggcgtgaggcccgaggtagcccgaaccaatcagaacattatggagaacaggctgctgatgcaggaccccgaaagacgttggttcggtgacgacggccgtattctggctttaccgaatcccatcaaaccattcccctccagacccccagtcctgacccaggagcagtctataaaagcagaactcgagactctatacaaaaaggcagttaaatatgtgcattcatctcagcatgttattagatcaggggacccccctggaaactttcagttagatatagatattagtggtctgatcttcactcatcatccatgtttctctagagaacatgtgttggctgctaagctagctcaactttatgaccaatacttggccagacaccagcgcaacaaggcgaaatttctcactgataagctgcaggcactaagaaacgccgtccagacaggtctagatccagagaagccccatcagtccctagacactatccagaaaaccataaatgagtataagagcgagattcgacagacacgcaaattccgtgatgcagagcaggagaaagataggacactgctgaaaaccattatcaaggtttggaaagaaatgaagagtcttcgcgagttccagaggttcacaaatacccccctgaagctggttctcaggaaggaaaaggccgaccagaaagccgacgaagaggcttacgaagccgagattcaagccgagatcagcgagttgctggaagaacacactgaagagtacgcacaaaaaatggaggaatataggacaagcctccagcagtggaaggcttggcggaaagtgcagagggctaagaaaaaaaaacgcaaacaggccgcagaagagcacccaggagatgagatcgccgaaccatacccagaagaagatctggttaaacccagccccccagaaccaactgatagggctgtgatcgagcaggaggtgcgggaaagggctgcccagtctcgacgccgaccctgggaacccacacttgtcccagagttatcattggctggtagcgtgaccccaaacgatcagtgcccgagggccgaggtgagccgcagggaagacgtgaaaaagagaagcgtctatttaaaagtcctgttcaataacaaagaggtttctaggaccgtgtcacgacctttaggggctgattttagggttcattttgggcaaatttttaacctgcagatcgtgaactggcctgaatccttgaccttacaggtttatgaaacggtcggccacagctcacccacactcctggcagaggtctttttgccaatacccgaaaccaccgttgtgaccgggagggctccaaccgaggaggttgagttctcctccaaccaacatgtgacgctggatcatgagggagtcgggagtggcgttccattttcttttgaggcggacggatctaaccaactgaccctgatgacatctggcaaggtgagccatagcgtcgcctgggcgatcggcgaaaacggcatccccctgatccctcccttgagccaacagaatattggattccggagcgcactcaaaaaggccgacgccatctctagtatcggcacatcagggttgacggacatgaagaagcttgccaaatgggccgctgagtcgaagttagatcctaatgaccccaataacgctccactcatgcaactcatctccgtcgccacttctggcgagtcatacgtgccagatttctttcggttagagcagctgcagcaggagtttaactttgtctcagatcaggagctgaaccgctctaagcgattcaggctccttcaccttaggtcccaggaagtgccggagttcagaaattacaagcaggtgcctgtatatgaccgagaaattatggagaaagtgttccaggactacgaaaagcgccttagagataggaacgtgatcgagacaaaggaacacatagacacacatcgggctatcgttgctaaatacctacagcaggtgcgggagagtgtgatcaatcggtttctgatcgccaaacagtactttctcctcgcggatatgatcgtggaggaggaagtgcctaacatctccatcctgggcttgtcactcttcaagttagctgagcagaagaggccattgagacccaggcggaagggccgtaagaaagtaaccgcacaaaatctgagcgacggggacatcaagcttctcgtgaatatcgtcagagcatatgatataccagtcaggaaacccgctgtttccaagtttcagcagccgtccagaagctcacgtatgtttagtgaaaagcatgccgcttctccttccacttatagtccaacccacaatgcggactaccccctcgggcaggtgctcgtgcgcccttttgtcgaggtgagcttccaacggaccgtctgtcatacaaccaccgcggaaggcccaaatccttcctggaacgaggagctcgaactgcccttccgggctcctaatggtgactatagcactgcctcactgcagtctgtgaaagatgtcgtgttcatcaatatcttcgatgaggtgctgcacgatgtgctagaagacgacagggagagggggtcagggatccataccaggatcgaaagacactggctgggctgcgtgaagatgccattttctacgatctatttccaggccaggatagacggaaccttcaaaatcgacatcccccctgtcttgcttggttactcaaaagaaaggaacatgatccttgagcgaggctttgactcggtccgtagtctaagcgaaggaagttatatcaccctgttcataaccattgagccccaattagtacctggggagtccattcgggaaaagttcgaatctcaggaagatgaaaagctacttcaagccactgagaagtttcaagctgaatgtgctttaaaattccccaatcgtcaatgtctcactacagtgatcgatatctccggaaagactgttttcatcacacgctatcttaaaccactgaatccccctcaggagctgcttaacgtctaccccaataatcttcaagctacagcagagctagtggccaggtatgtttcactcattccgttcctgcctgacacagtgagctttggcggaatatgtgacctgtggagcacctctgatcaatttctggatctgctggccggtgacgaggaagaacacgccgtcttgctgtgtaattatttcctttccttgggcaagaaggcctggctgttaatgggtaatgcgattcctgagggacccaccgcctatgtactgacttgggaacagggaaggtatctaatctggaacccgtgtagtggccacttctatggccagttcgatactttctgcccactcaaaaacgttggatgtctgattggccctgacaacatttggttcaacattcagcgttacgagtcccctctgagaatcaactttgacgtaaccagacccaaactctggaagagctttttttccagaagcttgccatacccagggctaagttccgtccagcccgaggaacttatttatcaaaggtcggataaagctgccgcagcagaactgcaggacaggatcgagaaaattctcaaggaaaaaatcatggattggaggcccagacatctgactaggtggaatcgctactgtacaagcaccctgaggcatttccttcctcttctggagaagtcccagggggaagacgtggaggatgaccatcgcgctgagctgcttaagcagctgggcgactacaggttctctggcttcccgctccatatgccctattctgaagtcaaaccgctaattgacgcggtgtattctaccggagtccataacattgatgttccaaacgtggagtttgcgctggcagtgtatatccacccttaccctaagaacgtgttatccgtgtggatttacgtagcttccctgattcgaaaccggtag

SEQ ID NO: 218765 - DNA, 369 bp, Artificial Sequence
  Description of Artificial Sequence: Synthetic coding sequence
atgaatccaagggaagaaaaagtcaagattatcaccgaggagtttatagagaacgatgaggatgccgacatgggcagacagaataagaatagtaaggttcgtcggcaaccacgcaagaagcaaaagcccacccccttttctagggcttgctggcagatactgcctcatttaagcgcaggcgtcccgctgcttggttgggagcaccctgtgcagggtaagtcatttcaagcgactaattgctgccctcaaggtaacggcgtgcgaaaaatcccaccctggcagcccccaggcgcatgcgccggtggagcccaagatcctccgccagagtatgactctcctgaacgacctactgaacgggctggatgctag

SEQ ID NO: 218766 - DNA, 4539 bp, Artificial Sequence
  Description of Artificial Sequence: Synthetic coding sequence
atggtgtcagaaaagtcccatctcggcaacccacaggaacccgtacaagaagagcccaagaccaggctgctgagcatgacggtccggcgaggaccaagatccctacctcctataccttctaccagtcgcacagggttcgccgaattctcaatgcgtgggcgtatgagggaaaaactccaggcagcacggtcaaaggcagaaagcgcactcctgcaggagatccctacaccacgtcctcggaggttacgtagtccctccaaaaaagaactggagacagaattcggcacagaacctggtaaggaggtggagcggacacagcaggaggtggactctcaatcctactccagggtgaagttccacgatagcgccaggaagattaagccgaagcctcaggtgcctcccggatttccatctgccgaggaggcatacaactttttcacattcaacttcgatccggaaccagaaggtagcgaagagaaaccgaaagcgcgacacagagctgggacaaaccaagaggaagaggaaggcgaggaagaggagcccccagcccagggtggcggaaaggagatggacgaggaggagttgctgaacggtgatgatgctgaggatttcctgctcgggctcgatcacgtcgcagacgacttcgtggcggtcaggcccgcagactatgagagtatccacgatagattacagatggagcgcgaaatgctattcattccttccaggcagaccgtacctacatataagaagttacctgagaacgtgcagccccgtttcttggaggatgaggggctgtacaccggcgtacgacccgaggttgcacggacgaatcagaatatcatggagaataggttgctgatgcaggatccagaacggagatggttcggtgatgacgggaggatactcgccctgcccaatcctatcaaacctttccccagccggcctcccgttctgacccaggaacagagcatcaaggccgaacttgagacgctgtataagaaagccgttaagtacgtgcactcatcacagcacgtaattagatcaggagaccccccagggaatttccagctagatattgatatatccggcctcatatttacccatcatccctgcttcagtcgcgagcacgttctggccgctaaacttgcccagttatacgaccagtatctcgcccgtcaccaaagaaacaaggctaagttcctcaccgataaattacaagcattacgcaatgcagtccagactggactcgatcccgaaaagcctcaccaatctttagataccattcaaaaaaccattaatgagtacaaaagcgagatcagacaaaccagaaaatttcgtgatgcagagcaggaaaaagatcggacgctgctgaaaactatcattaaggtctggaaggaaatgaagagcctccgggagtttcaacgcttcaccaatactccgctgaagcttgtgctgcggaaagagaaagctgatcagaaggccgacgaggaggcttacgaagcagagatacaggctgaaatctccgaattgcttgaggagcacaccgaggagtacgcgcaaaagatggaagagtatcggacttcactacagcagtggaaagcctggagaaaggtgcaaagagccaagaagaaaaaacgcaagcaagccgcagaggagcaccctggcgacgagattgccgagccttatccagaggaggatttggtaaaaccgtccccccctgaacctacagatagagcagtgatcgagcaggaagtgcgagagcgtgccgcacagtcgcggagaagaccctgggaaccaacattagttccagaattgagcttggcaggcagcgttacacctaacgatcagtgccccagggccgaagtctcacgaagagaagatgtcaagaagcgttccgtgtatctgaaagtgctgtttaacaacaaggaagtgtctagaactgtaagcagaccactgggcgctgactttcgggtgcacttcggccagatcttcaacctccagatcgtaaactggccagaatcattgacattgcaggtgtatgaaaccgtggggcactcctcacctacgctcttggccgaggtctttctccccattcccgaaacaacagtcgtgacgggcagggcgcctaccgaagaggttgagtttagttctaaccagcatgtgacactggatcatgagggggttggaagcggcgtcccattctcgttcgaggccgatggttccaaccagctgacactgatgacatccggcaaggtcagccattccgttgcctgggccataggagagaatggtatccccctgattccaccacttagtcagcagaacatcggtttccggagcgctctgaagaaggccgatgccattagcagtatcgggacatctgggctgaccgatatgaagaagctggccaaatgggccgcagaaagcaaacttgacccgaatgaccctaacaatgcaccattaatgcagctgatttcagtcgccacctctggagagtcatatgtcccagacttctttcggctggaacagttgcagcaggagttcaactttgtgagcgaccaggagctcaatcgctccaagcgctttagattgttgcacctgcggtcccaggaagtgcctgagttcaggaactataaacaggttcctgtgtatgatcgtgagattatggagaaggtgttccaagactatgagaaaagactgcgtgatcgcaatgtcatcgaaacaaaagaacacatcgacacacatcgagctatcgtggctaagtacctccagcaagtgagagagtctgttatcaacaggtttctgatagcaaagcagtacttcctgctggccgacatgatagtggaagaggaggtgcctaatatctctatactgggcctgagtctgttcaagctggctgagcagaagaggccactacggcctaggcgaaaaggccgaaagaaggtgacggcccagaatctgagcgatggcgacatcaagcttcttgtcaatattgtcagggcatacgatattccagttaggaagccagcggtttctaagtttcagcagccatccagatcctcccgtatgttttcagagaaacacgctgcaagcccttcaacctattcacctacccacaacgctgattatcctctagggcaggtcctggtgaggcccttcgtggaggtgtcttttcaacggacagtatgccatacaactaccgcagaggggccaaatccgagttggaatgaggagttggagctaccctttcgggctcccaacggcgactattcaaccgccagtctacagtctgtcaaggatgttgtctttatcaacattttcgatgaagtgttgcacgatgtgctggaggatgatcgggagagaggtagtggcatacacaccaggattgagcgccactggttgggctgcgtcaagatgcctttctctactatttacttccaagccagatttgaatcccaagaagatgagaaactgctgcaggccactgaaaaatttcaggcggaatgcgcactgaagttccccaaccgccagtgccttaccactgttatcgatatctccggcaaaaccgtctttattacacgataccttaaacccttaaaccctccgcaggaactgcttaacgtgtaccccaacaacctccaggccacagctgagctggtagcccgatacgtaagtttaatcccctttctgcccgatacagtctcctttgggggtatctgtgatctttggtcgactagcgatcagttccttgaccttctggctggtgacgaggaggaacatgccgtactgctctgtaactacttcctgagtttaggcaagaaagcatggctcctgatggggaacgctatcccagagggccctacagcatacgttctaacctgggaacagggaagatatctcatctggaacccatgttctggtcacttctatgggcaatttgacaccttttgccctctgaagaacgtcggctgcctgataggacccgacaatatttggtttaatattcagagatatgagtccccattgcggattaatttcgatgtcacacggcctaaactgtggaaaagctttttttctcgcagtttgccctatcccggtttatcttccgtgcaacctgaggagctgatctaccagcggtctgacaaggccgcagctgctgaactgcaggataggatcgagaagattctgaaagagaagataatggattggcgccctaggcatttgacaaggtggaatcggtattgcacctcgactctgaggcatttcttgcccttgctggaaaagagccagggagaagatgtcgaggatgaccatcgggctgagctgctaaagcagctgggggactaccggttttccggattcccgttgcatatgccttacagcgaagtgaaacctctaattgatgccgtgtactccacgggtgtccacaatatagacgtgcccaacgtggagttcgctctggcggtgtacatacacccatatcccaagaacgtgctaagcgtctggatctacgtcgcctcactgatcagaaaccggtag

SEQ ID NO: 218767 - DNA, 369 bp, Artificial Sequence
  Description of Artificial Sequence: Synthetic coding sequence
atgaacccaagggaggaaaaggtgaaaatcatcacagaagaattcatcgaaaatgatgaggatgctgacatgggcagacaaaacaagaactctaaggtgaggagacaaccgagaaaaaaacagaaacccacccccttcagccgggcatgctggcagattctgcctcaccttagtgccggagtgcctctgctgggctgggaacaccccgtgcagggaaagtcttttcaggcaacgaattgctgtccacaaggcaacggcgtgaggaaaatcccgccttggcaaccccctggagcctgtgccggtggagcccaagaccccccaccagagtatgacagccctgagaggcctacagaaagggccggatgctag

SEQ ID NO: 218768 - DNA, 1767 bp, Artificial Sequence
  Description of Artificial Sequence: Synthetic coding sequence
atgaatccacgagaggaaaaggtgaaaataatcactgaggaattcatcgaaaacgacgaggatgcggacatgggacgacagaataaaaactccaaggtcagacgtcagcccaggaagaagcaacccccaacagctgttcccaaagagatggtgtcagagaagagtcatctgggaaacccccaggaaccagtgcaggaagagcccaagacaaggctcctttcaatgacagtgcgccgtggaccaagatctctgcccccaattccttcaacctcccggacaggcttcgcagaattctccatgagggggcgaatgcgggagaagcttcaggcagcacgctcgaaagccgagagcgctctgctccaggagattcccacacccagacctagacgcctgcgctcccctagcaagaaggagcttgaaaccgagtttggaacggagcccggtaaagaagtggaacgtacccagcaggaagtcgactcgcagagctattccagagtgaagttccatgacagcgcaagaaagatcaagcctaaaccacaggtccccccaggttttccgtccgcagaggaagcatacaatttcttcacttttaatttcgatcccgaacctgagggcagcgaggagaaacccaaagcgcgacatcgtgcagggacaaaccaagaggaagaggagggcgaggaagaagaacctcccgcacagggtggtgggaaggagatggacgaagaagaacttcttaacggcgatgatgcggaagacttccttctgggcctggatcacgtggccgacgatttcgtagccgttagacccgctgattacgagagcatccatgaccggcttcagatggagagggagatgctgtttattccatctaggcagaccgtgccaacttataaaaagctgcccgaaaacgttcagccgcgattcctcgaggacgagggcctgtacaccggagtcagacccgaggtggctaggacaaatcagaacatcatggagaatcggctacttatgcaggacccagagaggcggtggttcggcgacgacgggaggattctggctctacctaatccaataaagccattcccgtcaagacccccagtgctgacccaggagcaatccatcaaggccgaactagagaccctttacaaaaaagcggtgaagtatgtgcattcgtctcagcacgtgatccggtccggagatccacccggaaacttccagttggatattgatatcagcgggctgatattcactcaccacccttgtttctcaagggaacatgtgcttgccgctaaacttgctcagttgtatgatcagtatctggcaagacatcagcggaataaagctaaatttctgacagacaagcttcaggcccttcggaacgccgtgcagacaggactggaccctgagaagccccatcaaagcctggatacaattcagaaaaccatcaatgaatacaagagcgagattaggcagactcgcaaattccgcgacgctgagcaagaaaaggacagaaccctcctcaagacgatcattaaggtatggaaggaaatgaaatctcttcgcgaattccagaggtttactaacacacctctgaaactcgtgctcaggaaggaaaaggccgatcagaaggccgatgaagaggcttatgaggccgagatacaggccgagatttccgaattactagaggagcacacggaagaatacgctcagaaaatggaggaatatcgcacttccttgcaacagtggaaggcttggagaaaggtgcaatag

SEQ ID NO: 218769 - DNA, 336 bp, Artificial Sequence
  Description of Artificial Sequence: Synthetic coding sequence
atgaaccccagggaagaaaaggtgaagatcatcactgaagagttcattgaaaacgatgaggacgcggacatgggtcgccagaataaaaactccaaggtacgccgtcagcctaggaaaaagcagccacctactgccgtgccaaaagagatggtcagtgagaagagccacctcggaaaccctcaagagccggtacaggaggagcctaagacacggctcttgtctatgactgtcaggcggggacctaggcgcgagttggtcgtgaaaaagtccttaggcaggcccggaacggttacgcacgtgtgtaacccaagcactctggagggacggggtggttag

SEQ ID NO: 218770 - DNA, 882 bp, Artificial Sequence
  Description of Artificial Sequence: Synthetic coding sequence
atggccctggtcagtgctgattccagaattgccgaacttctgaccgaacttcaccagcttattaaacaaacccaggaggaaaggtcccgatccgagcacaacctggtcaacatacagaagacccatgaacggatgcagacggagaataagatatctccatactataggacaaagctcaggggactttatacaaccgccaaagcagacgccgaagcagaatgtaatattctaaggaaggctctggacaaaatcgccgagattaagtcgctgcttgaggagcggaggatcgctgccaaaatagctggcctgtataatgactcagaacctcctcgcaagaccatgcggagaggagtgctgatgacccttttgcagcagtccgccatgactctaccattgtggattggtaagccgggtgataagccaccacctctctgtggggcaattccagcgtctggtgattacgtggcgaggccaggagacaaggtcgcggcaagagtcaaagccgtggacggggacgagcagtggatcctggctgaagtggtctcctatagtcatgcaactaataaatacgaggtggacgatatcgacgaagaaggtaaggagagacacacactgtcccggaggagagttattcctctgccgcagtggaaggcgaaccctgaaacagacccagaggccctcttccagaaggaacaactggtgcttgccttgtatccccagactacatgtttttatagagctcttattcacgcacctccacagcgacctcaggatgactatagcgttctctttgaggacacaagctatgcagatggctactctccgccactaaacgtagcccagcggtacgtcgttgcttgcaaagagcccaagaagaagtag

SEQ ID NO: 218771 - DNA, 843 bp, Artificial Sequence
  Description of Artificial Sequence: Synthetic coding sequence
atgaatgacaggtcaagcagacgcagaaccatgaaagacgatgaaacatttgagatttctatccccttcgacgaggctccacacctggacccacaaattttctatagcctgagtccctccaggcggaactttgaagagccccctgaagccgcttcttcagccttggccttgatgaacagtgtaaagacgcagctgcacatggctctcgagcggaattcctggctgcaaaagaggatcgaagacctcgaagaggagcgcgatttcctgcggtgccagcttgacaagtttatcagttctgccaggatggaagcggaggaccactgcagaatgaagcctgggcctcggagaatggaaggcgatagccggggaggagccggaggagaggctagcgatccggaaagcgctgctagcagcctgagcggggcttccgaagaaggtagtgcctccgagcgcagaagacaaaaacaaaagggaggagccagcagacggaggttcggcaaacccaaggcacgcgagagacagagggttaaggacgctgacggggtcctttgcaggtataaaaagattcttggaaccttccagaagctgaagagcatgtctagggcctttgagcaccaccgcgttgatagaaacacagtggcactcaccactcctatagcggaactacttatcgtggccccagagaaactggctgaagtcggagagttcgatcccagcaaggaaaggttgctagagtattctaggcgctgttttctcgcacttgacgatgaaacgctcaaaaaggttcaggccctgaaaaagagtaaactcttgcttcccattacttataggttcaagcgctag

SEQ ID NO: 218772 - DNA, 495 bp, Artificial Sequence
  Description of Artificial Sequence: Synthetic coding sequence
atgatgctgacacaagcccctagtagcgtggtgcgatctaggaacagccgtaaccacaccgtgaactccgggggatcctgtcttagcgccagtacagtggctattcccgcaatcaacgactcatcagcagcaatgagcgcttgctctaccatcagcgctcagccagcttcctccatggatacacaaatgcactcccccaagaaacaggagagggttaacaagagggtgatttgggggatcgaggtggccgaagaattacactggaaggggtgggagctgggcaaagaaacaacccgtaatcttgtgttaaagaaccgcagtttaaaactgcaaaagatgaaatacagatatcagtacaaaggctctcgaacacagtgtcatagtctagagcccaggaaacaagcactcttcaaaacgaagcagaataaacagaaaaaaccgctaacctgtcatattaaggcaagcgaatgcttgaaatacgtgcaatatgagtag

SEQ ID NO: 218773 - DNA, 495 bp, Artificial Sequence
  Description of Artificial Sequence: Synthetic coding sequence
atgatgctaactcaggcacccagctctgtcgtccgcagtagaaattctaggaaccacactgtgaactccggtggcagttgtctgagtgctagcactgtggctattcctgccataaacgattcctcggcagccatgtccgcctgttctaccatcagcgcacagcccgcttccagtatggacacccaaatgcactcacctaaaaagcaggaacgcgtcaacaaaagagtcatctgggggatcgaggtcgcggaggagctgcactggaagggatgggaactgggcaaggagaccactaggaacctagtgctaaagaatagatccctcaaactccaaaagatgaaataccgttaccagtataaaggcagccgaactcagtgtcacagcctggagccgcgaaagcaggcgctgtttaagaccaagcagaacaagcagaaaaagcccctcacctgtcatatcaaggcctccgaatgcctgaagtacgtgcaatacgagtag

SEQ ID NO: 218774 - DNA, 5777 bp, Artificial Sequence
  Description of Artificial Sequence: Synthetic coding sequence
atgtttactttgacagggtgccgcttggtggagaagacccaaaaagtggagaatcctagtgtaagctttgcaagtagctttccattgatccctttactgctgaggggtaaaagtgttcagaaaaaacaggcagagtccaaaagccagattaagttgcacacgcagagtgccccattcggactctgccccaaggatatgatgctgacacaggcccctagttccgtcgtgaggagcagaaattcccgcaatcacacagttaattcaggaggttcgtgtcttagtgcgagtactgttgcaataccggcaattaacgacagtagcgccgcaatgagcgcttgttccaccataagcgctcaaccggctagttccatggacactcagatgcacagcccgaagaagcaggagcgggttaataagagggttatttgggggattgaggtcgccgaggagctccactggaaaggctgggaactggggaaggaaacgactcgtaatctggtgctgaagaaccgcagtcttaaactacagaaaatgaaataccggcctccaaagacgaaattcttcttcacagttattcctcagcctatcttcttgagtcctggaattactctgactctgcccatcgtgttcagaccccttgaggctaaagaatatatggaccagctatggtttgagaaggctgagggcatgttttgcgttgggctgagggcaactctcccttgtcaccgcttgatctgtcggccaccgtccctccagctgcccatgtgcgccgtaggcgacaccacggaagctttcttttgcctcgacaatgtaggggatctgcccacctttttcacctgggagttttcctcaccctttcagatgttgccagccactggcctgcttgagcctggccaggcgtcccagataaaagtcacctttcaaccccttaccgccgtcatctacgaggttcaggccacatgctggtacggcgcaggctctcgccagcggtccagtattcagctccaggccgtggcaaagtgcgctcagcttctggtttccattaaacacaagtgcccagaggatcaggacgcggagggtttccaaaaactgctgtatttcggcagtgtggcggttggatgcacctcagaacgccagataaggctgcataatccctcagctgtgaacgctccgtttcggatcgagatcagccccgatgagctggctgaggaccaagccttttcgtgccctactgctcacggaattgtcttgcccggtgagaaaaagtgtgtctcagtgtttttccatccaaaaactctggacactagaacagtcgactattgtagtattatgccatcggggtgtgcctcaaagaccttacttaaggtggtcggcttttgcagaggccctgcggtatccttgcagcactactgtgtgaatttctcgtgggtcaacctgggggaacgctccgagcagcccctgtggattgagaatcaatccgattgcaccgcccattttcagtttgccattgactgcctggagtctgtgttcacaattcgtccggcttttggtacattggtgggcaaggccagaatgaccttgcactgcgctttccaacccacccacccaatcatctgctttaggagagttgcgtgcctgatccaccaccaggaccctctgtttctggatctgatgggcacgtgccactctgatagcaccaaacctgccattttaaagccacaacatcttacctggtacaggacccatctggcacgagggctgactctgtaccccccagatatcttagatgctatgctgaaggaaaaaaagctggcccaggatcaaaatggggcactgatgatccctatccaggacctcgaagatatgccagccccacaatatccttatatccccccaatgaccgaatttttctttgatggcactagtgatattactatttttcctccacccatcagcgtcgaacctgtcgaggtggatttcggagcatgtcccggacctgaagcacctaatccagtgccattgtgcctgatgaaccatactaagggaaagataatggtagtgtggacaaggcgctccgactgcccattctgggtgacgccagagtcctgtgatgtccctcctttgaaaagcatggccatgagactccattttcagcctccccatcctaactgtttgtacaccgtggaactggaagcattcgcaatatataaggtgctccagagttactcaaatatcgaagaggactgtacaatgtgcccttcttggtgtttaactgtgagagctaggggacactcctattttgctgggttcgagcaccatattccccagtacagtcttgatgtccccaagttattcccagctgtgtcatcgggagagccaacatatcgctctcttttgctagtgaataaagattgcaagctcctgactttttccttggcccctcagcgcggaagcgacgtgattctgagaccaacttctggcctggtggcccctggcgctcatcagattatattaatttgcacatatcccgagggcagtagctggaagcagcacacattttatctgcagtgtaatgcatccccacagtaccttaaggaggtgagtatgtattcacgggaggaacccctgcaactgaagttagatactcataaatcgctatatttcaagcccacatgggttggatgctcatcaacgtcgccgtttacctttaggaacccctctcgcctcccccttcaatttgaatggcgagtcagtgaacagcaccgaaagctgctcgccgtgcagccatcacgaggacttattcagcccaacgagaggttgacactgacttggactttctcaccgttggaagagacgaagtatctcttccaagtgggcatgtgggtctgggaggccggactcagccctaatgcaaatccggctgctactacacattatatgctgcgactcgtgggcgtcggactgacctcctccctctccgcaaaggaaaaagagttggctttcggcaacgtgttagtaaattccaaacagagtcgattcctcgtcctgttgaacgatgggaactgcactctgtactatcgcttgtacctggagcaggggagccctgaggctgtggataaccaccctctcgctctccaattagaccgcaccgaagggtcaatgcctccacggagtcaagacactatctgcttgacagcgtgtcccaagcaacggtcccagtatagctggactatcacctactcactgctgtcccacagagacaataaggcaggggagaagcaggagctgtgctgtgtgagcctcgtagccgtttaccctctactctcaatactcgacgtgagtagcatgggctcagctgaggggattacccgtaagcacctgtggcgactttttagtctagacctgctgaactcttacctggaacgtgatcccaccccctgcgaattaacgtacaaggtacccacccgccatagcatgtcccagatccctcctgtactgacccccctgcgcctcgattttaacttcggggcagcaccttttaaagcccctccatctgtcgtgttcttggcattaaagaattcaggcgtggtctcattagattgggcttttttacttcctagtgaccagcgaatagatgtcgaactctgggcggaacaggccgagctgaattctaccgagctacaccagatgcgcgttcaggacaactgtctatttagcattagccccaaagctgggtcactgtccccagggcaggaacagatggtcgagttgaaatactctcacctgtttattggtactgaccacctgcccgtgctatttaaggtatctcatggacgtgagatcttactgaactttatcggggttaccgttaaaccggaacagaaatatgtgcactttactagcacaacccatcagttcattcccattcccatcggggacaccctccctccacggcagatatacgaactatacaatggaggaagtgtccccgtgacctacgaagtacagaccgatgtcctgagccaggtacaggaaaagaatttcgaccatccaattttttgctgtttgaaccccaaaggcgaaatacagcctgggtccacggctagagtcctttggatcttctccccgattgaggccaagacttataccgtcgatgtgcctatacatatactgggctggaactccgccctcatccactttcagggcgtggggtacaatccacatatgatgggggatacggctcccttccacaacatatcctcatgggacaatagctcgattcacagccgactcgtagtccccggacaaaatgtctttctgtctcaatcccatataagtcttgggaacatcccagtacaaagtaagtgttcacggctattgttccttaataatattagcaagaacgaggagatagcttttagctggcagccatcaccgctagatttcggcgaggtttctgtgtccccgatgatcggcgtagtggctcctgaggagaccgtacccttcgtggtaacactacgagcatccgtccatgcttccttctattcagcagatctggtgtgcaaactttactcccagcaattgatgagacagtatcacaaagaattgcaggaatggaaagatgaaaaggtgaggcaagaggttgaattcacaatcactgacatgaaggttaaaaaacgcacctgctgtactgcctgcgaacccgcacgcaagtacaagactctccctcccatcaaaaatcaacagtcagtttctcggcctgcatcctggaagctccagacacctaaggaagaggtttcctggccatgtcctcagccaccaagccccggaatgctctgtctgggactgacagccagagcacatgccacagattacttcttagcgaatttcttcagtgagttcccctgtcattttcttcacagagagcttcccaaaaggaaggcgcctcgagaggagagtgaaacatccgaggaaaaatccccaaataaatggggccctgtgtctaagcaaaaaaagcagctgctcgttgacatactcaccaccataattagaggactgctcgaggacaaaaattttcacgaggcggtggatcaatcactggtggaacaggtgccctattttagacagttctggaacgaacagtccacaaagttcatggaccagaagaacagtctatatctgatgcccatcttgccggtgcccagctcaagttgggaggacggcaaaggcaaacagcctaaggaggataggcctgagcactatcctgggctggggaaaaaagaggagggagaagaagaaaaaggggaagaagaggaagaggaactggaagaagaggaagaggaagaggaggagaccgaagaggaagagttgggaaaagaagagattgaggaaaaagaggaagagagagacgagaaggaagagaaagtctcatgggccggtatcggacctactccccaaccagagagccaagaaagcatgcagtggcaatggcaacaacagctcaatgtgatggtaaaggaagagcaggagcaggacgaaaaagaggctattaggcggctcccagcctttgcaaatctgcaggaagctttgttggaaaacatgattcagaatatcctagtggaggcatccaggggcgaggtagttcttaccagccggcctcgtgtgattgccctgccgccattctgcgtgccaagaagtctgaccccggatactcttctgcctactcagcaggcggaggttctgcaccctgtcgtgcctcttcctaccgatttgcctta

SEQ ID NO: 218775 - DNA, 2190 bp, Artificial Sequence
  Description of Artificial Sequence: Synthetic coding sequence
atgctgacacaagcccctagtagtgtggtacggagccgtaactcaaggaaccacactgttaacagtggcggatcttgtctgtccgcaagtacagtcgccatacctgccatcaacgatagcagcgctgctatgagcgcctgcagcaccatttccgcacagcccgctagttccatggacacacagatgcactcacccaaaaagcaggagcgtgttaacaagcgcgttatttgggggattgaagtggcagaagaactccactggaaggggtgggaactgggaaaagaaactacccggaacctggtgttaaagaatcggtccctcaagctgcagaagatgaaatacagacccccaaaaaccaagttcttctttacagttatcccacagcccatcttcctgagtccgggaatcactctgactctccccatcgttttccggcctctggaggctaaggaatacatggaccagctgtggtttgagaaggccgagggcatgttttgtgtgggcctgcgcgcaacactcccctgtcaccgcttaatctgtaggccacccagtctccagctgccaatgtgcgcggttggtgatacaacagaggccttcttctgtcttgacaatgtaggagacctaccgaccttcttcacctgggagtttagtagcccctttcagatgctgcccgctaccggactcctggaacccggacaggcgtcacagattaaggtcacattccagcccctgacagccgtcatctacgaagttcaagcgacgtgttggtacggcgcagggagccgacaaagatcctcaattcaattgcaagcagtggccaagtgcgcccagctgctcgtttctattaagcataaatgcccagaggatcaggatgccgaaggctttcagaaattgctgtacttcggctcagtcgccgtcggctgtacatcggagagacagatccgactgcataatcctagtgctgtgaacgcacccttcaggatcgaaatcagccctgacgaattggcagaagatcaagcctttagctgccctactgcccatgggatcgttttacctggcgagaaaaaatgtgtgagtgtttttttccatccaaaaacactagatacccgcacagttgattattgcagcatcatgccctccggctgcgccagcaagacactcctaaaagtcgttggcttttgccgcggaccagcagtgtcactccaacactattgtgtcaacttcagttgggtcaacctgggcgaaagaagcgaacagcctctgtggattgagaaccagagtgactgtaccgcccattttcagtttgcaatcgactgtctggagtcagtctttacaatccgacccgcttttggcacactggttggtaaagcaagaatgacactgcactgtgcctttcagcccacacacccaatcatatgtttccgtcgggtggcgtgtctcatccaccaccaagatcccctgtttctagatcttatgggcacatgtcatagcgactctacgaaacctgcaattctcaagccacagcaccttacatggtataggacccacctcgccagggggttgacactgtaccctcctgatatactggatgcaatgctaaaagagaaaaagctagctcaggatcagaacggggctctgatgatcccaatacaggacctcgaggacatgcctgctccccagtacccctacatccctccgatgaccgaatttttctttgatggtactagtgacatcaccatctttcctccacccatatccgtcgagcctgttgaagtggatttcggtgcttgccctggacctgaggcccctaaccccgttccactatgccttatgaatcataccaagggaaagataatggtggtgtggactcggcgttcggattgtcctttctgggtgaccccagagtcttgcgatgttccacctttgaaaagcatggctatgaggctgcactttcaaccgcctcaccctaattgcctctacacagttgaattggaggcgtttgccatttacaaagtgtgcgctaggaacgaacgagaggaatgcggggttagtgctaggagcctgagcggactcgtaggttggcaggaagtaacagagggctcttttcgcctccaccccctgcgggcacggctgtcactggggtggaccgttacaccgatgtcccttagtcctcctaaacttctggcgtag

SEQ ID NO: 218776 - DNA, 5777 bp, Artificial Sequence
  Description of Artificial Sequence: Synthetic coding sequence
atgttcacactcacgggttgtcggcttgttgaaaaaacccaaaaggttgagaatccaagtgtctcatttgcaagctcctttccgctgatcccgcttcttctcaggggcaagagcgtacagaaaaaacaggccgaaagtaagtcccagattaagctccacactcaatccgcccctttcgggctttgccccaaagacatgatgctgacacaggcaccgtccagcgtcgtgcggagccggaatagcaggaatcatacagtgaattcagggggttcgtgcctaagcgccagtacagtggctattcccgctatcaatgactcctcagcagccatgtccgcctgcagcacgatctctgcccagcctgcctcgagcatggatactcagatgcatagtccaaaaaagcaggagcgtgttaataagcgcgtcatatggggtatcgaggtggcggaagaactccattggaaaggttgggaattgggaaaggagactactcgcaacctggtactgaagaacaggtcactgaaactccagaaaatgaaataccgccctccgaaaactaagtttttcttcaccgtcattccccagccgattttcctgtctccaggaatcactttgaccttgcccatcgtgttcagacccctagaagccaaggagtacatggaccaactatggttcgagaaagccgaaggaatgttttgtgtaggcttgcgagctactctaccctgtcaccgattgatctgcaggcctccatcactgcagctgcctatgtgcgccgtcggagacaccaccgaggcctttttctgtctggataatgttggagaccttcctacattctttacgtgggagttctctagtccttttcagatgctccctgctacaggcttactcgagcctgggcaggcatcccagataaaggtgacattccagcctctgacagcggtaatctacgaggtccaggccacttgttggtatggtgccggatcccggcagcgatcaagcattcagttgcaggccgtggctaagtgcgctcagctgctcgtttctatcaagcacaaatgccccgaggaccaggatgccgagggctttcagaaactgttgtactttggaagtgttgctgtgggctgtacatctgagaggcaaatcagactccacaaccccagcgccgtcaacgcaccgttccgtatcgagatctcccccgatgagctggctgaagatcaagctttttcctgccctactgcccacgggatcgtactacctggtgaaaagaagtgtgtctctgtgttttttcatccaaaaacactggatacaagaacagtggattactgttcaattatgccaagtgggtgcgcttccaagactcttctgaaggtggtcgggttctgcaggggcccagcagtcagtctgcaacactactgcgtcaatttctcctgggtaaacctgggggagcgctctgagcagccactgtggatcgagaaccagtcagattgcaccgctcacttccagtttgctatagactgcctggagagtgtatttacaatccgccctgcttttggcactttggtcgggaaagcgagaatgaccttacattgcgcgttccagcccacccatcccattatttgctttcgccgtgtggcgtgtctgattcaccatcaggatccattgtttctggatttgatggggacatgccactcggattctacaaaacctgccatattaaagccacagcaccttacgtggtatagaacccacctggcgcgtgggctgactttgtaccccccagacattctagatgccatgctgaaggagaaaaagctggcccaggatcagaacggtgctctaatgattcctatccaggacctcgaagatatgccagcccctcagtatccctacattccccctatgaccgaattcttttttgatggcacgtccgacataacaatcttccccccacccattagcgtggaacctgtggaggtggactttggcgcttgccctggaccagaggcacctaatccagttcctttgtgtctcatgaaccatacgaaaggaaagatcatggtagtgtggacacgcagatctgattgtcccttttgggtcactccagagagctgcgacgtcccacccctgaaatctatggccatgcgcctccacttccagcccccacaccctaactgcctgtacaccgttgagttggaggccttcgcaatttacaaggtcctgcagagctattccaacattgaggaggattgcactatgtgtccatcatggtgcctgacggtcagggctcgaggtcactcctattttgccggatttgaacatcacatcccgcagtactcgttggacgttcccaagcttttccctgctgtatcgagtggcgagcccacctatcggagtcttctactcgtgaataaggattgtaagctgttaactttttcccttgctccccagcggggaagcgatgtcatactcagaccaactagtgggctagtggcgccaggtgcacatcagataatacttatatgtacatatcccgaagggtcgtcgtggaagcagcacactttttatctgcagtgcaacgcgtcaccgcagtacctcaaggaggtgagcatgtatagccgagaggagcctcttcaacttaagctcgatacgcacaaaagcctgtatttcaagcctacatgggtgggttgcagtagcacaagcccctttaccttccgcaaccccagccggttacccttgcagttcgaatggcgggtctctgagcaacatcgaaaattgctcgcggtccaaccaagtaggggactgatccagccaaacgagagattgaccttaacctggacattctcccctttggaggagacaaagtacttgtttcaagttggaatgtgggtgtgggaagccggtctttctccaaacgctaaccctgccgcaaccacacattatatgctccgactggtcggcgttgggttaacctctagtctatctgcaaaggagaaggagttggccttcgggaatgtgttggtgaatagcaaacagagccggtttttagtgctcctgaatgacgggaattgcactctgtattatcgcctttatctggagcaggggagccccgaggccgtggataatcaccctctcgcactgcagttagatcgcacagaaggatccatgccaccgagatctcaggataccatttgtctcaccgcatgtcccaagcagagaagccaatactcttggactatcacatatagcctgctgtcgcaccgagacaacaaggccggagaaaaacaggagctttgctgtgtttctcttgtggcagtgtatcctctcctctccattttggacgtgagctccatgggcagcgcagaaggaattacccggaaacacctttggcgccttttttctctggatctgctcaattcttatttagagagagacccgaccccgtgcgagctgacctataaggtaccgacccggcacagcatgtctcagataccccctgtgttgaccccattgagactggactttaattttggggctgccccattcaaggcacctccctccgtcgtgtttctcgcgctgaagaattctggcgtggtgtcccttgactgggcctttcttctccctagcgatcagagaatcgacgttgaattgtgggccgagcaggccgaactgaatagcaccgaattgcatcagatgcgagtgcaggataactgcctgtttagcatatctcccaaagccggtagcctctcacctggacaggagcaaatggtagaactgaaatactcccatctttttatcggcacagatcacctgcccgtcctattcaaagtaagtcacggacgggaaattcttctgaacttcattggagtcactgttaagcctgagcagaaatacgttcattttacgtctacaactcatcagtttattcccatcccgatcggcgatacacttccccctcggcagatttacgagttatataacggcggatccgtccccgtgacatacgaggtccagacagacgtcctgagccaggttcaggaaaagaatttcgatcacccaatcttttgttgcctgaacccaaaaggcgagattcagccgggtagcaccgcgagggtgctgtggatattcagcccaatagaggccaaaacctacaccgtggatgttcctatccatattctgggctggaatagcgctctgattcacttccagggggtcggatacaatccccatatgatgggcgataccgcgccatttcataacattagttcctgggataattcatccatccactctcggctggtagtgcctggacagaacgtgttcctctcccagagtcatatttcattgggcaatatacccgtgcaaagtaagtgctctaggttgctgttccttaacaacatctccaagaacgaggaaattgcattctcctggcagccctcacccctggatttcggggaagtgtctgtgtccccaatgatcggcgtggtcgctcccgaagagaccgtccccttcgtggtcactctgagagcttctgttcacgcaagtttttactctgccgacctggtgtgtaaactatacagccagcagctaatgcggcagtaccacaaagaactgcaggagtggaaggatgagaaggtgcgtcaggaagtggaattcaccataaccgatatgaaagtgaagaagcgaacgtgctgtaccgcttgtgaaccagcccgaaaatacaaaactctgccgccaatcaagaatcagcagtcagtgagcagaccagcttcttggaaactccagacaccaaaggaagaggtgtcgtggccatgcccccagcctccgtctcctggcatgttgtgtctgggccttactgctagggctcatgcgaccgactacttcctggccaacttcttcagcgagtttccttgccattttcttcatcgagaactgcccaagaggaaggccccaagagaggaatcggagacatccgaggagaaatcaccgaacaaatggggccctgtgagcaaacagaagaaacagctcctcgtagacatccttaccactatcattcgcggtctccttgaggataaaaatttccacgaggccgtcgaccagtctttggtggaacaagtgccatatttccggcaattctggaacgagcaaagcaccaaattcatggaccagaagaacagcctctacctcatgcccattctgccagtccccagtagctcttgggaagatgggaaagggaaacagcccaaagaagatagacccgaacattatccaggccttggaaaaaaggaggagggcgaggaagaaaagggagaagaagaagaagaggagctggaggaagaggaagaagaagaggaggaaacagaggaggaggagctgggaaaggaagagatcgaagaaaaagaggaagaacgagatgagaaggaagagaaagtgagttgggctggaattgggcctacaccgcaacctgagtcacaggagtccatgcagtggcaatggcagcagcaactgaatgtaatggtaaaagaagaacaggagcaggatgaaaaagaggccattcgtcggctaccagcttttgccaatctccaggaagctctgctggagaatatgatccagaacatcctcgttgaggcctctcggggagaggtggtcctcacgtcacgcccaagggtgatcgccctaccaccattttgcgtcccacgtagtctaacccccgacaccctgcttccaacccagcaggcagaagtcctgcatccagtggtgccgctaccaactgatctgccata

SEQ ID NO: 218777 - DNA, 5777 bp, Artificial Sequence
  Description of Artificial Sequence: Synthetic coding sequence
atgttcactctgactggttgccgactcgtcgagaaaactcaaaaggtagagaacccgtccgttagctttgcatccagcttcccactaattcccctgttattgcgtggaaagtcagtacagaagaagcaggccgagagcaaatcacaaatcaagctccatacacagtcagcaccctttggactctgccccaaggacatgatgcttacccaggccccatcttcagtcgtgcgcagcagaaactccagaaaccacactgtcaactccggcggatcctgcttgtccgctagtacagtcgcaatccctgcaattaacgattcctccgctgcgatgagtgcttgctccacaattagcgctcagcccgctagcagtatggacacacagatgcacagtcccaagaaacaggaaagggtgaataaaagggtcatttgggggattgaggtggctgaagagctccactggaaaggttgggaactcggcaaggaaaccacgcggaacctcgtgcttaaaaatagatccctgaagctgcagaagatgaaataccgccctccaaagactaaatttttcttcaccgtgatccctcagcctatcttcttgtcacccggaatcacgctgactctcccaatcgtatttcggccactcgaagcaaaggaatacatggatcagttgtggtttgagaaagccgaaggtatgttttgcgtgggcttgcgggctactcttccctgtcatcggttaatctgtaggccgccttctctacagttaccgatgtgcgccgttggagacaccacagaggcatttttttgtctcgataacgtcggcgatctacccaccttttttacctgggaatttagtagcccttttcagatgctgccagccaccgggctgctagagcccggacaggcttctcaaatcaaagtaacttttcagcccctcactgccgtgatatatgaagtccaggccacctgttggtacggagctggcagcaggcagagaagctcgatccagctacaggccgtggctaagtgtgcgcaattactggtgagcattaagcacaagtgtcctgaggaccaggatgcggaggggtttcagaaactcctgtattttggttctgtcgctgtgggatgcacttcagagagacagattaggttacataatccatctgctgtgaacgctccattcaggattgagatctctcctgatgaactagctgaagaccaggctttcagttgtccaactgcccacggtattgtgttgcccggtgagaaaaagtgtgtgtctgttttctttcacccaaagactctcgatacgcggacagtagattattgctcaatcatgccctctggttgtgcctccaagaccttactaaaggtggtgggattttgccggggtcctgccgtgtccctgcaacattactgcgtaaacttctcttgggtgaaccttggtgaaagaagtgaacaaccactgtggatcgagaaccagagcgactgcacagcacacttccagttcgcaatagactgccttgaatcggtgtttacaatccgcccagcttttggtaccctcgtgggcaaagccaggatgaccttacattgtgccttccagcccacgcaccctatcatctgcttcaggcgggtggcttgtttaatccaccatcaggaccccttgtttttggatctgatgggtacttgccatagcgactctacgaagcccgcaatcctaaagccccagcatcttacctggtacaggacacatctcgcccgaggactgacactatatcctccagatatcttggacgccatgttaaaagagaaaaagctggcacaggaccaaaacggcgctttgatgatccccattcaagacctagaggacatgcccgcacctcagtacccatatattccgcctatgaccgagtttttcttcgatggaacgtcagatatcaccatattcccccctccaatctctgtcgagccagtggaagtcgactttggcgcttgccccggacccgaagcccctaatcccgtccctctatgccttatgaatcacacaaaaggaaaaatcatggtggtctggactaggagaagcgactgtcctttctgggtcactccagagtcatgcgatgtgcctccactgaagtccatggcgatgagacttcattttcaaccacctcatcccaactgcctttataccgtggagctcgaggcctttgcaatctataaggtgctgcagtcgtactctaatatcgaagaagactgcaccatgtgcccatcttggtgcctgacggtgcgagcacgcggtcatagttactttgcgggtttcgaacaccacatacctcaatactcactggacgtgccaaagctgttcccagctgtttcgtcaggcgaaccaacttaccgaagcttgttgcttgtaaataaagactgtaaattgctgaccttttcactggcaccacagagagggtcagatgttattctcagacctacaagtggcctggtggcccctggagctcatcagattattctcatctgtacctacccagaaggaagttcctggaagcagcacaccttctacctccagtgcaacgcctctccacagtacctgaaagaggtcagtatgtacagtcgcgaagaacccctgcagctgaagttagatacgcataagtccctttatttcaaacccacttgggtgggttgctctagtacatcaccattcacgtttagaaatccgagcagactgcctctccagttcgagtggagggtgtcggagcaacaccgaaagctcctggctgttcaaccgtcgcgcggactgatacagccaaacgagcggctcactcttacatggacgttctctccactcgaagaaaccaaatatctgttccaggtgggtatgtgggtgtgggaagcaggcctcagccccaatgcaaacccagccgctaccactcattatatgctgcggttggtgggggtggggctcacctcgtcgctcagcgctaaagagaaagaactggcctttggcaatgtgttggtgaatagcaagcagtcgcgctttttagtcctgctgaacgatggaaattgtaccctgtattatcggctgtatttggaacagggatcacccgaggcagtcgataaccatccactggccttgcagctcgaccgaactgaggggtcaatgccccctcgcagtcaagataccatatgcttgactgcctgtcccaagcagcgttcccagtacagttggaccattacctacagcctgctctcccacagagataataaggcaggagagaagcaggaactttgttgtgtgagccttgtggccgtgtatcccctgctcagcatcctggatgtgagtagcatgggctctgccgagggcataacacggaagcacctatggcggctgttctcgctggacctcctcaattcctatttggagagggatcccacgccctgcgaactgacatacaaggtgcctacccgccactctatgtcccagatccctcctgtcctgactccgctgaggctagatttcaactttggtgctgccccattcaaggctccccctagcgtcgtgtttcttgctctgaagaattccggcgtagtttcgctagattgggcttttttattgccaagcgatcagcgcattgacgtggaattatgggcagaacaggccgaactcaactccaccgagctgcatcagatgcgcgtccaggacaactgcctcttctctatcagcccaaaggccggatccctgtcaccgggacaggaacagatggtcgaattgaaatactcacaccttttcatcggaacggaccacctgccagttctgtttaaggtgtcacacggtcgagagatcctcctgaatttcataggtgtgaccgtcaaacctgagcaaaagtacgtgcatttcacctctacaactcatcaatttattcctatacccattggcgacaccctgcccccacgtcaaatttacgagctctataacggcggaagcgtgcccgtcacatacgaggtgcaaaccgatgttctgtctcaggttcaggaaaagaactttgaccacccaatcttctgttgtctcaaccccaaaggcgaaatccagccgggatcaacagccagagtactgtggattttcagccctatcgaagcaaagacttacaccgtcgacgtgccaatccacattttggggtggaattcagcactgattcacttccagggagtgggatacaatccccacatgatgggggatactgcaccttttcacaatatcagctcttgggacaactcctctattcactctagactggtcgtgcccggtcagaacgtctttttaagccagagccatatcagcctgggcaacatcccagtccagagtaagtgcagtaggctgctgtttcttaacaatatctccaaaaacgaggaaatcgcttttagctggcagccatcaccgctagactttggagaggtatcagtttcacctatgatcggagttgttgcgcctgaggagactgttccttttgttgtgactctgagagccagtgtgcacgcttccttctactccgccgatctcgtgtgtaagctatactcccagcagttgatgcgccaatatcataaggaactgcaagagtggaaggacgagaaggtgagacaggaggtggagttcacaattacagatatgaaggtgaagaagcggacttgctgcacagcgtgtgagccagccagaaagtacaaaacgttgccccctatcaagaaccagcagtccgtctcccggccagcctcctggaaactgcagaccccaaaagaggaggtatcatggccctgtccacagcccccttcccccggaatgctgtgcttaggattgacggcgagagcccatgcaacagattactttctggccaattttttttcagaattcccatgccacttcctgcatcgagagctcccaaaacggaaggctccacgggaagaatccgagaccagtgaggaaaaatctcccaacaagtggggtccagtgtccaagcagaagaagcagctcttagtagatatcctcaccactattatccggggtctgctagaggacaaaaacttccacgaggccgtggatcagtcactggttgagcaggtgccgtattttcggcaattctggaatgaacagtctactaaatttatggaccagaagaattccctataccttatgcccattctgcccgttccctccagcagttgggaggacggcaaaggaaagcagcccaaggaggacaggcccgaacactaccccggtctcgggaagaaagaggagggcgaggaggagaaaggcgaggaggaagaggaagagctggaggaagaggaggaagaggaagaggagaccgaggaggaggaactgggaaaagaggagattgaagaaaaggaagaagaaagggatgagaaagaagaaaaggtgagctgggcgggtattggacccacacctcagccggaatcacaagaaagtatgcaatggcagtggcaacaacagttaaatgtaatggttaaagaagaacaggaacaggacgagaaggaagccatccgtagactgcccgcttttgccaacctccaggaagcactcctagagaacatgatccagaacatccttgtcgaggcatctcgcggtgaagtggtgcttacatctcgtcccagggtgatcgcattaccccctttttgcgtgccaagaagccttacacccgacacattacttccgacacaacaggccgaggtcctgcatcctgtggtgcctttacccactgacctgccata

SEQ ID NO: 218778 - DNA, 816 bp, Artificial Sequence
  Description of Artificial Sequence: Synthetic coding sequence
atgaccctacattgcgcatttcagcccactcaccccattatctgctttcgtagagtcgcttgccttatccatcaccaagacccactcttcctggatttaatgggcacttgtcactcagactctactaaaccagccattctgaaacctcagcacctaacatggtatagaacccatctggcacgtgggctgacgttatacccccctgatatactcgacgccatgttaaaagaaaagaagctggcccaggatcagaatggggctctcatgatccccatccaagacctagaggacatgcctgccccacagtatccatatatcccacctatgaccgagtttttctttgacggaacttctgatataacaattttcccaccacctatctctgtcgagccagttgaggtggatttcggtgcttgtcctggcccagaagccccaaacccagtgcctttgtgtctgatgaaccacaccaaaggcaagattatggtcgtgtggactaggcggtcagactgtccattttgggtcacccctgaaagctgtgacgttcccccattaaagagcatggcgatgcggttacattttcagcctccccacccaaattgcctttataccgtcgagcttgaggcctttgccatttataaagtgtgcgcaagaaatgagcgcgaagaatgtggggtcagcgccaggtctttatctgggctcgtaggctggcaggaagtcaccgaggggtcgttccggttgcatcctttacgggctagactgagccttggctggacggtgacacccatgagtctaagtccaccaaaactgctggcctag

SEQ ID NO: 218779 - DNA, 543 bp, Artificial Sequence
  Description of Artificial Sequence: Synthetic coding sequence
atggccgcactcgacctaagagcagaattggatagcctcgtgctccaattactgggggatttggaagagttagaaggcaaaaggaccgtgctcaacgccagagttgaggaagggtggctgtctctagcaaaggctagatacgccatgggcgctaagtctgtggggcctcttcagtatgctagtcacatggaacctcaggtgtgcctgcacgcctccgaggcccaggaaggtcttcagaaatttaaggtggtaagagccggagtacatgctcctgaagaggtgggcccacgcgaggccggactccggaggcgaaagggccctaccaaaacccctgaaccagagagctctgaagcccctcaggatcccctgaactggttcggcattttggtaccccattcattgcgtcaggcacaggcttcattcagagatgggctgcaactggcagctgacatcgctagcctccaaaataggatagactgggggaggtctcagctgcgcggtctgcaggagaagctgaagcagttggagcccggtgccgcttag

SEQ ID NO: 218780 - DNA, 567 bp, Artificial Sequence
  Description of Artificial Sequence: Synthetic coding sequence
atggggactcctcttgatggtgggagtcgggtccccatagggtgtcctgccaaactccgaagggtgacacgcaaaaaggttgcccctgacctcgaaggctggcttagtctcgccaaagctcgatacgccatgggcgcaaagtctgtgggcccacttcaatatgcctctcacatggaaccgcaggtgtgtctgcatgcctccgaagctcaggaagggttacagaagttcaaagttgttcgggctggcgtgcatgcccctgaggaggttgggccacgcgaagctggattacgccgaagaaaaggacccactaagacaccggagcccgaaagctctgaggctccccaggaccctctgaattggttcggaatcctggttccgcatagccttagacaagcccaggcctcctttcgggatggtgtgttagaagctaagaagaggaagtgctttctggagcgggtgatacagtgtgtagtgagccccgctgctgagcaggaagcagaggacgaatcttgccccgaggattgggccgctgccgtgccagccgaaacttcggccaaagctatctag

SEQ ID NO: 218781 - DNA, 855 bp, Artificial Sequence
  Description of Artificial Sequence: Synthetic coding sequence
atgtccgataacaaagaacgaaaatcccagggttttcccaaagaagacaatcaggatacatcaagcctggctgatgccgtcgagaaggttgcaaagcagcagcagagtcaggccagtgaaattgaaaagaataaaaaggtcctctttaatctgaagaatgagcttcacgagctggaaaaagagatcgccgctatcagcgccgagaccaaagaaacagaaagacagatctaccagcaggactccgccatagagaacactaaactgcattgtgacagtttagaaacacagattaagagccttcactctgagaacgtgaaactgaagtttgatattgagacagcccaggaagacttcgaagagcatatgattaaatacaacgcatactacgctaaaattaaggcacacaaaaactctctcggtgaggtcgagagcaaatggtcctttatgaccgaactgcacgagaagcgagacttcgttaaaaagctaaaaacgatgaaggaggagctgatgcaggacctgcagaacccgggtgggaaccggatcacacaggtccaggaggacatcactaatcttaaagacaagatcattactgtaaaggagagtattattgaaaagacttgcttcctggaggaagagaagaaaactcatgaaaagcttcgtaaagagatagaatctttggccccatctccccgtctggaatgctccagcgcgatctccgcacactgcaaactgtgtctgcctggatcacgacattcaccggcttcagctagtggggtggctggaactaccggcgcatgccaccatacacaattgattttttgcatttttagcagagacggcgtgtctccatgctag

SEQ ID NO: 218782 - DNA, 822 bp, Artificial Sequence
  Description of Artificial Sequence: Synthetic coding sequence
atgagcgacaataaggagcgtaagtcacagggcttccctaaagaggataatcaggacacttctagtttggctgacgctgtggagaaggtagccaaacaacagcagagtcaggcctcagagatagaaaaaaacaaaaaggtgttgttcaacctgaaaaacgagctccacgagctagagaaggagatcgctgcaatctccgcggagaccaaggaaaccgagagacagatttatcagcaggactcagcaatcgagaatacaaagctgcattgcgacagtctggagacccagattaagtctctgcactcggaaaatgtaaaactcaaatttgacattgagaccgcacaagaggactttgaggagcacatgattaagtacaacgcttactacgccaagataaaggcacacaagaactcgctgggcgaagtggagtctaaatggtcgtttatgaccgaactgcacgaaaagcgggattttgtcaagaaacttaagaccatgaaagaagagctgatgcaggatttgcagaacccaggaggcaatcgcatcacccaagtgcaggaggatatcaccaacttgaaagataagataattaccgtaaaggaatccattattgaaaagacgtgctttctcgaggaggagaagaaaacgcacgagaaactgagaaaggagattgaggtgcagcacaaaaggtacgatgcaattctgaaaaggctccactgccaggttaacaagctacaatctaatcgacggcagtggcagtggaatattcagcagctggagaagaccgcagccgaactccgaaaatgcatcggcatgcaagaatag

SEQ ID NO: 218783 - DNA, 1536 bp, Artificial Sequence
  Description of Artificial Sequence: Synthetic coding sequence
atgtctaaagtcgctcgaagttccagcgaatcagatgtccagctgtgggagactgaggaagacgacatgacagagggggacctgggctatggcctgggaagaaagccgggaggaatttacgaaatcgagttcagccaccggtcccggaagcgaagtgacggtaagaattttagcccacccccatttccccgaaaaggcgaggagcgtaacgaggcatcatttcagtattccaagcacaaatctcagcaagacacattccctcaggtcagcaggatcagcaactacaggaggcagagttcaactgttgactccaatagtgagctgtccaacgaggagcttaggcagtgcttaaatgagacactcgaagaagtggagatgttgaagacagaattggaggcaagtcagcgccagttgaggggtaaggaagaggccttgaagattctgcagtcaatggccatcctgggaaaggctactagccatacccaggctgttttgcagaaaacaatggagcaaaatcggtctctggagaaggagatcaacgcattacagtgggaaatagagttcgatcataatcgatttaagaatatcgaggaaagttggatccagaagtacgatcggctgaactgtgaaaacgcagtcctgaaggagaacttgaaggtgaagaccgaagaaataaagatgttgaagtccgacaacgcggtactgaatcaacgctacctcgaggcattggcaatgctggacataaagcagcagaaaatggcccaggagaatatgtgttgcgacaagagcggctttgctgaggcaagtggtctcgaactggccgtgttgggcgcatgcctgtgccatgggcctgggggtaatccttgtagttgtgctcgtatggcagccagcaccaggaaactcctgttgcagctgaaacaggagctggagattctgcaaaaaagtaaagaagaggcctacgtgatggccgatgcctttcgtattgcgttcgagcagcagctcatgcggaagaatgaccaggccctccagttgacccagatggacaaaatgcacaagaaggctacaaagtggatgaactggaaacacttgaaggaagatggctttccatccccgaggagtaagaaaacgttcggtcagagactcctgggtatgctgccttcagaaaatagctctaaacgtatggaagaccaggattccccacaggaagtcctgaaaatgctcatcgatctcttgaacgacaaagaagaggccctggcccaccagcgaaaggtatcctacatgctggctcgggctcttgaggataaggacacagccagcaatgagaataaggagaaaaatcctattaaggagaacttcccatttaataacccttggagaaaaactagcgagttttccgttctcggggaccccattcatagctccgtatgtattctaaattccgttggatgcatttgcagtatccagcattcccagattgaccccaactacagaactctcaagcgctcccactcattgcccagctcaatcattttctag

SEQ ID NO: 218784 - DNA, 1536 bp, Artificial Sequence
  Description of Artificial Sequence: Synthetic coding sequence
atgtctaaggtggcaagatctagctcagagagcgatgtccagctgtgggaaactgaagaggatgatatgaccgaaggagacctgggatacggtctgggccgaaagccgggaggcatctatgaaatcgaattttctcacaggtcacggaaacggtcagacggtaagaatttctcccctccgccttttcccaggaagggcgaagagcgtaacgaggcctctttccagtacagcaagcacaaatcgcaacaagatacattcccccaagtcagccgtattagcaattacagacgtcagtcctcgactgtggactcgaacagtgaactctctaacgaagagctgaggcaatgcttgaatgaaacactggaggaggtagagatgctaaagacagaactagaggctagtcaaagacaattgaggggcaaggaggaagcactcaaaatcctgcagtccatggcaatacttggaaaagccaccagccacacccaggctgtcctgcagaagaccatggagcagaataggtccttggaaaaggaaatcaatgctttacagtgggaaattgagttcgaccacaacagattcaaaaacattgaggagagctggattcaaaaatacgacagactgaactgcgagaatgccgtcctgaaagaaaacttaaaagtaaagaccgaagagattaaaatgctcaagagcgacaacgccgtgttaaaccagaggtacttggaagccctggctatgctagacatcaagcagcagaagatggcacaggagaacatgtgttgtgataagtcaggcttcgccgaggcctcaggcttagaacttgcagtcctgggtgcctgtctatgccatggcccaggtggtaacccatgcagttgtgccaggatggcggcttcaactagaaagctgttgctgcaactcaagcaggagctcgaaatactgcaaaagagtaaggaagaggcttacgtcatggccgatgctttcaggatcgcctttgagcagcagttgatgcgaaagaatgatcaggccctccagttgacccaaatggacaagatgcataagaaggccacaaagtggatgaactggaagcacctgaaagaagacggatttccctctccacggtctaaaaagacctttggccaaaggctgttggggatgctgccctcagagaattcaagcaaaaggatggaagatcaggattcacctcaggaagtcctgaagatgttgattgacctccttaacgataaagaggaagccctcgcgcaccaaagaaaagtttcatacatgctcgcccgagccctggaagataaagacaccgcttccaatgagaataaagaaaaaaatcccatcaaggagaactttccctttaacaacccctggaggaagacgagtgagttcagtgtattgggcgatccaatccacagttcggtatgtattctgaactctgtgggctgcatctgctctatccagcacagccagatcgatcccaattatcgcactctgaaaaggtcccattctttaccctcttccattatcttctag

SEQ ID NO: 218785 - DNA, 1161 bp, Artificial Sequence
  Description of Artificial Sequence: Synthetic coding sequence
atgctcaagacggaactggaggcatcacagaggcagctgcggggaaaggaagaggccctaaaaatcctccaaagcatggccatcctgggtaaagctactagccatacacaggccgtactccagaaaaccatggagcagaacaggtcactggaaaaagaaataaatgctttgcagtgggaaatagagtttgatcacaataggttcaaaaacatcgaggaatcctggatacagaagtacgaccggctgaactgtgagaatgccgtattaaaagagaatctgaaagtcaagaccgaggagattaagatgctaaagtcagataacgccgtactgaatcagcggtatttagaggccctggcaatgttagacataaaacagcagaagatggcccaggaaaatatgtgctgcgacaagtcaggctttgctgaggcgtctggcctagagctggcagtgttgggggcttgtctgtgtcacgggccaggaggcaatccatgttcctgcgcaagaatggccgcatcgactaggaagctcctgttgcaactgaaacaagagctggagatcctgcagaagagcaaagaggaagcctatgtaatggccgacgccttcaggatcgctttcgagcaacaactgatgagaaagaacgaccaggctctgcagctgacccagatggataagatgcacaaaaaggctaccaaatggatgaactggaagcacttaaaagaggatggctttccttctcccagatctaaaaagaccttcggccagcggcttctgggcatgcttccaagcgaaaattcatctaagagaatggaagatcaggacagtccccaagaggtgcttaagatgttgatcgatctcttgaatgataaggaggaggcgcttgcccaccagcggaaggtctcctacatgttagcccgtgctctggaggacaaagataccgccagcaacgagaacaaggaaaagaatccaatcaaagagaacttccccttcaacaatccttggaggaagacctccgagttctctgttctgggtgacccaattcactcttccgtatgtattctcaacagcgtcggctgtatctgctccatccagcattcccagatcgaccctaactaccggaccctcaagcggagccacagcctgccttcttccataatcttctag

SEQ ID NO: 218786 - DNA, 3465 bp, Artificial Sequence
  Description of Artificial Sequence: Synthetic coding sequence
atgcaggctatggagggagaggtcttactccccgcattgtacgaagaagaagaagaagaggaagaagaggaggaggaggtcgaggaagaggaagagcaagtgcagaagggtgggagcgttggcagcctgtctgtgaataaacacagaggcctgtccctgactgagacagaactagaagaacttcgagcacaggttcttcagctcgtcgctgagctcgaggagaccagggagcttgctgggcagcacgaagatgattccctcgaactgcagggcctcttggaggatgaacgcctcgcgtctgctcaacaggcggaggtcttcactaaacagattcaacagctacagggcgagctgcgctcccttcgtgaagagatttcgctgctggagcacgagaaagagtccgaactgaaggaaatcgaacaggaattacacctagcacaggctgagattcagtctctgaggcaggctgctgaggactctgccacggaacatgagtcagacatcgcaagtctacaagaggacctttgccgcatgcagaatgagctggaggatatggaaaggatccgtggggattatgaaatggaaatagcgagcttgcgggcagaaatggaaatgaagtcttcggagccgtcaggctctttggggcttagcgactactcaggccttcaagaggaattgcaggagttgcgggagcgttaccatttccttaacgaggaatatcgtgccctacaggagtcgaatagctccctgacaggacagcttgcagacctggaaagcgaacgcacacagcgcgcaacggaaaggtggctacagagccagacgctgagcatgacttctgccgagtcccaaacaagcgagatggattttttagagcctgaccccgagatgcagctcctgcggcaacagttgagggacgcagaggaacagatgcacggcatgaaaaacaagtgccaagagctgtgctgcgaactggaggagctccagcaccatcgccaggtctcagaggaggaacagcgaagacttcagagggagctgaagtgtgcccaaaatgaagtattacgtttccagacaagccattccgtgacccagaacgaggaacttaaaagccggctttgcaccctgcagaagaaatacgatacttctcaggacgaacagaacgaactcttgaagatgcagctgcagctacagacagaacttcgacagctgaaggtcatgaaaagcactctggttgagaaccagtctgaaaaagagcttctgtgtcgtttgcagaaactgcaccttcaacaccagaatgtgacatgcgaaaaggaaaaactgctggaaagacaacagcagcttcaggaggagctacagtgccatgaggccgagctgcagcacctgagggatacggttgcctctttcaaggaatcaaatgagaaggacacagagacgcatgctcaactacaggagatgaagcagctttaccaggcatccaaagacgagctcgagagacagaaacatatgtatgatcagctggagcaggatctgctcctgtgccagctcgagctcaaggagctgaaggcctctcatcccatccctgaggataaaggcaagtgcgcgaataaatgtgataccctgctgagccgcttgacggaactgcaggaaaagtacaaagcatctcagaaagaaatgggccagttacagatggaacagtgcgaattactggaggatcagcgacggatgcaggaggaacaggggcaactccaggaggaattgcacaggttgactctgcctctgcctaagagcggcctgctgctgaagagtcaggagctgctgaccaaactggaagatctgtgcgagttacagctgctgtatcagggcatgcaggaggaacagaaaaagctgatccaaaatcaggattgcgttctcaaggaacagctcgaaatccacgaggaactgcggaggttcaaggagtcgcatttccaggaggtgctggagaatccagacgattcaaaattagcgaaatcttcaaagtgcaatcgtaacaagcagtccaaattactcatggagcagatgcaagccttgcaggtaatgtatgacgctgggcaggccaaacaagagctactccagcaggaacagggaaggcttctcgaagagaggaaaagattgcaggccgacttgcaactctgtctggaagagatgcaattgctgcaggtgcagagtccaagtatcaagatgtcattggaatcatacggtaaaagttacggttcaatggtccctagtaatgaaaactgcagaaagacatacgacactacggttgatgacaacgaatcctactacaaatcctatacgagcactcaaactagctctaaatctttcttgaagtcgtacgattccagcacatctgcatccgaggcgtacggcaaaagctattgtactacctccaattcctcgatcacatacaagaagagttacgggagcacgtcctcaagtgatacttgccaaaaatcttttgtctctagttgtactgatgaggaaccagctgagccagaggacatggagcgcttcgaggaaatggtcgtaaaagtcttgatcaagctacaggcagtgcaggcaatgtaccagatatctcaggaagaacatagccagctccaggaacaaatggagaaactattggctaagcaaaaagacctgaaagaggagcttgacgcttgtgagcgagagttcaaggagtgtatggagtgtcttgaaaaacccatggcgcctcaaaacgataaaaacgagattaaagaactccagaccaagctccgcgaactacaattgcagtaccaggccagtatggatgaacagggccgactcctggtggttcaagagcagcttgaagggcagctccaatgttgccaggaagaattgcgccagcttcgggagaagagacccagcgtggtcaaggaagcgaggggcaagaatgcgaacaaaaacatgaataagaatgcaaacggcgtaaagatgaaaaaagtgactaagccctgttctgacaccagtgagtctgatctggagacaaggaagagcctcgaagttgtgctatactacaaggcctcacaaagaaaactggatgggttagccaaggaagaagagaagaaagaggaaatggaagaggaaaagaaacaggtcaaagaagaagccaaggaacagtgcggagacgaattggtcgcggagcccgcagatcctgaagaggctaagtcaactgaagatcaggaggaaaatgaagaggataaggaagaagaagaaaaagaggaagactctgaggaagaggaagatgacgcggattcatctctggagagccctgaggagaacaatcccctcagactctcggaaagtaagaagtccagtcctaccccaaatcctcctatcttttcattgccattggttgggcttgtggttattagtgctctactgtggtgctggtgggctgaaacaagctcttag

SEQ ID NO: 218787 - DNA, 2874 bp, Artificial Sequence
  Description of Artificial Sequence: Synthetic coding sequence
ctcagagcccttgaaggcgaggtgctcttgcccgcattatatgaggaggaggaagaggaggaggaagaagaggaggaagtggaagaggaggaggagcaggtacaaaaaggcggaagtgtcggaagcctatcggttaataagcaccggggactgtcactgaccgaaacagaactggaagaactccgggcacaggtactgcagcttgttgcagagttagaggaaacccgtgagcttgctggccagcacgaagatgatagcctagaactccaagggctgctggaggatgagaggctggcctctgcccagcaggcagaggtcttcaccaaacagattcagcagctgcagggagagttacgatcgctgcgtgaggagataagtcttctggagcatgaaaaagagagcgagctgaaggaaatagaacaagaattacacctggcacaggctgagattcaatctctgcgtcaggccgcagaagactcagcaacagagcacgagtccgatatcgcgtctctgcaggaagacctctgccgcatgcagaatgaactggaggacatggaaaggatccgaggagactacgagatggaaatagccagtctgagggctgaaatggagatgaaatcctcagaacctagcgggagcctaggcctctctgactacagtgggctccaggaagagctgcaggagctccgcgagagatatcattttctcaatgaggaatatcgcgcactgcaggaaagcaatagctccctaactggccaactggccgatttggaaagtgagcgcacccagcgggctactgagcggtggttgcaatctcaaacgctgtccatgactagcgctgaatcgcagacatctgagatggactttctcgaacctgatccagaaatgcagctgctgaggcagcagcttcgggacgcagaagagcagatgcatgggatgaagaacaagtgccaggaactttgttgcgaactggaagagctccagcatcatcggcaggttagcgaagaagagcagaggaggctacagcgtgagctgaagtgcgcacaaaacgaagtgttacggttccagactagccactctgtgacccagaatgaagagctgaaaagtaggctttgcacccttcagaagaagtatgatacatcccaggatgagcagaatgagctcctgaagatgcagctgcagctgcagactgagcttcggcagcttaaagttatgaagagtactctcgtggagaaccaatcagagaaggaattgctatgtaggttgcagaagttgcacctccagcatcagaacgtcacatgtgaaaaggaaaaactcctagaaaggcagcagcagctgcaggaggaacttcaatgccacgaagctgaacttcagcatcttcgagacacagttgccagtttcaaggagtcaaatgagaaggacaccgagacccatgctcagctgcaggagatgaagcagctctaccaggccagcaaggacgaattggagcgccagaaacatatgtatgatcagctcgagcaagatttgcttctttgccaacttgaattgaaagagctgaaagcatcccatcccatcccggaagacaaggggaagtgcgctaacaagtgtgataccctgctgagtcggctcacagaactgcaagagaaatataaggccagccaaaaggagatgggtcagctccagatggaacagtgtgaactgcttgaggaccaaaggcgaatgcaggaagagcagggccagctgcaggaggagctccatcgacttacacttccactccccaaatcgggcctgctgctgaaatcccaggagttgttgacaaagttggaggatctttgcgagctgcagctgctgtaccagggaatgcaagaggaacaaaaaaagcttatccagaaccaggactgtgtgctcaaggaacagcttgagatccatgaagagctgcggagattcaaagagtcacacttccaggaggtgctggagaaccccgacgatagcaagctcgccaaaagctccaagtgtaatcggaacaagcagagcaaactcttgatggagcagatgcaggcactgcaggtgatgtatgacgccggacaagccaagcaggaactgctgcagcaggagcagggcagactcctggaagagagaaaaaggctgcaggccgacctgcagctttgtctggaagaaatgcagctgctgcaggtacagtctccttcgatcaaaatgtcacttgaatcatatggcaaatcttatgggagcatggtcccttctaacgagaattgcaggaagacatacgatacaactgtagatgacaatgaatcctactataagagctatacgtccactcagacctcatctaagagtttcctgaagtcctacgactcctctacgagcgcctccgaggcttacggcaaatcctattgtaccacctcaaattccagcattacctataaaaagtcatacggatctacctcttcttccgatacatgtcagaaaagcttcgtgagcagctgtaccgacgaggaacctgccgagccagaagatatggagagatttgaggagatggtggtcaaggtcctaatcaagctgcaggctgtgcaggccatgtatcagatctcccaagaggagcactcacagttgcaggaacagatggagaaactgctcgccaagcaaaaggatctcaaggaagagcttgacgcctgcgaacgggagttcaaagaatgtatggaatgtttggaaaaacctatggccccacagaacgacaagaatgagaacatgtttggcctgtggaagccgatggtgtttttggctattgccgcagtggcactatacgttctgccaaacatgagacagcaggagagcgaattctgtttgatggagtag

SEQ ID NO: 218788 - DNA, 1305 bp, Artificial Sequence
  Description of Artificial Sequence: Synthetic coding sequence
atggaggccggagcaggcgcaggggcaggcgcagccggttggtcatgcccagggcctgggccaaccgtgaccacactcggatcctacgaggccagcgagggctgtgaacgcaagaaagggcagaggtggggctccctcgagagacgcggaatgcaggcgatggaaggtgaggtcctgctccccgcactgtatgaagaggaggaggaagaagaggaagaagaagaagaggtcgaagaggaggaggagcaggtacagaagggaggatccgtgggctccctatccgtgaacaagcaccgtgggctgtccctaactgaaactgagctggaggaattgagagcccaggtgctacagctcgtggcagagcttgaagaaaccagagagcttgctggacagcatgaagacgacagcctggagctgcaggggctcctcgaagacgagcgcttagccagcgcacagcaggctgaagtgtttacaaagcagattcagcagctgcagggcgagctcaggagtctcagagaggagatctctttgttggaacacgaaaaggaatctgagctgaaagaaatcgagcaagaactgcacttggcacaggccgaaatacagagtctgagacaggccgcagaagattctgccactgaacacgaaagtgatatcgcctcactccaggaggacctgtgccgcatgcagaacgagctggaagacatggaaagaattcggggagattacgagatggaaatcgcatccttgcgggctgagatggagatgaagagctctgagccctcggaggaacttcaggaattgagagaacgttatcacttccttaatgaagaataccgagccctgcaggaatccaattccagtctcaccggacagctggcggacttggagagtgaaagaacacagagggccaccgagagatggttgcaatcgcaaacattatccatgacaagcgccgagagtcagacatcggagatggacttcctggaacccgatcccgaaatgcagctcctgcggcagcagctgagagacgctgaagaacaaatgcatggaatgaaaaacaagtgtcaggaattatgttgcgaactcgaggaactgcaacatcacagacaggtatctgaagaggaacagcgcaggctgcagcgggaactgaaatgcgcccagaatgaggttctcaggttccagacctcacacagtgtaacacagagcagccccactcccaacccaccaatctttagcctacccctagtgggcctggtggtaatctccgcactgctctggtgttggtgggccgagacatcctcatag

SEQ ID NO: 218789 - DNA, 3474 bp, Artificial Sequence
  Description of Artificial Sequence: Synthetic coding sequence
ctacgcgcacttgagggggaggtgctgctgcccgctctttacgaggaagaggaagaggaggaagaggaagaagaggaggtggaggaggaggaagagcaggtccagaagggaggaagcgtgggttctttatcagttaataaacatagaggtttatctcttactgagaccgaactggaggaactgagggcgcaggtgcttcagttggttgccgagcttgaggaaacccgggagctggccggacagcacgaagacgactccctcgagttacagggactgctagaggatgaaagactggcttcagctcagcaagccgaagtgtttactaaacagattcagcagctacaaggcgagttaaggagtctacgagaggagatctctcttcttgagcatgaaaaggagagcgagctaaaagagattgagcaggagctccacctcgcgcaggcagagatacagtcactacggcaggcagctgaggacagcgcaacagagcacgaatctgacatcgctagtctacaggaggacctctgccgcatgcagaacgagctggaggacatggaacgtattcgcggagattatgagatggagatagccagtttgagagccgagatggagatgaaatcttcggagcccagcgggagcctgggtttatccgattatagtggactgcaggaggagcttcaggaacttcgagagcgataccactttctgaatgaagagtaccgagctctgcaggaatccaatagctctctcactggacagctcgcagatcttgagtcggaacgaacccagcgagcaaccgagaggtggttgcagtcacaaactcttagcatgactagcgcagagagtcaaactagtgagatggattttttggaaccagatccagagatgcagctcctgagacagcagctgcgcgatgccgaagagcagatgcatggtatgaaaaacaaatgccaggagttatgttgcgagttggaggagctccagcaccaccggcaggtgtcggaagaggaacagcgccgtctgcagcgagagcttaaatgcgcccagaatgaggtgctgcgcttccagacttcgcactccgtaactcagaatgaggaactgaagtcgaggttgtgcactttacagaaaaagtacgacaccagccaggacgagcaaaatgagctcctaaaaatgcagctgcagctccaaacggagctaaggcaactaaaggtgatgaaatctacgctggtggaaaaccagtctgaaaaagaactgctctgtagactccagaagttgcaccttcaacaccagaacgttacatgcgaaaaagagaagcttcttgagcgccaacagcagctccaggaggaactgcagtgtcatgaagcggagcttcaacatctgagggacaccgtagcgagctttaaggaaagcaacgaaaaggacacagaaactcatgcgcaactgcaggagatgaagcagctgtaccaagcatctaaagatgaattggagcgacagaaacacatgtacgatcaactcgagcaggatctcctgctctgtcagctggagttgaaagaactgaaagcatctcaccccatccccgaggataaaggcaagtgcgcaaacaaatgcgatactttgctatctcgcttgacagaacttcaggagaaatataaggcctcccagaaggagatgggacagctccagatggaacagtgtgaactgctggaggaccaacgcaggatgcaggaggagcaaggccagctgcaggaggagttacacagactgactctgccactgccgaagtctggtctgctgctgaagtcacaggagcttctgactaaactcgaagacctctgtgaacttcagcttctgtaccaaggcatgcaagaagagcagaagaaactgatccagaaccaggactgtgtactcaaagagcaactagagatccatgaggaactgagaagattcaaggaatctcatttccaggaggttcttgagaacccggacgattccaaactggcgaagagtagtaagtgcaatcgaaacaagcagagcaaactcctcatggagcagatgcaggcactccaggtaatgtacgacgctggacaggccaagcaagaactcctacagcaggagcagggccgactgctcgaggagcgcaagcgtttacaagccgacctccagctgtgccttgaggagatgcagctgcttcaggtccagagtccttcaattaaaatgagcctcgaatcttatggcaaaagctatggctccatggtgcctagcaacgagaattgtagaaagacatacgacaccacagtggacgacaacgagtcttactacaagtcttatacctccacccagacatcaagcaaatcttttctcaaatcatacgacagctccacttcggcttctgaagcctatggaaagtcctactgtacgaccagtaactcatccatcacatacaagaaatcgtatggctccacatccagctccgacacttgccagaagagctttgtgtcaagttgtaccgacgaggaacccgctgaacccgaggatatggagcggtttgaagagatggtggtgaaggtactgatcaagctccaggcggtgcaggcgatgtaccagatctcccaagaagagcacagccagcttcaggagcagatggagaaactgttggctaagcagaaggatttgaaagaagagctcgatgcgtgtgaacgagaatttaaagagtgtatggagtgccttgaaaagcctatggctccccaaaatgataagaatgagatcaaggagctgcagaccaaactgagagagttacaactgcagtatcaagcatcaatggacgagcaggggcgtctgctggtcgtacaagagcaactggaaggacagctgcaatgctgccaggaagagttacgccagctcagggaaaagcggccatcagtggtcaaggaagcgagaggaaagaacgcaaacaaaaacatgaataaaaacgctaacggcgttaagatgaagaaagtgacaaagccctgctctgatacttccgaatcggatctggagacccggaaatcattggaggttgtgctgtactataaggctagccagcggaagcttgatggtctggcaaaagaggaagagaaaaaagaagagatggaggaggaaaaaaaacaggtgaaggaagaagctaaagaacagtgcggcgacgagctggtcgccgaaccagcggaccccgaagaagccaaaagcacagaggaccaggaggagaacgaagaagacaaggaagaggaagagaaagaagaggattccgaggaggaggaggacgacgccgatagctctttagagtcacctgaggaaaataaccctctgaggctcagcgagagcaagaaaaacatgtttgggttgtggaagccaatggtctttctagctatcgcagcagttgcactgtatgtgcttccgaatatgcgccaacaagaatcagagttttgtctgatggaatag

SEQ ID NO: 218790 - DNA, 309 bp, Artificial Sequence
  Description of Artificial Sequence: Synthetic coding sequence
atgcaagctatggagggcgaggttctgctcccggcactgtatgaggaggaggaggaggaggaagaagaggaggaagaagtggaagaagaagaggagcaagtccagaaagggggttccgtcgggtcactctctgttaataagcatcgaggattgtcactgactgagaccgaattggaagagttaagggcccaggtgttgcaattggttgctgagctggaggagacaagagaactggcaggtcaacacgaggacgactcactggaactccagggtctgctcgaggatgagagactagcctctgctcagtag

SEQ ID NO: 218791 - DNA, 1341 bp, Artificial Sequence
  Description of Artificial Sequence: Synthetic coding sequence
atggaggccggagctggcgcaggagcaggagctgctggttggtcttgtcccggtcccggacctacagtgaccacactgggcagttatgaggcctccgaagggtgtgagcggaaaaaagggcaaagatgggggtctcttgagcgccgaggcatgcaggcaatggagggggaggtgctgctgccagcgctctatgaagaggaagaggaagaagaagaggaggaagaggaagtggaagaggaagaggagcaggttcagaaagggggttctgtgggctctttgtccgtcaacaagcaccgtgggctttctctgacagaaaccgagttagaggaactgagagcacaggtcttgcagctcgtggccgaacttgaagaaactagggagttagctggccagcacgaggacgattccctcgagctccagggactgttggaagatgaacgtctcgcctctgcacagcaggccgaagtgtttactaagcagatccagcaactgcaaggcgagctgcgatccctacgtgaggagattagtttactggagcacgaaaaagaatctgagcttaaggagatcgaacaggagctacacctggcgcaagccgaaatccaatccctgcggcaggccgcagaggattccgctactgagcatgagtcagatatcgcctcacttcaggaggacctctgccgaatgcagaacgaactcgaggacatggagaggattcgtggcgattacgagatggaaattgcgagcctgagggcagaaatggagatgaagtccagtgaacccagtgggagtttaggcctttcagactactccgggctacaggaagagctgcaggagctgagagaaaggtaccacttccttaatgaggagtacagagctttacaggagtctaactctagcctcactggtcagttagcggatctcgaaagtgagagaacccaacgtgccacagagcgttggttgcagtcgcagactctttctatgacatccgctgaatcacagacaagcgaaatggacttcctggagcccgaccctgaaatgcagctgctgagacagcagctgagggacgctgaggagcagatgcacggcatgaagaataaatgccaagagctatgctgcgagttagaggagctccagcatcatcggcaggtcagtgaagaggagcaaaggcgtctacagcgggaacttaagtgtgcccagaacgaagtgcttagatttcagacgtcgcacagcgtcacgcagtctagccccactcccaacccccctatttttagcctccctctggttgggttggtggtaatttctgccctactctggtgctggtgggcggaaaccagcagttag

SEQ ID NO: 218792 - DNA, 21 bp, Artificial Sequence
  Description of Artificial Sequence: Synthetic coding sequence
atgcaggctatggaagggtag

SEQ ID NO: 218793 - DNA, 414 bp, Artificial Sequence
  Description of Artificial Sequence: Synthetic coding sequence
atgcaggcaatggagggtgaagtcctgttacccgctctatacgaagaagaggaggaagaagaagaggaggaggaagaggtcgaggaagaagaagaacaggtgcagaaggggggtagcgtggggtccctatccgtgaacaaacatagaggattgagcctgaccgagacggagctggaggagctccgtgcccaggtccttcagttagtggccgagctggaagaaacccgggaactggctggacaacatgaggacgacagtttagaactacaaggcttacttgaggatgagcggctggccagtgcccagcaagctgaggtgtttactaaacagattcagcagctgcagggagagctgcgctctctacgggaggaaatttcactcctggaacatgaaaaggagagcgaattgaaatag

SEQ ID NO: 218794 - DNA, 192 bp, Artificial Sequence
  Description of Artificial Sequence: Synthetic coding sequence
atgcaggccatggaaggggaagtgttgctgccagcgctgtacgaagaagaggaggaggaagaagaggaggaagaggaggtggaagaagaggaagagcaggtccaaaagggagggagcgtcggatctcttagcgtcaataagcaccggggactgtcacttacggagacggaactggaggagctgagggcctag

SEQ ID NO: 218795 - DNA, 870 bp, Artificial Sequence
  Description of Artificial Sequence: Synthetic coding sequence
atggccggagcgggaagaggagctgccgtctcccgggttcaagccggacccggatctcctcggcgagcaaggggaaggcagcaagtgcagccgctcggaaaacaaaggcctgcaccatggccaggacttaggtcaaaagagaagaagaaggttaactgtaagcctaaaaaccaggacgagcaggagataccattccgactgagagaaatcatgagatcccgtcaggagatgaagaatcccattagcaacaagaaaagaaaaaaggcagcccaagtgacctttcgcaagactctggagaaagaggccaagggggaggagcctgatattgccgtgcccaaattcaaacaacgcaagggagaaagcgatggtgcttatatccaccggatgcaacaagaggcccagcatgtgttattcctgtcgaagaatcaggccatcaggcagccagaggtgcaggctgcccctaaagagaaatccgagcagaagaaggccaaaaaagcttttcagaagaggcggctcgataaggtgcggagaaagaaagaagaaaaggccgctgacaggctggagcaagagctactgcgtgacaccgttaagttcggtgaggtggtgcttcaaccccctgaactcacagccagaccacagcgtagtgtcagtaaggaccaaccaggaaggagaagtcagatgctacgcatgctactcagtcccggaggtgtgtcccagcctcttactgcaagtttggcaagacaacggattgttgaggaggagagagagagggctgttcaggcctatagagccctgaaacaaaggcagcagcagctgcatggtgaacggcctcatcttactagccgaaagaagcccgagcctcagctttag

SEQ ID NO: 218796 - DNA, 1656 bp, Artificial Sequence
  Description of Artificial Sequence: Synthetic coding sequence
atgcctctgagcaccgccggaatcttgagctctagtagcgcagctagtaatcgctcgagaaacaaggccaggtataggacaaaggccgtaagtagcgaggtggacgaatccctctttggcgacataaagtccccagcgcagggacagtctgacagccccatcgtgctgttaagagacaagcacacactgcagaaaactctcaccgcactaggattagaccggaagccggagacaattcagcttatcacaagggacatggtgagagagttgatcgtgcccacagaggacccttcaggagaaagtctgattatctcacctgaggaatttgagagaatcaagtgggcctcccacgtcctaactcgggaagagttggaagcccgtgatcaagccttcaagaaggagaaggaggcaaccatggacgctgtgatgaccagaaaaaagataatgaagcagaaggagatggtttggaacaacaacaagaaactgagcgacctggaggaagttgcgaaagaacgcgcacagaacctgctccagcgagctaataagctgaggatggaacaggaagaggaactgaaggacatgtctaagattatcctgaacgcgaagtgtcatgccattagagacgcccaaatcctggagaaacagcagattcaaaaggaactggacacagaggagaagcgcctcgaccagatgatggaggtggagcgtcagaagtctatccagcgtcaggaagagcttgagaggaagcggagagaggaaagaattagaggcaggcgacagatagtggagcagatggagaaaaaccaagaagaacgcagcctgctggccgagcagcgggagcaggagaaagagcagatgctggagtacatggaacaactccaggaagaggacctcaaagacatggagcgacgtcagcagcaaaaactgaaaatgcaggcagagatcaagaggattaatgacgaaaaccagaagcagaaagcagaattgctcgctcaggagaagttagctgatcagatggttatggagttcacaaaaaaaaagatggctagggaggccgaatttgaggcggagcaggaacggatccggagagaaaaggagaaagaaatcgcgagactcagggctatgcaggagaaggcccaggattaccaggcagagcaagatgccctgagagccaagcgaaatcaggaggttgccgatagggaatggagacgaaaggaaaaggagaacgcgcgaaaaaagatggagactgaagcagagctccggaaaagtcgcctcgagcaagtcgcattcaaggagcacgcactcgctgtccaggttcagagggatcgggatgagtttgaacggatccttagggctcagagggaacagatcgaaaaggaaagactcgaagaagagaaaaaagctacagggaggttgcagcacgccaacgagctgcgcaggcaagtaagggaaaaccagcaaaaagaagttcagaaccggattgccacatttgaagagggtcggcgactgaaagaagaggcacagaagagaagggagagaatcgacgagatcaagcgcaaaaaacttgaagagctgcgcgctaccggcttgcctgagaagtactgtatcgaggccgaaagaaaggcaaacattctgccagcaactagtgtgaattag

SEQ ID NO: 218797 - DNA, 1401 bp, Artificial Sequence
  Description of Artificial Sequence: Synthetic coding sequence
atggtgcgggaactcattgtgcctacagaggatccaagtggagaatcactgataatttcccctgaggaatttgaacgaattaaatgggcctctcacgtattgacccgcgaggagttagaagcaagagaccaggcattcaaaaaagaaaaggaagctactatggacgccgtcatgacacgcaagaagatcatgaagcagaaggaaatggtgtggaataataataaaaagttgtccgacctggaagaggtcgctaaggagcgagcacagaatctactgcagagggcaaacaaactgcgtatggagcaagaggaagaactgaaagacatgtccaagattatactgaacgccaagtgtcacgctatcagagatgcccagatattggagaaacagcagatacagaaggagttagacaccgaggaaaaacggctggaccaaatgatggaagtagagaggcaaaaatccattcagcgacaagaggagctggaacggaaacgacgagaagagcgcatcagaggcaggcgccagattgtggagcagatggagaagaaccaggaagagagaagcctcctcgctgaacagcgagaacaggagaaggagcagatgttggagtacatggagcagctccaggaagaggatctgaaggacatggaacgcaggcaacaacagaaactgaaaatgcaggctgaaatcaagcgaatcaatgacgagaatcaaaagcagaaggcagagctgctggctcaggagaagctcgctgaccaaatggtgatggaatttactaagaaaaagatggccagagaggctgagttcgaggccgagcaggagcggatcaggcgcgaaaaggagaaggaaattgctcgactacgggcaatgcaggagaaagcacaggactatcaagccgagcaggacgcactgcgagccaaaagaaatcaggaagtggccgaccgggagtggagaagaaaggagaaagaaaacgctcggaaaaagatggagactgaagctgaactgaggaaatcgagactggagcaggtggcttttaaggagcacgctctggccgttcaggtgcagagagacagagacgaattcgagagaattctgagagctcagagagaacagatcgagaaagagcggctcgaggaagaaaagaaggccactggtcggctccagcacgcaaacgaactaaggcgacaagtcagagagaaccaacagaaagaggtccagaatcgcatcgcgacttttgaggagggacgcaggttaaaggaagaagcgcaaaaacggagagaacgtattgatgagatcaagagaaagaagctggaagagctgagagctacaggcctgcccgagaaatactgtatcgaagctgagagaaaggctaacatactaccagccacttcagtcaattag

SEQ ID NO: 218798 - DNA, 1884 bp, Artificial Sequence
  Description of Artificial Sequence: Synthetic coding sequence
atggaggaggcagataggattctaatccactctctgagacaagcgggaactgccgtcccccctgatgtgcagacattgcgcgcattcaccacagagctggtcgtggaggcagtagtaagatgtctgagagtgatcaaccccgcagttggaagcggactctcacctttactccctctagctatgagtgctagattccggctggcaatgtctcttgcgcaagcctgcatggacctgggataccccctggaactcggctaccaaaatttcctgtatccgtcagagccggatctgcgggacctgctcctgttcttggcggaaagactgcctaccgacgcctcggaagatgctgaccagcccgcaggcgattctgcaatcctgttgagagcaatcgggtcccagattagagaccagctggctctcccctgggtgcccccacatctgagaacccccaagctccagcatcttcaagggtcagccttgcagaagccatttcacgcctctagacttgtggtcccagaactgtcaagccggggagagcctcgcgaattccaggcctctcccttgttactgcctgtgcccactcaggtgccccagcccgttggacgggtggccagtctactagaacaccacgctcttcagctgtgtcagcaaacgggcagggacaggccgggagatgaagactgggtgcatcgaacctctaggctgccgcctcaagaagacacccgtgcccagcgccaaaggctgcaaaaacagctgaccgaacacctgaggcagtcatggggcctgctcggcgctcccattcaggccagggacctcggcgaactgctgcaagcctggggagcaggcgctaagacaggcgcacctaaaggctctcgttttactcactccgaaaagtttactttccacttagagcctcaggcccaggcaacccaggtatctgacgtgccagccacctcccggaggcctgaacaggtgacctgggcagcacaagagcaagaacttgaatccctccgcgaacagcttgaaggcgtaaatcgcagtatcgaggaagttgaagctgacatgaaaactcttggggttagcttcgtgcaagctgaaagcgagtgccgccacagcaaattatcaactgcagagagggaacaagcactgcgactcaagtcccgggcagtcgaactgctacctgacgggacggccaacctggctaaactgcagctcgtggtggagaacagtgcccagcgcgtgatacacctggctggacagtgggagaagcaccgtgttcccctgctagcagaatacagacacctgcggaaactccaggattgtcgggagctcgaatcctcgaggaggctggccgaaattcaggagctccaccagtccgtgagagctgctgccgaggaagccaggagaaaagaggaggtatacaagcagctaatgtctgagctcgagacacttccaagagacgtgtctcgactagcctatacccagcgcatcttagagatcgtcggtaacatacggaagcagaaggaagaaattaccaagattctctctgacacaaaggagttgcaaaaagagattaattctctgagcggcaaactggacaggaccttcgctgttaccgatgagttagtctttaaagacgccaagaaagatgatgcagttcgcaaagcatataaatatctggctgctctccacgagaactgttcacagctcatccaaaccattgaagacacagggaccataatgagggaagtaagagatctggaagaacaaatagagacagagctgggaaagaagaccctcagcaatctagagaagatccgcgaggactaccgcgcactccgccaggagaatgcagggttgctcggacgagtgagggaagcgtag

SEQ ID NO: 218799 - DNA, 1743 bp, Artificial Sequence
  Description of Artificial Sequence: Synthetic coding sequence
atggaagaggccgacaggattctgatccactccctgaggcaggcgggaacagctgtgccacccgatgttcagaccctgcgagcctttacgacggagctcgtcgtggaagccgtggttcgttgtctgagggtgataaatccggctgtaggtagcggactgagcccattgttgccattggccatgagcgccaggttccgcctcgcgatgtccctagcacaagcctgcatggatctggggtatccactggagctcggttaccagaatttcctctatccatctgaacctgacctccgcgatctgttgctcttcctggctgagaggctaccaactgatgctagcgaagacgccgaccagccagccggtgattccgccatcctactccgcgctataggtagccagatccgggaccaactagctctgccatgggtgccccctcacctccgcacgcctaagttgcagcacctgcagggctccgcgctgcagaagccttttcatgcctcccggctcgttgttcccgagctctcatccagaggagagcctagggaatttcaggcctcccccttgttactgccagtaccgacacaggtaccccagcccgtggggcgtgtggccagtttacttgaacaccacgcactccagttgtgtcaacagacaggaagagatcgcccaggggacgaagactgggtccatcgtacgtcccggttgccgccacaggaggacacaagggcgcaacgccagcggttacaaaagcagcttaccgagcatctgaggcaaagttggggcctattgggtgcgcctatccaagctcgcgacctgggagaactgcttcaggcctggggcgcaggcgcaaagactggcgctccaaagggctcccgctttacccactcggaaaaatttacctttcatctcgaacctcaggcccaggccacccaggtctctgatgtccccgcaacctctaggagacccgagcaggtgacttgggcagcccaagagcaagagttggagtcactgcgggagcaactggaaggagtaaatcgctcgatcgaggaggtggaagcagatatgaaaacattaggggtgtcatttgttcaagcggaaagtgaatgtcgccactccaagctgtcgacagcggaacgcgaacaggctttacggctcaaatcccgtgctgtcgaattactgcccgatgggactgcgaatctcgccaagctgcagttggttgttgagaatagcgctcagcgggttatccacctggccggacagtgggagaaacatcgggtaccactgctcgccgagtatcgccacctgcgcaaactgcaggattgtcgggaattggagagcagtagacgcctggcagaaattcaggagctacatcaatcagttagagccgctgctgaggaggccaggcgcaaagaggaagtgtataagcagcttatgtccgaattggaaacccttcccagggacgtgtctaggcttgcatacacccagcgaatcctcgaaattgtcggcaacatcaggaagcagaaagaggagattaccaaaatcctcagtgacacgaaagagctccagaaggagattaacagcttaagcggcaagttggatagaactttcgccgtgacagatgaactggtttttaaggacgctaaaaaagacgatgcagtgcggaaggcgtacaaatatttagctgccttgcatttcatcggcgatggcacagtgggatggggtccctggattccaaacaagtag

SEQ ID NO: 218800 - DNA, 603 bp, Artificial Sequence
  Description of Artificial Sequence: Synthetic coding sequence
atggatgacaagaagaagaaacgttctccaaagccttgcctggctcagcctgcacaggctccagggacgttgcgcagggttcccgtgcccaccagccactcaggctcacttgccctgggcctgccccacttaccctccccaaagcaaagggccaaatttaaacgcgtgggcaaagaaaagtgtcgccctgtattagcaggtggaggctcaggttccgccggaacccctttgcaacactcatttctgaccgaggtgactgatgtgtacgaaatggagggaggtctcctcaacctgctaaatgactttcatagtgggcgactccaagctttcggcaaggaatgttccttcgaacagctggagcatgtccgcgagatgcaggagaaactggccagactacatttctctctggatgtgtgtggagaggaggaggatgatgaggaggaagaggacggcgtgactgagggcttacccgaggaacagaagaagactatggctgatagaaatcttgaccagctgctctcaaatctggaggatttgagcaattccattcaaaagctccaccttgccgaaaacgccgaaccagaggagcaatctgcagcttag

SEQ ID NO: 218801 - DNA, 690 bp, Artificial Sequence
  Description of Artificial Sequence: Synthetic coding sequence
atgtgggctgccggtagatggggtcccacctttcctagctcctatgccggatttagcgctgactgcaggcccagaagccgtccttctagcgactcttgcagcgtgcccatgactggtgcacggggacagggactggaagtggtccgatctccgtccccccctcttcccctcagctgttcaaattcaacccgctccttgctgagccctctagggcatcagagtttccagtttgacgaggatgacggagacggggaagatgaagaggatgtagatgacgaggaggacgtggacgaggatgcgcatgacagtgaagcaaaagttgcaagtcttagaggaatggagctgcagggctgcgcatcaactcaggttgagtccgagaacaatcaggaggaacagaaacaagtacgactgccagagtctcgtttgactccttgggaagtatggtttatcggaaaagagaaggaggagagagacagactccagcttaaggccttggaggagctgaatcagcagctagagaaacgcaaagaaatggaggagcgggagaagcgcaaaattattgccgaagagaaacacaaggaatgggtccagaaaaaaaatgaacaggtgagaagggggaagtggattcacacccttactagcttattacagaatatcagttcttattatacttcactgccgagattttag

SEQ ID NO: 218802 - DNA, 1122 bp, Artificial Sequence
  Description of Artificial Sequence: Synthetic coding sequence
atgtgggccgctggaagatggggtcccaccttcccatcctcctacgctggattctctgccgattgcagacccaggtccagaccatcaagcgatagctgtagtgtacctatgaccggagctcgtggacagggcctcgaggtggtccgctccccctctccccctcttccattatcttgttctaactcaacacggagcctgttgtccccactggggcaccaatctttccaattcgatgaggatgatggcgacggagaagacgaagaggatgtggacgacgaggaggatgtcgacgaggatgcgcacgactccgaggcgaaagttgcctcactccggggaatggagctccaaggctgtgcaagtacccaggtggaatcagagaacaatcaagaggagcagaagcaggtgcgactgcccgaatcaagactcaccccctgggaggtctggttcattggcaaagagaaggaggaacgggaccgtctgcagctgaaagcccttgaagagctaaaccagcaactggagaagaggaaagagatggaggagcgcgagaaaaggaagatcattgcagaggagaaacacaaggagtgggtgcagaaaaaaaatgaacaaaaacgcaaagaacgcgagcaaaagattaacaaggagatggaggaaaaggccgcaaaagagctggaaaaggaataccttcaggaaaaagccaaagagaaataccaagagtggctgaaaaaaaagaacgctgaggaatgtgaaaggaagaaaaaggaaaaagagaaggagaaacagcaacaggctgagatccaggagaagaaggaaatagctgagaagaagttccaggaatggctcgagaatgctaaacataaacccagacccgctgccaaatcctacggctacgctaacggtaaactgactggcttctacagcgggaatagctaccccgagccagctttttacaatcccataccttggaagcctattcatatgcctcctccaaaagaggcgaaagacctctccgggagaaaatcgaaacggccagtcatatctcagcctcacaagagttcgtcactcgtgattcataaggccaggagcaacttgtgcctcgggactctctgtaggatccagcggtag

SEQ ID NO: 218803 - DNA, 2268 bp, Artificial Sequence
  Description of Artificial Sequence: Synthetic coding sequence
atggagtacatctttcccaacaccggagtcctgtggagctggttaatcaacattctgtgcaatagacgcatcgtctggtttacgagtagccagcttcccaggggaccgccagccagttcagggggacactcgtttcacactctgcgggaacgcagcgagagtcggttgttcgtcgagtcttacgccgcagcctggcagcctcccggaacatcgggcggagcctcttgttgtagcagcctgtccgcccaggtgatgtcatctgaatttctggctgaactccactgggaggacggatttgctattcccgttgcaaatgaagagaacaagctcctagaggaccaactatccaaattaaaggatgagagagctagcctgcaagatgagctgcgggaatatgaggaaaggattaactcaatgacctctcattttaagaatgtgaaacaggagctctctattacccagtcgctctgcaaagctcgagaacgggagacagaatctgaagaacattttaaggccatcgcccagcgcgagctgggaagggtgaaagatgaaattcagcgcttggagaacgagatggcctctatcctggagaagaagtccgacaaggagaacgggatcttcaaggccacgcaaaagttggacggcctcaaatgccaaatgaactgggaccagcaggccctggaggcctggttagaggagagtgcccataaggactccgacgccctgacacttcaaaagtacgcacagcaggatgacaacaaaatccgggcactgaccctccaactggaacggctaacactggaatgcaaccaaaagcgaaaaatccttgacaacgagcttaccgagactatcagcgcccagctcgagctggacaaggcagctcaggattttcgcaaaattcacaatgagcggcaagaacttataaaacagtgggagaataccatagagcagatgcagaagagggatggcgacatcgacaactgcgccctcgagctagctcggataaagcaagaaacacgcgagaaggaaaacctggtgaaagaaaaaattaagttcctagaatcagaaatcggtaataacacagagtttgaaaagaggatctcagtcgcagaccgcaaactgttaaaatgtcgtacggcctatcaggatcatgagacatcacggattcagctgaagggcgaactcgattccctgaaggctactgtgaaccggacatcctccgaccttgaagcccttcgcaagaacataagtaaaatcaagaaggacatacatgaagagactgcaaggctgcagaagaccaaaaaccacaatgagattattcagaccaagctaaaagagatcactgagaaaaccatgagtgttgaagaaaaggcaacgaatctggaagatatgctgaaggaggaggagaaagatgttaaggaggtagatgtgcaactcaatctcatcaagggtgtacttttcaagaaggcacaagaactgcaaaccgagaccatgaaggagaaggcagtcctgtccgagattgaaggaacccggtccagcctgaagcatctcaatcatcagttgcagaaattggactttgagacactgaagcagcaggagattatgtactcccaggatttccacatccagcaggtggagcggaggatgtcccggctgaagggcgagatcaacagcgaggaaaaacaggccctcgaagctaaaatagtggagctgaggaagagtttagaagaaaagaagtctacatgtggccttctggagacacaaatcaagaaactgcataacgatttgtacttcattaagaaagcccattccaagaactccgatgaaaagcagtctttgatgactaaaattaacgaactgaatctcttcatagacagaagcgagaaagagcttgacaaggccaagggatttaagcaggaccttatgattgaggacaaccttctgaagcttgaggtaaaacgtacccgcgagatgttacattctaaggccgaagaagtcctcagcttggaaaagcggaagcagcagttgtataccgctatggaggagcggaccgaggagatcaaggtgcataaaaccatgttggcctctcaaatacggtacgtggatcaggagcgggaaaatattagcacagaattccgcgagcgtctttcgaagatagagaaactgaagaatcggtacgagattcttacagtagtgatgctgccaccagagggggaggaagaaaagacacaagcttactatgtaatcaaggtcatgtctatgtcctag

SEQ ID NO: 218804 - DNA, 2826 bp, Artificial Sequence
  Description of Artificial Sequence: Synthetic coding sequence
atgagctccgagttcctcgccgaattacattgggaggatggatttgccattcccgtggccaacgaagagaataaacttctagaggaccagctctctaagctgaaggacgagcgcgcatcgcttcaggatgaactacgtgaatacgaggagagaattaactcgatgacgtcacacttcaagaacgtgaaacaagagctctctattacacagtcactttgtaaggcacgggaacgagagacggagagtgaagaacacttcaaagccatcgctcagcgcgaactgggtcgggtcaaggacgagattcaaagactggagaacgagatggcctctattctggagaaaaagtcagacaaagaaaacggtatcttcaaggccactcagaagctcgacgggctcaaatgtcagatgaattgggatcaacaggctctggaggcctggctggaggaatccgcccataaggacagtgacgccctgacgctccagaaatatgctcaacaagacgataataagatacgggctttaacattgcagctggagcgcctgacgttggagtgcaaccagaaaaggaagatcctcgacaatgaactcacagaaaccatctctgcacagttggagcttgacaaagccgcacaggattttcggaaaattcataacgaaagacaggagctgatcaaacaatgggaaaatactatcgagcagatgcagaaaagggacggagatatagacaactgcgccctggaacttgctcgcataaagcaagagacacgcgaaaaagaaaacctagtgaaggaaaagataaagttcctggagagcgagataggtaataacaccgaattcgaaaagcgaatttctgtggctgatcgtaaactcctgaaatgtcggaccgcctaccaagaccacgagacctcacgcatccagctcaaaggcgaactcgacagcctgaaagccacagttaatcgcacttctagcgaccttgaagccctccggaagaatatcagcaagattaaaaaagacatccacgaggagaccgctaggttacagaagacgaagaaccacaatgagatcattcagacaaagctgaaggaaataactgaaaagaccatgtcagtggaggagaaagctaccaatctggaggatatgctgaaggaagaggagaaggatgtgaaggaggtcgatgtccagttgaacctgatcaaaggtgtgctgtttaagaaggcccaggaactccagaccgaaaccatgaaggagaaagcagtgctctcggagatcgaggggactaggagtagcctcaaacaccttaaccaccagcttcaaaagcttgactttgaaactctgaagcagcaggagatcatgtattctcaggatttccacatccaacaggtcgagaggcgcatgtctcgcttaaaaggggaaatcaattccgaagagaagcaagcactcgaggccaaaatagtcgagttgcgtaagagcctagaggagaagaagtcgacgtgcgggctcttggagacccaaatcaagaaacttcataacgatctctattttatcaagaaagcccattccaagaactccgacgagaagcagtccctgatgaccaagattaatgagctcaacctgttcattgataggtcagagaaagagctggacaaagctaagggttttaagcaagatctgatgatcgaggataaccttctgaaactcgaggtaaaaagaactagagaaatgctccactctaaagcagaggaagtgctttcactggaaaaacggaaacaacagttgtacacagccatggaggagcgtacagaggaaataaaggttcacaagactatgctagcttcccagatacgatatgtggaccaggagcgcgagaacatcagcactgaatttagggagcgcttgagcaaaatcgaaaaactgaaaaatcggtacgaaatactcacagtggtgatgctaccacctgaaggagaagaagaaaagactcaggcttattacgtgatcaaggccgcacaagagaaggaggaactgcagcgggagggggattgtctggatgccaagatcaataaagcggagaaggaaatctacgccctagagaacacgctgcaagtactgaactcatgtaataacaattataagcagtcctttaagaaagtcacaccgtcttccgacgaatacgagctgaagattcagcttgaagagcaaaagcgggctgtggatgagaaatatcgatataaacagcgacaaatacgtgagttacaggaggatattcagtcgatggagaacacattagatgtcatcgagcacctggctaacaacgtgaaagagaagctaagcgagaagcaagcttacagtttccagctctctaaggaaacggaggagcaaaagcccaaattggaacgagtaaccaaacagtgtgctaagttaaccaaggagattaggttactgaaggacaccaaggacgagactatggaggagcaggacattaagctgagggagatgaagcaattccacaaagttatcgatgaaatgctcgtcgacatcatcgaggagaataccgaaatacggatcattttgcagacttactttcaacagagcggtttggagttgccaacagcatccacaaaaggaagcaggcaatcaagccggagtccatcacacacctctctatcagctcggagctcaaggtcgacgtctacatccacaagtcagtcctctatcaaagtcctcgagctgaaatttcctgcgtccagttccctggtgggatccccatctagaccatctagtgctagttcaagctcgagcaatgtgaaaagtaaaaaaagttctaaatag

SEQ ID NO: 218805 - DNA, 1740 bp, Artificial Sequence
  Description of Artificial Sequence: Synthetic coding sequence
atggccgagcccggtggcgcagctggtcgaagccatcctgaggatgggtccgcttctgagggcgaaaaggaaggaaataacgagagtcacatggtctcccccccagaaaaggacgatgggcagaagggtgaagaagccgttggttcaacagaacatcccgaagaggtgaccacgcaagctgaagccgctattgaggaaggagaagtagagacagagggtgaagcggctgtagaaggtgaggaggaggctgtctcttacggagacgctgagtccgaggaagagtattactacacagagacttccagcccagaaggccagatctcagccgctgataccacgtacccctacttttcaccccctcaggaactacctggggaggaagcttatgatagtgtgtccggggaggccggtctgcaaggatttcaacaggaggctactgggccacccgaatcccgcgagagacgcgtgacaagccccgagccctcacacggagtactgggaccatccgaacaaatggggcaggtgacttcaggaccggcagtaggacgcctgaccggcagcactgaagagcctcaggggcaggtgctgccaatgggcgtgcaacaccggttccggttgtcacacggtagcgacattgaaagctcagacctggaagaattcgtatcccaggagcctgtgatcccccctggagttcccgatgcccaccccagagaaggggaccttcccgtcttccaggatcagattcagcaaccttcgacggaggaaggcgctatggccgaaagggtggaaagtgagggctccgacgaagaggccgaagacgaaggcagtcagctggtggtcttagaccccgaccatccactcatggtacggttccaggcagcccttaagaactatcttaacaggcagatcgagaagctgaaactggaccttcaggaactcgtagttgctacaaaacagtcaagagcacagaggcaggagttaggggtcaacctctacgaggtgcaacagcacttggtgcatctgcagaagctgttggagaaaagccacgacaggcacgctatggccagctctgaacggcgtcaaaaagaggaggagctgcaggccgcaagggccctctacaccaagacatgcgccgcagcaaatgaagagcgaaaaaagcttgcggctcttcagaccgagatggagaacttagcactgcacctcttctacatgcagaacatcgaccaggacatgcgtgatgacatccgagtcatgacgcaggtggtcaaaaaagcagaaaccgaacgcatccgggcagaaatcgaaaagaagaagcaggatctctacgtggatcagctcacaactcgcgctcagcaattggaagaggacatcgcactttttgaagcacagtatctcgctcaggcagaagatactaggattctcagaaaggccgtcagcgaggcgtgcacagaaatagatgcaatctccgtggagaaaagaaggatcatgcaacaatgggcgagctcactcgtggggatgaagcatcgcgacgaggcccaccgcgctgtgcttgaggcattaagtgtgagtctcgaaaggtttcctagtcaaaatattaatacagctagaagtcgcttgtcaaccacatggcactctgctggcattctgttacggggttctttcctgcccggagcttctagagccttcgcctctgtgtgttatgggggagcggctgtggataaccgcatccgggagtgctag

SEQ ID NO: 218806 - DNA, 1437 bp, Artificial Sequence
  Description of Artificial Sequence: Synthetic coding sequence
atggctgaacctgggggagccgctggccgtagtcatcctgaggatggctccgcctcagaaggtgaaaaagagggaaacaacgaatcccacatggtcagccctcctgagaaggatgatgggcagaagggggaggaggccgtgggaagtactgagcaccccgaagaggtcacgacccaggccgaagccgcaatagaggaaggcgaagtggagacggaaggagaggcggctgtcgagggcgaggaagaagcagtcagctatggggatgcagagagtgaggaggagtactactataccgagacctcctctcctgagggtcagattagcgccgcagacacaacttatccctacttctcaccaccacaggagctgcccggagaggaagcctacgattcagtcagcggcgaggccggacttcaggggtttcagcaggaggctactggcccacccgaatcacgcgagagacgagtgacctcccccgaaccgtctcatggtgttttgggcccatctgaacaaatggggcaggtgacttcaggcccagcggtcgggcgtctcaccgggtccaccgaagagccccagggacaggtactacccatgggcgttcaacatcggtttcggttatcccacggcagcgatattgagtcttctgacctagaggaatttgtaagccaagagcccgtaattccacccggtgtcccggacgcccacccgagggagggtgatctgccagtgttccaggaccagattcaacaaccatccacagaggagggagcaatggccgaaagagtggaatctgaaggctccgatgaagaagccgaggacgaggggagccagttggtggtgctggaccccgaccatccccttatggtgcgatttcaagcagccctcaaaaattacctgaatagacagattgagaaactgaagctggacctacaggaactggtggtggcaaccaaacagtcccgggctcagcggcaggagctgggtgtgaacctatacgaagtacagcagcacctagtgcacctgcagaaactcctggagaaatcacacgaccgacatgccatggcaagctcggaacgcaggcagaaagaggaagagctccaggccgcaagggcactatacacaaaaacctgtgctgcggcaaatgaggagaggaaaaagctggcagccctgcagaccgaaatggagaacttggcccttcacttattctacatgcagaacatagatcaggacatgagagatgacattagagtgatgactcaggtggtgaaaaaggcggaaactgaaagaatacgtgcagagattgaaaagaagaaacaaggtgttggggacacaggagcagccttcatcccaaagactacacagggcgaccaggtgagcggcaggggtaaaaaaaaacctggaacagttgtcgctcgcgtcagccccgctgagctttag

SEQ ID NO: 218807 - DNA, 3093 bp, Artificial Sequence
  Description of Artificial Sequence: Synthetic coding sequence
atggccgagcctggcggagcggcagggcgaagccatccagaagacgggtccgcaagcgaaggagagaaggagggcaacaacgaaagccacatggtgtctccccctgaaaaagacgatggccagaaaggggaggaggcagtcgggagtaccgaacatcccgaggaggtaactactcaggcggaagccgctatcgaagaaggggaggtcgaaactgaaggcgaggctgctgtcgaaggcgaggaggaagccgtatcatatggagatgctgaatccgaagaagagtactattataccgaaacctcctccccggaaggacagatctctgccgcagacacgacttacccatacttctcgccacctcaagagttgcccggagaagaagcttacgactccgtgtcgggcgaagcagggctgcagggattccagcaggaagccactggcccaccagaatcgcgggagcgaagggtgaccagccccgaacctagtcacggggttctgggccctagcgaacagatggggcaggtcacttccggaccggctgttggaagacttacaggatccacagaagaaccccaaggtcaggtgcttcccatgggagtccagcaccggtttagattgagccacggatccgatatcgaaagttccgacctcgaggaattcgtctcgcaggagcctgttattccgcctggagttccagacgcccacccgcgtgagggtgatctgcctgtgtttcaggaccagatacagcagcccagtaccgaggagggagcgatggctgaaagagtcgaatccgaggggagtgatgaggaggccgaagatgagggaagtcagctggtagttctggaccccgaccacccattgatggtccggtttcaagctgcgctgaagaactacctcaaccggcagattgagaagctcaaattggatctgcaggaactcgttgtggcaacgaaacagtccagggcacagaggcaggaattaggggtgaacttatacgaggtccagcagcacctggtccacttacagaaactcctggagaagtcccacgaccgacatgccatggcttcctctgagagacgccagaaagaggaggaattacaagctgcccgagctctctacaccaagacttgcgcggctgccaacgaggagcggaagaagctagccgcactgcaaaccgaaatggagaatctggctctgcacctcttctatatgcagaacattgatcaggacatgcgagatgatatcagggtgatgacccaggtggtcaaaaaagcagagacagaacgtatccgggctgaaattgagaaaaagaaacaggatctatatgtcgatcagctgactaccagagcacaacagctggaagaagacattgctctgttcgaagcccagtacttagctcaggcagaggacacgcgtatccttcgaaaggccgtaagtgaggcatgcacagagatcgatgctatcagtgtggagaagcgacggattatgcagcagtgggcttctagtctggttggaatgaaacatagagatgaggcacacagagcagtgctagaagctctgcgcggatgtcagcaccaggccaagagcactgatggggagattgaggcttacaagaaatctatcatgaaggaagaagagaagaatgagaagctggcctcaattctgaaccgtactgagacagaggccaccctccttcaaaagctcacaacacagtgcctgacgaagcaagtggcactgcagtctcagttcaacacatataggcttactctgcaggacactgaagatgcactgtcacaggaccagttggagcagatgatcttaactgaggaattgcaggctatcaggcaggctatccaaggggagcttgaactgagaaggaagaccgacgccgcaattagggagaagctgcaggaacacatgactagtaacaagaccacaaaatattttaatcaacttatccttagacttcagaaggagaagactaacatgatgactcatctctccaagattaatggggatatcgcccagacaacactcgatattactcacacctctagtcgtctggacgcacaccagaaaactctggtggagctggaccaggacgtgaagaaagtgaatgagctgatcaccaacagccagtctgagattagccgacgcactatcctgatcgagcgaaaacaagggctgattaacttcttaaacaagcagctagaaaggatggtttccgaactgggtggtgaggaggtaggacccctcgagttagagatcaagcgactttctaagctgatagatgagcatgatggaaaggccgtgcaggctcaggtgacctggctgaggctacaacaagaaatggtcaaggtcactcaggagcaggaagagcagctggccagcttggatgcctctaaaaaggaactgcatataatggaacaaaagaagctccgcgtggagtctaagattgaacaagagaaaaaagagcagaaggagatcgagcaccacatgaaggacctggacaatgatctgaagaagttaaacatgctgatgaataaaaatcgatgttctagcgaggagctcgagcaaaacaatagagtaactgagaacgagtttgtgcgctcactgaaagcaagcgaaagagaaacaatcaagatgcaagacaagctgaatcagttgtccgaggaaaaagccacccttctcaaccaactcgttgaagcagagcaccagattatgctgtgggaaaagaaaatacagctggcaaaagagatgaggagcagtgtggattcggagataggtcagaccgagattcgtgcgatgaagggtgagattcaccgaatgaaaaagtactgtcggacgacacaagacgcacataggcatgttcatgagcaacatgggacccacgcagggacatgtacgaagaataccggcagggcccaggctcgcgcacgcaccaccagggatgctagaggccacgtgcacgagcagcatggcacacgcgctggcacgtgtacaaataataccgggagagcgcaggcccgagcaagaacccgagacgcgaggagacacgtgcacgaacaccgcactcataccgctcgggcatag

SEQ ID NO: 218808 - DNA, 3429 bp, Artificial Sequence
  Description of Artificial Sequence: Synthetic coding sequence
atggccgagcccggaggtgccgctggcaggagtcatccagaggacggatctgcatctgagggcgaaaaagaaggaaataatgagagtcatatggtcagccctccagaaaaagatgatggacagaaaggcgaggaggccgtgggctccacagagcaccccgaggaggtcaccactcaggccgaagcagcaattgaggaaggagaagtggaaaccgaaggcgaagctgccgtcgagggagaagaggaggcggtgagttatggcgatgctgagagcgaggaagagtattattatactgagaccagcagccctgagggccaaatctctgcagcagacacgacgtatccctacttctctccaccgcaggaattgcccggtgaggaagcatacgacagtgtgtcaggcgaggcaggcttgcagggttttcagcaggaggcaaccggccctcccgagagcagagaaagaagagttacatcgcccgagcccagtcacggagtcttaggacccagcgagcagatggggcaggtaaccagtggaccagccgtgggcaggctgacaggctctacggaagaacctcagggacaggttctgccaatgggggtgcaacacagattcaggttaagtcacggctcagatatcgaatcaagcgacctggaagaattcgttagccaagaacctgtcatccccccaggtgtgcccgacgcccatccaagggaaggcgatctgcctgtgtttcaggaccagatccagcagccatccacggaagaaggcgctatggcagagcgtgtggagtccgagggctccgatgaggaagcagaggatgaggggtcccagctggtcgttcttgaccccgaccatccacttatggttcggttccaggccgcattgaagaattacctcaaccgacagatagagaaacttaaactggaccttcaagaactcgttgttgccacaaagcagtccagagcgcagcgtcaggaactgggggtgaatctgtatgaggtacagcagcatttagtgcaccttcaaaagctgctcgagaaaagccacgaccggcacgctatggctagttcggaacgacgccagaaggaggaggagctgcaggcggcaagagccctctacactaagacctgcgcggctgccaacgaagaacgcaagaaactagcagcactgcaaaccgaaatggagaaccttgcccttcatctgttctatatgcagaacattgaccaagatatgcgggatgatatacgcgtgatgacgcaggttgtcaagaaggccgaaaccgagagaatcagagcagaaatcgagaagaaaaagcaggacctatacgttgaccagctgaccacacgggctcaacaactggaagaggatatcgcccttttcgaggctcagtatttagcacaggctgaggacacacgcattctgcgaaaggccgttagtgaggcctgcacggaaatcgatgctatctcggtcgaaaaaagaagaatcatgcagcagtgggcttcttcactggtcggcatgaagcaccgggacgaagctcacagagctgtcctggaagccctgaggggctgtcagcatcaggccaagagtactgatggcgaaatagaagcttacaaaaagtctattatgaaagaggaagaaaaaaatgaaaaattggcatcaattctgaaccgcaccgaaaccgaggcaacactcctccaaaaactgaccacccaatgcctgaccaagcaggtcgcattgcagtcacaattcaacacttaccgtctgactctgcaggacactgaagatgctctttcccaggatcagctggaacagatgatcctgaccgaagagctacaggctattagacaggccatccagggggaactcgagctgcgtcgcaaaaccgacgccgcaatccgcgagaaactgcaggagcacatgaccagcaacaaaactaccaagtatttcaatcagctgattcttagactacagaaagagaagacaaatatgatgacccacttatccaaaatcaatggagacatcgcgcaaactaccctagacatcacccatactagctcccgcctcgatgcgcaccagaagaccttggtggaactcgatcaggacgttaaaaaggtgaacgaactgattaccaatagccagtccgaaattagcaggcggacaattctgatcgagaggaaacagggattgattaatttcctcaataaacaactcgagcgtatggttagcgagctgggcggagaggaggtgggccctctggagctcgagattaagcggctctccaaattgatcgatgagcatgatggcaaagcagtgcaggcccaggtgacctggcttagactgcagcaagagatggtaaaggtcacccaggagcaagaagagcagttagcaagccttgatgccagcaagaaagagctgcatatcatggagcaaaagaaactacgggtggaaagtaagatagagcaagagaagaaggaacagaaggaaattgagcaccacatgaaagacttagacaatgacctcaagaagctcaatatgctgatgaacaaaaatcgctgctctagcgaggagttggaacagaacaatcgcgtgaccgagaacgagttcgtacggtcactgaaagcctcagagcgggaaaccataaagatgcaggacaaactcaatcagctgtctgaagaaaaagcgaccttgctgaaccagctggttgaggctgaacaccagattatgctgtgggagaagaaaatccaactcgccaaagaaatgagaagctcagtggattcagaaattggacagacagagatccgcgcaatgaagggcgaaatacaccggatgaaggtgcggctgggccagttactaaaacagcaggaaaagatgatcagggctatggaacttgctgtggcccgacgcgaaactgtgactacacaagcagaaggccagcggaaaatggatagaaaggcccttactcgaactgactttcatcacaaacagctggagctgcgcaggaagattcgagatgtacggaaggctacagatgaatgtacaaagacggttttggaactggaagagacacagcgcaacgtgagttctagtctgttggaaaagcaggaaaagttatccgtgattcaagctgacttcgacactcttgaggcagacctgacacgattaggggctctgaaacgccagaatctatctgaaatcgtggcactccaaacccggctgaaacacctgcaggccgtgaaagaaggtcgatacgtgttcttatttaggtcaaagcaatcgttagtgctcgaacgacagaggctcgataaacggctcgccctgattgccactatactggaccgcgtgcgagatgaatacccccaattccaggaggcattgcataaggtaagtcaaatgattgcaaataagcttgagtcccccggtcctagctag

SEQ ID NO: 218809 - DNA, 921 bp, Artificial Sequence
  Description of Artificial Sequence: Synthetic coding sequence
atggcagaggtatccatagatcagtccaaattgccgggagtcaaggaagtttgtagggactttgcagtgcttgaggaccacacactggcccactctctgcaggagcaggagattgagcatcacttagcgtccaatgtccagcgaaataggttggtccagcatgaccttcaggtcgcgaagcagcttcaggaggaggaccttaaggcccaggctcaactccagaagaggtacaaggacctcgagcagcaggattgtgaaattgctcaggagatacaggagaagctggcaattgaggcagagcggaggcgtatccaggagaagaaagatgaggacatcgcaagattgctgcaggagaaagaactgcaggaggagaagaagcgtaaaaagcacttcccagaattccccgcaacacgggcttacgcagattcctattactacgaagacggaggcatgaagccacgagttatgaaagaagcagtgtccactccctcgcgcatggcgcatcgtgaccaggagtggtacgacgcagagattgcgaggaaactccaggaggaagagctgctggccacacaggtagacatgcgggcagctcaagtggcccaggatgaggagattgcgcgacttcttatggcggaggagaagaaggcgtataagaaagccaaggagcgagagaagtcctcgttagacaaaaggaaacaagaccccgagtggaaaccaaagacagcaaaggccgctaatagcaaatctaaggaatcagatgagccccatcatagcaaaaacgagcgcccagccaggccccctcccccaatcatgacggatggggaggacgcggactatacacattttaccaatcagcagtcttccactaggcacttttctaaatccgaatcctcacacaagggctttcactacaagcattag

SEQ ID NO: 218810 - DNA, 1449 bp, Artificial Sequence
  Description of Artificial Sequence: Synthetic coding sequence
atggccgaagtctcaattgaccagagtaagctccctggtgtcaaagaggtgtgccgggacttcgctgtgttggaggaccatactctggctcactcattgcaggagcaggagattgaacaccatctggcaagcaacgtgcagcggaaccgcctagtgcaacatgatttgcaggtcgccaagcagctccaggaggaggacctgaaagctcaggcccaacttcagaagaggtacaaggacctggaacagcaggactgcgagatcgcacaagagattcaggagaagctcgccattgaagcagagagacgtcggatccaggagaaaaaagatgaagacattgcacggctgctgcaggagaaagagctacaagaggagaaaaaacgcaagaaacactttccagagttccccgcaaccagggcctacgccgattcatactactacgaggacggagaccaaccgggaagccggcgagccagggagttaggcagtggtttctctaggccttgcaggttacagagggatggcaagaccgtgaagcacaagaaggaaaaacctgagcacccactggaaaatctggaagaacctgaacagcactgcagctctaaaaggtccctctctagtagttcttcggggaaagggagagacaatccgcacatcaacaacgagcagcatgagaggaagaggtccacacaggaacgtccccgacgcccactgttgccaaccatttctggtgaagtgtttcttagcaccgagtgtgacgactgggagaccaagattaaccaccagacacgcaactgggaaaaacaaagtcgacaccaggacaggctgtcccccaaatcctcccagaaagccggactgcattgtaaagaggtggtttatggaagagatcatggccagggtgagcaccgcaagcgaaggcacaggcccagaacccctccattctccgagagcgaagagcaattacacttgcatgatgccggaatgaagccccgtgtgatgaaggaagcagtgagtactccttctaggatggctcatcgggaccaggagtggtatgacgccgaaatcgcgcgtaagttacaggaggaggaactccttgcgacccaggtcgatatgagagctgcccaggtggcacaggacgaagaaatagcaagactcctgatggctgaggagaaaaaggcttacaagaaggccaaggaacgggagaagtcgagcttggataagagaaaacaagatcctgagtggaagccaaagactgccaaggcggcaaattccaagagtaaggaaagtgacgagccgcatcacagtaagaacgaacgcccagcgaggccaccccctcctataatgactgacggagaggacgcggattatacgcattttactaaccagcaatctagcaccagacacttcagcaagagtgagagctctcacaagggctttcattacaagcattag

SEQ ID NO: 218811 - DNA, 1425 bp, Artificial Sequence
  Description of Artificial Sequence: Synthetic coding sequence
atggcagattcggcatcagaatctgacacagacggcgctgggggtaattccagcagttccgcggcaatgcagagtagttgtagctccacatccggcggaggaggcggagggggtggaggtggtggcggtggcaaaagtggcggtattgtgatctccccttttagactggaggagctgacgaaccggctggcatctttgcaacaagagaataaagtccttaaaatagaactggagacatataaactgaaatgcaaagcattacaggaggaaaatagggatttgcgcaaggcatcagttaccatccaagccagggccgaacaagaggaggagtttatatctaataccttgtttaagaaaatccaggctctgcaaaaagaaaaagagacactggccgtcaattatgagaaggaggaggagttcctgaccaacgaactgagtaggaagcttatgcagcttcaacatgagaaggctgaacttgagcagcacctcgagcaagagcaggaatttcaggttaacaagctgatgaagaaaatcaaaaaactcgaaaatgatacaatttctaagcagctgactctggaacagctgcgaagggaaaagattgatctggagaacacacttgagcaagaacaagaggccctggtgaaccgtctatggaaacgaatggacaaacttgaggctgagaaacgtattctccaggagaaactcgatcagccagtgagtgcccctcctagtccgagggatattagcatggagatcgattcgcccgaaaatatgatgcggcatattcggtttcttaagaatgaggtggaacgtctgaagaagcaactgagggcggcacaactgcagcactcagaaaagatggcacagtaccttgaggaggagcgccacatgcgggaagaaaatctaagactgcagcggaaactgcagcgcgaaatggaaagaagagaggctctctgccgacagctctcagaatcagagtcctctcttgagatggacgacgaacggtacttcaacgaaatgtctgcccaagggctgcgccctcgcaccgtgtcctcaccaatcccctacacaccgtctccctcatcaagccgaccaatcagtccaggcctcagctatgccagccacactgtggggttcaccccgcctacctcattaacacgagccggtatgtcatactacaacagtccaggcttgcatgtgcagcacatggggacctcacacgggatcaccaggccttcgcctcgacgttccaactcaccagacaagttcaaaagaccaacccctccccctagtcctaacacgcagacacccgtgcagcctcccccaccacctccccctccacccatgcaaccgacggtacccagcgccgctacctctcagccgactccttcacaacactctgcacacccatctagccagccctag

SEQ ID NO: 218812 - DNA, 2055 bp, Artificial Sequence
  Description of Artificial Sequence: Synthetic coding sequence
atgaatcccccagccgctttccttgccggtcgacaaaacatcggctcggaggttgagatctcaaccattgagaagcaacggaaggagttacagctgctgatcggggaattaaaggacagggacaaagagctgaacgatatggtcgcagtgcaccagcaacaactcttgtcatgggaggaggaccgacagaaagttctgaccttggaggaaagatgcagtaaactggagggggagctccacaagcggactgagatcatccgcagcctgacaaaaaaagtaaaggctctggaatctaaccagatggagtgccagaccgcccttcagaagacccagctgcagctgcaagagatggcacagaaagctacccactcgagcctactgagtgaagatctcgaggccagaaatgagaccctgtccaatactcttgtcgagctgagcgcacaggtgggccagttgcaggccagagagcaagccctcaccactatgattaagctcaaggataaagacatcatagaggcagtgaaccacatcgcggactgttctgggaaattcaaaatgctagaacacgcactccgcgacgctaaaatggccgagacttgtattgtcaaggagaagcaagactacaaacaaaagctgaaggccctgaagattgaggtgaataaactgaaggaggacctaaacgaaaaaacaacagagaataatgagcagagggaggaaattatacggctgaagcaggagaaatcctgtctccacgatgagttgctgtttaccgtggagcgagaaaaacgcaaggatgaacttcttaacatcgccaaatccaagcaggagcgcaccaactcagaactgcacaatctgaggcagatctatgtgaagcagcagtccgatctgcaatttttgaatttcaatgtcgaaaactcccaggaactcatccagatgtacgattccaaaatggaagagtcaaaagcgctggacagctccagggatatgtgtctttcagatctggaaaataatcaccccaaggtggacatcaaaagggaaaagaaccaaaaatccctatttaaggaccagaagtttgaggcaatgctggtacagcagaatcggagcgataagagtagctgcgacgagtgcaaggagaagaagcagcagattgacactgtattcggcgaaaagtcggtgatcacgctgtccagtatctttacaaaggacctggtcgaaaaacacaacctgccatggtcccttgggggaaagacccagatcgaaccagagaataaaatcaccttatgtaagattcacaccaaatctccaaaatgccacgggacgggtgttcaaaacgagggcaagcaaccgagtgagacccctacactcagtgacgagaaacagtggcacgatgttagcgtttatctcgggctgacaaactgccctagcagcaaacatccggagaaactggatgttgaatgccaagaccaaatggaaagaagcgagatctcttgctgccagaaaaatgaggcgtgtctcggcgagtcaggaatgtgcgatagcaaatgttgccatccctccaattttatcattgaggccccaggacatatgagcgacgtggaatggatgagcatttttaagccaagcaaaatgcaaaggatagttaggctgaaaagcgggtgtacgtgctctgagagcatctgcggcacacaacacgattccccggcttctgagttaatcgcaattcaggattctcatagcctcggctcttctaagtccgctctgcgggaggacgaaaccgaatcctcatctaacaaaaagaacagtcccacatccttgctaatctataaagatgcacccgctttcaacgagaaggctagcattgtactgccttctcaggatgatttttcacctacaagcaaattgcagaggctgctggctgagagccggcagatggtcacggatctggaattgtctacgctcctacccatcagccatgagaatttgaccggttccgccaccaataagagcgaggtgccagaggagagcgcacaaaagaacacattcgtgagctattag

SEQ ID NO: 218813 - DNA, 1338 bp, Artificial Sequence
  Description of Artificial Sequence: Synthetic coding sequence
atgccgaattcatccccgaaggaccccacaaccgccagtgggaacgggagcaaagtggagcgggagaaaaggaaggacgaactcttgaatatcgcgaaatccaaacaggaaaggacaaatagcgagctgcacaacttacggcagatctatgtgaagcagcagagcgacctgcagttcctcaacttcaatgtagagaactcccaggagctgatccagatgtacgattccaagatggaggagtccaaggcgctcgacagttcaagagacatgtgcttatcagatttggagaacaaccacccaaaggtcgatattaagcgtgaaaaaaatcagaagtcactatttaaggatcagaagttcgaagccatgctggtccaacagaaccgatcagacaaatcttcatgtgacgagtgcaaggaaaaaaaacagcagatagatactgtattcggggagaagtccgtcatcacactgtcctccatattcactaaggacctggtcgagaagcataacctcccttggagcctggggggaaaaacccaaatcgaacccgagaacaagattacactttgtaaaattcacactaagagccccaaatgtcatggaacgggcgtgcagaatgaagggaagcagccttccgaaacacctacactttctgatgagaaacagtggcacgatgtgagcgtatatcttggcttgacgaactgcccctctagcaagcatccggaaaagcttgatgtcgaatgccaagatcagatggaacggagcgagatcagttgttgccagaagaatgaggcatgccttggcgaatccggcatgtgcgactccaaatgctgtcatcccagcaacttcattattgaagcgccagggcacatgagtgatgtggagtggatgagcatcttcaaacccagcaaaatgcagcgcattgtcagactgaagagtggatgcacctgttctgaatccatttgtgggacacagcacgattcaccggcttcagagttgatagccatccaggactctcactccctgggctcgagtaaatccgccctgagagaggatgaaactgagtcttctagtaataagaagaatagtcctacgagtctcctgatctataaggatgccccagcctttaacgaaaaagcaagtattgtcctcccttctcaagacgacttttcccccacctctaagctgcagcgcctgctggctgagtctaggcagatggtgacagatttagagttatctactctactccctatcagtcacgagaacctgaccggatccgcaactaacaaatccgaggtgcccgaagagagcgcgcagaaaaatactttcgtctcgtactag

SEQ ID NO: 218814 - DNA, 2049 bp, Artificial Sequence
  Description of Artificial Sequence: Synthetic coding sequence
atgaaccctccagctgcatttcttgccggaaggcagaatataggcagtgaagtagaaatatctaccatagagaagcagcgcaaagaactgcagttattgataggagagctgaaagatagggacaaggagctcaacgatatggtcgctgtccatcaacagcagctgctgagttgggaagaggacaggcagaaggtactcacattggaagagaggtgcagtaaattagagggggaacttcacaaaaggacggaaattatcagaagcttaacgaaaaaggtgaaggctctggagagcaatcagatggaatgtcaaactgctctgcagaaaacccagcttcagctccaggaaatggcacaaaaggcaacccatagcagcctgttgtccgaggacctggaagcaaggaacgaaactctctctaatacactggtggagctgagtgcacaggtgggccagctacaagctcgcgaacaagcactgacgacgatgataaagctgaaggataaggatattattgaagctgtgaaccatattgccgactgttccggcaaattcaagatgttggagcatgccctcagagacgcgaagatggcggaaacatgcattgtcaaagagaaacaggattacaaacagaagctgaaagccttgaaaatcgaagtgaataaactgaaggaagacctcaatgagaagactacggagaacaacgaacagcgcgaggaaattatccggctgaagcaggagaaatcttgccttcatgatgaactgctgttcaccgtggaacgggagaaacgaaaggacgagctgctcaatatcgcaaagtctaaacaggagcgaacaaattccgaactgcacaatctgcggcagatttatgttaaacagcagtccgatctgcagttccttaattttaatgtagaaaactctcaagagttgatccagatgtacgatagcaaaatggaggaaagtaaggctttggacagctctcgggacatgtgcctgagcgatcttgaaaacaatcaccctaaagtggatataaagagagagaaaaatcagaaatccctgttcaaggaccaaaaatttgaagctatgctggtccagcaaaacaggtctgataagagctcatgcgacgagtgtaaagagaagaaacagcaaattgataccgttttcggggaaaaatccgtgatcaccttgtctagtatttttacaaaagatctggttgaaaagcacaatctaccgtggtccctcggcggaaaaactcaaattgaacctgaaaataagatcaccctgtgcaagatacacactaagtcgcccaagtgccacggcacaggtgtccaaaacgaaggcaagcagcccagcgagacgcccacgctcagcgatgaaaagcagtggcacgacgtttctgtgtatctgggcctgacaaattgtccgtcctcaaagcaccctgagaagctggacgtggaatgccaggaccagatggagcgctctgagattagttgctgtcagaagaacgaggcctgtcttggggaaagcgggatgtgtgactccaagtgttgccatccaagcaactttataatcgaagctccaggtcacatgtccgacgtagaatggatgtcgatcttcaagcccagcaagatgcagagaattgttcggctgaaaagcgggtgcacttgttccgagagtatttgtgggacccaacatgattctcccgcatctgaactcatcgccattcaggattcgcacagtctgggctcctcgaaatcggctcttagggaggacgagaccgaaagcagctccaataaaaagaattccccaacctcccttctcatctataaggacgcgcctgctttcaatgaaaaggcctcaatcgtgctgccctcgcaggacgacttttcacccacatccaagctccagcgcctcctggctgagtctagacagatggtaacagatctcgagttaagcactctgctaccaatctcccatgagaatctgactggctccgccaccaatataagtcacctttgcggtagacagaaagccgacactaacactgaatag

SEQ ID NO: 218815 - DNA, 1494 bp, Artificial Sequence
  Description of Artificial Sequence: Synthetic coding sequence
atgccaaaaaaggaaaagatggctaaaacccctctgagcgatgaaaagcagctactgcttttccagcagaagcttctcgcagaggaggagatggctaagaagaaggaaagacttcttagtcaattcttgaaagacaagctggcaaaagaggaacataatagtgcccttaacctgaataagatcaacacccagtggcgcactgtgctgagggaggtaaagacgagagagctgcacaaagacatcgagatcttgagtcaaacatttgaaagggtggttgactgcaaggacaatgtgattaaatcccttgcaaaagacttgtcggaggccgaagagcagtatgcccatgcactgaggtcacatctacacaacgtcgatcagttactagccttgcagcggcacaggctgagcctcctagaggaatcttataacatggagttggaggccctaaccaaggaatttgagacagagcgcaaaacgatcatcgaccagcacgaaaaagagattcattatttgcaagatatttttatggcaatggaacaaaattacatagatagtgagtatgagtccaaactggagttccaatccatgtggaatgacttaaaaaacatgaatttggaagaaaagcacttcttgcgcctacacctggagaacagggttgaggacctgtggcgtaaatttcaagatgtcctcaaaaactataccgacgctacggaggataggaaagcagctttcgaaacactgcaggtgaaagacgagaagtcaagcaaggaaatagaagtgcaaatgaagaagatccaaaagctccaggatgctataactattagcaaaggtaaaataatgatacattcacgggaatcagaagatgaaaaccgctacattcgtaacgataaggagctcgttctggtgcagctgcgcaaactgaaggcccagcggacgcaggcccgtgcagcttcccagaaaaacctggtgcgcctgacactggagtctaacgctaccttgaaagcgctgcggaaaatagttgataagggtgaaaaaatcttgaagctggccgagatctgtcgcaagtttgagacggaggaggaaaaggttttaccattctattcctcagtcctgaccccaaaggaacaggaaggcatccagaagaataatcttgaagaactgaccgaagagttaacaaaagtgatggtggactacatagggatggagaatttctggaagagatataataaagttaaactggaacagctatccctgcagcaccgacgagctcagctgctggatattaatggaaaactgagagagatgctcaagcagtatttggatggcatatccgtgtcggacgaggtactatctcagcttaatccactgttcatcgtaaattatcagtctaacctgctgcagcccctgagcataaggatcgcccaccctggaagcactagccctagcgccccttggagagaccagcgtcggagcttctttcttggaagctcctag

SEQ ID NO: 218816 - DNA, 1455 bp, Artificial Sequence
  Description of Artificial Sequence: Synthetic coding sequence
atgccgaagaaagaaaaaatggcaaaaacccctctgtcagatgaaaaacagctactgctcttccagcagaagctgctggccgaggaagaaatggcaaagaaaaaggaaaggttgctcagccagttcttgaaagacaagctcgcgaaggaggagcacaactctgcgctgaatcttaacaagattaatacacaatggcggactgtcttacgggaagttaaaacaagggagctgcacaaggatatagagattcttagtcagactttcgaacgcgtcgtggattgcaaggacaacgttataaaatcactagccaaggacctgtccgaggcagaggagcagtacgctcacgcacttcggtcccacctgcataacgtcgaccagctcttggcactgcaacggcataggctgtctctgttagaggagtcatataacatggagctggaggccctgactaaggagttcgagactgagagaaagacgattatcgaccagcacgagaaggaaattcactacctgcaggatatcttcatggccatggagcaaaactacatcgacagcgaatacgaatccaaactggagttccagagtatgtggaacgacctaaagaatatgaacctcgaggagaagcattttcttcgcctgcacctggaaaatagagtcgaggacttgtggcgcaaatttcaggatgtgctcaagaattataccgatgctacggaggaccgtaaagcagcatttgaaacactccaggttaaggatgagaaatcaagcaaggagatcgaagtccagatgaagaaaatccagaagttacaggatgctatcactatctccaagggaaagattatgattcactctagagagtctgaggacgagaaccggtacataagaaatgacaaggagctggtattggtgcaactacgtaagctgaaagcgcagcgaacccaggccagagccgcaagccagaaaaatcttgttaggctgaccttggagagcaatgctaccctgaaagcactgcgaaagatagtggataagggggagaaaatacttaagctggccgagatttgtagaaaatttgagacagaggaagagaaagttctgcccttttacagctccgtgctgactcctaaggagcaagagggaatccaaaaaaataacctggaagaactgaccgaagagctgacaaaagtgatggtggattacatcggcatggaaaatttttggaagcggtataataaggtgaagctggagcagttatccttacaacataggagggctcagttattggatatcaacggaaaattgcgcgagatgctcaaacagtatttagatggcatcagtgtgtccgacgaagtgttgagccagttgaatccactattcatcgtgaactaccagagcaatctactacagccactgtctattaggatcgctcaccccggagataaacagcaccctaccacctag

SEQ ID NO: 218817 - DNA, 3240 bp, Artificial Sequence
  Description of Artificial Sequence: Synthetic coding sequence
atggagtctaatttcaatactgagagctcttccaccttcactctgcagagctctagtgaaacattatttagtattcaactgctcgactttaagacttcactccttgaagcgctcgaggagctccggatgcgtcgggaagcggagatccattatgaggagcagatcgggaaaattatcgtagagacccaggagttgaagtggcagaaagagacacttcagaaccagaaagagacactcgcggagcaacacaaagaggccatggccgtgtttaaaaagcagctccaaatgaaaatgtgcgcactcgaggaagaaaaggggaagtaccaactggcgactgaaattaaagagaaggaaatagaaggcctgaaagaaaccctaaaagcactgcaggtgtcgaagtacagcctgcagaaaaaggttagcgaaatggagcaaaaggtacagctacatttgttggccaaagaagattatcataagcagctgtctgagatcgaaaaatactacgctacaatcaccggacagttcgggctggtcaaagaaaaccacgagaaacttgaacagaacgtccgcgaggccattcagtcgaacaaaaggctctccgctctgaataaaaagcaggaggcagaaatttgctcgctgaagaaggagttgaaaaaggcggctagtgatttgattaaaagcaaagtgacctgccaatacaaaatgggcgaggagaacatcaaccttacgattaaagaacagaagtttcaagagctgcaggagaggctcaacatggaactggagttgaatgaaaagatcaacgaggaaataacacacatacaggaggagaagcaggacataatcataagcttccagcatatgcagcaactgctcaggcagcaaatacaggccaatacagaaatggaagctgaactgaaggtcctgaaagagaacaaccagaccctggaacgtgacaacgaactgcagagagagaaggttaaagagaacgaggaaaaatttttaaatctccaaaatgaacatgagaaggccctcgggacttggaaacgccatgccgaggagctcaacggtgaaatcaacaagattaagaatgagctctcgtctctgaaagagacacacatcaagctacaggaacactacaataagctgtgtaatcagaaaacattcgaagaagataaaaagtttcagaatgtcccagaagtcaataatgagaattcggagatgtcaacagagaaatctgagaacacaataatacagaagtataatacagaacaggagatcagagaagagaatatggaaaacttttgctctgatacagagtatcgcgaaaaagaggagaaaaaagagggatctttcattgaagagatcattattgatgacctacaacttttcgagaaaagcttcaagaatgagattgacactgtcgtatcccaggatgaaaatcagtcagagatctcattaagtaaaaccctgagcctggacaaggaggtcatttctcagggacagacctccaacgtgaccgataatcggaagtctgtaaccacagagatcaaggacaagatctgtttggaaaaggacaatggctgcactgagttcaagtcacccaataaccacttcgttgtgttggataccgcaatagagactgaaaaaatccatcttgaacggactagggggttggacgttcaccatactgacgtaaacttagaagtggagaataataagacaagtttcaatagcattctaaacgagaccgctcataacacttatcacaacaacaacaaggatgtgtcagagaacgagccctttaaacagtttcggctccttcctggaacccgtgagcatgccctagaaaaggagatcaccaatagcgaccaaacgaaggccgacctggacagcagtcttgacatcaaaaaaaatcccgtcccctgccagaaatactctctccgaaattcatccaatgtgatgctcgatgataaacagtgtaagataaagcaaatccaactcctaacaaagaaatctgaatgttcgattctgctctcgaagcaaacgtctgactttctgcaggtctgcaacgacaccctggaaaagagtgaactgactgtgccttgcgacattgtgattgatcatcacgtttcatacgccgcattctccgctaattctaagctactgctcaagaattctgataaaaatgtgcactctatgtccatgctagtgaagccaaacagctctccgggtgggaagactatgtgtaagaacatgtccgatatgcagaacagccagtttaacaattgtctgggatacttagagaacaccaacgttaatattagtcacctgcacctgaataatgagaattctcatgcttcccaggcgaaggacgtcaagacagccgtgcatatgaagacatgtactgaaacggagttcagcaataagaaaaaccagattgacgagaatcaggtgacagaggcaaccaaaaatgacctgtttctttttgtctccatcaatgagcggcagcataccctgttgaacaacactgagaagacagagagcctgaatgacatcgtgtccggcaaaatgttttctgagggccagctggaggagtctcacagttttcatattgagcccagtggcgacctcgtgaataggtctggcaggtcaacttttgacctttccaccagcgacaaaaagacagaaaagacccccgtctatatgaatttttcagacccaggcccatggagtaaggtcaatcacattgaaagccagaccgcgagttctagtacaccctgcatatccttacttctaaaggagagaccactggatcctagcgaaaataagaagatcattagcatggctctatgtaagaatataggtgtcgacgatgtcggcaaggacattggcccagacaccacctctatcaaccgagtggccgacaccttaaacaattggtcaatccaccccgacccaaaaggagagccgtcagaggagaagaatgcaatggctaagacattctacgattcatcctttcccactgagcacgttaagacaaagccgctgataagtacacctttgcagagtcatctgcaagctatcaaaactacaaaaaacacatcgggtgatgacgattggcaatccttgatcaccaaccagctcaacaaatcagaaaatctcctgtcactggaaaacgacaaccagcctaaaaagcgaaaggccgaagaaacactcgaaaagaacaacaggttaaagtag

SEQ ID NO: 218818 - DNA, 1617 bp, Artificial Sequence
  Description of Artificial Sequence: Synthetic coding sequence
atgcttcagattggagaggatgtggactatctgttgatccctcgtgaagtacggctagctggcggtgtctggcgcgtcatcagcaaacccgctacaaaagaggcagaattcagagagcggctgacgcagtttctcgaagaagaaggtagaactctggaggatgttgcaagaatcatggagaagagcactccccaccccccacagcccccaaagaagcccaaagagcccagggtgcgccgacgcgtgcagcagatggtaaccccacctcctcgccttgttgtggggacatacgacagcagcaatgctagcgattctgaattcagtgatttcgaaacctcgcgtgacaaaagccggcagggaccacgacggggaaagaaagtgcggaagatgcctgtttcatatttaggcagcaagtttctaggatcggacctggagtccgaggatgacgaagagctggttgaggcatttctacgcagacaagagaaacaaccaagtgccccacctgctagaaggagagtgaatctcccggtgcccatgttcgaggataatcttggccctcagctgagtaaggcggaccgctggagggagtacgtgtcccaagtttcctggggtaagctgaagaggcgagttaaaggctgggcacccagagctggcccaggagtcggggaggcgcgacttgccagcaccgctgtcgagtccgcaggcgtctcgtctgcacccgagggtacctcaccaggagatcgcttgggaaatgccggtgacgtgtgtgtgccccaggcttccccccgtaggtggagacctaaaataaattgggcctctttccggcgtaggcgaaaggaacaaaccgctcctacaggtcagggtgccgacatcgaagccgatcaggggggagaggctgctgactctcaacgcgaggaagccatcgccgaccagagggagggcgcagctggaaaccagagggctggagcacctgctgaccagggcgcagaagccgcagataaccagcgagaagaggctgccgataaccagcgggcaggcgctccggctgaggagggggcagaggccgcagataatcagagagaagaagctgccgataaccagcgcgctgaggctcctgccgaccaacggtcgcaaggaacagataatcaccgagaggaggccgcagataaccaacgcgcagaagctcctgccgatcaaggctctgaagtgaccgacaaccaaagagaggaggcagtacacgaccagagggagagggcgcctgctgtacagggtgctgacaaccagcgtgcccaggcgagagccggacagagagccgaggctgcccataaccagcgagccggagctcccggaatccaggaagcagaggtatcagccgctcaggggactaccggaactgcgccaggtgctcgcgctcgaaaacaggtgaaaacagtgcggttccagacccccggaagatttagttggttttgtaaacggaggagagcgttctggcacacccctagactgcccacactaccgaagagggtccctagagccggtgaggccagaaatctgagagttctgagagcagaggccagagctgaagctgaacagggggaacaggaagaccaactttag

SEQ ID NO: 218819 - DNA, 975 bp, Artificial Sequence
  Description of Artificial Sequence: Synthetic coding sequence
atgttacaaatcggggaagatgtggattacttgctcatccctcgagaggtgcgtctggcaggtggagtctggcgggtcatttctaagcccgctacaaaagaggctgagtttcgagagaggctaacacaattcctcgaggaagaaggacgaactcttgaggatgtggctaggataatggaaaagagcactccacatcccccacagcctcctaaaaagccaaaagaacccagagtgcgtagacgggtccagcaaatggtcacacctccgccacgcctggtggtgggcacatatgatagcagcaacgcatccgacagtgagttttcagatttcgagactagccgagacaaatcccggcaagggcctagacggggaaagaaggtccgcaaaatgcccgtgagttaccttggctctaaatttttaggaagcgaccttgagtcagaagatgacgaagagctagtcgaggcgttcctgcgacgccaggggctgcaagtgatccgaggccaaggcccacagctgacaagggggcagcgcctccagattattcgcggaaagaggctgcagattattcgtggacagggaccccagcttcgaaggggacagagactccagattacaaggggcaagcggctgcagattatcagaggacagcgcccacagctgaccagagggcaccgcgcacagataaccacgggcaagcggctgcaaattattcggggacggaggccccagctcaccaggggacaacgactccaaattatcaagggtaaacggccttatatgaccagaggaaagggaccacagctctcacgagttcagatcatccggggtcaccggcctgggttggccagaggacagcggctgcatatcatccgcggacaagggcctcaggtcagcagaaagttaaaaagtcagttacctaagggccctcaggaacaattacaggagccaggccctggaaatcggtcacggcaatag

SEQ ID NO: 218820 - DNA, 5532 bp, Artificial Sequence
  Description of Artificial Sequence: Synthetic coding sequence
atggaaaatgagattttcacaccattacttgagcagtttatgacatctcccctcgtgacatgggtgaaaactttcggaccactggccgcaggaaacggtactaaccttgacgaatacgtggcactggttgatggagttttcttgaatcaggttatgttgcagataaatccgaaactggaatcccagcgggttaataaaaaagtcaacaacgacgcgtcgctgagaatgcacaacttgtctatcctagtgaggcagattaagttctactaccaggagactctccagcaactgattatgatgtccctgcctaacgtcctgatcattggaaagaatcccttttcagagcagggcacagaggaggttaaaaaattactgttgctgcttctggggtgcgccgtacagtgccagaagaaggaagaatttatagagcgaatccagggactcgactttgacacaaaggctgctgtagcggcacacatccaggaagtcacacacaaccaggagaatgtgttcgacctgcaatggatggaagtgacagacatgtctcaagaggacatcgagcccctcctgaagaacatggcactgcacttgaaaaggctgattgatgagagagacgagcactccgagactatcatcgagctctcggaggaaagggacggcctccacttcttgccccacgccagttcatctgcccagtcaccttgcgggagccccggtatgaagcgcacagagtccaggcaacacctgtccgtcgaactcgctgatgctaaggctaaaattaggaggcttagacaggagttagaggaaaaaaccgagcagctgttagattgtaaacaggaactcgagcagatggagatcgagctgaagcgcctccagcaggagaacatgaatctgctcagtgacgcaaggagtgccaggatgtatagggacgaactggacgcgcttagggaaaaggctgtccgagtggacaaacttgagagcgaagttagtcggtataaagagcggctgcacgacatcgaattttataaagctcgtgtcgaagaactgaaagaggataatcaggtcttactggagaccaagactatgctggaagaccagcttgaggggaccagggccaggtcagataaattacacgagctggaaaaagagaacctgcagttgaaagccaagctgcatgatatggagatggaaagggacatggatcgcaaaaagatcgaggaattgatggaggagaacatgacactggaaatggcccagaaacagtctatggacgagagtttgcatctggggtgggagctggagcagatatctcgcaccagcgaactgagtgaagccccacagaaatccctgggacatgaggtgaacgaattaacctcaagtcgactgctcaaattggaaatggaaaaccaatcactaaccaaaaccgtggaagagctgagaacaactgtagactctgtggaaggtaatgcatctaaaatcctgaagatggagaaggaaaaccagagattgtcaaaaaaggttgagattttggagaatgaaattgtgcaggaaaaacagagcctgcagaactgtcagaacctctctaaggacttgatgaaagagaaagcacagctcgaaaagactattgagaccctgagagagaactctgaaaggcagattaaaattctggagcaagagaacgaacacctgaaccagacggtttcaagcttgaggcagcgctctcagatatcagcagaggccagggtcaaggacatcgaaaaagagaacaagattctccacgagtcgatcaaagagactagcagcaagctgagcaagatcgagttcgaaaagcgtcagatcaagaaagagcttgagcattataaggaaaaaggggagagagccgaagagctggaaaatgaactgcaccacctagaaaaggagaacgaacttctccagaagaagattaccaacctcaaaatcacatgcgagaagattgaggctcttgagcaggagaatagtgagctagagagagagaatcgcaaactgaagaaaactcttgattcttttaaaaatctgacatttcaactcgagtcactcgagaaagaaaatagccagctggacgaggagaatctagagctgaggcgcaatgtggagtccctgaaatgcgcctccatgaaaatggcacagcttcagctggaaaacaaggagttagaatcagaaaaagagcaactaaaaaagggacttgagctactgaaggcttctttcaagaagactgaacgcctcgaagtaagctatcagggattggatatcgagaaccaacgtttgcaaaagaccttggaaaactctaataaaaaaattcagcaactcgaaagcgagctacaggatctggagatggaaaatcagactctgcagaagaatttagaggaactgaaaatcagttcgaagcggctggagcaactcgagaaagagaacaagtcccttgagcaagagactagccaattggagaaggacaagaagcagctggagaaggaaaacaaacgtttgagacagcaggctgagatcaaggatactactctcgaggagaacaacgttaaaattggaaacttagaaaaagagaacaagacgctgagtaaggaaattggtatttacaaagaatcatgcgtccgccttaaggagctggagaaagaaaacaaggagttggtaaagcgggctaccatcgacattaaaacgctcgtgacactgcgcgaggacttggtcagtgaaaaacttaagacacagcagatgaacaatgatctggaaaaactgacgcatgaactcgaaaagatagggctcaacaaagagagactgctgcacgatgagcagtccacagatgatagtcgctacaagctcctcgagagcaagctggaatcaaccttgaagaagtcactggagatcaaagaagagaagatagcagccttggaggcaaggctggaggagagtactaactataaccaacagctgcgacaagagctaaagaccgtgaagaaaaattacgaagccctcaagcagcgccaggatgaggagaggatggtccagtcgtctcctcccatctccggcgaagacaacaagtgggagcgggagagccaggaaaccacacgcgagctcctgaaggtgaaagatcgtctcatcgaagtggaacgcaacaacgcaacactgcaggccgagaagcaggccttgaagactcaactcaaacagctggaaacacagaacaataatttgcaggctcaaattctggctctgcagaggcaaactgtttctctccaagaacaaaacaccacactgcaaactcagaacgctaagctacaagtggaaaactcaaccctcaactcacagagcacgtcgctgatgaatcagaacgcccagctgctgatccagcaatcctccctggagaatgagaacgagagcgtgattaaggaacgcgaggatctgaagtctctgtatgacagcctgattaaagaccacgagaagctggagctcttacatgagaggcaggcttccgaatatgaatctctcatcagcaagcacggcactctgaagtcagcccacaagaacctggaggtagagcatcgagatctcgaggatagatataatcagctccttaagcagaaaggacagttagaagacctggagaaaatgctcaaagtggagcaggaaaagatgctcttagagaataagaaccatgaaactgtggctgccgagtacaaaaagctgtgcggcgagaacgaccggctaaaccacacctattcccaactgttaaaggagactgaagtgctgcagacggaccacaagaatctcaaatcattactgaacaactcaaagcttgagcagacaagactggaggctgaattttcaaaactgaaggagcagtaccaacagctagatattaccagtacgaagttaaataatcaatgcgagctcttgtcacagctgaaaggaaatctggaggaggaaaacaggcatttacttgatcagattcagaccttgatgctccagaataggactctcctggaacagaacatggagagcaaggatttattccacgtcgaacagaggcagtatatcgataaactgaacgagctgcgcagacagaaggagaagcttgaagaaaagatcatggatcagtataagttctacgacccctccccccctaggagacgcggaaactggatcaccctcaagatgcggaaactcatcaaaagtaagaaagacattaaccgggaaagacagaaatcacttacactaactccaactcgttccgactcctccgaggggtttctgcagctacctcaccaggatagtcaagattcaagcagcgtggggagtaactctctagaagatggccagactctagggacaaagaagtcttccacaatgaacgaccttgtgcagtccatggtcctggcaggccagtggactgggtcaaccgaaaatctggaagtgccagatgatatctccaccggaaaacgcagaaaagagctgggagccatggcattcagcacaacggctattaattttagtacggtcaactcatccgccggttttcgaagcaagcagctagtgaacaataaggatactacctctttcgaagatatttctccccagggcgtgtccgatgactctagcactggaagccgcgttcatgcatcccggcctgcctcactcgattcaggacgtacctctactagcaacagcaacaataacgcatcactgcatgaggttaaagccggagctgtgaataatcaatccagacctcaaagccattctagtggggaattttctttactgcatgaccacgaggcttggagtagttcagggagcagtcccatccagtacctgaaaagacagacgcggtcctctcccgtgctccagcacaaaatttcagaaacactcgagagccgacaccacaagatcaagacaggatctcccggtagtgaagtagtaacactgcagcagttccttgaagagagcaataaactcaccagtgtacaaatcaagagctcatcgcaagagaatctgctcgatgaagtgatgaaatccctgagcgtgtcatcagactttctgggaaaagacaagccggtgtcatgcgggctcgccagatcagtgagcgggaagacgcccggtgacttttatgacagaaggactaccaagccggagttcctgcgcccaggcccaaggaagaccgaagacacttactttatctctagtgcaggaaaaccaacacccggtacccaagggaagatcaagctggtcaaagaaagcagcctgtcccgccagtcaaaagatagtaacccatacgccaccctgccacgagcaagctccgtgataagcactgccgaagggacgacgagaaggactagtatccacgattttctcacaaaggactccagattacctatcagcgtagactccccgccagctgccgctgacagtaacacaactgccgctagtaacgttgataaggtacaggagtctcgcaattctaaaagtcgctccagggaacagcaaagcagctac

SEQ ID NO: 218821 - DNA, 5612 bp, Artificial Sequence
  Description of Artificial Sequence: Synthetic coding sequence
atggaaaacgagatttttacccctttgctggaacagtttatgaccagtcccctagtgacatgggttaagaccttcgggccactggcagctgggaacggaaccaacctggatgagtacgtggccctggtcgacggggtgtttttgaaccaggtgatgcttcagattaacccaaaactggaatcccagcgggttaacaaaaaagttaataatgacgctagcttgcgtatgcacaatctgtctatactcgttcgccagatcaaattctactatcaggagacattacagcagctgattatgatgagtctgccaaacgtcctgatcatcgggaaaaatcccttctctgaacaaggcaccgaggaagtcaagaaactgctcctgctccttctgggctgtgccgtccagtgtcagaagaaagaagaattcatcgaacggatccagggactcgactttgatacaaaggctgcggtagcagcgcacattcaggaagtgacacacaaccaagagaatgtgttcgacctccagtggatggaagtcactgatatgtctcaggaagatatcgaacctctgctgaagaatatggccctccacctcaagagactgattgatgagcgcgatgagcatagcgaaaccattatcgagctctctgaggaacgtgacggtctccatttccttccacacgctagttcgtcagctcaatccccttgtggttctcccggaatgaaaaggactgagagccgccaacatctctcagttgaactagccgatgcgaaggccaagattagaaggttaagacaggagctagaggagaaaaccgagcagcttttggattgcaagcaggaactggaacagatggaaattgagctaaaacgtctccagcaagaaaatatgaatctgcttagcgatgcacggagcgcaaggatgtacagggacgaattggacgccctccgagagaaagccgttcgagtcgacaaacttgagtctgaggtgtctcgatacaaggaacggctccatgacatcgaattctacaaggccagggtggaagaacttaaggaggataatcaagtgttactcgagactaagaccatgctcgaggatcagctcgaaggcacaagagcgaggtcagacaaattacacgagctggaaaaagagaatctacaattaaaagccaaattgcatgacatggaaatggagagagacatggacaggaaaaaaatcgaggagttaatggaagagaatatgaccttggaaatggcccagaagcaatcaatggatgagagtctccatctgggttgggagttagagcagatttcccgtacaagcgaactgagcgaggcacctcaaaagtcactcggacacgaggtgaacgagttaaccagctcccgtctgctcaagctggagatggagaaccagtcgctgacaaagacagtggaggagctgaggaccacggttgattccgtcgagggtaatgcctccaagattctgaaaatggagaaggagaaccagcgcctttcaaagaaagtcgagatcctggagaacgagattgtgcaggaaaagcagagcctccagaactgtcagaacctgtccaaggacttgatgaaggaaaaggctcaacttgaaaaaacgatagagacactaagggaaaattccgaacgacagataaagatcttagagcaggagaatgaacatctgaaccagacggtgagcagcctgcgccagcgatcccagatatctgccgaggccagagtcaaggatatcgagaaggaaaacaaaattcttcacgagtccatcaaagagactagttctaagctgtccaagatcgagttcgagaaacgacagattaaaaaggaactagagcattacaaggaaaaaggcgagcgcgctgaagaactcgagaatgagcttcaccacctcgagaaagagaacgagctcctgcagaagaaaatcaccaatctgaaaattacctgcgagaagattgaggccctggaacaggaaaattcagaactggagagggagaaccggaaattgaagaagaccttggatagtttcaagaacctgaccttccagctggagtcactcgaaaaggagaatagtcagctcgatgaagaaaacttggagctgcgaagaaacgtggagagtctcaaatgtgccagcatgaagatggcccagctccagctggaaaataaagagctcgagtccgaaaaggaacagcttaagaaaggcctggaactactcaaggcatctttcaaaaagactgagagactggaggtaagttaccaggggctcgatattgagaatcagagattacagaagacccttgaaaactccaataagaagatccaacagctggagagcgagctgcaagacttggagatggagaaccagacactgcagaagaacctagaagagctaaaaataagttccaagaggctggaacagttagaaaaagagaataagtcgctcgaacaagaaacgtcacagctggagaaggataaaaagcaactggagaaagagaataaacggctgagacagcaggctgaaatcaaggatacgactctcgaggagaacaatgtgaagattggcaaccttgagaaagagaacaagaccctgtcgaaagaaatcggcatctacaaggagtcctgtgtaagactgaaagagctcgaaaaagagaataaggagctcgtgaaaagagctacaatagatattaaaacccttgtgaccctgcgggaggatctggtcagcgagaagctcaaaacccagcagatgaataacgacctggaaaaactcacccacgagctcgagaagatcggcctgaacaaagaacgacttttacacgacgaacaatcaaccgatgaccggtataaattgctggaatccaaactggagtctacactcaaaaagtcccttgagataaaggaagaaaagatagccgctctggaagctcgtctcgaagagtctacaaactataatcaacagttgcggcaagagcttaaaactgtgaagaaaaactacgaagctctaaaacaaaggcaagacgaagagcgcatggtgcagagctcaccaccaattagcggggaggataacaagtgggagcgggagagtcaagagactactagagaactattgaaagtaaaagatcgcttaattgaagtcgaacgcaataatgcaaccctgcaggccgagaaacaggccctgaagacccaactaaagcagttggagacgcagaacaataatctgcaggctcagatcctggccctgcagcgccagactgtctcgttgcaggagcagaacacgactttgcaaacacaaaacgctaaactccaagtggaaaactcaaccctcaatagtcaatcaactagcttgatgaaccagaacgcacagttactgattcagcagtcctcacttgaaaatgagaacgagagtgtcataaaggagagggaggatctgaagtccctgtatgattcactaataaaagaccacgagaagctggaactgctgcacgagaggcaagctagcgaatatgaaagtttaatttctaaacatggaacgctgaaatcagcccataagaatttagaagttgaacatagggatctcgaggacaggtataaccagctgctgaagcagaagggtcagctggaggatctggagaagatgctgaaggttgaacaagaaaaaatgcttctcgaaaacaagaaccacgagactgttgccgcagagtacaagaagctgtgtggggaaaatgatagactgaaccacacttattcacaactgctcaaagaaacagaagtgttacagaccgaccataaaaacctgaaaagcctgttgaataactccaaactcgagcagaccaggctggaggcagagttttctaaattaaaggagcagtaccagcagctagatatcacctcaacgaagctgaacaatcagtgcgagttgctatcccaattgaaaggaaacttggaggaagagaacaggcatctactggatcaaatccagacgctgatgctgcagaaccgaaccctgctcgagcagaacatggagtcaaaagatttgttccatgtcgaacagagacagtacattgacaaactgaatgagctgcgacgccagaaagagaaactggaggagaagattatggatcagtataagttctatgatccttcccctccgagacgcagaggtaattggatcacattgaaaatgaggaagctgatcaagtcgaaaaaggatattaaccgggaaagacagaagagcctaaccctcactccaacaagaagtgattcctccgaaggctttctgcagttgccacaccaagattcgcaggactcctcatccgtgggttccaacagtttggaggatggccaaacgctagggaccaaaaagtcaagcatggtggctcttaaacggctccccttcctccggaatcggccaaaagacaaggataaaatgaaggcttgttacaggcggtctatgagcatgaatgacctggtgcaatcaatggtcctggcgggacagtggaccggctctactgagaatctggaggtcccagacgatatctccaccggaaagagaaggaaggaactgggggcaatggccttctccaccaccgctattaacttctctacagtgaacagctcagcaggcttccgctcaaagcagctggtcaacaataaggataccactagttttgaggatatctccccacagggcgtaagtgatgactcaagcactggatcccgggtgcacgcgtctcgcccagctagcttggattcgggacggacctccacaagtaactcaaacaataatgcgagtttgcacgaggtcaaagccggtgcagtaaacaatcaaagccggccacagtcccattctagtggtgaattcagtttgcttcatgaccacgaggcttggtcctcctccggctcctcaccaattcagtacctcaagcgccagacccgctcaagtccagtgcttcaacacaagattagtgaaaccctggaaagccggcaccacaagatcaagactgggtcaccgggatccgaagtagtgaccctgcagcagttcctcgaggagtccaacaaactgaccagtgtgcagataaaatcctcctcacaagagaatctgctggatgaggtcatgaaatcactgtctgtgagctcggacttcttgggcaaggacaagcctgtctcatgcggtctcgcccgtagtgtgagtgggaagacaccaggggatttctacgaccgtagaactaccaagcctgagttcctgcgtccagggccacggaaaacggaagatacctactttattagctccgctggtaaaccaacaccgggtacgcaggggaaaattaaacttgtcaaagaaagcagcttgtctagacagagtaaggattccaacccatacgcgaccctcccgagggcctcgtccgtgatttcaaccgcagaaggcaccactcgcaggacaagtattcatgactttctgactaaggattcaaggcttcccattagcgtggattccccaccagccgctgcggactccaatacaacagcagcctccaacgtagacaaagtgcaggagagcagaaattccaaatcgcgtagccgggagcaacaatcctcgta

SEQ ID NO: 218822 - DNA, 2667 bp, Artificial Sequence
  Description of Artificial Sequence: Synthetic coding sequence
ctgcttgaaagcaagttggagtctacacttaagaagtccctcgaaattaaggaagagaaaattgctgccctggaggcacgccttgaggaaagcactaattataatcaacagctgcggcaagagctgaaaactgtgaagaaaaattacgaagcgcttaaacaacggcaggatgaagagcgaatggtgcaaagctcaccacccatctcgggggaagataataagtgggaacgtgagagccaggaaaccaccagagagcttctcaaggtaaaagacaggctgatcgaggtcgagcggaacaacgccaccctgcaggccgaaaagcaggcactcaagactcagttgaaacagttagagacccaaaataataacctacaggcccagattctggctctgcaaagacagacagtgagtctccaggagcaaaataccactctgcagacacagaacgccaagcttcaggtggaaaactccaccttaaactcacaaagcacatcgctgatgaaccagaatgcccaactactgattcaacagtcatccctcgaaaatgaaaacgaatccgtgatcaaggagcgcgaagacctgaagagtctgtacgattccctcatcaaggatcatgaaaagttagaattgctccacgagagacaggccagcgaatatgaaagtttgattagcaaacatgggactctaaagagcgctcacaaaaatctggaggttgagcacagagatctggaagatagatataaccagttactcaaacagaaagggcagctcgaagacctggagaagatgctgaaggtggaacaggaaaaaatgctgctcgagaacaaaaaccacgagactgtcgctgcggagtataaaaaactgtgcggggaaaacgacaggctgaatcatacttacagtcagctgttaaaggagaccgaggttctccagacggaccacaaaaatctgaagagccttctaaataactctaaactggaacagacccgccttgaagctgagttcagcaagctgaaagagcaatatcagcaattagatattactagtactaagttaaacaatcagtgtgaactactgtcccagctcaaggggaatctcgaagaggagaatcgccacttactggaccagatacagacactgatgctgcaaaaccgaacattgcttgagcagaatatggaatccaaggacctcttccacgtggagcagcgacagtacatagacaagctaaacgagctgagaaggcagaaggagaaattagaggagaagattatggaccagtacaaattttatgacccatctcctccacgcaggcggggaaactggattaccctgaagatgcgaaaactgataaagagcaagaaggacataaatagggagaggcagaaatctctgactctgacaccaactcggagcgactcctccgaaggattcctgcaattgccacatcaggatagccaggacagtagctctgttgggtctaactcgctggaggacggacagacgttgggcacaaagaagtcctctactatgaatgacttggtccagtctatggtgctggccggacaatggactgggagcacagagaacctcgaggttcctgacgacatctccacaggtaagaggcgcaaagaactgggcgcaatggcttttagcactacggccatcaatttctccacagtcaattctagcgccggtttcaggtcaaagcagctggtgaacaacaaagatacaactagcttcgaggacatctctccccaaggagtgagtgacgacagttcaactggtagtcgcgtacacgcgtccagaccagccagtctggattctggaagaacatcaacgtctaactccaacaataacgccagtctccacgaagtcaaagctggagccgtaaataatcaatcccggcctcagtcacattcatccggtgagttcagcctgcttcatgatcatgaagcttggtctagcagtgggtcctctcccatccagtacttgaagaggcaaacccgatctagtcctgtgctccaacacaaaatctcagagaccctggagtcccgtcaccacaaaataaaaacaggcagccctggatcagaggtggtgactctacagcaattcctagaggagtccaacaagctgactagcgtgcagattaaatcgagctcccaggaaaaccttctggacgaagttatgaagtcactgagtgtttcctccgactttctcgggaaggataagccagtgagttgcggcctcgcccgatcagtcagtggaaaaactcctggagatttctacgataggaggactactaaacccgaatttctccggccagggccaagaaaaaccgaggatacctacttcataagtagtgctgggaagcccaccccagggacacaagggaagattaagctagtcaaggagtccagcctgtcacgccaaagtaaggactccaacccctacgcaaccttacctcgggcatcctctgtcatctctaccgcagagggaaccactcgtaggacatctattcacgactttctgactaaagatagccgactacccatctctgtggattcgcctcctgccgctgcagacagtaataccaccgctgcttcgaatgtggacaaggtccaggagagcagaaatagcaaatcccgctcccgtgagcagcagtcatcatag

SEQ ID NO: 218823 - DNA, 5391 bp, Artificial Sequence
  Description of Artificial Sequence: Synthetic coding sequence
atggaaaatgaaattttcacccccctgctggaacagttcatgacatcccctctggtgacatgggttaaaacttttgggcctctggcggctgggaacggaaccaacctcgacgaatatgtggccctggtggatggcgtcttcctgaaccaggtgatgctccagatcaatcctaaattggagtcgcagagggtaaacaagaaggttaataacgacgcatccttgcggatgcacaatctcagtatcttggtgcgccagatcaagttttattaccaagagaccctccagcagttgatcatgatgagcctgcctaatgtgcttattataggtaaaaatccctttagcgagcaagggactgaggaagtcaagaaactgttgctattgcttctgggatgtgccgtgcagtgccaaaaaaaggaggaatttatagagcgcattcagggactggacttcgacacaaaagctgctgtggccgctcatatccaggaggttacacataaccaggaaaacgtcttcgacttgcaatggatggaggtcacagatatgtcccaggaagacattgaacctctgctgaagaatatggcactccatcttaagaggcttatcgatgagagagacgaacacagcgaaacgataatcgaactatctgaggaaagggacggtttgcatttcctgcctcatgcatccagctctgcacagtcaccttgcgggagccccggtatgaagcgcaccgaaagccgccagcatctttccgtggagctcgcggatgccaaagccaaaatcaggcgacttcggcaggagctggaagagaaaactgaacagctgctggattgcaagcaggagctggagcaaatggaaattgagctaaaaagactgcagcaggaaaacatgaaccttctttcggacgcccgatccgccaggatgtaccgtgacgaactggatgcgctgcgcgagaaggcggtcagggtggataaattggagtcagaagtcagccgttacaaagagcgcctgcacgatattgaattctataaagcgagggtagaagagctgaaggaggacaatcaggtattgttagaaaccaaaaccatgctggaggatcagctcgaaggaaccagggcccgatctgataaactgcatgagcttgagaaggagaacctgcagcttaaagcgaaactgcatgatatggaaatggagcgggacatggacaggaagaagattgaagaactgatggaagagaatatgacgctggagatggctcagaagcaaagcatggatgaaagcctacatctggggtgggagctggagcagattagccggacgtcagaactgtctgaggcccctcagaaaagcctggggcacgaagtgaatgaattgacttccagcaggctgctcaagctggaaatggaaaaccaaagtttaactaaaaccgtggaagagctgcgcaccacagttgactccgtcgaaggtaacgcttccaagattctcaagatggagaaagagaaccagcgtctgtccaagaaagtggagattctggagaatgaaatagtccaggagaaacagagtctacagaactgccagaatctgagcaaagacctgatgaaggaaaaagcccagctcgaaaagactatcgaaactctgcgagagaattcggagaggcagattaaaattttggaacaagaaaacgaacacctcaatcagactgtgtcgagcttgcggcagagatcccaaatttctgcagaagctagagtgaaagacattgaaaaggagaacaagattctacacgaatccatcaaggagacctctagtaagcttagcaagatcgaatttgaaaaacgccagattaagaaagagttagagcattacaaggaaaagggcgagcgggcagaagaacttgaaaacgagttgcaccacctcgaaaaagagaatgagcttctccagaagaaaatcacaaacctcaaaataacctgtgaaaagatagaggctctggaacaggaaaactctgagctcgagagggaaaatcgaaaattgaagaagactcttgatagcttcaaaaatctgacattccagttagaaagcttagagaaggagaattcccagctagacgaagagaacttagagctcaggaggaatgtggaatccctcaagtgcgcatcaatgaaaatggcacaactacagctggagaataaagagctggaatccgagaaagaacagttgaagaaaggacttgagttactgaaggcaagttttaagaaaacagagagactagaagtgagttaccagggacttgacatcgagaaccagcgcttacagaagactctggagaactccaataagaagattcagcagctggagtctgaattacaagacctggagatggaaaatcagacattgcaaaaaaatctcgaagaattgaaaatctcttctaaacggctggaacaactcgagaaagagaataagtctctggaacaagaaacgagccagctggagaaagataagaaacagcttgaaaaagagaacaagagactccggcagcaggcagagatcaaagataccacattggaggagaataatgttaagatcggtaatctcgagaaagagaacaagactctatcaaaggaaatcgggatctataaagagtcttgcgtcagactaaaggagctggaaaaagagaataaggagctcgtaaagcgggcaacaatagatatcaaaacgctggtgactctgcgggaagatcttgtgtctgaaaagctgaagactcaacagatgaataacgacctggaaaagttaacgcacgaactcgagaaaatcggcctcaacaaggagcgtctgttgcatgatgaacagtctaccgacgatcgctacaagctgctggagtcaaagttggagtcgacgctgaagaaatccctggaaatcaaagaggagaagatcgctgctttggaggcgagactcgaggagtcaaccaactacaaccagcagctccgacaagagcttaagacagtgaaaaaaaattacgaggccctgaaacagagacaggatgaggaacgaatggtccagagctctcctcctatctccggggaagacaataaatgggagagagaatctcaggaaaccacacgggaactcctcaaggtgaaggacaggctaatcgaggtggagcgaaacaatgcgacccttcaggccgagaagcaagctttgaagacccagctgaaacagcttgagacccaaaacaataacctacaggcgcagatcctggcacttcagcgacagacagtgtctctgcaagaacaaaatactaccttacagacacagaatgcgaaactgcaggtcgaaaatagcaccctgaacagtcagtctacctctcttatgaaccagaatgctcagttgctgattcagcaatctagcctggagaatgagaacgaatccgtaatcaaggagcgagaagacttgaagagcctatatgatagcctgatcaaagatcacgaaaaacttgaactgctacacgagaggcaagcttcagagtacgaaagtctgatctctaagcacggcaccctcaagagtgcacataagaatctcgaggtggagcatagagatctggaggacagatacaaccagctgctcaagcagaaggggcaacttgaggacctcgagaagatgctgaaagtcgagcaggagaaaatgctgctggaaaataaaaatcacgagacagtcgctgcagagtataagaaactgtgcggggagaacgaccgactaaatcatacttacagccaactcctcaaagagaccgaagtgcttcagacagaccacaaaaacctaaagtccttattaaataattccaaacttgagcagaccagactggaggcagagttctctaaactcaaagaacaataccagcagctggatataacatctaccaagctgaataaccagtgcgagttgctatctcagcttaaaggcaacctcgaggaggaaaataggcaccttttagatcaaatccagactttaatgctgcaaaaccggacactgcttgagcagaacatggagtcaaaggatttattccacgtcgaacaacgtcaatacatcgacaaactgaacgaactgcggaggcaaaaagagaagctggaagaaaaaattatggatcaatataaattctatgacccttcacctccacggaggcggggaaattggattacactgaaaatgaggaagctcatcaagagtaagaaagatataaacagagagaggcaaaagtctctgacactcaccccaacccgatccgactccagtgaaggtttcttgcaactacctcatcaggactcacaggactcatctagcgtgggatctaactcgttggaagacggtcagacgctgggcactaaaaagtcatcaatggtggctttaaagaggttaccatttctgcggaacaggcctaaagacaaggataagatgaaggcttgctatcgaagaagtatgtccatgaacgatttggtccagtctatggtgcttgctggtcagtggacaggatcaacagagaacctggaagtgcccgacgatatctccactggaaaacgccgaaaagaacttggcgctatggcttttagcactacagctattaactttagcaccgttaactcatccgcagggtttagaagcaagcagctggtcaataataaagataccactagcttcgaggatatatcccctcaaggagtttctgatgacagcagtaccggctccagagtgcatgcttctcgcccagccagtctggactccggccgtaccagcacatccaattccaataataatgcttccctgcacgaggtgaaggccggtgctgtaaacaatcaaagcagaccacagtcacacagtagtggtgaattttccctgctgcatgatcacgaagcctggtcatccagtggctctagccctatccagtatctcaagcggcagacccgctcctcccctgtccttcagcataaaatttccgaaaccctggaatcccggcatcacaagatcaagaccggaagtcccggtagcgaggtagtcactctgcagcagtttctcgaagagagcaataagctcacctctgtccagattaagagttcttcacaggaaaacctcctcgatgaagtgatgaagtctctcagtgtttcatctgattttttgggcaaggacaagccggtgtcctgtggcctggcgtctgttatttctacagctgagggcactactagaaggaccagcatccacgacttcctgactaaggactcacgtcttccaatctcagttgattcacccccagcggcagcagattccaacacaaccgccgcaagcaacgtggataaggtgcaggagtcgcgcaacagcaagtcccgctcacgagagcagcagtctagttat

SEQ ID NO: 218824 - DNA, 1119 bp, Artificial Sequence
  Description of Artificial Sequence: Synthetic coding sequence
atggatcagtacaaattttacgatccgagcccacccagacgaagagggaattggatcactttaaagatgcgcaagctcattaagtccaagaaggacataaatcgcgaaaggcagaagtctctgaccttgacacccacaagatccgattcctcagaaggattcttacagcttccacatcaggatagtcaagatagtagtagtgtcgggagcaattcactcgaagatggtcaaaccctcggcacaaagaagagctccaataccacgtctttcgaggacatatcacctcagggagttagcgacgactcctcaacaggcagccgcgttcatgcgggagcagtgaacaaccagagcaggccccagagccactcctctggggagttctcacttctgcatgaccatgaagcctggagctctagcgggagctcaccaattcaatacttgaaaagacaaacacggagctctcccgtgttgcagcacaagattagcgaaactctggagtctagacaccataagatcaagacaggatcccctggctctgaggtagttacactccagcagtttctagaagagtctaacaagttaacctctgtgcagataaaatctagctcgcaggaaaatttacttgatgaggtgatgaaaagcctttccgtgtccagtgactttctaggcaaggataaaccagtgtcttgcgggcttgccagatcagtgtctgggaaaactcccggtgacttttacgacagaagaaccacaaagccagagttcctgcgtccaggacccaggaaaacagaggatacctatttcatcagctcagccggtaagcccacccctggcacccagggcaagattaaattggtcaaagagtccagcctctcccgtcagagtaaagactccaacccgtacgccacgctgccaagagcaagcagtgtgatatccaccgcggaaggcaccaccaggcggacgtctatccacgattttttgacaaaagactccaggctgccaatctccgttgattccccaccagctgcggctgactctaatactaccgcggctagtaatgtggacaaagttcaggaatcacgcaatagcaagagccggagccgtgaacaacaaagttcatag

SEQ ID NO: 218825 - DNA, 5615 bp, Artificial Sequence
  Description of Artificial Sequence: Synthetic coding sequence
atggaaaatgagatattcactccgctgctggagcagtttatgacatcccctctggtgacgtgggtgaagacgttcggacccctggccgcaggcaatggcacaaatcttgatgagtatgtggcactagtcgacggtgtgttcctgaaccaggtaatgctgcagatcaaccctaaactcgagagccaaagagtgaacaagaaagtgaataacgatgcctccttgcgcatgcacaatctgtccattctcgtccggcagatcaagttttattaccaggaaacattgcaacaactcattatgatgagtttgccgaatgtgctaatcatcggcaagaatccattcagcgaacaaggtacggaggaagtgaagaagctgctgctacttctcctgggctgcgccgtgcagtgccagaagaaagaagaatttatcgagagaatacagggcctggatttcgatacaaaggccgctgtggcagcccatatacaggaggttactcataaccaggagaacgttttcgacttacagtggatggaagtgacggacatgagtcaggaagatattgaacctctgcttaagaacatggctcttcatctgaagagactgattgacgaacgcgacgaacactccgagaccataatcgagttatccgaggagcgggacgggctgcattttttgccacatgcctcctcatccgcccagtccccctgtggatcccccggtatgaagagaactgaaagtcggcagcacttgtccgttgagcttgccgatgcaaaagccaagatccgacggttgcggcaagaactcgaggagaagactgagcagcttttggactgtaaacaggaacttgagcaaatggaaatagagctgaagagacttcagcaagagaacatgaatctcctctcagatgcaagaagtgctaggatgtatagagacgaactagatgctttgagggaaaaggcagtgagagtagataaattggaatcagaggtgtcccgttataaggagcgcctgcacgatatcgagttttataaagctcgagtggaagaactaaaagaggataatcaagtgcttcttgagaccaagaccatgcttgaagaccagcttgaaggcactcgagccaggtctgacaaactgcatgagcttgagaaggaaaacctgcaactcaaggcaaagctgcatgacatggagatggagcgagacatggatcggaagaagatcgaggagttgatggaagaaaacatgacgctggagatggctcagaagcagagcatggatgagagcctgcatctaggatgggagcttgagcaaatctcaaggactagtgagctaagtgaagcccctcaaaagtccctgggtcacgaggtgaacgaactaacaagttcgaggctcctcaagctggagatggagaaccagagccttacgaagactgttgaagaactacgaactacggtcgatagtgtcgaagggaacgccagcaagatcctgaagatggaaaaagagaatcaacgtctgtccaagaaagtcgagattctggaaaatgaaattgtgcaggagaaacagagcctgcagaactgtcagaacttgtccaaggatctcatgaaagaaaaggcccaacttgagaaaacaattgaaacgctccgcgagaattcagagcggcagatcaagattctcgaacaggaaaatgagcacctgaatcaaaccgtgtcaagtctgagacagaggtcccagatcagcgcagaggcccgagtgaaagatatcgagaaagaaaacaagatactacacgagagtattaaggagacctccagcaaactctccaaaatcgagttcgaaaagcgacagataaaaaaagaactggagcattacaaagagaagggcgagcgggctgaagaattagagaatgagctgcaccacctggaaaaggaaaacgaactgctgcaaaagaagatcaccaacctgaaaattacttgcgagaaaattgaagccctcgaacaagagaacagcgagctggagcgagaaaatcggaagctgaagaaaacccttgactcgttcaagaacctgacgtttcagttggagagcctggagaaggaaaatagccagttggatgaggaaaaccttgaattgcgacgaaacgtggagtctctgaagtgcgcttcaatgaagatggctcagctacagctagagaataaagaactagagtccgagaaggagcagctgaaaaaaggattagaactgctgaaagccagctttaaaaagacggaacgccttgaagtttcctaccaggggttagatattgaaaaccaaaggctccagaagacactggaaaactctaataagaagatccaacagttggaatctgagttgcaggatcttgagatggaaaatcagaccctgcagaagaacctggaggagttaaaaattagcagcaaaaggctcgaacagctggagaaggaaaataagagcctcgagcaagagaccagtcagttggagaaggataagaagcagttggaaaaagaaaataaacggctgcggcagcaggccgagatcaaagacaccaccttggaggagaacaacgttaaaatcggtaatctggagaaagaaaataagactcttagtaaggaaatcggcatttataaggaatcctgcgtgaggcttaaggagctggaaaaggaaaacaaagaattggtgaaaagggcaaccatcgacataaagaccctagtgacccttcgggaagacctggttagtgagaaacttaagactcagcagatgaataacgatttggagaaactgacccacgaacttgagaagataggtctgaacaaggagagacttttacatgatgaacagtccaccgatgactccaggtacaagcttcttgaaagtaagctcgagagtacacttaagaaatccttagagattaaggaggaaaagatcgctgcccttgaagccagattagaagagtccaccaactacaaccagcagctacgtcaggagttaaaaaccgtcaagaagaactacgaagctctcaagcagagacaggacgaggaacgaatggtccagagctcaccacccataagcggtgaagataataaatgggagcgagagtctcaggaaaccacaagggagctgctgaaggttaaggatagactaatcgaagtggagcgcaataatgccactttacaggcagagaaacaagcactgaagactcagctgaagcagcttgagactcaaaataacaatctgcaggcacagatcctcgctttacaaagacagactgtgtctttacaggagcagaataccactctccaaacccagaatgctaaactccaggtggagaacagtactctcaactctcagagcacatctctgatgaaccagaacgcacaactgctgattcagcagagtagcctggagaatgagaacgagtccgtgatcaaggaaagagaagacttgaagtcactgtatgacagccttatcaaggaccacgagaagttggagctcttgcacgagcgacaggcgtctgagtacgagagcctgataagtaaacatggtacactgaaaagcgcacacaagaatctggaggtcgaacaccgggatctcgaagataggtacaatcagctgctgaagcagaaagggcagctggaagaccttgagaaaatgctgaaggtggagcaggagaaaatgctcctcgagaacaagaaccatgaaaccgtggctgcggaatacaagaaactttgtggtgagaatgatagattgaatcatacgtatagccaactcctcaaagaaaccgaagttctgcagaccgaccacaagaatctaaaaagtctgcttaataactccaaacttgagcagacccgattagaggccgagttcagtaagcttaaagagcagtatcaacagttagacataacaagcaccaaactgaacaaccagtgcgaactgctaagtcagctgaagggaaatttagaagaagagaaccgccacctgctggatcagattcagacattaatgctacagaacagaacattgctcgaacagaacatggagtctaaggatctgtttcacgtggaacaaagacagtatattgacaagctgaatgaattgagaagacagaaagagaagctcgaggagaagattatggaccagtacaaattctacgatcccagtccacctaggcggcgaggcaattggataacactaaagatgcgcaagctgattaaatcaaaaaaggatatcaacagggaacgccaaaagtcgctgacattgaccccgacacggtccgactcctctgagggatttttgcaactcccccaccaggatagccaggactcctcatcggtgggcagcaatagtctggaagacgggcagacgctaggcacaaaaaagagctctatggttgccctaaaaaggctcccatttttacgcaatcgtcccaaggataaggacaaaatgaaagcgtgctatcggaggagcatgagcatgaacgacctagtacagtcgatggtgctggctggccagtggactggaagcaccgaaaacctggaagtgccagatgatatctccaccgggaagcgcagaaaggagcttggagctatggctttcagtaccaccgcgataaatttcagtactgtgaactccagcgcaggattccgaagtaagcagctggttaacaataaggatacaacctctttcgaagatatctccccgcagggcgtgagcgacgactcctccaccggtagcagagtgcatgccagcaggcccgcatctctagatagcgggagaacaagtacatcgaactcgaataataatgccagtctgcatgaagtgaaggcgggtgcagtgaacaaccagagcaggcctcagagccactccagcggtgagttttccctgctgcatgaccatgaggcatggtcatcatcgggatccagtcctatccagtacctgaaacgccagacgagaagttcccccgtgctccagcacaagatctccgagactctggagtctaggcaccacaagatcaaaaccggaagccccggatccgaagtggtgacacttcagcagttcctggaggagtcaaacaagctgacgagtgtgcagatcaagagctccagccaggaaaatctgctcgatgaggtcatgaagtcactttcggtgtcgtctgatttcctcggcaaggataagcctgttagttgcggtttggctagatcagtcagcggaaagacacctggcgacttctatgatagacggaccaccaaacccgagtttctaaggcccggtccaagaaaaactgaagacacttacttcatctccagtgcgggaaaaccaacccctggtacccaggggaaaataaaactggtgaaagagtcttccctctcaagacagtcaaaagactccaacccgtacgctacactgccacgagcatcaagtgtgatatcaaccgccgaaggcaccacacggcgaacatccatccacgatttccttacaaaggactcccgattgcctatctctgtagactcccctccggctgctgccgattccaatactacggcggcttccaacgtggacaaagttcaggagagcagaaatagcaagtctcggtcccgcgagcagcagagttcata

SEQ ID NO: 218826 - DNA, 420 bp, Artificial Sequence
  Description of Artificial Sequence: Synthetic coding sequence
atgccctgcgccgctcggagccggagctcttggaggagaagctggacaaacacagcttgttggtccttgtgcccatgtcccggacccagaagtccatcacccgctcctatgagaagagctcagagtagcctgtgtctgcgcgacgaaactctggcgggtggtcagaggcgcaagctcagctctcggttccctgttggccgatccagtgaaagcttctcccctggcgacaccccaagacagcggttcaggcagaggcatccgggtccgctgggcgctcctgtctcacactccaagggccctggcgtgggttgggaaaactctgctgagactctgcaggaacacgaaaccgatgccaacagagagggccctgaggtgcaggaacccgaaaagcggccactaacaccttcactgtcccagtag

SEQ ID NO: 218827 - DNA, 4431 bp, Artificial Sequence
  Description of Artificial Sequence: Synthetic coding sequence
atggaaggaggcaaagggcctcgtcttagagactttctgtccggctcccttgccacatgggccttaggtctcgcgggactggtcggagaagcagaagattctgagggagaggaagaggaggaggaagaagagccacccctgtggctggaaaagaggttcctgcgacttagcgacggagccctacttctccgagttctgggaataattgccccatcaagccgaggcggaccaagaatgctccggggactcgatgggcctgctgcctggcgggtttggaacttgaaccacttatggggccgtttgcgggacttctaccaggaagagcttcagctgctgatactttcaccacctcccgatttgcaaacattgggctttgatcccttgtccgaggaggccgtagaacagctggagggagttctgcgcctcctcctcggcgcatctgttcaatgtgagcatcgagagctcttcattagacatatccaggggctcagcttagaagtgcagtccgaactggctgcagctatccaggaagtgactcaaccaggcgcaggggtcgtactggccctgtccgggccagacccgggtgaactggctccggctgagttggaaatgctctctagaagcttgatgggaacgctcagtaaactggccagggaacgtgacctgggggctcagcgccttgcagaattactgctggagcgagagcccctgtgtttgcggccagaggccccaagtcgcgctcccgcagagggcccaagtcaccatttggctttacagctggctaacgcgaaggcacagctacgtagactccgccaggagctggaagaaaaagctgaactgctcctggattcccaggctgaggttcaaggcctcgaggccgaaataaggcgcctacggcaggaggcacaggctctcagcggtcaagctaaaagggcagaactctaccgggaggaagccgaggccttacgcgaaagggccggtcgattacctcggctccaggaggaactaaggcgctgtcgcgagagactgcaggccgctgaggcctataagtcacagctcgaggaagagcgggtgctgtccggcgtcctggaagctagcaaagcgcttctagaggagcaactcgaggctgccagagaacggtgcgccaggcttcatgagacgcaacgcgagaacctcctgttacggaccaggctcggcgaagcgcacgccgagcttgactcccttcgacaccaggtggatcagctggctgaagaaaacgtcgagctggaattggagctacagcggtctctggagcctccaccaggttctcccggagaagctcctctggccggagcagcaccatctttacaagatgaagtccgggaagccgaggccggtcggttacggactttggagagagagaaccgcgaacttcgcggactactgcaggtgcttcagggccagccaggcggtcagcatccattgctggaagcccctcgcgaagacccagtgttgccagtcctggaggaggcaccccagacacccgtggccttcgaccacagcccacagggattggtccaaaaggccagagacgggggtccacaggcactggacctggcaccccctgcccttgattccgtgttggaagcctccgcagaatgtccacaggcccctgacagcgatccacaggaagccgagtcccctctccaagcagctgccatggacccacaggcatccgattggtcccctcaggaatctggcagtcctgtggaaactcaggagtctcccgagaaagccggacgccgttcctccttgcagtctccagcatctgtcgcaccacctcagggacccggaacaaaaatccaggccccacagttactagggggtgagacagagggcagagaggcaccgcagggagaattggtgccagaggcctggggcctgcgtcaggagggacccgagcacaagcccggtccctcagagccctcgtcagtccagctggaggaacaggagggaccaaaccagggtctggacctcgctactggtcaggctgaggccagggaacatgatcagcgcttggaaggtactgtgagagatccggcttggcagaagccacagcaaaagtccgaaggggctctggaagtacaggtgtgggaaggacccattcccggagaatctctcgcttctggtgtggccgagcaggaggccctgcgcgaggaagttgcccagctgcgcaggaaggccgaggccctgggcgatgagttagaagcacaggcccgtaagctcgaggctcaaaatacagaagccgcacggctgagcaaggagctggcccaagctcggagagctgaagcggaggcccatcgggaagcagaggcacaagcttgggaacaggctcgacttcgggaagcagtggaggcagccggacaggagctcgagagcgctagccaggaacgcgaggctctggtggaggcgctcgccgctgcaggccgagaacgacggcagtgggagcgtgaagggagccgccttcgcgctcaatccgaagcagctgaagagcgaatgcaggtgctagaatctgagggaagacagcacttggaggaggctgagagagagcgcagggagaaggaagccctgcaagcagagctggagaaggccgtggtcagaggcaaggagctgggcgacaggctggaacatcttcagcgcgagttggagcaggccgctttggagaggcaggagtttttacgtgaaaaggagagccagcatcagcgctatcaaggtctggagcaaagacttgaggccgagctgcaagcagctgccacaagtaaggaagaggccctcatggagctcaaaaccagggccctgcagcttgaggaggagcttttccaactgcgtcaaggtccagcagggctcgggcctaaaaagcgggcagaaccccaactggtagagacacagaacgtgagactgattgaggtggagcggagcaacgccatgcttgtcgcagagaaagctgctttgcagggccagctacagcatctggagggacagctgggatcattacagggacgggcacaggagctgctccttcaatcgcagcgtgcccaggagcattcatcacgcttgcaggctgaaaaaagtgtactggagattcagggacaggaactacaccgtaagctcgaggtcttggaagaggaggtcagagccgcacggcagtctcaggaggagacgagaggccaacagcaggcattactgcgtgatcacaaagcccttgcccagctgcagcgccgtcaggaagcagagttggaaggcttgcttgttaggcaccgagatctgaaggcaaatatgagggccctggagctcgcacatagagagctgcaggggagacatgagcagctgcaggcccaaagggcgtctgtcgaggcccaagaagtagcactgctagcggagcgcgagcgacttatgcaagatggacataggcagaggggtctggaagaggagctcagaaggctgcagtccgagcatgaccgggctcaaatgctgcttgctgagttgtcccgtgaacggggtgaacttcaaggggagcgtggggaacttaggggcaggcttgccaggctggagcttgagcgcgcacagctggagatgcagtcccaacaacttagggagtccaaccagcagcttgacctctccgcatgtcggctgaccacccaatgcgaacttctgactcaactgcggtcagctcaggaagaggagaataggcaactcctggccgaggtgcaggcactgtctcgagaaaatcgggaattgttagagaggtccctggaaagtagagaccacctgcatagggagcagcgagaatatctggaccagttaaacgccctgcggagagagaagcagaagcttgtggagaagataatggatcagtatagggtgcttgagcctgttcccctccccagaactaaaaagggctcatggctggcagacaaagtaaaaagactaatgcgtccgaggcgggaaggagggccacctggcggattacggttaggcgctgacggcgctggctctaccgagtccttaggaggcccacccgagaccgagctgccagaggggcgagaagccgatgggaccggcagccctagcccagctccaatgcgcagagcccaatcctctctctgcctgcgagacgagaccctagctggtgggcaaagaaggaaactgtcctctcggtttcctgtgggaagatcttccgagtccttttccccaggtgatacacccagacagcggtttaggcagcgccatcccggacctctaggcgctcctgtgagccacagtaaaggacccggtgtgggctgggagaacagtgcagaaacactccaggaacacgagacggacgctaacagggagggtcctgaggtacaggaacctgaaaaaaggccactgacaccatctctctcccagtag

SEQ ID NO: 218828 - DNA, 2139 bp, Artificial Sequence
  Description of Artificial Sequence: Synthetic coding sequence
atggcaggcgtagccgctcatagagcacatcctccctttaccgctcatatgaaaaacagggggctccgggaagaactagaaaaagccgtagtgaggggcaaagagcttggggatcggctggaacacctccagagggagttggaacaggcagccctggaacgccaggaattcctgcgggaaaaggagagccaacatcagaggtatcaggggctagagcagcgcctggaggcagaactccaggcagccgctacttctaaggaggaagctcttatggagctgaagacgcgggctctacagctcgaggaagaactgtttcaattgcggcaggggcctgctgggctaggacctaagaaacgggctgaaccacagcttgtggagactcaaaacgtgcgtttaattgaagtggagcgctctaacgcaatgctggttgccgaaaaggctgctctgcagggtcaactccagcatttagaaggccagctgggtagtttgcagggcagagcccaagaactgctgttgcagtcccaaagagcacaggagcatagttccaggctgcaagctgaaaagtccgttctggaaattcagggccaagaactgcacagaaagttggaggtacttgaggaggaagtccgcgctgcgcgtcagtcccaggaagagactcgcggacagcagcaggctcttctcagagaccataaagcactggcacagctgcagcgacggcaggaagcagaacttgagggactgcttgtgaggcaccgggacctcaaagccaatatgcgagccctggagctggcccacagggaacttcagggacgccacgagcagctccaggctcaaagagcttctgtcgaagcccaggaggtggccctgttggccgaacgcgagagactcatgcaggatgggcaccggcaaagggggttagaggaggaattacgcagactgcagtcagaacatgatagggcccaaatgctccttgccgaactgagtagagagcggggagagcttcagggcgaacgaggtgaattgcggggaaggctggcccgattggagcttgagcgggctcaattggagatgcagagccagcaactgcgggagtctaatcagcaactagacctgtcagcgtgccggctgaccacacagtgtgagctcctgacccagttacggtcagctcaggaggaggagaacaggcagttgctcgccgaagtgcaggccctctctcgggaaaaccgggaacttctggaaaggagtttggaaagtcgcgaccacctgcacagggagcagcgggaatacctcgaccagcttaacgcacttagaagagagaagcagaagctagttgaaaaaatcatggaccagtatcgggtccttgaacctgtccccctgccacggaccaagaaaggctcatggttagctgataagggacccctgcctagacatccatgtgctgggcctagagctccgtctgcctgtggaatgagaccttggcaggctgggagtggaggcaattccgcccaaggatcccgttggggagaagccctctcacatagtgcgcttggcacccccctcgggaatgacagtgatagtgctatccaggccccttggggtagaccctcgccaacggccaaggacttggtgtgggatggcagaacaccgctgcggccatgccggaatacgaagcagatgcccacagagcgtgccctgaggtacaggaaccgcaggaatgtgccatccccccatccatctgcctctgatacagtgggaactgccggtcttggagtgcagcctagtcggcactggagcgtctctggaggccctcgacagccgaagtcctcagggtcacaaggaccccagggcgagagcctagacaaggaggcctgggccctgcgatccagcacagtgagtgctggggctcgccgttggtcttgggatgaatgcgttgaccgtggcgacgggtggcctcctcgagccgcacccggatggtctagtggaagtagccgctggctgcctctgcgacagcgcagcctaggagatccccctgccgaggggggttggcaagagctagcccgagagccaccagcgctgtccagatgggaggcggaatcacaatgctggggaacagtggcatgggccgacctggagccctag

SEQ ID NO: 218829 - DNA, 4077 bp, Artificial Sequence
  Description of Artificial Sequence: Synthetic coding sequence
atggaaggaggcaaaggccctaggctccgggacttcctgtcaggatctctcgccacctgggcactcggcctggcaggcctcgttggcgaggcagaggacagtgaaggagaggaggaggaggaagaggaagagcctccactatggttggagaaacggttcctgagactgtctgacggtgcactgctactgcgcgtcctcggtatcatcgcaccatcctcacgcggaggaccccgaatgctgcgtggactggatggccctgctgcttggcgggtgtggaacctgaaccatctttggggcagactgagggacttctaccaggaggaactgcagttgctcatactgtcaccacctcccgatctgcagactctcggtttcgacccactgagtgaggaagcagtggaacaactcgagggtgtacttcggctgttattaggggcatccgtccagtgcgagcacagggaattattcatacgccacatccaggggctctctctggaggtgcaaagtgagctggctgctgccattcaggaggtaacgcagccaggagccggtgttgtactcgctctaagtgggccagatcctggcgagctggcacccgcagaacttgaaatgttgtcaaggtctctcatggggactctgtcaaagcttgcgagagagagagacctgggcgctcagcggttggcagaactgctcctcgaaagagagcctctgtgcctgagacccgaagcccctagccgcgcacccgctgaaggccctagtcaccacctggcacttcagctggctaacgctaaagctcagctgagacgactgcgacaggagctggaggaaaaggcagagctgttgttggatagccaggccgaggtgcagggacttgaagctgagatcagacgccttaggcaggaggcccaggccctctcaggccaggcaaagcgcgctgagctctaccgggaggaagccgaggccttgcgcgaacgggcaggcaggctgccacggctacaggaggaactgcgccgttgccgggaaaggctccaggccgctgaggcttataaatcacaactcgaggaggagcgagtgctctccggtgttttggaagcctccaaggcgctcctcgaagagcaactggaggccgcaagagagcgctgcgccaggttgcacgagactcagagagagaatctcctcttgaggacgcggcttggcgaagcccatgctgagcttgactccctcagacaccaggtcgaccaactcgcagaggagaatgtcgagctcgagctggagctacaacggagccttgagccacctcccggatctcctggagaagccccattggccggagctgcaccctccctgcaagatgaggtgagagaagccgaggcgggtcgcctccgcacactggagagagaaaaccgcgagctccggggtctgttgcaggtcctgcaagggcagcccggtggccagcaccctctcttagaagcccctagggaagatcccgttctgccggtgttggaggaggctcctcagactccggtagcttttgatcactccccccaaggcctcgtgcagaaagcccgtgacggtggcccacaagctctggacttagctcccccagccctggattcagtactggaggcttccgctgaatgtccccaagccccagatagcgatccgcaggaagctgagagtccacttcaggctgcggctatggacccccaggcgagtgattggtctccacaggagtctggtagccccgtggaaacccaggagagccctgaaaaggcagggcgacggtcctcactgcaatctccggcaagtgtggccccaccccagggaccaggaaccaagatccaggcgcctcaattactgggtggcgagactgagggccgagaagcaccacagggagagctggttccagaggcctggggcctccggcaggagggacctgaacacaagccaggcccttcggaaccaagcagtgtccagctggaggaacaggagggacccaatcagggcttagatctggccacaggtcaagcagaggcacgcgaacacgatcagcgcctggagggcaccgtccgggacccagcctggcagaaaccccaacagaaaagtgagggcgcactcgaggtgcaggtatgggaaggacccataccaggcgagtccttggcgtcaggggttgcggagcaagaggctctgagggaggaggtcgcccagctaagaagaaaagccgaggccctgggagatgagttggaggcccaggccaggaagcttgaggctcagaacaccgaagcggctagactgtccaaggaactggcacaagccagacgcgctgaggcagaggcacaccgggaggcggaagctcaggcctgggaacaggcgcgactgcgggaggctgtggaagcagctggacaggaattggaaagcgcttcgcaggaaagagaggctctggtggaagctctggcggctgctgggcgtgaacgtcgtcagtgggaacgggagggctctagattaagagctcagtccgaagctgcggaggagagaatgcaggtgctggagagcgaggggagacagcacttagaggaggccgaaagggagcgcagggagaaggaagcactgcaggcagaattagaaaaggccgtcgttcgaggaaaagaactgggcgataggctggagcacctgcaacgggaattggagcaggctgcccttgagcgccaggagttcctgagagagaaggaaagccaacatcagagataccaaggactcgaacagcgcctggaggccgaactacaggccgctgccacgtctaaagaagaggccctaatggagcttaaaactagagcgcttcagcttgaggaggagctatttcagctgcgccagggcccagctgggctgggacccaagaaacgcgcagagccacagctcgtagaaacacagaacgtacgacttattgaggtggagcgctcaaacgccatgctagtggcagaaaaagctgcacttcaagggcagcttcaacacctggagggacagctgggatccctgcaggggagagcgcaggagctgctcctggcggaaagagaacggcttatgcaagatggccaccgtcagcgcggactggaggaagaacttaggcgcctgcagtcagagcacgacagagcacagatgctccttgccgagttatcacgggaacgaggcgagctccagggcgaaaggggcgagctgcgcggacggctggcacgccttgagttagagcgagcccaattagagatgcaatctcagcagctgagggagtcgaatcagcagcttgatcttagcgcctgccgcctgaccacccagtgcgagcttctgactcagctgagaagcgctcaggaggaagaaaatcgtcaactactggctgaggtccaagcactatctagagagaatcgagaattgctggaacggtcccttgagtctagagatcatctccatagggaacaaagggaatacttggatcagctgaatgctctacgcagagagaaacagaagctcgtggaaaaaatcatggatcagtatagggttttggaacccgtgccgcttcccaggaccaagaaaggatcatggctggcggacaaagttaaaagactcatgcgtccacggagagagggtgggccacccggaggcctacgtctcggagccgacggcgctggttctactgagagtttggggggacccccagagactgagcttccagaagggcgtgaagccgatggaactgggtctccttctccagctccgatgaggagagcccagagctcgctgtgtcttagagacgagacactcgccggtggtcaacgcaggaaactgtcatcaagattccctgtaggccgaagttccgagtcatttagcccaggcgacactccaagacagagattccggcagaggcatcctggcccactaggagctccagtcagccatagtaagggccctggtgtgggctgggagaacagcgccgagacattgcaggaacatgagaccgacgcgaatcgagaggggcctgaagtgcaggagcccgagaaaaggcccctcacaccctcgctgtcccagtag

SEQ ID NO: 218830 - DNA, 684 bp, Artificial Sequence
  Description of Artificial Sequence: Synthetic coding sequence
atggggggaacgacgtcaactcggagagtcacctttgaggcggacgagaacgagaacattaccgtggtgaaggggattcggctctcggaaaacgtgattgaccgtatgaaagaatcttcgccgtcgggatcaaaaagccaacgatactctggcgcatacggtgcgagcgtaagcgacgaagagctcaaacgccgtgtcgctgaagagttggcgttagaacaggctaagaaggaatcagaagatcagaagcgccttaagcaggcaaaagagttggatagagagcgggctgccgcaaatgaacaactgacacgggctatcctcagggaacgtatatgcagtgaagaagagcgcgcaaaagctaagcacctggccagacaactcgaggaaaaggaccgggtacttaagaaacaggacgcattctacaaagagcagctggctcgcctcgaagagcgctcctccgagttttatagggtgaccaccgagcagtaccagaaagcagcagaggaagttgaagccaaattcaagcgttacgagtctcatccggtgtgtgccgatctgcaggcaaaaattctacagtgctatagagagaacacccaccaaaccctgaaatgctccgccctagctacccaatatatgcactgtgtgaaccacgcaaagcagtccatgctcgagaaaggtggctag

SEQ ID NO: 218831 - DNA, 417 bp, Artificial Sequence
  Description of Artificial Sequence: Synthetic coding sequence
atgggaggcacaacctcgacgaggagggtgacatttgaagcagatgagaacgagaacatcacagtggtcaaagggatcagactgtcggagaacgttattgataggatgaaagagtcctcacctagcggatcaaagtctcaaagatatagcggtgcttatggcgcatccgtctccgacgaggaactgaagcgcagagttgctgaggagctggcgttggaacaggccaagaaggagagcgaagaccagaagaggctcaaacaggcaaaggagctcgatagggaaagagccgctgcaaatgagcaactcaccagagcgattcttagggaaaggatttgcagtgaagaagagcgcgcaaaagctaagcacctgatcaaggtggaattactttgggtcaaacccggagtattgactgcctag

SEQ ID NO: 218832 - DNA, 333 bp, Artificial Sequence
  Description of Artificial Sequence: Synthetic coding sequence
atgaaatgcgaggagacacacgctccaaatagtaactgggtctacgtcatgctccccagtaaaaagacagtgagaatgccatctgtcacccaacggttgagagatcccgacattaatccctgcctgagcgagagtgatgctagtacgcgatgcctagacgagaacaattatgacagggaaagatgtagcacttactttttaaggtacaagaattgtcgacgcttctggaactccatcgtgatgcagcgacggaagaacggcgttaagccttttatgcccaccgccgcagagagagacgagattctgcgcgcagttggcaatatgccatattag

SEQ ID NO: 218833 - DNA, 258 bp, Artificial Sequence
  Description of Artificial Sequence: Synthetic coding sequence
atgccttctgtgacccaacgacttcgagatccagacattaatccttgccttagcgaatcagatgcgtcaaccagatgcctggatgagaataactacgatagagaacggtgtagtacatactttctccgctacaagaactgccgtaggttttggaattccatcgtcatgcagcgcaggaaaaatggagttaagcctttcatgcccacggctgccgagagggacgaaattttacgagctgtcggtaacatgccatactag

SEQ ID NO: 218834 - DNA, 285 bp, Artificial Sequence
  Description of Artificial Sequence: Synthetic coding sequence
atgctcccaagtaaaaaaaccgtgaggatgccttcagtgacgcagcgtcttcgggacccggatattaatccatgtctttcagaatcagatgcctcaactcgctgccttgacgaaaacaattatgaccgggagcggtgcagtacatacttcctgcggtacaaaaattgtagaaggttttggaactcaattgtgatgcagagacgtaaaaacggcgtgaagccctttatgcccactgccgctgaacgagacgaaattttacgtgctgtggggaacatgccatattag

SEQ ID NO: 218835 - DNA, 135 bp, Artificial Sequence
  Description of Artificial Sequence: Synthetic coding sequence
atgcccagtgtaacacagcgcctgagggatcctgatataaatccttgcctgagcgagtccgatgccagtaccaggtgtttagacgagaataattacgaccgcgagcggtgtagtacttactttttgcgctattag

SEQ ID NO: 218836 - DNA, 294 bp, Artificial Sequence
  Description of Artificial Sequence: Synthetic coding sequence
atgcaccaaactcggacaggcaaaaaaacagtgcgtatgccaagtgtgacacaacgtctcagggaccccgacatcaacccttgtttgtcagagagtgatgcatccacaagatgtctcgacgaaaacaactacgacagggaacgatgcagcacatattttttgcgctataaaaactgtcgcaggttctggaactcaatcgtgatgcagcggaggaagaatggcgtgaagccatttatgcctacagctgccgagcgggacgaaattttacgggctgtgggcaacatgccctattag

SEQ ID NO: 218837 - DNA, 207 bp, Artificial Sequence
  Description of Artificial Sequence: Synthetic coding sequence
atgcatcagacacgcactggcaagaagaccgtgcgcatgccatcagttacccagagactgagggacccggacatcaatccgtgtctgtctatccttttctacttgctgaatgatgcatctctcatttctgtaaggaacctaatgctgcccccagatgtctggatgaagatcacaatgacggggaagggcgtgcccctgacctcatag

SEQ ID NO: 218838 - DNA, 264 bp, Artificial Sequence
  Description of Artificial Sequence: Synthetic coding sequence
atgtccacatcagtgccacagggtcatacatggacccagcgcgttaaaaaggacgacgaggaagaggaccccctggaccagctgatcagccgaagtgggtgcgccgcttcccacttcgcagtacaggaatgcatggctcagcaccaagattggcgccagtgtcaacctcaggtccaagcgttcaaggactgcatgagcgaacagcaggccaggaggcaagaggagttgcagcgcaggcaggaacaagccggtgcacaccattag

SEQ ID NO: 218839 - DNA, 264 bp, Artificial Sequence
  Description of Artificial Sequence: Synthetic coding sequence
atgagcacatcagtgcctcaaggccatacctggacacaacgcgtcaagaaggacgatgaggaagaggaccctctcgaccagctgatctcccgatctggttgcgccgcttctcattttgctgtccaggaatgtatggcccaacaccaagactggaggcagtgccagccccaggttcaggctttcaaggattgcatgtcagaacagcaggccagaaggcaggaggaactccaacgtagacaggagcaagccggagcccatcattag

SEQ ID NO: 218840 - DNA, 291 bp, Artificial Sequence
  Description of Artificial Sequence: Synthetic coding sequence
atgttctatcggctgccgattccgaggatgagcacgtccgtccctcaggggcacacgtggacccagagggtcaagaaggacgatgaggaagaggatcctctggaccagctcatcagccgctctggatgtgctgccagtcacttcgctgtgcaggagtgcatggcccaacatcaggattggcgccagtgtcagcctcaggtgcaagctttcaaagactgcatgtcagaacagcaggcccgacgtcaagaagagctgcaacgacgacaggagcaggctggtgcccaccactag

SEQ ID NO: 218841 - DNA, 264 bp, Artificial Sequence
  Description of Artificial Sequence: Synthetic coding sequence
atgtccaccagcgtaccacagggacatacttggacgcagagagtaaagaaggatgacgaggaagaggaccctttggatcagctgatttctaggtctggctgtgcagcttcccatttcgcagtacaggagtgtatggcccagcatcaggactggaggcagtgtcagccccaagtgcaagcctttaaagattgcatgtcagaacagcaagctcgcagacaggaggaattacagaggagacaagaacaggctggcgctcatcactag

SEQ ID NO: 218842 - DNA, 1731 bp, Artificial Sequence
  Description of Artificial Sequence: Synthetic coding sequence
atggctgctagtgagaccgtgagactgcgcttacaatttgattacccaccgccagccacgcctcactgcactgctttctggcttctggtggatctcaacagatgccgggttgtgacggacctgatatctctcatacgacaaaggtttggctttagctctggggcattcctcggtctttacctcgagggcggacttctacctcccgcagaaagtgccagactcgtgagagataatgactgccttcgcgtgaagctggaagagaggggagtggcggaaaactctgttgttataagtaacggggacattaatctgtcactgcggaaagcaaaaaagcgggcattccagctagaagagggggaggagaccgagcccgactgtaagtattccaagaaacactggaagtcccgcgaaaacaacaataacaacgagaaagtcttggatcttgaacccaaggcagttactgaccagacagtttctaagaagaacaagcggaaaaacaaagctacttgcggtacagttggggatgacaacgaagaggccaaaagaaaaagtccaaagaagaaggagaagtgtgaatataagaagaaggccaaaaacccgaaaagccccaaggtgcaggcggttaaggactgggctaatcagcgctgtagctcgcctaaaggatcagcccgtaatagcttggtcaaggctaagcgcaagggctctgtgagtgtgtgcagtaaggagtccccttctagctcttcagaaagcgagtcgtgcgacgagtctatctctgatggcccatcgaaagtcactctggaagctcgaaacagtagcgagaagctcccaactgaactatccaaggaggagccctccactaagaatactactgcggacaaactggcaataaagcttgggtttagtcttactccctctaaaggaaaaacttctggcacaacctctagttccagcgattccagtgccgagtccgacgatcagtgcctcatgagcagcagcacaccagaatgcgccgctggtttcctgaagacggtcggtctgttcgccggaaggggccgtcccggtcccggtctatcatcccagaccgcaggcgctgccggttggcggaggagcggctccaatggcggtggccaggctccgggtgcctcacctagcgtatccctgccagcgagtttgggaagggggtggggcagagaggaaaatctgtttagctggaaaggggctaagggcagaggaatgcggggtaggggccgtggccgtggacatccggtctcttgcgtcgtcaatcgcagcactgacaatcaaagacagcaacagctcaacgacgtagtgaaaaattctagcacaataatccagaatcctgtggagacgccaaagaaggactatagcctattacctctcctcgcagcagcccctcaggtgggggagaagatcgcttttaagctcctcgaacttacgagcagctactccccagacgtcagcgactataaggaaggccgaatcctaagccataaccctgagacacaacaggtggatatcgagatactgagctcattgccagccttaagagaacccggtaaatttgacctggtctaccataacgagaacggtgctgaggtcgttgaatatgccgtgacgcaagaatctaaaattacggtgttctggaaagaattgatcgaccccaggcttatcatagaatctccgagtaatacgtcaagtaccgaacccgcatag

SEQ ID NO: 218843 - DNA, 519 bp, Artificial Sequence
  Description of Artificial Sequence: Synthetic coding sequence
atggcctctgatgaggggaaactgtttgtcgggggtctgtcatttgacacaaacgaacaatcgctggagcaagtgttctccaagtacggccagattagcgaggtggtagtagtgaaagatcgggagactcaacgctctagaggattcgggttcgtgacctttgagaacatcgatgatgccaaagacgctatgatggccatgaacggcaagtccgtggatgggagacagatccgggtagaccaggctggcaagtccagcgacaataggtcgcggggatatagaggcggaagtgcgggtggtaggggcttttttagaggcggtcggggaaggggacgcggattctctcgcggtgggggagatagggggtacggcggtaataggttcgaatcaaggagcggagggtatggcggatcccgagattattactcttctagatcccagtcaggaggatattcagatcggtcatccggaggctcttatagggactcttatgactcttatgcaacccacaatgaatag

SEQ ID NO: 218844 - DNA, 792 bp, Artificial Sequence
  Description of Artificial Sequence: Synthetic coding sequence
atggccagcgatgagggcaagctgttcgtgggcggactctcttttgacactaacgaacagtcactcgaacaggtcttttccaagtatggacagatcagcgaggtggtggtggtgaaagatagggagacccagcggtctcgaggcttcggcttcgttacttttgaaaatatagacgacgccaaggatgccatgatggccatgaatggcaaaagcgtcgacggaagacagataagggtagaccaggctggagggggagatagagggtatggaggcaatcggtttgagagccgcagtggaggctatggcggatctagggactattacagctcccgtagccagtcaggcggttattccgataggtctagtggaggtagctaccgcgactcctatgactcttacggtaaaagtcacagtgagggtgccacactcctgtggccggctgtgggcgcacgttttacgctggtaccctccccctcgaccctcggctggacccttagaccctgtcactgtgcctgtcccgaagaggcccatctatctagccaatcacacttttatcgccgaacccaaaagcccaatgaaacggatcagaagggcaagggcgagcgcggacctgcaggtcaatcggccagatgtatgtgcggtcgcaggccggcaagtctcgggtgcggcggatggctcctgcccggtaggcgccctcggccaggcctagcctccggtgttaagttgcccttagtcgcctctgtgccgctgcattgtgcctgcttcctttccagcgccacacacaacgagtag

SEQ ID NO: 218845 - DNA, 735 bp, Artificial Sequence
  Description of Artificial Sequence: Synthetic coding sequence
atgtcctcccgctggtcacggagtagccagtcaacggatcggtctttaaaatctgtggacgggcgacagatacgggttgaccaggctggtaaatcgtcagataatcggtccagagggtatcggggaggcagtgccggagggaggggattctttcggggaggtcgaggaagagggagaggcttctcacgcggaggcggagatcgaggatatggcggaaacagatttgagtctcgctccggcggttacggaggatcacgcgattattattcttcacggagccagtctggaggatattctgacaggtcctcaggtggctcttaccgcgacagttatgacagctatggcaagagccactctgagggggctacactgctttggcccgcagttggggctcggtttactctcgtgcctagtccatccacactgggatggaccctgaggccctgccactgtgcttgccctgaagaggctcatctgtccagtcagagtcacttttatcggaggactcagaagccgaacgaaactgatcaaaagggaaagggggaaaggggcccagctggacagtccgccagatgtatgtgcggtagacgcccagcctcactcggatgtgggggatggctgctgcccggacggagaccacggccaggattagcctccggcgtgaagttgcctctggttgcctcggtaccactacactgtgcttgctttctttcttcagcaacccataatgagtag

SEQ ID NO: 218846 - DNA, 519 bp, Artificial Sequence
  Description of Artificial Sequence: Synthetic coding sequence
atggccagtgatgaggggaagctctttgtcggaggcctcagcttcgatacaaacgaacagtcactcgagcaggttttctctaagtacggacagatttcagaggtggttgtcgttaaagatagggagacccaaaggagtcgtggattcggctttgtgacctttgagaatattgacgacgctaaggacgcgatgatggccatgaacggcaagtctgtggatggaaggcagattcgcgtcgaccaggccggtaagagttccgacaatagaagcaggggctatcgaggtggaagtgctggcggtcgcggtttcttcagaggtggaagggggagaggcaggggattttcccggggaggtggcgatagaggctatggcggtaatagatttgagagcaggtctggaggttatggaggatcccgtgattattactctagccgcagccagtccggcggttactccgaccgaagctcaggagggagctaccgggacagctacgatagctacgccacacacaacgaatag

SEQ ID NO: 218847 - DNA, 2304 bp, Artificial Sequence
  Description of Artificial Sequence: Synthetic coding sequence
atgagcttcgacccaaatctccttcacaataatggtcataatggctaccccaatggcacgagcgcagcactgagggaaacgggtgtcattgagaaacttctgacctcctatgggttcattcaatgttcagagagacaggcccgactctttttccactgcagtcagtacaacggtaacttacaggaccttaaagtcggggacgacgtcgagtttgaagtcagcagcgaccgccgtactgggaaacctatagctgtgaagctagtgaagattaagcaggagattctgccggaggaacggatgaacggccaggaggtgttctatcttacttatactcccgaagatgtggaaggtaatgtgcagctcgaaacgggagataagatcaatttcgtcattgacaacaataagcataccggcgcagtttcagctcgcaatataatgctcttaaaaaagaaacaggcacgctgccaaggtgtggtttgtgcgatgaaggaagctttcggctttatagaacgaggagacgtggtgaaggaaatatttttccactatagtgagttcaagggggacctggagacactgcagcccggagacgacgtggagtttaccatcaaagacaggaacggaaaggaagttgctacagatgttcgcctgttaccacagggaacagtgatctttgaagatatcagtattgaacattttgaggggacagtgactaaggtcatccccaaagtgccatccaaaaaccagaatgaccctttacctggacggatcaaagtggattttgtcatcccaaaggagcttccgtttggggacaaagacaccaagtcaaaggtcaccttactggagggcgatcatgtgcgctttaacatatccacagatagacgcgacaaactggagcgcgcaaccaacatcgaggtcctcagcaatacattccaattcacgaacgaagcccgagaaatgggggtaattgcagcaatgagagacggctttggatttataaaatgtgtggacagagatgttcgcatgttcttccacttttccgagatcctggatgggaaccagctgcacatcgccgatgaagtggaatttactgtagtgccagatatgctctcagcccagaggaatcacgccattaggatcaagaagctgcctaagggaactgtcagttttcacagccactcggaccatcgttttctgggcacggtggaaaaggaagccacatttagcaatcccaaaactacgagcccaaacaaagggaaagaaaaggaggctgaggatggtatcatagcatacgacgattgtggcgtgaaactaactatagcctttcaggctaaagatgtggaagggtccacgagccctcagattggtgataaggtagagttctctatttcagataaacaaagacccggacaacaggtggctacctgcgtgcgcttgctgggcagaaattcaaatagtaaacgattattagggtacgtggcaactctgaaggataacttcggattcatcgagacggccaaccatgataaggaaatattttttcactacagcgaattctcaggcgacgtagattctttggagttgggcgatatggtggaatactccttatctaagggcaaaggcaataaagtcagtgcagagaaagttaacaagacgcatagtgtcaacgggatcactgaggaagctgatcccaccatatattctgggaaggtgattcgaccccttagaagtgtcgacccaactcagacagagtatcaggggatgatagagattgtggaagagggtgacatgaaaggtgaagtgtacccattcgggatcgtcggcatggctaacaagggggactgcctgcaaaagggagaaagcgtgaagttccagttatgtgtactcggacagaacgctcagaccatggcgtacaatataacgcctctgagacgggctacagtggagtgtgttaaagatcaattcgggtttattaattacgaagtgggagattctaaaaaactattcttccacgtaaaagaggtacaggatggaatcgagctgcaggccggagatgaggtggagttttcagtgatcctcaaccagcgcactgggaagtgttccgcatgtaatgtttggcgtgtatgcgaaggcccaaaggccgtagccgcacctagacccgataggctggtgaacagactgaagaacataacccttgatgacgcctccgcacccagactgatggtgctgagacaacctcgaggccctgataatagcatgggatttggcgcagagaggaagatccgccaggcgggagtgatcgactag

SEQ ID NO: 218848 - DNA, 2304 bp, Artificial Sequence
  Description of Artificial Sequence: Synthetic coding sequence
atgtccttcgatccaaacctgctgcataataatgggcacaacggttacccaaacggcacaagcgccgctcttcgagaaaccggggtgattgagaagcttctcacctcttatggcttcattcagtgttcagaaagacaagccaggctcttttttcactgctctcagtacaacggtaacctgcaggaccttaaggtgggtgacgatgtcgagttcgaagtctcctccgaccggagaactgggaagcctattgccgttaaattggtcaagattaagcaggagatcctaccggaggagcgcatgaatggacaggaggtgttctacctgacatacacccccgaggacgtcgaggggaacgttcagctggaaacaggggataaaatcaatttcgtcattgacaataataagcatactggggctgtgtccgctcgaaacatcatgctgcttaaaaagaagcaggcaaggtgtcagggggtggtttgtgctatgaaagaggcattcgggtttattgagaggggcgacgtggtgaaggagatctttttccactactccgaatttaaaggcgatctcgagacattacaacccggagacgacgtggagttcaccatcaaggataggaacggcaaggaagtggcaaccgatgttagactcctccctcagggcactgtaatttttgaagatataagcatagaacacttcgagggcacagtcaccaaagtgattccaaaagtgccaagtaaaaatcaaaacgaccccttgccgggtcggattaaagtagactttgtcattcccaaagaattgccctttggcgataaggacaccaaatccaaagttacactcctggaaggagatcacgtcagatttaacatctccaccgatcgtagagacaagttagaaagagcaaccaacattgaagtgctgtccaacacttttcagtttaccaacgaagccagagaaatgggggtaattgccgcaatgcgtgacgggttcggcttcattaagtgtgtggaccgagacgtccgtatgtttttccattttagtgagattctggacgggaatcaactccacattgctgatgaagtcgagttcactgtagtgcccgacatgctgtccgctcagcgtaatcatgccatccgtattaaaaagctgcccaaggggacagtctctttccattcacactctgatcacagattccttggtactgtggaaaaagaggctacgttcagtaatccaaaaacaacatccccaaataagggtaaggagaaggaagctgaagacggaatcatcgcttacgacgactgcggtgtaaaactcactatagccttccaagcaaaggatgtggaaggcagcactagcccccagatcggtgataaggttgaattctctatttccgacaaacagcgaccagggcagcaggtggccacctgcgtgcggttgcttgggcgtaactctaattctaaacgactgctcgggtacgtggccacgcttaaagataatttcgggtttatcgagacagcaaaccacgataaggaaatcttttttcattactccgagtttagtggtgacgtggactccctcgaactgggcgacatggtcgagtactcactgtccaaggggaaaggaaacaaggtatcagcagaaaaggtgaacaagacgcacagcgtcaacggcatcacggaggaagcggaccctaccatctattccggcaaggttatacgcccactgcggagtgtggacccaacacaaactgagtaccagggaatgattgaaattgtggaggaaggtgacatgaaaggtgaggtttacccatttggtatagtcggaatggccaataaaggggattgcctccagaagggcgagtccgtgaaattccagctgtgcgtgctgggacagaatgcccaaacaatggcctacaacataacacccctgcgacgggctaccgtggagtgtgtcaaggaccaatttggcttcatcaactacgaagtgggagacagcaagaaactgtttttccacgtcaaggaggtacaggatggtatcgagctgcaggcaggtgacgaggtggaattttccgtgatcctcaaccagaggacggggaaatgctctgcatgcaatgtatggcgggtgtgtgaggggcctaaagcggtagccgcaccgaggcccgatagacttgtcaatcgcctgaaaaatataacacttgacgatgcttccgcgccacgactcatggtgctgcggcaacctcgcggtcctgataattcaatggggtttggagccgagcggaagattaggcaagcgggagttatagactag

SEQ ID NO: 218849 - DNA, 2397 bp, Artificial Sequence
  Description of Artificial Sequence: Synthetic coding sequence
atgtcatttgatccaaacttgctgcacaataatgggcacaacggctaccctaacggcacctctgcagcgctgcgcgaaaccggagtcatagaaaagttactcacatcctatggctttatacagtgctcagagcggcaggccagactttttttccactgcagccagtacaatggcaatttgcaggatttgaaggtgggcgatgatgttgaattcgaagtgagctccgatcgaaggaccggcaagccgattgctgtaaagctcgttaaaatcaaacaagagatcctgcccgaagagcgcatgaacggacaggtcgtctgcgcggtgccgcataatctggagtcaaaatctcccgcagcaccgggtcaaagtccaacaggtagcgtatgctatgagagaaacggtgaagtgttctacctgacctacacgccagaggatgtggagggcaatgtgcagcttgaaacaggtgacaaaataaactttgttatcgataacaacaagcacactggagccgtgtctgcacgaaacatcatgctcctgaaaaagaagcaggccaggtgtcaaggagttgtgtgcgctatgaaagaagctttcggtttcatagagcggggtgacgtggttaaggagattttcttccactatagcgaattcaagggtgacttggagaccctccaacccggagacgacgtggaatttactatcaaggacaggaatggtaaagaagttgcgacagatgtcaggctgctgcctcaagggacagtgatttttgaggacatctcaatagaacacttcgaaggtaccgtaacaaaagtgattcctaaagtgccatccaaaaatcagaacgatccactccctgggagaatcaaagtagatttcgtcatcccaaaagaattgccattcggggataaagataccaaaagtaaagtaaccctcctggagggggaccatgttcgatttaacatcagcacagaccgtagagataagctcgagcgcgcaaccaatattgaagtcctgtcgaacacttttcagtttactaacgaggctcgcgagatgggcgtcatcgctgctatgcgcgatggcttcggattcataaagtgtgttgatagagacgttagaatgttttttcacttttcggaaatcctggatgggaatcagctccatattgcggatgaagtcgagttcacagtcgtgccggatatgttgtctgctcaaaggaatcatgccattcgtatcaagaaactacccaagggtactgtgagtttccactcacactccgatcaccgattcctgggcaccgtggaaaaggaggccacgttctctaacccaaaaaccacctctcctaacaaagggaaggagaaggaggcagaagatggtattattgcttatgatgactgcggggtcaaactgaccatcgcgttccaggccaaagacgtggagggcagtacaagtccccagattggagacaaagtggaattctctatttctgacaaacagcgcccagggcagcaagttgccacatgcgtgcggctgctgggacggaattctaactctaagagactgttgggttacgttgccacactgaaggataatttcgggtttattgagactgctaatcatgacaaagagattttcttccactacagcgagttctcaggagacgttgactccctagaactcggcgacatggttgagtactcgctgtctaagggaaagggcaacaaagtcagtgccgaaaaggtgaataagactcacagcgtgaatggaatcacagaagaagctgatcctaccatctatagtggcaaggtaattagacctctgagaagtgtggacccaacgcagacagagtaccagggcatgattgaaatcgtcgaggaaggggacatgaaaggcgaggtgtacccgttcgggatcgttggcatggccaacaaaggggattgccttcagaagggtgagtccgtcaaatttcagttgtgcgtgcttggacagaacgctcaaactatggcctataacattactcccttgaggcgcgcaaccgtggagtgtgtgaaggaccaatttggctttattaactacgaggttggcgacagcaaaaaattattctttcacgtgaaagaagttcaggacggaatcgagctccaggctggcgatgaagtagaattcagtgttattttgaaccagagaacaggcaagtgcagtgcttgcaacgtctggagagtgtgcgaaggtcctaaggcagtggctgccccacgacccgacaggctggtcaacagattgaaaaacattactctggacgacgcctctgcaccaagattaatggtgctgagacaacccaggggaccagacaacagtatgggttttggtgctgagaggaaaatacgccaagctggtgtcatcgactag

SEQ ID NO: 218850 - DNA, 2442 bp, Artificial Sequence
  Description of Artificial Sequence: Synthetic coding sequence
atggagaacgtctttaccgtaagtagtgatcctcacccttctcctgccgcacctccttccctgtcgctgcccttgagcagcagctctacctcgagcggaaccaagaagcagaaacgcacaccaacttatcagaggtcaatgtcgttcgatcctaatcttctacataacaacggtcacaacggctaccctaacgggacctcagctgccctgcgggaaaccggcgtgattgagaaactgctcacatcatacggcttcatccagtgttctgagaggcaagccagacttttcttccactgctcacagtacaacggtaacctgcaggacctcaaggtgggcgatgacgtcgaatttgaagtgtcttccgatcggcgtactggtaagccgatcgccgttaagttagtgaagatcaagcaggaaatcctgccagaggaaagaatgaacggccaggaggtgttttacctcacctatactcccgaggacgtagaaggcaatgttcaactggaaactggggacaaaattaactttgtgatagataataataagcatacaggagcagtgtctgccagaaatataatgctgctcaagaagaagcaggcaagatgccaaggtgttgtctgcgccatgaaggaggccttcggcttcatcgagcgcggagacgtagtaaaagaaattttttttcactattcagagtttaaaggcgatctggagacactgcagccgggagacgacgtggagtttaccattaaagataggaatggtaaagaggtggcaactgatgttcgcttattgccgcagggcactgtcatctttgaagacatttcaatcgagcacttcgaaggtaccgttacaaaggtgatcccaaaagtcccttccaagaaccagaatgatcccctgccaggcaggataaaagtggatttcgtgatccctaaggagctgccgtttggcgacaaggatactaaaagcaaagtgacactactagaaggagaccatgtgcggtttaacatttcgaccgatcggcgagacaagctcgaacgagcaaccaatatcgaggtgctatctaacacgtttcagttcacaaatgaagcacgcgagatgggggtgattgcagctatgagggacggtttcggcttcataaagtgtgtggacagagacgtcaggatgttttttcacttcagcgaaatcctggatgggaatcagttgcatatagccgacgaggttgaatttaccgtcgtgccagatatgttatccgctcagcgaaaccatgcaattcgcattaaaaagttgccaaaaggcactgtgtccttccattcccattccgaccatcgctttctcgggacagtagagaaagaggcaacattttccaatcccaaaacaacttcccctaacaaaggtaaggaaaaagaggctgaggacgggatcatcgcgtatgacgactgtggggttaagttgaccatcgcatttcaggctaaagatgtggagggaagtaccagcccacagataggggataaagtggagttctccatcagcgataaacagcggcctggccagcaggtggctacatgtgtgcggttgctggggcgtaacagcaacagcaaacgactactgggctacgtggcaacactgaaggacaactttggatttatcgagacagccaatcatgataaagagatctttttccattactccgagtttagcggcgatgtcgacagtctcgaacttggggacatggtggagtactccctttcaaaagggaagggaaacaaagtgtccgcagagaaggttaacaaaactcactcagtaaacggtataactgaagaggctgaccctaccatctattcaggcaaggtgattcgcccacttcgatccgtggaccctacccagacagaatatcaggggatgatcgaaatagtcgaggagggggatatgaagggtgaggtctaccccttcgggatagtgggaatggccaacaagggcgattgcttacagaaaggtgaatcggttaaattccaattgtgcgttcttggccagaacgctcaaacaatggcctataatatcacacctttacgtcgggctactgtggaatgcgtcaaggaccagttcgggttcatcaattatgaagtgggcgactccaagaagctgttttttcatgtaaaagaagtccaggacggtatcgagttacaggcaggcgatgaggtggagttctccgtcatcctgaaccaacggacaggaaagtgctcggcatgcaacgtgtggcgtgtgtgcgaaggccctaaagccgttgctgcaccacgacctgacaggctcgttaatagattaaaaaacattaccctcgacgacgcatcagctcccagactgatggtgctcagacagcccaggggccctgataattccatgggatttggggcagagcgcaaaattaggcaggcgggtgtgatcgactag

SEQ ID NO: 218851 - DNA, 2535 bp, Artificial Sequence
  Description of Artificial Sequence: Synthetic coding sequence
atggagaatgtattcacggttagttccgatcctcacccatccccagcagcccctcctagcctgtctctgccactgtcaagcagctccacaagttccggtaccaaaaaacaaaagaggacgcctacctaccagcgcagtatgagcttcgatccaaacttgctgcataataatggacacaacgggtatcccaacggaaccagcgctgcactgagggaaacaggtgtgatcgaaaagttattgacttcttatggctttatccagtgtagcgagaggcaggcccgtctcttctttcactgttcccagtacaacggcaatcttcaggatcttaaggtgggcgatgacgtagagttcgaagtgtcaagcgaccgtaggacaggaaagcccatcgcagtcaaacttgtcaagataaaacaggaaattcttcccgaggaacgtatgaacgggcaggttgtgtgcgccgtgccacacaatcttgaatctaagagcccggctgccccaggacagtctccaacgggatcagtatgttacgagagaaatggcgaagtgttctatcttacatacaccccagaggacgtggaaggcaatgtacagttggagacgggtgacaaaatcaactttgttatagataacaacaagcacacaggagcagtgagtgccagaaacatcatgctgctcaagaagaagcaagctcggtgccagggcgtcgtatgtgctatgaaggaggctttcgggtttatcgagaggggggatgttgttaaggagatcttcttccattatagcgaattcaaaggtgacctggagacactgcagcccggagatgacgttgagttcaccattaaagatcgcaacggcaaggaggtggcaaccgacgtgcggcttctgcctcagggcacagttatcttcgaagatatctctatcgaacactttgagggcacggtgacaaaagtcatccccaaggttccatcaaagaaccaaaatgaccccctgccgggaagaattaaagtcgattttgtcatccctaaggagctccctttcggggataaggacaccaagtcaaaagttactctgctggaaggtgaccacgttcgctttaacatctcaacagacaggagagataagttagagagggctacgaacattgaggtattatctaacacctttcagtttacaaatgaggcacgggaaatgggcgtaatcgccgctatgcgtgatggatttggcttcatcaaatgtgtcgatcgagatgtaagaatgttcttccattttagtgaaatcctggacggaaatcagctgcatattgccgacgaagtcgagtttaccgtcgtgccagatatgctctcagcgcagagaaaccacgctattcgaataaaaaagctccctaaagggacagtatctttccactcccacagcgatcaccggttcctgggaacggtggaaaaggaggctacattctccaacccgaagaccacatcgcccaataaggggaaagagaaagaagccgaggatggcatcattgcctacgatgactgtggcgtcaagctgaccatcgccttccaggccaaagacgtggaaggtagtacgtccccccagatcggtgacaaagtggaattttccataagtgacaaacagcggccaggacagcaagtcgccacatgtgtgcgacttctgggacggaacagtaatagcaagaggctccttggttacgtggccactctgaaggataatttcgggttcatcgaaaccgctaaccacgataaggaaattttctttcattactctgaattctcgggtgacgtggacagcttggaactgggggatatggtcgagtactcactgagcaagggcaagggaaataaggtgtcagcagagaaagtcaacaagacacattctgttaatggaatcaccgaagaagccgaccctacaatttactccggtaaagtgatccgaccgctccggagcgtagatcccacccagaccgaatatcaaggcatgattgaaattgttgaggagggagatatgaaaggtgaggtgtaccccttcgggattgtcggaatggctaacaagggggattgtctacagaaaggggagagcgtgaagtttcaattatgcgtgcttggacagaacgcccaaacaatggcatataatattaccccgctcagacgggctaccgttgaatgcgtgaaggaccaattcggttttatcaactacgaagttggggatagcaaaaaattgttttttcacgtgaaggaggtacaggatggaatcgagttgcaggcaggagacgaggtggagtttagcgtaattctgaaccagcgcaccggaaagtgttccgcctgcaacgtatggcgggtgtgcgaggggccaaaggctgttgcagccccacgtccagatcgattggtgaatagactgaagaacatcactctggacgatgcatccgccccaagactgatggtgttgcgacaacccagggggcctgacaactcaatgggctttggggcagagagaaaaattaggcaagccggtgtgattgactag

SEQ ID NO: 218852 - DNA, 141 bp, Artificial Sequence
  Description of Artificial Sequence: Synthetic coding sequence
atgtcctttgaccctaatcttttgcataacaatggccataacgggtatccaaacggtaccagtgccgctctccgggagacaggagtcattgagaaactactaacttcctacggcttcatccagtgcagcgagagacagtag

SEQ ID NO: 218853 - DNA, 24 bp, Artificial Sequence
  Description of Artificial Sequence: Synthetic coding sequence
atgtcatttgaccctaatctctag

SEQ ID NO: 218854 - DNA, 2007 bp, Artificial Sequence
  Description of Artificial Sequence: Synthetic coding sequence
atgaatggccaggaagttttttacctgacctacacacccgaggacgtggaaggcaacgttcagctggagacaggtgacaaaatcaactttgtcatcgacaacaataagcataccggtgccgttagtgctagaaatatcatgctcctgaagaagaagcaggctcgctgccagggcgtcgtgtgtgccatgaaggaggcatttggtttcatcgagcggggagatgtggttaaagaaatcttcttccattacagtgagttcaagggcgatctggagaccctgcagcctggggatgatgtggaatttacaattaaagatcggaatggtaaagaagttgccactgacgtccggctgctaccccaggggaccgtgattttcgaggatattagcatcgagcattttgaaggcaccgtgactaaggtgatcccgaaggtgccatccaaaaaccagaatgaccctctccccggacggatcaaggtggatttcgtgatacctaaagaactgccgttcggagataaggacacaaaatccaaggtaacgctgctggagggagatcatgtaagattcaacataagcactgatagaagggataaactggaaagagccactaatatcgaggtactctctaatacatttcagttcaccaacgaagctagggaaatgggagttatcgctgctatgcgggacggtttcggatttattaagtgtgtggatagagacgtaaggatgtttttccatttctcagagatcctagatgggaaccagctgcatatcgcagacgaggtggagttcaccgtcgtacccgatatgctgagtgctcagcgaaatcacgctatcaggattaagaagctcccaaagggcactgtgtcatttcatagccactcggaccatcggtttctgggcaccgtggagaaggaagcaacctttagcaatcccaagaccacaagccctaacaaagggaaagagaaggaggctgaagacggaatcattgcttacgatgactgtggtgtgaaactcacaattgcgttccaggctaaagatgtggagggatcaacctcccctcagatcggagacaaggtggagttttccatttctgacaaacagaggcctgggcagcaggtcgctacctgcgtgaggcttctggggaggaatagcaattctaagcgacttctgggatatgtggcgaccttgaaggacaacttcgggttcatcgaaacagctaatcatgataaagaaatctttttccactattctgaattcagtggagatgtggattctctggagctgggcgatatggtggagtatagcctctccaaaggcaagggtaataaggtgtcagcagaaaaagtcaataagactcatagcgtgaacggtatcacagaagaggcagatccgacaatctacagcggtaaggtgattaggcctcttcgctctgtcgatccaactcagactgaatatcagggtatgatcgagattgtggaggagggagacatgaaaggtgaggtgtatccctttggcatagtcggaatggccaacaagggagactgcctccagaagggcgagagtgttaagtttcagctttgcgtgttaggacaaaatgctcagaccatggcatataacatcactcccctgcgcagagctacagttgagtgcgtgaaagaccagttcggcttcataaactacgaggtgggcgactcgaagaagctcttctttcacgtcaaggaggtgcaagacggtatcgagttacaggccggagatgaagtagaatttagcgtgatcctcaaccagcgcactgggaagtgcagcgcctgtaatgtctggcgggtgtgcgagggacctaaggcagtcgcggctccccgaccggatcgtctagtcaatcgtctgaaaaatattacattagacgatgcgagcgccccacgcctcatggttctgaggcaaccacgcggaccagacaatagtatggggtttggggctgaaaggaagatccgtcaagctggcgttatcgactag

SEQ ID NO: 218855 - DNA, 288 bp, Artificial Sequence
  Description of Artificial Sequence: Synthetic coding sequence
atgtcatttgaccccaacttgctgcataacaatggccacaacggctaccctaacggcacctcagccgctctgagggagaccggcgtgattgagaaactcctgacaagctacggatttatccaatgtagtgagagacaggcacgactctttttccactgcagtcagtacaacgggaacctgcaagacttaaaggtgggggacgatgtagaatttgaagtatcctccgaccgcagaacaggaaagcccatagctgttaagcttgtgaagatcaaacaggagattctgtag

SEQ ID NO: 218856 - DNA, 2397 bp, Artificial Sequence
  Description of Artificial Sequence: Synthetic coding sequence
atgtccttcgacccgaatctgctccacaataatggtcataacggataccccaacgggacttctgccgctctgcgggaaactggtgtcatcgaaaagctcctgacttcctacggctttatccagtgctccgaaagacaggcaaggctcttcttccattgcagccagtataatggtaatctccaggacctgaaagtgggggacgacgtggagtttgaggtgagcagcgaccgcaggacaggcaaacctattgcagtcaaactagtgaaaattaaacaggagattctgcccgaagagagaatgaatggccaggttgtttgcgccgtgccgcacaacttggagtccaaaagcccagcggctcccggtcaatctcccacaggttccgtctgctacgaacggaacggtgaggtgttttatctgacctacaccccggaagatgttgaaggtaacgtgcagcttgagactggcgataagatcaacttcgtgatagataacaataaacacaccggggctgtgtcagccaggaatatcatgcttcttaagaagaaacaagccagatgccaaggtgtggtgtgcgcaatgaaggaggccttcggatttatcgagaggggtgacgtcgtgaaggaaatcttcttccattactcagagttcaaaggggatctcgagacactgcaacccggagatgatgtggagtttacaataaaggaccggaatggcaaagaagtcgcgacagatgtgaggctgctccctcagggcacagtaatattcgaggatatctccatcgagcactttgagggcactgttactaaagtcatcccaaaggtcccctcaaagaatcagaacgatccgttgcccggaagaatcaaggtagactttgtgatacctaaagaactcccctttggtgataaagacacaaagagcaaggttactttgctggagggggaccatgttcgatttaacatttcaactgacagaagagataagctcgagcgcgcaaccaacattgaagtgttaagcaacaccttccaatttaccaatgaggctcgggagatgggtgtcatcgcggcaatgcgggatggctttggttttattaagtgtgtcgatagagacgtgcgcatgttctttcacttttcagagatccttgatggtaaccagttgcatattgcagacgaagtcgagttcaccgtggtgcccgacatgttgtccgcccagcgcaaccacgcaatcagaatcaagaaactgcccaagggaaccgtgtccttccatagccactccgatcatcggttcctgggtacagtggaaaaggaagccacattttctaaccccaagaccacttccccgaacaagggcaaggagaaagaggccgaggatgggataatcgcttacgacgactgtggggtgaaacttacaatcgcctttcaggcgaaagatgtggaaggaagtacttctccgcagatcggtgataaggttgagttcagtatcagtgacaaacaaaggccaggacagcaggtggccacttgcgtacggctattggggaggaatagcaacagtaaaaggctacttggttacgtcgctactctgaaggataattttgggttcatcgagaccgccaaccatgataaggaaatattctttcattactccgagttctcaggcgatgtcgactctctggaactaggggacatggttgaatatagcctgtctaagggtaagggcaacaaagtctcagctgagaaggttaacaaaacccatagtgtgaatgggataaccgaggaagcagatccaacaatctactctgggaaggtgatccgccctctgagatccgtggaccctactcagacagaatatcagggcatgatcgagatcgtcgaagaaggcgatatgaagggcgaggtgtacccttttggcatagtcggtatggccaacaaaggcgactgtcttcagaaaggggaaagcgtgaaattccagctttgcgtgctgggtcaaaacgcccaaactatggcttataatattaccccactccgtagggccacagtggagtgtgtgaaggatcagtttggtttcatcaactacgaagtgggtgactccaaaaagctgtttttccatgtcaaggaggtgcaggatggcatcgagctgcaggccggagatgaagttgaattcagtgtcatcctgaaccaaaggactggcaagtgctctgcctgcaatgtctggcgggtctgtgagggtcccaaagctgtggctgcacctagaccggacagactggtaaatcggttgaagaatatcaccctggatgacgcatccgcgccacgccttatggttcttagacaaccaagaggacctgacaactcgatggggtttggcgctgagcggaagattcgtcaggccggagtaatagactag

SEQ ID NO: 218857 - DNA, 1329 bp, Artificial Sequence
  Description of Artificial Sequence: Synthetic coding sequence
atggaggcatccagatgtaggttatccccatctggcgactcagtttttcatgaagaaatgatgaagatgcggcaagcaaagctggactatcagcgcttgttgctggagaagcgccaacgcaagaagcggctggagccctttatggtccagccaaatcccgaggcacggttgaggcgcgcaaagcccagagcctccgatgagcaaacccctctagtgaattgtcacacacctcactccaacgtgatcctgcacggcattgatggacccgcagcggtgctgaagcccgatgaggtacacgctccctcagtgtcatctagtgtcgtggaggaggacgcagaaaacactgtggatactgctagtaagcctggcctgcaggaaaggctgcaaaaacatgatattagcgagagcgtaaatttcgacgaggagacagatggtatctctcagtccgcatgcctggagcggccaaattcagcttcaagccagaacagtactgatacaggcaccagcggtagcgctactgctgcccaacccgcagataatcttttaggggatatagatgacctagaagattttgtttattcgcccgcaccacaaggagttactgtccggtgccggatcatccgagataagagaggaatggacagagggctattccccacctactatatgtacctggagaaagaggagaatcagaagatcttcctgctggcagcgcgaaaaagaaagaaaagtaagactgctaattacttgatcagcatcgacccagtggacctgagcagggagggagaatcctatgtgggtaagctcaggagcaacttgatggggaccaaatttacagtttacgaccggggaatctgccctatgaagggaagaggactggtgggtgcagctcatacccgacaggagttagccgctatttcgtacgagactaacgtgttgggatttaaagggccacgaaagatgtctgttatcattcctggcatgaccctcaaccataagcaaatcccgtaccagccccagaataaccacgacagtctgctcagccgctggcagaacagaactatggagaatcttgtggagctacacaataaggcccctgtctggaattccgatacccagagctacgtgctgaacttccggggacgagttacccaggcaagtgtgaaaaatttccagattgtccataagaatgatcccgactatatcgtcatgcaatttggcagagtggctgacgacgtgttcaccctcgattacaactatcccttgtgcgcagtgcaggcatttggcatcggtctcagctcttttgactctaaattggcatgtgaatag

SEQ ID NO: 218858 - DNA, 912 bp, Artificial Sequence
  Description of Artificial Sequence: Synthetic coding sequence
atgtcagaggctggggaggctactaccaccacaacaaccacattgccccaagcacccaccgaggcagccgctgcagctccccaagatccagccccaaaatctcccgtggggagcggagcaccccaagctgccgctcctgcccctgccgctcacgtggccggaaatccgggtggggatgccgcacctgccgctacgggcaccgctgccgcagccagcctcgcgaccgctgcagggagtgaggatgcggagaagaaagttcttgctacaaaggttctcgggacagttaaatggttcaacgttcgcaatggctacggtttcatcaataggaacgacacgaaagaggatgtttttgttcatcagactgcaattaaaaaaaataatcccagaaaatacctgagaagtgtcggggacggggaaacagtcgaattcgacgtggtggagggggaaaagggagccgaagcagcgaacgtcaccgggcctgatggtgtgccagtggagggttcacgatatgcggctgatcggagacggtaccgcaggggttattacggtcggagaagggggccacccagaaacgcaggggaaatcggcgagatgaaagacggggttccagagggcgcacaactgcaggggcctgtacacagaaacccaacctaccggccaagataccggagtcggggtccaccaagacccagaccggcacctgccgtgggtgaggctgaggacaaggaaaatcagcaggccacttcggggcctaaccagcccagcgtccgacgagggtatcgccgtccatacaactacaggcggcgacccagacctccaaatgcaccgagccaggacggcaaagaggcgaaggccggagaggcgccaaccgaaaacccggctccacctacccagcaatcctctgcggagtag

SEQ ID NO: 218859 - DNA, 339 bp, Artificial Sequence
  Description of Artificial Sequence: Synthetic coding sequence
atggagaaaatactgatacttttgcttgtggccctgtcagtagcctatgccgctccagggcctagagggatcataatcaaccttgaaaacggcgaactgtgtatgaacagcgctcaatgcaagagcaactgttgtcagcactcctctgcactaggtctcgctcggtgcacgagtatggcctcagaaaattccgaatgttccgttaaaaccctctacggaatttattacaagtgtccctgtgaacgcggtctcacttgcgaaggcgataaaaccatcgtcggatccatcactaacaccaattttgggatctgtcacgatgctgggagatctaaacagtag

SEQ ID NO: 218860 - DNA, 216 bp, Artificial Sequence
  Description of Artificial Sequence: Synthetic coding sequence
atggaaaaaatcctgatcctcctgcttgtggcactctccgtggcctatgccgctcccggtcctcggggaattatcatcaatcttacactgtatggcatctactacaagtgcccctgcgagcgcggactgacgtgtgagggcgataaaaccatcgttgggagcattacaaatacaaactttggaatttgccacgacgcaggccgttctaagcagtag

SEQ ID NO: 218861 - DNA, 408 bp, Artificial Sequence
  Description of Artificial Sequence: Synthetic coding sequence
atgcagttaacatgggcttcgattagcctcgtaacccggtgttggccccagactccaacgtttcaggatttgctggcttgtctgggcgctagggcattgccgggaccacctggggctccaggcagagacggcagcaaaggggagaggggggcacccggtccacgtggcagtcctggccctcccggatctttcgattttctcctgctcatgctcgctgacatccgaaatgacattacagaactgcaggagaaggtgtttggacatcggactcactcttcggccgaggagttcccactgccccaggagttccctagttaccctgaggcaatggatttgggctccggcgatgaccatccgagacggactgagacacgggacctgagggcacctcgagatttttacccttag

SEQ ID NO: 218862 - DNA, 1221 bp, Artificial Sequence
  Description of Artificial Sequence: Synthetic coding sequence
atggttcccccaccaccctcccgaggtggtgctgcaaggggccagctggggcgatctttaggcccattgcttctgctcttggcccttgggcatacctggacctacagagaggagccggaagacggagacagggagatttgctctgaatccaaaatcgccactacgaaatacccatgcctgaaaagcagtggagagctcacaacctgttaccgaaaaaagtgttgtaagggttataagttcgtgcttggccagtgtatcccagaggattacgacgtgtgcgccgaagcgccatgcgaacagcagtgcaccgataattttggcagagtgctgtgcacatgctatcctggatatcggtacgatcgagagaggcacagaaagcgggaaaagccatactgtctggacatcgatgagtgcgcatcatcaaacggtaccctttgtgcgcacatctgcataaacaccctaggctcttacagatgtgagtgtcgtgagggctacattcgggaggatgatggaaaaacttgtacacgtggtgacaagtatcccaatgatactgggcacgagaagtcagagaatatggtaaaggcaggcacatgttgtgcgacctgcaaggaattctatcagatgaaacagaccgttctccagttgaagcagaagattgccctgctcccgaataacgcagccgacctggggaagtatatcactggcgacaaggtgttggctagcaacacatatctcccaggccctcctggtctgccagggggacaggggcctccgggatcccccggacccaagggctctccgggtttccccggaatgccgggtccccctggccaaccaggaccccgaggatccatggggccaatgggcccaagccccgacttaagccacatcaaacaggggagaaggggccctgtaggccctcccggagctcctggacgtgatgggagcaagggtgaacgtggagccccaggccctcgtggctcccccggacccccaggcagtttcgactttctgctgctcatgctcgctgacatccgcaatgacatcacagagttgcaggagaaagtatttgggcacaggacacatagttcggccgaggaattccccctcccccaggaattcccctcatatcccgaggccatggatctggggtccggcgatgaccacccacgacgcactgaaacccgcgatctcagagccccacgagacttttacccctag

SEQ ID NO: 218863 - DNA, 699 bp, Artificial Sequence
  Description of Artificial Sequence: Synthetic coding sequence
atgtggcctcctggccgttctatcactgtgaagctgcgcgaaaaaaccgtgtcgcgcaaactagagatgaacggaccttccgcttttcaggggctgatctgcgggaaatataacgggatgtgtctgcaggggcctgcaggagtgcccggacgggacggcagcccgggtgctaacggcattccaggaactcccggaatcccgggacgagatgggtttaagggagagaagggagaatgtctaagagaatcctttgaagaaagctggacccctaactataagcagtgctcatggtctagtctgaattacggcatagacctgggcaaaatagctgagtgtaccttcacaaaaatgaggagcaactccgccttacgcgttctgttcagtggatctctccggctcaaatgccgaaacgcctgctgccagagatggtatttcactttcaacggcgctgaatgcagcgggccacttcctatagaagctatcatctacttagaccaggggtccccagaaatgaattccactataaacatccacaggacctccagtgttgagggcttgtgcgaaggaatcggagctggcttggttgatgtagcaatttgggttgggacttgctcagattatcccaaaggtgacgcatctactggatggaactccgtcagccgcattattattgaggaacttcccaactacctgttctag

SEQ ID NO: 218864 - DNA, 732 bp, Artificial Sequence
  Description of Artificial Sequence: Synthetic coding sequence
atgagaccacagggaccagcggcttccccacaaaggctccggggactgctgcttctcctgctgctgcagttgccagctccgtcaagtgctagcgaaatccccaaggggaaacagaaggcacaattgcggcaacgagaagtcgtagatctgtataatggcatgtgcttacagggccctgcaggggtgcccggaagggacggatcaccaggagccaatggaattccagggacacctggcattccaggacgggacggctttaagggtgagaagggagagtgcctccgggagtctttcgaagagtcttggacccctaattacaagcagtgttcttggagctcactgaactacggaattgatctcggaaagatagcagagtgcaccttcacgaaaatgagatccaactctgccctccgtgtgctgttttccggctcgttgaggctcaagtgccgcaacgcttgctgccaacgatggtatttcacattcaatggtgccgaatgtagtgggccactccctatcgaggcaataatttatctggaccagggtagccccgagatgaattccaccattaacatccatcggacatcatctgtcgaaggcctgtgcgagggaatcggtgcgggactggtcgacgtcgcaatttgggtcggtacctgtagcgattatcctaagggggacgcaagcaccggctggaattccgtttccaggatcattattgaagaactcccaaagtag

SEQ ID NO: 218865 - DNA, 690 bp, Artificial Sequence
  Description of Artificial Sequence: Synthetic coding sequence
atgtggcctcctggcaggagtatcaccgtgaagttgagagagaagactgtttctcgtaaactggagatgaacggcccatcagcgtttcagggacttatctgcggtaaatacaatgggatgtgcctgcaggggccagccggagttcccggtcgagatggctctccgggtgccaacgggatccctggcactcccggtatccctggcagggacggcttcaaaggagagaaaggggagtgtttgagagagagttttgaggagtcctggacacctaactacaaacaatgctcctggtcatcactgaactatggcatagacctcggcaagattgcagaatgtactttcacaaagatgcgttcaaattccgccctgagagttctattttccggatctctccgccttaagtgccgaaatgcatgttgccaacgatggtacttcacattcaatggggctgagtgctctggccctctccctattgaggcgatcatctacctggaccagggctcaccagagatgaactctacaatcaacatccaccgcaccagttcggtagaaggcctttgtgagggaatcggtgctggtctcgtggacgtggccatctgggtagggacctgtagcgactatcccaagggcgacgccagtactgggtggaactcggtgtcacgaattatcatcgaggagctgcccaaatag

SEQ ID NO: 218866 - DNA, 5036 bp, Artificial Sequence
  Description of Artificial Sequence: Synthetic coding sequence
atgcatccaggtttgtggctgctgctggtcacgctctgtctcacggaggagttggcagctgctggagaaaaaagctacggcaagccatgcggagggcaggactgctccgggagttgccaatgcttccccgaaaagggcgcacgaggtcgcccaggccctatcggtatccagggacctactggccctcagggcttcactgggagcacagggctgtcaggtttgaagggggagcggggtttcccaggtttgctggggccttatggtcccaaaggggacaaaggacccatgggggtacccggattcctgggcattaatgggatccctggccacccgggacagccagggcctagaggaccacccggtctcgatggatgcaacggaacccaaggcgctgtcgggtttccaggccctgatgggtatcctggtctgctcggacctccaggattgccgggacagaagggcagcaaaggggaccctgtgctggcccctggaagcttcaagggcatgaagggggatcctgggctgcccggattggacggaatcaccgggcctcagggcgctcctggttttccaggcgctgtgggcccagctggtcccccaggactccagggacccccagggccaccaggcccattgggacctgatggtaatatggggttgggatttcagggcgaaaaaggagtcaagggggatgtgggcttgccaggtccagcaggacctcccccaagtacgggagaattagagtttatggggttcccaaaaggtaaaaaaggatctaaaggggagcccggtccgaagggctttcccggaatcagcggcccaccaggctttcccggacttggaacaaccggtgaaaaaggcgagaagggtgagaaaggcatcccaggactcccgggacccagaggacctatgggcagtgagggcgtgcaaggcccacccggacagcaggggaagaagggcactttaggattccccggtctgaatggcttccaggggatcgaggggcagaaaggcgatattggcttgcctggacccgacgttttcatcgacatcgatggcgcagtgattagcggaaaccccggtgatcctggagttccaggcctacccggactgaaaggagacgaggggatacagggcctgaggggaccctctggcgtcccagggctgcccgcactgtccggagtccccggagcactgggccctcagggatttcctggcctaaaaggcgatcaaggaaaccctggcagaactacgattggtgcggctggtctgccaggacgagatggcctcccaggcccacctggacccccagggccacctagccctgagttcgagactgagacgctccacaataaggagtccggttttcccggtctcaggggagagcagggccctaaagggaacttggggttaaaaggcatcaaaggggattcgggcttctgcgcctgtgatgggggagtgccaaacacaggccctcccggagaacccggacctcccggtccttggggtctgatcgggctacctgggttaaaaggtgccaggggcgaccggggaagcggcggtgcacagggcccagctggagcccctgggttggtgggcccactggggccttccggacctaaggggaagaagggagaacctatcctctcaactattcaaggaatgccaggagaccgtggcgattctggctcccagggatttaggggcgtgatcggcgagcccggaaaagatggagttcctggcctccctggcctccctggcctccctggcgatggcggtcaaggctttcccggagaaaaaggactgccgggactaccaggggagaaagggcacccaggtccgccaggattgccaggaaatggcctgcctggcttgcccggacccagaggcctccctggggacaaagggaaagatggactcccaggtcaacagggcctgccaggaagtaaaggtatcaccctaccctgtattattccaggaagctatggaccctccgggtttcccggaacacccggattcccgggtcctaagggaagtcgcggattgccagggaccccgggtcagccgggatcttctgggtcaaaaggcgaacctggcagccccggtctggtgcaccttcccgagctccctggatttcctgggcctagaggcgagaaaggtctccctggctttccaggcctgcctgggaaggacggcctgcccggaatgatcggctctcccggactgcccggaagcaaaggagccactggagatattttcggggcagaaaatggagcccctggagagcagggcctgcaaggcctgaccgggcacaaaggctttctgggtgactctgggctgcccggactgaagggggtgcatggaaagcccggtctgcttgggcctaagggtgaaagaggttcaccgggtactcccggacaagttgggcaaccgggaacccctgggtcatctggtccctacggcattaagggcaagtcaggccttcccggagctcccggatttcctggcatcagcggccatccaggcaagaagggaaccaggggaaagaaagggcctcccggatccattgtgaaaaaaggcctaccgggtctgaagggactcccaggcaacccagggttggtgggtctgaaaggctctcctggctcacccggagtggccggtctacctgcgttgtctggacctaaaggcgaaaagggcagcgtaggatttgtggggttccccggtattcccggactgccaggtattcctggcacaagaggtctcaagggcataccagggagcactggaaagatgggcccttccggacgtgccggaacgcctggcgagaagggtgataggggtaatcctggtcccgtggggattccctccccccgaaggccaatgagtaatctgtggctgaagggggacaagggatcgcagggttccgctggcagcaacgggttccccggacctcgcggagacaagggagaagctggaagacctggaccaccaggcctgcctggggctcccggactgcctgggataatcaagggagtctccggaaagcccggtcctccgggattcatgggcatccggggacttccaggactgaagggctcttcaggaattaccggcttccccggaatgccaggcgagtcgggatcccagggcatccggggaagcccaggcctaccgggagcttctggcctgccaggtctgaagggtgataacggacagactgtggagatctccggcagtccaggacctaagggacaaccgggtgagagcggctttaaagggaccaaggggagagatggactcatcgggaatatcggcttccctggtaacaaaggtgaggatggtaaagtcggcgtgagcggcgatgtgggactgccgggagcccctggatttccaggcgtggctggcatgcggggtgaacccggactgccgggatcatctgggcaccagggagccattgggcctctgggaagtccaggactgattggaccaaaagggttccccggtttccccggtctgcatggcttgaatggacttccaggaacaaagggcacacatggaacacctgggcctagtatcacaggtgtgccaggacctgccggactgccaggaccaaagggggagaaaggctaccctgggatcggcatcggcgctcccggaaagcccggactccgagggcagaaaggtgataggggctttcctggcctgcaagggcctgcaggtctacccggtgccccaggaatttccctgcccagtcttatagcgggacaacccggagatcctggacggccaggcttagacggcgagcggggtaggcccggacccgcagggccacctggcccacctggtcctagttccaaccaaggcgacaccggagaccccggtttccccggaatacccggatttagcggactgcctggagaactcggcctgaagggaatgagaggagaaccgggatttatgggcaccccgggaaaggtggggccaccaggagaccccggatttcctggaatgaaaggaaaggcgggacccagaggcagctccggactgcagggagatccgggtcagacaccgactgctgaagcagtacaggttcccccaggcccactaggcctgcctggaatcgatgggatccctggactgaccggagacccaggggctcaaggtccagtgggacttcagggaagcaaggggctacccggaatcccgggtaaggacggcccatcaggcttacctggccctcctggagccctcggagacccaggtctccccggattgcaaggccctcccggattcgagggtgcccctggtcagcaggggccttttggcatgcccggaatgcctgggcaatccatgagagtcggatatacccttgtcaagcattcccagtccgaacaagtgcctccttgtccgatcgggatgagccagctctgggtcgggtatagtctgttgttcgtggagggacaggagaaggcacataatcaagatctgggatttgctggaagctgtctccctaggttttccacaatgccttttatctattgtaacatcaacgaggtctgccactacgcacggcgaaacgacaagtcctactggttatccaccacagcccctatccctatgatgcctgttagccagacacagatccctcaatacatcagtagatgttccgtgtgcgaggctccgagtcaagcaatcgccgtacattctcaagatatcacaattcctcagtgcccgctgggttggagatcactgtggatcggctacagctttcttatgcacaccgcagccggtgcagagggcggtggtcagtcgctagtgagccccggatcttgtctggaggatttccgggctacaccctttatcgagtgtagcggagccagagggacatgccactacttcgccaataagtatagcttctggctgacaaccgttgaggagcgtcagcaattcggagagctcccagtttctgagactttgaaagccggtcagctgcacactcgggtatccagatgccaggtatgtatgaaaagtcttta

SEQ ID NO: 218867 - DNA, 3087 bp, Artificial Sequence
  Description of Artificial Sequence: Synthetic coding sequence
atgagggcagcccgagctctcctccctcttctgctgcaggcctgttggacagccgcacaggacgaacctgaaacccccagagccgtggccttccaagattgtcctgtggatttattctttgtgctggacactagtgagtccgtggcccttcgactgaaaccttacggcgctctcgtggataaggtcaagtcctttactaagcggttcattgacaaccttagggaccggtattaccggtgcgacagaaacttagtgtggaatgctggcgctctgcattactctgacgaggtggagattatacaaggcctcacaagaatgcccggaggaagggatgctctgaagtcttcagtagatgccgtcaagtacttcggaaagggtacatacaccgattgtgcaattaagaaagggctggagcaactgttggtaggtggaagccacctgaaggaaaacaagtacctcatagtagtgaccgatggccaccctctggaggggtataaagagccttgtggcggactggaagacgctgtgaatgaggcaaaacacctgggcgtcaaggttttttccgttgcaatcactccagaccacttagaaccacgcctgtctattatagcaacagaccatacataccggcgaaatttcacagctgccgattgggggcagagccgagacgcggaagaggccatctcccagacgatagatacaatcgtggacatgatcaagaataacgtagagcaggtttgctgctccttcgagtgtcaaccggcaaggggtcctcctggtctccgcggagacccaggcttcgagggcgagcgcggaaagcctggtttacccggtgagaagggagaggctggcgatcccggaaggcctggggacctcgggcctgtgggttatcaaggaatgaaaggtgagaagggctcccgtggagaaaaaggatcacggggtccgaagggctataaaggagaaaaaggaaagcgtggtatcgacggagtggatggcgtcaagggcgagatgggttaccccggactcccaggatgcaagggctcacctggctttgacgggatccagggccctcctggaccaaaaggagaccccggagcgttcggccttaagggcgagaaaggggaacctggagcagatggcgaggccggtaggcccggatcctcaggacctagcggagacgagggccagccaggcgagccaggcccacctggtgaaaagggtgaagccggagacgagggcaatcctggcccagatggagccccaggggagagaggagggccaggcgagagaggcccaagaggcacacctggaacacgcggtccgagaggggaccccggtgaagcagggcctcagggggaccaggggagggaaggccctgtaggagtccctggcgacccaggagaggccggtcccatcggccctaagggatatcgaggcgacgagggacctccagggtctgagggtgccaggggggctcctggaccagctggaccccctggggatcctggactcatgggtgagcggggagaagatggcccagcgggtaatggaacagagggatttcctggattccccggatacccgggtaatagaggagcccctgggatcaatggaaccaaaggctaccctggactgaagggcgacgaaggcgaggcaggggatcctggcgatgataacaacgacattgcccctcggggtgtgaaaggggctaaagggtaccggggacctgaaggtccccagggacccccagggcatcagggacctcctggacccgacgagtgcgagattctagatataatcatgaagatgtgcagctgttgtgaatgtaagtgcggacctattgacctgctgttcgtgctggattcttccgaaagcatcggcctccaaaatttcgaaattgcaaaggacttcgtagtgaaggtaatcgatcgtctctcccgagacgaactcgtgaagttcgaacctgggcagtcctacgcaggggtggtgcagtactcccacagccagatgcaggagcacgtcagccttcggagcccatcgatccgtaacgtacaggagctaaaggaagccatcaaatccctccagtggatggcgggaggcactttcacaggggaggccttgcagtacactagggatcagctgttgcctccgagcccgaataataggattgcgctggtgatcacagatggcagatccgatactcagagggatacaactcctttgaatgtcctgtgcagccctggcatccaggtggtgtccgtgggaatcaaagacgtgttcgacttcatccccggaagtgaccagctgaacgtgatctcatgccagggcttagcaccctcacaaggccgacccggactgagcctggtaaaagagaattatgccgaactactggaggacgcctttctcaagaatgtgaccgcccagatctgcatcgacaagaagtgtcctgattacacctgtcccattacgttttcgtcgcccgcagacatcacgatcctcctggatggtagcgcttcagtgggaagtcacaacttcgacaccacgaagcgatttgctaaaagactcgcagaacggtttttgactgcgggtaggaccgacccagcccatgacgtcagagttgccgtggtccagtatagcggaaccgggcagcagagacctgagagagccagtcttcagtttcttcagaactacactgccctagcttctgctgtggatgcaatggatttcattaacgacgcaaccgacgtcaacgacgccctgggatatgtcacacgcttctaccgcgaagcaagtagtggcgcagccaagaagcgccttttgcttttcagcgacggcaattctcagggcgctacaccggctgccattgagaaagccgtccaggaagcccagagggcaggtattgagatatttgttgtggtggttgggcgtcaggttaatgagccccacatccgcgttttggtaaccggaaaaacagcagagtacgatgttgcttacggggagtctcatttgtttagagtgccttcttaccaggcattgctgagaggcgtctttcaccagaccgtgtcccgtaaggtggccctcgggtag

SEQ ID NO: 218868 - DNA, 1770 bp, Artificial Sequence
  Description of Artificial Sequence: Synthetic coding sequence
atgcgagcagccagggcactgctgcctctcctgctgcaggcatgctggacagcggctcaagatgagcctgagactcctagagctgttgcgttccaagattgtcccgtggacctctttttcgtgttggacacgtcagaatccgtggccctgcgtctcaagccctatggtgccctcgtggacaaagtcaaatcttttacaaaacgctttatagataacctccgggacaggtattacaggtgcgatcggaatcttgtttggaacgccggtgcattgcactacagcgatgaggttgagatcatccaggggctgacccggatgcccggaggccgagatgcacttaagtcctcagtagatgcagtgaagtatttcggcaagggcacatacacagactgtgccattaaaaaaggactcgagcagctgctggttgggggatcacatctcaaggaaaacaagtacctcatcgtggtaaccgacggacacccccttgagggttataaggagccttgtgggggactggaggacgccgtgaatgaggctaaacatcttggggtcaaagtcttcagcgttgctatcacacccgatcacctcgagccgaggctatctattatcgctactgatcatacctaccggagaaacttcaccgccgcagactggggacagtcccgcgacgcagaagaagcgatatctcagaccattgacaccattgttgacatgataaagaacaacgttgaacaggtctgttgttccttcgagtgtcaacccgcaagaggaccccctggactgagaggcgacccagggttcgagggcgagcgaggaaagccaggcctgcccggagagaaaggggaggcaggagatcctggacgccctggggatttggggcctgtcggctaccaaggaatgaaaggtgagaagggctcgcgcggagagaaaggttctaggggccctaaggggtacaaaggagaaaagggtaagagagggattgatggcgtggacggagtgaaaggagaaatgggataccccggattgccagggtgcaagggcagtcccggtttcgacgggattcagggaccacctggccctaagggcgatcctggcgctttcggccttaagggggaaaaaggagaacccggtgctgacggggaagctggaagacccggttcaagcgggccatccggtgacgagggtcagcccggtgagcctggtccacccggagagaagggcgaggcaggagacgaaggaaaccctgggcctgacggtgcgcctggcgagaggggcggacccggtgagagagggccacggggaacaccaggaaccaggggcccacgcggagaccctggggaggccggtccacagggagatcagggcagagaaggtccggtaggagtgccaggagacccaggagaagcaggcccaataggacccaagggatataggggggatgaagggcctcccggtagcgagggggctaggggcgctcccggtcccgcaggaccacctggggatccaggcctgatgggagagcgaggtgaggacggtcccgctggaaacggcacagaaggcttccctggctttcctgggtatccaggcaaccggggagctcctggaattaatgggaccaagggttatccaggcttaaaaggagatgagggtgaagccggagaccctggagatgataataacgacatcgcacccagattgctcagggtattgctcgttacagggctggacctcggcccaacagccctagaggctgcagcggatcagcactag

SEQ ID NO: 218869 - DNA, 324 bp, Artificial Sequence
  Description of Artificial Sequence: Synthetic coding sequence
atgagagcagcaagggccctgctccctttgctgttgcaagcatgttggactgccgctcaggacgaaccagagacaccgagagctgtggccttccaagactgtcctgttgatctcttcttcgtactggatactagcgaaagtgtggctctccgactcaaaccgtacggagctttagtggataaagtaaagtccttcacaaaaaggtttattgataatctgcgagaccggtactaccgatgcgatcgaaacctcgtgtggaatgccggagctcttcactacagtgatgaggtggagattatccagggattgacccggatgccttag

SEQ ID NO: 218870 - DNA, 3060 bp, Artificial Sequence
  Description of Artificial Sequence: Synthetic coding sequence
atgttgcaaggaacatgcagcgttttgctgttgtgggggatccttggcgcaatccaggctcaacagcaagaggtgatctcaccagacactacggaacgcaacaacaactgtccggaaaagaccgattgtccgatccacgtatactttgtgttggacacctctgaatccgtgacgatgcagagccctaccgacatactgctgttccatatgaaacagtttgtccctcagtttatctcccaattgcagaatgaattctatcttgatcaggttgctctcagttggaggtacggcggactccattttagtgatcaagtggaggtgtttagcccccctggtagcgaccgcgcaagctttataaagaacctccagggaattagcagcttcagaagaggaactttcacggactgtgccttggctaacatgacagaacagatacgccaggatcgatccaaaggcacagtacattttgccgttgtgatcacagacggccacgtgactggatccccttgcggaggaataaagttgcaagccgagagggctcgggaggaagggatccgtttattcgccgtggcccctaatcagaatctgaaggaacagggattacgcgatatcgcaagcacgccacacgagctatacagaaatgactatgccactatgctcccagatagcaccgaaatagaccaagacaccattaaccggattattaaagtgatgaagcatgaggcttacggcgagtgctacaaggtctcctgtctggaaatccctggcccttctggaccaaagggatacaggggccagaagggtgcaaagggcaacatgggtgagcctggtgaaccaggacagaagggcaggcagggggaccctggcatcgaagggccaattggttttcctggcccaaaaggagtgccaggcttcaaaggtgagaaaggcgaattcggcgctgatggacgaaagggcgcacctggcctagcagggaagaacggaacagatgggcaaaaggggaagttgggaaggatcggacctccagggtgcaagggcgatcccggaaatagaggtcccgacgggtatcccggagaggctggttctcccggagagcgtggagaccagggagggaaaggagatcccggtagacccggacgcagggggcctcctggtgagatcggggcaaaaggctcaaaagggtaccagggaaactctggagcgccaggcagcccaggtgtcaaaggggctaaaggagggcctgggccacgtggcccaaagggcgaaccaggtagaaggggtgatcctggcaccaaaggctcccccggtagcgatgggcctaaaggcgagaaaggagaccccggtcctgaggggcctcggggattggctggagaagtggggaataagggcgcaaagggtgatcggggtttgccaggccctcgtggtccccagggcgcactcggtgagcctggtaaacaggggtctcgtggcgaccctggcgacgccggacctcgaggggatagcggacagcctggacctaagggagatccagggagaccaggtttcagttatcctgggcctagaggtgcccctggcgagaagggagagcctgggccacgtggaccagagggaggacggggtgatttcgggctgaaaggcgagcctggccgtaagggcgagaagggcgaacccgcagatcccggacccccaggcgagcccggacctagaggtcctagaggggtccccggacccgaaggggaacccggaccccctggggatcccggacttacagagtgcgatgtgatgacttacgtgagggaaacttgcggatgctgcgattgcgagaagagatgtggtgcactcgacgtcgtttttgtgatcgattcgtccgagagtatcggctatacaaattttaccttggagaagaattttgtaattaatgtagttaaccgcttgggcgcaattgctaaggatcccaagtccgagacaggaactcgagttggagtggtgcagtacagtcacgagggcacttttgaggcgattcagctcgatgatgagcgaatcgattctctgtcctcatttaaggaggcagtcaagaatcttgagtggattgcaggtggcacctggacaccttctgcgttaaagtttgcttacgatcgcttgatcaaggagtctaggcgacagaagacccgcgtatttgctgtcgttataaccgacggaaggcacgaccccagggatgatgatcttaatctaagggcactctgcgatagggacgtgactgtgactgcgatcggaatcggagacatgttccacgagaagcatgagtcagagaatctgtatagtatcgcgtgcgataaaccgcagcaggttcggaatatgaccctgttctctgatctggtcgccgaaaaatttatcgacgacatggaggatgtgctgtgtcctgatccccagattgtgtgccctgatttgccatgtcagaccgagctcagcgtcgcccagtgtacccagcgccctgtcgacattgtgtttcttcttgacgggtctgagaggcttggtgaacaaaactttcacaaggctaggcggtttgttgagcaggttgcccgaagactcaccctcgctcgtcgcgatgacgatccactcaacgcacgcgtcgctctcctgcaattcggcggtcctggagaacagcaggtggcgttccctctgtcccacaaccttactgccattcatgaagctctggagactacccagtatctgaatagttttagccacgttggggctggggtggttcatgccattaacgccatcgtgcggtctcctcgcggaggggcaaggcggcacgcagaactctcatttgttttcctgacagatggggtgaccggcaacgatagtctgcacgaatccgcccattctatgcgaaagcagaacgtggtgccaacagttcttgctctggggagtgacgtcgacatggacgtgctcacaacgctgtcactgggtgaccgtgcggctgtgttccatgaaaaagactacgattctcttgcacagcccggtttcttcgatagatttattagatggatctgttag

SEQ ID NO: 218871 - DNA, 2487 bp, Artificial Sequence
  Description of Artificial Sequence: Synthetic coding sequence
atgcttcaggggacctgcagtgtgttgctgctttggggcatattaggtgccattcaggcccagcagcaagaggtgatctcaccagacaccaccgagcgtaataataattgccctgagaagactgattgcccgatccatgtctactttgtgctcgacacctctgagagcgttactatgcaaagccctacagacattctactcttccacatgaagcagttcgtgccccagttcatcagtcaactgcagaatgaattctatctggaccaggtagccctgtcctggcgatacgggggactgcatttcagcgaccaggtggaggtcttttcgccaccgggatcggaccgcgcttcctttatcaagaaccttcaggggatatcaagctttagacgaggaacctttaccgactgcgccctagcgaacatgactgagcaaatcagacaggatcgatcgaagggaaccgtccactttgccgtggtgatcactgacgggcacgtcacaggcagtccgtgcggcggtatcaagctacaagccgaacgggcacgggaggaaggcattcgactctttgctgtagctcccaatcaaaacttgaaggagcagggcctgcgggacattgcatccacaccccacgaactttaccggaacgattatgcgaccatgttaccggacagcacagaaatcgaccaagacactatcaaccggatcataaaggtgatgaagcacgaggcatacggcgagtgttacaaggtctcttgcctagagatacccggaccgagtgggccaaaggggtaccgaggtcagaagggtgccaaaggcaatatgggtgagccaggagagccaggtcaaaagggacgccagggggatcctgggatcgagggaccgatcgggttccccggacccaaaggtgtgcctggcttcaaaggagaaaaaggcgaatttggcgctgacggtcgcaaaggcgcacctggactcgccggaaagaacggaacagacggacagaaaggaaaattgggccgaattgggcctcccggatgcaagggtgatcctggcaaccgcggacctgatggctatccgggagaagccggaagtccaggagaacggggtgaccaaggcggtaaaggcgacccagggcgtcccggaaggcgcggacccccaggagagatcggtgcaaagggctctaaagggtatcaggggaacagcggcgcacctgggtcacctggggtgaaaggcgctaagggagggccaggtccgagggggccaaagggggagccaggcaggcgcggtgacccgggtaccaaagggtcccctggtagtgatggtccaaaaggcgaaaagggcgatcctgggccagaggggcctaggggtttagcaggcgaggtcgggaacaaaggtgcaaagggagacaggggtctgccaggccctcggggtcctcagggcgctttgggcgaaccgggaaagcaaggaagcaggggagacccgggtgatgcgggtccacgcggagactcaggccagccgggacctaagggagacccaggaagacctggattctcatatcctggtcccagaggcgctccaggcgagaagggggagcccggtccgaggggacctgagggaggaagaggagattttggactgaagggggagccagggagaaagggcgaaaaaggagagcccgcagaccctggccctcctggggagcctgggccacgtggtccccgaggagtccctggccctgagggtgagcctggccctcctggagatccagggttgaccgagtgtgatgttatgacttatgtgcgcgaaacctgtgggtgctgtgactgtgagaagagatgcggtgccctggacgtggtcttcgtgatcgatagctcagagagtatcggttataccaattttactctggagaaaaacttcgtgatcaacgtggtgaacaggctgggggcaatcgcgaaggatcctaaatctgagactgggacacgagtgggagtcgttcaatactcccatgagggtacttttgaggccatccagctggatgacgagaggatcgacagtctctccagttttaaggaggccgtgaaaaacctggaatggatcgccggtgggacctggaccccctcagcgctgaagtttgcctatgacagactgattaaggagtcgcggcgacaaaaaactagagtgttcgctgtggtaataaccgacggtcgacatgatcctcgcgacgatgaccttaaccttagagcactctgtgatcgggacgtgacagttaccgcgataggcataggcgacatgtttcatgaaaagcacgagagcgaaaatctgtattccatcgcgtgtgataagccacagcaggtcaggaacatgacactgttcagcgatctcgtagcagagaagtttatagacgatatggaagacgtgctgtgcccggatccgcagatcgtgtgtcctgatctgccttgccaaactggtctggatggcgctgtgctttgttag

SEQ ID NO: 218872 - DNA, 2757 bp, Artificial Sequence
  Description of Artificial Sequence: Synthetic coding sequence
atgctgcaagggacttgcagcgtgcttctgttgtggggaattctcggcgctattcaagcccagcagcaagaggtgatttctcctgatactacagagagaaataacaactgtccagagaaaacagactgccccatccacgtctattttgtgcttgacaccagcgagtccgtgactatgcagtccccaacagacatcctgctcttccacatgaaacagttcgttccgcagtttatctcccagttgcagaatgagttttatctggaccaggtggcgttgagctggaggtacggcggactgcactttagcgatcaggtagaagtgtttagcccccctggatccgatagagctagcttcatcaaaaatcttcagggaatctcgagctttaggcgtggcaccttcactgattgcgccctcgccaatatgacagaacagatcagacaggacaggagcaagggcaccgtccacttcgcggtggtgattaccgatgggcacgtcacaggatctccatgtgggggaatcaaattacaggcagaacgtgctagggaggaaggaattcggctttttgcggtcgccccaaaccagaacctgaaggagcaaggtctgagagacatcgcttctaccccccatgaactgtatcggaatgactacgccacaatgctcccagacagcacggaaatagaccaagacacaatcaatcggatcatcaaggtgatgaagcacgaggcttacggcgagtgctataaggtttcttgccttgaaatccccggacccagcgggccaaaaggataccggggacagaaaggtgctaagggaaacatgggcgagcctggcgagcctggacagaagggccgacaaggggatccgggaatcgaaggcccaattggctttcccggaccaaaaggtgtgccaggcttcaagggggagaagggcgaatttggcgcagatggacgcaaaggggctcccggactcgcaggcaagaatggcactgacgggcagaagggcaagctgggaaggatcggtcccccaggctgcaaaggcgacccaggcaataggggcccagacgggtaccccggagaggccggaagcccaggggaaaggggggaccagggaggcaaaggtgaccctggcagacccggtcggagaggtcccccaggagagatcggagccaagggctctaagggttaccaggggaatagtggcgctccaggctctcccggtgtgaagggagctaagggagggccagggccaaggggcccaaagggcgagccaggtcggcgtggcgacccaggcacaaaggggtcccctggcagtgatggacccaagggggaaaagggagaccccggtccagaagggcctagaggattggccggagaggttggcaataaaggcgctaaaggcgatcggggactgcccggacccagggggcctcagggcgctctgggcgagccaggtaaacagggctctaggggcgaccccggtgacgcaggccctagaggggattctggacagcccggtcccaagggggatccaggaaggcctggcttcagctacccaggccctcgaggcgctcctggtgagaaaggtgagcctggccctcgcggtccagagggtggcagaggcgactttggcctcaagggagagcctggacggaaaggcgaaaagggggagcccgctgacccaggccctcccggagagcccggtcccagaggccctagaggcgtgcctggaccggagggagaacccggacctccgggagaccctggtctgacggaatgtgatgtaatgacatatgtccgagagacatgtggctgctgcgattgcgagaaacgttgtggtgcattggatgtggtgtttgtgattgacagttccgagagcataggctacaccaattttactcttgagaagaatttcgtgatcaatgtcgttaacagattgggcgctattgctaaagatccaaaatccgaaactggcacaagagtgggcgttgtgcaatactcacacgaggggacctttgaagcgatccaactggatgacgagaggattgacagcttgagctcatttaaggaggccgtgaagaacttggaatggattgcaggcggtacatggaccccatcagccctaaagttcgcctatgatcgtctgattaaagagtctcggagacagaagactcgggtatttgccgtagtgatcaccgacgggaggcacgaccctagggacgacgacctgaatctacgggcattatgtgatagagatgtgaccgtcacagcaatagggattggagacatgttccacgagaaacacgaatcagaaaatctttattccatagcctgcgacaagccacagcaagtacggaacatgaccctcttctctgatctggttgcagaaaaattcatagacgacatggaagacgtgctgtgtcccgatcctcagatcgtttgcccggatctcccttgccaaactgatgctccatggccaggaggtgaacctccagtcacattcttacggacagaagaggggcctgacgccaccttccctcgtacaattcctcttatccagcagttacttaacgccaccgaacttacccaggatcctgcagcctattctcagctggttgccgttctggtatatacggcagaacgggctaagtttgctacaggagtcgaaagacaagattggatggagttattcatcgacacgttcaagttggtgcaccgagatatcgtgggggaccccgagaccgccttagctttatgctag

SEQ ID NO: 218873 - DNA, 2757 bp, Artificial Sequence
  Description of Artificial Sequence: Synthetic coding sequence
atgttacagggtacctgtagcgtgctgctgctgtggggtattcttggtgcaatccaggcccagcagcaggaggtaattagtccggacacaacagaacgcaataataattgcccagagaagactgattgtccaatccatgtatacttcgttctggacacaagcgagtccgttactatgcagagccctacagacatcttactttttcatatgaagcagttcgtgccccagtttatctctcagctgcagaatgagttttatttagaccaagtggcactgagctggaggtacggcggacttcatttttcagatcaggttgaagtcttttctcccccaggctccgaccgggcaagcttcattaagaatttacaaggtatttcctccttccgcagggggactttcaccgattgtgccctggctaatatgacagaacaaattaggcaggaccgctccaaaggaacggtgcacttcgcagtggttattacagatggccacgtgactgggtctccttgcggtgggatcaagctccaggcagagcgcgctcgcgaggagggcataagattgtttgccgtggctcccaaccagaacctcaaagagcaaggcctgagagatatcgcctccacgccgcatgaattgtaccgaaatgactacgctacaatgttacctgatagcacagagatcgatcaggacactatcaatagaatcatcaaggtcatgaagcatgaggcctatggcgaatgctataaggtatcttgtttagagatcccaggaccctccgggcctaagggctatcggggacagaagggggctaagggcaatatgggcgaacctggagagcccggacagaagggtcgtcagggagatccgggaattgagggccctatcggctttcctggaccaaaaggggtacctggcttcaagggcgaaaagggggaatttggggcagacggccgaaagggagcccctggtctcgcgggtaaaaacggaactgacggtcagaagggcaagctcggtcgtattggacctcccggatgcaagggcgaccccggaaatcggggacccgatgggtatcctggcgaagctggctcaccaggcgaaagaggcgatcagggaggcaagggggacccaggcaggccagggagaaggggtcccccaggtgaaattggcgctaaaggttctaaagggtatcaggggaacagcggggctcctggttcccccggtgttaaaggagctaagggcggacccggtccgaggggccctaaaggagagcctgggaggcggggagatcctgggactaaggggtccccgggatccgatggccctaagggtgagaagggtgacccaggaccggaagggcctcgcggactggctggagaagtcggaaataagggcgctaaaggcgatagggggctgcctggacctcgcggtccccagggggcactgggtgaacccggtaagcagggctcgaggggcgacccaggcgatgccggtccccgaggagattcaggacagcccggtcccaagggcgatcctgggagacccggattttcctaccccggacccagaggcgctccaggcgagaagggggaaccaggccctagagggccagaagggggacgcggagactttggcctgaaaggggagcccggtaggaaaggcgaaaaaggcgagcccgcagatcccggaccccctggggagccaggaccccgagggccaagaggtgtccccggacctgagggggagcctggaccccctggggaccctggcctcaccgagtgtgacgtaatgacatacgtcagggagacttgcggatgctgtgactgcgagaaaaggtgtggtgctctggacgtggtgtttgttattgactctagtgagtcaatcgggtataccaactttacactggagaagaactttgtgattaacgtggtcaacaggcttggtgcgattgcaaaagaccctaagtcggagacaggaaccagagtaggggttgtgcagtattcccacgagggcacttttgaagcaattcagttggacgacgagcggatcgattccctctccagttttaaagaggccgttaaaaatcttgaatggattgccggagggacatggacaccgtcagcgttgaagttcgcctatgaccgcctaataaaagagtcacgcaggcagaagacaagagtgtttgctgtggtgatcaccgatggtcgacacgaccctagagacgacgatcttaacttaagggccctctgtgaccgcgatgtaaccgtgaccgctattggtataggcgatatgttccacgagaagcacgagagtgagaatctttacagcatagcctgtgacaagccgcaacaagtgcgaaacatgacgctctttagcgacctggtagccgagaagtttatcgacgacatggaggacgtcctgtgcccagatccacagattgtgtgtcccgatctcccgtgtcaaacggacgccccatggcccggaggggaaccaccagtgaccttcctgaggactgaagaagggcctgatgccacgttcccacgcacaatcccactaatccagcagttgctaaatgcaacggagttgacccaggatcctgcagcctacagtcagctggtggctgtgctggtgtataccgctgaaagggccaagttcgccactggggtggagcgccaggattggatggagctgtttatcgacacgttcaaattagttcacagagatatcgtgggtgatcccgaaacagcactggcactatgttag

SEQ ID NO: 218874 - DNA, 2487 bp, Artificial Sequence
  Description of Artificial Sequence: Synthetic coding sequence
atgcttcaggggacgtgtagtgtattacttttatggggtatactaggcgcaattcaggctcagcagcaggaggttatcagtcctgatacaacagaacgcaataataactgcccagaaaaaacagactgcccaatacacgtgtatttcgtcctagacacttcagagtctgtgactatgcagtccccaacagacatcttactgttccatatgaagcagtttgtcccccaattcatcagtcaactccagaacgagttttacctcgatcaggtcgctttatcctggaggtacggtgggctccacttcagtgatcaagtcgaggtgttctcgcctcccggaagtgaccgcgcaagcttcattaagaatctgcaggggatcagtagttttagacggggaacttttaccgattgcgcgctggcaaatatgactgagcaaatccgccaggaccgaagcaagggcactgtgcactttgctgtcgtgatcacagatgggcacgtcaccggctcaccttgtggtggaatcaagctgcaagcagaaagggcaagagaggagggaatccggctatttgccgtagctccaaaccagaatctgaaagagcagggtctgcgtgacatcgcatctactccacacgagctgtatagaaacgactatgctacgatgctgcccgattcaacagagatcgatcaggacaccattaaccggattatcaaagtcatgaagcatgaagcatacggcgaatgttacaaagtgtcctgtcttgaaatacccggaccatctgggccaaaaggctatagaggccagaagggagctaaaggtaacatgggagaaccaggagaacctggccagaagggtagacagggagatcctgggatagagggccctatcgggttccccggtccaaagggagttcctggattcaaaggagaaaaaggcgagttcggggctgatggcagaaagggagctccgggactggccggaaagaacggcaccgacggccaaaaaggaaaacttggacggatcgggccacctggctgcaagggcgaccctggcaatcggggtccagatggttacccaggcgaagccggatcacctggtgagagaggtgaccagggagggaagggcgaccctggcagacccggacgaagagggcctccaggcgaaatcggagctaaggggtctaaagggtaccaggggaactccggggcaccaggctcacccggagtcaaaggtgccaaggggggtcccggtccacggggacccaaaggcgaacccggacgtaggggggaccctggtactaaggggagcccaggaagcgacgggccaaaaggggagaaaggggatcctggtcccgagggccctcggggtctggccggtgaagtggggaataagggtgccaagggcgacagaggcttgccaggacctcggggtccgcagggagctctaggggagccgggaaaacaaggaagtcggggagatccaggggatgcagggcctcgcggagattccggacagcctgggcctaaaggagaccctgggaggcctgggttctcctacccagggccacgtggtgccccaggggagaagggggagccaggtcccaggggccctgaagggggtcgaggagatttcggactcaagggggagccgggtagaaagggggaaaagggggagcccgctgacccgggtccacctggagagccaggccctagaggcccaaggggggttcccggtccagaaggggaacctggcccacccggtgatcctgggctgaccgagtgcgacgtgatgacatatgtccgagagacttgcggttgctgcgattgcgagaaacggtgcggcgctctggatgtcgtgttcgttatagattcctccgaatctatcggttatacaaacttcaccctcgagaagaatttcgtgatcaacgtcgtcaaccggcttggagctattgcgaaagatcccaagagtgaaactggaactagagtgggagtggtccagtattctcatgaaggaacattcgaagcgattcagctggacgacgaacgaatcgactccctgtcttcatttaaagaggcagtcaagaacctggagtggatcgccggaggcacgtggacgcctagtgcattgaaatttgcctacgatcgactgatcaaggagagccgtaggcaaaagacaagagtgttcgccgttgtgattaccgacggcagacatgacccaagggacgatgacctcaatctgcgcgcattgtgtgatcgagacgtcacagttacagctattggaatcggagatatgtttcacgagaaacacgaatccgaaaacctgtacagcatcgcatgcgacaagcctcagcaagtaagaaacatgacgttattctcagatctcgtagcagagaaatttattgacgatatggaagacgtgttgtgtcctgacccgcaaatcgtttgtccagatcttccctgccagaccggcctggatggagccgtcttgtgttag

SEQ ID NO: 218875 - DNA, 543 bp, Artificial Sequence
  Description of Artificial Sequence: Synthetic coding sequence
atgctgcagggaacttgctctgtgcttctcctctggggtatcctcggagccatccaggcgcaacaacaagaagtcattagcccggacacaaccgagcggaacaataattgtccagagaaaactgattgtccaatccatgtctactttgttctggatacttccgagtctgtcacgatgcaatcgcctacagatatcctccttttccacatgaaacaatttgtaccacaattcattagccagctgcagaatgaattttatttagatcaggtggccctctcctggcgatatggagggttgcatttcagtgatcaagtggaggttttttctccacccggttcagatcgggcatctttcattaaaaatctccaaggtatctcatccttccggcgtggcacgtttacagactgcgctctggcaaatatgactgagcagatccgtcaggaccgatcaaagggcactgtgcatttcgcggtggtgattacggatggtcatgtaactgggagcccatgtggaggtatcaaactccaagccgaacgcgcttag

SEQ ID NO: 218876 - DNA, 2235 bp, Artificial Sequence
  Description of Artificial Sequence: Synthetic coding sequence
atggcggtccttccaggtcccttgcaactgcttggcgtgctgttaaccatctcactcagcagtattcgcttgatccaggccggagcttattatggaataaaacccctaccaccgcagatccccccacagatgcctccacagatcccccagtaccagccattggggcagcaggttccacatatgcccttggctaaagacggactggccatgggaaaggaaatgccccacttacagtatggcaaggagtacccgcacctgccccagtacatgaaggaaattcaaccagctcccagaatgggaaaagaggccgttcctaagaaggggaaggagatacccctggcttctctcagaggcgagcagggaccgaggggagagcccggacctagagggcctcctggacccccaggtctccctggccatgggatccctggtattaaaggcaagccaggcccacagggttaccctggagtggggaaacctggcatgcccggaatgcccggaaagcctggagcgatgggcatgcctggagccaagggcgaaatcggccaaaagggagagataggaccaatgggtatccctggcccacagggtcccccaggaccgcacggtctaccaggtatcggcaagcccggtgggccaggcctgccgggacagcccggaccgaagggcgatagagggcctaaggggttgcccggaccacaaggcttaaggggcccaaaaggcgacaaaggatttggcatgccaggcgcaccgggagtcaaaggccctccaggtatgcacggccctcccggacctgtggggctcccaggtgtggggaagcctggggtgacaggctttccaggccctcagggccctttaggaaagcccggagccccaggcgaacccggtccacagggtccaatcggcgtgccaggcgttcaaggaccgcctggcatacctgggataggaaaaccagggcaggacggcattcctggccagccagggtttccgggagggaagggggaacaaggcctgcccggtctcccgggaccgcctgggttgccaggcatcggcaaacctggattcccaggccctaaaggcgaccgcggaatggggggtgtccctggtgcgttggggcctagaggcgagaaaggccctattggcgcacctggaatcggtggcccacccggtgagcccggtctaccaggcatcccaggcccaatgggaccccctggtgctatcggattccccggtcctaagggggaggggggaatcgtgggccctcaggggccaccgggtcccaagggcgagcctggtcttcagggctttccagggaagccaggtttcctgggggaggtgggcccacccggaatgcgtggactgccgggacctatcggccctaaaggggaggctggccagaaaggagtgccaggcctgcctggcgttccgggtttgctaggcccaaagggcgagccaggcatcccaggcgaccaggggctacaagggcctcccggaatccccggaatcgggggaccatctggcccaattggccctccaggaattcccggaccaaagggagaaccagggctccccggaccaccgggattccctggcattggcaaacctggagtcgcgggactgcatggaccgcctggtaagccaggtgcgctgggccctcaggggcagccaggcctgcctggccctccgggtcctcccggaccgcctggcccaccggcagtgatgccaccaacaccaccccctcagggggaatatttgccagatatgggcctcggcattgacggagttaagcctccccacgcatacggtgcaaagaaaggcaaaaatggcggtcctgcctacgagatgccagcatttacggcagaactcactgctccgttccctccagtcggcgctcccgtgaaatttaataaactgctgtacaatggacggcagaactataatcctcagaccgggattttcacttgtgaagttccaggtgtatattatttcgcttaccatgtgcactgcaagggagggaatgtgtgggtcgccctctttaagaacaacgagccggtgatgtatacatacgatgaatacaagaagggctttctcgaccaggccagtgggtccgctgtcctgctcctgcggccaggagatagggtgttcctgcaaatgccatcagaacaggctgcgggattatatgctgggcagtacgtccactcgagtttctccggataccttctctacccaatgtag

SEQ ID NO: 218877 - DNA, 2235 bp, Artificial Sequence
  Description of Artificial Sequence: Synthetic coding sequence
atggccgtgttgccagggcctctccaactgctaggggtcctgcttacaatttctctgagctctatcagacttattcaggccggagcttattatggcattaagccattgccgccacagatcccgcctcagatgcccccacagattccccagtatcagcctctggggcagcaagtgccacacatgcccttggctaaggacggtctggccatgggaaaggagatgccgcatcttcagtatggcaaagaatatcctcatctcccccagtatatgaaagagatccagccagcccctagaatggggaaagaagcggtgcccaaaaagggaaaagaaatccctttggcatcactgcgcggtgaacagggtcctcggggtgaaccaggcccaagaggtccccctgggccaccagggcttcctggtcatgggatccccggaataaaaggtaaacctggccctcagggatatcccggtgtagggaagcctggaatgcccggtatgccagggaaaccaggggcaatgggaatgcctggagccaaaggcgaaattggccagaagggggagattggcccaatgggcatccccggaccccagggtcctcctgggcctcacggcctgccgggaatcgggaaacctggaggtcccggacttcctgggcaacctggccctaaaggagatagaggtccgaagggactaccagggccacaaggcttgcgaggtccaaagggggacaaagggtttgggatgccgggagcccctggcgtcaagggccctcctggtatgcacggacccccagggcctgtggggctccccggagttggtaaacccggagtcacgggctttcctggacctcaagggcctttgggcaaaccaggggcacctggcgaacctggccctcagggaccaataggcgtgcctggggttcaaggacctcccggaatccctggcatcggaaaacctgggcaggacgggattcctggccagccgggtttccctggaggaaagggggaacagggattaccaggactgcccggacctccgggactcccgggaatcggaaaaccaggttttcccggacccaagggtgacagaggaatgggaggcgtgccgggagcactgggcccacgaggagagaaggggccaatcggggcaccgggaatcggaggcccacctggcgagccgggacttcccggtatcccgggacccatggggcctcctggcgcaatcggatttcccggaccaaaaggcgagggagggattgtgggtccccaagggcctcccggtcccaagggagagccaggcttacaaggcttccccggtaagcccggattcttgggcgaggtaggcccacctggaatgagaggtcttcccggtcctattggacctaaaggggaggccggtcagaaaggtgtgcctggattacctggagtgcctggactcttagggccaaaaggggagcccggaatcccgggtgaccagggccttcagggcccacctgggatccctggaatcggcggtccgagtggcccaataggcccacccggaatccctgggccaaaaggtgaaccgggtctgccaggccctcctggatttccaggcatcggcaagccgggagtggctggcctccatggaccccctggcaagcccggtgccctcggcccacagggacagcccggactcccagggcctcctggaccaccgggacccccaggccctcctgccgtcatgcctcccacccccccacctcagggcgaatacctgccagatatggggttggggatagacggcgtgaagccacctcatgcttacggggctaaaaagggaaagaacggagggccagcgtatgagatgccagccttcaccgctgaattgaccgccccattccctccagttggagccccagtgaagtttaacaaactcttgtacaatgggagacagaactataacccccagacaggtatcttcacttgcgaggtgcctggagtttattatttcgcttaccatgtacattgtaagggaggaaacgtgtgggtcgctctgttcaaaaataacgaacctgtgatgtatacttacgacgaatacaagaaggggttcctcgaccaagcatcgggcagtgccgtgctgctgttacggcctggcgaccgggtattcctgcaaatgccctccgaacaagcagccggactctatgccggacagtatgttcactcgtccttttctggatatctcttgtaccccatgtag

SEQ ID NO: 218878 - DNA, 345 bp, Artificial Sequence
  Description of Artificial Sequence: Synthetic coding sequence
atggccgtgctgccagggccactccagctgctcggcgttctcctaacaatctccctgagtagcatcagacttattcaggctggagcctactacggtattaagcccctaccaccccagatccccccacagatgcctccccaaatcccccagtaccaacctctggggcagcaggtcccccatatgcctctggctaaagatgggttggccatgggtaaggaaatgccccaccttcagtatggaaaggaatatccacacctgccccaatacatgaaggagattcagccagcccctagaatggggaaagaggccgtacctaagaagggcaaggagataccactcgcctag

SEQ ID NO: 218879 - DNA, 2061 bp, Artificial Sequence
  Description of Artificial Sequence: Synthetic coding sequence
atggtggcagaacgcacgcacaaagccgctgctaccggggcacgtggcccaggagagttgggagctcccggtaccgtggctttagtagctgccagggctgaaaggggagccagattgcctagccctggtagttgcggccttctgaccctcgcgttgtgctctttggctctgtcccttctggcccattttaggacagctgaactgcaagctagggttcttcggctggaagctgaaagaggtgaacaacagatggagaccgcaattttaggtcgggttaatcaactgttggacgagaaatggaaactccattctcggagacggagagaagcgcctaagacctcccccggatgtaactgcccccctggcccacccggtccgaccggccgtccaggactccccggtgacaagggtgccatcgggatgccaggacgagtgggcagcccaggcgatgctgggctatcaatcatcggccctcggggtcccccaggccagccaggtactcggggattcccagggtttcctgggcctattggcctcgacggtaaacccggacatcctggcccaaagggggatatgggtctcacggggcctcctggccagccagggccacaggggcagaagggcgaaaagggtcagtgcggtgaatacccacacaggctcttgcccctgctaaatagcgtcagactggctccaccaccagtaatcaagcgaagaactttccagggtgagcagtctcaggcctccatccaaggccctcccggtccccctggaccacctggaccttccgggcctctgggccatcctggcctccctggaccgatggggccaccagggctccctggacccccaggccctaaaggagacccaggaattcagggttaccacggcaggaaaggggagcggggaatgccaggtatgcctggtaagcacggagctaagggagctcctgggattgctgtggctggcatgaagggcgaacccggtattcctggcacaaaaggagagaagggggctgaaggctccccgggtctgcctgggcttttgggccaaaaaggggaaaaaggtgacgcaggcaacagcatcggcggtgggcgaggagaaccaggtccacccggtcttcccggacctccaggcccaaaaggcgaggctggcgtagacggacaggtgggtccacccggacagccaggcgataaaggtgagcggggagctgccggagagcaggggccagatgggccaaagggaagtaaaggagaacctgggaagggggagatggtggattacaacggcaacatcaacgaggctctgcaggaaatcaggacacttgccctgatgggaccgccaggcctccccggtcagatcggaccgcctggcgctcccggtatccctggccagaagggagaaatcgggcttcctggccctcctgggcatgacggagaaaaagggccacggggaaagccaggagatatgggcccacccggtccccagggtcccccagggaaggacgggccacctggcgttaaaggtgagaatggtcacccgggaagcccaggtgagaaaggtgagaaaggcgagacagggcaggcgggaagtccaggtgagaagggggaagctggtgaaaaaggcaatcccggtgccgaggtcccaggcctgcccggtcctgagggcccacctggtccaccaggtctacaaggtgttcctgggccaaaaggggaggcagggctcgatggcgcaaaaggggagaaaggattccagggcgaaaaaggggatagggggcctctagggctccctgggacccccggtcccatcggagttcctgggcctgctggcccaaagggggaacgcggttctaaaggtgacccaggcatgacaggccctacaggggcagcgggtttgcccggactgcacgggccacccggtgacaaagggaaccggggtgagagaggtaaaaagggatcccgcggaccaaagggggataagggtgatcagggggcaccaggcctggacgccccatgtcctttgggggaggatgggctccctgtccagggatgctggaacaaatag

SEQ ID NO: 218880 - DNA, 1338 bp, Artificial Sequence
  Description of Artificial Sequence: Synthetic coding sequence
atgacaggcagctccttctctctggcgcatcttctaataatttctgggctgttgtgctactccgccggatgtctggctctaccctccctcgatcagaagaaacgcggaggccataaggcttgctgccttcttacccccccaccgccacctctgtttccccctcctttttttagaggcggtagaagccccttgctgtcacccgacatgaaaaacctgatgctggaactagagacttcacagagcccttgtatgcagggatccttaggatccccagggccacccggaccacagggacccccagggcttcccggtaagaccggcccaaaaggtgaaaaaggggagttgggtaggccgggtaggaagggcagaccaggaccaccaggggtccccggtatgccgggacctattggttggcctggccctgagggacccagaggcgaaaaaggcgacctcgggatgatggggttaccaggtagtcgaggcccaatgggaagcaagggctatccagggtcccgtggggagaagggatccagaggcgaaaagggagacctaggccctaaaggagagaaaggctttccaggctttccagggatgttaggacagaagggagagatgggccctaagggtgaaccagggatcgccggacataggggccctacaggcagacctggcaaaagaggtaagcagggccagaaaggagatagcggcgtcatgggcccacctggcaagcccggaccttctggacagccaggtcgaccaggccctccgggaccaccccctgcaggccaactgataatgggtcctaagggcgagcggggattccctgggccaccaggtcggtgcctatgtggacccaccatgaacgtgaataatccttcttatggggagtcagtttatggaccatcttcgccacgcgtgcccgttattttcgtcgttaataatcaggaagagctggaacgattgaatactcagaatgctatcgccttccggcgtgaccagcgctctctatacttcaaggactcactcgggtggcttccgatccagctgacccccttttacccagtggactataccgctgaccaacatggaacctgcggcgacgggctgttgcagccaggcgaggaatgcgacgacggcaatagcgacgttggagacgattgcatccgctgccaccgggcatattgcggagacgggcacaggcacgagggagtggaggactgcgacggtagtgacttcggatatcttacctgtgaaacatacctccccggtagctacggcgacttgcaatgcacccagtattgctatattgactcaacaccttgtaggtactttacctag

SEQ ID NO: 218881 - DNA, 876 bp, Artificial Sequence
  Description of Artificial Sequence: Synthetic coding sequence
atggtggtgctgaaccccatgaccctgggcatatacctccagttgtttttcctttccatcgtctctcagcccacattcatcaattccgtgctcccaatttctgccgctcttccctccctggaccagaaaaagaggggaggacacaaggcatgctgtttgctcacaccaccgccaccgcctttgttccctcctccatttttcagagggggacggtcccctctgctgtcacctgacatgaaaaacctgatgctagaattggaaaccagccaaagcccgtgcatgcagggctccctcggtagtcccggacccccagggcctcaggggcctcccggactgcccggtaagacaggacccaaaggcgagaagggggagctgggtcgccctggtcgaaaagggaggcccggacctcctggcgtacctggaatgcctggacccataggatggccagggccagaaggacctaggggggagaaaggcgacctaggcatgatggggctgcccggtagcagaggcccaatgggcagtaagggttaccctgggtcgcgcggagaaaaggggagccgaggggagaaaggcgacctaggtccaaaaggagagaagggcttccctggcttccccggtatgctgggtcagaaaggagaaatgggacccaagggggaaccgggaattgctggccacagagggccaacgggtcgcccaggcaagaggggtaagcagagcagtagaactccctgcacactgcctcgccgacctcctgtgccatgcgggcaagggagtagaagcccggtgacagttgttgctggcaaggagtcccaggcttgccttctgccacgttttgaggaggactacataagctcagggactgaacgcggatag

SEQ ID NO: 218882 - DNA, 1266 bp, Artificial Sequence
  Description of Artificial Sequence: Synthetic coding sequence
atggtcgtcctcaaccctatgacattgggaatatacctgcaattgttctttctgtcaatcgtgtctcagcctaccttcatcaacagtgtgctgcccatcagcgccgcactacccagccttgatcagaaaaagagaggtggacacaaggcgtgttgtttgcttacgcccccacctccacccctttttcctccaccttttttcagggggggaaggagtcccggaccccctggccttccaggtaagacggggcctaagggggagaaaggcgaattggggaggcccggacgtaagggtcggccaggaccacccggagtgccaggtatgccaggccctatcggttggcctggtcctgagggccctcgaggagagaagggtgacctggggatgatggggctccccggatctagaggcccaatgggttcaaagggttacccaggctcgagaggagaaaaaggcagccggggtgagaaaggcgacttaggtccaaaaggtgagaaaggttttccgggttttcccggaatgcttggacagaaaggcgaaatgggtccaaaaggggaacccggaatcgcagggcatcgcggaccaactgggagaccgggtaagcggggaaaacaggggcaaaagggtgattcgggtgtgatggggcctccgggtaagcccggtccctcgggccagcccggtaggcccggtccccctggccctccaccagctgggcagctgattatgggtccaaaaggcgagcggggattccccggaccccctgggaggtgcctctgcggcccaacaatgaacgtcaacaatccctcctatggcgagagcgtctacggtccatcatcacccagggtgcccgtgattttcgtcgttaataaccaagaggaactcgaaagactgaatacccagaatgctatagccttcagacgggaccaacgcagcctctacttcaaagatagtctgggatggctgcctatccaactgaccccattttatcctgtggattacactgccgatcagcacgggacctgcggcgacggcttgcttcagcccggagaagaatgcgatgatggaaattcagatgtgggggatgattgtattagatgtcatcgcgcatattgcggcgacgggcaccgacacgaaggggttgaggattgtgatggctcagacttcggttacctgacttgcgaaacctatctaccgggatcttatggagatctgcagtgcacacaatactgttacatcgactctaccccctgtcgttacttcacctag

SEQ ID NO: 218883 - DNA, 1341 bp, Artificial Sequence
  Description of Artificial Sequence: Synthetic coding sequence
atggtggtgctgaatcccatgacactggggatttacctccaactgttctttctatcaatcgtcagccagcccactttcattaacagcgttctgccaattagcgcagcactgcccagcttggaccagaaaaaacggggaggtcacaaagcctgttgtctcctgaccccacccccacctccgctgttccctcctccctttttcagaggcggacggtctccactcctttcacccgacatgaagaacctgatgctcgaactcgaaactagccagagtccctgcatgcagggctccctgggtagcccaggcccaccagggccacaggggcctcccggactccccggtaaaactggccctaagggagagaagggccgtccaggacctccaggggttcctggcatgccagggccaatcggatggccaggcccagaaggccctcgaggcgagaagggagacctcgggatgatgggtctgcctgggagcaggggaccgatgggctctaaaggctatcctggaagcagaggggagaagggcagtagaggagagaagggggacctcgggcctaagggagaaaaaggattccccggattccccggtatgctgggtcagaaaggcgaaatgggccctaagggcgagcccggtatcgctggtcataggggcccaactggtaggcccggaaagaggggcaagcaggggcagaagggggatagcggtgtgatggggccaccaggaaagcccggtccgtctgggcagcctggtcggcctggccctcctggcccaccaccagccggacagctgatcatgggacccaagggggagagagggttcccgggaccccctggacggtgtttgtgtggcccaactatgaacgtgaataatccttcctatggcgaatctgtgtatggtcctagcagccccagggtccctgtcattttcgtggtgaacaatcaggaagagcttgaaagactcaacacacagaacgctattgcctttcgacgcgaccagcgtagcctgtattttaaggactccctgggctggctgccaatccagctaacacccttctacccggttgactacacggccgaccagcatggcacttgtggggatggtctgcttcagccgggtgaggagtgcgacgatggcaactccgacgttggcgacgattgcattagatgtcaccgggcttattgtggtgacgggcaccgccatgaaggtgtggaagattgtgatggttccgatttcggctatttgacctgtgagacctatcttcccggtagctacggtgatttacagtgtacccagtattgttatatcgacagcactccctgtaggtactttacatag

SEQ ID NO: 218884 - DNA, 1368 bp, Artificial Sequence
  Description of Artificial Sequence: Synthetic coding sequence
atggtggtgcttaacccgatgacactcggaatctatcttcaacttttttttctgagcatcgtgtcccagcctaccttcatcaactctgtgcttccaatctccgctgcgctgcctagtctcgatcagaagaaaaggggaggacacaaagcatgctgtctgctcaccccaccacctcctcccctgttcccacccccatttttcaggggagggagatctccccttctgagtccagatatgaaaaatctgatgcttgagctggagactagccaatcaccttgcatgcagggctcactgggctcacccggtcctccgggaccacaaggacctccaggcctgcctgggaaaactggccctaagggcgagaagggcgagttaggcagacccggaaggaaaggcagaccaggccctcctggggtgccgggtatgcctggacccatagggtggcctggccctgagggcccaaggggcgagaaaggtgacctaggtatgatggggctgcctggaagtagaggtccgatgggaagcaagggctatccaggcagtaggggagagaaagggagccgtggcgagaagggggacctcgggcctaagggagagaaaggcttccccggtttccccggaatgctgggtcagaagggcgagatgggccctaaaggtgaaccaggaatcgcaggccaccgaggacccacaggaaggcctggtaaaaggggcaaacagggacagaagggtgattctggggtgatgggcccacctggaaagcctggcccttccggtcaaccagggcgtcccggacctcctggcccaccacccgcaggccaactcattatgggccctaaaggcgagcggggatttcctggaccacctgggagatgtctttgtggacctactatgaatgtgaataatccaagttatggggagtctgtctacgggccaagttcccccagggtaccagttatcttcgtcgtcaataaccaggaggaactggagcgccttaacacccagaatgccattgcctttagacgcgatcagagatcgctgtatttcaaggacagcctgggctggctccctatccaactcacaccattctatccagtcgattacacagcggatcagcatggaacatgtggggatggactcctgcagcctggggaagagtgcgacgatgggaattctgatgttggggacgattgcatcagatgtcatcgcgcatactgtggagacggccaccgtcatgaaggcgtggaagactgcgatgggtcggatttcggctatctgacatgtgaaacctatctgcctggctcctacggtgacctgcaatgtactcaatactgctatatagattctacaccatgccgttatttcacctag

SEQ ID NO: 218885 - DNA, 1338 bp, Artificial Sequence
  Description of Artificial Sequence: Synthetic coding sequence
atgacaggctctagtttctctctcgcacacttactgattatcagcgggctactctgttatagcgccggatgcctcgcgttgcccagcctggaccagaaaaagcgcggaggacataaagcctgctgtctgctgactccacccccaccaccacttttccccccaccattcttccgcggtggacggtcccctctgttatcacccgacatgaaaaacttgatgctggagctcgaaacgagccagtcaccatgcatgcagggctccctcggaagccccggaccgcctgggcctcaggggcctccgggtttacctggcaaaacaggacctaagggggagaagggagagctagggcgtcccggaagaaagggccgacccggtcctccaggagtcccagggatgccgggacctatcgggtggcctggacccgagggaccacgaggggaaaagggggacttggggatgatgggactgccagggtcccgtgggccaatgggaagcaaaggctatcctggttcccgcggagaaaaagggagtagaggcgagaaaggagacctggggccaaagggggaaaagggctttccaggattcccgggaatgctgggtcaaaaaggagaaatgggtcccaagggggaacctgggattgccggacacagaggccctaccggacgtccgggaaagagagggaagcagggccagaaaggcgactctggggtcatgggccctccaggtaagcccggaccttcggggcagccagggcgacccggaccccctggtccaccgccagccggtcagctgatcatgggcccaaagggtgaaagagggtttccaggacctccgggtcgttgtctgtgtggccctacaatgaacgtaaacaacccttcctacggtgaatccgtgtatggaccttcaagtcctcgggtcccagtgatcttcgtggtgaacaaccaggaagaattggagaggctcaatacacaaaacgcaattgcctttaggcgcgaccagaggtccctgtacttcaaagattccctgggctggctgccaatccagctgactccattttatcccgtggattacaccgcggatcagcatggaacctgcggcgacggcctgctgcaacccggtgaagagtgcgacgatgggaattcagatgtcggagatgactgtatccgatgccacagggcctactgcggcgacgggcaccgacacgagggtgtagaggattgcgatgggagcgattttggatatctcacctgtgaaacttatttgccgggtagctatggggacctgcagtgtacacagtactgctacattgactctacaccatgccgatactttacctag

SEQ ID NO: 218886 - DNA, 585 bp, Artificial Sequence
  Description of Artificial Sequence: Synthetic coding sequence
attagtggacttctgtgttattccgcgggttgcctcgctcttccatctctcgaccagaagaagagggggggacataaagcttgctgccttttaaccccacccccacccccattgtttcctcctccatttttccgtggtggacgatcaccaggccctcctgggctgcccggtaagaccgggccaaaaggggaaaagggggagctgggacgcccagggcgaaagggccgacccggacctcccggagtgcccggtatgccaggccctattgggtggcccggacccgaggggccacggggagagaagggcgatctaggaatgatggggttaccgggtagccggggacctatgggtagcaaaggataccctggatcaagaggggagaagggttctagaggcgagaaaggggacttgggcccaaaaggcgagaagggctttcctggcttccctggtatgctggggcagaaaggcgagatgggcccaaagggcgagccagggattgccggtcaccggggaccgacaggacgcccagggaagaggggcaagcagggccagaaaggtgacagtggggtgatgggacccccatag

SEQ ID NO: 218887 - DNA, 1338 bp, Artificial Sequence
  Description of Artificial Sequence: Synthetic coding sequence
atgacagggtctagttttagtctcgcacatctgcttataataagcggattgttgtgttatagtgcgggttgcctggccctgccgtcgctggatcaaaagaaacggggaggccacaaagcttgctgtttgttaacacctccaccaccccctctgttccctcccccattcttcagaggcggacgatctcccctgctgagcccagatatgaaaaacctgatgcttgaactggagacatcacagtcaccctgcatgcaaggatctctgggaagccccggaccccctgggcctcaaggtcccccaggactgcctggaaaaacgggcccaaaaggggaaaagggcgaactgggcaggcctggcagaaaggggagacccggaccaccgggtgtgccgggaatgccgggacccatcggatggcccggacctgaaggccctaggggagagaaaggagacctgggaatgatggggctgcctgggtcaagggggcctatgggttctaagggctatccaggctccaggggggaaaaggggagcaggggggaaaagggagatcttggacccaaaggagaaaaatgcaatcctctgctcctattgttcccctcattccagggagagatgggccctaaaggcgaacccggaatcgctggtcatcgaggtcccacaggcagacctggaaaaagaggaaagcaggggcagaagggagactctggagtgatgggtccacccggtaagcctgggccttctgggcagccaggaaggccaggacctcccggtcccccacccgcaggacagctcatcatgggccctaagggcgagagaggatttcccggaccacctggaaggtgtctgtgtggtccaaccatgaacgtaaataacccctcttacggagagtcagtatatggaccctcctcccccagagtgcctgtgattttcgttgtaaataaccaggaagagctcgagaggctaaatacgcagaacgcgatcgccttccgacgagaccagaggagtctctattttaaagattccctgggctggctccccattcaactgacgccattttaccctgttgactacaccgccgatcaacacggcacatgcggggatggtctgctgcaaccaggcgaggagtgtgatgatggtaatagcgacgtgggggatgactgtatacgatgccatagagcctactgcggagatggccaccggcatgagggggttgaggactgcgatggctcagatttcgggtatctaacctgtgaaacctacttgcctgggtcttacggcgatctgcagtgtacgcagtactgttacatcgattccactccctgcaggtatttcacatag

SEQ ID NO: 218888 - DNA, 2061 bp, Artificial Sequence
  Description of Artificial Sequence: Synthetic coding sequence
atggctgaccgcaggagggcatggaacacggaggatgatctgcccgtatatctagctaggccaggttcggcagcccagactcccaggcagaagtatggtggaatgtttgccgcagtagagggggcatatgaaaataaaactatcgattttgatgcttacagcgtggggagaaggggctccgcacgcacacccagatcggcgggacgccctgacgccgttgggctgccaggcccagggggaagcgaggatactgccagtgacgtatcagaaccttcagggagtgccgtgtcctcccccggagaacgtgatgaacggcctcctacactcagaatcagacgccctgccccacgggacctgcctctggggagagacaatggtcaatccgatagactcctgattaaagggggtaggataataaacgatgatcagagcctctatgcagacgtctatctcgaagacggactgataaagcaaatcggcgagaatctgatcgtgcccggaggagtcaagacgatcgaagctaatggtcggatggtgatacccggaggaattgatgttaatacatacctgcaaaaaccttcccagggcatgacggccgctgatgattttttccagggaacccgagcagccctggtgggaggtactaccatgattattgaccacgtggtccctgagcctggctcttccctccttacgtcctttgagaagtggcacgaagctgcagacactaagtcctgttgcgactactctttgcacgttgatatcacgagctggtatgacggagtcagagaagagttggaagtgttggtgcaggataaaggggtgaattccttccaagtctacatggcatacaaggacgtgtatcagatgtccgacagtcagctttacgaggccttcacattcctcaaggggctgggagccgtaatcctcgtgcatgccgagaatggcgatttgatcgcccaggaacagaagcgcatccttgaaatgggaattacaggcccagaagggcacgccctgtcacgccctgaagagctggaggcagaagctgtgtttcgtgcgatcactattgcaggcagaattaactgccccgtgtacattacgaaagtgatgagcaaatctgccgctgacattattgctctcgcaagaaagaaagggccactcgtgtttggcgagcctattgcggctagcctcggaacggatggtacccattactggtccaagaattgggccaaggccgctgcatttgtaacatctcccccactgtcaccagaccctacaacaccggattacctaactagcctcctggcctgcggggacctccaggtcaccggcagcggccattgtccatattcaactgcccagaaggccgttggaaaagataacttcacactgataccagagggagtaaacggcatcgaggagagaatgacagtggtgtgggacaaagccgtggccaccggaaaaatggacgagaaccaattcgtcgcagtaaccagtactaacgccgcaaagatcttcaacctttatccgagaaagggtcgcatcgcagtcggaagcgacgccgacgtggtgatatgggatcccgacaagctgaagaccataaccgctaaatcccataagagcgcggtcgagtataatattttcgaagggatggagtgccacggaagccccctcgttgtgatcagccaaggtaagattgtctttgaagacggcaacattaatgtcaataagggaatgggtcggttcatcccgcgaaaggcgtttccagaacacctctaccagcgagtcaagatccgaaacaaggttttcggtctccaaggcgtgtcccgcggtatgtatgatggcccagtgtacgaggtacccgctactcccaaatatgctacaccagccccatctgcgaaatccagcccgtctaagcatcagccacccccaatccggaacttacaccagagtaacttctctctttccggggctcagatcgacgacaacaatccaagacggaccggtcacagaatcgtcgctccccctggcggtcgttccaacattacctctcttggatag

SEQ ID NO: 218889 - DNA, 1719 bp, Artificial Sequence
  Description of Artificial Sequence: Synthetic coding sequence
atgtcatatcaaggtaagaaatctatccctcacattacgagtgacaggctgctaattaagggcggacggatcattaatgacgatcagtctctgtacgccgacgtttatttggaggacggactgattaagcaaattggcgagaatttgatagtacctggaggcgtgaaaactatagaagccaatgggagaatggttattcctggcggaattgatgtcaatacctacctccagaagccctcacagggaatgacagctgctgacgatttctttcagggaacccgagcagcactcgttggtgggacaacaatgatcattgaccatgtggtgccagagccaggctcgtccctgctgacctccttcgagaaatggcacgaggctgcagatactaagtcttgctgtgattacagcctgcacgtggacataacatcctggtatgacggtgtaagggaggaactggaggtattagtgcaggacaagggtgtcaacagttttcaggtgtatatggcttataaagacgtctaccagatgagtgatagccagttgtatgaagcttttaccttcctaaaggggctgggtgcagttatccttgtgcatgctgaaaatggggacttaatcgctcaggaacagaagcgcattctagaaatggggatcacgggaccagaagggcacgcgctatcccgaccagaggagctagaagcggaggccgttttccgggcaataaccatcgcaggtagaatcaattgcccagtttacataaccaaggtcatgagtaagagcgcggctgacattatcgcgctggcaagaaaaaagggccctctggtgtttggtgagcctattgccgcaagcctgggcactgacggcacccattattggtcgaagaactgggctaaggctgctgcctttgttacctccccacctctgtccccagatccaactacgccagactacctaacctcattgctcgcatgcggagatctgcaggtcacaggctcaggccattgcccttattccaccgctcagaaagctgtaggtaaggacaacttcactctgattcctgaaggcgtcaacggcattgaagaacgaatgacagtggtgtgggataaagccgtggctaccgggaaaatggatgaaaatcagtttgtagcagtgacaagtacaaatgcagctaaaatttttaatctgtatcctcgaaagggtagaattgcagtcgggtccgatgcggacgtggtgatttgggaccccgataagctgaagaccattaccgcaaagtctcacaaaagcgccgtcgagtacaacatcttcgaaggcatggaatgccacggatctcccctggtggttatctctcaaggcaaaattgtttttgaagacgggaatatcaatgtaaacaagggcatgggccgattcatccctcgcaaggctttcccagaacatctgtaccagcgggtgaagataagaaacaaagtgtttggcctccagggcgtctcacggggtatgtacgacggcccagtttacgaagtccctgcgacgccaaaatacgccaccccagccccttccgccaagtctagcccaagcaagcaccagcccccacccattaggaatctgcaccaaagcaactttagtctgtcaggggcacagattgacgacaataacccacgacgaaccggccacagaatagtggctccacccggaggtcgaagtaatatcacatctctcggctag

SEQ ID NO: 218890 - DNA, 1713 bp, Artificial Sequence
  Description of Artificial Sequence: Synthetic coding sequence
atgcagaagatgaacaatgaagtggtagacaagtccgatcggctgttgataaaaggaggccgaattattaacgacgatcaatcactgtacgctgatgtttacttggaggatggtctgatcaagcagattggggagaatttgatcgttccaggaggtgttaagaccatcgaggccaacggccgaatggttatcccaggaggcatagacgttaacacttacctgcagaaacccagtcaaggcatgacggcagcagacgacttcttccagggcacccgtgccgcactcgtgggtgggactacaatgatcatcgatcacgtcgtgcccgagccaggcagctcattgcttacctcattcgaaaagtggcacgaagcagccgataccaagtcatgctgtgattattccctgcacgttgacatcacctcttggtacgacggcgttcgcgaagagctggaagtactcgtgcaggataaaggcgtgaactccttccaggtatacatggcctacaaagacgtatatcaaatgtcagacagtcagctgtacgaggcgtttacgttcttgaaaggccttggtgccgttattctcgttcatgccgagaacggtgacttgatagcacaggagcagaagcgcattctcgaaatggggatcaccggcccagaaggtcatgccttaagtaggccagaggaactcgaggctgaggccgtcttccgcgctatcactatcgcaggcagaatcaattgccctgtgtacatcactaaagtgatgagcaaaagcgcagctgatatcattgctttggctagaaagaaggggcctcttgttttcggagaaccaattgcggctagtctgggtaccgacggaacccattattggtccaaaaactgggccaaggctgctgccttcgtgactagcccccctttatcacccgatcccacaaccccagattatcttacctccctcctggcctgtggcgatctccaagtgacaggcagcggccattgtccatacagcaccgctcagaaagctgttggaaaggacaattttacattgatacccgagggcgtgaatggtatagaggaaagaatgaccgtcgtttgggacaaggctgtagcaacggggaagatggacgagaaccagttcgttgccgtaacaagcaccaacgcagcaaagattttcaacttgtacccaaggaaaggcagaatcgccgttggcagcgacgcagatgtcgtgatctgggacccagacaagttgaagaccatcacagcaaagtcacataaatctgctgtcgagtacaacatcttcgagggaatggaatgtcacggttccccactggtggtgatatcacaaggcaaaatagtctttgaggacggcaacattaacgtcaacaagggtatggggcgattcatcccacggaaagcctttcctgagcacttgtaccagagagtcaaaataagaaataaagtgtttggtctgcagggcgtgtcacgcggtatgtatgacggacctgtgtacgaggtgcccgcaacacctaagtatgccacccctgcacccagcgccaaatccagccctagtaaacaccagcccccacccatcaggaatctgcaccagtcgaatttcagcctgtctggagcccaaatcgacgataacaaccccaggcggacaggacatagaatcgtcgcacctccaggcggaaggtcaaacataacatcactgggctag

SEQ ID NO: 218891 - DNA, 1719 bp, Artificial Sequence
  Description of Artificial Sequence: Synthetic coding sequence
atgtcttaccaggggaagaagtctatccctcacattacttcagaccgcttgctgataaaaggaggacgtataataaatgacgaccagagtttgtacgccgacgtgtaccttgaggatggcctgatcaaacagattggagaaaaccttattgtgcctggtggggtgaagaccatcgaggcgaacggacgaatggttatccccggaggtatcgatgtcaacacatacctccaaaagcctagtcagggtatgaccgcagctgatgacttttttcaggggactcgcgctgccttagtcggcggaaccactatgattatcgaccacgtggtgccagaaccgggatcctcattgctcacatcctttgaaaaatggcatgaggccgcagataccaaatcatgttgtgactactctttacacgttgacattacgtcttggtacgatggtgtcagggaagagcttgaggtattggtccaggacaaaggagtgaattcttttcaggtgtacatggcctataaagatgtgtaccagatgagcgactctcaactctatgaggcctttacatttctaaagggtcttggtgccgtcatcctggttcacgccgagaacggggacctgatcgcgcaggagcaaaaaagaattctggagatgggaattactggccctgagggtcacgctctgtccaggccagaagagctggaggctgaggccgtcttcagagccatcaccatcgcaggtcgaatcaactgtccagtgtacattacaaaggtgatgagcaagagcgccgcagatataatagctttggccaggaagaaaggtccgctggtgttcggcgaaccaatcgctgcgagtctaggtaccgatggcacccactattggtctaagaattgggccaaggccgctgcattcgtgacatcacccccactctctcctgatcccacaacccctgattaccttaccagcctcctggcatgcggagatctccaagttaccggatccggccactgcccttactccaccgcccagaaggctgtgggaaaggataacttcacactgatccccgaaggtgtgaacggcattgaagagcggatgactgtcgtgtgggacaaggccgtggccacaggcaagatggatgagaaccagttcgtcgccgttacttccactaatgccgctaagatttttaatctctacccaaggaaaggtcgcattgccgtcgggtctgatgcagatgtagttatttgggatcccgacaaactgaaaactatcacggcaaaaagtcacaaatcggcagttgaatacaacattttcgaaggaatggagtgccacgggagccctttggtcgtcatcagtcaggggaagattgtgtttgaggatgggaatatcaatgtgaataaagggatgggacgatttatccccaggaaggccttcccagaacatctgtatcagagggtaaagatcagaaacaaggtattcggccttcagggtgtgtccagaggtatgtacgacggacccgtatacgaggtgcctgctacacctaaatacgcgacacccgctccatcagctaaatctagccctagcaaacaccagcccccaccaatcaggaatcttcaccagtcgaacttttccctgtctggggcacagatcgacgataataacccccgacgaaccgggcatcgcatagtagcgccaccaggtggcaggagtaatatcacctcactcggctag

SEQ ID NO: 218892 - DNA, 834 bp, Artificial Sequence
  Description of Artificial Sequence: Synthetic coding sequence
atgaatggattcgccagtctgctcagaagaaaccagttcatcctgttagtgctcttcctcctgcaaattcagagccttgggctggacatcgattctcgccctaccgccgaggtgtgtgctacacatacgataagccctggccctaaaggagatgatggggaaaagggcgaccccggagaggaagggaaacatggcaaggtgggtcggatgggcccaaagggaataaagggggaactcggcgacatgggagatcagggaaacattggaaagacgggtccaattgggaaaaaaggcgacaagggagaaaaaggcctgctcggcattccgggagaaaagggcaaagctggcacagtgtgtgactgcggcagataccgaaagtttgtgggccagttggatatatcaattgcacggctgaagacttcaatgaaattcgtcaaaaacgtgatcgctggaatccgtgagaccgaggagaaattttactacattgtgcaggaggagaaaaactaccgggagtccctcacccactgtcgtattcggggtggtatgttagctatgcccaaagacgaggcggctaataccctgatcgctgactacgtcgccaagagcggctttttccgggtcttcattggcgtgaacgaccttgagcgcgagggccagtacatgttcaccgataacacgccattacagaattactcaaactggaatgagggagagccatcagacccctacggtcatgaggactgcgtggagatgcttagctctggcagatggaacgataccgaatgtcatttaacaatgtactttgtctgcgaattcattaaaaagaaaaagtag

SEQ ID NO: 218893 - DNA, 807 bp, Artificial Sequence
  Description of Artificial Sequence: Synthetic coding sequence
atgactcctgccttgtgcagaagctcctctctcgccagtaaagggatgagagagcgcagagagacaaaggcgccaccagatggtctggaagaaagtgcaccccgtgaaaaaaaacagtctcagcctgtggtaacagctagcgacattagtaagaggaagtgcaccagctccttcgttgagatgggatcacaaggagacatgggagataaaggtcagaagggttcagtggggaggcatggtaagattggtccaatcggaagtaagggggagaaaggtgattccggcgacatcggaccgccaggccctaacggggaacctggcctcccttgtgagtgctcgcagctgcggaaggccattggggagatggataatcaggtatctcagctcacaagcgaactgaagttcatcaaaaacgccgtggctggggttcgtgaaactgaaagcaagatttatttgctggttaaagaggaaaagaggtacgcggatgctcagttatcttgtcagggtcgtggcggaacgctgtccatgccgaaagatgaagctgcaaacggcctgatggcagcctatctggctcaggccggtctggcaagagtctttatcggtatcaatgatctggagaaggaaggcgctttcgtgtatagtgatcactctcctatgaggactttcaacaaatggcggtccggcgagcctaataacgcatacgatgaagaggactgcgtggaaatggtcgcctcaggaggctggaacgatgtggcgtgtcacaccactatgtactttatgtgtgagtttgataaggaaaatatgtag

SEQ ID NO: 218894 - DNA, 816 bp, Artificial Sequence
  Description of Artificial Sequence: Synthetic coding sequence
atgaggggcaatctggcactggtcggagtcctgatctcattagcctttctgagtttattaccctctggccatccacagcccgctggagatgacgcgtgctcggttcagatcctggtaccaggcctaaagggcgatgctggcgagaaaggagataagggggcaccgggaagaccaggacgtgtcggacccaccggagagaaaggggacatgggagacaagggtcagaagggcagtgtcggaagacacggcaagatcggcccaataggctcgaagggggaaaagggagacagcggcgacatcggtccaccgggaccaaacggcgagcctgggctgccatgtgagtgctcacagttgcgtaaggctattggggaaatggataatcaggtgagccagctcaccagcgagctcaagtttattaagaacgcagttgctggcgtgcgcgagacagagtccaagatttatctactcgtcaaagaagagaagcgctatgcagatgcacagttgtcctgtcaagggcgaggcggaactctgtcgatgccgaaggatgaagcggctaacggactaatggcagcatatctggcacaggcgggactggccagagtttttatcggcatcaatgacctcgaaaaagaaggtgccttcgtctattcagaccacagcccaatgaggaccttcaacaagtggaggagcggggagcctaacaacgcatacgatgaggaggattgtgttgagatggtggcatctgggggttggaacgacgttgcttgccacaccacaatgtactttatgtgcgaatttgataaggagaacatgtag

SEQ ID NO: 218895 - DNA, 744 bp, Artificial Sequence
  Description of Artificial Sequence: Synthetic coding sequence
atgcgaggaaacctggccctcgtaggtgtcctgatttccctggcttttctctctttgctaccttccggacacccccaacccgctggggacgatgcgtgttcagtgcagattttagtgcccggacttaagggagatgccggtgagaaaggggacaaaggcgcacccggacgaccgggacgcgttggaccgacgggtgaaaaaggggagaagggtgattctggggatataggaccaccaggtcctaatggggaacccggactaccttgcgaatgtagccaacttcggaaagcaatcggcgaaatggataatcaggtgtctcagcttacatccgagctcaaattcattaaaaacgctgtcgccggagtacgcgagacagagagcaaaatctacctcctcgtgaaggaggagaagcggtatgccgacgcacagcttagctgtcagggaaggggaggcacgctctccatgccgaaggacgaggccgctaacggacttatggcagcttacctagcccaggcgggactggccagagttttcataggaatcaacgatttggaaaaggaaggggcatttgtgtacagtgatcatagcccaatgcgcacttttaacaagtggcgatccggtgagccaaacaacgcctacgacgaagaggattgcgtggaaatggtagccagcggcggatggaatgatgtggcttgccatacaaccatgtactttatgtgcgaattcgacaaggagaacatgtag

SEQ ID NO: 218896 - DNA, 858 bp, Artificial Sequence
  Description of Artificial Sequence: Synthetic coding sequence
atgaaaaaacagaggggtgttggcgtccttcccgctcttcgcatgaggggcaatctcgccctggtgggtgtgcttattagcctcgctttcctgtcccttcttccgtccgggcatccccaaccagccggagatgacgcctgctccgtgcagattttggtcccaggcctcaaaggagacgcaggagagaaaggggataaaggtgccccaggacgcccaggtagagtgggaccgaccggggagaaaggagacatgggcgacaaaggacaaaaggggagcgtgggtcgtcacggcaaaattggccctatcgggagcaagggcgagaagggtgacagtggggacatcgggcctccagggcctaatggtgaacccggactgccttgcgagtgcagccagctgcggaaagctatcggagagatggataatcaggttagccagctgacatcagagctgaagttcataaagaacgcagttgccggtgtgcgggaaaccgaaagtaaaatatacctgttggtgaaagaggagaagcgctacgcagacgcccagctctcttgccagggcagaggcggtactctgtctatgcctaaagacgaggccgcaaacgggctaatggctgcgtacctggcacaggcgggtcttgctagggtgttcattggaatcaacgatttggagaaggaaggcgcatttgtatattctgatcatagtcccatgagaaccttcaacaagtggagatccggggaaccaaataatgcatatgatgaggaggattgcgtggagatggtggcctcagggggatggaacgatgtcgcctgccacactacgatgtactttatgtgcgagtttgataaggaaaatatgtag

SEQ ID NO: 218897 - DNA, 666 bp, Artificial Sequence
  Description of Artificial Sequence: Synthetic coding sequence
atgtggtgggtaccccctagcccatacggctgtctcccgtgtgctctgccgggagacatgggtgataagggccagaagggtagcgtagggcgtcacggaaagatcggccctattggctctaaaggagagaagggagatagcggggacattggcccaccaggaccgaatggcgagcccggactaccttgtgagtgttctcaattgcggaaagcaatcggcgaaatggacaaccaggtaagccagctcaccagtgagttgaagttcattaagaacgctgtggccggagtgagagaaaccgagagcaaaatctatctgctggtcaaagaggaaaagaggtatgccgacgcacagctgtcatgccagggcagaggcggaacactgtccatgccgaaagacgaagctgcaaacggacttatggctgcttacctagcacaggcaggcctggccagagtcttcattggaattaatgatctggagaaagaaggcgcttttgtgtactccgatcactctcctatgaggacatttaataaatggaggagtggagagccgaacaatgcttacgacgaagaagactgtgtggagatggtggcaagtggtggatggaacgatgttgcatgccatactacaatgtattttatgtgcgaattcgataaggagaatatgtag

SEQ ID NO: 218898 - DNA, 666 bp, Artificial Sequence
  Description of Artificial Sequence: Synthetic coding sequence
atgtggtgggtgcccccatccccctatgggtgtctgccgtgtgccttgcccggtgacgcgggtgagaaaggggacaaaggcgcaccgggacgccctgggagagtagggccaacaggggaaaagggggaaaagggcgacagcggtgacatcgggccacccggacctaatggtgaacccggactgccatgtgaatgttcccagctgcgcaaagccattggcgaaatggacaatcaagtgagtcagttaacatccgagctgaagttcatcaagaacgcggtggcaggcgtacgggagacagaatcgaagatttaccttctagtgaaggaggagaaacgctacgcagacgcccagttgtcctgtcaaggcagggggggaactctcagcatgcctaaggacgaggccgcaaacggactgatggccgcatacttggcccaagctggactggctcgagtgtttattggtataaacgacttggagaaggagggtgccttcgtctactctgatcatagccctatgcgcaccttcaataagtggcgaagcggggagcccaataatgcttacgacgaagaagactgcgtggaaatggtggcgtccggtggctggaatgacgtggcttgtcatacaaccatgtactttatgtgcgaattcgacaaagagaacatgtag

SEQ ID NO: 218899 - DNA, 594 bp, Artificial Sequence
  Description of Artificial Sequence: Synthetic coding sequence
atgtggtgggtacctccgagcccctatgggtgtctcccctgcgctctaccaggcgagaagggggactccggcgacattggcccacccggaccaaacggcgaacccggtctcccttgtgagtgctcccagctacgtaaagccataggagaaatggacaatcaggtctcccagttaacatccgagctcaagttcatcaaaaacgctgtggccggtgtccgcgagaccgagagcaagatttacttactggtaaaagaggaaaagcgctacgcagacgcccaattgtcctgtcagggcaggggtgggacactcagtatgccaaaggatgaagccgcaaatgggctcatggccgcttatcttgcccaagcaggcctggctcgggtcttcatcgggattaatgaccttgaaaaagagggcgctttcgtgtattctgatcacagtcctatgagaacctttaacaaatggcggagcggtgaacccaataatgcttatgacgaagaagactgtgtcgaaatggtcgcttcaggcggatggaacgatgtggcttgccacacgacgatgtattttatgtgcgagtttgataaggagaatatgtag

SEQ ID NO: 218900 - DNA, 2229 bp, Artificial Sequence
  Description of Artificial Sequence: Synthetic coding sequence
atgaaggacgacttcgctgaggaagaggaggtccaatctttcgggtataaacgctttggcattcaagagggtacacaatgtaccaagtgcaagaacaactgggcgctgaaattctctatcatcctactgtacatactgtgtgctctgctgacaatcactgtggcaatactggggtacaaggtggttgagaaaatggacaacgttaccggaggcatggaaacatccagacagacgtacgatgataagttaaccgctgtagagagcgatctgaaaaagttaggtgatcaaacgggcaagaaagctatctcaacgaactcagagctgtccacttttcggtccgacatcttagatctcaggcagcagttgcgagagatcaccgaaaagacctctaaaaataaggacaccctggagaaactgcaggccagtggtgacgcgctggtcgacagacaatcccagctcaaagagaccctggaaaacaatagtttcctgatcacgaccgtaaataaaaccctacaggcctacaatgggtatgttacaaacctgcaacaggacacatctgttcttcaggggaatcttcagaaccagatgtattctcacaatgtcgtgataatgaaccttaataatctcaatctgacccaggttcagcagcgaaatctcatcactaacctccagaggtccgtcgatgacacctcacaggccatccagagaatcaaaaatgactttcagaacctccagcaggtcttcctgcaggctaagaaagacactgactggctcaaagagaaggttcaaagcctccagaccttagcagcaaataattccgctctcgccaaagctaacaacgataccctcgaagatatgaattctcagctcaatagcttcaccggacagatggaaaatataaccaccatttcacaggccaatgagcagaacctgaaagacctccaggacctgcacaaagatgcggagaatagaaccgccataaagttcaaccagttggaagagaggttccagctgtttgaaactgacatcgtgaatattatttccaacatcagctatactgcccaccaccttaggacattgactagcaatttaaatgaggttcgaacaacatgcacagatacactgaccaaacacaccgacgatctcacgtccctaaataatacattggcaaatatacgcctcgattccgtctctctgcgtatgcagcaggatctgatgcgctctagactggacactgaggtggccaatctctccgttatcatggaggagatgaagctcgtagactcgaagcatgggcagcttatcaagaactttacaattctccagggccctccgggtccccgaggacctcggggagacagaggctcccaaggccctcccggtcctactgggaataagggtcagaaaggagaaaaaggggagcccggacctccaggtcccgcaggcgagaggggccctatcgggccagccggaccaccaggcgaacggggaggaaaaggctccaagggctcccaaggacctaaagggtctcggggatcacctggcaagcccggaccccagggatcttctggagatcctgggccacctggacctcccggaaaagagggcctgccgggtccgcagggaccacctggcttccagggattgcaaggcaccgtaggcgaacctggggtaccaggccctaggggactgcccggtcttcctggagtcccagggatgcctggacccaagggacctccaggaccgcctgggcctagtggggctgtagtccctctggccctccagaacgagcctacgcccgctcctgaggataacggatgcccaccccactggaagaactttaccgacaaatgttactatttctcggtcgaaaaagagatctttgaggacgcaaagctcttctgtgaggacaagtcatcgcatctggttttcatcaacactcgcgaggaacagcagtggatcaaaaaacagatggttggaagagagtcccattggattggccttacagattccgagcgggagaacgagtggaagtggttggacggtacctccccggattataagaactggaaggccggacaacctgacaactggggccacggccacggcccaggagaagactgtgccggactgatctatgccggacaatggaacgacttccagtgcgaggacgttaacaatttcatttgcgagaaagaccgcgagacggtgctatcctcggccttatag

SEQ ID NO: 218901 - DNA, 2919 bp, Artificial Sequence
  Description of Artificial Sequence: Synthetic coding sequence
atgggtcccggtgtgctattgctgcttctggtggcaaccgcctggcatggacaaggcatccctgtgatagagccttccgttcctgaattggtggtgaaacccggtgcaacagtgacactgcggtgcgtgggcaacggaagtgtggagtgggatggcccaccctcccctcactggacgctatactctgacgggtcctctagcattttgtctaccaataacgccaccttccagaataccgggacataccggtgcacggagccgggagatccacttggcggttccgccgcaatacacctttacgtgaaggaccccgcacgaccttggaatgtcttggctcaggaggtggtagtgtttgaagaccaggacgccctcctgccttgcctccttactgatcccgtgctggaggccggtgtgtcactggtccgagtgcgtggcaggccccttatgcggcacaccaactactcattctcaccatggcacgggtttactattcatcgagccaagttcatccagagtcaggactaccagtgttccgccttaatggggggaaggaaggtgatgtccatatccatccggttaaaggtccagaaggtcattccgggtccccctgctctcacccttgttccagccgagttagtccgaattaggggggaagccgcacagatcgtttgctcagcttccagcgtggacgttaactttgatgtatttctgcagcataacaataccaagctcgccatccctcaacagagcgatttccacaataatcggtaccagaaggtcctcactctcaatctcgaccaagtagacttccagcatgccggaaattatagttgtgtcgcttctaatgtgcaaggcaagcactctacctctatgttctttagggtggtggaatctgcctatctaaatttatcgtcagagcagaacctgattcaggaagtgacagtgggggaaggactgaacctcaaagtgatggttgaggcctatcctgggcttcaaggctttaactggacctacctggggcctttctccgaccaccaacctgaacctaagttagccaatgccaccacaaaggatacttaccggcacacattcaccctcagcctgcctagacttaaaccctcggaggcaggacgttactctttcctggcaagaaaccccggaggctggagggcattgacattcgagctcacgctgaggtatcccccagaagtttccgtgatctggaccttcattaatgggtctggcacacttctctgtgcagcatcaggttacccacaaccaaacgtgacttggctccaatgcagcggccacacagacagatgtgacgaggcccaggtgctacaggtctgggacgacccttatcctgaggtactgagccaagagcccttccacaaagtcaccgtgcagtccctattaactgtggaaaccctcgagcacaaccaaacttatgaatgccgggctcataattctgttgggtctgggtcctgggccttcattcccatcagcgcaggggctcacactcatccacccgacgaatttctgttcacccccgtcgtggtggcttgcatgagtatcatggctttgctgctgctgcttttgctcttattattatacaaatacaaacagaagccaaagtatcaagttagatggaagattattgaaagctatgagggaaattcatatacttttatagaccctacccagcttccctataacgaaaagtgggagttcccaaggaataatttacagtttgggaagactctgggagcaggcgcattcggaaaagtggtggaggctactgcttttggccttggaaaggaagatgctgtccttaaggtggcagttaaaatgctcaagagcactgcccatgccgatgagaaggaagccctgatgagcgagttgaaaattatgagccatcttgggcagcacgaaaacatcgtaaatctcctgggggcatgcacccatggcggacctgtgctcgtgattaccgagtactgttgttacggcgatctgttaaatttcctgaggcgcaaggccgaggccatgctgggaccaagtttgtctcccggtcaggaccccgaagggggtgtcgactataagaatattcatctggagaagaaatatgtgcgacgcgactccgggttttcttcacagggtgtcgacacatacgtcgaaatgagacccgtctcaaccagctcaaacgatagcttttcagaacaggacctggataaggaagacggccgaccgctagagctaagagatctgttacatttttctagccaggtcgcccaggggatggccttcttagccagtaagaattgcattcaccgcgacgtagctgccagaaatgtactcttaaccaacggacacgtggccaaaatcggagatttcggtctggccagggatattatgaacgacagcaactacattgttaagggaaacgcaagattgcctgttaagtggatggctcctgagtctatattcgattgtgtttatactgtgcagtcagacgtctggtcgtacggcatcctgctgtgggagattttcagtctaggtttaaacccctatcccggaatactggtgaattcaaaattttacaaactcgtcaaggacgggtatcagatggcccaaccagcctttgctcctaaaaacatttactcaattatgcaggcttgctgggccttggaacctacccaccgccctactttccagcaaatatgttcttttcttcaggaacaggcccaagaagataggcgggaaagggactataccaacctcccttcctcctcccgttcggggggatcaggcagttccagcagtgaactggaggaggagagctcttccgaacacctgacctgttgcgagcaaggcgatatcgcccagcctctgctacagcctaataattaccagttttgttag

SEQ ID NO: 218902 - DNA, 1506 bp, Artificial Sequence
  Description of Artificial Sequence: Synthetic coding sequence
atgcgccatacaaattactccttcagcccctggcatggatttactattcatcgggcaaagttcatccagagccaggattaccagtgctctgccctcatgggcggtcgcaaggttatgtctatctcaatccgactgaaggtacaaaaggtgatacctggcccaccggctctgactttggtacctgccgaactggtcaggatacgaggtgaagccgctcagatcgtttgtagcgcttcctctgtggatgtgaacttcgatgtttttctacagcacaacaataccaagttggctatcccccagcaaagtgacttccataacaatcgttatcagaaggttctcaccctgaatctggatcaggtggactttcagcatgctgggaactattcctgcgtggcatcaaatgtgcagggtaaacactcaacttctatgttcttcagggtagtagaaagcgcttacctgaacttgtccagtgagcagaatttgattcaggaggtcacggttggcgagggactgaatcttaaggtgatggtggaggcttatcccggtctgcaaggcttcaactggacctacctgggacccttcagcgaccatcaaccggagcctaaattggccaatgcgactacgaaggacacctataggcatacctttacactgtctctgccccgtctcaagccttctgaagctggtagatatagctttctggccaggaacccgggaggatggcgagcactcaccttcgaattaaccttgaggtatccacccgaagtatcagtgatctggacgtttataaatggcagcgggactctgctgtgtgcagcatctggataccctcaacccaatgttacttggctgcaatgctctggtcataccgaccgttgtgacgaggcgcaggttctgcaagtgtgggacgatccctacccagaggtgctatcacaggaaccatttcacaaggtaaccgtgcagagcctccttactgtagagacactcgaacacaatcagacctatgaatgtagagctcataacagtgtggggtccgggagttgggcattcatcccaatttccgccggagctcatacgcaccccccagacgagttcctttttacacccgtggtggttgcgtgtatgagtatcatggctctgctcttactgctactcctgctgctgctctacaaatacaaacagaagccaaagtaccaggtccgttggaagattatcgagagttatgagggcaatagttacaccttcattgaccctacacagttgccctacaatgagaaatgggagtttcctaggaacaaccttcagtttggcaagacactgggggctggagcctttggtaaggtggtggaagccactgctttcggcctgggaaaagaagacgcggtcctgaaggtagctgtcaagatgctcaagtcaaccgctcatgccgatgagaaggaagcctccggtctgtaccaatcggccgaacagcagcaaaaacgctggcaacgacagcagcagcagtag

SEQ ID NO: 218903 - DNA, 2016 bp, Artificial Sequence
  Description of Artificial Sequence: Synthetic coding sequence
atgggtcccggtgttctactgctcctgctcgtcgcgaccgcatggcatggccagggaatacctgtgatcgagccgagtgtccctgagctcgtggtgaaacccggagccactgtaactcttaggtgtgtcggcaacggcagcgtcgaatgggatggccctccctcccctcattggaccctgtatagtgacgggtccagctccattttatccaccaacaacgccactttccagaatacgggaacctaccggtgcacagagccaggcgacccgttggggggtagtgctgccatccatctgtatgtcaaggatcctgctcgaccttggaatgtgctcgcacaggaagtagtggtgttcgaagaccaggatgcgctgctcccctgtttactgaccgaccctgtacttgaagcgggtgtgtctctcgtgagggttagggggagacccctgatgagacatactaactattccttttcaccctggcatggattcaccatccaccgcgcaaagttcatccagtcccaagattaccagtgtagcgcactgatggggggtagaaaagtgatgtcgatctccattcggctgaaagttcaaaaggtgatccccggacctcccgcactgacactcgtgcccgcagagctggtgcgcattcgcggagaggcagctcagattgtttgcagcgcatccagcgtggatgtgaacttcgatgtgttcttgcagcacaacaacacaaaactggccatcccacagcagagcgattttcacaataaccggtaccagaaggtactgacacttaatctggatcaggtagacttccagcatgcaggcaactattcatgcgtggcctctaatgtgcagggtaaacactcaactagcatgttttttagggtggtagagtcagcatacctgaacctcagctcggagcagaatttgatacaggaggtgacggtaggtgaagggctcaacctgaaagtaatggtggaggcctaccctggactgcagggttttaactggacatatttgggaccttttagcgatcatcagcccgagcccaagcttgcaaacgccaccactaaggacacataccgacacacttttaccttgagtcttccacggcttaagccatctgaagcgggaagatattcctttctggccaggaaccctggtggctggcgggctctcacttttgaactgaccctcaggtacccacccgaagtcagtgtgatctggaccttcattaatggctccggtaccctgctgtgcgcggcttctggatacccgcagccaaacgttacgtggctgcaatgttcagggcataccgatcgctgcgacgaggcccaggtcttgcaagtgtgggatgatccataccctgaagtgttgtctcaggagccttttcacaaagtgaccgtgcagagtcttttgacagtggagaccctggaacataatcaaacatacgaatgcagagcacacaatagcgtggggtcaggaagctgggccttcattccaatatctgccggagcccatacgcatccccctgatgagttcctgtttactccagttgtggtcgcatgtatgagtattatggctcttctgctcctgctgctgttgcttctcctgtataagtataagcagaagccaaagtatcaagttaggtggaagataatcgaaagttacgaaggcaacagctacacctttatcgatcctacccaactcccgtacaacgaaaaatgggagttccctcgcaataatttgcaattcgggaaaaccctgggagccggtgccttcggaaaagtggtggaggctacagccttcggacttggcaaggaagacgctgtgttgaaggtcgccgtaaaaatgctgaaaagcactgcccatgctgacgagaaggaggccctgatgagcgaattgaagattatgtctcacctcgggcagcacgagaatatcgtgaacttgttaggggcttgcacccatggagggacagttgcctctcccgctagggtgtggacgccaatgtggaggtag

SEQ ID NO: 218904 - DNA, 921 bp, Artificial Sequence
  Description of Artificial Sequence: Synthetic coding sequence
atgggccctggcgttctgctgctgctccttgtggccaccgcctggcatggccagggaatccctgtgattgaaccaagtgttcccgaactggttgtgaagccaggggcaacagttacgctgcggtgtgtgggaaacggctccgtggaatgggatggtcctccttcccctcattggacgctgtatagcgatggcagttcctcaattttgtctacaaataatgccacattccagaacactgggacttacagatgtactgagcctggcgacccactgggaggcagtgccgctattcacttgtacgtaaaggatcccgctcgtccctggaacgtgcttgcgcaggaggtggtggtctttgaggatcaagacgctctcctgccttgcttacttaccgacccggtacttgaagctggcgtgagtttggtaagagtgcgaggacggcctcttatgaggcacaccaactacagcttctccccgtggcatggctttaccattcaccgcgctaaatttattcagtcccaggactaccagtgctccgcccttatggggggtagaaaagtcatgtcgatctcaatacgtctcaaagtacaaaaggtaatccctggtccgcctgcacttaccctcgtccccgcagagctcgttcgtattcggggagaggccgctcagattgtttgctcagcaagctccgtggacgtcaactttgacgtcttcctgcaacataataacactaaattggccataccacagcaatccgattttcataacaatagataccagaaggtgttgacacttaaccttgaccaggtcgatttccaacatgcgggaaactatagctgtgtggctagtaacgtacagggaaagcactccaccagcatgttctttcgcgtcgtgggaacgccgtccccttccctgtgcccagcctag

SEQ ID NO: 218905 - DNA, 1134 bp, Artificial Sequence
  Description of Artificial Sequence: Synthetic coding sequence
atgttacttctggttacttccctgttgttgtgcgaacttccgcatccggctttccttctgatccctgagaaatcagatctgcggacagtggccccagcaagctcgttgaacgttagatttgatagtagaaccatgaacctgtcttgggactgtcaggagaacaccactttttctaaatgtttcctgacggacaagaagaaccgagtcgtcgagccaagattatcaaacaacgagtgtagctgcaccttccgtgagatctgcctgcatgagggcgtcacttttgaggtccatgtgaacacaagtcagagaggtttccagcagaagttgctgtatcccaactcgggtagggaagggaccgcagcacagaactttagctgttttatctataacgccgatctgatgaactgcacctgggctaggggcccaacagcacctagggacgttcagtatttcttgtatatcagaaacagcaagaggcgacgtgagatccggtgcccctactacattcaggactcggggactcacgtgggctgtcacttagataatctgtctggcctgacgagccggaattacttcctggtgaacggaacctccagggagatcgggattcagttttttgatagcctgcttgacactaaaaagatcgaaagattcaatccgccttccaacgtgacagttaggtgcaacactacacattgtctggtgcggtggaaacagccacgaacctaccagaagctcagttacctggacttccagtatcaactggacgttcaccgcaaaaatacgcaacctgggactgaaaatctgttaatcaacgtgagcggagatctcgaaaaccgctacaacttcccttccagcgagcctagggccaagcactccgtgaaaatccgggctgccgacgtccggattctgaactggtcctcgtggtctgaggctatcgagttcgaccatttgggtgggattcaccccaggggcagagaaagactccccagacggggattggacagagagggcaactacctgcgacccaggggatgccgcaacggtatggatatttctgccagcgcaacccggggaaactgctttctagacgatgcagtgaacttgtacatcattttttatgtgtttatctag

SEQ ID NO: 218906 - DNA, 702 bp, Artificial Sequence
  Description of Artificial Sequence: Synthetic coding sequence
atgcttcttctagtgactagtctgcttctctgtgagctgccccaccccgcttttcttttgatccccgagaagagcgaccttaggaccgtggcacctgcttctagtctgaacgttagattcgacagtcggaccatgaatttaagctgggattgccaggagaatactacgttctctaagtgctttttgaccgacaaaaaaaatagagtagtagagccacgactgtcaaacaacgaatgcagttgtacattccgggaaatttgcctacatgagggcgttacttttgaggtacatgtgaatacaagtcaaaggggtttccagcaaaagttgctgtatccaaattctggtagggaggggaccgcagcacagaattttagctgttttatctacaacgcggatttgatgaactgcacctgggccagagggccaactgctcctcgggatgttcagtattttctgtatatccggaactccaagaggcgaagggaaataagatgcccttattacattcaggattctggcacgcatgtcggttgtcatcttgacaacttatccggcctgacctcccgcaactattttctcgtgaatggaacctctcgcgaaatcggcattcagttcttcgacagcctcctagatacgaaaaaaatcgggtctctcggatactccggttgttccagacagttccacaggtctaagactaactag

SEQ ID NO: 218907 - DNA, 1002 bp, Artificial Sequence
  Description of Artificial Sequence: Synthetic coding sequence
atgctcctgctcgtgacttcactcctgctctgcgaactcccacatccggcattccttttgatccccgagaaatctgatctcaggacggtggctccagcctccagccttaacgttcggttcgactcccggacaatgaatctatcttgggactgtcaggaaaacacaaccttctccaagtgctttctaaccgacaagaagaatagagttgtggaaccaagactgtcaaataacgagtgtagttgcacctttcgcgagatctgtctgcatgaaggcgtgaccttcgaggtacatgtaaatacctcccagaggggtttccagcagaaattgctctacccgaactccggaagagagggaacagctgcgcaaaacttttcctgttttatttataacgcggatctgatgaattgtacatgggctagagggcctacagctccaagggacgttcagtactttttgtatatcaggaattcaaagcgacgcagggaaattcgctgtccctattacatccaagattccggtacccacgtggggtgccacctggataatctgtccggattgacctctcggaactactttctggtgaacggaacatccagggagatcggaattcagttcttcgattcactgcttgacacaaagaagatcgagcgcttcaatcctccttccaatgtcacagttagatgcaatacaacgcattgtctggtacggtggaagcagcctagaacttatcaaaaactgtcataccttgactttcaataccaactggacgtgcaccggaaaaatacacaacccggaactgaaaacctgctcattaacgtgagcggggatttagaaaacagatataattttccttctagcgagcctcgcgctaagcactcagtgaagatccgcgcagcggacgtgagaatcctcaactggtcatcctggagcgaagccattgagttcggaagtcttggctatagtggctgttctagacagtttcaccgcagcaagaccaactag

SEQ ID NO: 218908 - DNA, 1002 bp, Artificial Sequence
  Description of Artificial Sequence: Synthetic coding sequence
atgctcctccttgtgacgagcctcctgttgtgtgaactcccccaccctgcttttctcctcatcccggaaaagagcgaccttaggactgtcgccccagccagctctcttaacgtgcgattcgactctcgcactatgaacctcagctgggattgtcaggagaataccacctttagtaaatgttttttgacagacaaaaaaaaccgcgtcgtcgagcctagactgtcaaacaatgaatgttcatgtactttccgggagatctgtctgcacgagggcgtgaccttcgaggtccatgtcaacacatcccagcgcggattccagcagaaattgttgtaccctaatagcggcagagaaggtacagccgcacagaacttctcttgctttatatataacgctgatttaatgaattgtacctgggctagaggccctacagcccctcgcgacgtacagtattttctttatattagaaacagcaaaagacgcagggagatacgctgtccttattatattcaggattccgggacccacgtaggctgtcatctcgacaatctttccggactcacctccaggaactattttttggttaacggcacctcacgagagattggaattcagttttttgattcacttctggatacaaagaagatcgaacgattcaatcccccaagcaacgtgaccgtccgctgcaatactacccactgcttggtcagatggaagcaacctcgtacgtaccagaagctgtcatacctcgactttcagtaccagctggatgtgcatcgaaaaaacactcagcccggaacagagaatttgttgatcaacgtgtctggcgatctcgaaaatcgttacaatttcccatcttctgagccacgcgcaaaacactcagtcaagattcgggctgccgacgtcagaattttgaactggagcagttggagtgaagccattgaatttggttcactcggatattcagggtgtagccggcaattccacagatctaaaactaactag

SEQ ID NO: 218909 - DNA, 861 bp, Artificial Sequence
  Description of Artificial Sequence: Synthetic coding sequence
atgctgcttctggtgacatctctgctactatgcgaattgccccatcctgcattcctgcttattcctgaaaaatctgacctccgaaccgtggcccctgccagcagcctgaatgtgagattcgattccagaactatgaacctctcctgggactgtcaggagaatacgacgttctccaaatgtttcctgacagataagaagaaccgcgtagttgagcccagactgagtaacaacgagtgctcgtgtacattccgcgagatctgtcttcatgagggggtgaccttcgaggtccatgttaacacaagccagaggggattccaacagaaactactttatcccaacagcggacgagagggaacggccgctcagaacttttcttgcttcatatacaacgcggacctaatgaactgcacgtgggctagagggcctacagctccccgagacgtgcagtatttcctgtatataaggaattccaaacggcgtcgtgaaattagatgcccctactacatccaggactccggaacacacgtggggtgccatttggacaacctgtctggtctgacaagcagaaattactttctggtgaatgggacctcgagagagatcgggattcagtttttcgactccctgctggacactaagaaaattgaacggttcaaccccccttctaacgtcactgtgcgctgtaacacgacccattgcctggtgaggtggaaacagccgaggacctatcagaagcttagctatctggattttcaataccagctcgatgtccatcgaaagaacacccaaccaggcacagaaaacctgctggtggtcctgacaactggcaccagtgcattgtgcactttcatgtgttcgtag

SEQ ID NO: 218910 - DNA, 1233 bp, Artificial Sequence
  Description of Artificial Sequence: Synthetic coding sequence
atgctcctgttggtcacatcgctgctcctctgcgaactccctcacccagcattcctcctcatcccagagaagagcgaccttaggaccgttgcacccgcttctagtctcaatgtgagatttgattctcggaccatgaacctctcttgggactgccaagagaacacaacattctcgaaatgctttctgacagacaagaaaaaccgggttgtggagccacgtctaagtaacaatgaatgctcttgtacatttcgagagatatgcctgcacgagggagtgacattcgaggttcacgtcaacacaagccagagagggttccaacagaaactgctgtaccctaatagtggaagagaggggacagctgctcagaacttctcctgcttcatctataatgccgacctcatgaactgtacctgggcacgcggtcctactgccccacgggatgttcaatactttctttacatacggaactcaaagagaagaagggaaattcggtgcccgtattatattcaggacagcggaacccatgtgggctgtcatcttgacaatcttagcgggcttacttctcgtaattacttcctggtgaacgggacctctcgtgaaatcggcatccagttttttgattcgctgctcgacactaaaaagattgagaggttcaatccccctagcaacgtgaccgtcagatgtaacactactcactgtctcgtccgctggaaacaacccaggacctaccagaagctcagctatctcgatttccaatatcagctagacgtgcacaggaagaatacccagccaggcaccgagaatctgctgataaatgtttctggcgatctcgagaacagatataatttcccatcttccgagcccagagcaaagcacagcgtaaaaatacgcgctgcagacgtacggatcctgaattggagctcatggtccgaagcaatcgaatttggtagcgatgacggaaacctgggatctgtgtatatctacgttcttctgatcgttggaacccttgtctgcgggatcgtgctgggcttcctgtttaagaggtttttgagaatccagcgactgtttcctcctgtgccacagatcaaggataagctcaacgataatcatgaggtggaggacgagatgggcccacagcgacaccacagatgcggttggaacctgtaccctacccctggtccttcccctggcagtggatctagtcctcggctgggcagtgagtcaagtctctag

SEQ ID NO: 218911 - DNA, 1203 bp, Artificial Sequence
  Description of Artificial Sequence: Synthetic coding sequence
atgttactactggtaacatccctgttgctctgcgagctaccacaccctgctttccttcttattcctgaaaagtccgatctccggactgtggccccagcgagttctcttaacgtgaggttcgatagccgcacaatgaatctttcttgggactgtcaggaaaatacaacattttccaaatgctttctgacagataagaaaaatagggtcgtggaacccaggctttctaataatgaatgcagctgcaccttcagagaaatatgcctgcatgaaggagtgaccttcgaagtccatgtgaatacttctcagcggggatttcagcagaagctgctgtaccctaattcagggagagaaggaactgccgctcaaaacttctcatgtttcatatataacgcggacctcatgaactgtacatgggctcggggacccaccgccccaagggatgttcagtactttctgtacatccgaaatagtaagcggagacgggagattaggtgtccctattacatacaggactcgggtacccatgttgggtgccatctcgataacctaagtgggctgacctcacgcaactacttcctagtgaacgggactagtagagaaatcgggatccagttcttcgactcacttcttgacacaaagaagatcgagagattcaacccgccaagcaacgtcaccgtacgttgtaacacgacccactgtttggtaagatggaaacagccaagaacataccagaagctgtcttatctggactttcagtatcagctagatgtgcacaggaagaacacacaaccagggaccgagaacctgcttataaatgtcagcggggacctcgaaaataggtacaatttcccaagctccgagccccgagccaagcatagcgtcaagatccgtgcggctgacgtgaggatattgaattggagtagctggagtgaagccatagaatttggatccgatgacggaaaccttggatccgtgtacatatacgtcctcctcattgtgggcacattagtgtgcggcattgtgttgggcttcttgttcaagcggttcctgcggattcaacggctcttccccccagttccacagatcaaggacaaactgaatgacaaccacgaggtcgaggacgagatcatatgggaggaattcactcctgaagagggtaaaggataccgggaagaggtcctaacagtaaaagagataacctag

SEQ ID NO: 218912 - DNA, 1203 bp, Artificial Sequence
  Description of Artificial Sequence: Synthetic coding sequence
atgctgttgctggtgacgtcgctgctgctttgcgaacttcctcaccccgctttccttttgatccccgaaaaatccgacctgcgaaccgtggctccagcaagttcactaaatgtaaggtttgacagcagaacaatgaacttatcatgggactgtcaagaaaatacaacattctctaaatgttttctaacggacaaaaagaatcgtgttgtagaacccaggctgtccaataacgagtgttcctgtacctttcgggagatttgtctgcacgaaggcgttactttcgaagtgcatgtgaatacgtcgcagcgtggatttcagcagaaactcctctatcctaacagcggtagggagggaacagcagctcagaatttttcctgtttcatctacaatgccgacctaatgaactgtacgtgggctagaggcccaacagccccacgagacgtccagtacttcctctacatccgtaactcaaagaggcgccgagagattcgctgtccttactatattcaggactcggggacccacgttggatgtcatctggacaatctaagtggtcttaccagccggaactatttcttggtaaatgggacgtcaagagagatcgggatccaattctttgattcccttttggacactaagaaaatcgaaagatttaaccctccttccaacgtgacggtgagatgtaataccacacactgccttgttaggtggaaacaacctcggacataccagaaactttcttacctggacttccaatatcagctcgacgtgcatcgaaagaatacacagcccggaacggagaacctgcttatcaatgtgtcgggcgatcttgagaatcggtacaactttcccagctccgaacctcgagccaagcactccgtcaaaattagggcagcggacgttagaattctgaactggtcaagttggagcgaggccattgaattcggttccgacgacgggaatctgggctctgtgtatatctacgtgctgcttattgttggcactcttgtctgcgggattgtcttaggctttttatttaagcggttccttaggatacagagactgttcccaccagtaccacagatcaaggataagttgaatgataaccatgaggtggaagatgaaatcatttgggaggaattcactccggaggaagggaagggttacagggaagaagtgttgaccgttaaggaaataacctag

SEQ ID NO: 218913 - DNA, 717 bp, Artificial Sequence
  Description of Artificial Sequence: Synthetic coding sequence
atgctactattggtcacatccctccttctctgcgaactgcctcacccggctttcctattaatccccgaaaaaagcgacttgagaaccgtcgccccagccagcagcttaaatgtaaggtttgatagcaggaccatgaacttgtcgtgggactgccaggagaacacaaccttttctaaatgtttcttaactgacaaaaaaaatcgggtggttgagcctcgcctcagcaacaacgagtgtagctgcacttttcgggaaatttgtcttcacgagggtgtaactttcgaggttcacgtgaatacatcccagcgaggctttcagcagaaactcctctaccccaattccggtagagagggaaccgctgcccagaacttctcatgcttcatctacaatgcagatctgatgaactgcacctgggcccgtgggcctacggcaccccgtgatgtgcagtacttcctgtatatcaggaatagcaagcggagacgggagattagatgcccctactacatacaggattctgggacacacgtcggatgccacctcgataatctatccggcttaacctcgaggaattattttctcgtgaatggcaccagcagagagattggaatacagtttttcgattccctgttggacaccaaaaagatcgagcgcttcaatccaccatctaatgtgaccgtcaggtgcaacactacccactgtctcgtccgctggaaatag

SEQ ID NO: 218914 - DNA, 1305 bp, Artificial Sequence
  Description of Artificial Sequence: Synthetic coding sequence
atgctgctgttggtcacctccctgttgctatgtgaattacctcacccagctttcctcttgatcccagaaaagagcgacctgcgtactgtcgcacccgcaagctctctgaatgtccgattcgattccagaactatgaacctatcctgggattgtcaagagaatacaacttttagtaagtgcttcctcacagacaagaaaaacagagtcgttgaacccagattgtctaataatgagtgcagttgcactttccgagaaatctgcttacatgagggcgttacctttgaagtgcacgttaatacgtcacagcgcggatttcaacagaaactgctgtaccctaacagtggcagggaaggcactgccgctcaaaacttttcatgtttcatctacaatgccgatctcatgaactgtacctgggccagaggtcccacagctccgagagacgttcaatactttctgtacattaggaatagtaaacgtaggcgtgaaatccgctgcccctactacatccaggacagtgggacacacgttggatgccacctcgacaacctgagcgggttgacctctcgcaactactttttggttaacggaacgtcgagagaaattggcatccagttttttgattcactgttagacactaaaaaaatcgaacgatttaatccgccttctaacgtcaccgtgaggtgcaacaccacccactgtctagtgcgatggaaacaacccagaacatatcagaaactctcttatctggacttccaataccagctcgatgtgcatcggaagaacacacaacctggtaccgaaaatcttctgattaacgtaagtggcgacctggagaatcgatataactttcctagctccgagccccgagcgaaacattcagtgaaaattagagccgcagacgtcagaatcctgaactggagctcgtggagcgaagccatcgagtttggcagtcactctgtgacccaggccggtgtccagtggcacaacctcggttctctgcagcctccatctccgaggttgaaacgcttttcttgtttgagactgcccggaagcgacgatgggaatctcggctcagtctacatctatgtgttgctcatcgtggggactctcgtttgcggtattgtgctcggctttcttttcaagcggtttctgcgtatacaacggctgtttcctcccgtgccgcagatcaaggacaaattaaatgacaaccacgaggtggaggatgaaattatttgggaagagtttacaccagaagaaggaaagggatatagggaggaagtcctgactgtgaaagagattacatag

SEQ ID NO: 218915 - DNA, 567 bp, Artificial Sequence
  Description of Artificial Sequence: Synthetic coding sequence
atgctacttctggtcactagcctgttgttgtgtgagcttccacaccccgcttttctgctgatccctgagaaaagcgatctgcgtacagtggcacctgcaagctccctgaatgtgcgcttcgactctcgcaccatgaacctctcctgggattgtcaggagaatacgacatttagcaagtgctttctgactgataagaagaatcgggtcgtggagccgagactctcgaataacgagtgcagttgcacctttagagaaatttgtcttcacgaaggggtgacattcgaggtccacgttaacacctcccagcggggattccagcaaaagcttctgtaccccaattccggtagagaaggcactgccgctcaaaacttcagctgctttatttacaacgcggacctgatgaattgtacttgggccaggggacccactgctccgcgagacgttcagtacttcctctatattagaaatagtaagagacgtcgagagatccgatgcccctactatatccaagacagcggaacgcacgtggggtgccatttggataatttgagcggcctgacctcctag

SEQ ID NO: 218916 - DNA, 1203 bp, Artificial Sequence
  Description of Artificial Sequence: Synthetic coding sequence
atgcttttgctggttacgagtctgctgctatgcgaactgcctcatcccgctttccttctgatccccgagaagagcgaccttagaaccgtcgccccagcctccagtctgaacgtgcggtttgatagtcgcactatgaacctgagctgggattgccaggaaaatacaacgttttccaaatgttttctcacagataagaagaaccgggtggtggagcctcggttgagtaacaatgaatgttcttgcacattccgagaaatctgtctccacgagggtgtaactttcgaagtgcacgttaacacctcccagagaggatttcagcagaagctactgtatcctaactctggtagagaaggtacagcagcccagaactttagctgtttcatttataacgccgaccttatgaactgtacttgggcgagggggccaactgcacccagggatgtccaatacttcttgtacatcaggaactctaagcgacggagagaaattcgttgcccctattatatccaggactcaggtactcacgttgggtgtcacctcgacaatctatccggcctcaccagcagaaattatttcttggtgaatggaacctccagagaaatcggtatacagttttttgattctctgctggacaccaagaaaatcgaacggtttaatcctccatccaacgtcactgtcaggtgtaacacgacacactgcttagtgcgatggaagcaaccgaggacctaccagaaattgtcctacctcgatttccagtatcaattagacgttcacaggaaaaatacacagccaggcactgagaacttgttgatcaacgtgagcggtgacctggaaaaccggtacaattttccatcatccgagcccagggctaaacactccgtcaagattagagcagccgacgtgagaatattgaactggtcttcatggtcagaggctatcgaatttggatctgatgatggcaatctgggcagcgtgtatatatacgtgttgctgatcgttgggacgttagtttgtgggatcgtattgggcttcctcttcaagcgttttctgcggattcagagattgtttccgcctgtgcctcagatcaaagataagctgaatgataaccatgaggtggaggatgaaattatctgggaagagtttacccccgaagaagggaaagggtaccgcgaggaggtcttgactgtgaaagaaattacatag

SEQ ID NO: 218917 - DNA, 804 bp, Artificial Sequence
  Description of Artificial Sequence: Synthetic coding sequence
atgaattgtacctgggcacggggtccgacagccccacgggatgtgcagtattttctttacatcagaaacagcaaacgacgaagggagattaggtgtccctactacatccaggactcaggcacacatgtcggttgtcatttggacaatctgagtgggctcacatccagaaactactttctggttaatggcacctcacgtgagatcggaatccagtttttcgatagtctgctagatacaaagaagatcgaaaggttcaaccccccttcaaatgtgaccgtccggtgtaataccacgcactgtctcgtgaggtggaagcagccccgtacttaccaaaaactgtcatatctggactttcagtaccagctggatgtgcatcggaaaaatactcagccaggtaccgagaatctcctgatcaacgtctcaggtgacctcgagaatcgatacaatttcccgagctccgagccaagggcaaaacactccgtaaagatacgggcagccgatgtacgtatactgaattggtccagctggtcagaagcgatcgaattcggatctgatgacggcaatcttggctccgtgtatatctatgtacttctgattgtaggcactctggtctgcggcattgtgctcggcttcttattcaaaagatttctgagaatccagcggctgttcccacctgttcctcagattaaagataaactgaatgataaccacgaggtggaggacgaaatcatctgggaggagttcacccccgaagagggcaagggatatcgcgaagaggtgttgactgtgaaggaaataacttag

SEQ ID NO: 218918 - DNA, 2712 bp, Artificial Sequence
  Description of Artificial Sequence: Synthetic coding sequence
atggtgctggcacaggggctgctaagtatggccttgctggccctttgttgggaacgtagcttagcaggtgccgaggagactatccctcttcaaacactgcgctgctacaatgattatacctcccacataacctgcagatgggctgatacacaggatgcgcaaaggctggtgaatgttacgttaatccggcgagtgaatgaggacctgcttgagcctgtgtcatgcgacctgtcggacgacatgccctggtcggcgtgtccccaccccaggtgcgttccacggcgatgtgttatcccctgccagagctttgtcgtcactgatgtggactattttagcttccagcctgatcggccactcggcacgcgcctgactgtgacgctgacgcagcatgtccaaccacccgaacctcgcgatcttcagattagcaccgatcaggaccattttcttttgacttggagcgtcgcacttggaagtcctcagtcgcattggttaagccccggagatctagaattcgaagtggtatacaagcgcctccaggattcgtgggaggatgctgccatcttgttatcgaacactagtcaggccactctcggcccagagcatctgatgccaagctcgacatacgtggcaagagtgcgtactaggctggcccctggttcgaggctttctggacgtccctccaagtggtcgcccgaggtttgctgggattcacagcccggtgatgaggcccagcctcaaaatctggaatgtttctttgacggcgctgccgtcctgagctgctcttgggaggtacgaaaggaggtggcatccagcgtgtctttcggtcttttttacaagccttcaccggatgcagggtccgctgtgctccttcgggaggaggagtgtagccctgttcttagggagggacttggatccctgcatacacggcaccattgccaaatccctgtgcccgacccggctacgcatgggcagtacattgtgtccgtgcaaccacgtcgggctgagaagcatattaagagcagcgtcaacattcagatggcaccacccagtctcaacgtcactaaggatggggattcctattccctcagatgggagaccatgaagatgagatacgagcacattgaccatacattcgaaattcagtataggaaggatacagctacttggaaggactccaaaacagagaccctgcaaaatgcccacagtatggctctgccagccctagagccatccacgcggtactgggccagagtgagagtccggacctcaaggacgggatataacggcatctggtcagaatggagcgaggctcgctcgtgggacaccgagtccgttctgccaatgtgggtgctcgccctgatcgtgatctttttgacaatcgctgtgctgctcgctctaagattctgtggaatctatggctatcgtctgcgcaggaagtgggaggagaaaatacccaacccatcaaaatcccaccttttccagaacggtagcgcagagctctggcctcctgggtcaatgtcggcgttcaccagtggctcaccaccacatcagggcccatgggggtcacgttttccagagctggaaggagtgtttccagtcggtttcggggatagtgaagttagccctctaacaatagaggatccaaagcatgtgtgtgacccaccgtctgggcctgatacaacaccagctgcaagtgacctccctaccgaacaacccccaagtcctcaaccaggcccacccgctgcttcccatacccctgaaaaacaggcctctagttttgacttcaacggaccttacttagggcctccccattcaagatccctgcccgacattttgggtcagccagaaccacctcaggaggggggaagtcagaagtcacctccacctggtagcctggagtatttgtgcttacccgctggaggacaggtacagctggttccactcgcccaggctatgggtccgggacaggctgtggaggtagagaggcggccttcacagggagccgctggatctccaagtctcgaaagtgggggagggccagcccctcccgctctgggacccagagttggaggccaggatcagaaggattcacccgtcgccatacctatgtccagcggggatacggaagacccaggtgtggccagtggttatgtgtcaagcgctgatttggtatttactcccaattctggcgcatcctccgtgtccctggttcctagtttgggccttcctagcgaccaaacacctagcctgtgccccggattggcgtccggccctcccggagccccagggcctgtgaagtctggctttgaaggctacgtggagctccctccaattgaggggaggagcccaaggagtccaagaaataaccccgtgccgccagaagccaagtcgccggtcttgaatcctggcgagcgacccgctgacgtgtcccctaccagccctcagcctgaaggcctcctcgtacttcagcaggtgggcgattactgttttctccccggacttggaccaggacccctgtcactgagatctaaaccatcctcccctgggcctggtcctgagattaaaaacttggaccaggcattccaggttaaaaaacccccaggccaagccgtgccacaggtgcctgtcattcagttattcaaggccctcaagcagcaagactacctatcactgcctccctgggaagtcaataagcctggcgaggtctgctag

SEQ ID NO: 218919 - DNA, 2694 bp, Artificial Sequence
  Description of Artificial Sequence: Synthetic coding sequence
atggtgctggcccaggggctgttaagcatggctttgctcgcactctgttgggagagatcattggcgggagcagaagagaccatccctctgcagacgctgcgttgctataatgattacaccagccatatcacatgtagatgggccgacacccaggacgctcagagactggtgaatgtgacattgatacggagggtaaatgaggatcttctcgaaccggtgtcatgtgacctgtccgatgacatgccctggtctgcgtgccctcatcctcggtgtgttccacgcagatgtgttatcccttgccagtcctttgttgtaacagacgtggattacttttctttccagcccgatcgtcctcttggcactaggctgactgtcaccctgactcagcatgtgcagcctcctgaacctagagatctccaaataagtaccgatcaggaccattttcttttgacttggtccgtcgctctgggatccccacaatcacactggctctctcctggtgatcttgagttcgaggtggtgtataagaggctgcaggatagctgggaagatgcagccatccttttgagcaacacatcccaggcgacactggggcctgaacaccttatgcctagctctacttacgttgcccgagtgcgtacccgccttgcacccggttccagattatcgggcagacccagtaaatggtcgccagaggtatgttgggacagccaaccaggtgatgaagctcagccgcaaaatctggagtgtttttttgatggagcagccgtattgtcatgctcttgggaggtccgtaaggaggtcgcatccagcgtgtcttttggcctgttctacaagccatctcctgatgccggtgaggaagaatgctcgccggtgctacgcgagggattagggtcactccacaccagacaccactgccagatccctgtgccagatcctgctacccacgggcaatacattgtgagcgttcagccacgacgagccgagaagcacatcaagtcttccgtcaacatccaaatggcgccaccttcattgaacgttacgaaggatggggacagctatagcctgaggtgggaaactatgaagatgcggtacgaacatattgaccatacattcgaaatccaatatcgaaaggacaccgctacttggaaagattctaagactgaaaccctgcagaatgcacactcaatggccctacccgcactcgagccttccacccgctattgggctagggtacgagtgcgcaccagtaggaccggttataatggaatctggagcgaatggagcgaggccaggtcctgggacaccgagtctgttttgcctatgtgggtcttagcactcatagtgattttcctcaccatagcagtcctgctcgcgttgaggttttgtggaatttatggatatcgcctgaggcgcaaatgggaggagaaaatccctaacccttctaagtctcacctgttccagaatggcagcgccgagctctggcctccaggctccatgtcggcatttacatcaggttctcctcctcatcaaggcccttggggcagcagattccctgaactggagggtgtgttcccagtaggattcggagactccgaggtgtctcccctgactatcgaagacccaaaacatgtgtgtgatcctccttctggcccagatactacacccgcagcgtctgatctacctaccgaacaacctcccagcccacaacccggacctcccgctgccagccatacacctgagaaacaggcatcctctttcgacttcaatgggccttacctgggaccccctcactctcgatcgttgcccgacattctggggcagcccgagcctcctcaggaaggcggatcccagaagtctccgcctcccggatccttagagtacctctgcttgcctgctgggggtcaagtgcagctggtgccactggcgcaggccatgggaccaggtcaggcggtcgaggtggagaggcgtccttcccagggcgctgcaggctcaccctctctggaaagtggcggtggccctgcaccacccgctctgggaccacgagttggcggacaggaccagaaggactccccagttgcaattccaatgtctagtggtgataccgaagacccaggagtcgcgagcggttatgtctcatccgcagacttggtatttaccccgaactccggggcttcttcggtgagtcttgtgccctccctggggctaccctctgatcagacccctagcctttgcccagggctggcaagcgggcctccaggtgctcctggacccgttaaaagcggcttcgagggatacgtagaactccctccaatcgagggacggtctccgcgttctccacgcaataacccagtccccccagaggcaaaatctcccgtattgaacccgggtgaaaggccagcggacgtgtccccgacctcccctcagcctgaggggctgcttgtgcttcagcaggtgggggactactgcttcctgcccggacttggacctgggccattgtctttaaggtcaaaaccatccagtcccggtccagggccagagatcaaaaatctagaccaggccttccaggtgaaaaagcctccagggcaggcagtcccccaggtcccggtgattcagctcttcaaagctctcaagcaacaggactacttaagtctgcctccctgggaagtcaacaaaccaggcgaggtctgctag

SEQ ID NO: 218920 - DNA, 690 bp, Artificial Sequence
  Description of Artificial Sequence: Synthetic coding sequence
atgccttggtctgcctgtccacaccccaggtgtgttccacgcagatgcgtcattccttgccagagttttgtcgttaccgacgtcgattactttagcttccagcctgaccgccctttagggactaggttgacagtgactctgacccagcacgtccaacctcctgagccccgagacttgcagatcagtaccgaccaggatcactttctgctgacttggagtgtcgcactgggctctcctcaaagccactggctcagccccggagatctggagttcgaagtggtatacaaacgcctccaggactcatgggaggacgcagccattctgctcagcaatacttctcaggctaccctggggcctgagcacctgatgccatcgagcacttatgtcgctcgagtgcgcacccgccttgcaccgggttcacgtctctccggcaggccgagcaagtggagtcctgaggtctgctgggattctcagccgggtgatgaggctcaaccccagaacctcgagtgcttttttgacggtgctgccgtgctcagttgtagttgggaggtgcggaaggaggtggccagttccgtgtcatttgggttattttataaaccatccccggacgccggagaagaggaatgctcacctgtgctacgtgagggacttggctctctgcataccagacatcattgccagattccatag

SEQ ID NO: 218921 - DNA, 2535 bp, Artificial Sequence
  Description of Artificial Sequence: Synthetic coding sequence
atgggaaaacttagaccatggcgggatctcttggagccagtcagctgtgacctgagcgatgacatgccttggagcgcctgtcctcacccacggtgtgtgccaaggaggtgcgtcatcccttgtcagtccttcgtggtgactgacgttgattattttagcttccagccagaccgaccactgggaacccggttaactgtgaccctgactcaacatgttcagccacccgaacctagagacctacagatttcgactgaccaggatcacttcctgctgacatggtccgtcgccctgggaagcccacagagccattggttgagccccggtgacctggaattcgaagtagtttataaacgcttgcaggactcctgggaggacgctgccatcctgctgtcaaacacgtcacaagctacattgggcccagagcatctaatgccttcttccacgtatgttgccagggttagaacacgcctggccccagggagcagactgtctggcaggccgagtaaatggtcccccgaggtgtgctgggactcccagcctggcgatgaggcccaacctcaaaacctggaatgttttttcgacggcgctgcggtcttgtcatgcagttgggaagtgagaaaggaggttgcctctagcgtgagcttcggacttttttataagccgtcacccgatgcaggatctgctgtgcttctgagagaagaggaatgtagcccagtgctgcgcgaaggtctaggtagccttcataccagacatcactgtcagatccctgtcccagaccctgccacacacggtcagtatatcgtgtcagtccagccgagacgcgcagaaaagcacattaaatccagcgtgaacatccagatggcccctccatccctgaacgtgaccaaagatggggattcctacagcctacggtgggagaccatgaaaatgaggtacgaacacatcgatcacaccttcgaaatacaatatcggaaggacaccgcgacctggaaggacagcaagacggagaccctccagaacgctcactccatggcactgccggcattggagcccagtaccaggtactgggctcgggtacgtgtgcgcacgtcccgcactggatacaacgggatatggagtgaatggtctgaggcacgcagctgggataccgagtctgtgctcccaatgtgggtgttggcgctgattgtgatctttttgactatcgctgtccttctcgcattgagattctgcggaatctacggatacaggctgcggcgaaaatgggaagaaaaaattccaaatccgtctaaatcccacctttttcagaacggctccgcggagctgtggccaccgggatccatgagtgcttttaccagtggcagcccgcctcatcagggcccttggggatccagattcccagagctcgagggcgtgtttcccgtgggattcggcgatagtgaagtttccccccttacaatcgaggatccaaagcacgtgtgcgaccctcccagcgggcctgacacaactcccgctgctagcgacctgccgaccgaacaaccaccttccccacaacctggccctccagcagcctctcatacacctgagaagcaggcctcatcattcgatttcaacggaccgtacctgggtccaccgcattccagatcattacccgatatactggggcagccagagcctccccaggagggtggaagccaaaagagtcctcctcctggctcactcgaatacttgtgcctgcctgctggcggtcaggtgcagctagtaccgttagctcaggctatggggccagggcaagctgtagaggttgaaaggaggccatcacaaggcgctgctggtagcccatcactcgaatctggagggggacccgcaccccctgctctaggaccacgggtcgggggacaggatcagaaggactctccagtggccatcccaatgtcttccggcgacacagaggatccaggcgtggctagcggctacgtgtctagtgccgacctcgtcttcaccccaaattcaggcgcatcaagcgtgagtctcgtcccatcactagggctgccctccgaccagactcctagtctgtgccccggtttagcaagcggaccccctggtgcccctggtccagtgaagagtgggtttgagggctacgtggaactgccacccatcgaaggcagaagccctaggagccctagaaacaatccggtgcccccagaggccaagagcccagtgctgaacccaggggagcgcccagcggacgttagtcctacaagcccacagccagagggtcttctcgtgctgcaacaagtaggcgactactgctttctccctggactgggcccaggccctctgagcctccgctccaagccgtctagtccaggacccggtccagaaatcaagaatctagaccaggctttccaggtgaagaagcccccaggacaggcagtgcctcaggttcccgtcatccagcttttcaaagccctgaaacaacaggattacctgtccctgcccccatgggaagtgaataagccaggcgaagtctgttag

SEQ ID NO: 218922 - DNA, 2670 bp, Artificial Sequence
  Description of Artificial Sequence: Synthetic coding sequence
atggtactggctcaggggctactgtccatggccttactggccctgtgctgggagaggtcattggcaggagccgaggagacaattcctctgcagactcttcgctgctacaatgattacacctctcacatcacatgtagatgggctgacacccaggatgcacagagactggtgaatgtgaccctcatacgaagagttaatgaggacttgctggaaccagtatcttgtgatctctcagacgacatgccatggagtgcttgcccccatccccgttgtgtgccaagaaggtgtgtcattccctgccaatctttcgtagtgactgatgtcgattattttagcttccaacctgacagaccactgggtacgagactcaccgtgaccctgacccagcatgtccagccccctgagcccagagacctgcaaatttcaacagatcaagaccacttcctgttgacctggagcgtggcccttggttccccacagtcacattggctatccccaggtgatctggagttcgaggtggtgtacaagcggcttcaggattcatgggaagatgcggcaatactgctaagtaatacgagtcaggccacgctcgggcctgagcaccttatgcctagcagcacttacgtggcaagggtccgaactaggctggctcctggttctcgcctctccggcagaccctctaaatggtcgcctgaagtgtgctgggattcacagccaggagatgaagctcagccccagaatttagaatgttttttcgatggggcagcggtcctcagctgttcttgggaagttcgcaaggaggtcgcatcttctgttagttttggtctgttttataaacctagtcccgatgcgggtgaggaggagtgctcacccgtactgcgcgaaggtctgggcagccttcacacacgccaccactgtcagatccccgtccctgaccccgcaacccatggacagtatatcgtcagcgtccagcctagacgggctgaaaaacacatcaagagctctgtgaacatacagatggcacccccttcccttaacgtgacaaaggacggcgattcctatagccttcggtgggagactatgaaaatgcgatatgaacatatcgaccatacatttgaaatccaatatcgcaaggacacagcaacctggaaagactctaagaccgagacgttacagaacgcccattctatggccctgccagcattggagcccagtactcgttactgggccagagtgagagttcgcacttctcgcactggatacaatggcatttggagtgaatggtccgaagctcggtcctgggacaccgaaagcgtgcttccaatgtgggttcttgcactgatcgtgatcttcctcacgatcgccgtgctccttgccctgcgcttctgtggcatctatgggtacaggctccgtcgtaaatgggaagagaagatccccaacccgtctaagtcacacctatttcaaaatggatctgctgagttatggcccccaggatcaatgtcggcgtttacgtcgggcagcccaccgcatcagggtccctggggatctagattccccgagcttgaaggcgtattccctgttggcttcggagacagcgaggtgtctcctctcacaatagaggatcccaagcacgtctgcgatcccccaagcggcccagacactactcctgcagccagcgatctgcccaccgagcagccgccttctccgcagcccggtccacccgcagcctcgcatacacctgagaagcaagcctcctcctttgatttcaatgggccatacctgggccctccacactcccgttccctcccagatatcttaggccagccagagccacctcaggagggcggttctcagaagtcccctcccccaggaagtctggaatacttatgcttacccgctggcggacaggtgcagctggtacctcttgcacaggccatgggcccagggcaagctgttgaagtggagcgcaggccatcacagggggctgcagggtcaccttccctagagtctggagggggacccgctcccccagctctaggccctcgtgtgggcggtcaggaccagaaagatagcccggtggccatccccatgtcctccggcgatactgaggatcccggtgtcgcgagcgggtacgtgtcctcagcagacctggtctttactccaaattctggggcaagttccgtgtcacttgtcccctccctgggcctgcccagtgatcagactccctcactgtgcccaggccttgcttctggacccccaggagctcctgggcctgtcaaaagtggttttgagggctacgtcgaactgccacccatcgagggcaggagccctagatcgccccgaaataaccccgtgcccccagaagccaaaagccctgtgttgaatccaggagaacggccagccgacgttagtcccacctctccccagccagagggcctgttggtgctacagcaggtcggagattactgcttcctccccggactggggccaggtcctctttcgctccggtctaaaccatcatcccctggaccgggacccgaaattaagaacctagatcaggcctttcaggttaagaaaccaccgggacaggccgtccctcaagttcctgtgatacagctgtttaaagctttagtggttagtgtaatgtcagtcggaccacctgtgccctag

SEQ ID NO: 218923 - DNA, 2352 bp, Artificial Sequence
  Description of Artificial Sequence: Synthetic coding sequence
atggctcgactggggaactgttcccttacctgggctgcattaataatactcctcctccccggtagtcttgaggaatgcgggcacatcagcgtatccgcacctatcgtgcacctgggagatccgattacagctagctgcatcatcaagcaaaattgtagccatctggacccagagccacaaatcctttggaggctgggcgctgagctccagcctggcggaaggcagcaaagactaagtgatggaacacaggagtctatcatcacccttccccacctgaatcatactcaggcctttctgtcctgctgtctgaattgggggaacagtctacagatccttgatcaggtggagctcagagccggatatccacccgcaattccccacaatctgtcctgcctcatgaacctcacaacatcctcccttatttgccagtgggaacccggacccgaaacccatcttccaacaagcttcacattgaaatcgtttaaaagtagggggaactgccaaacccagggggactctattctggactgcgtgccaaaggatggtcagtcacactgttgcattccaagaaaacacctcctcctataccagaacatggggatctgggtccaagccgaaaacgccctcggaaccagcatgtcaccccaactctgcctggatcccatggatgttgttaaactggagccccctatgctccgcaccatggatccttctccagaagcggcacctccacaggctgggtgtcttcagctttgttgggaaccatggcagcctggcttgcatattaaccaaaaatgcgaactgagacataagccgcaaaggggagaggcgagctgggcgcttgtcgggccattgcctttggaggctctgcagtacgaattgtgcggtctcttgccagctaccgcttacactctacagataaggtgcatccgctggccactaccgggtcattggtccgattggtctccatccctggaattgcgtacaacggaacgggcaccaacagttcgtcttgatacttggtggcgccaacggcagcttgatcctcgaactgttcagcttttctggaagcctgtcccattggaagaggactcaggaagaattcagggctacgtagtatcttggaggccctctgggcaggccggagcaattttgcccctttgcaatactacagaactgtcatgcacctttcatttgccatccgaggcccaggaggtggcacttgtggcttataattcggccggaaccagtaggccaacacccgttgtgttctctgagagccgcggtcctgctttaaccagactacacgctatggcgagggatccacactcactgtgggtggggtgggaaccaccaaatccatggccacaagggtatgttatcgagtgggggctaggtccaccttccgcaagcaattcaaacaagacttggcggatggaacagaatgggagggctacaggtttcttgctgaaagagaacattagaccattccagctgtacgagatcattgttacccccctgtatcaggacacaatggggcctagtcagcacgtctacgcgtattctcaggaaatggccccttcccacgctcctgagttacatctcaagcatataggtaagacgtgggcccaactggaatgggtcccagaaccacccgaactcgggaagagccccctgacacactatacgatcttctggaccaatgcccagaatcaaagcttttcagccattctgaacgccagctcccgtgggttcgtcctacacgggctggagccagctagtctatatcacattcacctgatggccgcaagtcaggccggagccactaactctactgtgttgaccctaatgacattgacaccagagggcagcgagctgcacatcatcctcggacttttcggtctgctgttactcttaacatgcctgtgtggaactgcatggctgtgctgttccccaaatcgtaagaatccattgtggcccagcgtcccagacccggctcactcaagcctgggcagctgggtcccaacaattatggaggaggatgcctttcagctcccaggtctcggaacccctcccatcacaaagctgaccgtgctcgaggaggatgaaaaaaagcccgtcccctgggaatctcacaacagctcagaaacgtgcggtctacctactttagtgcagacatacgttctgcagggagaccctcgcgctgtgagtacccagcctcagtctcaatctggcaccagcgatcaggcaggccctccacggagatctgcctatttcaaagaccagatcatgctgcaccccgctccacccaacggcctgctatgcctttttcctatcacctctgtcctgtag

SEQ ID NO: 218924 - DNA, 2310 bp, Artificial Sequence
  Description of Artificial Sequence: Synthetic coding sequence
atggcacggttgggcaactgttccctaacttgggctgcactgatcatactcctgttgccaggcagtttggaagagtgtggtcatatctctgtgagtgcacccattgtccacttgggcgatcccataacagccagttgtattattaaacagaactgcagccacctcgatccggagcctcagattttgtggaggttgggagctgaactgcaacctggtgggagacagcagagactgtctgatggtactcaagagagcatcatcactcttccccacctgaaccatactcaggccttcttgagttgctgtctcaactggggaaatagtcttcagatcctggatcaggtcgagcttcgcgcaggatatccaccagctataccacacaacctgagctgtctaatgaatctgactaccagttctctgatatgtcagtgggaacccggaccggaaacccacctaccaacaagtttcacactgaaaagctttaaatctcggggtaattgtcagacacagggtgactcaatactagactgcgtcccaaaagatgggcagtcccactgttgcatccccagaaaacacctgctgctctatcagaacatgggtatttgggtgcaggctgagaatgcattaggaacaagcatgtctccgcagctgtgcctcgacccaatggatgtggtaaagctggagcctcccatgttgcggactatggatccttctcccgaggccgcacccccacaggctggctgtttgcagttgtgctgggaaccttggcagccaggcctgcatatcaatcagaaatgcgagttaaggcacaagcctcaacgaggggaggctagttgggctttggtcgggcctctgccgctagaagccctgcaatacgagctgtgcggcctgttgcccgcaaccgcttataccctgcagattcgatgcattaggtggccactgccgggacactggtcagattggtctccatcactggaactccgcactactgaaagagctcctaccgtcagactggacacctggtggcgacagcggcagttagatcctagaacagttcaattattttggaaacccgtcccactggaagaggactccggcaggatccagggctacgttgttagttggagaccttcaggacaggccggtgcaatcctcccgctgtgtaatacaactgagctgtcatgtaccttccacctgccctccgaggcccaggaagtcgccctagttgcctacaactccgctggtaccagcagacccactcccgtagtgttttctgaatcgaggggtcctgccttgacacggttgcacgcaatggccagggaccctcattccctgtgggtcggatgggagccacccaacccatggccccaggggtatgtgatcgagtgggggctcggacctccttctgcatccaactctaataagacctggcgtatggagcagaatgggagagctacaggcttcctgcttaaggaaaacataagaccattccagctgtatgaaataatagtgacgcccttataccaggatactatgggtccaagccagcatgtgtacgcctactcccaggaaatggcaccttcgcatgcaccggagctgcacctaaagcacatcggaaagacatgggcccagttggagtgggtcccggagcctcctgagctggggaagtccccactgacccactatacaattttttggaccaacgcccagaatcagagctttagcgccatcctgaatgcctcttcacggggattcgtactccatgggctagagcctgcctcactgtaccatatccatctgatggctgcatcacaggctggcgcaactaactcgaccgtgctgactctcatgactctgaccccagccggacgaatccccagcggccaagttagtcagacacagctgacagctgcctgggcaccaggatgcccacagtcttggaggcgcatgccatccagctgtccagcacttgcaaggcacccctccccttcttcacaatgctggcgcaggatgaaacggtccagatgtcccggaagtccaattactgcacaaaggcccgtcgcttcaccactatggagtcgaccaatgtgttccaggggcacacaggagcagtttccaccttctccaaatccgtcccttgccccagcaatcagaagcttcatgggctcatgttgggcagcgcctcaggcacagggccaagggactatttcagcagtgactccactcagcccaagctggagggctagtccacctgccccttctcctatgcgtacctcgggttctcggccagcaccgtggggaccatggtag

SEQ ID NO: 218925 - DNA, 2511 bp, Artificial Sequence
  Description of Artificial Sequence: Synthetic coding sequence
atggcccgtcttgggaactgcagcctgacttgggccgctctcataatactgttattgcccggttcactggaggagtgcgggcacatttctgtatctgccccaatcgtgcacttaggggatccaatcacagcctcatgcatcatcaagcagaactgtagtcacttagacccagagccacagattctgtggagactaggtgcggagctgcaacctggcggtcgtcagcagcgactgtctgatgggacacaggaaagcattattacacttccccacttgaatcacactcaagccttcctcagctgctgcctgaattggggcaactccctgcagatcttggatcaggtggagctgcgggcaggctatcctcccgctatcccccataatctatcttgcctcatgaacctcacgacttcttctttaatctgtcagtgggaacccggacccgagacccatctgcccacgtccttcacactgaagtcgtttaagtcccgaggcaattgtcagacgcagggcgatagcatactggattgtgttccaaaagacggacaatctcattgctgcatcccacggaaacacctgttgctctaccagaacatgggcatatgggtccaggccgaaaacgcacttggaacatctatgagtccacagctttgtcttgaccccatggatgtggtgaagttggagcctcctatgctgaggacaatggaccccagtcctgaagctgccccaccgcaggccggttgtctgcagctttgttgggaaccctggcagcccggactgcatataaaccagaaatgcgagctgaggcacaagccccaacggggagaggcctcatgggccctggtggggcctttgcctttggaggccttacagtatgaactttgcgggctccttcctgcgactgcatatacactgcagatccgctgcatacgttggccgctacccggtcattggagcgactggagcccctcactcgaactgcgcacaacagagagggccccaactgtacgactcgatacgtggtggcggcagagacaactcgaccctagaaccgtgcagctattttggaaacctgtcccactggaggaggactcaggtaggatccaaggatacgtcgtaagctggagaccttccggacaagcaggagctatactgcccctgtgtaatacaaccgagctgtcctgtactttccacctgcctagcgaggcacaggaagtggccctggtggcttacaacagcgccggaacatctcggcctacacctgtggtcttcagcgagagtaggggccctgcactcactcggctgcacgccatggccagggacccacactcactgtgggtcgggtgggagccccctaacccttggcctcaggggtatgtaattgagtggggtctgggaccgccatccgcttcaaactctaataaaacctggcgtatggagcagaatggcagggcaactggattccttcttaaagagaatattcgccctttccagttatacgagatcattgtaaccccactgtaccaggacacaatgggcccttcacagcacgtctacgcatacagccaggagatggccccttcacacgcccctgagttgcacctcaagcatattgggaaaacttgggcccagctggaatgggtgcctgagcctccagagctgggcaaatctcccttgacgcattacaccattttttggaccaatgcccagaatcaatccttcagcgctattctgaatgcatccagccgcggtttcgtcttgcatggcctggaacccgcatccttgtaccacatacatctcatggccgcaagtcaggcaggcgcaacaaactctaccgtgctcacactgatgacattgacccccgagggatcggaactccatatcattcttggcctctttggtctcctgctgttgcttacctgcctctgtgggactgcctggctgtgctgctcccctaaccggaagaacccgctgtggccgtctgtccctgaccctgcccacagctcattggggtcctgggtgcctaccataatggaagaggacgccttccaactccctgggctgggtacgccacctatcaccaagctgacagtactagaagaggatgagaaaaagcccgttccttgggagagccacaattccagtgaaacatgcggactgcctaccctggtgcaaacttacgtcttacaaggagacccgagggccgtcagtactcagccccagagccagagcggcacctcagatcaggttctttatggacagctgctgggctctccgacctctcctggcccaggccactacctaaggtgcgattctacccagccattacttgcaggcctgaccccttctccaaagagctatgagaatctgtggttccaggcctccccccttggaacactggttacccccgcacccagccaggaggacgactgcgtgttcggacctcttctgaatttcccattgctccaagggatccgggtgcacggaatggaggccttgggcagcttctag

SEQ ID NO: 218926 - DNA, 2592 bp, Artificial Sequence
  Description of Artificial Sequence: Synthetic coding sequence
atggctcgcctgggcaactgttccctgacttgggcagccctgatcatcctcctgctgccgggtagcctcgaagagtgtggtcacataagcgtaagcgccccaatcgttcacctgggcgacccgattacagccagctgtattatcaagcaaaattgtagccacctcgatccagaaccccagatcttgtggagattaggagcagagttgcagcctgggggacgacaacaaagactcagcgatgggactcaggaatcaattattactcttccgcaccttaaccacacacaggccttcctgtcctgttgtctcaactggggtaactcactacaaatcctggaccaagtcgagcttagggctggatatcctcccgcaattcctcacaatctgtcctgtcttatgaacctcactacaagttcgctgatctgtcagtgggaacctggaccagaaacacatctgccaacatctttcacactgaaatcctttaagagcaggggcaactgccagacacagggcgactcaattctggattgcgtgcctaaagacggccagtcgcactgttgcatccccagaaagcatttattgttgtaccagaacatgggaatttgggttcaggctgagaacgcattaggaacatcaatgtcacctcagctgtgcctcgatccaatggatgttgtcaagcttgaaccaccaatgcttcgtaccatggatccatctcccgaggctgcccctccccaagccggatgtctccagctgtgctgggagccttggcaacctggacttcatattaaccagaaatgcgagctccgccataaaccccagcgcggtgaggcctcctgggcactggtggggcctctgcctctagaagccctgcagtacgagctgtgcggcctattgcccgctacagcatacacactgcagatccgatgcattaggtggccacttcccggacactggtcggactggtccccaagtcttgagctgaggaccacggagagggcacctaccgtaaggctggatacgtggtggcgtcagcggcaattggaccctcgcaccgtgcagcttttctggaaacctgtgcctctggaggaggacagtgggaggatccaggggtacgtagtatcatggcgtccatctggacaggcaggtgcaatcctgcccctgtgtaacaccaccgagttgtcatgcacttttcatctgccttcagaggcccaggaggtcgccctcgttgcatataacagtgcaggaaccagcagacctacacctgtggtattctcagaatctcgtggcccagcccttacccggctgcatgccatggcacgagacccccatagcctctgggtaggctgggagccacctaatccttggcctcagggctacgtaattgaatggggcctgggccctccctccgcgtctaactcaaataagacctggagaatggagcagaatggcagagccacaggatttctgctcaaggagaatatcagaccatttcagttgtacgaaatcatagtgaccccactgtaccaggacacaatgggcccatcccagcacgtgtacgcctactctcaggagatggccccatcacatgccccagagctacatctaaaacacatcgggaaaacgtgggcccagcttgaatgggtgccggagccaccagagctcggaaagtctcctttaacacattacacaatcttctggacaaatgcccagaatcagtcatttagcgccatcctgaacgcaagcagtcgcggattcgtgttgcatggtctggagccggctagcttgtatcatatccacctgatggcggcttctcaggcgggagcaaccaactcaaccgtcctcacattaatgacactgacccctgagggctccgaactgcacataatccttggactgtttggccttctgctgctgctgacgtgcctgtgtggtacagcatggctgtgctgtagcccaaaccgcaaaaacccactctggccatccgtgcctgacccagcgcatagctctcttggatcttgggtgcccacgattatggaggagctaccgggtccacggcagggccagtggctcggccagacctccgaaatgagtcgagccctaacaccccatccctgtgttcaggatgccttccaattaccaggcctcggtacccccccaattaccaaactaaccgtgttggaggaagatgaaaaaaaacctgtcccctgggagtcccacaacagctctgagacctgtggcctgcccacactggttcagacctacgtactccagggggatccacgcgcagtctccactcagcctcagtctcagtctgggacttccgaccaggtattgtatgggcagctgttaggcagtccaacctcaccagggccaggccactacctgcggtgcgattccacgcagcccctcctagctggacttacacctagcccaaagagctacgagaatttgtggtttcaggcctccccactaggcactcttgtgacacctgctcccagccaggaggacgactgtgtatttggacccctgctgaacttccccctcttgcaggggatcagagtgcacgggatggaagctctgggcagcttttag

SEQ ID NO: 218927 - DNA, 2352 bp, Artificial Sequence
  Description of Artificial Sequence: Synthetic coding sequence
atggccaggcttggcaactgtagtcttacctgggctgctctgatcatcctgctcctgccagggtcacttgaggagtgtggacatatttccgtgtcagcgcctatcgtccacctgggagatcctatcactgcatcgtgtattatcaaacagaactgctcccacctcgaccccgagccacagatcttgtggcggttaggagctgagcttcagcctgggggtagacaacagcggcttagcgatggaacccaggaatctatcatcactttgcctcatctaaaccacacgcaggctttcctatcctgctgcttgaactgggggaatagtctgcaaatccttgaccaagtcgagctgcgtgcaggatatcccccagcgatcccccacaatttaagctgtctaatgaatttgaccacctccagcctcatctgccagtgggagcccggacccgaaacccatctgccaacatccttcacgcttaagtctttcaagtctcggggtaactgccagacgcagggcgattcaattctcgactgcgtgcctaaggacggtcagtcccattgttgtatccctcggaaacacctcctgctctaccaaaatatgggtatttgggtgcaggctgagaacgctctcggaacctcaatgtcgccacaactgtgtctggatcctatggatgtggtgaagctcgaaccacccatgctccggactatggacccttcacccgaggccgcacccccacaggccggttgtttgcaactgtgctgggagccatggcaaccgggtctccacatcaaccagaaatgtgagctgaggcataagcctcaaagaggcgaggctagttgggcactggtagggccactgcccctggaagccctgcagtatgagctgtgtgggctcctgccagccacagcctacacacttcagattagatgcatccgctggcccctgcccggacattggagcgattggagcccatccttagagcttaggactactgaaagggctcccaccgtgcggctggacacttggtggaggcagagacagctagaccccagaacagtccagctgttttggaaaccggtgccactagaagaagattcaggaaggatacaagggtatgtcgtgagttggagaccttcgggtcaagcaggggctattctaccactttgcaatacaacagaactgtcttgtacctttcacctgcccagtgaggcccaagaggtggcccttgttgcctataacagcgcaggtacatcaagacctaccccagttgtcttttccgaatctcggggacccgctctgacacggctgcatgctatggctcgggacccccatagcttgtgggtcggctgggaacccccaaacccatggccccagggctatgtaattgagtggggacttggaccgccttctgcctccaattcaaataagacttggaggatggagcaaaacggccgtgccaccggctttctcctgaaagagaacatccggcctttccaactctacgagataattgtgaccccactctatcaagacacgatggggccatcccagcatgtgtatgcctactcccaggaaatggccccaagtcacgcacctgagctgcacttaaagcacattgggaaaacctgggcacagctcgaatgggtgcctgaacccccagagttaggcaaatcgcctctcactcattacactatcttctggactaatgcccagaaccagtccttctcagcaatcctgaatgcatcatcccgaggtttcgttctgcacggcctcgaacccgcttctctgtatcacatccatctgatggcagcctcacaggccggtgcaacaaattctacggtactgacgttaatgacacttaccccagagggctccgagttacacattatcctgggcctgtttgggttgctgcttctcctgacttgcctgtgtggaacggcctggctgtgttgttctcctaatcgtaagaatcctctatggccttccgtgccagacccagcccactcatctttggggtcatgggttccgacgatcatggaggaggatgcgttccaactgcccggactaggtacaccaccgatcacgaaactgactgtcctcgaggaagacgagaagaagcctgtgccctgggaatcacataactctagcgagacatgtggactcccaactctggttcaaacttatgttctgcagggggatccgagagctgtgtccacccaaccacagagccagagcggaacctctgatcaagccggtccacctcggaggtcagcctattttaaagaccagatcatgcttcatcccgctccacctaacggactgctttgtttgttccccataacatctgtcctctag

SEQ ID NO: 218928 - DNA, 2511 bp, Artificial Sequence
  Description of Artificial Sequence: Synthetic coding sequence
atggccaggttaggtaattgtagcctaacatgggccgcactcatcatactgcttctgcctggttctctggaggagtgcgggcacatctcagtgagtgccccaatcgtccatctcggggatcccatcaccgcttcttgcatcatcaagcaaaactgcagccatctcgacccagaaccccagattctgtggagactgggtgctgagttacaaccgggtggcaggcaacaaaggctaagcgacggtacacaggagtccattatcacccttcctcatctgaatcacacccaggcttttctgagctgttgtctgaactgggggaattcattgcaaattttggaccaggtggaactgcgggcaggttacccacccgcaattccccataacctttcctgcctgatgaacttgaccacctccagtctgatttgtcagtgggaacccggtcctgagactcatcttcccacaagttttaccctcaaatcatttaagtccaggggcaattgtcagacacagggggattctatcctggactgcgtgcccaaggatggacagagccattgctgtatccctaggaagcaccttctgctctaccagaacatgggcatatgggttcaggccgaaaatgccctaggaactagtatgagtccccagttgtgtctcgacccaatggacgttgtgaaactcgagccgcctatgctgaggaccatggatccttcaccagaggccgctccccctcaggcaggatgcctgcagctttgttgggaaccgtggcaacctggcctgcatataaaccagaaatgcgagctgagacataaacctcagagaggcgaggcctcatgggctctcgtcgggccactacccttagaagcccttcagtatgaattatgtgggttacttcccgcaactgcttatactctccagattagatgcatcagatggccactgccaggccactggtcagactggtcaccttccctcgagttgcgcactaccgaaagagctcccactgtgcgtttggacacttggtggcgacagaggcagctggaccctcgcactgttcagttattctggaagcctgtacccctcgaggaagattccggtaggatacagggctatgtggtttcatggcgcccaagtgggcaggctggtgctatattgcccctctgcaacactaccgaactgtcatgcacctttcacttacctagcgaagctcaggaagtggctctcgtcgcctacaattctgcaggcacctcccgtcccacaccggtcgtcttttcggagagccggggtccagcactcactaggctgcatgccatggccagagatcctcacagtctgtgggtaggttgggagccgcctaacccttggcctcaagggtatgtcattgagtggggactcggtccaccaagcgcctccaattctaataagacgtggcgcatggagcagaatgggagggccacaggatttctcttaaaggagaatatccgccctttccaactgtacgaaatcatcgtgacacccctctaccaggacacaatgggcccttcacaacatgtgtacgcgtattcacaggaaatggcaccatcccacgcaccagagttgcacttgaagcacattggcaaaacgtgggcccagctagaatgggttccagaacccccagagcttggaaaatcccccttgacccactacactattttctggacaaatgctcagaaccagtcctttagcgccattttaaacgcatcttcacgaggctttgtactccacggactggagccagcatctttataccatattcacctgatggctgcctctcaggccggagcaacaaactctacagtgctgacattaatgacactgactcccgaagggagtgagcttcacataattctcggcctgttcggactgctgctgctgctaacttgtctatgcggcacagcctggttgtgctgcagtccaaacaggaaaaaccccctgtggccctcagttcccgaccccgcacacagcagtctgggcagctgggtccccacaatcatggaagaagacgcctttcagctccccggactcggaacccccccaatcactaagctgaccgtgctggaggaagacgagaagaagccagtgccatgggaaagtcataattctagcgaaacttgcggattacctaccttggtgcagacatatgtgctgcaaggagacccaagggccgtctctacacaaccgcagtcacagtcgggtacgtcagatcaggtgctgtacggtcagctgcttggcagcccaacatccccaggccctgggcattacctgagatgcgactcgactcagcccctcctggctgggctgacaccaagtcccaaatcctacgagaatctgtggttccaggcaagtcccctgggtacactcgtgaccccagccccatcacaggaggatgattgtgtatttggacctctgcttaacttccccctcttacaggggatccgcgtacacggcatggaggctctgggttcattttag

SEQ ID NO: 218929 - DNA, 2511 bp, Artificial Sequence
  Description of Artificial Sequence: Synthetic coding sequence
atggcacgacttgggaattgctcccttacatgggcagcactcatcatactgctcctgcccggttctcttgaggaatgcggacatatcagtgtgagcgctccaattgttcacctgggcgatcccattaccgcatcatgcatcataaagcagaattgctcgcatctggaccccgagccccagatcctgtggcgcctaggcgcagagttgcagccgggtgggaggcagcagcggctgtctgacgggacacaggagtcgatcatcacactgccccatctgaaccatacacaagcctttctgagctgttgtctcaattggggcaattcactccagatcctagaccaggttgaactaagagccggatatcctcccgctattccccacaatctgagttgcttgatgaatctaacaacaagttcactcatatgccaatgggaaccagggccagagacccatttacctaccagctttactctcaagagtttcaaatcaagggggaactgccagacgcagggcgattcaatcctcgactgcgtcccgaaggacggtcagtcccattgttgtattcctcgcaagcacctcctgctctaccaaaacatgggcatatgggtgcaggcagaaaacgcactcggtaccagcatgtccccacaactgtgcctcgaccctatggacgttgtgaagctggagccccctatgctgaggactatggacccctccccagaggccgcaccccctcaggccggatgtctacagttgtgttgggagccttggcagccaggccttcacatcaaccaaaagtgcgaattgagacacaagccgcagcggggtgaggcatcatgggccctggttgggccattgcctctggaggcgctccagtacgaactgtgtggcctattacctgccacagcatacactctacagatacggtgtataaggtggcctctgcccggacattggtctgactggtcaccctcgctggagcttcgcacaactgaacgggctcctaccgttcgcctcgacacatggtggcggcagagacagctggatcccaggactgttcagttgttttggaaacccgtgcccttggaagaggacagcgggaggatacaggggtacgtggtttcatggagaccaagtggtcaagctggggcaatattgccgctgtgcaatacaacagaacttagttgcacgttccatttgccctctgaggcgcaggaagtggccctagtggcttataacagtgcaggaactagcaggccgacccctgtagtttttagtgagagtcgcggtccagccctaacccgcttgcatgctatggcaagggatcctcactccttatgggtaggatgggagccaccgaatccttggccccaggggtatgtaattgagtgggggctgggccctccatccgcttctaacagcaataaaacatggcggatggaacagaacgggagagccactggatttctgctgaaagagaacattagaccttttcagctttacgagatcatcgttaccccactgtaccaagacaccatgggcccaagccagcatgtttatgcttatagccaagaaatggccccttctcatgcacctgagcttcacctgaaacacattgggaagacttgggcccaactcgaatgggtccccgagccccctgagttgggtaaatcccctctgactcactatacaattttttggacaaacgctcagaaccagagctttagtgctattcttaacgcatcctcacgcggtttcgttctgcatgggcttgaaccagcaagtctatatcacatccacctgatggcagcctctcaggctggagccaccaattcaactgttctgacacttatgacattaacccctgaaggcagcgagctgcacattatccttggtctctttggccttctcttgctgctgacatgcctgtgcggcacagcatggctgtgttgtagcccgaatcgcaagaatccgctgtggcctagcgtgcccgacccagcacactcttctctgggctcctgggtgccgaccattatggaggaggacgctttccagctgccgggtctggggacgccccctatcacgaaactgacagtgcttgaagaagatgagaagaagcccgtaccatgggagagtcataatagctccgagacctgcgggctgcccaccttggtgcagacgtacgtgctccagggcgatccgagagccgtttctacacagccacagtcccagagcggtacttcagaccaggtcctgtacgggcagttgctggggagccctacctcccccggaccaggacattatttgcggtgtgactccactcagccactcctcgcgggattgactccctcccctaagtcatatgaaaacctgtggttccaagcgagtccgcttggaaccctcgttactcctgctcccagccaggaggacgattgtgtgtttgggccactcctgaacttcccccttctgcaaggaattagagtgcacggaatggaagcccttggctcattttag

SEQ ID NO: 218930 - DNA, 2592 bp, Artificial Sequence
  Description of Artificial Sequence: Synthetic coding sequence
atggcccgtctcggtaactgctccctgacatgggccgcattaattattttattgttgcccggttctctcgaggagtgtgggcatatttcagtgtcagcaccaatagtgcaccttggcgaccccatcactgccagctgcattattaagcaaaattgcagccacctggaccccgaaccccagatactgtggcggctgggagctgaactgcagccgggtggacgccagcagagactctcggacggaactcaggaatccattattaccctcccgcacttgaatcacactcaggctttcctgagttgctgtttgaactggggaaacagtctgcagattttagaccaggtggagttgcgggctggttacccgcctgctattccacacaatctctcatgcctgatgaatcttaccactagtagcttgatctgtcaatgggaacccggacccgagacccatctgccaactagctttaccctcaagagttttaagtctcgcggaaattgccagacacagggcgatagcatactggattgcgtccccaaggacgggcaatcgcactgctgcatacctcggaaacacttactgttgtaccagaacatgggaatttgggtccaagctgaaaatgccttgggcacatctatgtccccccagttatgcctcgatcccatggacgtggtcaaacttgagcctcccatgctgagaacgatggaccctagccccgaggctgccccaccacaggccggatgtcttcagttatgttgggagccttggcagcctgggctgcatatcaatcagaaatgcgagctgaggcataaaccccagcgtggcgaagccagctgggccctggtgggtccactgccacttgaagccctccagtatgaactgtgtggcctgctgccagctacggcctatactctacagatcagatgcattaggtggcctctaccaggtcactggagtgattggtctccgtctctagaactgcggaccaccgaacgcgcacctaccgttcgactggatacttggtggcggcagcgccagctcgatccacgtacagtgcagctgttctggaaaccggtgcccctggaggaagactcaggcaggatccaaggctacgtcgtgtcttggagaccctccggacaggctggggcaattctgccattatgcaataccacggagctgtcctgtacttttcatctgccctccgaagcccaggaagttgccctggttgcctacaattccgccggaactagccgccctacccccgttgtgttctctgagtccagaggccctgccctaacacgactgcacgcgatggctcgcgacccacacagcttgtgggtggggtgggagccacctaatccgtggccccagggttacgtaatcgaatgggggctgggcccaccatctgcaagtaactctaacaagacctggcgaatggaacagaacggccgagctactggattcttgctgaaggaaaacattagaccctttcagctttacgaaattatcgtgacccctctctatcaggatactatgggacccagccagcatgtgtacgcgtatagccaggagatggctccaagccatgctcccgaactgcatttgaagcacatcggaaaaacctgggctcagcttgaatgggtccccgagccgccagaactgggcaagtctccgttaacccattatacaatcttctggacgaatgcccagaaccagtccttttccgctatcctgaatgcatcaagccggggatttgtgcttcatgggctggaaccggcttcactctaccatatccacctcatggcagcttcccaagccggtgcgactaactctaccgtgctgacactcatgactctgacacctgagggatcagagctgcacataatactgggcctgttcgggctgttgctgctgttgacctgcttgtgcggtacggcctggctgtgttgttcaccaaatcggaagaatcccctctggccaagtgttcctgaccctgcccattcatcgttagggtcatgggtgcccacaatcatggaggagctccccggaccaagacagggtcagtggcttggtcagactagtgaaatgtctcgagccttaacccctcatccctgtgttcaggacgccttccagctgcccggactaggcaccccacctattaccaagctcacagtgctcgaagaagatgagaagaaaccagtcccctgggaatcgcataatagctctgaaacctgtgggttgccgactctggtccagacttacgtgctgcagggagacccacgcgctgtgagtactcaacctcagtcacaatcagggacatcggaccaggtgctatacggccagttactggggagcccaactagccccggtccaggccactacctgcgctgtgacagcacccagccactgctcgctggtttgaccccaagcccgaagtcttacgagaacctctggttccaggcctcccccctgggcaccttagtgaccccagccccaagccaggaagatgactgcgtgttcggacccctgctgaacttccctctcttacaaggtattagagtgcacggaatggaggcactcgggtctttctag

SEQ ID NO: 218931 - DNA, 1167 bp, Artificial Sequence
  Description of Artificial Sequence: Synthetic coding sequence
taaacgtcaagaccaacccccgtggtcttcagcgagagtcgcggtccagccttaactcgcctgcacgcaatggcaagggacccccatagcctttgggtcgggtgggagccaccaaatccatggccccaaggctatgtcatcgaatggggtctcggcccaccatctgcctctaattcaaataaaacgtggaggatggagcagaacggtcgcgctactgggtttttactaaaggcaccatcgcacgccccagagctccacctgaaacacataggcaagacctgggcccaactcgagtgggtgcccgagccacctgagcttggcaaaagcccactgactcactacacaattttttggacaaacgcgcaaaatcagtctttttctgctattctgaacgccagctcgcggggttttgtgctacacggacttgagccagctagcctctaccacattcatcttatggccgcttcccaggcaggtgcgacaaactctactgtcctgaccctaatgaccctgactcccgagggtagtgagttgcacatcatcctgggactgtttggcctgcttcttcttctaacatgtctgtgtgggacagcgtggttatgctgttcccccaaccgaaagaatccactctggcccagcgtgccagaccctgctcattccagtctaggaagctgggtccccactatcatggaggaggatgctttccagctgccgggtctgggaacgcccccaattaccaaacttaccgtgcttgaggaagacgagaagaaacccgttccttgggaatcacacaattccagcgagacatgtggcctcccgactctggtccagacttatgtacttcaaggagaccctcgggctgtgtctactcagccacagtcccagtccggcacctcagatcaggtcttatacggccagttactcggcagccccacttctcccggacccggacactacttgcgctgcgattccactcagcccctattggccggacttacccccagcccaaaaagctacgaaaacctgtggtttcaggccagcccactggggacactggtgacccctgccccttctcaggaggatgactgcgtttttgggccactgttgaatttccccttgttgcaggggatcagagtgcatggaatggaagccctgggttctttttag

SEQ ID NO: 218932 - DNA, 66 bp, Artificial Sequence
  Description of Artificial Sequence: Synthetic coding sequence
atggcgagactaggtaattgtagcctcacctgggctgctcttatcattcttttgctccctggatag

SEQ ID NO: 218933 - DNA, 675 bp, Artificial Sequence
  Description of Artificial Sequence: Synthetic coding sequence
atgagcgccgtgggtgcagcaacaccttatctgcatcaccctggcgattcacattccggcagagtatcttttttaggcgcacagctgcctcccgaagttgccgctatggccaggctcttgggcgacctggacagatcaacctttcggaaacttcttaaattcgttgtctcgagcctccagggagaggattgtcgcgaggccgtgcagcgtctgggggtgtccgcaaacctcccggaagagcagttgggggcactcctggccggaatgcacacattgctgcaacaggctcttaggctgccccctacctctctgaagcctgatacattccgtgaccagttacaggaactctgcatacctcaggatcttgtcggtgacttagctagcgtggtgttcggaagccagcgccctctccttgactccgtggcgcagcagcagggcgcatggttgccacacgtagccgattttcgctggagagttgatgttgccatctccaccagcgccctggctaggagcctgcagccgtccgtgctgatgcagcttaaactgtctgacggatccgcctacagattcgaggttcctactgccaaatttcaagagctgcgctacagcgttgcgctcgtcctcaaggagatggctgatctggagaagagatgtgagaggcgcttacaggactag

SEQ ID NO: 218934 - DNA, 675 bp, Artificial Sequence
  Description of Artificial Sequence: Synthetic coding sequence
atgagcgctgtaggagccgctactccctacctccaccacccaggcgatagtcatagcgggagggtctcatttttgggggcacagttgccgcctgaagtggcggcaatggctcgcttgctcggcgatctggatcgatctacattcagaaagctcctgaaatttgtagttagcagccttcaaggggaggactgcagggaagctgtgcagcgtcttggcgtgtccgccaatcttcctgaggagcaactaggcgctctgctggcagggatgcatactcttctacagcaggccctccgattgccacccacctcccttaagcctgatacattcagagatcaattacaagagttgtgtattccacaagatttggtcggcgacctcgctagcgtcgtcttcggttcacagagaccattgttggactcagtcgcccagcagcaaggggcttggctgcctcacgtcgccgacttccgctggcgcgtggacgtggctatatccacatcggcacttgctaggagcctgcagcctagcgttctgatgcagttgaaactgtcagacggatctgcttaccgatttgaagtaccgaccgccaagttccaggaactccggtacagcgtggctctggtcctaaaggaaatggccgacttagaaaaaagatgcgagaggagactgcaggattag

SEQ ID NO: 218935 - DNA, 675 bp, Artificial Sequence
  Description of Artificial Sequence: Synthetic coding sequence
atgagcgcagtgggcgcagccaccccttacctccaccatcccggtgattctcattccggcagagtcagtttcctgggagcccagctccccccagaggtggctgcaatggccagattgctgggcgacctggacaggagcactttcagaaagttgcttaagtttgtggtgagttccctccagggtgaagattgcagggaagcagttcagcgactcggcgtctctgccaacctgcctgaagagcaacttggggcactgctggcaggcatgcacacgctcctgcagcaggccctccggttgccaccaacctcccttaaaccggatacatttagagatcagttacaggagctatgcatcccccaggatcttgttggggacctggcctctgttgtgttcggcagtcaacgccctctgctcgactccgtcgcccagcagcagggggcatggctgccccatgtggccgattttcggtggcgagtggacgtcgcaatcagcactagcgctctggcccgtagcctgcagccttctgtcctgatgcagctcaagctgagcgacgggtcagcataccggttcgaagttccaaccgccaagttccaagaacttcggtattctgtcgcgctggtcttaaaagagatggcagatctcgagaaaaggtgcgagcggagactacaggactag

SEQ ID NO: 218936 - DNA, 297 bp, Artificial Sequence
  Description of Artificial Sequence: Synthetic coding sequence
atggaagcttcgtccgaaccgccactcgacgctaaatcggacgtgactaatcagctagtggatttccagtggaaacttggcatggctgtatcatccgatacgtgccggtcgttgaaatacccctacgttgctgtgatgcttaaggtggctgaccattctgggcaggtaaagacgaagtgttttgagatgaccataccacaattccagccgcagctcctcgccacaagcagtctgctatctgcctccaatttctataggcagttcaaagagatcgccgctgtgatcgagaccgtttag

SEQ ID NO: 218937 - DNA, 258 bp, Artificial Sequence
  Description of Artificial Sequence: Synthetic coding sequence
atggaggcttcaagcgaaccacccctcgatgctaagagcgatgtcacgaaccagttggtagactttcagtggaagctaggcatggccgtgagctccgacacatgtcggtccctcaagtacccatacgttgctgtgatgttgaaggtagctgaccattccggccaggtgaaaacaaaatgttttgagatgaccatcccccagtttcagaacttttaccggcagttcaaggaaatcgcagcagtcatcgagaccgtctag

SEQ ID NO: 218938 - DNA, 258 bp, Artificial Sequence
  Description of Artificial Sequence: Synthetic coding sequence
atggaagcatctagcgaacctccgctggacgctaagagtgatgtaacgaatcagctggtcgatttccagtggaaactaggaatggctgttagtagcgacacatgcagaagcctcaaatacccctatgtggctgtgatgctgaaagtggccgaccatagcggccaggtgaagaccaagtgttttgagatgactattccacagttccagaacttctatagacagtttaaagagatcgccgcagttatcgagactgtgtag

SEQ ID NO: 218939 - DNA, 7469 bp, Artificial Sequence
  Description of Artificial Sequence: Synthetic coding sequence
atgggagcatcttctccacggtcccccgagcctgtgggacctcccgctccaggtctacctttctgctgcggaggctccctcctagcagttgtagtgttgctcgcgttgcccgtagcctggggccagtgtaacgcacctgaatggttaccattcgcaaggcccaccaaccttacggacgaattcgaatttccaatcggaacgtatctgaattacgagtgtagaccgggatatagtggacgacctttcagcatcatatgtctaaaaaattcggtttggaccggggcaaaggacagatgtagacgtaagagctgcaggaatccgccagacccagtcaacggaatggtgcacgtgattaaagggattcagttcgggagccagattaaatatagctgtacaaaagggtatcgcttgatcggctcaagtagcgccacatgcatcatttctggcgataccgttatctgggataacgagacgcccatttgcgatcgaatcccctgtggcctcccacctacgatcacgaatggggattttatctccacaaatcgggaaaatttccattacggctctgttgtcacctataggtgtaatcctgggtctgggggaaggaaggttttcgaacttgttggggaaccatcaatatattgtactagcaacgatgaccaggtggggatatggtccggacccgcaccgcagtgcattatccctaataagtgcaccccacccaatgtggaaaatgggatccttgtcagcgataacagatcccttttcagtttgaatgaggtggtggagtttcgctgtcagcccggtttcgtgatgaagggaccaaggcgcgtgaagtgtcaggctctcaacaagtgggagcccgagctgccgtcatgctctcgggtgtgccagcctccgcctgacgttttgcacgccgaacgcacccagcgggataaggataactttagcccaggccaggaagtcttttacagctgcgaacctgggtacgacctccggggtgctgccagtatgcgctgtacgccacagggcgattggagccccgctgcccctacctgtgaggtgaagtcatgcgacgacttcatgggccagctcctgaatggccgtgtcttgtttccagtcaacctgcagctcggggcaaaggttgatttcgtgtgtgatgagggctttcagctgaagggcagttccgcctcctactgtgtgctggcaggtatggaaagcctgtggaacagctcagttccggtatgtgaacaaatcttctgtccatccccccctgtgatacccaatggtaggcacaccggaaagcccctggaggtgttccccttcggcaagaccgttaactatacctgcgacccccaccccgatagggggacatcattcgacctcataggcgagtctacaatacggtgtacgtcagatccccagggaaacggcgtatggtcttcaccggcaccaaggtgcgggatcctgggtcactgtcaagcaccagatcacttcctcttcgcaaaactgaagacacagacaaatgctagtgacttccccatcggaacatccctgaagtatgagtgtaggccagaatactacggacgcccttttagcataacatgcctcgacaatcttgtgtggagttccccgaaggatgtgtgtaaaagaaaatcatgcaagacaccaccagatcccgtgaatggcatggtacatgtgattacagacatacaagtgggttcaagaattaattacagttgcacaacaggacaccggctgatcggtcattcctcagctgaatgcatcttgtctgggaacgcagctcattggagtactaagcccccaatctgtcagcgaattccctgcggtttaccccctaccatagctaatggggactttatctcgactaatcgcgagaactttcattatggctcggtggtcacttatcggtgcaaccccggaagcggcggacgcaaggtgtttgagctggtgggggagccttcaatctactgtacctcaaatgatgatcaagtcgggatatggagcgggcctgcaccacagtgtatcatcccaaacaaatgcactccaccaaatgtggagaacggaatcctcgtctctgacaacagaagcctgtttagcctcaatgaagtggtggaattccggtgccagccagggttcgtaatgaaaggaccacggagggtgaagtgccaagccctcaataagtgggaacccgaacttccttcgtgctcacgagtgtgccagcccccacctgatgttcttcacgcagagaggacacaaagggacaaggacaacttctctccaggtcaggaagtattctactcttgtgagcccggatatgacctgaggggggcagccagcatgaggtgtacccctcagggcgactggagtccggcagcaccaacatgtgaagtgaagtcctgcgacgacttcatgggccagttactcaacgggagagtgctatttcccgttaatcttcagttaggggcaaaggtcgactttgtgtgcgacgaaggttttcagctgaaaggatctagcgcttcttattgtgtgctcgctggaatggagagtctgtggaattcttctgtgcccgtatgtgagcaaatattctgcccttccccccctgtcatacccaatggcagacacacaggcaagccactggaagtattcccatttggcaaaactgtaaactatacgtgtgatcctcaccccgataggggaactagcttcgacctcattggcgaatcaaccatccgttgcacctccgatccccagggaaatggagtgtggtccagtccagcgccaagatgcggtatcctcggccactgccaggcaccagaccactttttgttcgcaaaattgaagacacagactaatgcgagtgacttcccaatcggcaccagtctcaagtacgaatgccgccctgagtactatggccgacccttcagtatcacttgcctagataaccttgtgtggtcttcaccgaaagacgtgtgcaagcggaaatcgtgcaagacccctcccgatcctgtgaacgggatggtccacgttatcactgatattcaagtgggtagtaggataaactacagctgcacaacgggacacaggttaatcggacactcaagcgccgagtgcatcctgtctggcaatgccgcacactggtccaccaaaccaccgatttgtcagcgcatcccgtgcggtctccctccaactattgccaacggggactttatctccactaaccgcgagaacttccactacggtagtgttgtgacttatcgttgcaaccctggtagtggaggcaggaaagtgttcgagctggttggcgagccaagtatttactgcaccagcaacgacgatcaggtgggtatctggagcggaccagcgcctcagtgcattattccaaacaagtgtacacctccaaatgttgagaatggaatccttgtgtccgacaatcgaagcctcttttctttaaatgaagtggtcgaattcagatgccaacccggttttgtcatgaaggggccacggagagtgaaatgtcaggccctgaacaaatgggagcctgaactcccctcatgtagcagggtgtgtcagcccccaccggatgttctccatgcagagcgcacccagcgcgataaggataattttagccccggacaagaagtgttttatagctgcgagcctggctatgatcttaggggtgcggcatctatgcggtgcactcctcaaggtgattggtcgccagctgcaccaacctgtgaggtgaagtcctgcgatgacttcatgggtcagcttctgaacggccgagtactgttccctgtcaacctacagttaggggcaaaggttgacttcgtgtgtgatgagggcttccagttgaaaggatccagtgccagctattgcgtgctggcaggtatggagagcttatggaactctagtgttcctgtgtgcgagcagatcttctgcccaagtccccctgttatccctaacgggcgtcacacaggtaagcccctggaagttttcccatttggcaaagctgttaattatacctgtgatcctcatccagaccgcggtacgagctttgaccttattggggagtccaccattcgctgcacctcagatcctcagggcaatggcgtgtggtccagcccagctcccaggtgtggcatcctcggtcactgtcaagcgccagatcattttttattcgccaagttaaaaacccagacaaacgcgagcgactttcccatcggtaccagtcttaaatatgagtgtcggccagaatattatggtcgcccattctcgataacatgtctggataatctcgtttggtcgagccccaaggacgtatgtaaacgaaaatcctgtaaaacacccccagatccggtgaacgggatggtccacgtgatcaccgatatccaggtcgggagtagaattaactactcttgcaccaccggccacaggctcatcggacactcatcagccgaatgtatcttgtctgggaacacagcccattggtccacgaagccccctatctgtcagagaattccatgcggcctacctcctactattgcaaacggcgactttatctccaccaaccgggagaatttccattatgggagcgtggttacatatcgttgtaacttggggtcacgcggacgtaaggtcttcgaactggtcggagaaccatcgatctactgcacatctaatgatgaccaagtgggcatatggagcggacctgccccacagtgtattatccctaacaagtgcaccccccctaatgtcgaaaatggcatactcgtttccgataatagatcactgttctcattaaacgaagttgtggaatttagatgtcagcccggttttgtgatgaagggtccacgccgtgtgaagtgtcaagcactcaataaatgggaacctgagctgcccagctgttcccgcgtgtgccagccccctccggaaattctgcatggcgaacatactcccagccaccaggataatttctcgcccggacaggaggtattttacagctgtgagcctggatatgacctgcgcggagctgctagcctgcattgcactcctcagggcgactggagtcccgaggcccctcggtgcgctgtcaaatcatgtgatgatttccttggccagctaccccatggaagggtattgtttccactgaacctacagttaggcgcaaaagtaagttttgtgtgtgatgaggggttccggctgaaagggtcttctgtgtcgcattgtgtgctggttggaatgcgaagtctatggaacaattcagtccctgtctgcgagcatatcttctgcccaaatcccccagctattcttaacgggcgtcacactggaactccatccggcgacatcccatacggcaaagagatctcttatacctgtgatccacatccagatcgcggtatgacattcaatttgataggcgagtcaactataaggtgcacctcggacccccacggcaacggggtgtggtcgtcgccggctcccagatgcgaactgtccgtgagggcaggccattgtaaaacaccagagcagtttccattcgcaagtcctacaatccctatcaacgacttcgagtttccggtcgggacttccctgaactatgagtgtagaccaggctactttggtaaaatgttctcaattagctgccttgaaaatctggtgtggagtagcgtggaggacaattgccgacgcaagagctgcggacctccgcctgagcctttcaatggcatggtccatattaatacggacacccagttcggatccacggttaactattcctgcaacgagggttttaggctcatcgggtccccctcgacaacctgtctggtatcgggcaacaatgttacatgggataagaaggccccaatctgtgagataatttcgtgcgagcccccacctaccattagtaacggagatttctactctaataatcgtacatccttccataacggaacggtggtaacttaccagtgccacaccggcccagacggagagcagctgttcgagctggttggtgagcgcagcatctactgtacctctaaggatgatcaggtaggcgtgtggagctcgccccctcccaggtgcatcagcacaaacaagtgcaccgcccctgaggtggagaatgccatccgcgtgcctggtaaccgatcttttttcacattgacagaaataattcgtttccgctgtcaacccggtttcgtgatggttgggagccatactgtgcagtgtcagacgaacggtcgctgggggccaaagctgccgcattgctccagggtatgccagcctcctccagagatcctgcatggcgagcacactttaagccatcaggacaacttcagcccgggacaggaagtcttctattcctgtgaacccagttacgaccttcgcggagccgcttcacttcattgcactccccagggtgactggagccctgaggcccctcgatgcaccgtgaagtcttgcgacgattttctaggacaactgccccatggcagagtgttgctccccctcaatttgcagttgggggcaaaggtttcattcgtatgtgacgaggggttccgactcaagggaagaagcgcatcacactgcgtgctggccggtatgaaggccttgtggaattcaagtgtgccagtttgcgagcagatcttctgccccaaccctcccgctatcctcaatggcaggcacaccggtactccgttcggcgatataccctacggcaaagaaataagctatgcatgcgatactcatcccgacaggggtatgaccttcaacctgattggtgagtcgtcgattcgctgtacttccgacccccagggcaatggagtatggtcctccccggctcccagatgtgagctgagcgtgcccgctgcctgccctcaccctccaaaaattcaaaacggacactacattggaggccacgtttcactgtacctcccagggatgaccatatcttacatatgcgaccccggatacctgctggtgggcaaaggattcattttttgcacagaccagggaatctggtctcagctagaccactactgtaaggaggttaattgttcttttcccctgttcatgaacggaatctcaaaggaactggagatgaaaaaggtgtaccactatggagattatgtcacattgaagtgtgaggatggctacaccctggagggctccccttggagtcagtgccaggctgatgacagatgggatccaccactggcgaagtgtaccagccgcacccacgacgctctcattgtaggaaccctgtccgggaccatcttttttattctgctgatcatatttctgtcatggatcatcctcaagcacagaaaaggcaataatgcccacgaaaatcctaaagaggtagctatacatctacattcccagggaggttcaagtgtgcaccccaggactctccagacaaacgaggaaaacagtcgagttctcccata

SEQ ID NO: 218940 - DNA, 6119 bp, Artificial Sequence
  Description of Artificial Sequence: Synthetic coding sequence
atgggagcctcgtcccccagaagtcctgagcccgtgggcccacccgcacctggactcccattttgctgcgggggttctctgcttgctgtggtggtgttactggcactgcccgtggcctggggccagtgtaatgctccagaatggctaccttttgccaggcctaccaacctcacagatgagttcgagttccctataggaacttacctgaactacgaatgccgtcccggatattcaggacgccctttcagtataatttgtctaaagaactcagtatggaccggggctaaggatcggtgtcgcagaaagtcctgcaggaatccccctgatccggtgaatggcatggtgcatgtcattaaggggatccaattcggctctcaaatcaaatatagctgtacgaagggctaccgccttatcggtagctcatccgcgacttgtattatttccggggacacggtcatctgggacaatgaaaccccaatatgcgatagaattccctgtggccttccgcctacgatcgctaacggagactttatatcaactaatcgcgagaatttccactacgggtctgtcgtcacataccggtgtaatccaggatctggcggacgcaaggtcttcgagctcgtgggtgagccctccatatactgcacatctaatgatgaccaggttggcatctggagcggtcccgcaccgcagtgcattattcccaacaaatgcacacccccaaacgtggagaatggtatacttgtgtccgataaccgtagcctgttttccctgaacgaagttgtagagttccgctgtcagcccggtttcgtgatgaagggtcctcgacgggtcaagtgccaggccctgaataagtgggaacctgaactcccctcctgcagtagagtctgccagccccctcccgacgtattgcatgctgagagaacccaacgcgataaggacaacttttctcccggacaagaggtgttttactcgtgtgagcctgggtacgacctccgcggagctgcatcgatgcgatgcaccccccagggggactggtctcccgcagctcccacttgtgaagtgaagagctgtgacgatttcatggggcagctgttaaatggaagggtgctgtttcctgtaaacctgcaactgggagctaaagtagatttcgtgtgcgacgaggggtttcagctcaagggcagcagcgcttcttactgtgttctggcagggatggaaagtttatggaactcaagtgtgccagtctgtgagcaaatcttctgcccgagtccccctgtgatccctaacggaagacacaccggcaagccactggaggtttttccttttgggaagacagtaaattacacatgcgacccacacccagatcgtgggacttcttttgaccttatcggggaatctactatcaggtgtacaagcgacccacagggtaatggcgtatggagtagccccgctcctcggtgtgggattctggggcactgccaggcgcctgatcacttcctgttcgccaagcttaagacacagactaacgccagtgactttccaatcggaacctcactaaagtatgagtgcaggccggagtactacggcagaccatttagcatcacatgtttagacaatctcgtgtggtcatccccaaaagatgtttgtaagaggaagagttgcaagacacccccagaccccgtgaatggaatggtgcacgtgatcaccgatatacaggtgggaagcagaataaattactcttgtacaaccgggcacaggctcattgggcacagctctgcagagtgcatcctaagcggaaacgcagcacactggagtaccaagcctcccatttgtcagcgaataccctgtggacttccacccaccattgccaatggcgatttcatttcaacaaaccgggaaaatttccactacggctccgtggtgacctatcgctgcaacccaggatcagggggaagaaaagtgttcgaactggtcggtgaaccctctatttattgcacctctaatgacgaccaggtgggaatttggtccggccctgccccacagtgtattattcccaataaatgtacaccgccaaatgtggagaacggaattctagtgtctgataacaggagtctgttctccctgaacgaagtcgtggagtttcggtgccagcctggcttcgtgatgaaaggccctcggagggtgaagtgccaagcactaaacaaatgggagcccgagctaccctcatgctctcgcgtctgccagccaccccctgatgttcttcatgctgaaagaacccagcgtgacaaggataacttctcacccggacaggaagtattctattcttgcgagcctggctatgatctacgcggtgccgcttcaatgcgctgtaccccgcagggagattggtcccctgccgcaccaacgtgtgaggtgaagtcctgcgatgattttatgggccaactgctcaacggacgcgtactgttcccggtaaacctgcaactgggggctaaagtcgactttgtttgcgatgaagggtttcagttgaagggctcgagtgcctcttattgtgtcctggctggaatggaaagtttatggaacagtagcgttccggtctgcgagcagatcttctgtccatctccacctgttataccaaatggtcgacacaccggcaaaccattggaggtgttcccatttggaaaagccgtgaactatacctgtgacccccacccagatcgcggaacctcgtttgatctcatcggggaaagtaccatccgctgtacttcagatccacagggtaacggggtgtggtcttcccctgcacccaggtgcgggattctagggcactgccaggccccagatcacttcctgtttgccaagttgaagacgcaaactaacgcatctgacttccctatcggaacatcccttaaatatgagtgtcggccagagtactacgggagacccttttctataacctgcctcgataatctcgtctggagcagcccaaaagacgtgtgtaagaggaagagctgcaagacacccccagatcctgttaatggcatggtccacgtgatcactgatatacaggttggtagcagaattaactactcttgtacaaccggacacagactcattggccattctagtgcagagtgcatcctgtcaggcaacacagcccattggagcactaagcctcccatttgtcagagaatcccatgtggattgcccccaactattgcaaacggagactttatttccacgaatcgcgagaacttccactacggctctgtcgttacgtatcgctgcaatcttgggagccgcggtcggaaggtcttcgaactggtgggcgagccttcaatctattgcacctcaaacgacgatcaggtaggaatctggtcgggtcctgctcctcagtgcattattccaaataagtgtactcccccaaatgtcgagaacggtattctcgtatccgataacagatcattgttcagtctgaacgaagtggttgagtttaggtgccaacccggtttcgtgatgaaggggccacggagggtaaaatgccaggccctgaacaagtgggagcccgagctaccttcatgctcccgcgtatgtcagcctcctcctgagatcctgcacggcgaacacacaccgtctcatcaggacaacttttctcctggacaggaggtcttctatagttgtgagcccggatacgacctgcgaggggcagcgagcttgcattgtaccccacagggtgattggtctcctgaggctcctcgatgtgctgtgaaatcatgcgatgactttctgggccagctcccacatgggagggtgctgttcccactcaacctacagctgggcgcaaaggtcagcttcgtctgtgacgaagggtttcgccttaagggcagttccgtttcgcattgcgttctggtcggcatgcgctcattgtggaacaactcagtaccagtatgcgaacacattttttgcccgaacccacccgcaatcctgaatggccgtcatacgggcactccctctggggacattccatatggaaaagagatctcctacacctgtgatccccacccggacagaggaatgacatttaatcttatcggggaatccactatcaggtgcacgagcgatccccatgggaacggtgtgtggtcctctcctgccccaagatgcgaactgtcggtaagggccggacactgtaaaacacctgagcagttcccttttgcctcccccacgataccaattaacgatttcgaattccccgtgggaaccagcctgaactatgagtgtcggcctgggtacttcggcaagatgttctcaatttcatgtctggagaacctggtgtggagctctgtcgaggacaactgtcggaggaaatcttgcggcccacctcctgagccattcaacggcatggtgcacatcaacaccgatacccaatttggatccaccgtcaattactcatgcaacgagggattccggctgatagggagccctagcacaacatgtctggttagcggcaataatgtgacgtgggataagaaggcacccatttgcgaaataattagttgtgagcctcccccaaccatctccaatggtgatttttactccaacaataggaccagcttccataatggcaccgtggtgacttatcagtgccacacaggccctgatggggagcaacttttcgagctggtgggagagagatcaatctattgtacaagtaaggatgatcaggttggggtatggtcgtctccaccaccaaggtgtataagtaccaacaagtgcacagcaccagaagtggaaaacgccataagggtgcccggtaaccgtagtttctttacacttaccgagatcataaggtttcgatgccagccagggtttgttatggtcggtagccacactgttcaatgccagactaatggccgttggggcccaaagcttcctcactgctcacgcgtctgccagccgcctccggagatcctccacggcgagcacaccttgagccatcaggacaactttagccccggtcaggaggtcttttactcttgcgaaccgtcttacgacctgcgcggagcagcaagcctccactgcacccctcagggcgattggtcacccgaggcgcctagatgcacggtgaagagctgtgatgactttctcggccagctgccacacggccgagtactgcttcctctgaacctgcagctaggagctaaggtgagcttcgtgtgcgatgagggctttaggttaaaaggacgcagcgcttcccattgcgttttggccggtatgaaggccctgtggaactcatccgtcccagtgtgcgagcagatcttttgtcctaatcctcctgctatacttaatgggcgacataccggaacaccctttggagacattccctacggaaaggagatcagctacgcgtgcgacacccatcctgatagaggcatgacattcaatctgattggcgaatcctcaattaggtgtactagcgatccccagggaaatggtgtgtggagcagtccggcaccacggtgtgaattgagcgtcccagctgcctgcccacacccaccaaaaatccagaatggacattatatcggcggtcatgtaagtctttacctgcccggtatgactatctcttatatatgcgatcctggatatctgctggtgggcaaaggattcatcttttgcaccgatcagggaatttggagtcagctcgaccactactgtaaggaggtcaactgcagctttcctctattcatgaacggcatcagtaaggaactggagatgaagaaagtttatcattacggcgactatgtcacactgaagtgcgaagatggatacacattagaagggagcccatggtctcagtgccaggcagacgatcgctgggaccctccgctggctaagtgcacctctcggacccacgatgcactgattgttggaactctgagcggcacaatcttctttatcctcctgatcatattcctctcctggattattctgaagcataggaagggcaacaacgcgcatgagaatcctaaggaggtggcgatccatttgcactctcagggtggatcttctgtgcatcctaggaccctgcagaccaacgaagaaaacagcagagtcctgcctta

SEQ ID NO: 218941 - DNA, 6119 bp, Artificial Sequence
  Description of Artificial Sequence: Synthetic coding sequence
atgggggcatcatcacctcgctcccctgagcctgttggtccccctgccccaggtttacccttttgttgcggcggttctctgctcgcagtggtggttcttctcgccttgcctgtggcatggggccagtgtaatgccccagagtggttaccttttgctcgcccaacaaatctaaccgacgagtttgagtttcccatcgggacatacttaaattacgaatgtagaccagggtatagtggaaggcccttctccatcatctgtttgaaaaatagcgtctggacaggagcaaaggataggtgtcggaggaaatcctgtagaaaccccccagatcccgtgaacggaatggtgcacgtgatcaaagggatccagttcgggtcacagatcaaatatagctgcacgaagggatacaggctcattgggtcttcttccgctacatgcatcatcagcggagatactgttatctgggacaacgaaactccgatttgcgatcgaatcccatgcggtctgcctcctacgattacaaatggggacttcatcagcactaatcgagaaaatttccactacggttcagtcgtgacctaccgctgtaaccccggaagtggcggacgcaaggtgttcgaactcgttggagagccctctatctactgcacttcaaacgacgaccaggtgggaatttggagcggacccgcaccccagtgcattattcctaacaagtgtacaccacccaacgtagagaatggcatactggtttctgataacagatcactcttttcgctcaatgaggtcgttgaattcaggtgtcagcctggcttcgtaatgaaaggaccacgcagagtgaaatgccaagctttgaacaaatgggagcctgaactgccttcttgctcacgggtgtgccaaccgccacctgacgtcctgcacgctgagcgcacgcagcgcgacaaagataatttcagccctggacaggaggttttctattcctgtgagcccggttatgatttgcgtggcgctgcctcgatgaggtgcacaccacagggcgactggagtcccgcagcgcctacttgcgaggtcaagtcgtgtgatgacttcatggggcagctgctcaacggtagagtgttatttcccgttaatctgcagttgggagcaaaagttgactttgtctgcgacgagggcttccagttgaagggttcctccgcatcgtactgtgtcctggccggaatggagtcactctggaattccagtgttcctgtttgtgagcagatcttctgtccttctccgccagtaatcccaaatggcagacacacagggaagccactggaagtttttcctttcggcaagactgtcaactacacatgtgatcctcatccagaccgtggtacatcttttgatctcatcggtgagagcacgatacgctgtacatccgacccccaggggaatggcgtctggtccagcccagctcccagatgtggcattttggggcactgtcaagccccagatcatttcttgttcgccaaattgaaaacgcagacaaatgcctctgacttcccaatcgggaccagcttgaaatatgagtgcagaccagagtactatgggaggcccttttccatcacctgcttagacaacctggtatggagctctccaaaagatgtgtgcaaacggaagtcttgcaagaccccaccggatccagtgaatggaatggtgcacgtcatcacggacatccaagtgggcagtcgcattaactattcctgtacaacggggcacaggttgataggccacagctctgcagaatgtattctgtctggcaatgcggcacattggtcaaccaaaccgccaatatgccagagaatcccttgcggcctccccccaactatcgctaacggcgactttatttcgactaacagggaaaactttcattacggctctgtggtcacataccgctgcaacccaggtagtggtggtcgtaaggtgttcgaacttgtcggggagccctctatctattgcacgagcaacgatgaccaggtcggaatttggtcagggcctgccccacaatgcatcatcccaaataagtgcactcctcccaacgtagagaacggcatcctggtcagcgacaatcgcagcctgttttccctgaacgaggtcgtggaattccggtgccagccaggctttgtgatgaagggacctcgcagggtcaaatgtcaagcattaaacaagtgggaaccggagcttccgtcctgcagccgtgtgtgtcagcccccaccggacgtgctgcatgctgaaaggactcagagagacaaagataatttttcccctgggcaggaggtgttctattcatgtgaacccggttacgacctgaggggcgctgccagcatgaggtgtacacctcagggagactggtctcctgccgcacccacgtgtgaggtgaaatcctgcgatgacttcatggggcagttgcttaacggtcgcgtactgtttcccgtgaacctgcaattgggagcaaaagtggatttcgtttgtgatgaagggtttcaacttaagggcagctccgccagctactgtgtgctggctgggatggaatctttatggaattctagtgtgccagtttgcgaacaaattttttgcccgagccctcctgtgatcccgaatggacgtcatactgggaaacccctcgaggtttttcctttcgggaagacagtgaactacacatgcgacccacaccccgatcgcggaactagttttgacctgatcggagaatcaactattcgatgtacttccgaccctcagggaaatggcgtgtggtccagcccagccccaaggtgtgggatccttggccattgtcaagcgcctgaccacttcttgttcgccaagctaaagacccagaccaacgcttctgattttcctatcggtacttccctcaaatacgaatgccgtccagaatactatgggagaccattttccatcacatgtctggataatctagtctggtcctctcccaaggatgtgtgcaaaaggaaatcttgcaaaacccccccagaccctgtgaatggcatggtgcatgtaatcaccgacatacaggtggggtcacgcatcaattacagctgtaccacgggacaccggctaatcgggcattctagcgccgaatgtattctgagcggaaacaccgcccactggtccactaagccgcctatttgccaacgaataccctgcgggctgccaccgactatcgctaatggtgacttcatctccacaaatcgtgagaacttccactacgggtccgtcgtgacctacaggtgtaacctgggctcccgcggacgaaaagtttttgaactggtaggagaaccatccatctactgcaccagtaatgatgaccaggtcggaatttggtcggggcctgcacctcaatgcatcattcctaacaaatgcacacccccaaacgtggagaatggaattctcgtgtctgataatagaagcttgttctcactgaatgaggtcgtggagttcaggtgtcagcctgggttcgtgatgaagggtccccgtagggtgaagtgtcaagcactgaataaatgggaacctgagttgccctcatgctcacgcgtctgtcaacctccccctgagattctacacggagagcatactcccagccatcaggacaacttttccccgggacaggaggtgttctattcctgcgagcccggatatgacttacgtggggctgcctccctgcactgtactccccagggggactggtctcctgaggcaccccgttgcgcagtcaagtcttgtgacgattttttaggccagctgccgcacggtagagttctgtttccgttaaatctgcagcttggggcaaaggtgtccttcgtttgcgatgaaggcttcagattaaagggcagcagtgtgtcccactgtgtcctcgtgggcatgcgctcactctggaacaactctgtgcctgtttgcgaacacatattttgcccgaaccctccagctattctcaatggacgacacacagggaccccttcgggggacattccctatggcaaggagatctcctacacctgcgatccgcatcccgataggggtatgaccttcaatttaattggcgagagtactatcaggtgcacatccgatccacacggcaacggagtgtggtcatcccccgcacccaggtgtgagttgagtgtgagggccggtcattgtaagacccctgagcagttcccattcgcttcgcctacgatacccatcaacgattttgagttccctgtggggaccagtctcaattatgaatgcaggccaggatatttcggcaaaatgttttcgatctcctgcctggagaacctagtatggtcttctgtggaagataactgtaggagaaaatcttgtgggcctcctcccgagccttttaatggcatggtccatatcaacaccgatacacaattcggctccactgtgaactacagctgtaatgaggggtttaggctgattggctccccaagcacgacctgcctcgtgagcggaaataacgttacctgggacaaaaaagcccctatctgcgaaattatttcttgtgaaccgcctcctacaatctccaacggcgatttctactctaataaccgtaccagcttccacaatggaaccgtggtgacctaccagtgtcacactggaccagacggagagcagctgtttgagctggtgggagagaggtcaatctactgtacgtcgaaagacgaccaggttggggtgtggtcaagtccccctcccagatgcatctctaccaacaagtgtacagctcccgaggtcgaaaacgccatccgagtgccaggtaaccgcagtttttttactctgacagagataattaggttcaggtgtcagccaggtttcgtgatggtcggttcgcacaccgtccagtgtcagaccaacggtagatggggccctaagctgccccattgcagccgtgtgtgccagcccccaccagaaatactgcatggggagcatactctgagccatcaggacaacttttcgcctggccaggaagtgttttactcatgcgaaccttcctacgacctaaggggcgctgcatctttacactgcactcctcagggcgactggtcccctgaagcaccacggtgtactgtcaagtcgtgtgatgattttctgggccaattgccccacggcagggtgttattgccattaaacctccagctgggggcaaaagtgtcctttgtgtgtgacgaggggttccgcttgaagggtcgctcggcctcgcactgcgtcctcgccggaatgaaggcattgtggaacagtagcgttccagtctgcgagcaaattttttgccctaacccccctgctattctaaacggacggcacacaggaacccctttcggagacattccctatgggaaagagatcagttatgcttgcgacactcaccctgatagaggaatgacctttaatctgattggcgagagctctatacggtgtaccagcgatccacaaggcaatggagtgtggtcttccccagccccaagatgtgagctgagtgtgcccgctgcttgtcctcaccctccaaaaatacagaacggccactacatcggtgggcacgtgtctctttacctccctggaatgactatttcctacatatgtgacccgggatatcttctcgtgggcaaagggttcatcttctgcacagaccaggggatttggtcacagctggaccactactgcaaggaggtgaattgctcatttccgctcttcatgaacggcatatcaaaggagctggagatgaaaaaagtatatcactacggggactacgtgacactgaagtgcgaggacggttacaccctggaaggtagcccatggagtcagtgtcaagccgacgatagatgggatccacccttggccaaatgtacctctcgcacgcacgatgcattaatcgtggggacactgtccggcaccatcttcttcatcttgctgatcattttcctttcctggattattctcaaacacaggaagggcaacaatgcccatgagaatccaaaggaggttgccattcacttacacagccaaggaggctcatcggtccacccgagaaccctgcagacaaatgaggaaaactcccgtgtgctgcccta

SEQ ID NO: 218942 - DNA, 6119 bp, Artificial Sequence
  Description of Artificial Sequence: Synthetic coding sequence
atgggcgcttcatctcctcggtcacctgaaccagttggtcctcccgctccgggtcttcctttctgctgcggcggttctctgctggccgtcgtggttttgctggccctccccgtggcttggggtcagtgtaatgctcccgagtggctgccatttgcgcgacctacaaacctcaccgacgaattcgaatttcctatcggcacatacttaaattatgaatgtaggccaggttattccggcagacctttctctataatatgccttaagaatagcgtctggactggcgctaaagaccgctgtcgtaggaagtcgtgtagaaacccacccgaccctgtcaacggtatggtgcatgtgatcaaaggtatccagttcgggagtcagataaagtacagttgtacaaaaggctatcggctgatcggcagctccagcgccacctgtataatctcgggggacaccgttatttgggacaacgagaccccaatttgcgatcggataccttgcgggctcccgcctacaatcacaaatggggacttcatttcaacaaaccgcgagaatttccattacggtagtgtcgttacatatcgctgtaaccccggttccggcggacgaaaggtgttcgaattggtcggcgaaccctcaatatactgcacttccaacgatgaccaggtggggatctggagtgggccagccccacaatgcattatacctaacaagtgcacaccgcctaacgtcgagaatgggatcctggtgtcagacaaccggtcacttttcagcttgaacgaagtcgtggagtttcggtgccagccaggcttcgtcatgaaaggcccacggagagtgaaatgccaggccctgaataaatgggaacccgagttgccaagctgctccagggtatgccagccgcctccggatgttctgcacgcagaacgaacccagcgggataaagacaattttagtccgggacaggaagtgttttatagctgtgagccagggtatgacctcagaggcgctgccagtatgagatgtacaccccagggcgattggtccccggcagcgcctacgtgtgaagtaaagagctgtgacgactttatgggacaactgctgaatggaagggttttattcccagtgaatttgcagttaggagcaaaagtggactttgtctgtgatgaagggtttcagctcaagggctccagtgcgagctactgtgtactggctggcatggagtcgctgtggaacagtagtgttccagtgtgtgaacagatcttctgtccatctccacctgttattccaaacggaagacacacaggaaaacccctggaggtgtttccgttcggaaagacggttaattatacctgcgacccgcaccccgacaggggcacatcttttgatctgatcggtgagagcacgataaggtgtacaagcgatcctcaaggcaatggggtgtggtcgtctccagcacctcggtgtggaatattgggccactgccaggctcccgatcattttctgttcgctaaactgaaaacccagaccaacgcctccgatttccccatcggtacatcactcaagtatgagtgccgcccagaatattacggaaggcccttttcaataacctgtctggacaatctcgtgtggagcagcccgaaagacgtctgtaagcggaagtcctgcaaaactcccccagacccagtgaatggtatggtgcatgtgatcaccgacatccaagtgggatcccgcataaattattcttgcacgacagggcatagactgattggccatagctccgcagagtgcattctctccggcaacgcagcacactggagcaccaaacctccaatttgtcaaaggatcccgtgcggtctgccgccaactatagctaatggagactttatctccaccaatcgtgaaaatttccattatggcagcgttgttacttaccgatgcaatcccggtagtggaggcagaaaagtattcgagctggttggagaaccgtccatctactgcactagcaacgatgatcaagtgggcatttggtctggaccggcaccacaatgtataattccaaataaatgtacccccccaaacgtcgagaatggtattctggtgtccgataatagaagcctgtttagtctgaacgaggtggttgagttccggtgccagccgggatttgtcatgaagggcccaagaagagtgaagtgtcaagccttaaacaagtgggagccagaactgccttcctgtagccgagtgtgtcagccaccaccagatgtgctgcacgccgaacgtacccagcgagacaaggataacttctcaccaggccaagaggttttctattcatgcgaacccggatacgacctcaggggtgctgcctctatgaggtgcaccccccaaggagactggtcccctgctgcccctacctgcgaagtcaaatcatgtgatgacttcatggggcagttactgaacggtcgggtgctattccctgttaacctccaattgggcgctaaggtggattttgtctgcgatgaaggatttcagctgaagggcagcagtgccagctattgcgttctggccggaatggagagcctgtggaacagcagcgtcccggtctgtgagcagatcttttgtccatcaccacccgtgattccaaacggacggcatactggaaaacccctggaagttttcccttttggaaaagcagtgaattacacatgtgatcctcaccctgacaggggcacctcttttgatctgattggggagtcaacaattaggtgtacctccgaccctcagggaaacggagtgtggtccagccctgcacccagatgcggcatcctaggccactgtcaggcacctgatcacttcctctttgctaagttaaagacccagacaaacgcaagtgatttccctatcggcacatcattgaagtacgagtgccgacctgagtattacggccgtcccttcagtataacatgcctcgataatcttgtgtggagctcccctaaggacgtctgtaaaaggaagagctgtaagacgcctcccgatccggttaatgggatggttcacgtgattacggacatccaggtgggcagcagaataaattatagctgcacaaccgggcaccgactgattggccactcctcagcagaatgcatactgtccggtaatacagcccactggtcaacaaaacctccgatctgtcagagaatcccatgcgggttgcctcctaccattgccaacggtgatttcatctcaaccaatagggagaatttccattacggcagcgtggtgacgtaccgatgtaatctcggatcacggggacggaaggtatttgaactggtgggggaacctagtatctactgcacctcaaatgatgatcaggttgggatctggtctggacctgcccctcaatgcataattccaaacaagtgtacaccccctaatgtcgagaacgggattttggtctcagataacagaagcctgttcagtctaaacgaggttgttgagttccgttgccagcccggattcgtgatgaaaggacccagaagggttaagtgtcaggccttgaacaagtgggaaccggagctgcccagctgcagtcgagtctgccagcccccaccggaaatccttcatggtgagcacactccaagtcaccaggacaatttttctcctggtcaagaagtgttttactcttgcgagcccggttacgatttgaggggtgctgcatccctccactgtaccccccagggagattggtctcctgaagctcccagatgcgccgttaagtcatgtgacgactttttgggacagcttcctcacgggagagtgctcttccctctgaatctccagcttggggctaaagtgtctttcgtttgcgacgagggctttcggcttaaggggtcgagcgtcagtcactgtgtgttagtggggatgcgctctctttggaataacagcgtgcccgtgtgtgaacacatattctgtcccaatcccccagctattctcaatggacggcatactgggacccccagcggcgacataccatatggtaaggagatatcttacacatgcgatccccaccctgaccgaggcatgactttcaacctgataggggaaagcaccattcgttgcacaagtgatcctcacggcaacggagtgtggagctcccctgctccacgttgcgagctctctgttagagccggtcactgcaagacgccggaacagtttcccttcgcttccccaaccatcccaatcaatgattttgaattccccgttggcacatctctgaattatgaatgtcgaccaggctacttcgggaagatgtttagcatcagctgcctcgaaaacctggtgtggagcagcgtggaagacaactgcagacgcaagtcgtgcggaccccctccagagcccttcaacggtatggtccacatcaacacagatacgcaatttggatcaaccgtcaactactcctgcaacgagggctttcgtcttataggatctccgagtactacatgccttgtctccgggaacaatgtcacatgggacaaaaaagctccaatatgtgaaatcatatcgtgcgaacccccacccacaatatcaaatggtgacttctacagcaataaccgcaccagctttcataacggcacggtggtgacgtaccagtgccataccggaccagacggagagcaactgttcgaactagttggagagagaagcatttactgcacttcaaaagatgaccaagtgggtgtctggagttcccccccaccccgatgtatttccaccaataagtgtacggccccagaggtggagaatgcgatccgggtgcccggtaatagatccttttttacactgactgagattattcgctttagatgtcagcccggatttgtgatggtcggtagccatactgtgcagtgtcaaactaatggaaggtggggacctaagctgccacattgcagtagggtctgtcagcccccacctgaaatactgcacggggagcacaccctgagtcatcaggataatttctctccgggacaggaagtcttttactcctgcgagccaagctacgacctgagaggcgctgcatctctgcactgcacgccacagggcgactggagtccagaggccccacgatgtactgttaaaagttgtgacgattttctgggccagttgccacacggcagggtgctcctgcccctgaatctgcaactcggcgctaaggtgtccttcgtgtgtgatgagggcttccgtctcaaaggcagatctgcaagtcactgcgtacttgcaggaatgaaagccctgtggaacagtagcgtgcccgtgtgcgagcagattttttgccctaatcccccagccattctgaacggaaggcacaccggaaccccatttggtgatataccttatggcaaagaaattagctatgcctgcgacacacaccctgatcgcggtatgacatttaatttgatcggcgaaagctcaattcgctgcacttccgatccccagggaaatggcgtttggagctctcccgctcccagatgtgagctgtctgtccccgctgcttgcccccatccaccaaaaatacaaaatggccactatataggcggacatgtatccctctatctgcccggaatgacaatcagttacatctgtgatccaggatatttattggtgggaaagggattcatcttctgcacagatcaggggatctggtcccagctggatcactactgcaaagaagttaactgttcgtttcctctctttatgaacggcatttccaaggagctcgaaatgaagaaggtttaccactatggagactacgtaactctaaagtgtgaggacggctatacactggaggggtcaccttggagtcagtgtcaggccgatgaccggtgggaccccccactagcaaagtgtacgtcccgtacacatgatgcactgattgttggaacactttctggcacaattttctttattctgctcattatattcctcagttggatcatcttaaagcatagaaaggggaacaacgctcacgagaatccaaaggaagttgccattcatcttcactctcagggtggttcatcagtacaccctcgcaccctccagaccaatgaagaaaacagccgcgttcttcctta

SEQ ID NO: 218943 - DNA, 6119 bp, Artificial Sequence
  Description of Artificial Sequence: Synthetic coding sequence
atgggggcatcctccccaagaagtcctgaacctgttggacctccagctccaggacttccgttctgctgtgggggatccttgctcgccgttgtggtgttgctcgcactcccagtggcctggggtcagtgcaacgctccagaatggctcccattcgctaggccaactaatcttactgatgagttcgagttccctattggcacttacctcaattacgagtgtaggccgggatacagtggaaggccgttcagcatcatctgcctcaagaactccgtgtggactggagcgaaggatcgatgtcggagaaagtcctgtcggaatcccccagaccctgtcaatggtatggtacacgtaattaaggggattcagttcgggtctcagattaagtacagctgcaccaagggctacaggctgatcgggtcctcaagtgctacctgcatcatcagcggcgatactgtgatctgggacaacgagaccccaatttgtgaccgcatcccgtgcgggctgcctccgactatcaccaacggggatttcatctccactaacagagagaactttcactacggttctgttgtcacataccgttgtaaccctggatctggaggcagaaaggtgtttgaattggttggggagccctctatttattgcactagcaacgatgatcaggtgggcatttggtctgggccagctccgcagtgcataattcccaataagtgtacacccccaaacgtggagaatgggatcctggtgagcgataatagaagtctctttagcctcaacgaggtcgttgagttccgctgtcagccaggcttcgtgatgaagggcccaaggcgtgtaaaatgtcaggccttgaacaagtgggagcccgagctgcctagttgctccagagtgtgccagcctcctcctgatgtattgcacgctgaacggacacagcgcgacaaggacaatttcagccctgggcaggaggttttttactcgtgcgaacccggttatgatctaaggggcgcagcatccatgcgttgtaccccacagggtgattggtcacccgctgcacctacctgcgaggttaaaagttgtgacgattttatgggccagttactgaacggcagagtactgttcccagtcaatctgcagctaggtgccaaggtggacttcgtctgtgacgagggatttcaattgaaaggctccagtgcttcctattgtgtgttggccggtatggagagtctctggaactcctcagtgcccgtgtgcgagcagattttttgtccctccccaccagttatacctaatggccgtcatacaggaaagccattggaagtttttccattcgggaaaactgtcaattatacatgtgatccacaccctgacagagggactagtttcgaccttattggtgagtccaccattcgctgtaccagcgatccacagggaaatggagtgtggtctagccccgcaccacggtgtgggattctggggcattgtcaggctccggaccattttttatttgccaaattaaagacacagactaacgccagcgactttccaatcgggacaagcctgaaatacgagtgcaggcccgagtattacggcagacccttttctatcacctgtctggataacctggtgtggtcctctcccaaagatgtgtgtaaaagaaagtcatgcaagacaccccctgaccctgtcaacggaatggtccacgtcatcaccgacatccaggtggggtcccggattaattattcttgcaccacaggacaccggctgatcggacacagttccgcagaatgtattctatccggcaatgcagcgcactggtctactaaaccacccatctgccagaggatcccgtgtggattgcccccaactatcgctaacggcgacttcatctccactaacagggaaaatttccactacggatctgttgtcacatatcgctgcaatcctggatccgggggaaggaaagtattcgaactggtgggagaaccatccatctattgcacttctaacgacgaccaggtggggatttggtctggtcctgctcctcaatgtatcatacctaacaaatgtactccgcctaatgtcgagaacggcattctcgtaagtgataacagatctctgttctcactcaatgaggttgtcgagtttcgctgtcagccaggcttcgttatgaaagggccacgtcgcgtgaaatgtcaggcactaaataagtgggaacccgagttgccctcctgttccagagtgtgccagcctccacccgatgtgttgcacgccgaaagaacacagagagacaaagacaatttcagcccgggacaggaggtcttttatagttgcgagcccggatatgacctcaggggtgccgcttcaatgcgttgcaccccacagggcgattggtctcctgcggcacctacttgcgaggtaaagagttgtgacgactttatggggcagctgttgaatggacgcgtgctcttccctgtgaatcttcagctgggtgcaaaagtagatttcgtgtgcgatgaaggctttcagctgaagggctccagcgcgtcttactgcgtattagccggtatggagtctttatggaattcctctgtgcccgtttgcgagcagatattttgccccagcccacccgtcattcctaacggaagacatacgggaaagcccctggaggtcttcccttttggcaaggccgtcaattacacttgtgacccgcatccagaccggggtacaagtttcgaccttatcggcgaatctacaattcggtgcacgtcagacccccagggcaatggagtttggtcttcccctgccccaagatgtgggatacttgggcactgccaagcccctgatcatttcctgttcgcgaagctgaaaacacagaccaacgcaagtgatttccccatcgggaccagccttaaatacgagtgtcggccagaatactacggtcgcccattcagtatcacttgtctggataacctggtgtggtcatctccgaaagatgtgtgtaaacgcaagtcatgcaagacaccccctgaccctgtaaacggaatggtccacgttataacagacatacaggtcggctctcgaattaattattcatgcaccacagggcaccggctgatcggtcacagttccgcggaatgcattttgagtgggaacactgctcactggtctacgaaaccacccatctgccaaagaatcccctgtggactgcctcccaccatagccaacggcgactttatttcaaccaatcgagaaaacttccattatggctcagtcgtaacttaccggtgcaatcttggaagccggggtcggaaggtgtttgagctagtcggcgagccatccatttactgtaccagtaacgacgatcaagtgggaatctggtccggacccgctccccagtgtattatcccaaataagtgcacgcccccaaacgtcgagaacggcatccttgtgagcgataataggtccttgttttctctgaatgaggtggtagagtttcgctgccagccgggttttgtcatgaagggacctcgccgagtgaagtgccaagctttgaataagtgggaaccagagctgccaagctgctcacgtgtatgtcagccacccccagagattcttcacggggagcacaccccctcccaccaagataactttagcccgggtcaagaagtcttttattcatgtgaacctgggtacgatctgagaggcgctgccagcttacactgcacaccgcagggggactggtcacccgaagcgcctcggtgtgccgtgaagtcttgcgatgattttctgggacagctaccacacgggagggttctgttccccctgaacctgcaactgggggcaaaggtgagttttgtgtgcgacgagggtttccgactgaagggcagcagcgtctcccattgcgtcctggtggggatgcgctctctgtggaataattccgttcccgtttgcgagcacatcttctgtccaaacccgccagccattctgaatggccgtcatactgggacaccatctggcgatatcccttacggtaaagagatcagttacacctgtgaccctcaccccgataggggcatgacttttaatctaattggggagagcaccatcaggtgcacttcagacccgcatggtaatggcgtttggtcttctcctgcgccacgttgtgagctatccgtgcgggctggccactgcaagaccccagagcaatttcccttcgctagtcccaccatccctataaatgattttgagtttccagtcggcacatcactgaactacgagtgccgtcctggctattttggcaagatgttctccatcagctgcctggagaaccttgtgtggtcctcagtggaggacaattgccgccgaaagtcttgcggccctccacccgaacctttcaatgggatggtgcatatcaacaccgatacgcagttcggctctaccgtcaactatagctgcaacgaaggcttcagactaatcggatcacccagcacaacctgtctcgtttctggcaataacgtcacctgggacaaaaaagcacctatctgcgaaatcatatcttgtgagcccccacctaccatttccaacggggacttctattccaataaccgtacctcattccacaatggcacagtcgtaacttatcagtgccacacgggccctgatggcgaacagcttttcgaacttgtgggcgagaggtctatctattgtacctccaaggacgaccaggtgggtgtgtggagctctcctccacctcgatgtatctcaaccaacaagtgtactgccccagaagtcgagaacgctattcgagttccagggaatcgcagctttttcaccctgaccgagatcatcagatttcgctgtcagccaggattcgtgatggtcgggtcgcacaccgtgcagtgtcaaacaaatggtcgttgggggcctaaactgccccattgctctcgcgtatgccagccacccccagagattctacacggcgaacacacattgtctcaccaggacaacttttcccctggccaggaggtcttttatagctgcgagccgtcttatgacctcagaggcgcagcatctctgcactgtactccgcagggggactggagccccgaggctcccagatgcacggtcaaaagctgtgatgacttcctgggacagctgccccacggccgtgtgctcctgcctcttaacctgcagctgggagctaaggtttccttcgtatgtgatgagggctttaggttaaagggtcggtccgctagccactgcgtgctcgcaggcatgaaggcactctggaactctagcgtgccagtgtgtgaacagatcttctgtcccaatccccctgctattcttaacggcagacatacaggaacgccatttggggatatcccctatgggaaggagataagctatgcctgtgacactcacccagacaggggaatgaccttcaaccttatcggggaatcgagcattcgctgtaccagtgatccccagggaaatggagtttggtcatcgcctgccccacgctgcgaactcagcgtcccggcagcctgcccacatccacccaagattcaaaacggacactacatcggaggccacgtgtccctgtacctgcccggaatgaccattagttacatatgtgacccaggctaccttttggttggcaaaggttttatcttctgcaccgaccagggtatttggtctcaactggaccactactgcaaagaggtaaactgcagcttcccattgtttatgaacggtatcagcaaggagctggaaatgaagaaggtgtaccattatggcgattacgtgacactaaaatgcgaagatggctataccttggaaggctctccatggagtcaatgtcaggctgacgacaggtgggaccctcccctggctaaatgcaccagtaggacgcatgatgcactaatagtgggcaccctttcagggactatctttttcattttacttattatctttctcagctggatcattctgaagcaccgaaaaggcaataacgctcatgagaatccgaaggaggtggcgatccatctgcactctcaaggcggaagttccgttcaccctcgtacgttgcagacaaacgaagagaacagccgggtgttgccata

SEQ ID NO: 218944 - DNA, 1755 bp, Artificial Sequence
  Description of Artificial Sequence: Synthetic coding sequence
gggcactgccaagctcctgatcatttccttttcgccaaactgaagacccagactaatgcctccgacttcccgatcgggacatcgctgaagtatgagtgtcgcccagagtattatggcaggcctttcagtatcacatgtctggataatctggtttggagcagtccaaaggatgtatgtaagagaaagtcgtgcaagactccacctgatcccgtcaacggcatggtacatgtgattaccgatatccaagtgggcagcagaattaactattcctgtaccactgggcatcggttgattgggcacagctctgccgaatgtatcttgtcaggtaacgctgcccactggagtacaaagccaccaatatgccagagaattccctgtggcctgccgcctactattgctaacggggacttcatcagtaccaatagggagaatttccactacggtagcgtggtcacgtacagatgtaatcccggaagcggcggtcgcaaggtgtttgaactcgtcggagaacccagcatctattgtacttcaaatgacgatcaggtgggaatatggtccggcccagcccctcagtgtatcattcctaataaatgtacccctccgaacgtcgaaaatgggattcttgtgtctgacaatcggtcactgttctcccttaacgaggtggtggagttcagatgccaaccaggtttcgtcatgaaaggcccaagaagagttaaatgtcaggctcttaacaagtgggaaccggaactgccatcttgcagtcgggtgtgccagccccctcctgatgtcctgcatgccgaaaggacacagcgtgataaagacaattttagccccggacaggaggtgttctatagctgtgagccaggctacgatctccggggagcagcgtctatgcgttgcactccgcaaggggattggagtcccgcagcacccacgtgtgaggtgaagtcttgcgacgacttcatgggccaactcttgaacggacgggtgctatttcccgttaaccttcaactcggagccaaagtcgattttgtgtgcgatgaaggattccagctgaaggggagcagcgctagctattgcgtgttggccggtatggagagcctctggaacagttcagttcccgtatgcgagcaaatcttctgcccttcacccccagtgatccctaatggtcgccacacaggcaaaccactggaggtattccctttcgggaagacggttaactatacttgtgacccacacccggatagagggacctccttcgacctcatcggcgagagcaccattagatgtactagtgaccctcaaggaaacggtgtctggtcctctcctgcccctcgctgcggcattctgggccactgtcaggctcctgatcacttcctgttcgcaaaattgaagacccagactaacgcctccgacttcccgatcggtacatcccttaagtatgagtgtcggcctgagtactatggccgtccttttagcattacctgtctggataacctcgtttggagctctcctaaagacgtgtgtaagcgcaagtcttgcaaaactccccctgaccccgtgaatggaatggtgcacgtgatcaccgacatccaggtgggatccaggataaattactcctgtactactgggcatcgtctcataggccatagttcagccgaatgtatactttctggcaatgccgctcactggagcacaaagccacccatttgtcagagaagttgtcacctgccttgcgagctctttgggagatag

SEQ ID NO: 218945 - DNA, 1335 bp, Artificial Sequence
  Description of Artificial Sequence: Synthetic coding sequence
atggcacccccagtgagattggagaggccatttcccagtcggagatttcccggacttttactcgcagctctggtactgttgctttcttcattttccgaccagtgcaatgttccggagtggctgccttttgcaaggcctacaaaccttaccgacgatttcgaatttcccattggcacatacctaaattacgaatgtcgacccggttactcagggaggcctttcagcatcatttgcctgaagaacagcgtgtggacctctgctaaggataaatgtaaacggaagagctgcaggaacccccctgacccagtcaatgggatggcacatgtgattaaggacatccagtttcgtagtcagatcaagtattcatgccccaaggggtaccggctgataggatcatcaagcgctacatgcataatatccggcaatacagtgatctgggataataagacacccgtttgcgatcggatcatatgcgggcttcccccaacaatagccaacggcgactttacaagtatcagccgggaatattttcactacggcagtgttgtcacataccattgcaatttaggctccagaggtaaaaaggtttttgagctagtgggcgaaccctcgatatattgtactagcaaggatgatcaggtgggcatctggagcgggcctgctccacagtgtatcatccctaataagtgtaccccccctaacgtagaaaatggtattctggtgagtgacaatcgttccctcttcagtctcaacgaagtcgtcgagttccgctgccagcctggcttcgggatgaaggggccaagtcatgtgaaatgccaggcactgaataagtgggagcctgaactcccctcgtgctcacgcgtctgccagcctcccccagacgtgctgcacgctgagaggactcagagggacaaggataacttctctcccggtcaggaagtgttctattcatgtgaacccggatacgatctgagaggctcaacttatttacactgcactccacagggtgattggagtccggctgcgccacggtgtgaggttaaatcctgcgacgactttcttgggcagctcccaaatggtcatgtcctttttccgcttaacctacagcttggggcaaaggtcgactttgtgtgcgatgaaggatttcagctgaagggaagctccgcttcgtattgtgtgttagccggaatggaaagcctgtggaactcctctgtccccgtctgcgagcgcaaatcatgcgagaccccacccgtccctgttaatggcatggtgcacgtgatcaccgacattcacgtcggcagccgaattaattattcatgcacaacggggttttag

SEQ ID NO: 218946 - DNA, 1710 bp, Artificial Sequence
  Description of Artificial Sequence: Synthetic coding sequence
atggccccaccagtacggctagaaagaccattcccatcgaggcgattccccggtttactcctggcagccctcgttctcctgctgtcctctttcagcgaccagtgtaatgtgcccgaatggttaccctttgcgcgtcctactaatctcaccgacgactttgaatttccgataggaacataccttaattatgagtgtcgcccaggatattcgggccgacctttctcaattatttgccttaagaactcagtttggacatctgctaaggacaagtgcaaaaggaaaagctgtcggaatccgccagatccggttaacgggatggcccacgtaattaaggacatccagttccgtagtcaaatcaagtactcatgccctaagggataccgtctgatcgggtcttcctccgctacatgtattattagcggcaatacagtcatttgggacaataagacacccgtgtgcgatagaataatctgcgggctgccaccgactatcgcaaacggcgatttcactagtataagtcgcgagtattttcattatggatccgtggtgacctatcactgtaatctgggatcgcgagggaagaaagtgttcgaactggtcggagagccttccatctattgcacgtccaaggatgatcaagtagggatttggtctggccctgcccctcaatgtatcattcctaataagtgtacccctccaaatgtggagaacggcatacttgtgtccgacaacaggtccctgtttagtctgaatgaggtagtggagtttaggtgccaaccgggatttggcatgaagggtccctcccatgttaagtgtcaggcactgaacaaatgggagccagagctgccaagttgtagccgcgtatgccagccaccccctgacgtcctgcatgccgagaggacccagagggataaagataactttagccctggacaggaagtcttctattcatgtgagcccggatatgatctgagaggttctacttacctgcactgcacaccacagggagactggtcaccagctgcacccagatgtgaggtcaagagctgtgacgactttctcggacaactgcctaacggacatgtgcttttccctttaaacctgcagctgggggcaaaggtggatttcgtgtgtgatgaaggattccagcttaagggatcatctgcgtcttactgcgtgcttgcaggtatggagtccctatggaactcgagcgtcccagtttgcgagcggaagagttgtgaaaccccacccgttccggtgaacggaatggtacatgttattacggacatccacgttgggagtcggattaactactcctgtacaactggacacaggctgattgggcactcatcagccgagtgcatactgtccggaaatactgctcactggagtatgaagcctcctatatgccagcagattttttgtcccaatcctcctgctatcctgaatggtcgccacaccggtacgcctctgggagatatcccctacgggaaagaggtaagctatacgtgcgatcctcatcccgatcggggaatgacctttaatttgatcggtgagagcaccatccgccgtacaagtgaacctcatggtaacggggtatggtcttctccagctcccagatgcgaacttccagttggggctggctcgcacgatgcccttatcgtggggaagttctatgaagtttttgccgaagagttctgtcacctctag

SEQ ID NO: 218947 - DNA, 3279 bp, Artificial Sequence
  Description of Artificial Sequence: Synthetic coding sequence
atgggagccgcaggacttctgggtgttttcctggccctcgttgcgccaggcgtgctgggcataagttgcggcagccccccaccgattctgaacgggcgaatcagctactattcaactcccatcgctgtgggcaccgtcatcaggtacagctgttctggaactttccgccttattggcgaaaagagtttgttgtgtattactaaggacaaggtagatggaacctgggacaaacccgctcccaaatgcgagtactttaataaatattcttcgtgccctgaacccatagtgcctggaggatacaagattagaggtagcacgccctatcgtcacggtgacagtgttacatttgcctgcaaaactaactttagcatgaatgggaacaagtccgtgtggtgccaagctaacaacatgtggggacccactaggcttccaacgtgtgtctcagtcttcccgctcgagtgtccggcactcccaatgattcataatggacatcatacttctgagaacgtcggctccatagcaccgggactgtcagtaacctatagctgcgagtccggctatctactggtcggcgagaagatcattaactgccttagttcaggcaaatggagtgccgtccctcctacatgtgaagaggcacgatgcaagagcctagggcgtttcccaaacggcaaggtgaaggaaccccctattctaagggtgggcgtgacagctaacttcttttgtgacgaagggtaccggctgcaaggcccaccttcctctcggtgtgtcatcgctggacagggcgtagcctggacaaagatgcccgtctgtgaagaaattttttgcccatctcctccgcctatcctgaacgggaggcatattggaaatagcctcgccaacgtgtcttacgggtcaattgttacgtacacttgtgaccccgaccccgaagaaggtgtgaattttatcctgattggcgagtcgaccttgcgatgcacagtggacagccagaaaaccggcacatggtctgggcctgccccacgctgcgagctctcgacgtccgctgtgcagtgccctcatccacaaatcctccgaggccgaatggtttctggccagaaggatcgctatacctataacgacacagtgattttcgcatgtatgttcggattcacactgaaggggtccaagcagattaggtgtaatgctcagggtacatgggaacccagcgcaccagtgtgtgaaaaggagtgtcaggccccaccgaacatccttaacggccaaaaagaggataggcatatggtgaggtttgatcccggaacttcaatcaaatacagttgcaacccagggtacgtgctggtgggggaagaatcaatccagtgtacgtctgaaggagtctggactccacctgttccccagtgtaaggtagccgcttgcgaagctacaggaaggcaactcctgacaaagcctcaacaccagtttgtaaggccggatgttaattccagctgcggtgagggatataagctatcaggaagcgtataccaggagtgtcagggaactattccttggtttatggagatacggctttgcaaggagatcacatgcccaccccctccagtcatctacaacggtgcacataccgggtcttctctggaggacttcccctatgggaccactgttacatatacttgtaatcccggtcctgagaggggagtggagttttcactgattggcgagtccacaatcaggtgcacatccaatgaccaagaacggggaacctggagcgggcctgcacccttatgtaaactttcgctgcttgcagttcagtgctctcacgtacatatagcaaatggttacaagatcagtgggaaagaggcaccctacttctacaatgatacagttactttcaagtgctactcagggtttactctgaaaggctcctctcagatccggtgtaaagccgacaatacttgggatccagagatccccgtgtgcgaaaaagggtgtcagtcaccacctggcctgcaccacggtagacatacaggtggcaatacagtgttcttcgtgagcgggatgaccgtagactacacttgtgacccaggctacctgttggtcggtaacaagtctatccactgcatgccctctggaaactggagccccagcgctcctcggtgtgaggagacatgtcaacatgtccgacagtcacttcaggagcttcctgccggatcacgggtagaactcgtgaacacctcttgccaggatggttatcagctaactgggcacgcctatcagatgtgccaggatgcagaaaatggcatttggttcaagaaaatccctctgtgcaaagtgatccattgtcacccacccccagtaatcgttaacggtaaacatactggtatgatggctgagaacttcctgtacggaaatgaggtgagctacgagtgcgaccagggcttctatctccttggtgagaaaaagttacagtgtagatcggactctaaagggcacgggtcatggtcaggcccaagccctcaatgtcttcggtccccccctgtgacgcggtgtcccaatccagaagtaaagcacggatacaaattaaataagacacactcagcctacagccataatgacatagtctacgttgactgcaatcctggttttataatgaacggatcacgggtcatccgctgccacactgataacacttgggtccccggagtccctacatgcataaagaaggcttttatagggtgtcccccacctccaaagacacccaacggcaatcacacaggtggaaacatcgcgagattttctcccggaatgtctattctgtactcttgcgatcagggatacctgctggtgggcgaagctttgttgctctgcacccacgagggcacgtggagtcagccggcaccccattgtaaggaggtgaactgcagctcaccagcggacatggacggtattcagaagggactggagcccaggaagatgtaccaatacggcgcagttgtcactctcgagtgcgaagacggctatatgttagaaggcagtccacagagtcaatgccagtctgaccaccagtggaatcctccattggcagtgtgccgaagtaggtctttggctccggtgttgtgtggcattgccgctggcctcattcttcttacattcctgatcgtcatcacactgtatgtgatctctaagcaccgcgctaggaactactacactgacacctcgcaaaaagaggctttccacctcgaggctcgggaggtgtacagcgtagatccgtataatcccgcaagttag

SEQ ID NO: 218948 - DNA, 3102 bp, Artificial Sequence
  Description of Artificial Sequence: Synthetic coding sequence
atgggcgcagctggcttactgggggtattcctggctctagtggctcccggtgtgcttggcatctcctgcggatcccctcctccaattctgaatgggcgtattagttactatagcaccccgattgcagtcggaacagttatccgctattcatgtagtggtacatttcgcctcatcggggagaagtcattgctgtgtattaccaaggataaggtggacggcacatgggacaagccagccccaaagtgcgagtattttaataagtattcttcgtgccccgagcccattgtgcctggcggatacaagatacggggttccaccccttacaggcacggcgacagtgttacctttgcttgtaagacaaatttttccatgaatggaaataagtcagtgtggtgtcaggctaacaatatgtggggaccaaccaggctccctacttgcgtctcagtgttcccactcgagtgtcctgctctcccgatgatacacaatggacaccatacaagtgagaatgtaggtagcatcgccccaggcctgagcgtgacatatagctgtgagagtggctacctcctggtcggcgagaaaattatcaactgtttgtcaagtggtaaatggtccgccgtaccacccacttgtgaagaggcaagatgcaagtccctgggacggtttccaaatggaaaagtgaaggagccgccaattttgcgggtgggagtgacagcaaactttttctgcgacgagggataccgcctgcagggtcccccaagcagccgctgtgttatcgccggtcagggtgtggcctggaccaaaatgcctgtgtgcgaggaaatcttctgtcctagcccccctcccattcttaacgggaggcacattggcaattcgttggctaatgtttcgtacggatcaattgtcacgtacacgtgcgatcccgatcctgaggagggtgttaatttcattctcatcggtgagagtacactgagatgtacagttgattcacagaagactggaacatggagcggccctgccccacggtgtgagttgagcacaagtgctgtgcagtgcccccacccccagattctccggggacgcatggtgtccggacagaaggaccggtacacatataatgacacagtaatcttcgcctgtatgtttggcttcacattgaagggatcaaagcagatccggtgcaacgcccagggtacctgggaaccctcagctcctgtatgcgagaaagagtgtcaggcccctccaaacatccttaacgggcagaaggaggacagacatatggtgaggttcgatcctggtacttccataaaatacagttgcaatccgggatacgtgctagtaggagaggagagcatccagtgtacctccgagggggtgtggacccctccggtcccccagtgcaaggtcgcagcatgcgaggctacaggaagacagctactgactaaacctcagcaccagttcgtccgccctgacgttaactcctcctgtggtgaaggttataaactgagtggctccgtttaccaggagtgtcagggcacaatcccctggtttatggagattagactttgcaaggaaataacatgtcctcctccccctgtgatatacaacggtgcccacaccggcagcagtctcgaggatttcccgtacggcactactgtcacatatacttgtaaccccggtcctgagcgcggagtggagttttccttgatcggggagtctacaatccgttgtacctccaatgaccaggaaagaggcacatggagtggcccagcgccactgtgtaagctatcattattggccgttcagtgttctcatgtgcatattgccaacggctacaagatctcaggcaaggaggccccttacttttataacgatacggttaccttcaaatgctactctggtttcacactcaaaggatccagccagattagatgtaaagcggataatacttgggaccccgagatcccggtgtgtgagaaagagacctgccagcacgtccggcagtcactacaggaactcccagccggatcccgcgtggagctggtgaacacctcctgtcaggacggctaccagttgactggccatgcttaccagatgtgccaggacgccgagaatggaatatggttcaagaaaattcctctttgtaaagtgatccactgccacccccctccagtcatcgtcaacggcaaacacaccggaatgatggccgaaaattttctctatggcaacgaagtttcatacgagtgcgaccaaggattctatttgctgggcgaaaagaagttgcaatgccgctccgatagtaagggtcatggctcatggtcaggtcccagcccacagtgcctccgtagccctcccgtcaccagatgccccaacccagaggtcaaacacgggtacaagctgaacaagacccattctgcttactcccacaatgacatagtctacgtggactgcaacccgggatttatcatgaatggaagcagggtgatacgatgccacaccgacaatacatgggtcccgggagttccaacatgtatcaagaaggcttttattggctgcccaccgcctccaaagactccaaatggtaatcacaccgggggaaatatcgctaggttctcaccgggaatgtcgatcctgtatagctgtgatcaggggtacctgttggttggcgaggcgttactgctgtgtacccatgaagggacttggtcgcagcctgcgcctcactgcaaggaggttaattgtagctcccctgccgatatggatggtatccagaagggccttgagcccagaaaaatgtatcaatacggagccgtcgtgacccttgaatgcgaagatggttacatgctcgaaggctctccacagagccagtgtcaaagtgatcaccagtggaatcccccacttgcggtctgtcgctctcggagtttggcgccagtgctgtgtgggatcgctgccggactcattctcttgacattcttgattgtgatcacactttatgtgattagcaaacatcgcgctcgaaactattataccgacactagccagaaggaagcatttcaccttgaggccagggaggtgtacagtgtggatccatacaatcccgcatcttag

SEQ ID NO: 218949 - DNA, 2916 bp, Artificial Sequence
  Description of Artificial Sequence: Synthetic coding sequence
atgggcgctgctgggctcttgggggtctttttagccctcgtggccccaggtgtgttgggaattagctgcgggtccccgcctccaatactcaacgggaggattagttactactctaccccaatcgccgtgggcactgtgatccggtattcttgcagcgggacattccgactcattggcgaaaaatccctgttgtgtatcacaaaggataaggtggatggaacctgggacaaacctgctccaaagtgcgagtacttcaataagtactctagttgtcccgagccaattgtgcctggcggatacaagatccggggttcaaccccctatcgccatggcgactcggtcacattcgcttgcaagaccaatttctccatgaatggcaacaaatctgtgtggtgccaggccaacaacatgtggggcccaacaagattacctacgtgcgtgagcgttttccccctggagtgccctgccctacctatgatacacaacggccaccatacttccgaaaatgttggctcaatcgctcctgggctgtccgtaacttattcatgtgagagcggttatctgttggttggagagaagattattaattgtttgtcttccggcaaatggtccgctgtgcccccaacctgcgaggaggccaggtgcaaaagtctcggaagattcccgaacggtaaggtgaaggagcctccaatactgcgcgtgggtgtcactgccaacttcttctgtgatgaaggttatcgcctgcaagggccaccctcctctagatgtgtgattgcaggccaaggggtggcatggactaaaatgccagtttgcgaggaaattttttgccctagccctccccctatcctgaacggacgccacattggaaattccctagctaacgtctcatatggcagcatcgtaacctatacctgcgaccctgatcctgaagaaggagtaaattttattttaatcggggaatcaacgctacgctgcaccgtagactctcaaaaaaccggcacctggagcggtcctgctccccgttgtgagcttagtacttcagccgttcagtgcccccacccacaaatcttaaggggaagaatggtgagcggtcagaaagacaggtacacatacaacgataccgttatttttgcatgtatgtttggatttactctgaaagggagtaagcagatccgttgcaatgctcagggcacatgggagccgagtgctcctgtgtgtgaaaaagagtgtcaggctccacctaacattcttaatggccaaaaagaggatcggcacatggtcaggttcgaccctggtacctcaatcaaatactcttgtaaccccggatacgtgttggttggagaagaatcaattcagtgcaccagcgagggggtgtggaccccccctgtcccacagtgtaaagtggcagcttgtgaggctacggggagacagcttcttaccaagccacagcatcagttcgtgcgcccagacgtgaatagctcgtgcggcgaaggctataaactttctgggtcagtttaccaggagtgccaggggaccatcccctggttcatggagataaggctgtgcaaggagataacgtgtccaccaccccctgttatttataacggcgctcatacaggctcctcattggaggatttcccttacggcactactgtcacatatacgtgcaatcctggaccagagagaggagtggaatttagccttattggcgagtctacgattcgatgcaccagtaacgaccaagagcgcggtacttggtcgggacccgctccactgtgtaagctctcgctgctcgcagtacagtgcagtcatgttcacatcgctaatggctataagataagcggtaaggaggcaccctacttctacaacgatactgtcacctttaaatgttacagcggcttcacactcaaaggaagctctcaaattaggtgtaaagcagataacacgtgggacccagagattccagtgtgcgagaaggagacctgccagcatgtacgtcagtccctgcaggagctacctgcgggttcccgagtggaacttgtcaacacctcttgccaagatgggtatcagctaacgggccatgcctatcagatgtgtcaggacgcagaaaacgggatctggttcaaaaagattcccctttgtaaagtcatccattgccatccgcctcccgtcatcgtcaacggtaagcacacagggatgatggccgagaacttcctgtacgggaacgaagtgagctatgagtgcgaccaaggattctacttgcttggggaaaagaaactgcagtgtcgttctgacagtaagggacacggtagctggtccggcccttctccccagtgtcttaggagccccccagtgacccgctgcccgaatcccgaggtgaagcacggctacaaactgaacaaaactcacagtgcatatagtcataacgatattgtctacgttgactgcaatccaggttttatcatgaacgggagccgagtgatccgctgccacacggacaacacgtgggtcccaggggttccgacctgtatcaaaaaagaagtgaattgctctagccccgctgacatggacgggatacagaaaggccttgagcccagaaaaatgtatcagtatggcgcagtggttactcttgagtgcgaagacgggtacatgttggaaggatccccccagagccagtgtcaaagcgatcaccagtggaacccacccttggccgtgtgcagatcgcggagcctggcaccagttctttgcggtattgctgcaggactgatcctgctcacctttctgattgtcattacactctacgtcatctcaaagcaccgtgccaggaactactatactgacaccagtcagaaggaagcgttccacttggaggccagggaagtttactctgtcgacccgtataaccccgcttcttag

SEQ ID NO: 218950 - DNA, 3021 bp, Artificial Sequence
  Description of Artificial Sequence: Synthetic coding sequence
atgggagcagccggtttactgggtgtgtttctcgcactggtggccccaggggtcttgggtatctcttgtggctctccgcctcctatcttaaatggtaggatcagctactacagcactccaatcgccgtgggaaccgtaattcgctattcctgcagtggaaccttcagactgatcggcgaaaaatccctgttgtgtatcacgaaagacaaagtggacggcacgtgggataagcctgctccaaagtgcgaatattttaataaatatagcagttgtcctgagcctatcgttcccggtggctataagatacggggttcaaccccgtaccggcacggtgactctgtcaccttcgcatgcaagacaaatttcagcatgaacggcaataagtctgtgtggtgtcaggccaacaatatgtggggcccaacccggttgcctacctgcgttagtgttttcccccttgagtgccccgctctgcccatgattcataatggccaccacacctcagagaacgtcgggtctattgccccaggcctttccgtgacttattcctgcgaatcagggtatttgctagtgggagagaaaatcatcaattgtcttagctctggcaaatggtccgcagttcccccaacctgcgaggaggcacgatgtaagtcactcggtcgatttccgaacgggaaggtgaaggaacctcctatccttagggtcggcgttaccgccaacttcttttgtgacgagggttacaggcttcagggccctccaagtagtagatgcgtgatcgcaggccagggcgttgcatggaccaaaatgcctgtctgtgaagaaattttttgtccaagcccccctcccattctgaacggcaggcacattggcaacagccttgccaacgtctcctacggaagcatcgtgacctacacctgcgatcctgacccagaagagggggtgaacttcatcctgattggagagagtacattaaggtgcactgtggactcacagaaaacaggaacgtggtcaggtccagccccaaggtgtgaattgtcaacatccgccgttcagtgcccgcacccccagattctccgcggtagaatggtctcagggcaaaaagataggtacacctataatgatactgtgatctttgcctgtatgttcggattcacgctcaaggggtccaagcagattcgctgcaacgcacaaggtacctgggaaccctcagctcccgtgtgcgaaaaggaatgccaggcaccaccaaatattctgaatggccagaaggaggataggcatatggtgcgtttcgatccaggaaccagtatcaagtacagctgtaatccaggctacgtgctggtgggcgaagagagtatacagtgcacgagcgagggagtatggacacctccagtccctcagtgcaaggtggccgcttgcgaggctactggacgccagctgctcaccaagccacagcatcagtttgtacgaccagatgttaattcatcgtgtggagaaggaaaccacctgcctacaactccatgttacctccaatggggaacccatagagagttcctgcgcagattcagcatatggaaccacggccatctgcatatgcctgggccagagcggggagtggaattttctctgatcggagaatcaacaatccggtgcacttcaaacgatcaagagaggggtacttggagcggcccagctcccctgtgtaaactttccctgctggcggtgcagtgcagccatgtccacattgctaatgggtacaagatctctggcaaagaggctccatacttctacaatgacacggttacatttaagtgctactcgggtttcaccctgaagggctccagtcagatcagatgcaaggccgacaacacgtgggatcctgaaatcccggtgtgcgagaaggagacttgtcagcacgtgaggcagtcgctgcaggagctcccggctggcagccgtgttgagcttgtcaacacatcgtgccaggacggctaccaactgacaggccacgcctaccaaatgtgccaggacgccgagaatggcatttggttcaaaaaaattcccctttgcaaggtgattcattgccaccccccacccgtaattgtaaatggaaagcacactggaatgatggcggaaaattttctttatgggaatgaggtcagttacgagtgcgaccagggtttttatttactgggagaaaaaaagctacagtgccgttcggattcgaagggtcacggcagctggtccggcccatcaccacagtgcttgagatctccccctgtgacacgatgtccaaatccagaggtgaagcatggctataagctgaataagacccatagtgcttattcgcataacgatatcgtgtatgtcgactgtaaccctgggttcataatgaatgggagtagggtcatccgttgccacactgataatacctgggttccgggagtccccacttgtattaaaaaggcgttcatagggtgccctccacccccaaaaactccgaacgggaaccacaccggcggtaacatagccaggttctcacccggaatgtcgattttatacagctgtgatcaaggatacctgttggtaggcgaggctctccttttgtgcacgcacgagggcacctggtctcagccagctcctcattgtaaagaagtgaattgcagtagccccgcagatatggatggaatccagaaaggcttggaaccccgaaagatgtaccagtatggcgctgtggtaactctggagtgcgaggacggatatatgttagaagggtcaccacagtctcagtgtcagtccgaccaccagtggaatccacccctggctgtgtgtcgctcacgcagcttggcacccgtgctctgtggcatcgcagccggactcatactgctgaccttcctgatcgttattactttatacgtgatttccaaacatagggccaggaactactacaccgacaccagccagaaggaggcctttcatctggaggccagggaggtgtactctgtggacccttacaatccggcatcctag

SEQ ID NO: 218951 - DNA, 2226 bp, Artificial Sequence
  Description of Artificial Sequence: Synthetic coding sequence
atggctgccgcagagggaccggtaggagacggtgaactgtggcagacctggttacccaaccatgtggtttttttgcggcttcgcgagggcctgaagaaccagagccccaccgaagcagaaaagcccgcaagtagcagtttaccaagttcccctcccccacagctgctcaccagaaatgtggtatttggactaggcggtgagctgttcctctgggatggagaagactccagctttctagtggtcaggctgagaggcccttcaggcggtggcgaggaaccagctctgtctcaataccagcgcctgctgtgcattaacccacccctatttgaaatataccaggttctcctctcaccaacccagcaccacgtcgccctgatcggcattaaagggctgatggttctggaacttcctaagcgatggggtaaaaacagcgaatttgagggcggtaagtcaacagtgaattgtagcacaaccccagttgcagaacgatttttcacatcatccacatctctcaccctgaaacatgccgcttggtatccctctgaaattctggatccccatgttgtcctgcttacatctgataatgtgatccgcatctacagcctcagagagccgcaaactcctacaaacgtgattatcctgagcgaggctgaggaggagagcctggttctgaataaagggagagcttataccgcatccttgggagaaactgctgttgcttttgactttgggccacttgctgcagtacccaaaacactgttcggtcaaaacggaaaagacgaagtggtggcctatccgctctacatcctctacgagaatggcgaaaccttcctgacatatattagcctgctccattccccaggtaacatagggaagctgctgggccctctgcctatgcacccggcagccgaagataactatgggtacgacgcctgtgcagtgctgtgcctcccatgcgtgcctaatattctggtaatcgccaccgagagcggtatgctgtaccactgtgtggttctagaaggcgaagaagaggacgatcacaccagcgagaagtcgtgggattcgcgcatagacttaatcccatccttgtacgtgtttgaatgcgtggagctggaactcgccctcaagttggccagcggtgaggatgatcctttcgactcagactttagctgtccagtaaagttgcaccgcgaccctaaatgcccttcccgctatcattgtacccatgaggcaggggttcacagcgtaggactgacgtggattcacaagttgcacaagtttctgggctccgatgaagaggacaaagactcactgcaagaactgagcactgaacaaaagtgcttcgtggaacatattctctgcaccaaacccctcccttgccggcagcccgctcccatccggggattttggatagtcccagatattctaggaccaacgatgatctgcatcacctctacctacgagtgtcttatatggcccctattgtccaccgtccaccccgcatcacctcctcttctgtgcacacgcgaagacgtggaagttgcggagtctcccctccgagtcctcgccgagacaccggattcgtttgaaaagcatattcgttccatcctgcaaagaagcgttgctaatcctgcctttctgaaggcatccgagaaggatattgcaccccctcccgaggaatgtttacagcttttgtcacgcgctactcaggtcttcagagagcagtatatccttaagcaggatctggccaaagaagaaatccagcggcgagtgaagcttctctgcgatcagaagaagaaacagctcgaggatttgagctactgtcgggaagagcgcaaatcactcagggaaatggcggaacgcttggctgacaagtacgaggaagccaaggaaaagcaagaagacatcatgaatcgcatgaaaaaactgcttcactcatttcattcggagctcccagtgcttagcgattccgagcgcgacatgaagaaagagctccaactgatcccggatcagctgcgacatttggggaatgcaattaaacaggtgacaatgaaaaaggactaccagcagcagaaaatggaaaaagtgctgagtctgcctaagccgacgatcattttatcggcgtaccagaggaaatgtatccagtctatcttgaaggaggaaggagaacatattcgcgagatggttaagcagatcaatgacattcgcaaccatgtcaatttctag

SEQ ID NO: 218952 - DNA, 762 bp, Artificial Sequence
  Description of Artificial Sequence: Synthetic coding sequence
atgatgatgaagatcccatgggggtccatcccggtgcttatgcttctcctgctcctcggactgatcgatatctcccaggcccagctgtcctgcactggtcctcctgcaatccctggtatacccggaattcccggaactcctggccctgacgggcagcctggtactcccggtatcaagggagagaaaggcctccctgggctggccggtgaccatggcgaattcggcgagaagggcgaccccggtatccccggaaatccagggaaagtcggcccaaaagggcctatgggcccaaagggaggcccaggcgctccgggagctccaggcccaaagggtgaaagtggcgattacaaagcaactcagaagatcgctttctctgcaaccagaaccataaacgtgcccctccggagggatcagacaatcagatttgaccacgtcattacaaatatgaacaacaactatgaacccaggtctggaaagtttacctgtaaagtcccaggcctctactacttcacctaccacgcttcctctcggggaaacctgtgtgtaaatctgatgaggggccgtgaaagggcccagaaggtggtcaccttctgtgattatgcctataacactttccaggtgactacaggcggtatggtgttgaagctcgaacaaggcgagaatgtgttcctgcaggctacggacaagaatagtctgttgggaatggaaggcgcaaactccatattctcgggcttcctgctgtttccggacatggaagcttag

SEQ ID NO: 218953 - DNA, 690 bp, Artificial Sequence
  Description of Artificial Sequence: Synthetic coding sequence
atgaagattccctgggggagcatacccgttctgatgctgttacttctgctcggcctgattgacatttcacaggcgcagctgagctgcactgggccaccagcaatcccaggaatccctgggatccccggaaccccaggacctgacggacagccgggtacccccggtatcaagggggaaaagggactgcccggtctggccggagatcatggtgaattcggcgagaaaggcgacccaggaatacccggtaaccccggaaaggtgggacctaaaggtcccatggggcctaagggcggtccaggggctcctggtgctccgggaccgaagggtgagtctggcgattacaaagccacacagaagatcgcatttagcgcgactcgcaccatcaatgtccccttaaggcgcgatcagacaataagattcgatcacgtaattacgaatatgaacaacaactatgagcctagaagcggaaagtttacttgcaaggtgcctggcttgtactatttcacttatcatgcctccagccgcggtaatctgtgcgtcaatttaatgcgcggtcgggagcgcgcacagaaagttgtgacgttttgcgattacgcgtataacacattccaagtcactactggcggtatggtgctgaagctggaacagggagagaatgtttttttgcaagccaccgacaagaatagctag

SEQ ID NO: 218954 - DNA, 756 bp, Artificial Sequence
  Description of Artificial Sequence: Synthetic coding sequence
atgaagataccttggggttctattcccgtgctaatgctgttactgctcctgggactcattgatatatctcaggctcagctcagttgtacagggccaccagccatccctggaatccccggtatccctgggacaccaggaccggatggccagcccggaactccgggaatcaaaggagaaaagggattaccgggtctcgccggtgaccatggggagtttggcgagaagggagatcccggtatcccaggcaaccctgggaaggtaggaccaaaggggccaatggggccaaagggcggacccggtgccccaggggcaccaggccctaaaggagagtctggcgattataaggctactcagaaaattgctttttcagcaacacgcacaatcaacgttccacttcgccgagaccagactataagattcgaccatgtgataacgaacatgaataacaactatgagccgcgaagcggaaaatttacatgtaaagtgcccggtttatactactttacttaccacgcgtcttctagaggaaatctgtgcgtgaacctcatgagaggtagagagcgggctcagaaggtagtgacattttgcgactacgcgtacaatacttttcaggtcacaacaggtggcatggttcttaagctggagcagggcgaaaatgtgtttctccaggcaactgacaagaattctctgttaggcatggaaggggctaacagtatcttctctggcttcttattatttccagatatggaagcctag

SEQ ID NO: 218955 - DNA, 462 bp, Artificial Sequence
  Description of Artificial Sequence: Synthetic coding sequence
atgaaaattccatgggggagcattcccgtcctgatgcttctgttactgctcggactcatagacatctctcaggcgcaactcagttgcactggaccgcctgccatacccggaattcctggcatccccggaacacctgggcctgacggacagcctggaacacccggtatcaagggggaaaagggtctccctgggctcgccggagatcatggagaatttggagagaagggcgacccaggtatccccggaaatcctgggaaagttggccctaagggccctatgggcccaaaagggggacctggcgcacctggtgctcctggccctaagggcgaatcgggcgactacaaagccacgcaaaaaatagcattttccgccacaagaacaatcaatgtgccactccggagggaccaaaccattagattcgaccacgtaattactaatatgaataataattatgaaccttag

SEQ ID NO: 218956 - DNA, 738 bp, Artificial Sequence
  Description of Artificial Sequence: Synthetic coding sequence
atggatgtaggaccttcctctttgccgcatcttggactgaagctgttactgctgctgctgctgctgccccttcgaggccaagccaacacaggctgctatggcatcccaggaatgcctggacttcctggggcaccagggaaagacggttatgatggccttccgggtcccaagggagaacctggcatcccggcaatccctgggattcgtggccctaaaggccaaaagggggagccagggttgcccggtcatccaggcaagaatggtccgatggggccacccggaatgcccggtgtccctggccctatggggattcctggtgaacccggagaagagggcagatacaaacagaagttccagtcagtgtttactgtcactaggcagacccatcagccaccagcaccaaattctctgattcgtttcaatgcagtcttaactaacccccagggggactacgatacatcaacaggcaagtttacttgtaaggtacccggtctgtattacttcgtgtatcatgcgtcacacacagccaacctgtgcgttttgctctacaggtctggggtgaaggtagtgacgttttgtggacatacttctaagaccaaccaggtgaactcgggtggggtgcttttgcggctgcaggttggagaggaggtgtggctggccgtgaatgactactacgatatggtcggcattcaggggtccgattccgtcttttcaggatttttgttgtttcccgattag

SEQ ID NO: 218957 - DNA, 738 bp, Artificial Sequence
  Description of Artificial Sequence: Synthetic coding sequence
atggatgtgggaccgagtagcttacctcatcttggattaaaacttctgttgctgctgcttctcttgcctctgagaggacaagccaacaccggttgctatgggatcccaggaatgcctggcctgccgggagcaccaggcaaggacgggtatgacgggttgccaggtcccaagggcgaacccggtatccccgctatacctggtatacgcggacctaagggccagaaaggcgaaccaggcctgcctggccatccaggaaagaatgggcctatgggaccgcctgggatgcccggagtgcccggaccgatgggcatcccgggtgaacccggagaagagggcagatataagcagaagtttcagtcggtgttcacagtgacccgccagacgcaccaaccgccagcccctaattccctcatcagattcaacgctgtgctcaccaatccacagggagactacgatacgtccaccgggaagtttacctgcaaagtccccggtctgtactattttgtgtaccacgcttcacatacagccaatctgtgtgtccttctgtacaggtctggtgtgaaggtggtgaccttctgcggccatacttcaaaaacaaatcaggtcaatagcgggggtgtgttgttacgactgcaggtaggcgaggaagtctggctcgccgtgaacgattattacgacatggtcggaatccaggggtctgatagcgtgttctctgggttcctcctgttcccagactag

SEQ ID NO: 218958 - DNA, 738 bp, Artificial Sequence
  Description of Artificial Sequence: Synthetic coding sequence
atggacgtaggcccatcaagcctgccacatctaggcctcaaactgctgcttctgctgctgctccttcctctccgcggtcaggcaaacaccgggtgctatggcatacccggaatgccagggctccctggcgcaccgggtaaggacgggtacgatggcctccctggaccaaagggtgagccaggcatcccagcgattcctggtatccgtggtcccaagggccagaagggcgagcctgggttacctggacatcccggtaagaatggccctatgggtcctcctgggatgcctggcgttccgggacccatggggattcccggagagcctggtgaagagggaaggtacaagcagaaatttcaaagcgtgttcaccgttacccgccaaacgcatcagccccctgcaccgaactcactgattcgattcaacgccgtcctaacgaatccgcagggagattatgatactagcacaggcaagttcacttgcaaggtgccaggattgtattatttcgtgtatcatgcctctcacaccgctaatctctgcgtgctgctgtatagatccggtgtcaaggtggtgactttttgtggtcacacctccaagacaaaccaggttaattccggaggggtgctgctcaggctacaagtcggagaggaggtttggttggctgttaacgattattatgacatggtcggcatccagggctcggattctgtgtttagcggatttctgctcttccccgattag

SEQ ID NO: 218959 - DNA, 777 bp, Artificial Sequence
  Description of Artificial Sequence: Synthetic coding sequence
atgttactggtcctagtggtcctaatacccgtgttggtcagtagcggcggacccgaaggccattatgagatgcttggaacttgccgcatggtctgcgatccgtaccctgcacgaggacccggagctggcgcacggacagatggcggtgatgcgctcagtgagcagtccggggctcctcccccttctaccctggtgcaagggccacagggaaaacctggcagaaccggcaagccaggccctccaggacctcctggggatcctggaccccctggacccgtgggacctcccggagagaaaggagagccgggtaaaccgggtcccccaggcctgccaggggctggtgggtcaggcgctattagcaccgctacgtatacgaccgtccccagggtcgctttttacgcaggcctgaagaatcctcacgagggttacgaagttctgaagtttgacgatgtcgtcactaacctgggtaataactatgatgcagccagtggtaaattcacctgcaatatcccgggaacctacttctttacctatcatgtgctgatgagaggcggtgatgggacatcaatgtgggcggatctgtgcaagaatggtcaggtccgcgcatcagccatcgcccaggatgctgatcaaaactacgattacgcttccaattccgtgatcctgcatcttgatgctggagatgaggtcttcattaagcttgatggagggaaagcccacggcggaaacagcaacaagtacagcacattttcagggttcataatttactccgattag

SEQ ID NO: 218960 - DNA, 864 bp, Artificial Sequence
  Description of Artificial Sequence: Synthetic coding sequence
atggcccttggtctcctcattgctgtcccattactcctacaagcagccccaagaggagcagcgcactatgagatgatggggacttgcagaatgatttgtgatccttacaccgcggctcctgggggagaaccccctggtgccaaggcccagccgccaggcccatcaacagcagcgctcgaggtgatgcaagatctgtcagccaatccacctcctccatttatacagggcccaaagggcgacccgggacggcctggcaaacccggtcctcggggaccgccaggtgagccaggcccacccggaccaagaggtcccccaggggagaagggcgatagcggaaggcccggtcttccagggctgcagctcactgcgggaactgcctccggcgtcggtgttgtcggaggcggtgcaggcgttgggggagatagcgaaggggaagtgacctcggcgctcagcgcgaccttctccgggcctaagattgctttttatgttgggctgaagtctccgcacgaagggtatgaagtgctaaaatttgatgatgttgtcacaaacttggggaaccattacgaccccacaacaggcaaattctcctgccaggtgcgcggaatatacttcttcacttatcacattttaatgcgcggaggcgacggaacttctatgtgggcagacctgtgtaagaatggtcaggttagggcgtcagccatagctcaggatgccgatcagaattacgactatgctagtaactcagtcgtgttgcacctggactctggagatgaggtgtatgtgaagctggatggaggaaaggcgcacggcggaaacaacaacaagtatagcaccttctcaggtttcttactgtaccccgactag

SEQ ID NO: 218961 - DNA, 2007 bp, Artificial Sequence
  Description of Artificial Sequence: Synthetic coding sequence
atgagcgtgcggttccgagtgggcagggaagagaatgcccagtggtggctgctgtacctcctggtacccgcactgttctgccgtgcaggaggatccatccccatccctcaaaaactattcggggaagtgacttccccactctttcctaagccttaccccaacaacttcgaaacgacaacagtgatcaccgtacccacgggctaccgggttaagttggtcttccagcaattcgacctggagcctagcgaaggctgcttttatgattacgtgaaaatatccgctgacaaaaagagcttaggccgtttctgtggtcagttgggttctccacttggcaatccacctggaaaaaaggaattcatgagccagggcaacaagatgctattgacctttcacacagattttagcaacgaagagaatggcactattatgttttataagggatttctggcgtattatcaggcagtggaccttgacgaatgcgctagccggtccaagtccggagaagaggatccccagccccaatgtcaacacctgtgccataactacgtgggaggctacttttgttcctgccggcctgggtacgaattgcaagaggaccgccacagttgtcaggctgagtgcagctctgagctgtataccgaagctagcggctatatttctagtctggaatatcctaggagttacccgccagatcttcggtgtaattattctattagggtcgaacggggactgacgcttcatctaaagtttctggaaccattcgatatcgatgatcaccagcaggtgcactgtccctacgatcaactacagatctatgccaacggaaagaatattggagagttctgcggcaagcagcgccctcccgatctggacacctcttccaatgccgtggatttgttgttcttcacagacgagtccggagactccagaggatggaaactgagatacaccaccgagatcatcaaatgtccccaaccgaaaactctggacgaattcactatcatccagaatttgcaaccccagtatcaatttcgagattatttcattgctacctgtaaacagggttatcagctcatcgaaggaatccaggtggtggcgggagttgtggatgtgagcgcgggacgagtgagctggagcacgagcagccagacctgttgcacaagagtttatacctgtaccgcccagggaatttggaagaacgaacagaaaggcgagaagatcccacggtgtcttccagtgtgtggtaagccggtgaatccggtcgagcagcggcagaggatcataggtggacagaaagccaagatgggtaatttcccatggcaggtgtttaccaatatccacgggagaggcggaggggctctgctcggcgaccgttggatcctcaccgctgctcacactctgtatcccaaagaacatgaggctcagagtaatgctagtctagacgtgttcctcggtcatactaatgttgaagagctgatgaagctgggcaatcacccgatcagacgagtttccgtccaccccgactaccggcaggatgagtcatataactttgagggcgacatcgccctactggaactggaaaattcagtgacgcttggaccgaatttgcttcccatatgtctgcctgacaatgataccttctacgatcttggactgatgggctacgtgtccggctttggggtaatggaagagaaaatcgcccatgatctacgtttcgtgcgcttgccagtcgctaacccacaggcctgtgaaaactggctccgcggtaagaatcggatggacgttttctctcaaaacatgttttgcgcgggacatcctagcctaaaacaggacgcctgtcaaggggactccggtggagtctttgctgtgcgtgacccgaatacagaccgatgggtggccaccggaatcgtttcctggggtattggatgttcacggggatacggtttttacaccaaagttctcaattatgtcgactggatcaagaaagagatggaggaggaagattag

SEQ ID NO: 218962 - DNA, 1131 bp, Artificial Sequence
  Description of Artificial Sequence: Synthetic coding sequence
atgtggctgctgtatctattggtacccgcactcttctgcagagcgggtggcagcattccaattccccagaaattgtttggtgaggtgaccagccccctcttccccaagccatatccaaacaacttcgagactacgaccgtcatcaccgtccctactgggtatcgggttaagctggtatttcagcaattcgacctcgaaccttctgaaggatgcttttacgattacgttaagatctccgctgacaaaaaaagtttaggcaggttttgcggacagctgggctcacccttgggaaatcctcccggaaagaaggaatttatgtcacagggcaacaagatgctgctgacgttccacacagacttttcaaatgaggagaacggaaccatcatgttctacaaagggtttctggcatactatcaggccgtggatctggacgagtgcgcctcccgatcaaagagcggggaggaggacccccagccacagtgtcagcacctgtgccacaactacgtgggtggttacttctgttcctgtagacctggttatgaacttcaggaggacaggcacagttgtcaggctgagtgtagctcagagctatatactgaggcaagtggatatatttccagtctcgagtatccccgaagctaccccccagacctgcgttgcaactactcgatacgcgtagaaaggggcctgacacttcatctcaagtttctggaacctttcgacatcgatgatcatcagcaggtgcattgcccgtatgaccagctgcaaatctatgcgaacgggaaaaatattggcgagttctgtggcaaacagcggccacccgacctggatacatcttctaatgctgtagatttgcttttttttacagacgagagcggagactctaggggctggaagctgcgatataccaccgagattattaaatgtccacagccaaagacactcgacgagtttactatcattcagaatctccagccacaataccaattccgagactacttcatcgccacatgcaagcaggggtatcaacttatagagggttgtacccccgcacagcacagagcgttcggcagaatgaatcgcagggagcggcgattcctgggggcatgtcagtgcgtggggagtccttag

SEQ ID NO: 218963 - DNA, 1962 bp, Artificial Sequence
  Description of Artificial Sequence: Synthetic coding sequence
tggttattgtatctgctcgtgcccgcattattttgtcgcgctggtggttctattccaattccccaaaagctctttggggaggtaacaagccctttattccccaagccatatcccaacaactttgagacaacaactgtaatcacagtgcctacaggctatcgagtcaagctggtctttcagcaattcgacctagaacctagtgagggttgtttctacgattatgtcaagatcagcgctgataagaagtccttgggacgcttctgcggtcagctgggttctccattggggaacccgcctgggaagaaagagttcatgtcccagggaaacaagatgctcctcacattccacaccgacttcagcaatgaagagaacgggacaatcatgttttataaggggtttctggcttactaccaagcagtcgatctggacgagtgtgccagcagatctaaatcaggagaggaggaccctcagccccaatgtcaacacctctgtcataattatgtcggcggttatttctgctcctgcaggcctggttacgagctccaggaagacaggcattcgtgccaggcagaatgtagctccgagctgtataccgaggcctccggatacatctctagcctggagtatcccaggtcttacccgcctgacctgcggtgtaactacagcatcagagtagagcggggacttacattgcacctaaaatttctggagccgtttgatatagacgaccaccagcaagtccactgcccctacgaccaactgcagatttacgcaaatggcaaaaacatcggagagttttgtggaaagcaaagacctccagatttggatacaagcagcaatgcagtcgacctccttttttttaccgatgagtccggcgacagccggggttggaaactcagatacaccacagagataattaaatgccctcagcctaagactctcgacgaattcactatcattcagaatctgcagcctcaatatcagtttagagattattttatcgctacctgcaaacaaggatatcagctcatcgaaggaatccaggttgttgccggagtggtcgacgtttccgcagggagggtatcatggtctacttctagccagacctgctgtacaagagtttacacatgcacagctcagggcatctggaagaatgagcagaagggcgaaaaaatcccccgatgtctgcccgtctgtgggaaacccgttaacccggtggaacagcggcagagaataatcggtggtcagaaagcaaaaatgggtaacttcccctggcaggtatttaccaacatccacgggcgtggaggtggcgcactgctaggtgatagatggattctgacagccgcacacaccctttatccaaaagagcatgaggcgcagtctaacgcaagtctggatgtgtttctcgggcataccaatgttgaggaattgatgaagctcgggaaccatccgatccgcagggtaagtgtgcacccagactatcgccaagacgaaagttacaacttcgagggagatatagcactacttgagctggaaaattctgtgactctggggccaaacttgctccccatttgcctgccagataacgacaccttctatgacctcggtttgatgggatatgtatccggcttcggggtgatggaggagaagatcgctcacgatttaaggttcgtgcgtttgcctgtagcaaatccgcaggcctgcgagaattggctgcgtgggaaaaacagaatggatgtattcagccagaatatgttttgcgcaggacacccatccctaaagcaggatgcttgtcagggggactcaggcggagttttcgcagtccgggatccgaatactgacagatgggtcgcaacagggatcgtctcttggggtatcggttgctctcgcggttatgggttttacaccaaagtgttgaattatgtggattggatcaagaaggaaatggaggaagaagactag

SEQ ID NO: 218964 - DNA, 1464 bp, Artificial Sequence
  Description of Artificial Sequence: Synthetic coding sequence
atgccaggcccaagggtttggggaaagtacttatggcgatctccccattctaagggatgtcccggtgccatgtggtggctgttactgtggggagtcctgcaggcctgccctacgagaggaagtgtccttcttgcacaagaactgccacagcagctcacttcgccaggatatcccgaaccctatgggaaaggccaggaatcgtccaccgacatcaaagccccagagggctttgccgtaaggctcgtcttccaggattttgacctggagccaagtcaggattgcgccggagacagcgtcactatctcttttgtggggagtgacccttctcaattctgtgggcaacaggggagccccctggggaggccaccagggcagcgcgaattcgtttcctccggtcggtccctgaggttgacattcagaactcagccatcttccgaaaataagacagcacacttgcataaaggatttttggctttgtaccagaccgtcgctgtgaactactcacagcccatttccgaagccagtaggggaagcgaggcaattaacgctccgggagacaatcctgctaaggtacagaatcactgtcaggagccttactaccaggctgctgcggcaggagcactcacctgtgcaacgcctggcacatggaaggacaggcaggacggtgaagaggtgctgcaatgcatgcctgtgtgcgggagaccagtgacccccattgcccaaaatcagactacccttggatcctccagggcaaaacttggaaactttccctggcaggcattcacctccatccacggccgaggcggtggggctctgttaggagatcggtggatcctgaccgccgctcatacaatataccctaaggacagcgtatctctgcggaagaatcagagcgtcaatgtcttcctcgggcacacagccatcgacgagatgttaaagctcggtaatcatccagtccatcgcgtggtggtacatccagattacagacagaacgaatcgcacaactttagtggagatattgctcttcttgagctccagcattcaataccgctggggccaaacgtcctgcccgtctgtcttcctgataatgaaacactctatagatcaggactgctcggctacgtctctggctttgggatggagatgggatggctcaccaccgagctgaaatatagcaggctgccagttgcaccgcgtgaggcatgtaacgcttggcttcagaagagacaaagaccggaagtgttttccgataatatgttctgcgtaggcgatgaaacgcagcgccattctgtttgccagggagactctggtagcgtatatgtcgtttgggacaaccacgcccatcactgggtggctaccggaattgtaagctggggcattggctgcggcgagggctatgatttttacactaaggtgctgagctacgtggactggataaagggcgtgatgaacgggaaaaactag

SEQ ID NO: 218965 - DNA, 1317 bp, Artificial Sequence
  Description of Artificial Sequence: Synthetic coding sequence
atgcccggtcccagggtttggggtaagtacctgtggaggtccccccacagcaaaggttgcccgggagccatgtggtggctcctgctatggggggttctgcaggcctgtcccacaaggggaagtgtactgcttgcccaggaactccctcagcagttgaccagtcccggttacccagaaccctacgggaaggggcaggagagctcaacagacattaaggctcccgaggggttcgcagtccggctggtgttccaggattttgacctggaaccttcccaggactgcgccggtgactccgtgacgatttcgtttgtggggtctgatccctcccagttttgcggacaacagggatccccactgggtaggccaccaggccaacgagaatttgtttcctcaggtcgctccctaaggctgaccttccgcactcaaccctcaagcgagaataaaacggcccacctgcacaagggattcctcgcgctgtatcagaccgtggctgtgaattattcacagcccattagcgaagctagtaggggctctgaagcaattaatgcccctggagacaatccggcaaaggttcaaaatcactgccaggagccatactaccaggcagccgcagcaggggcactgacctgcgccacaccaggaacatggaaagacaggcaggatggagaagaggtacttcagtgtatgccagtgtgcggcaggccagtgacaccaattgcccagaatcagactaccctggggtcctctagggccaagctcggcaacttcccctggcaagcatttacatccattcacgggcgtggcggtggcgctttgctgggagacaggtggattctcacagcagcccacacaatctatccaaaggactcagtgagcctgagaaagaatcagagcgtgaatgtctttctgggacacacggccatcgatgaaatgctgaagttaggaaaccatccggtgcatagggttgtggtgcacccagactatcggcagaacgagagccataacttttcaggcgacatagcactcctggaactgcagcatagcattcccctgggacctaacgtgctgccagtctgcctcccggataacgagaccctgtatagatcaggactactgggctacgtgagtggctttggaatggagatggggtggctgacgaccgaactcaagtacagtcgtctgcctgtggctcccagagaagcgtgcaacgcatggcttcagaagcgccagcgcccagaagttttctctgacaacatgttctgcgtgggggacgaagcgggtgagtcactggagcccggtaggaggcgtttgcagtag

SEQ ID NO: 218966 - DNA, 2067 bp, Artificial Sequence
  Description of Artificial Sequence: Synthetic coding sequence
atgtggtgtattgtgcttttttcgctgctcgcatgggtctatgctgagcccaccatgtacggggaaattctctctcctaactatccccaggcataccccagtgaggttgaaaagagttgggatatagaagttcctgagggttacggtattcacttgtacttcactcaccttgatattgagttatctgaaaactgcgcctatgactccgtacagatcatttcgggcgatactgaagagggtagactatgcgggcaacggtcatccaacaaccctcatagtccaatcgttgaggagttccaggtgccatataataagctccaggtgatcttcaagagtgacttcagtaacgaggaaaggttcaccggttttgccgcttattacgtggccactgatattaatgagtgcacagactttgtagacgtgccttgcagtcacttttgtaataactttataggtgggtacttttgtagttgtccacctgaatacttcctgcacgatgacatgaaaaattgcggggttaattgctccggagacgtatttactgcactcatcggcgagattgcctctcccaactatccaaagccttacccggagaactcgcggtgcgaatatcaaatcaggctcgagaagggcttccaagtggttgtcactttgaggagagaagacttcgacgtggaggctgccgattcagccggaaactgccttgactccctcgtgtttgtcgccggagatcggcaattcggaccgtactgcggtcatggatttcctggccctctgaatatcgagacaaaatcgaatgccttggatattatctttcagacagacctgaccgggcaaaaaaaaggctggaaattgcggtatcatggggaccccatgccctgccccaaagaagacacccctaactctgtgtgggagcctgctaaagccaaatacgtgttcagagatgttgtgcagattacctgtttagacggttttgaggtggttgagggcagggtgggagccaccagcttctattctacctgccaatctaatggtaagtggtccaactccaaactgaaatgccagcccgtggactgcgggattcctgagtccattgagaacgggaaggtcgaagacccagagagtaccctgttcggaagtgttataaggtatacctgtgaggagccctactactatatggagaatggcggaggtggggagtatcattgcgctggtaacggctcttgggtcaatgaggtgctgggaccagaactccccaaatgtgtccccgtttgtggagtccctcgcgagccgttcgaggagaaacagcgaattattggcggttcagacgccgatattaagaacttcccttggcaggttttcttcgataacccatgggcagggggtgctttaatcaatgaatattgggtgctgactgctgcacacgtcgtcgaaggaaatcgcgaacctaccatgtatgttgggtccacctccgttcagactagcagacttgccaaatctaagatgctgacccctgagcacgtgtttattcaccccggatggaagttgctcgaagtgcctgagggcagaacaaattttgacaatgatatagcactcgtgcgcctgaaagatcccgttaagatgggtcctacagtgagccctatttgtctccccggtacgtctagtgattacaacctcatggatggagatttagggctgatttctgggtggggaaggaccgaaaagcgagatagggctgtgcgtctaaaggctgctcggctaccggtcgctcctctgaggaagtgtaaggaggtgaaagtggaaaaaccaactgcagatgccgaggcttatgtgtttacgccgaacatgatctgcgcaggaggtgaaaagggcatggattcttgtaaaggagattcgggaggggcatttgcggtccaagaccccaacgacaagacaaaattttatgctgccggtttggtgagttggggccctcagtgcggtacatacggactgtatactagagtgaaaaactacgtggactggatcatgaaaacgatgcaggagaattcgacacctcgagaggactag

SEQ ID NO: 218967 - DNA, 2067 bp, Artificial Sequence
  Description of Artificial Sequence: Synthetic coding sequence
atgtggtgcatcgtactgttttccttattggcttgggtgtatgcagaacctacgatgtacggcgaaattctgtcgcctaactatccacaggcctatccctcagaagtggaaaagtcatgggatattgaggtgccagaaggctacggcatccatttgtactttacacatctggacatcgagctgtctgagaattgcgcctatgacagcgtacagataattagcggggatacggaggaaggtcgcttgtgcggacagaggagctccaacaacccccacagtcccattgtggaggagtttcaggtcccctacaacaagcttcaagttatattcaagtcagatttctcaaacgaagagcggttcaccgggttcgctgcatattacgtcgcaactgatataaacgagtgtacagattttgtggacgtcccatgtagccatttctgcaacaactttatcggtggatatttctgtagttgcccccctgagtattttcttcacgacgatatgaagaactgtggagtcaattgttcaggtgacgtgttcacggcattgattggagagatcgcttcccctaactacccaaagccataccccgaaaacagcagatgtgaatatcagatccgattagaaaagggcttccaggtggtagtaacgctccgtcgcgaggacttcgacgtcgaggcagctgactccgcgggaaactgcctggacagtttggtctttgttgcaggagacagacagtttggaccctactgcggacacgggttccctgggcctctgaacatcgaaactaagtcaaacgcactggatatcatctttcaaaccgacctaactggccagaagaaagggtggaagctgagataccacggagaccccatgccttgccccaaagaggataccccaaattctgtttgggagcctgccaaagccaagtatgtttttcgggatgttgtgcagatcacatgcctcgatgggttcgaagtggtggagggtagagtcggagctacctcattctacagcacttgtcagtcaaacggaaagtggtcgaacagcaagttaaaatgccagcctgtggactgtggtattccagaatcaattgaaaatggaaaagtggaggaccccgagtctaccctcttcggatctgtgattaggtacacttgtgaggagccatattactacatggagaacggaggtggaggcgaatatcattgtgccggtaacggaagttgggttaacgaagttctaggccctgaattgcctaaatgtgtgccggtttgtggcgtccctcgagagccatttgaagaaaagcagcgtatcatagggggatctgacgctgacattaagaattttccatggcaagtgttcttcgacaatccttgggctggcggtgcccttattaatgaatactgggttctgacagcagcccacgtcgtggagggcaacagggaacccactatgtacgttggtagcacttctgtgcagactagccgcttggccaagtctaaaatgttaactccggaacacgtgttcatccatccgggatggaagctgctggaagtccctgagggccgaacgaattttgacaatgacatcgctctggtgagactcaaggaccccgtgaagatgggccctacggtgtcccccatctgtctccctggcacctcctctgattataaccttatggatggagacctcgggctaatctccggctggggtaggaccgaaaagagggaccgggcagtccgcttgaaggctgctagactgcctgtcgccccactgcgcaaatgcaaggaggtgaaggtggagaagccaactgccgacgctgaggcatacgtgttcaccccaaacatgatctgtgccggtggggaaaaggggatggactcctgcaaaggcgattcagggggagccttcgccgtgcaagatcccaacgacaaaacaaaattttacgcggcagggttggtgagctggggccctcaatgcggcacctatggtttgtatacccgcgtgaaaaattacgttgattggatcatgaagacgatgcaggaaaacagcactcctagagaagactag

SEQ ID NO: 218968 - DNA, 2049 bp, Artificial Sequence
  Description of Artificial Sequence: Synthetic coding sequence
atgtatggcgaaatcctttcccctaactatccccaggcctacccctccgaagtcgagaaatcatgggacatcgaggtccctgaggggtacggaattcacctgtattttacccatctggatatagaactgtccgagaactgcgcatacgattccgtgcagataatttcgggcgataccgaggagggaaggttgtgcggacagagatcatcgaacaacccacactctccaatcgttgaagagtttcaagtgccgtacaataagttgcaggtcatattcaagtctgacttctccaacgaggagcggttcactggttttgccgcttattatgttgcaacagataaagacgagtgctccggccgagcgcagctctggaaccacatgagcgatgtaccatgtagccatttttgtaataatttcattggaggttacttttgctcatgcccgccagaatactttcttcatgatgatatgaaaaattgcggagtgaattgctctggtgatgtctttacggccctcatcggagagatagccagccctaactaccctaaaccctatccagaaaactcacgatgtgagtatcagatccgattggaaaaggggttccaagttcacctgtcgctgctcctcaagcttgaatgtagcggcgcaatcacggcccactgctccctggaccttctgggcagcatagctggtgaccggcagtttggaccctactgtggacatggtttccccggtcctctgaacatcgaaacgaagtctaatgccctggatatcatcttccaaacagatctaacaggacaaaagaagggatggaaattgcggtaccatggagatcccatgccttgccctaaggaggatactcccaattccgtttgggagccagccaaggccaaatatgtgttccgcgatgtggtccaaattacatgtctggatgggtttgaggtcgtggaaggacgagtgggcgcaacttctttttactccacatgccagtctaacggtaagtggtcgaacagtaaactaaagtgtcaacccgtcgactgcgggatccctgagtcaatcgagaacggaaaagttgaggatccagagtctacattattcggcagcgtaatcaggtacacgtgtgaagagccttactattatatggagaacggtggaggtggcgaagagcgggagcgaggagagtatcactgcgcgggtaacggatcttgggtaaacgaagtcctgggccctgaacttcctaaatgcgtacccgtctgtggggtcccaagggagccgtttgaagagaagcagcggattatcgggggaagcgacgccgacatcaaaaatttcccttggcaagtgtttttcgacaatccctgggctgggggagccctcattaatgagtattgggtgctgaccgccgctcatgttgtggagggcaatcgagagccaacaatgtacgttggaagcacctcggtgcagacctcaaggttagctaaatctaagatgctgacccctgaacacgtgtttattcatcctgggtggaaactgctggaggtacccgagggtagaaccaacttcgataatgacattgctctggtgcgcctcaaggacccagtgaagatgggacccaccgtgtcccccatctgtttaccaggtacgtcaagcgactacaaccttatggacggcgacttgggattgatttcaggctggggaaggacggagaagagagacagagccgtaagactcaaggccgcacggctgccagtggctcctctgcggaaatgcaaagaggtgaaagttgagaagccaaccgccgatgccgaggcttatgttttcacacccaacatgatttgtgcaggaggagaaaagggaatggactcctgtaaaggggacagtggaggcgcattcgcagtacaggatcctaacgacaagactaaattctacgcagcgggactagtatcctggggcccacaatgtgggacatacgggttgtatacccgcgtgaagaattatgtagattggatcatgaagactatgcaagagaacagtacaccacgcgaagattag

SEQ ID NO: 218969 - DNA, 507 bp, Artificial Sequence
  Description of Artificial Sequence: Synthetic coding sequence
atgtggtgcattgtgttgttctctctgttggcatgggtatacgccgaaccaacgatgtacggtgagatcctcagtcccaactacccccaggcttacccaagcgaggttgaaaagtcatgggacattgaagtgcccgaagggtatgggatccatctgtatttcactcatttggacattgagctatccgagaactgtgcatatgactccgtgcagattatcagcggggatacagaagagggaagactgtgcggccagcgcagctccaataatccacatagtccaatcgtggaggagtttcaagttccatacaataagctccaagtcatttttaagagcgacttttctaatgaggagcggtttacaggatttgcagcttactacgtggcaacagatatcaatgaatgcaccgacttcgttgatgtgccatgctctcacttctgtaacaacttcatcggaggttatttttgctcatgcccgcctgagtacttccttcacgatgatatgtag

SEQ ID NO: 218970 - DNA, 2067 bp, Artificial Sequence
  Description of Artificial Sequence: Synthetic coding sequence
atgtggtgcatcgtgttattcagtctgttggcatgggtgtacgccgagccaacaatgtacggggagatcctctcccccaactatccgcaggcctacccctctgaagtggaaaaatcttgggatatagaggttcctgaaggttacgggatccatctgtactttacccatctggacattgagttgagcgagaactgcgcctacgattcagttcaaattatttccggagatactgaggagggtcggttatgtggccagcgcagctcaaataaccctcatagcccgatagtggaggagttccaagttccttataataagcttcaggtgattttcaagagtgatttctccaacgaggaacgattcaccggtttcgctgcttactatgtggcaaccgatatcaatgaatgtacagattttgtggacgtgccttgctcccacttctgcaacaacttcatagggggttatttttgtagctgcccccctgaatacttcctgcacgatgatatgaagaattgcggcgtgaactgctcaggggatgtgttcaccgcacttataggagaaatcgcatcaccgaactaccccaaaccctacccagagaattcccggtgtgaataccagattcgcttagaaaaaggattccaagttgtggtgacactaaggagagaggatttcgatgttgaggctgctgactcagctggtaattgtcttgattccctcgttttcgtagcgggagacaggcagttcggaccttactgcggacacgggttccccggacccttaaacatagaaaccaaaagcaacgccctcgatataatctttcagaccgatcttaccggacagaaaaagggatggaagctgcgataccacggtgacccaatgccgtgtccaaaggaagatactcccaatagcgtgtgggaacctgccaaggctaaatacgtgtttcgggatgtggtgcagatcacgtgtctggacgggttcgaggtcgtggaaggcagggtgggagcgacctcattttacagcacctgtcagtcaaatggaaagtggtcgaactctaagctgaagtgtcagcccgtggactgtggtatacctgaaagcattgaaaacggcaaggtggaggatccggaatccacgctgttcgggtcggttatcaggtatacctgtgaagagccttattattacatggaaaacggtgggggtggtgaataccactgtgcaggaaacggtagctgggtgaatgaggtgctaggcccagagttgcctaaatgcgtgcccgtgtgtggagttcccagggagccctttgaggaaaagcagcgcattattggcggtagcgacgcggatatcaagaacttcccgtggcaggtgttctttgacaacccctgggccggaggtgcccttattaacgagtactgggtgcttacggcagcccacgtggttgagggcaaccgtgaacctactatgtatgtgggctccacaagtgtccagacaagccgcctggcgaagtctaaaatgctgactcccgagcacgtgtttatccaccccggatggaaattgttggaggtgcctgagggcagaactaactttgataatgacatcgccctggtgcgtttgaaagatccggttaagatggggccaaccgtgagccctatttgcttacccggaacatctagtgactacaaccttatggatggagacctaggcttgatctccggctgggggcgtaccgagaagcgggaccgggcagtccggttgaaagctgcccgtcttcccgtggccccactgcgaaaatgcaaggaggtcaaggtggaaaagccaactgccgatgccgaagcttatgtgttcacgccgaatatgatatgcgcaggcggagaaaaggggatggactcatgcaaaggcgacagcggaggggcattcgccgtgcaggaccccaacgacaagacaaagttctatgcagccggactggttagctggggtccacaatgcgggacatatggcctttatactcgcgtaaagaactacgtcgattggataatgaagaccatgcaagaaaattcaacccccagagaagactag

SEQ ID NO: 218971 - DNA, 312 bp, Artificial Sequence
  Description of Artificial Sequence: Synthetic coding sequence
atgtggtgtatagtcctattctccctgctcgcctgggtgtacgcagaaccaaccatgtacggcgagatcctttctccaaactacccacaggcctacccaagcgaagtcgagaaaagctgggacattgaagtgcctgagggctatggcatccacttatacttcacccacctggacatcgaactctccgagaactgcgcctatgattcagtccaaatcatatctggtgatacagaagagggcaggctgtgcggacaaagatcctccaataatcctcattctcccatcgtggaagaattccaggtgccttattag

SEQ ID NO: 218972 - DNA, 306 bp, Artificial Sequence
  Description of Artificial Sequence: Synthetic coding sequence
atgtggtgtattgtacttttctctctgctggcatgggtttatgccgaaccaaccatgtacggtgaaatcttatcccctaattacccccaggcctatccatctgaagtggagaagagctgggatatcgaagtcccagaagggtacggcatccatctctatttcacccacttagacatcgaattaagtgaaaattgcgcctatgattccgtccaaattatctctggagatactgaagagggacggctgtgcgggcagaggtcttccaacaatccccactctccaatcgtggaagaattccaggtgtag

SEQ ID NO: 218973 - DNA, 2259 bp, Artificial Sequence
  Description of Artificial Sequence: Synthetic coding sequence
atgggcccactgatggtgctattttgcctcttattcctgtatcctgggcttgctgacagcgccccatcgtgcccccaaaatgtgaatatatccggcggtaccttcacactgtctcatggttgggctccaggatcactgctgacatattcatgcccgcagggattgtaccccagcccggcaagtcgcctatgcaaatctagtgggcagtggcagacgcccggtgccacgcggtcgctcagtaaggccgtttgtaaacccgtgagatgccctgctcctgtctccttcgaaaatggaatctacactccaaggttgggatcctatcctgtaggcggtaacgtgtccttcgagtgcgaggatggctttatattaagaggcagcccagtgagacagtgtcgcccaaacggaatgtgggacggcgaaaccgcagtctgtgataatggagcgggacattgccccaaccctggaatctcactgggagctgttcgaaccggtttcagatttggtcatggggacaaggtgagatataggtgctcttccaaccttgtgctgacggggtccagcgaaagagagtgccaagggaatggggtatggtctggcacagagccaatctgtcgacagccgtactcctacgacttcccagaagacgtggcacctgctcttggcacttctttctcgcatatgctcggagccacaaaccctacacagaagaccaaggaaagtctgggacgcaaaatacagattcagcgcagcggtcatcttaacctgtatttactgctcgactgttcccagtctgtctcagagaatgactttcttatcttcaaggagtctgccagtcttatggtggaccgaattttctctttcgaaataaatgtatcagtggctattattactttcgcttctgagcccaaagtgctgatgtctgtcctgaacgacaactctagggacatgacagaagtcatctctagcttggagaatgcaaattataaagaccatgagaatggcaccgggacaaacacgtacgcggctctgaactctgtctatctcatgatgaacaatcagatgcggttgctgggtatggagaccatggcttggcaggaaattcgccacgccatcatactgctgaccgatggcaaatcgaacatgggtgggtctccaaaaactgccgtagaccatatcagggagatactgaacataaatcaaaagagaaatgattatttggatatctacgctattggagtcggcaagctggatgtcgactggagggagttgaacgaattgggttcaaagaaagatggggagcgccacgcctttatccttcaggacaccaaggccctccatcaggtgttcgagcacatgctggatgtaagtaaacttactgacaccatctgcggcgttggcaatatgagtgcaaatgcctccgatcaggaacgcacaccctggcatgtcactatcaagcccaaaagccaggagacatgcaggggagcccttatttctgatcaatgggtgctgaccgctgcccactgtttcagggacgggaatgatcactccttgtggcgcgttaacgtgggtgatccaaagtctcagtggggtaaagaatttctgattgagaaggctgtgatctccccaggttttgacgtctttgccaagaagaaccagggtattctggaattttatggagacgatatcgccctgctaaaactggctcagaaagttaagatgtctactcatgccaggccaatctgtctgccttgtacgatggaggctaatctggcccttcgcaggcctcagggctccacctgtcgggaccacgagaacgagctgctcaataagcagtccgtccccgctcactttgtggcactgaacggaagcaaactcaacattaatctcaaaatgggcgttgagtggacatcatgcgccgaggtcgtgtcccaggaaaaaaccatgtttcccaatctgacagacgttagagaagtggttacggaccagtttttgtgctctggcacacaggaggacgagtccccatgtaaaggcgaatccggcggagcagtgttcttggagaggagatttagattttttcaggtaggactagtcagctgggggttgtataacccttgccttggaagcgcagataaaaattccagaaaaagagccccacgctccaaggtccctccccctagagattttcacattaatctctttaggatgcagccctggttaaggcagcatcttggcgatgtgttaaattttttacctttgtag

SEQ ID NO: 218974 - DNA, 1134 bp, Artificial Sequence
  Description of Artificial Sequence: Synthetic coding sequence
atgactgaggtcatttcttctctggagaacgccaactataaggatcatgaaaacggtacaggcaccaacacttacgctgctttgaatagcgtgtacctcatgatgaataaccaaatgaggcttttgggaatggaaacgatggcatggcaggagatccgccatgcgatcatccttctgactgatggaaagagtaacatgggaggaagtcctaagaccgccgtggaccacattcgagaaattctgaacatcaaccagaagcgaaatgactatcttgatatatatgctattggtgtgggaaagttggacgtggactggagagaattgaacgaattgggcagcaaaaaggatggtgaaagacacgccttcattctgcaagatactaaagccctccatcaggtattcgagcatatgctggatgtgtccaagctcaccgatacaatttgtggggtggggaatatgagcgctaacgcgagcgaccaggagcgtaccccatggcacgtgacaatcaagccgaagagccaggaaacttgtcgcggtgctttaatctccgatcaatgggtgctgacggctgcccattgcttcagagacggaaatgaccactcgctctggcgggtcaacgtcggcgaccctaaatcacaatgggggaaagaattcctgattgaaaaagcagtcatttctcccggattcgatgtcttcgccaagaagaaccagggtattctggagttctatggtgacgatatcgcgttgttaaaactggctcagaaagtaaagatgtctactcacgctcggcctatttgcttgccttgtacgatggaggcaaatcttgccctgcgaagaccgcagggctctacgtgcagggatcatgagaacgaactgctgaataagcagagcgttcctgcccacttcgtggctctcaatggcagtaagctgaatattaacctgaagatgggggttgagtggaccagttgcgcagaagtcgttagccaagagaagaccatgttccccaatttaacagatgtacgtgaagtagtgaccgaccagttcctctgcagcggaacccaagaggacgagagcccctgcaagggcggtagcggggagcttgggagtttgcagcccctaccgtggctgtgttag

SEQ ID NO: 218975 - DNA, 2259 bp, Artificial Sequence
  Description of Artificial Sequence: Synthetic coding sequence
atgggtccactgatggtgcttttctgcttactgtttctctaccccggtttagcggattcagccccttcttgtcctcagaacgttaacatctcagggggaacctttactctcagtcatggatgggccccagggtccctacttacgtattcatgtcctcaaggcctgtacccatccccggcatctcgattatgcaagtcctcaggccagtggcagaccccaggagctacaaggtcccttagtaaggccgtgtgtaagcctgtgcgctgccctgctccagtatcttttgaaaacgggatttatactccacgacttgggagctatccagtgggagggaacgtctcctttgagtgcgaggatgggttcatactgagaggcagccctgtgaggcaatgcaggcccaatggcatgtgggacggtgagacagctgtctgcgacaacggcgctggtcactgtccgaaccccggtatttcattgggtgctgtccgcaccggctttagattcgggcacggagataaggtgcgctacaggtgttcaagtaacctcgtccttacgggctctagtgagcgggaatgtcagggcaatggcgtgtggagtggtacagaaccgatctgtagacagccatactcttacgatttccctgaggatgtcgcgcctgcccttggcacttcctttagtcacatgctgggagccacaaacccgactcagaagacaaaggagtctctcggacggaagatccagattcaacgtagcggacatctgaatctctacctgctgctcgattgttctcagagtgtgtcagaaaatgactttctcatcttcaaagagtctgcgagcttaatggtcgacaggattttcagttttgaaataaacgtgtccgtggccatcatcacctttgcctctgagccaaaggtattaatgagcgtgctgaatgataactctagagatatgaccgaggtcattagctccctggagaacgccaactacaaggaccacgaaaacggaacaggtactaatacctacgccgctctaaacagcgtgtatctgatgatgaataatcagatgagacttttgggtatggaaaccatggcctggcaagaaatccgccatgccattattctcttgactgatgggaagtctaacatgggaggttcacccaaaactgccgtagaccatatacgggaaattctgaacatcaaccagaaaagaaacgactatcttgacatatatgccataggagtggggaagctggatgtcgactggcgcgaattaaatgaattgggaagcaaaaaggacggtgaacgccacgccttcatcctccaagataccaaggctctccaccaggtattcgagcatatgcttgacgtcagtaaactgacagacaccatctgcggtgtcggcaatatgagtgctaacgcctcagaccaggagcgcaccccatggcacgtaacaatcaaacctaagtcgcaggaaacttgcagaggggctctaatctctgaccagtgggtcctaacagctgcacactgcttcagggatggcaacgaccactccctgtggagagtgaacgtgggggacccaaagagtcaatggggcaaggagttcctgattgaaaaggccgtgattagccccggatttgatgttttcgctaagaaaaatcaggggattctagaattttacggcgacgatatcgccctcttgaagcttgcacagaaggtgaagatgagcacccacgccaggcctatctgcctaccttgcaccatggaagcaaatctcgccctacggcgaccacaaggcagcacatgccgggaccatgagaatgagctcttaaacaaacagtcagtaccggctcatttcgtagcgcttaacgggagtaagctgaatattaacctgaagatgggagtagaatggacgtcctgtgctgaggtagtcagtcaggaaaagaccatgtttcccaatcttactgatgtgcgtgaggtggtgacagaccaatttctgtgctccggcacacaggaagacgagagcccatgtaaaggcgagtcaggaggggctgtattcttagagcggagatttaggttcttccaggtaggattagtctcctgggggctgtacaatccttgcttaggcagcgccgataagaactctcggaagagagctcccaggtccaaagtgcctcctcccagggatttccacattaacttattccgtatgcagccttggctgagacagcacctgggggatgtccttaatttccttccactgtag

SEQ ID NO: 218976 - DNA, 1578 bp, Artificial Sequence
  Description of Artificial Sequence: Synthetic coding sequence
atggttttattctgccttttgttcctctaccccgcagggcattgtcccaacccaggaatttccctgggagccgtgcgaacagggttccgttttggccacggcgacaaagtgcggtatcgatgtagctcaaatctggtgctgaccgggtcctcagaacgtgagtgtcagggcaacggagtgtggagtggtaccgagccaatttgcagacagccatacagctacgacttccccgaggacgtggccccagcacttggtacttccttctctcacatgttgggcgcaaccaaccctactcagaagactaaagaccacgaaaacggaacgggaaccaacacctacgcagccctcaattccgtgtacctaatgatgaacaatcaaatgagactcctcgggatggagaccatggcctggcaggagatcagacacgcaattattttactcacagacggtaagagcaacatgggtgggagcccaaagaccgccgtcgatcatatcagagaaatactgaatatcaatcagaagcgcaatgactatctggacatctacgcgatcggtgtgggcaagctcgatgttgattggcgcgaactaaatgagcttggctccaaaaaggacggggaaagacacgccttcatactgcaggacacaaaggccctacatcaggtgttcgagcatatgctggatgtatctaagttgacagacaccatttgcggagttgggaacatgagcgctaatgcatccgatcaagaacggaccccttggcacgtgactattaagcctaagagtcaagagacctgtagaggcgctctcatcagtgatcaatgggtgcttacagctgcccactgttttcgcgatggtaatgaccatagtttgtggcgagttaatgtaggtgatccaaaatctcagtggggcaaagaatttctgattgagaaggctgttatcagccccggatttgatgtttttgcaaagaagaaccaggggattctagagttctatggggacgatattgctttgctgaaactggcacagaaagtaaagatgtcgactcatgccagacccatctgtcttccttgcacaatggaagcgaaccttgccctgcgtagaccacagggctctacttgtcgagaccacgagaacgagcttctgaacaaacagagcgtaccggctcacttcgtggctttgaacggtagcaaactcaatatcaatttgaagatgggcgtagaatggaccagttgtgccgaggtagttagtcaagaaaaaactatgtttccaaacttgaccgatgtgcgggaggtcgttaccgaccagtttctttgcagcggcactcaggaggacgagtccccctgcaaaggtgagtccgggggagctgtttttctcgagagaagatttagattcttccaggtgggactggtttcatggggtctgtataacccctgcctgggatcagctgataagaattctaggaagagagcgcctcgatctaaagtgcctccaccgagagacttccacatcaatctgtttcgtatgcagccctggcttagacagcatctgggtgacgtgttgaacttcttgcctctctag

SEQ ID NO: 218977 - DNA, 2259 bp, Artificial Sequence
  Description of Artificial Sequence: Synthetic coding sequence
atgggacctttgatggtgctgttttgccttctgtttctgtacccaggtcttgctgacagcgccccttcttgtcctcagaacgtaaatatctctggaggtacctttacactaagccacggatgggctcccggtagccttctgacttactcctgcccacaaggcctgtatccatcacccgcaagccggctgtgcaaaagtagcggccagtggcagacacctggggctacaaggagtttatcaaaagccgtctgcaagcctgtcagatgccccgcacccgtgagcttcgagaatggaatttacactccgagattggggtcttacccagtgggcggtaatgtctccttcgaatgtgaggacggatttattcttagaggatcgcccgtgagacagtgtcgcccaaacggaatgtgggacggtgaaactgccgtgtgtgacaatggagctggccactgtcctaacccagggatttctttgggcgcagtgcgcaccgggtttcggttcggacacggcgacaaggtgcgctaccggtgtagcagcaatcttgtcttgaccggtagttccgaaagagaatgtcaaggtaatggagtctggtctggtacagaacccatttgccgacagccttacagctacgactttccagaggatgtagctcctgcccttggtacttctttctcccacatgttgggagccacaaatccgacgcaaaagaccaaagagtcgcttgggaggaaaattcaaatccagaggtcgggacacctgaacctgtacctccttctggattgctcccagagtgtgtctgagaatgattttctcatatttaaggagtcggcgagcctcatggtcgaccgcatctttagctttgagattaatgtgagcgtcgcaataattacctttgccagcgagcccaaagtgctcatgtcagtattgaacgataatagccgcgacatgactgaggtgattagcagtttagagaacgccaactacaaggaccacgaaaacggtacagggactaacacttacgcagccctaaacagcgtttatctaatgatgaacaatcaaatgcgcctcctgggtatggagactatggcttggcaggagattagacacgctattattctgctgacagacggtaaatcaaacatggggggatctcctaaaacagcagttgaccacattagagaaatcctgaacatcaaccagaagcgaaatgactatctggatatctatgcaattggagtcggaaagcttgatgtggactggcgggaactcaatgagctgggttccaagaaggatggggagcgccatgcttttatcttgcaggacaccaaggccctccatcaggtgttcgaacatatgcttgatgtgtcaaagcttacagacaccatttgcggggtgggcaacatgtctgccaacgccagcgaccaggagcgcaccccttggcacgtgaccattaagccgaagagccaggagacatgccggggagcgttaatctcagaccagtgggtcctcacagctgctcactgctttagggatggaaacgatcactccctttggagagtaaacgtgggtgaccccaaatcacagtggggcaaggaattccttatcgaaaaggctgtgatcagtccgggattcgatgttttcgctaaaaagaaccagggcatcctggagttctacggcgacgatattgctctgctgaaattagcacagaaggtcaaaatgtctacacacgcaaggccaatctgtcttccctgcaccatggaagccaatctggctcttcggcgaccccagggaagtacctgccgggatcacgaaaacgaacttttgaacaagcaatctgtccctgcccactttgtagccttgaatggatcaaagctcaacattaacctgaagatgggggtggagtggacaagctgcgccgaagtggtgagtcaggagaagactatgtttccaaacctgaccgatgtgcgcgaggtggtcacagaccagtttctgtgctccggaacgcaggaggatgagtcaccctgcaaaggtgaatcgggtggagccgtctttcttgaacgacgcttccgcttctttcaagtggggttggtcagctggggcctctataatccctgtctcggcagcgcagacaagaactcccgcaagcgcgctcccaggtcaaaggtgcccccacctcgggacttccatattaacttgttcagaatgcagccatggctaagacagcacctgggtgacgtactgaatttcctccccctgtag

SEQ ID NO: 218978 - DNA, 1578 bp, Artificial Sequence
  Description of Artificial Sequence: Synthetic coding sequence
atggtgctgttctgtcttttgtttctgtacccggctggccactgcccgaatccaggaatctcgctgggagcagtccgcacggggttccgatttggtcatggggacaaggttcgttacagatgcagtagtaatttagtgctaacgggaagtagcgagcgagaatgccaggggaacggggtgtggagcggaacagaaccgatttgcaggcaaccttactcgtacgatttcccagaggatgtggccccagcattagggacgtcattcagccacatgctgggggctaccaatcccacccagaagactaaagaccatgaaaacggcaccgggactaatacctatgcagcattaaatagcgtttatttgatgatgaataatcagatgcgcctgttggggatggagacaatggcctggcaggagattaggcacgctatcatcctcttaacagacggaaagtccaacatgggcggtagtccgaaaaccgcagtggatcacattagggagattctaaatatcaatcagaagagaaacgattaccttgatatatatgccattggcgttgggaagctggacgtcgattggagagaactcaacgagttggggtcaaagaaggacggtgagcgccacgcttttatactgcaggacacaaaggcattacaccaggtatttgaacacatgctggatgtctccaagctgaccgacaccatctgtggcgtggggaacatgtctgctaatgcatctgatcaggagaggactccatggcacgtgaccattaaaccaaaatcgcaggagacctgtcgtggtgcgttgattagcgaccaatgggtgctgacagcagcccactgtttcagggatggcaacgaccactctctatggagggtgaatgtaggcgacccaaaaagtcagtgggggaaagaatttttgatagaaaaggctgtgatcagccctggcttcgatgtcttcgccaagaagaaccagggcatccttgagttctacggtgatgatatcgcgctgttgaagttagctcagaaggtgaagatgagcactcacgcaaggccaatctgcctgccttgcacaatggaggcaaatctcgccttgaggcgccctcagggcagcacctgccgggaccatgaaaacgagctactgaacaaacaaagtgtgcctgcccattttgtggctttaaatggctctaaactgaatattaacctcaagatgggcgtcgaatggacttcatgcgcagaggtggtttcccaagagaagacaatgttcccaaatctgaccgacgtgcgcgaggtcgtcactgaccagttcctgtgtagcggaacacaagaggatgagagcccctgcaaaggagaatcaggcggtgcagtgtttctagagcggaggttccgtttttttcaggtcggactggtgagctgggggctgtacaatccttgcttaggctccgccgataagaactcccgaaaaagagcacctaggagcaaagtgccgcctccaagagacttccatatcaatctgtttcgcatgcagccctggctgcgacagcacctaggcgacgttcttaacttcctgcccctttag

SEQ ID NO: 218979 - DNA, 2259 bp, Artificial Sequence
  Description of Artificial Sequence: Synthetic coding sequence
atgggaccgctgatggtgcttttttgcctgttatttctctatccaggcctcgctgattcagctcccagttgtccccagaacgttaacatctccggcggaacatttaccctttctcatggctgggcccctggtagcctgttaacatatagctgccctcagggcctttatcccagtcccgctagcagactatgtaagtcctctggacagtggcaaactcccggagccacgaggtcattgtccaaggccgtgtgcaagcctgtaagatgtcccgctccagtttcattcgagaacggcatctataccccgcgtctgggaagctatcccgtgggcggtaacgtgagctttgaatgcgaggacggttttatcctgagaggatccccagtgcgccaatgcagacccaatggcatgtgggacggagaaaccgcagtttgtgacaatggagcaggacactgccctaaccccggaatctcactcggagccgtaaggacagggtttcgctttggtcatggcgataaggtccgataccgatgctcctccaatctggtgctgactggctcgtcagaacgtgagtgccagggcaatggagtatggtccggcactgaaccaatctgtcgccaaccttattcctacgatttccctgaagacgtggctcccgctctgggcaccagctttagtcacatgctgggagcgaccaaccctactcagaaaacaaaagaatctcttggcaggaagattcagatccagcgatcaggacaccttaatctttatttgttacttgactgctcccagtctgtttcagagaacgattttctcattttcaaagagtccgcttctctgatggtcgatagaatttttagctttgaaataaacgtgagtgtggctatcattacgttcgctagcgaaccaaaagtcctgatgtctgtcctcaacgataattcaagagatatgactgaagttattagtagcctggaaaacgctaattataaagaccacgagaacggcaccggtactaacacctacgctgctcttaactcggtgtatctgatgatgaacaaccagatgcgcctgctgggaatggagaccatggcatggcaagaaatcagacacgccattattctcctcacagacggcaagtcaaatatggggggtagtccgaagacagcagtagaccacatacgagaaattcttaatatcaaccagaagcggaacgattatttagatatctatgctatcggcgtagggaagttggatgtcgactggcgcgaacttaacgagctggggtccaaaaaggatggagagagacacgcattcatcctgcaagacacgaaggcgttacatcaggtgtttgagcacatgctcgacgtgtctaagttaacagataccatctgtggggtaggcaatatgagcgccaacgctagcgaccaagagcggactccatggcacgtgaccatcaaacccaaatcgcaagagacctgccgtggggctctgataagcgaccaatgggtgctgaccgccgcacattgtttcagagatggtaacgaccacagtctctggcgggtgaatgtgggcgatcctaaatcacaatggggaaaagaatttctgattgaaaaagctgtgatctcccccggttttgacgtcttcgccaagaaaaaccagggaatactggaattctatggagacgatattgcccttttaaagctggcccagaaagtgaagatgtctacacacgctcgccctatctgtctgccttgcaccatggaggctaatcttgccttacgaaggcctcaggggtcaacctgccgtgaccatgaaaacgagctgttaaacaagcaatccgtgccggctcacttcgtggcactgaacggatcaaagctgaatatcaacctgaaaatgggggtagaatggaccagctgcgctgaagtcgtgtctcaggaaaaaactatgttccccaatctgacggatgtacgagaagtggtcaccgaccaatttttgtgcagcggaacacaagaggacgagtcaccatgtaaaggtgagagtggtggcgcagtgtttctggaacgtcgctttaggttttttcaggtgggactggtgagctggggcttgtacaatccttgcctaggttcagccgacaaaaatagtcggaaacgagcgccacggtctaaggtgccgcctcctcgtgatttccatattaacctcttcagaatgcagccgtggctgcgtcagcacctgggcgacgtcctgaatttcttgccgctctag

SEQ ID NO: 218980 - DNA, 420 bp, Artificial Sequence
  Description of Artificial Sequence: Synthetic coding sequence
atgggtcctttgatggtcctcttctgcctgctattcctctaccccggtcttgcggacagtgccccttcgtgtcctcagaacgtgaatatctcgggcggaacgttcacactgagtcatggatgggccccaggtagtctattaacttattcctgcccccaggggctgtacccaagcccagcttctcgcctgtgtaaatcttctggccagtggcagacccctggagccactcgcagtctgtcaaaggctgtatgcaagcccgtgagatgcccggcaccagtttcctttgagaatggtatatatacacctagactggggagttaccccgtgggaggaaatgtttcctttgagtgtgaggacggcttcatcctgcgcggttcccctgttaggcaatgccggccaaatggtatgtgggatggatag

SEQ ID NO: 218981 - DNA, 510 bp, Artificial Sequence
  Description of Artificial Sequence: Synthetic coding sequence
atgcgggcactttgcataagggagacgtgctccagtgagctgggattctcgcgtaactggtcccgccgaaaagctggccattgcccgaaccccggaatctcgctgggggcagtgcggacggggtttagattcggccatggcgacaaggttagataccgctgttccagcaacctggtgctgacaggatcatccgaacgtgagtgtcagggcaacggggtgtggagcggtactgagcctatttgtcggcagccctacagctatgatttcccagaggatgtagcccctgctcttggcacaagtttcagccatatgcttggtgctacgaaccccactcagaaaacaaaagaccacgagaacggaactggtactaatacttatgcagctctgaactccgtttatctgatgatgaataatcagatgaggcttctggggatggaaaccatggcttggcaggagatcagacatgccattatacttctcacagatgggaaaagtaatatgggaggatag

SEQ ID NO: 218982 - DNA, 420 bp, Artificial Sequence
  Description of Artificial Sequence: Synthetic coding sequence
atggggccacttatggttttgttctgtctgctgttcctttacccgggactggcagattctgcaccaagctgcccacagaatgtcaacatctccggtggcaccttcaccttatctcatggatgggcccctggctctctccttacatactcatgcccccaggggctgtacccttctccggcttctcgtttatgcaagagttccggccaatggcagaccccaggagcgaccagaagcctgagtaaagcggtctgcaaacctgtgagatgcccagcaccagttagttttgaaaacggaatctatacgccgaggctgggctcttacccagtcgggggtaacgtctcttttgaatgtgaagatggatttatcctgcgtggtagcccggtccggcagtgtagacccaatggcatgtgggatggctag

SEQ ID NO: 218983 - DNA, 2259 bp, Artificial Sequence
  Description of Artificial Sequence: Synthetic coding sequence
atggggcctttgatggtgctgttttgtctgctgttcttgtatcctggtctggccgactcggcacctagctgccctcaaaatgtgaacatctcaggcggaaccttcacactgtctcacggctgggcacccggttcgctcctcacctactcttgtccccagggcctgtacccaagcccggcatctcgcctgtgcaaaagtagcggccagtggcagactccaggtgctacacgctctctgtctaaggcggtctgtaaaccagttaggtgtccagctcctgtgagtttcgagaatggaatctacacgcctcgcttgggctcctacccagtgggaggcaacgtgtcattcgagtgtgaggacggtttcattcttcggggaagcccggtccgccagtgcagaccgaacggaatgtgggacggggagaccgctgtctgtgacaacggtgcgggtcactgccccaaccctggaatctcactgggagccgtgagaacgggctttcggtttggacacggagataaagtaaggtatagatgtagctccaacctggtacttacaggcagcagtgaaagggagtgtcaggggaatggtgtgtggtctggcaccgagcccatttgcagacaaccctattcctacgattttccggaggacgtcgcaccagccctcggcactagtttctctcatatgctcggggcaaccaatcctacacaaaaaacgaaggagtcactgggccgaaagatccaaattcagagaagcggacacctgaacctgtacctgctacttgactgttctcagtctgtgagcgagaacgacttcctcattttcaaagagtctgcgagtctgatggtagaccgcatcttctcttttgagattaacgtatctgtcgctattattacttttgcatccgagccaaaagttctgatgtcagtattgaacgacaattccagggatatgaccgaagtcataagctcactggagaacgctaattacaaggatcacgagaatgggaccggcacaaacacttacgctgccctcaactccgtttatcttatgatgaacaaccagatgaggcttctgggcatggagaccatggcatggcaggaaattcggcatgcaattattctactgacggatgggaagtccaatatgggcggtagcccgaagactgccgttgaccatattagagaaatcttaaacataaaccaaaagaggaacgattatctggacatctacgctatcggcgttggcaaactcgatgtcgattggagagagctgaatgagctaggttctaagaaagatggcgaacggcatgcattcattctgcaggacacaaaagctctccaccaggtcttcgagcacatgctggacgtgtcgaaactcacagacacaatctgcggcgtcgggaacatgagcgccaacgccagcgaccaggagcgcaccccctggcacgtgacaataaagcccaagtcacaggagacctgccgaggtgcgctgatatcggatcagtgggtgttgacagccgcacactgctttagagacggcaatgatcactctctttggcgcgtaaacgtaggagaccctaagtcccagtggggaaaggagtttctgattgagaaagcagttatctcccccggatttgacgtgttcgccaaaaagaaccaggggatcctggagttttatggcgacgacattgccctgcttaaactcgcccagaaggtcaaaatgtccactcacgcacgacccatctgtctcccttgtactatggaggcaaacctggccctgcggagaccccagggctctacatgccgcgaccacgaaaatgagctcctcaacaagcagagtgtccctgcccacttcgtggccctgaacgggtctaaattaaatattaaccttaaaatgggcgtggagtggactagctgcgctgaggtggtgtctcaggaaaaaacaatgttcccaaatctgaccgatgttagagaggtcgtcacagatcaatttctctgtagcggaacccaggaagacgagagtccctgtaagggtgagagcggaggcgctgtgttcctggagagacgctttcgcttttttcaggtgggcttagtaagctggggcctgtataatccctgcctcgggagtgcagataagaattcgaggaagcgggctccccgatctaaagtgccgcctcccagggactttcatatcaacttgttccgaatgcaaccttggttaagacaacacctgggcgatgtactcaatttcctacccctctag

SEQ ID NO: 218984 - DNA, 378 bp, Artificial Sequence
  Description of Artificial Sequence: Synthetic coding sequence
atgggccctctgatggtgcttttctgtctgctcttcctttatcctggtctggcagacagcgccccttcctgtccccagaacgtcaatatctcaggcggaacatttaccctgtcccacggctgggcacctgggtcattgctgacatactcttgtccccaggggctctacccgtctcctgcatctcgtctctgtaagtcatcaggccagtggcaaaccccaggcgctacgagaagtttgtctaaggccgtgtgcaaacccggacactgcccaaatccgggaattagtctgggagcggtgcgtactggcttccgtttcggtcacggcgataaggttaggtatcgctgctcatctaacttggtgttgaccggtagcagctag

SEQ ID NO: 218985 - DNA, 510 bp, Artificial Sequence
  Description of Artificial Sequence: Synthetic coding sequence
atgagggcactttgcattcgcgaaacttgtagcagcgagctgggcttcagtcggaactggtcacgccgtaaagccggtcattgccccaatccaggcatttcattgggggctgtcaggacgggttttcgatttggccacggagataaagtgagatacagatgtagctctaacctcgttctgactggaagctcagagcgtgagtgtcagggaaacggcgtgtggtctggtacggagcccatttgtcggcaaccctatagttacgactttccagaagacgtggccccagccctgggtactagtttctcacatatgctcggcgctacaaaccctacccagaagaccaaagaccacgagaatggaactggaactaatacatacgcagcactgaacagcgtgtacctgatgatgaataaccaaatgcgacttctgggaatggaaacaatggcttggcaagagatacgccacgctatcatcttgctgactgacggaaaaagtaacatggggggttag

SEQ ID NO: 218986 - DNA, 1062 bp, Artificial Sequence
  Description of Artificial Sequence: Synthetic coding sequence
atgggccctctgatggtactcttttgcctactgtttctttatccggctggccactgcccaaatcccggtatttcactgggggcagtccgcaccgggttccggtttgggcacggggataaagtgcgttatcgttgctcctcaaacttggtgcttactggatcaagcgagagagaatgtcaaggaaatggcgtgtggagcggtacagagcctatttgtcgccagccctacagctatgactttcccgaggatgtagcccctgctctgggcacaagctttagtcatatgctgggcgctactaatccaacccagaagacgaaagaaagcctgggtcgaaagattcaaatccaaaggtcaggccatcttaacctgtacctgctcctggactgcagccaatccgtgtcagagaacgatttccttattttcaaagagtcagcctccctgatggtggatcgcattttttcattcgagatcaacgtaagcgtagcgattattacttttgcctcggagccaaaagtcctcatgtcagtccttaacgacaacagccgggacatgactgaggttatatccagcctggaaaacgcaaactataaggaccatgaaaacggaacaggcacaaatacttatgctgcactgaactctgtctacctgatgatgaacaatcaaatgcgactcctgggcatggagacgatggcctggcaggagataaggcatgccatcatcctgttaaccgacgggaaatccaatatgggtggatccccaaaaaccgccgtcgaccatattcgagagatcctcaacatcaatcagaagaggaacgattatctcgacatttatgcaatcggcgttggaaagctggatgtggattggcgggagctgaatgaattaggatctaaaaaagacggcgagagacacgcatttatactccaggatacaaaagccctgcaccaggtctttgagcacatgcttgacgtgagcaagctgaccgatacaatttgcggcgtgggaaacatgagcgccaatgccagtgaccaggagcgcacaccttggcacgtgaccattaagtag

SEQ ID NO: 218987 - DNA, 2259 bp, Artificial Sequence
  Description of Artificial Sequence: Synthetic coding sequence
atgggtccactcatggtgctgttttgtttgctctttctctatcctggcctagccgatagtgctccaagctgtcctcaaaacgtgaatatttcagggggaactttcacactgtcacacgggtgggccccagggtccctgctaacctattcttgtccacagggactgtacccttcccctgcaagccgtttgtgtaagtctagcggccagtggcaaacgccgggagccaccaggtccctctccaaggcagtgtgcaaaccagtgcggtgcccagctcctgtgagcttcgaaaacgggatttataccccaagattaggatcgtatcctgtgggtggcaatgtcagtttcgaatgtgaagatggatttatcctgcgaggcagccccgtgagacagtgtagaccaaatggtatgtgggacggtgagacagcagtatgcgataacggagcaggccactgcccaaatcctggcataagtctcggagccgtgaggactggattcaggtttggacacggcgataaggtgcgatacagatgcagctcaaatttggtgttgactggatctagcgaacgggagtgccaagggaatggagtgtggagtggaaccgaaccaatttgcagacagccttacagctatgatttccccgaggacgttgcacccgctttagggacctccttttctcatatgctcggtgcaacaaaccccacccagaaaaccaaggagagcctaggtcgcaagatccagattcagagatcaggccacttgaacttatacctgcttcttgattgcagtcagagtgtgagcgagaatgattttctgatattcaaggagtcagccagcctcatggtggatagaatcttcagttttgagataaatgtgagtgtggccattataacgtttgctagtgaaccaaaagttcttatgagtgtccttaacgacaatagcagggatatgaccgaggtgatttcatccctggaaaacgcgaactacaaagaccacgagaacggcactgggacaaatacatatgctgccctgaatagcgtgtacctcatgatgaataaccagatgagactactgggcatggagaccatggcatggcaggaaatccggcatgcaatcatcctcctcactgacggaaagagtaatatgggcggtagtccgaagactgctgtcgatcacattcgggagattctgaacatcaatcagaagcgaaacgactacttggacatctacgcaatcggggtagggaagctcgatgtagactggcgggaactgaatgaactgggaagtaagaaggacggcgagagacatgcttttattctgcaggacactaaagcattgcatcaggtgttcgagcatatgctggacgtttctaagttgacagatacaatatgcggagtcgggaatatgtctgctaatgcctcggaccaggagcggactccctggcacgtcactattaagcccaagtcccaggaaacatgcagaggcgcattaattagcgaccagtgggtcctgacagccgctcattgcttcagagacgggaatgaccactccctatggagggttaatgtcggggaccccaagtcacagtggggcaaagaattcctgatcgagaaagctgtgatcagcccaggattcgatgttttcgctaagaagaatcaaggcatattggaattctatggggatgacatagccctgctgaaactcgcccagaaggtgaagatgagtacccatgccagaccaatctgcctgccgtgtacaatggaagccaatctggccctccggaggccccagggctccacctgcagggatcatgaaaatgagttactcaacaagcagtccgtgccggctcactttgtggcgttaaacggatctaagctgaacataaatcttaaaatgggtgtggagtggacatcctgtgccgaagtggtgtctcaggaaaagactatgttcccaaacctgactgacgtccgggaagtcgtgacagaccaatttctctgctccgggacccaggaagacgagtctccatgtaagggtgagtcaggcggagctgtttttctcgagaggcgattcaggttttttcaggtcggattggtaagttgggggctctacaatccgtgtctgggaagtgccgacaagaactcccgcaaacgggcaccacgtagtaaagtgccaccccctcgagattttcatatcaacttgttccgaatgcagccatggctcaggcagcatctcggtgacgtcctcaattttttgcccctgtag

SEQ ID NO: 218988 - DNA, 1062 bp, Artificial Sequence
  Description of Artificial Sequence: Synthetic coding sequence
atgggacccctcatggttctgttctgcctcctgtttctctacccagccggacactgccccaatccgggtatctctctaggcgctgtcaggacaggatttcgatttggccacggagacaaagtgaggtataggtgtagttccaacctggtgctgaccggttccagcgagagggagtgtcagggaaacggggtctggagtgggacagaaccgatctgccggcaaccttattcatacgacttccctgaggacgtggcaccagctctgggtacatcatttagccacatgcttggtgcaaccaatcctacccaaaagacaaaggagagcttagggcgaaagatacaaattcagcgcagcggccacctgaacctctacctgctattagactgcagccagagcgtgtcagaaaacgattttctgatcttcaaagagtcagcaagcctgatggtggataggattttctccttcgagattaatgtgtctgtagcgattatcactttcgcctcggagcccaaagtgctgatgagcgtgcttaacgacaacagcagggacatgaccgaggttatctccagtttggagaatgcgaattacaaggatcacgagaacggaactgggactaatacatacgcagctctgaattcggtatatctaatgatgaacaaccagatgcgcctgcttggcatggaaacaatggcgtggcaagaaatacgccatgccattatcctattaactgacggtaagtcaaatatggggggtagtcctaaaaccgcagtagaccacatcagagagattctgaacattaaccagaaaaggaacgactacctggatatctatgccatcggggtgggcaagcttgatgtggattggcgcgaactgaacgagctcgggagcaagaaggatggagagcggcatgcattcatcctacaggacactaaggctttgcatcaggtatttgaacatatgttggatgtgtcaaaactgacggacaccatatgcggagtgggtaacatgagcgccaatgcaagcgatcaggagcgaaccccatggcacgtcaccatcaagtag

SEQ ID NO: 218989 - DNA, 1062 bp, Artificial Sequence
  Description of Artificial Sequence: Synthetic coding sequence
atgggtcccctcatggtcttattctgcctcctcttcttgtaccccgctggccactgccctaacccgggaatttctcttggtgccgtgagaacaggattccggtttggccatggcgacaaagtacgatatcggtgctcctctaatctggtactgactggctcctcagaacgcgagtgccagggtaatggtgtgtggtccggcacagaacccatctgtcggcagccttattcatacgatttccccgaagacgttgccccagcacttgggacttcctttagtcacatgttaggggctaccaacccgacccaaaagacaaaggaatctctgggcagaaagattcagatccagaggagtggtcatttgaacttgtacttactgctcgattgttcccagtccgtgtcagagaatgactttctaatctttaaggaatctgcgtcactgatggtagaccgcatcttcagtttcgagatcaacgtgagcgtagccataatcacatttgccagcgagcctaaggtgctgatgagcgtgttaaatgataactcgcgtgacatgacggaggttataagctccctggagaatgcaaattacaaggaccacgagaatgggacgggaacaaacacgtacgctgctctgaacagtgtgtatctgatgatgaataatcagatgaggctgctcgggatggaaacaatggcgtggcaggaaatacgccacgcaatcattttgttgacagatggtaagtctaacatgggcggatctccaaagactgctgttgaccatatcagggaaattctgaatattaaccagaaaaggaatgattaccttgacatctacgcaattggggtcggcaagttagatgtagattggcgggaactcaatgagctcggaagcaagaaggacggcgaacgccacgcttttatactgcaggatactaaggccttgcatcaagtgtttgagcacatgctggacgtgtccaagcttactgatacgatctgcggcgttggcaatatgagcgccaatgcttcagatcaagagaggaccccttggcatgtaactataaagtag

SEQ ID NO: 218990 - DNA, 510 bp, Artificial Sequence
  Description of Artificial Sequence: Synthetic coding sequence
atgagagccctctgtattagggaaacctgtagctccgagcttggcttctctcgcaactggtctcggagaaaggcagggcactgcccgaatcctgggatcagcctgggtgccgtgcgtaccggatttcgtttcgggcatggagacaaagttcggtataggtgttcgagcaatctggtactgactggctccagcgagcgggagtgtcaaggaaatggagtttggtctggcacagaaccaatctgccggcagccctattcctacgattttcccgaggacgtcgcgcctgccctggggaccagcttcagccacatgctcggcgcaactaatcccacccagaagactaaagaccacgagaacgggaccggtaccaatacatatgccgctctgaattccgtgtacttaatgatgaacaaccagatgcgactgctgggaatggagacgatggcctggcaagagatcaggcacgcaatcatattgctcacagatggaaagtcaaatatgggcggttag

SEQ ID NO: 218991 - DNA, 1578 bp, Artificial Sequence
  Description of Artificial Sequence: Synthetic coding sequence
atggttctgttttgtttactttttttgtaccctgcaggccactgccctaaccctggcatctctttgggtgccgttcggaccggttttagatttggacacggtgataaagtgcgctaccgctgcagtagtaacctcgtgctgaccggttccagtgagcgagagtgtcagggcaatggtgtatggagcggaactgaaccaatttgccgacagccatattcctatgactttcccgaggatgtcgcccctgccttaggaacaagctttagccatatgctaggggcaacaaatcctacccagaagacaaaagaccacgaaaacggtaccggcacaaatacttatgccgcactgaacagcgtgtatctgatgatgaacaatcagatgcggttgctcgggatggaaactatggcatggcaggaaattcgccatgccattattctccttactgatggcaaatctaacatgggaggaagccccaagacggccgtcgatcatattcgagaaatcctgaatatcaaccagaagcgaaatgattatctggacatctacgcaattggggtgggaaagctggatgtggattggagggaactgaatgagctgggatcaaaaaaagatggcgaacggcacgcattcatactgcaggatactaaggccctccaccaggtctttgagcatatgctagacgtcagtaagttaacggacaccatctgtggtgtcggaaatatgtcagctaacgctagtgatcaagaacgaactccgtggcatgtgacaataaagccaaaaagtcaggagacctgtcgaggagcattaatttcggaccagtgggttttgaccgcggctcattgcttccgtgatggaaatgaccactcactttggagggtgaacgttggtgatcccaaatcccagtggggcaaagaattcttgatagagaaggccgtgattagccccggttttgatgttttcgctaaaaagaatcaagggattcttgaattttatggcgatgatattgcccttttaaagctcgcccaaaaggtgaagatgagtactcatgcccgtccgatatgcctgccctgtaccatggaggccaacctggctttaaggcggcctcagggatcaacttgtcgtgatcatgaaaacgaactcctgaataagcagagcgttcccgcacatttcgtggcactaaacggcagcaaactgaatattaacctcaaaatgggcgttgaatggacatcctgtgccgaggtcgtgtcacaggagaaaacaatgttccccaacctcacagacgtaagagaggtagtcacagatcagttcctgtgttctgggacacaggaggatgagtcgccatgcaagggcgagtccggcggagcggtgttcctcgagcgcaggtttaggttcttccaagttggactcgtgagctggggcctatataacccatgtctcggttcagccgataagaactctcgcaagcgcgctccgcgatctaaggtcccaccaccccgagattttcacataaacctgttcaggatgcagccttggctgaggcaacatcttggcgatgtgctgaatttcctgcccttatag

SEQ ID NO: 218992 - DNA, 1062 bp, Artificial Sequence
  Description of Artificial Sequence: Synthetic coding sequence
atgggcccactgatggtcctgttctgcctgctgttcctctacccggctgggcattgccctaatcctgggatatctctcggtgctgtgagaaccgggttcagatttgggcacggggataaggtccggtatcgatgctcctctaatcttgtcctcacgggcagctcagaaagggagtgccaagggaacggcgtctggagcgggacagagccgatatgcagacagccatacagctatgattttcccgaagacgtggctcctgcgttgggtaccagcttctctcacatgcttggggcaactaacccgacccagaagacgaaagaatctttaggtcggaagattcagatacaacgttcaggccatctgaatctgtacctgctgctggactgtagccaatcagtcagcgaaaacgacttcctcatcttcaaagagtccgcctctctgatggttgaccgcattttctcgttcgaaatcaatgtgagcgtggccatcattaccttcgcctcagagccaaaagttctcatgtcagtcctgaatgataacagtagagatatgaccgaggtcatttctagtctcgagaacgccaactacaaggatcatgaaaacggcacgggcacaaacacatatgccgcacttaactccgtgtacctgatgatgaataatcagatgagactgctgggcatggaaaccatggcttggcaggaaatacgacacgctatcattttgctgacagacggcaaaagcaacatgggaggaagccccaaaaccgctgtggaccacatccgagagattctcaatatcaatcaaaaacggaacgactacctagacatctatgccattggcgttggaaagttagatgtggactggcgggagttaaacgaacttggcagtaaaaaagacggcgagagacacgccttcatactgcaagatacaaaggctcttcaccaggtgtttgagcatatgctagacgtcagcaaactcacggacactatttgcggggtgggtaatatgtcagcgaacgcctccgaccaagaaagaaccccatggcacgttactatcaaatag

SEQ ID NO: 218993 - DNA, 405 bp, Artificial Sequence
  Description of Artificial Sequence: Synthetic coding sequence
tgaggccactgtcccaacccaggcatcagcctcggcgctgtgcggaccggtttcaggtttgggcatggagacaaagtcagatacagatgttcctctaatctggttctaaccggatcgagcgaacgagaatgtcagggcaacggggtatggtccggaaccgagcccatctgtaggcaaccgtattcatacgatttccctgaggacgtggctccagctctcggcacaagtttctcgcacatgctgggggctacaaacccaacccagaagacaaaggaaagtctgggtcgtaagatacagatccaacgctctgggcatctgaatctctacctgctcctggactgttctcagagtgtgagtgagaacgattttctgatcttcaaagagagcgcctcactgatggtgtag

SEQ ID NO: 218994 - DNA, 1578 bp, Artificial Sequence
  Description of Artificial Sequence: Synthetic coding sequence
atggtactcttctgcctcctgttcttgtatccagcgggacactgccccaaccctggaatctccctgggcgcagtcagaaccggatttcgcttcggtcacggcgataaagtgcggtatcgatgtagctctaacctggttctaactggcagttctgagcgagagtgtcaggggaacggcgtatggtctggtaccgagccaatatgccgacaaccatatagctacgatttccctgaggacgtggccccagctcttggaacatcgttcagccacatgctgggcgctacaaaccctacacagaagacaaaagaccatgagaacggaaccggaaccaatacttatgccgctcttaattcggtgtatctaatgatgaataaccagatgcgcctcttgggaatggagaccatggcatggcaggagatccgccatgccataatcctgctgaccgacgggaagagcaatatgggaggatcccccaagactgccgtcgatcacattcgagagatccttaatatcaaccagaaaaggaacgattacctggatatctacgccattggtgtgggaaaactggacgtggattggcgggagctaaacgaactcggcagcaagaaagatggagaacggcatgcctttattctccaggacactaaggctctgcatcaggtgtttgaacatatgttggacgtgagcaagctcacagacacaatctgcggagtgggtaacatgtcagctaacgcttcagaccaggaacggactccatggcatgttaccatcaagcccaaatcgcaggagacatgccgcggtgctctgatcagtgaccagtgggtgctgactgcggctcattgttttcgagatggaaacgaccattcactgtggagggtcaatgtaggagacccgaagagtcagtggggaaaagaattcctgattgagaaagctgtgatctcccccggtttcgacgtgtttgcaaagaagaaccaggggattctcgaattttacggagatgatatcgcccttctgaagctggcccagaaagtgaagatgtctacacatgcacgcccaatctgtctcccctgcacaatggaagcaaacttggccttaaggcggccacagggcagtacctgccgagaccacgagaacgagttactaaataaacaatctgtcccagctcacttcgtggcactgaacggaagcaagctgaacatcaatctgaaaatgggagttgagtggacgagctgcgccgaggttgtgagccaggaaaaaaccatgttccccaatctcacagatgtgcgagaggtcgtcacagaccagttcctctgcagcggcacacaagaagacgaatccccatgtaagggagagtcaggtggtgccgtattccttgagaggcgttttagattttttcaggtgggccttgtgtcttgggggctgtataatccttgtctcggcagtgccgacaagaatagtcggaaacgggcaccaagaagcaaagtgccccctcctcgtgactttcacataaacctgttcagaatgcagccttggttgcgccagcatttgggagatgtcctgaattttctgcctttatag

SEQ ID NO: 218995 - DNA, 1578 bp, Artificial Sequence
  Description of Artificial Sequence: Synthetic coding sequence
atggtcctattctgcctgctgttcctgtaccccgcaggccactgtcccaaccccggaatcagcctcggcgcagtgcggaccggttttcgctttggacacggagacaaggttcgttataggtgctcatccaacctcgtgttaacgggatcttccgaacgggagtgtcaaggtaacggggtgtggtccggcactgagccaatctgtagacaaccgtattcttatgattttccagaggacgtggcgcctgcgctggggacttctttttcccacatgttgggtgcaacaaaccctacgcaaaaaaccaaggaccatgagaacgggaccggaacgaacacttacgcggcactaaattctgtatacctaatgatgaataaccagatgcgcctgttgggtatggaaaccatggcgtggcaagagattagacatgccataatcctgctcaccgatgggaaatccaacatgggcggatcacccaagacggcagtggaccatatccgtgagatcctgaacataaaccagaaacggaatgattacttggatatctatgcaattggagtaggaaagctggacgtcgattggcgagaactcaatgaactcgggagcaaaaaggacggagagcggcacgcttttattttgcaggatacaaaggctctccaccaggtgtttgagcacatgctggatgtgtctaagctgaccgatacaatctgcggagtgggtaatatgtccgccaatgcctctgaccaggagagaaccccctggcacgtcacaatcaagcctaaatcccaagaaacctgtcggggagccctgatatctgaccaatgggtgctgacagcagctcactgctttagggacggaaacgaccacagcctgtggcgggtgaatgtgggtgaccccaaatctcagtggggaaaggagttcttgatcgaaaaggcggttatttcaccgggatttgacgtctttgccaaaaaaaaccagggaatcctggaattctacggtgacgacattgccctactcaaactagcgcagaaggtcaaaatgtccactcacgcgaggcctatctgcctgccgtgcactatggaagcgaacttagctctgagaaggccccagggaagcacttgccgggaccacgagaacgaattgctaaacaagcagtctgtcccagctcatttcgtggctttgaacggaagcaagttgaacattaatctaaagatgggggtggagtggacctcctgcgccgaagtggtatcccaagagaagaccatgttccccaacctcaccgacgtgcgggaggtcgtaacagaccagttcctgtgctcaggcactcaagaagatgaatcaccttgtaagggggagagcgggggagctgttttcttggaacgcagatttcgcttctttcaggtgggcctggtgtcttggggtttgtataacccttgtctggggtccgctgacaaaaactctcgcaagcgggctcccaggagcaaggttcccccaccacgcgatttccacattaatctgttcagaatgcagccgtggctcagacagcacttaggtgatgtgctaaacttcctgcccctctag

SEQ ID NO: 218996 - DNA, 1062 bp, Artificial Sequence
  Description of Artificial Sequence: Synthetic coding sequence
atgggccctctgatggtgctgttctgccttcttttcctttacccggcaggtcactgcccaaaccccggaatctctctcggcgcagtgcgtactggatttcgcttcggacatggtgataaggtgagatacagatgctcatctaatcttgtgctgacggggtcgtccgagcgtgagtgccagggtaatggtgtgtggtcaggtaccgaaccgatctgccgccagccctactcttatgacttccctgaagatgtcgctccagcactgggtacatctttctcccacatgctgggcgctaccaaccctacccaaaagactaaagagagcctgggaagaaagatccagattcagagatcaggtcacttgaacctgtaccttctcttggattgttcgcagtcagtatccgagaatgattttctgatttttaaagaaagtgcctcactgatggttgatcgcattttctcttttgagatcaatgtctctgtggctatcatcaccttcgcttcagaaccaaaagttctcatgtcggtccttaatgataactctcgggacatgactgaagtgattagtagccttgaaaacgcgaattacaaagatcacgagaacggaacagggacgaacacctatgccgcacttaattcggtttaccttatgatgaataaccaaatgcgcttgttaggcatggaaactatggcctggcaggagattcgccacgctatcattctcctcaccgatggcaagtccaatatgggcggtagccctaagacagccgtggaccacattcgcgagatactgaacattaaccaaaaaagaaacgattatctcgacatctatgcaatcggcgtaggcaagttagacgttgactggcgggaactcaacgaactggggagcaaaaaggacggtgagagacacgcctttatcctccaagatactaaggccctgcaccaggtatttgagcacatgttggatgtgagcaagttgaccgatactatctgtggagttggaaacatgtcagcaaacgcgagcgaccaagaacgcactccctggcatgtcacgatcaagtag

SEQ ID NO: 218997 - DNA, 477 bp, Artificial Sequence
  Description of Artificial Sequence: Synthetic coding sequence
atgcgcgcactgtgtattcgggagacttgtagctcagaactgggctttagtcggaattggtcaaggaggaaggctggccactgccccaaccctgggatctcgctcggagccgtgagaacgggtttccgcttcggccatggggataaagtgcgttaccgttgttcttccaaccttgtgctgaccgggagcagtgagagagaatgccagggtaacggggtgtggagtggtaccgagccaatctgtagacagccatattcctacgattttccggaagacgttgccccagctctcggcactagtttcagtcacatgctgggcgctactaatcccacgcagaagacaaaagagagcctgggaagaaagatacagatccagcgaagcggacaccttaacctgtacctgctcctggattgctcgcagtccgtatcggagaatgatttcctaatttttaaagagagcgccagcctgatggtatag

SEQ ID NO: 218998 - DNA, 477 bp, Artificial Sequence
  Description of Artificial Sequence: Synthetic coding sequence
atgagggcgctgtgtataagagagacgtgcagctccgaattgggcttttctcgtaattggtcaaggagaaaggccggtcattgtccaaaccctgggatttccctgggggctgtccgaaccggcttcagattcggacatggagataaagtgaggtatagatgcagctcaaatcttgtgctgactggttcctctgagagggagtgtcaaggtaacggagtgtggtcaggcacggagccaatatgccggcagccgtatagctacgacttccctgaggacgtggcacctgccttagggacctccttttctcacatgctgggtgccaccaacccaacgcagaaaaccaaggagagccttggacggaagattcagattcagcgatccgggcatctgaatctgtatttgctcttggactgttctcagtctgtgagcgaaaatgactttctgattttcaaggagtccgcctccttaatggtctag

SEQ ID NO: 218999 - DNA, 978 bp, Artificial Sequence
  Description of Artificial Sequence: Synthetic coding sequence
atgggtacgaggagtgcaatcgccgcaccccgtatcctgtgttctcgcggtctgcggagtggcagcgcgagggcgactggctctggggtagagcggagcccatctgccgcaaatcccaccttgatgacctcgctgcgaacttggcccctcccctgggcattgccatctcccacctgtctaggaccaccaatccccccacgcagacagcgcattttttcattcgagatcaacgtttccgtggccatcatcacctttgcatctgagccaaaggtgctcatgtctgtgcttaacgacaattcaagagatatgacagaagtgatatccagtctagaaaacgctaattacaaggaccatgaaaatggaaccggaactaatacttacgcagcgctaaactctgtttatttgatgatgaacaaccagatgaggcttcttggaatggagaccatggcctggcaagaaatccgccatgccatcatccttctaaccgatggcaaatctaatatgggtggttctcccaagaccgccgtggatcatatacgggaaatacttaatatcaaccagaaacggaatgactatctggacatctacgcgattggcgtcgggaagttggacgtggactggagggagctgaacgaacttgggagcaagaaagatggtgagagacatgcctttatcctccaggatacgaaggcacttcaccaggtgttcgagcacatgctagatgtatcaaaactcacagacacaatttgcggggtgggaaatatgagcgcgaacgcgagtgatcaggagaggacaccctggcacgtcaccatcaagcccaagtcacaggaaacttgcaggggtgccctgatctccgaccagtgggtgctgaccgccgcacactgctttagagacggcaacgatcactccctttggcgggttaacgttggggatccgaaaagtcaatgggggaaagagttcttgatcgaaaaggcctag

SEQ ID NO: 219000 - DNA, 477 bp, Artificial Sequence
  Description of Artificial Sequence: Synthetic coding sequence
atgagagccctgtgtatccgggagacctgctctagtgaactgggcttcagcagaaactggtcccgcagaaaggctggtcactgccctaatcccggtatctccttgggagcggtccgcacaggtttccgcttcgggcacggcgataaagtcagataccgctgcagctccaacctagtgcttacagggtcctctgagcgggagtgccagggtaacggagtgtggtccggaactgaacccatttgtcggcaaccgtacagttatgatttccctgaggacgtggccccagcgctcggcactagctttagccacatgttaggtgcaacaaacccgactcagaagaccaaagagtccctgggcagaaaaattcagattcagaggagtggccatcttaacctttacctgctgctcgattgttcccaatcagttagcgagaatgactttctcatcttcaaggagagcgctagcctaatggtatag

SEQ ID NO: 219001 - DNA, 1062 bp, Artificial Sequence
  Description of Artificial Sequence: Synthetic coding sequence
atggggccactcatggtccttttttgtcttttattcctctatcccgcagggcactgccccaatcccggtatctccctaggcgcagtcaggaccgggtttcgtttcggccacggtgataaggtaagataccgatgtagctcaaacctggtcttgaccggttcttccgagcgggagtgccaaggaaatggagtgtggtcagggaccgaacccatatgtaggcagccttactcatatgacttccctgaggatgtggcccctgcgctagggacctctttttcccatatgctgggtgctacaaacccaacacagaagaccaaagaatccctgggcaggaagatccagattcagagatcagggcatctgaacctgtatcttctgctggactgttcacagagcgtcagcgagaatgattttttaatcttcaaagagtccgcttctctgatggtggacagaatatttagtttcgaaataaacgtatcagttgcaatcattaccttcgctagcgagcctaaagtcctgatgagcgttctgaacgacaatagtcgggacatgaccgaggtcatctctagcctggaaaacgctaactacaaagaccacgaaaatgggaccggtaccaacacatacgccgctctgaactcagtttatctgatgatgaataaccagatgaggctactggggatggaaactatggcttggcaggagatacggcatgctataattcttctcaccgacggaaagtccaacatgggaggcagccccaagacagcggtagatcatattagggagattttgaatatcaatcagaagaggaatgactatttggacatatacgccatcggggttggaaagctggatgtcgattggcgagagctgaacgagctgggcagtaagaaggatggcgaacggcacgcctttatcttacaagatactaaagctctgcaccaagtattcgagcacatgctggacgtgagcaaactcaccgataccatttgcggtgtcgggaacatgtcagccaatgccagcgatcaagaaagaactccttggcatgtcacaatcaaatag

SEQ ID NO: 219002 - DNA, 420 bp, Artificial Sequence
  Description of Artificial Sequence: Synthetic coding sequence
atgggcccattaatggtattattttgcctcctgtttctgtacccaggtctggcggattcggctccaagctgtccccaaaatgtcaatatttcaggcggaacattcactctatctcacggctgggcgcctggaagtctcttaacctactcatgccctcaggggttgtatccttcgcccgcttcacggctttgtaagagcagtggacagtggcagacccctggtgcaacaagatccctttcaaaagctgtgtgcaagcccgttagatgcccagcacccgtttctttcgaaaatgggatttatacaccgcgtttggggtcatacccagttggaggtaacgtgtcattcgagtgtgaggatggttttattctgaggggaagccctgtgcgtcaatgtcgaccaaatggcatgtgggacgggtag

SEQ ID NO: 219003 - DNA, 438 bp, Artificial Sequence
  Description of Artificial Sequence: Synthetic coding sequence
tgaggacattgccctaatccgggaatttcacttggcgctgtgcggactggctttagattcggccacggagacaaggtacgatacagatgctctagcaatttggttctgacaggctccagcgagagagagtgtcaaggaaacggagtttggtccggaactgagcctatctgtaggcagccttactcctatgatttccctgaggacgtggcacctgccctgggcacatcctttagtcacatgttgggtgccacaaaccccacacaaaagacaaaagatcacgagaatggcaccggcactaacacttacgcagccctgaactctgtttacctgatgatgaataaccagatgcgccttctgggaatggagacaatggcttggcaggagatacgccacgcgattattttacttacggatgggaagtcaaacatgggaggttag

SEQ ID NO: 219004 - DNA, 378 bp, Artificial Sequence
  Description of Artificial Sequence: Synthetic coding sequence
atgggcccactgatggtactattttgcctccttttcttgtaccctggcctcgccgacagcgccccttcttgtcctcagaatgtgaacatttcagggggtacgtttaccctgagccacggttgggcaccaggatccttgcttacttactcctgtcctcagggtctgtatccttctccagctagccggctctgtaagagctcggggcagtggcagactccgggagcaacccggagtctgtctaaggccgtgtgcaagccaggtcactgtcctaatcccggaatcagtctcggagctgtgagaacaggatttcgatttggacacggcgataaggtccgctaccgttgcagtagcaacctggtgcttactggatcttcctag

SEQ ID NO: 219005 - DNA, 420 bp, Artificial Sequence
  Description of Artificial Sequence: Synthetic coding sequence
atgggaccactgatggtccttttttgcttattgtttctgtaccccggtctggcggactcagccccaagctgtcctcaaaacgtgaatatttccggtggaacctttacactgtctcacgggtgggcccctgggtctctgctgacctattcttgccctcagggattatatcccagcccggcttctcgactctgtaaatccagtggtcagtggcaaacgcctggggctacgcggtctctgagtaaggctgtgtgtaagccagttaggtgtcctgcaccggtgtctttcgaaaacgggatctacacacctcgcctgggcagttaccctgtgggtggtaacgtttcattcgagtgtgaggacggctttatcctgagggggtctcctgtgaggcaatgtcgtccaaatggcatgtgggacggatag

SEQ ID NO: 219006 - DNA, 477 bp, Artificial Sequence
  Description of Artificial Sequence: Synthetic coding sequence
atgcgggctctgtgcattagagagacatgttcttccgaactcggcttcagtcggaactggtctcgtaggaaggctggacactgccctaatccaggcattagcctcggcgcagtcagaaccggattccgcttcggacatggcgacaaagttcggtaccgatgctcatccaacctggtccttacagggagcagcgaacgcgagtgccaaggaaacggagtgtggtctggaactgagcctatctgcaggcagccctattcttacgacttccccgaggatgttgcccctgcgctgggaacctccttttctcatatgttgggcgcaactaaccccacgcaaaaaactaaggaaagtctgggacgcaagatccagattcagagatctggccacctgaacctgtaccttctccttgactgctcacagagtgtaagtgaaaacgatttcttaatattcaaggagagtgcaagtctgatggtgtag

SEQ ID NO: 219007 - DNA, 378 bp, Artificial Sequence
  Description of Artificial Sequence: Synthetic coding sequence
atgggccctcttatggtgctcttctgtctcctctttctttatcctggtctggccgatagtgccccatcttgtccacagaatgtcaatattagcggtgggactttcacactgagccatggctgggctcctgggtccctcctgacctactcctgtccccaagggctgtacccatcgcccgcatctagactgtgcaagagcagcgggcagtggcaaactcctggcgctacgaggagcctcagtaaggccgtgtgcaagcctggacactgtccgaaccccggaatatccctaggggcagtccgcactgggtttcgattcggacatggcgacaaggttcgttatagatgttcgtctaaccttgttcttactggatcatcctag

SEQ ID NO: 219008 - DNA, 1863 bp, Artificial Sequence
  Description of Artificial Sequence: Synthetic coding sequence
atgggcccacttatggtgttgttttgccttctgttcctgtaccctgccggacactgtcctaatccaggcatctcgttgggagctgtgcgcacaggatttaggtttggacatggtgacaaagtgaggtatcggtgttcttccaacttggtacttactggctcctccgagagggagtgtcagggcaatggtgtctggtctgggactgagcctatatgtagacagccctactcttatgattttccagaggatgttgcgcctgctctgggaacatcatttagccacatgctgggcgcaaccaacccaacccagaaaaccaaggagtctctgggtcgcaaaatccaaatccagcgcagtggccacctcaatttatatctgctgctggattgtagccagagtgtgtccgaaaacgacttcctcatctttaaagaatctgccagcctcatggtagatcggatattcagcttcgagatcaacgtgtctgtcgctatcattactttcgcttccgaacctaaggttctgatgtcggtcctcaatgacaacagccgcgatatgactgaagtcatttcgtctttggagaacgccaattacaaggatcatgaaaatggcactggaaccaatacatatgccgctcttaactctgtgtaccttatgatgaataaccagatgcgtcttctggggatggaaaccatggcatggcaggagattagacacgccattattctgttaaccgacggcaaatctaatatgggaggcagccccaagacagccgtggatcatattcgggagatccttaatatcaatcagaaacggaatgattacctcgacatctacgctatcggagtaggcaaactggacgttgactggagagagctgaatgaactaggttcaaaaaaggatggtgagaggcacgctttcatcttacaggacacaaaggcccttcatcaggtgttcgagcatatgctggacgtgtccaaattaaccgatacgatatgtggagtgggaaacatgagcgctaacgcttcggaccaggaacgcacaccatggcatgtgaccatcaaacccaaatcccaggagacgtgtcgtggagcattgatcagtgaccaatgggtccttactgccgcacactgtttcagggacgggaacgatcactcactatggagagtaaatgtgggggacccaaagtcccagtggggtaaagagtttctgatcgagaaagcagttattagccccggattcgatgtattcgccaagaaaaatcagggcatcctggaattctatggtgatgacatcgccctgttgaagctcgcacagaaggtgaagatgtccacacacgcacgtccgatctgcttgccctgcaccatggaggcaaatctggcgcttcggagacctcagggatccacttgtagagaccacgagaacgaattgctgaataagcaaagtgtgcccgcacacttcgtggcgctgaatggaagcaagctgaatattaacttaaagatgggagttgagtggacaagttgcgctgaagtagtatctcaagaaaaaactatgttcccaaaccttacagacgtgagggaggtcgttaccgaccagttcctgtgctcgggcacccaggaggatgagagtccctgcaagggagaatccggaggcgctgttttcctggaaagaaggtttcgcttcttccaggtgggtttagtgagctgggggctgtataatccatgcttgggaagcgctgacaagaattctcggaaacgagccccacgatctaaggttccccctcccagagactttcacatcaatttatttagaatgcagccatggctgcgacagcatctcggtgatgtgctcaactttctgccactgtag

SEQ ID NO: 219009 - DNA, 378 bp, Artificial Sequence
  Description of Artificial Sequence: Synthetic coding sequence
atgggaccactgatggtcttgttctgccttttattcttgtaccccggtctcgctgatagcgcaccaagctgtccccaaaatgtgaatatcagtggagggaccttcacgttgtcccatgggtgggcgccagggtccctgctgacatacagttgtccacagggcttatatcctagtcccgctagtcggttgtgtaaaagcagtggacagtggcaaacacccggtgcaacgaggagcctctccaaggccgtctgcaagcctggtcattgtccaaaccccggtatttcactcggcgcagtgcgcacaggctttcgattcgggcatggggacaaggtgagataccgatgctcttcaaatctcgtgctaactggttcatcgtag

SEQ ID NO: 219010 - DNA, 420 bp, Artificial Sequence
  Description of Artificial Sequence: Synthetic coding sequence
atgggaccccttatggtactgttttgcctcctgtttctgtatcccggactggccgattctgcccctagttgtcctcagaacgtgaatatcagcggcggaacttttacactgtcacatggatgggcccctggctctcttcttacgtactcctgtcctcagggtctatatccgtcaccagcatcccggctctgtaagtccagcggtcagtggcagacacctggagctaccagatcgctgtctaaggcggtatgtaaaccagtccgctgccctgcgcctgtgagcttcgagaacggaatctacactcctcgtctaggaagctatcccgtgggcggaaatgtcagttttgaatgcgaggatggctttatcctcaggggctcgccagttcggcagtgtaggccaaacggaatgtgggatgggtag

SEQ ID NO: 219011 - DNA, 378 bp, Artificial Sequence
  Description of Artificial Sequence: Synthetic coding sequence
atgggcccactgatggtgcttttctgcttactgttcctgtaccctggactggctgacagcgccccaagctgtccccaaaacgtgaacattagtggtgggaccttcaccctctcacatggttgggcacctggatctctcctcacctattcctgccctcaagggctgtatcccagcccagcgagtagactctgtaaaagcagtggtcagtggcagacccccggtgcaacacgctccctttccaaagcagtctgtaaaccagggcactgtccaaatcccggaattagcctgggcgcagtacgtacgggcttccgattcggacatggcgataaagtacggtatagatgtagtagcaatctcgtgctgactggaagcagctag

SEQ ID NO: 219012 - DNA, 2259 bp, Artificial Sequence
  Description of Artificial Sequence: Synthetic coding sequence
atggggcctctcatggttctgttctgcctgctgttcttatatcctggtttggcggattctgccccttcttgcccacagaacgtaaatatcagtggtggaactttcacattgtcccatggctgggccccaggttccctcctgacatacagctgtccccagggcctctacccctcccctgcctcgaggctgtgcaaatcatccggccagtggcaaactcccggagccacgagatcgctgtcaaaggctgtgtgcaaacccgtgcgctgtcccgcaccagtttcttttgagaatgggatatacacaccaagactggggagttaccctgttggtggcaacgtgagttttgaatgcgaggacggatttatattacggggttcccccgtaagacaatgcaggcccaatggaatgtgggatggggagaccgctgtatgcgacaacggagcaggacactgtccgaaccctggtatctctctcggcgcagtgcggacaggattcaggtttggacatggtgataaggtccgctaccgatgttcatccaaccttgtgctgactgggtcaagtgagcgggagtgtcagggaaacggcgtgtggagtggcacagagcccatctgtcgccagccatactcctatgacttccctgaagacgtggctcccgcactggggacgagctttagccacatgctaggggcaacaaaccccacacagaagaccaaagagagcctgggacggaagatccagatccagaggagcgggcatttaaacctttacttgctactggactgctcacagagtgtttctgaaaatgattttctcattttcaaagagtctgctagtctgatggtagatagaatcttctcattcgaaattaatgtaagcgtggctatcatcacattcgccagcgaacccaaagtgttgatgagcgtattaaacgacaattctcgagatatgacagaggttatctcatccctcgaaaacgcaaattacaaagatcatgaaaatgggacaggcactaacacctacgcggcactcaacagcgtgtacctgatgatgaacaatcaaatgcgcctgctcggaatggaaactatggcctggcaggagatccgacacgcaattatcctcctaaccgacgggaagagcaatatggggggtagccccaagacagccgtcgatcacattcgggagattctcaatattaaccagaagcgcaatgattatctagacatttatgctatcggagtgggaaaactggatgtggattggcgcgagctaaacgaacttggctctaagaaggacggggagcgccacgcattcatactacaagacaccaaagccctgcatcaggtgtttgagcacatgttggacgtctctaaactcactgataccatatgtggtgtcggtaatatgtcagccaatgcatccgaccaggagcggaccccttggcacgttactattaagccaaagtcacaagagacttgccggggagctttgatcagtgaccagtgggtgttgactgccgctcattgctttagagacggcaatgatcatagtttgtggcgcgttaacgttggcgaccctaagtctcagtggggaaaagaattcctcatcgaaaaggcagtgattagccccggattcgatgttttcgccaagaagaatcagggtattctcgagttctatggcgacgacattgccttgttgaagctggcacaaaaagtcaaaatgtctacccatgctaggcctatatgcctgccgtgtaccatggaagcaaaccttgccctccggagaccacaagggtcaacttgtagagaccacgagaatgagttgttgaataaacagtctgttcccgcacacttcgtcgcgttgaacggctctaagttgaacatcaatctcaagatgggagtagagtggactagctgtgccgaagtggtgagccaggagaagactatgtttcccaatctgactgacgttagagaagtggtaacagaccagtttttatgttctgggactcaggaggatgaatctccctgcaaaggcgaatcaggaggagcggtctttctcgaaaggcggtttaggttcttccaggtcgggctggtgtcatggggactgtacaacccatgtctaggttcagcagacaagaactcccggaaacgcgcacctcgttccaaagtgccccctccacgcgacttccatatcaacctgtttcgaatgcaaccctggcttcggcagcatctgggggacgtcctaaacttcttacctctttag

SEQ ID NO: 219013 - DNA, 378 bp, Artificial Sequence
  Description of Artificial Sequence: Synthetic coding sequence
atggggccattgatggtactattttgcctgctgttcctatacccgggtctggccgacagcgcccctagttgccctcagaacgtaaatatctcgggaggtactttcaccctgtcacacggatgggcccctggcagcctccttacctacagttgtccgcaaggactatacccttctcccgcaagccgcctctgtaaatcctccggccaatggcagacaccaggcgctactaggtctctttcaaaggccgtgtgtaaacccggacactgccccaaccccggtatctcactgggagcagtgcggacaggctttcggtttggtcacggtgacaaggtccgctacaggtgctcatcaaatctggtgctgactggtagctcctag

SEQ ID NO: 219014 - DNA, 510 bp, Artificial Sequence
  Description of Artificial Sequence: Synthetic coding sequence
atgcgggcattgtgtattcgcgagacctgctctagcgaactgggcttttctcgcaactggagtcgtagaaaagccggacattgtcctaatcctggaatatccctgggggcagtgcgtacaggcttccgtttcggacatggagataaagtacggtaccgctgctcaagcaacttggtgctgacgggaagctccgagcgggaatgtcaggggaacggagtgtggagcgggacggaacctatttgcagacagccatactcctatgacttccccgaagatgtcgctcctgccctcgggactagcttttctcacatgctgggtgcgactaatcccactcaaaaaacaaaggaccacgaaaacggcactggtactaacacctatgccgcactgaacagcgtctacctcatgatgaacaaccagatgcgccttctcggtatggaaactatggcctggcaggagatccggcacgcaattatcctgctgacagatggcaaaagtaatatgggcggttag

SEQ ID NO: 219015 - DNA, 1578 bp, Artificial Sequence
  Description of Artificial Sequence: Synthetic coding sequence
atggtcctcttttgcttgctgttcctgtacccggctggccactgccctaaccccggtatttcgctgggggcagtcaggactggcttccgctttggacacggggacaaagtgaggtaccgctgctctagtaacttggttttaaccggttcctctgagcgggaatgccaggggaatggcgtgtggagtggcaccgagcctatctgtcgccaaccctacagctatgattttcccgaagatgtcgccccagctctgggcacatctttctcccacatgctgggtgcgacaaacccaacacagaagaccaaggaccatgagaacggtaccggcacaaacacctacgccgctcttaactctgtttacctgatgatgaacaatcagatgaggcttcttggaatggagactatggcctggcaggagattaggcatgccataatccttctgaccgacggaaagagcaatatggggggatcccctaagacagctgtagaccacattcgggaaattctgaacataaaccagaagcggaacgactatcttgatatctacgccattggcgtgggtaagctcgatgtggattggcgggagctaaacgagctcggcagcaagaaggacggggagaggcatgcgttcatacttcaggatacaaaagccctccaccaggtcttcgagcacatgctcgacgtgtccaaactcaccgatacaatttgcggagtaggcaatatgtccgcaaacgcctcagatcaggagagaactccctggcacgtcacaattaaacctaagagtcaggagacgtgtaggggtgccctgatctccgatcaatgggtgctcaccgcagctcattgtttccgcgacggaaacgatcattcattgtggcgcgtgaacgtcggggaccctaaatctcagtgggggaaggaattcctgattgaaaaggcggtcatctctccgggttttgatgtgtttgctaagaagaatcaaggaatcttggagttttacggagatgatattgctctgttaaaactagcccaaaaggtgaaaatgtccacccacgctaggccgatttgtctgccctgtacgatggaagcaaatctggccctccggagaccgcagggttccacatgtcgcgaccacgaaaatgagctgctgaacaaacagtccgttcccgcacatttcgttgccttgaacggatcaaaattgaatatcaatctgaagatgggcgtcgaatggaccagttgcgcagaggtggtctcacaggaaaaaaccatgtttccaaatttgactgatgttcgagaagtcgtcacagatcaattcctatgctctggtactcaggaggacgagtcgccttgtaaaggcgagtctggcggagccgtcttcttagaaagacgattcaggttctttcaggtcggactagtatcatggggcttgtataacccctgcctaggctccgccgacaagaactcaaggaaacgagccccaaggagcaaagtgccaccacctagggattttcacattaatctatttaggatgcagccctggttacggcagcatttgggtgacgtcctaaactttctgcctctgtag

SEQ ID NO: 219016 - DNA, 438 bp, Artificial Sequence
  Description of Artificial Sequence: Synthetic coding sequence
taagggcactgtccaaaccccggtatcagtctgggcgcagtccggacgggcttccgcttcgggcacggcgacaaggtcagatatagatgttccagtaacctggtactgacaggatcctccgaaagagagtgtcaagggaacggagtgtggagtggcaccgagccaatctgtaggcaaccttacagctacgacttcccagaagacgtggctccagctctgggcacctcttttagccacatgctcggcgctactaaccctacacagaaaactaaggatcatgagaacggaacaggaaccaacacctacgcggctcttaacagtgtctacctgatgatgaataatcagatgaggctgctcggcatggaaaccatggcctggcaggagattcgacatgccatcatcctcctaactgacgggaagtcaaacatggggggatag

SEQ ID NO: 219017 - DNA, 405 bp, Artificial Sequence
  Description of Artificial Sequence: Synthetic coding sequence
taaggccactgccccaaccccggtatctctctgggggctgtcaggacaggttttaggttcgggcatggagataaggtgcggtatcggtgctcttccaatcttgttttaacagggtctagcgagagggagtgtcagggcaacggagtgtggagcggaactgagcctatttgtagacagccctactcttatgattttcccgaagatgtggctcccgcactgggtaccagtttctcacatatgctcggcgcaaccaatcccacccagaaaacaaaggagagcctaggacggaagatccagatacagagatccgggcatttgaacctatatctgttattggattgtagccagtccgtgtcagagaatgattttcttatctttaaagagtcagcaagcctgatggtgtag

SEQ ID NO: 219018 - DNA, 420 bp, Artificial Sequence
  Description of Artificial Sequence: Synthetic coding sequence
atgggcccactgatggtgctgttctgcctcctgtttctgtatcccggattagccgattcggctccctcttgtccccaaaacgttaacatctccgggggaacattcacactgtcgcatggttgggccccaggcagtcttttgacctacagttgcccccaaggcttgtatccgagccctgcttcacgcttgtgcaaaagctccggccaatggcagacacccggagctactcgaagcctctctaaagccgtctgtaaacctgtgcgttgtcctgcacctgtcagctttgagaacggtatttacactccacgactcggctcttacccggtgggcggtaatgtgagttttgaatgtgaagacggcttcatcttgcgaggcagtcccgtaagacagtgcagaccaaacgggatgtgggacggttag

SEQ ID NO: 219019 - DNA, 420 bp, Artificial Sequence
  Description of Artificial Sequence: Synthetic coding sequence
atgggcccactgatggtgctcttctgtctgctgttcctgtacccaggtcttgccgattcggctcccagctgccctcagaatgtgaatattagcggtgggacctttacgcttagccatgggtgggccccaggtagcctgctgacatatagctgtccccaggggttgtatccatcccccgcttcacgcctgtgcaagtctagcgggcagtggcagaccccaggcgctactcgctccctgagtaaagccgtctgcaaaccggttaggtgcccagccccagtgagcttcgaaaacggaatctacaccccccgattgggctcttacccagtcggtggaaatgtgtcattcgaatgtgaagatggcttcatcctcagaggttcacctgttaggcagtgcagaccaaatggcatgtgggatggctag

SEQ ID NO: 219020 - DNA, 1617 bp, Artificial Sequence
  Description of Artificial Sequence: Synthetic coding sequence
atgcgggcactttgcatcagagagacgtgctcctccgaactggggttttctcgcaactggtcgcgccgtaaggccggacattgcccaaacccgggaatctctctcggtgcggttcgaaccggattccggttcggccacggagataaagttcgttatcgctgcagctcaaacctagtgctcacagggagcagcgaacgcgagtgccagggtaatggtgtctggtccggaactgaaccaatatgcagacaaccctattcatatgacttccctgaagacgttgcacctgccttaggcacgtcgttttcgcacatgctgggggctaccaaccctacacaaaagaccaaagaccatgaaaatgggactggaactaatacgtatgcagccctaaactccgtgtacctaatgatgaacaaccagatgagactgctgggtatggaaacaatggcttggcaagagattcggcacgccataatcctactgacagacggcaagagcaatatgggcggaagtcctaagactgcagttgatcatatcagggaaatcctcaacataaaccagaagcgaaacgattatctcgacatctacgcaattggcgtgggcaagctggacgttgattggcgcgaactgaacgagcttgggtctaaaaaggatggggaacgccatgccttcatcctgcaagatacgaaagcattacaccaggtcttcgagcatatgctcgacgtctctaagcttacagacactatctgcggagtcggcaatatgtctgcaaacgcttcagaccaggaacgaacaccatggcacgtgacaattaagcccaagtcgcaggagacctgtagaggcgctctgattagcgatcagtgggtcctgactgccgcacactgctttcgagatgggaacgatcactcattatggagagttaatgtcggtgacccaaaaagtcagtggggaaaagagtttcttatcgagaaagctgtgatttccccaggatttgatgtctttgcaaagaaaaaccagggcattctcgagttctacggcgatgacattgccttgttgaaactggctcagaaggtgaaaatgtctacccatgccaggccaatctgcctgccctgcacaatggaggccaatctcgccctgcggaggccccaggggagcacttgtcgtgatcatgagaatgaattgctgaataagcagtccgtgcctgcacactttgtcgcccttaacggctccaagttgaacatcaatttgaagatgggtgtcgagtggacttcatgcgctgaggtggtcagtcaagaaaaaacaatgtttcctaacctgacagatgtcagagaagtggtgacagaccagtttctgtgctcaggaacgcaggaggatgagtccccttgtaagggcgagtctggaggagcggtgtttctggagaggcggtttcggttctttcaggttggtcttgtctcctggggcctctataacccatgcctaggaagcgccgacaagaatagccgcaagcgagctcctcgctccaaggttcccccacctcgggactttcatatcaatttgttccgcatgcagccatggctacggcagcacctcggtgatgtcctgaatttcctgcccctgtag

SEQ ID NO: 219021 - DNA, 1521 bp, Artificial Sequence
  Description of Artificial Sequence: Synthetic coding sequence
atgggcacacgctccgcaatagctgcccctcgtattctttgcagccggggacttaggagcggctccgcccgagccactggctctggcgtcgaacgatctccttccgcggcaatcttctcattcgaaatcaacgtgagcgtggccattatcaccttcgcctctgagcccaaagtactcatgagtgtactgaatgacaacagcagggatatgacggaggtgattagctcattggagaatgccaattacaaggaccacgagaacgggaccggtacgaacacctacgctgccctaaacagtgtttacttgatgatgaacaatcagatgcgattacttggcatggagactatggcttggcaggaaattcgacacgcaattattctgctgaccgatgggaaatcaaacatggggggaagcccgaaaactgccgtggaccacataagagagattctgaatatcaaccagaaacgcaacgattacctcgacatatacgcaatcggggtgggaaagctggacgtcgactggagggaactgaatgaactgggctctaagaaggacggcgaaagacacgcattcatcctgcaggatacaaaggctctgcaccaggttttcgagcacatgctggacgtgagtaaactgaccgatacaatctgtggagtggggaacatgagcgccaacgcatccgaccaagagaggaccccttggcatgttaccattaagcccaaatctcaggagacctgcaggggggcactcatttcagatcagtgggttctcacggcggctcattgttttagagacgggaacgaccattcactttggcgtgtgaacgtaggtgatccaaagagtcagtggggaaaggaatttcttatcgagaaggcggtgatctcacccggattcgatgtcttcgcgaagaagaatcaggggatccttgaattttacggtgacgatattgccctgttaaagctggcccagaaagtcaagatgtccacccacgctagacctatctgcctcccttgtactatggaagccaacttggccctccggagaccccagggcagcacttgccgcgatcacgaaaacgaactgctcaacaaacagtccgtgccagcacattttgttgcactcaatggatcaaaactgaatattaatctgaaaatgggcgtcgagtggacaagttgcgctgaagtggtaagtcaggagaaaaccatgttcccaaatctgacagatgtgcgggaagtggtgactgaccagttcctctgttccggtacccaggaggatgaaagcccatgcaagggcgagagcggcggagctgtgtttttggagcgaagatttcggttttttcaggtcggcttagtgtcctggggactgtataatccctgtctgggtagcgcagacaagaattcaaggaaacgggctccccgtagcaaagtcccccctcccagggattttcatatcaacttgtttcgaatgcagccttggcttcgccaacatctcggtgatgttttaaatttcctgcctctgtag

SEQ ID NO: 219022 - DNA, 1521 bp, Artificial Sequence
  Description of Artificial Sequence: Synthetic coding sequence
atgggaacaaggagtgcgattgctgcccctcggatcctatgctcacgcggactgagatctgggagtgcccgtgcaacaggtagcggtgtggaaagatccccatctgccgctatctttagttttgagattaatgtttctgtggctattattacatttgcttcagaacccaaggtgttaatgagtgttcttaacgataacagtcgcgatatgacagaagtgatttcttccctcgaaaacgcgaattataaggaccatgagaatggcactggaacaaatacatacgccgctttaaattccgtgtacttaatgatgaacaaccaaatgagactgttgggcatggagacaatggcgtggcaagagatcaggcatgcaatcatactgctcaccgacgggaaatctaatatgggaggtagccctaagaccgctgtggatcatatccgggagatccttaacatcaatcagaagcgaaatgattacctggacatatatgccatcggcgttgggaaactggacgtcgattggagggaattgaacgaactaggcagcaagaaagacggcgagagacacgccttcatcttgcaggacactaaagcactccatcaggtcttcgagcacatgcttgatgtgtcaaagctgaccgatacaatttgcggtgtgggcaatatgtcagctaatgcttctgaccaggaacggacgccatggcacgtcacaattaaaccaaagtctcaggagacctgcaggggggcactgattagcgatcagtgggttctcacagcagcacattgcttccgggacggtaacgatcactccctctggagggttaatgtgggcgatcctaagagtcagtgggggaaggaatttctcatcgaaaaagccgtcataagcccaggctttgacgtattcgccaaaaaaaatcagggcatcctggagttctacggcgacgacatagctttgctcaagctggctcagaaggtgaaaatgtcaactcacgcccgtccaatatgtctaccctgcaccatggaagctaacctggccttgcgtaggcctcaaggatctacatgtcgtgaccatgaaaatgaactgttaaataagcagtcagtcccagcccacttcgtcgccctcaatggttcgaagctgaatatcaatcttaagatgggcgtagagtggaccagctgtgcagaggtcgtttcccaggaaaagacaatgttcccaaatctcacagacgtgagggaagtagtaaccgaccagttcctgtgcagcggcacacaggaggacgaaagtccctgtaaaggagaatcgggtggagctgtgtttctggagcgtcggtttcgattcttccaggtgggtttggtcagctggggactctataatccatgtctcgggagtgccgacaaaaacagcagaaaacgggctccacgttccaaagtcccacctccccgtgactttcacatcaacctcttccggatgcaaccctggttgaggcaacacttgggagacgtgcttaattttctcccgctttag

SEQ ID NO: 219023 - DNA, 1521 bp, Artificial Sequence
  Description of Artificial Sequence: Synthetic coding sequence
atgggcacgagatccgccattgccgcacccaggatcctatgcagtaggggtttaaggtcaggcagtgctagggccactggaagcggcgttgagcgctctccttcggcagccatattctcgtttgagattaatgtatctgtggccatcatcacttttgccagtgagcccaaggtgttaatgtccgtcctcaacgataactcaagagatatgacggaggtgattagcagtctggagaatgctaattacaaggaccacgagaacgggactggcaccaacacttacgccgctctaaacagtgtgtatctgatgatgaacaaccagatgagactgctgggtatggagacaatggcctggcaggaaatcagacacgccattattctgctgacagatggtaagtccaatatgggtgggtcgccgaagaccgccgtggaccatataagagagatcctgaacatcaaccagaaacggaacgattacctggacatttacgctataggagtcggaaagctggatgtggattggcgtgaactcaacgaattaggaagtaaaaaggatggcgaacgccacgcgtttattctgcaggacaccaaggctctgcaccaagtgtttgagcatatgctggacgtgtctaaactgacagacacgatttgtggggtcggcaacatgagcgcaaatgcctccgatcaggagagaacgccatggcacgtaacaatcaaacctaagtcccaggagacctgtcggggagccctcatcagcgaccaatgggtacttaccgcagctcactgtttccgcgatggcaatgaccactccctctggcgcgtgaatgtgggtgaccccaagtcacagtggggaaaagagtttctgatcgaaaaagccgtgatttctcccggatttgatgtgttcgctaagaaaaaccagggcatcctggaattctatggcgatgatatcgctttactgaagctggctcaaaaggtcaagatgtctactcacgcacgccctatctgtttgccctgcacgatggaggctaatctggctctgaggcgaccacagggttccacctgtcgcgatcacgagaacgagctgctaaataaacaatccgttcccgctcattttgtggccctgaatggcagtaaattgaatataaatctcaagatgggggtggaatggactagttgcgctgaggttgtgtcccaggagaagacaatgtttccaaatctgaccgatgttcgggaggtggtgaccgatcaattcctgtgtagtggtacgcaggaagatgagagcccgtgcaaaggggaaagtgggggtgcagtgtttctcgaacggcgtttccggttttttcaagtagggctggtcagctggggcctgtacaacccatgtttgggttccgcagataagaattcccggaaaagagccccacgctctaaggtgcccccaccgagggacttccacattaacctgttcaggatgcagccatggctgcgacagcatctcggcgacgtcctgaattttcttcctctgtag

SEQ ID NO: 219024 - DNA, 1134 bp, Artificial Sequence
  Description of Artificial Sequence: Synthetic coding sequence
atgactgaggtgatttcatccctagagaatgcaaattacaaggatcacgagaacggcactggaacaaatacatacgctgcccttaacagcgtttacctgatgatgaataaccagatgagactgttgggcatggagactatggcttggcaagaaatccgccacgccataatcctgctgaccgacgggaaatctaacatgggaggatcccctaaaacagcggtggatcatatacgagagatcctcaacattaaccagaagcgcaatgattatcttgatatctatgcaattggcgtgggtaaactggatgtggactggcgggagcttaacgaactgggctctaaaaaagatggtgaaagacatgcgttcatcttgcaggacacaaaggctttgcatcaagtgttcgagcacatgctggacgtgagcaagctgaccgacaccatctgcggcgtggggaacatgtcagcaaacgctagtgaccaggagagaaccccatggcacgtaactattaagccaaagagtcaggaaacatgccgaggagcattgatcagtgaccagtgggttttaactgccgctcactgtttccgggatgggaacgaccattcattgtggcgggttaacgtgggagatccaaagtctcagtggggtaaggaatttctgatcgagaaagctgtaattagccccggattcgacgtgttcgccaagaagaaccagggcattctggaattctatggcgacgacattgccttgcttaagctggcccagaaggtgaagatgagtacacatgcgcgacctatctgcctgccatgtacaatggaggctaatttggccctgaggaggccccaaggctcaacatgccgcgatcatgagaacgaactcctcaataaacagagcgtacccgcacactttgtggcactgaacggctcaaagctcaatattaatcttaagatgggggtcgaatggacctcttgtgccgaggtggtgtcccaggagaagacaatgtttcccaacctgactgacgtcagggaagttgttaccgaccagtttctgtgctctggtacgcaggaagacgaatccccctgcaaagggggaagcggggagctgggctcattgcagcccctgccttggttgtgttag

SEQ ID NO: 219025 - DNA, 978 bp, Artificial Sequence
  Description of Artificial Sequence: Synthetic coding sequence
atggggaccagaagcgctatagcagcacctcgcattctttgcagtcgaggactgagaagcggctctgccagggcaaccggcagtggggtggaacggtccccaagcgcagccaatccaacactcatgacgtcgctgcggacgtggcccctgccgtgggctcttcccagtcccacctgtcttggcccacccattccgccacgtcgccagaggatttttagctttgaaataaacgtgtcagtcgcgattattactttcgcgtcggaacccaaagtgctgatgtccgtcctcaatgacaacagtcgggacatgaccgaggtgatttcaagtcttgaaaacgccaattacaaagatcacgaaaacggaacaggcacgaatacatacgcagccctgaattctgtctatctcatgatgaataatcaaatgcgcctactcgggatggagacaatggcatggcaagagatcaggcacgctatcattctgctgaccgatgggaagtccaacatgggcggaagccctaagacagcagtggatcacatcagggagatcctgaatataaatcagaagagaaacgactacctggacatttacgctataggcgttggcaagctagacgttgattggcgagaactcaacgagctcggttcaaagaaagacggggaaagacatgcgtttatccttcaggataccaaagccctgcaccaggtgttcgaacatatgctcgacgtgagtaaactcactgacacaatatgcggcgtcggaaacatgagtgctaatgcctcagatcaggaaaggacaccttggcacgtcactattaagcctaagtctcaggagacctgtcgaggagccctgattagcgatcagtgggtgctgacggctgcacattgttttagagatgggaacgatcatagtttgtggcgtgttaatgtgggtgaccccaagagccagtgggggaaggagtttctcattgagaaggcatag

SEQ ID NO: 219026 - DNA, 1521 bp, Artificial Sequence
  Description of Artificial Sequence: Synthetic coding sequence
atgggcacacgatctgctatcgccgctccgagaatactgtgctccagaggtctcaggtcaggcagcgcacgcgctacgggctccggcgtggagcggagtccttccgcagcgatcttcagctttgaaatcaatgtgtccgtagccattataacatttgccagtgaacctaaagtcctgatgtctgtactcaacgacaactcccgggatatgacagaggtaatctcatcactagagaacgccaactacaaggatcacgagaacggcaccgggacaaacacatatgctgctctcaatagcgtttatcttatgatgaataatcagatgcgtctgctgggaatggagacgatggcgtggcaggaaatcagacatgccatcatactattaaccgacggaaagagcaacatgggagggtccccgaaaaccgctgtcgatcacattcgcgaaatcctgaatattaaccagaagcgcaacgattacttagacatctacgctatcggcgtcggcaagctcgacgttgattggcgggagctcaacgaactcggttctaaaaaggatggtgaacggcacgcttttattttgcaggacaccaaagcacttcatcaagtgtttgagcacatgctggatgtcagtaaattgacagacaccatttgtggcgtcggcaacatgtcggccaacgcttccgatcaggaacgcacaccctggcatgtgaccatcaaacccaagtcccaggagacctgtaggggcgctctcatctctgatcagtgggtgctgaccgctgcccactgcttccgtgacggaaatgaccattctctctggcgcgtcaacgttggagaccccaagagccaatgggggaaggaattcctcatagaaaaggctgtgatttctccaggattcgacgtgttcgctaaaaaaaatcagggcatcctggaattctatggcgatgacattgcgctgcttaagttggcccagaaggtcaaaatgtctacccacgcacgacccatctgcttgccatgtactatggaagccaatctggccctgcgcagacctcaaggcagcacgtgccgcgaccatgaaaacgaactcttaaataagcagtctgtccccgctcactttgtcgcattgaacgggtctaagcttaatatcaacctgaagatgggggtggaatggacctcatgtgctgaggtggtctcacaggaaaaaaccatgtttcctaatctgaccgacgtgcgcgaggtggtcaccgatcaattcctgtgttctgggactcaggaggacgaatctccctgcaagggtgagtctggaggtgccgttttccttgagaggcgtttccggttctttcaggtgggtctggtttcatgggggttgtacaacccgtgtttgggcagcgccgataaaaatagcaggaagcgcgctccaaggagcaaggtgccgccacctagagactttcacatcaacctgtttcgaatgcagccatggctacgccaacatttaggcgatgtgctgaacttcctgccactctag

SEQ ID NO: 219027 - DNA, 1521 bp, Artificial Sequence
  Description of Artificial Sequence: Synthetic coding sequence
atgggtacaagatccgcgatcgctgcgcctcggatcctttgttctaggggcctgcggagcggttcagcgagggcaactggttctggcgtcgagaggtcacctagcgcagcaattttcagctttgagatcaatgtgtcagtggccattattacctttgcatcagagccaaaggttctcatgtctgtgcttaacgacaacagccgggacatgacagaagtgatcagctccctggagaatgccaattataaagatcacgagaatgggacaggtactaatacttacgcagctctaaattctgtttatctgatgatgaataaccagatgcgcctgctagggatggagacgatggcctggcaggagattcgccacgccattattctgctgacagatggcaagagtaacatgggcggaagcccaaagacagccgtggaccatattcgcgagatccttaatattaaccagaagaggaatgactatcttgacatctatgccatcggagtcggcaagctcgatgtggattggagggaattgaacgaacttgggtctaagaaggacggcgagaggcatgctttcatcctgcaagataccaaggctctgcatcaggtgtttgagcacatgctggatgtgtcaaaactgactgacacaatctgtggagtgggtaacatgtcggcaaacgcaagcgatcaggagcgaaccccgtggcacgtcactatcaagccaaaatcccaggagacatgccggggagctcttatctccgatcagtgggtgctcactgcagcccattgttttcgtgatgggaacgaccactcactgtggcgtgtaaacgtgggggacccaaagtctcaatggggcaaggagttcctcatcgaaaaagctgtaattagccctgggtttgacgtgtttgccaagaaaaatcagggtatactggagttctacggtgacgatatcgctctccttaagctagcccagaaagtgaaaatgtcaactcacgcccgtcccatatgtctgccttgcacaatggaggccaacctggcgctcagacgccctcagggaagtacctgtcgggatcacgaaaatgaactgctgaacaagcaatctgtgcccgcacacttcgtggcactgaacggaagcaagctcaatatcaatctcaagatgggagtggagtggacctcctgtgccgaggttgtgtctcaggaaaaaacaatgtttcccaatctcacagacgtgcgcgaggtggtaactgaccagttcttgtgctcaggtacccaagaagacgagagtccctgcaagggggaatccggaggagccgtgttcctggagcggcgttttagattttttcaagtcggcctcgtttcctgggggctgtacaatccctgtctcggttctgcagataagaatagtcgcaaacgggctcccaggagcaaggtcccaccaccacgggatttccatataaacctgtttcgaatgcaaccctggctgagacagcatctgggtgacgttctcaactttctgcctctctag

SEQ ID NO: 219028 - DNA, 1617 bp, Artificial Sequence
  Description of Artificial Sequence: Synthetic coding sequence
atgagggcactctgtattcgggagacatgcagttcggagttgggtttctcaagaaattggagccgtcgcaaagccggtcattgccctaatccagggatttcactgggtgccgtgcggacagggttccgattcggccatggcgataaagtgcggtatcggtgtagttctaatttggtgctcacgggttctagtgagcgcgagtgccaaggtaatggcgtgtggagtggaaccgaacccatctgtaggcagccttatagctacgatttcccagaggatgtcgcgccagcactgggcacttccttctcacatatgcttggcgctacaaatccaactcaaaagacgaaagatcatgaaaatgggaccggtactaatacctatgccgcattgaacagcgtttatctgatgatgaataatcaaatgcgcctcttgggcatggagaccatggcgtggcaagaaataaggcatgctattatcctccttactgatggtaagtcaaacatggggggatcaccaaaaacagccgtagatcatattcgagaaatcctgaatataaaccagaaaaggaacgattatctggacatttacgccataggggtggggaaactggacgtggactggcgcgagctcaacgaactggggagtaagaaggatggagaacggcacgcatttatactgcaggacacgaaagcactccatcaagtgttcgagcacatgttggatgtgagcaagctgactgatactatctgtggggtgggaaacatgagtgccaacgcctccgaccaggagaggaccccctggcacgttaccatcaaacccaaaagccaggaaacgtgtagaggtgctctgattagcgaccaatgggtgctcaccgctgctcactgtttccgggacggcaacgaccatagcttgtggcgcgtcaacgtgggcgaccccaaaagccagtgggggaaagagttcctaatagaaaaggcagtcatctctccaggctttgatgttttcgcaaagaagaaccagggaattttggaattctacggtgatgacatcgccttacttaaactggcacaaaaggttaagatgagcacccatgctcgcccaatctgcctgccctgtacaatggaagctaatctggctctaagaagaccccagggctccacgtgtcgcgaccacgagaatgaactgctcaataaacagagtgtgccggctcacttcgtggcgctgaatggatcaaaacttaacatcaatctgaagatgggcgtggagtggacaagctgcgccgaggtcgtgtcccaggaaaagaccatgtttcccaacctgaccgacgtacgggaggtcgtgaccgatcagttcttgtgcagtggtacccaagaggacgaaagcccctgcaagggagagagtggaggtgcggtcttcttggaaaggcgctttcggttcttccaggttgggttggtcagctggggactgtacaacccgtgtctcggttcggctgataagaacagtagaaagcgggctccacgttccaaagtaccgcctccccgagacttccatatcaatctgtttcgtatgcaaccgtggctgcgccagcacctcggggacgttctgaatttccttccgctatag

SEQ ID NO: 219029 - DNA, 1134 bp, Artificial Sequence
  Description of Artificial Sequence: Synthetic coding sequence
atgaccgaggtcatttccagtctagagaatgcgaattacaaggatcacgaaaatgggaccggtactaatacatatgcagcactgaattctgtgtatcttatgatgaataaccagatgcgcctcttgggcatggaaaccatggcttggcaggaaatcaggcacgccataatcctgttgactgatggaaaatccaacatgggcggttctcctaagacagccgtcgatcacatcagagagatattgaacattaatcaaaaacgcaacgactacctggatatctatgcaatcggagtgggaaagttggatgtcgactggagggagcttaacgagctgggctcaaaaaaagatggcgagaggcacgccttcatactccaggataccaaggcgctacaccaggtgttcgaacatatgcttgacgtctcaaaactgactgatactatatgcggcgtggggaatatgtccgctaatgcctcagaccaggagcgcactccatggcatgttacgattaagcccaaatcacaggaaacctgcagaggggctctgatatcagaccaatgggttctcacggcagcacactgtttccgcgacggtaatgatcacagtctctggagggtgaacgtgggcgaccccaagtcccagtggggcaaagagtttctcattgaaaaagccgtgatttctccaggatttgatgtgtttgcaaaaaaaaatcaaggcattctcgaattctatggagacgacatcgccctactgaagcttgctcagaaggttaagatgagtacccatgccagaccaatatgtctcccgtgtactatggaggccaatctggctctccggaggcctcagggatcaacctgtcgggatcacgagaatgagcttctaaacaagcaaagcgtgcccgcacattttgtggcgctcaacggctccaaacttaacattaacctaaagatgggcgtggaatggacaagctgcgccgaggtagtatcccaggagaagactatgttcccaaatctgacagatgtgagagaagtggtgaccgaccaatttctgtgctccgggacgcaggaagacgagtccccatgtaagggcggttcaggggagctcggaagcttacagcctttgccttggctatgctag

SEQ ID NO: 219030 - DNA, 1863 bp, Artificial Sequence
  Description of Artificial Sequence: Synthetic coding sequence
atgggcccacttatggtgctcttctgtctcctgtttctttatccagcaggtcactgccccaaccccggtatctcattgggggcagtacgaactggttttaggttcggacatggagacaaggtacggtatagatgctcaagcaatctggttttgaccggttcttctgaacgagagtgccagggaaacggtgtgtggtcgggcacagaaccaatttgtagacagccctattcatacgacttccccgaagatgtcgccccagccctagggactagctttagtcatatgttgggcgctacaaatccgacacagaaaaccaaggagtcgcttggtcgcaagatacagatccagcgttctgggcacctgaacctttacctcctgcttgactgtagccagagtgtgagcgaaaacgatttcctgatcttcaaggagtcagcatcattaatggtggaccggattttctcatttgaaattaacgtgtccgttgcgataatcacttttgcatcagagccaaaagttttaatgtccgtgcttaacgacaattctcgagacatgaccgaagtgattagcagcctggagaacgccaactacaaagaccacgagaatgggaccggcaccaacacatatgccgctctaaactccgtgtatctgatgatgaacaaccagatgcgactcctgggcatggagacaatggcatggcaggaaatcagacacgcgatcattctccttacagacggcaaatcaaatatgggaggatctcccaaaaccgctgttgaccacattagagaaattctgaatatcaaccaaaagcggaacgactacctggacatctatgcgatcggggtgggaaagctcgacgtcgactggcgagaactgaatgaactgggttctaagaaggatggagagcgccatgcattcatcttgcaggataccaaggcgcttcaccaagtatttgagcacatgctggacgtgagtaagctcactgacaccatttgtggagttggcaatatgtcagccaatgcaagtgaccaggaacgcactccatggcacgtgaccatcaagccaaagtctcaggagacttgtcggggagccctgatctctgatcagtgggtgctgacagctgctcactgcttcagagatggtaatgaccacagcctttggcgggttaacgtgggcgacccgaagtctcagtgggggaaagagtttcttatcgagaaggccgtcataagtccagggttcgatgtcttcgccaagaaaaatcagggcatcctcgaattttacggcgacgatatcgcactcttgaaactggcacagaaagtgaaaatgtctacacatgcacgcccaatttgtttaccatgtaccatggaggcgaatctcgcattgagaagaccccagggctccacatgtagggatcacgagaacgagctgctgaataagcagtccgtcccagctcacttcgtggctctaaatgggtctaaactgaacatcaatctgaaaatgggggtcgagtggacgagttgcgccgaagttgtttcacaagagaagactatgttccccaacctaaccgatgtccgggaggtggtgacagatcagttcctttgcagcgggactcaggaggacgagtctccctgcaagggagaatcaggcggagctgtctttttggagcgccgatttcgcttcttccaggtcgggctcgtgtcatggggcctgtacaatccttgtctgggaagtgctgacaagaactctaggaaaagggcaccccgatctaaggtgcccccaccaagagatttccatatcaacctgtttcggatgcaaccatggctgagacagcacttaggcgacgttctgaactttctgcccctgtag

SEQ ID NO: 219031 - DNA, 1863 bp, Artificial Sequence
  Description of Artificial Sequence: Synthetic coding sequence
atgggccctttaatggtgttattctgtctgctgttcctctatcctgcaggtcattgccctaaccctggaatcagtttaggagccgttaggaccggattccgattcggccacggagacaaggtgaggtaccgctgcagcagtaaccttgtgttaacgggcagctcagagcgcgaatgccaaggaaatggcgtttggtccgggaccgaacccatctgtcgacagccttatagctatgacttcccagaggatgtggcgcctgcattgggtacctcgtttagccatatgctgggggctacaaatcctacacaaaagactaaggagtctctgggtcgcaagattcagatccagcggtcgggacaccttaatctctacctgcttttggactgttcccagtccgtgagcgagaacgattttctgatctttaaagaaagcgctagcttgatggttgatcgcatcttttcttttgaaatcaatgtgtctgtagccataatcacgttcgcttccgaaccaaaggtccttatgtccgttctgaacgacaactctagggatatgaccgaagtcatcagctccctcgagaatgccaattataaggaccacgagaacgggacaggtaccaacacatacgctgcacttaactcggtctacctcatgatgaacaatcagatgcgactgctcggcatggagacgatggcctggcaggagatcagacacgccatcatcctgctgacagatgggaaatctaacatgggagggtcccccaaaactgccgtggatcacattcgcgaaatcctgaacatcaaccaaaagcgtaacgactatctggacatctacgccattggagttggaaagttggatgtagactggagggaactgaatgaattaggaagcaagaaagacggagagcgtcacgcttttattctgcaagataccaaggcactccatcaggtcttcgaacacatgctggatgtcagtaagctcaccgacacaatctgcggagtcggcaacatgtccgccaacgcctccgaccaagagagaacaccatggcatgtgaccatcaaaccaaagagccaggagacctgtagaggggctctgatatcggaccagtgggttcttacagccgctcattgcttcagagatggcaatgaccacagtctctggcgcgtgaacgtcggagatcctaaaagtcagtggggaaaagagtttctgatagagaaagcagtcatttcacccggatttgacgtattcgcaaaaaagaaccagggaatccttgagttctacggggatgatattgcactgcttaaactggcccagaaggtgaagatgagcacccacgcacgcccaatttgtctcccttgtactatggaagctaatttagccttacgcagaccacagggatccacctgtagagaccacgagaatgagcttttgaacaagcagagcgtccctgcgcactttgtggccctgaacggaagtaagttgaatataaacttaaagatgggggtggagtggacctcatgtgctgaggttgtgagtcaagagaaaacaatgttccccaacctgacagatgtcagggaagtggttactgatcagttcctttgtagtgggacccaagaagacgagagtccatgcaagggcgagagtggcggagctgtctttttggagagacggtttcggttctttcaggtcggactggtaagttggggactgtacaatccatgcctgggtagtgctgacaaaaactctcggaagcgtgcaccacggagcaaagtccccccacccagagacttccacatcaacctattccgtatgcaaccctggctgcggcaacacctcggcgacgtacttaattttttgcccctgtag

SEQ ID NO: 219032 - DNA, 978 bp, Artificial Sequence
  Description of Artificial Sequence: Synthetic coding sequence
atgggcacacggtccgccattgctgccccacggattctttgctcaaggggcttgaggagtggttcagcgagagccactgggagtggagtggagcgctcccctagtgcagcgaatccaaccctgatgactagtctacgtacatggcctctgccttgggcactgcccagccccacttgcttgggcccacctataccgccacgacgacaaagaattttctcattcgaaatcaacgtgtcagtcgctattatcacgttcgcctctgagccgaaggttctgatgagcgtccttaatgataatagcagggatatgaccgaggttatcagttcgctcgagaatgccaactataaagaccatgagaacgggacgggtaccaatacttacgccgctctcaattctgtatatctgatgatgaacaaccagatgcgtttattaggtatggagactatggcatggcaagaaataaggcacgccatcatcctgcttacagacggaaagtcaaacatgggtgggtcgcccaagaccgcagtggaccatataagagagatccttaatatcaatcagaagcgcaacgactacctggatatatacgcaataggggttggcaaactcgacgttgactggagggagctcaacgagctgggttctaagaaggatggagaacggcacgccttcatcctacaagacactaaggctctgcatcaggtttttgagcacatgctcgatgtgtctaaacttaccgacacaatttgtggggtgggcaacatgagcgctaacgcctccgaccaggagagaaccccgtggcatgttactattaagcccaagtcacaggaaacttgtcgtggcgctttaattagtgatcagtgggtcctcacagccgctcactgcttccgggacggtaatgaccatagcctatggagagtcaatgtgggcgatccaaagtcccagtggggaaaagagtttctcatcgaaaaagcctag

SEQ ID NO: 219033 - DNA, 978 bp, Artificial Sequence
  Description of Artificial Sequence: Synthetic coding sequence
atggggaccaggagcgctatcgcagctccacgaatactttgttcccgaggcctgagatcaggctccgcgagggcaacaggcagcggggtggaacggtccccaagcgccgcaaatcccacgctgatgacatccctccgaacgtggccccttccgtgggcactgccgtctccaacatgcctcggccctccaattcccccacgtagacaacggattttttcctttgagataaatgtctcagttgcgattatcacatttgcatcggaacccaaggttctgatgtccgttctcaacgataatagtagagacatgaccgaggtgatctcatcactggagaatgctaactataaagaccacgagaatggcacaggcactaatacttacgccgctctgaatagcgtttacctcatgatgaataaccagatgcgccttcttggcatggagacaatggcatggcaggaaatccgccacgccataatcctcctaaccgacggaaaatcaaatatggggggatcaccaaagaccgccgtggatcatatacgcgaaattctcaacattaaccagaaaagaaatgactatcttgacatttatgcaataggggtgggtaagctcgacgtagactggcgggaacttaacgagctaggaagtaaaaaggacggagagcgacacgccttcattctgcaagacactaaagccctccaccaggtgtttgaacatatgctggacgtctctaagctgacagacactatttgcggggttggcaatatgagcgcaaacgccagcgatcaggagcggaccccttggcacgttacaataaagcctaagagccaggaaacctgtaggggagcccttatctctgatcagtgggtactgaccgctgcacattgctttagagacgggaacgaccactcactgtggcgagtgaatgttggcgaccctaaatcccagtggggcaaggagtttctcatcgaaaaagcctag

SEQ ID NO: 219034 - DNA, 1521 bp, Artificial Sequence
  Description of Artificial Sequence: Synthetic coding sequence
atgggcacacgatctgcaattgccgctcccagaatcctgtgttcccggggattgaggtctgggtcggccagagcaaccggttcgggggttgagcggtctccgtccgcagctattttttcctttgagatcaatgtgagcgtcgccatcatcacttttgcgagcgagccaaaggttctcatgagcgtgcttaatgacaattctagggatatgaccgaagtgattagctccctggagaacgctaattataaggaccatgaaaacggaaccggcacgaatacctacgcagccctgaattcagtctaccttatgatgaacaaccagatgagactactgggaatggaaactatggcatggcaggaaattcgtcacgccattattttgctgaccgacggaaagagcaacatgggcggtagtccgaagacagctgtcgatcatattagggagattctgaacattaaccaaaaaagaaacgattatctggatatatatgccatcggggttgggaagctggatgtggactggagggagctgaatgaattgggctccaaaaaagatggagagcgacacgcctttatactacaggatactaaggccctccaccaggtgtttgaacacatgctggacgtaagtaaactcactgatactatctgtggagtcggcaatatgtctgcgaatgcttcggaccaggaaagaacaccctggcacgttaccatcaaaccgaagagccaggagacgtgcagaggcgctctgatttccgaccagtgggttctgaccgcagctcattgtttccgggatggtaacgaccactccctatggcgggtgaacgtcggcgacccgaaatcccagtggggaaaggaattcttaatcgagaaggccgtgattagcccaggcttcgacgtcttcgccaagaagaatcagggcattctagagttttatggagacgacattgcgctgctcaaactggcccagaaggtgaaaatgagtacccatgctagacctatatgcctgccctgcacgatggaggctaatctggcgcttcgacgccctcaggggagcacgtgcagagatcacgaaaatgagttgctgaataaacaatcagtgcccgctcacttcgtggctctcaacggatctaaacttaacatcaatttgaaaatgggagtggagtggacctcttgtgctgaggtggtatcccaggagaagacaatgtttccaaacctgacagacgttagggaagtggtcacagatcagtttctgtgtagcggcactcaggaggacgagagtccttgtaaaggcgaaagcggtggggctgtattcctagagcgcaggttcagattcttccaagtggggttggttagctgggggctctataacccttgcttggggtcggcagataagaatagcaggaagagagcacccagaagtaaagtgcctcctcctcgtgatttccacattaaccttttcaggatgcagccttggctgagacaacacctcggcgacgtgctgaatttcctgccattatag

SEQ ID NO: 219035 - DNA, 978 bp, Artificial Sequence
  Description of Artificial Sequence: Synthetic coding sequence
atgggtactcgatctgctatagctgccccaaggatcctgtgtagtcggggtctgcggagtggaagcgcacgggcaaccggctccggcgtcgagcgatctccaagcgccgcaaatccaaccctgatgacgagcctccggacctggcctcttccctgggccttgccatcgccaacgtgcctcggcccacccataccacccaggagacagcggatcttctcattcgagatcaatgtgagcgtcgcgattatcaccttcgcctcagaacccaaggttcttatgagtgtgctgaatgacaactctcgcgacatgaccgaagtcatctcgtctctcgaaaatgctaactataaagaccatgagaatggtacaggaactaacacatatgctgcgttaaatagcgtgtatctgatgatgaataaccagatgcgcctgctgggcatggaaaccatggcatggcaggaaatccgacacgcgattatcctcctgaccgacggaaagagtaatatggggggatcacctaagactgccgtggaccacattagagaaatcctgaacattaaccaaaaacgcaacgattatctggacatctacgctattggagtaggaaaacttgatgtggattggcgcgaattaaatgagttgggttctaagaaggacggagagcgccacgctttcattctgcaggacaccaaagcgttacaccaagtcttcgagcatatgcttgatgtcagtaagttaaccgacacaatctgtggagtgggaaacatgagcgccaacgctagcgatcaagagcgaacgccttggcatgtcacgatcaaaccgaagagccaggaaacctgcaggggtgctcttatatccgatcagtgggtgctgacagctgcacactgcttcagagatggaaacgaccactcgttatggcgagtgaacgttggtgatcccaagagtcagtggggaaaagaattcttgatagagaaggcatag

SEQ ID NO: 219036 - DNA, 1863 bp, Artificial Sequence
  Description of Artificial Sequence: Synthetic coding sequence
atgggaccactgatggtcctattttgtcttctctttttgtatcccgctggccattgcccgaatccaggtatcagtctaggcgctgtacgcacaggcttcaggtttggccacggagataaagtgagataccgctgctctagcaatctggttctcacaggatcttcagaacgagagtgccaaggaaacggggtgtggtctggaacagaacctatatgcagacagccgtattcctacgacttccccgaagacgtcgccccagctcttgggacgagtttctctcacatgctcggagctacaaatccaactcagaagaccaaggagagcctgggacgtaagattcaaatccaaaggagcggtcatctgaacttgtatctgctgctggactgttctcaatccgtgtcagagaacgacttcctgattttcaaagagtccgcatccctaatggtggatcgtatcttcagcttcgaaattaatgtgtctgtggccatcattactttcgcatccgagcctaaagtccttatgagcgtgcttaatgataattcccgtgatatgaccgaagtcatcagtagcctggagaatgccaattacaaggatcacgaaaacggcaccggtactaacacgtacgccgcactgaatagcgtttacctgatgatgaacaaccagatgagattgctcgggatggagactatggcatggcaagaaattcggcatgccattatactgctgacagacgggaagtctaatatggggggtagcccaaaaacagccgtagatcacatcagagagattcttaacataaaccaaaagcgcaacgactatctcgatatttacgcaattggagtggggaaactggacgtggattggagagagcttaacgagcttggctccaagaaggacggcgaaagacatgcatttatcctgcaggatacaaaggccctccaccaggtgttcgagcatatgctagatgtgtccaagcttacagacaccatctgcggagttggcaatatgtcagccaatgcttccgaccaggagcggaccccctggcatgtcaccattaagcccaagagtcaagagacttgtagaggggctctgatttctgaccagtgggtgctgacagcggctcactgcttcagggacggcaacgaccacagcctgtggagggttaacgtgggtgatccgaaatctcaatggggaaaagagttcctcatcgagaaagccgtaatctcccctggctttgatgtgtttgccaaaaaaaatcagggaatcctggagttttatggggatgacattgccttattaaaactggcgcaaaaggtcaagatgtctacccacgctcggccaatatgtttaccttgtaccatggaggcgaacttggcgctccggcgaccgcaggggagcacctgtcgcgaccatgagaatgagctcctcaataaacagtccgtgcctgctcactttgtagcgctgaatgggtccaaactcaatatcaacctgaaaatgggtgtcgaatggacctcctgcgcagaagtggtgagccaggagaagactatgttcccaaatttaacagatgtcagggaggttgtcaccgatcagttcctctgttccggaacccaggaggacgagagcccctgcaagggtgagtctggcggagccgtctttctggagcgcaggtttagattcttccaggtggggctggtcagctgggggctgtataatccctgcttaggaagtgcagacaaaaattcacggaagcgggctcctagatctaaggtcccgcctccacgggattttcacatcaacctttttagaatgcagccatggctccggcagcacttaggtgatgtgttaaatttcctgccgctgtag

SEQ ID NO: 219037 - DNA, 1134 bp, Artificial Sequence
  Description of Artificial Sequence: Synthetic coding sequence
atgacggaggtcattagcagcttggaaaatgcgaattacaaggaccacgaaaacggtacaggaaccaacacctacgccgcattgaactctgtgtacttaatgatgaacaatcagatgcgcctgctgggtatggagacaatggcctggcaggaaattaggcacgcgattatcctgctcaccgatggcaagtctaacatggggggttctccgaagaccgcagtcgaccatatacgcgagattctcaacatcaaccaaaagcgtaatgattatctcgatatctacgccataggggtggggaagcttgatgttgactggagggagctgaatgagctgggaagcaagaaggacggggagaggcatgcctttattttgcaggacaccaaggctctccaccaagtgttcgagcacatgctcgatgtctcaaagctcaccgacactatttgcggggtcggcaacatgtccgccaatgctagcgatcaggaacgcactccttggcacgtgacaataaaacctaagagtcaggagacgtgccgcggtgccctgatcagcgaccagtgggtcctgaccgcagctcactgctttcgtgacggaaatgaccatagcctgtggagagtcaacgtcggggaccctaagagtcaatggggcaaagaatttttgattgagaaagccgtgatcagtcctggattcgatgtttttgcaaagaaaaaccagggtatcctggaattttatggagatgacatcgccttgctcaaattggcccagaaggtgaaaatgagcacccacgccaggcctatctgtctgccttgcaccatggaggctaatttggctctgagacgcccacagggctcgacctgtagagaccacgagaacgagctgctgaataagcagtccgtgccggctcattttgtcgctctgaacggctcaaagcttaacatcaacctgaaaatgggggtggagtggacgagttgtgcggaggtagtgtctcaggaaaaaaccatgtttcccaatctgacggacgttcgggaagtagtgacagaccagttcctgtgttcaggcacacaggaagatgagagtccctgcaaaggaggatccggagagttgggaagcctccagcccctgccttggctctgctag

SEQ ID NO: 219038 - DNA, 1134 bp, Artificial Sequence
  Description of Artificial Sequence: Synthetic coding sequence
atgactgaagtaatctcatccctcgagaatgcgaattacaaagatcacgaaaatgggaccggcacaaatacatatgctgctttaaactctgtgtacctgatgatgaacaaccagatgcgacttctagggatggaaaccatggcctggcaggagatccgtcatgccatcatcctgctgacagatggaaaaagtaacatgggaggcagtcctaagacagcagtggaccacatccgagagattctcaacattaaccagaaacggaatgactacctggacatctacgctattggggtaggcaagctcgatgtggattggcgggaactaaatgagctgggctccaagaaagacggggagcggcacgcgtttatcctgcaagatacgaaagctctgcaccaggttttcgagcatatgcttgatgtgagtaaactaactgacactatttgcggggttggaaatatgtctgcgaatgcatctgatcaggaacgcaccccttggcatgtcaccatcaaaccgaagtctcaagaaacatgcaggggagccctgatcagcgatcagtgggtccttactgcagcccactgtttcagggacggaaacgatcactccctgtggagggtgaatgtcggcgaccccaagagccagtgggggaaggagtttttaatcgagaaggccgtcatctctccgggtttcgacgtctttgccaagaagaatcagggaatcctagagttttacggggacgacatagccctcctcaagctggcccagaaggtcaagatgtctactcatgcacgccctatttgcctcccatgtacgatggaggctaatctggcacttcgcaggcctcaggggtccacctgcagggatcatgagaatgagctcctcaacaaacagtctgtgccagctcactttgtagctctgaacgggtctaaactcaacatcaacctcaaaatgggcgttgagtggacgtcctgcgcagaagtggtatcccaggaaaagaccatgtttccaaatcttacagacgtcagggaggtagtcaccgatcagtttttatgttcaggcacccaggaagatgagtcaccctgcaaaggaggcagtggagaattaggcagcctgcagcccctcccatggctctgctag

SEQ ID NO: 219039 - DNA, 978 bp, Artificial Sequence
  Description of Artificial Sequence: Synthetic coding sequence
atgggaacccgttccgctatcgctgcacctcgcattttgtgttcccggggtcttcgaagcggcagcgcccgagccacggggtccggtgtcgagcgctctcccagcgctgcgaatcctactctaatgacatccctgagaacatggcccttaccctgggccctgccctcaccaacatgtctgggccctccaattccacccagaagacagcggatttttagcttcgagataaatgtgtctgtcgctatcatcacatttgcatctgaaccaaaggtcctcatgtcagtgctgaatgacaacagtcgggatatgacagaggtgatttcctctctggagaatgctaactacaaggaccacgaaaacgggaccggcaccaatacgtacgctgctttaaacagcgtctacctcatgatgaataatcagatgagactgctcggcatggagacgatggcctggcaggaaatacgccacgcaataattctgctcactgatggaaagtccaatatggggggaagccccaaaactgccgttgaccatatcagggagatccttaacattaaccagaaacgcaatgactacctggatatttatgctattggcgtgggcaagttggatgtcgactggcgcgagttgaatgaactcggttctaaaaaagacggagaaaggcacgcttttatactgcaggacaccaaggcattgcaccaggtttttgagcacatgctcgatgttagcaagctcaccgacactatatgcggggttggcaatatgagcgcaaatgcaagcgaccaggaacgcacaccatggcatgtgaccatcaaacccaagtcccaggagacatgtcgaggggcactcataagtgatcagtgggttctgaccgctgcacactgttttagggacggcaacgaccactccttatggagggtaaatgtaggtgaccccaagtcccagtggggcaaggaatttctgatagagaaggcctag

SEQ ID NO: 219040 - DNA, 1134 bp, Artificial Sequence
  Description of Artificial Sequence: Synthetic coding sequence
atgaccgaggtaattagctcactggaaaatgcaaattacaaggatcacgagaatggcaccggcaccaatacatatgccgctctgaattccgtgtatctcatgatgaataatcagatgcgtctcctggggatggagacgatggcatggcaagagatccgccacgccatcattctccttaccgatggaaaatcgaatatggggggatcccctaagacggctgtggatcacatccgtgaaatcttgaacataaatcaaaagcgtaacgattacctggacatttatgcaatcggggtgggaaagctggatgtggactggcgcgagctgaacgaactgggaagcaagaaagacggggagagacacgccttcatcctgcaggatactaaggccctgcaccaagtgttcgagcatatgctggatgtcagtaagcttacagatacgatctgtggtgtgggaaacatgtcagcaaacgcaagcgaccaggaaagaaccccctggcacgtaaccatcaaacctaaatcccaggaaacatgtcgcggtgctttgatctcagaccagtgggtgctaacagcggctcactgttttcgggacgggaacgaccacagcctgtggcgtgtaaatgtgggggacccgaagtcgcagtggggcaaggaattcttaatcgagaaggccgttatatcccccggattcgacgtattcgccaaaaagaatcaaggaatcctggagttctatggcgacgacatagcactgctgaagctagcgcagaaagtgaaaatgagcacccatgctaggccgatctgtctcccttgcaccatggaggcgaaccttgcactgaggcggcctcaaggctccacatgccgggatcacgagaacgagctgctgaacaaacagtccgtccctgcccatttcgttgcactgaacgggtccaaattgaacataaatctgaagatgggcgtcgaatggacatcctgtgccgaggtcgtcagccaggagaaaaccatgtttcctaaccttaccgacgttcgcgaagtcgtcaccgaccaattcttatgctctgggactcaggaggatgagagtccatgcaagggtggatccggcgaactgggcagcttacaacccctgccctggctatgttag

SEQ ID NO: 219041 - DNA, 1617 bp, Artificial Sequence
  Description of Artificial Sequence: Synthetic coding sequence
atgagggccctctgtattcgggaaacatgttcttctgaacttgggttctctcggaactggtctcgtcgtaaagcaggtcactgtcccaatccaggcatcagcttgggcgctgtgcgcaccgggttcaggttcggccacggggataaggtgcggtaccgctgcagctccaatctcgtcctgacagggagcagtgagagagaatgccaaggcaatggggtgtggtcaggaaccgaacctatctgccgacagccctatagctacgatttcccggaagacgtcgctcccgctttaggtactagcttcagtcatatgttaggcgctaccaaccctacacagaaaaccaaggaccatgagaacggcactggcaccaatacgtatgccgcactgaatagcgtatatctaatgatgaacaatcagatgcggctcctggggatggaaactatggcttggcaggagatccgtcatgccattattctccttaccgacgggaagagtaatatgggaggaagcccaaaaaccgccgtagatcatattcgcgagattctcaatatcaatcaaaagcgaaacgattatctcgacatttatgctatcggtgtgggcaaattagacgttgattggcgagagctaaacgaactaggcagtaagaaagatggggagagacacgccttcatcctgcaggatactaaagctctccaccaggtgttcgagcatatgctggatgtgtctaaactaacggatacaatatgtggcgttggaaatatgtcagccaacgctagtgaccaggaaaggaccccttggcacgttactatcaagcccaagtcacaagaaacttgtagaggggctctaatcagcgaccagtgggttctcactgctgcccactgcttcagagacggtaatgaccactccttgtggagagtcaacgtgggggaccccaagagtcagtggggcaaggaattccttatcgagaaggctgtgatcagcccaggcttcgacgtcttcgcaaagaagaatcaggggatcctcgagttttacggggacgatattgctttgctcaaattggctcaaaaggtgaaaatgtctacccacgcgcgtcccatttgcctgccctgtacaatggaagccaatttagctctgcggagacctcagggttctacctgccgggaccacgaaaacgagttactcaataaacaatctgtacctgcccattttgtggccctcaacggctccaaactcaacattaacctgaaaatgggcgtcgagtggactagctgtgccgaggttgtgtctcaagaaaagactatgtttcccaatttgactgacgtgcgagaagtggtgaccgatcagtttttatgttccgggacccaggaggatgaaagtccctgcaagggcgaatccgggggtgcagtcttcttggagagaaggttcagatttttccaagtgggtctggtatcatggggattgtacaatccctgcctcggctccgctgataagaactcaagaaagcgggcaccccgtagtaaggtgcctccccctcgggattttcacataaacctgttccggatgcagccctggttacgccagcacctcggcgacgtgttaaattttttgcctctctag

SEQ ID NO: 219042 - DNA, 1863 bp, Artificial Sequence
  Description of Artificial Sequence: Synthetic coding sequence
atggggccacttatggtcctcttttgtcttctgttcctgtaccctgctggccattgtccaaaccccggtattagcctgggcgctgtgagaacgggcttccggttcggacacggtgacaaagtgcgctatagatgctcaagcaacttagtcctaacagggtcatctgagcgtgagtgccagggcaacggagtgtggtccgggaccgagcccatctgccggcagccctacagctatgactttccagaagacgtggcccctgcactcggcacatccttttctcatatgctaggtgccactaacccgacccagaagaccaaagagagcctgggtcgcaagatccagatccaacgttccgggcacctcaatctgtatctgctgctggactgttctcaaagtgtgagtgagaatgacttcctcatctttaaggaatccgcgtccctgatggtagatcgcatcttttccttcgaaattaacgtctcagtcgccatcatcacattcgcatctgagcctaaggtgctcatgagcgtcctcaacgataacagcagagatatgacagaggttatctcgagcctggagaacgcgaattataaagaccacgagaacggaactggcactaacacttatgcagcccttaactcagtgtatctcatgatgaacaaccagatgcggcttttggggatggaaactatggcttggcaagaaatcaggcatgccattattttgttgacagacggtaaaagcaatatgggaggctccccgaaaaccgcggtggaccatatcagggagatcttaaatatcaaccagaagaggaatgattacttggatatttacgctatcggggtgggcaagctcgacgtggactggagagaacttaatgagctgggctcaaaaaaagacggcgagcggcatgcattcattttacaagacaccaaggctctacaccaggtttttgagcacatgctggacgtctccaagctgactgacacaatctgcggtgtaggtaacatgtcggccaatgcctcagaccaggagagaaccccctggcacgtgacgatcaaacctaagtcccaggagacctgccgcggtgccctcattagtgatcagtgggtgctcaccgcagcccattgttttcgggatggcaatgatcactccctgtggagggtgaatgtcggagacccgaaaagccagtggggcaaggagtttctgatagagaaagccgtgatttcacccggttttgacgtgtttgcaaagaagaaccagggcatcctcgaattttacggggatgacattgcactgctgaaattggctcaaaaggtcaagatgtcaacccacgcgcgacctatatgtttgccatgtacgatggaggccaacctcgcgctgcggcgtccacagggctcgacgtgtcgcgaccacgagaacgagctcctgaataagcagagtgtccccgcacactttgtggctctaaatggttccaaacttaatattaacttgaaaatgggcgttgagtggaccagctgcgcagaagtggtgtcacaggagaagactatgtttcctaacctcacagatgtgcgagaggtcgtgactgaccaatttctgtgctcagggacacaagaggatgagagcccttgcaagggagagtcggggggagccgttttcctagaacgaagattcagatttttccaggtgggactggtgagctggggtctgtataatccatgcttggggtctgccgacaagaattcacgcaaacgcgcacctcgcagcaaagtaccccctccgcgtgattttcatatcaaccttttcaggatgcaaccatggctgcgacagcatctcggtgacgtattaaattttctgccactctag

SEQ ID NO: 219043 - DNA, 1863 bp, Artificial Sequence
  Description of Artificial Sequence: Synthetic coding sequence
atgggacccttgatggtccttttttgcctcctcttcttgtaccctgctggacactgtcccaatcctggcatttctctgggggctgtccggaccggctttcgcttcggccatggggacaaggttagataccgttgttcttccaatctggtcttgaccggctcctcagaacgggagtgccagggcaatggagtgtggagcggtactgagcctatatgtcgccaaccttacagctatgactttccagaggacgttgcccctgctctgggaacttctttttcacatatgctcggagctacaaacccaacccagaagactaaagaaagcctcggtcggaagattcagatccagcgcagcggacacttaaatctttacctactccttgattgctcacagagtgtctccgaaaacgactttctcattttcaaggagtctgcctccctgatggtggaccgtatctttagttttgagattaacgtgtccgtcgcaataattaccttcgcctctgaaccaaaggttcttatgtccgtgctcaatgacaattcccgcgatatgaccgaggtgatttcttctctggaaaacgccaactacaaggaccacgagaatggtacaggaactaacacatatgcagccctaaattccgtgtatttgatgatgaacaaccagatgagactcctggggatggagacaatggcctggcaggagatccgtcatgccatcattcttctcaccgacggtaagagcaacatggggggtagtccgaaaactgcagtcgaccacataagagaaattttaaatattaaccagaagcggaatgactacctggatatttatgccattggcgtggggaagttggacgtcgactggcgggagctgaatgaacttggcagcaagaaggatggcgagagacatgctttcattcttcaggacacaaaagcactacaccaggttttcgagcatatgttagacgtctctaagctgacagacaccatctgtggagtcggtaacatgtcagcaaacgcttcagaccaggaaagaacgccttggcacgtaacaattaagcccaagagccaggagacctgcagaggggctctcatttccgaccagtgggtgttgactgcagcccactgttttagagatggaaatgatcattctctttggagagtgaacgtgggcgatcccaaatcacagtggggtaaggagtttctcatagaaaaggcagtgatttccccaggattcgatgtgttcgcaaaaaagaaccagggcatcctcgaattttacggtgacgacatcgcactactgaaattagctcagaaggtaaaaatgagtacacatgccagacctatctgcctgccttgtaccatggaggcaaatctggctttgcgtcggccacaggggagcacctgcagagatcatgaaaacgagttactgaacaaacagtccgtcccggcacatttcgtagcccttaatggctcgaagctgaacatcaatctcaagatgggggtagaatggactagttgcgcggaggttgtgtctcaggagaaaaccatgttccctaacctgactgacgtgcgcgaagtcgtgacagaccagtttctttgctccggaacccaggaggacgaatccccttgcaagggagaatcaggaggcgcagtgttcttagagagacgctttcgcttcttccaggtggggttagtgagctggggattatataatccctgcttaggcagcgcggacaagaattcaagaaagcgagccccaaggtctaaagtgccccctcccagggatttccacatcaacttatttaggatgcagccttggttgaggcagcacctcggcgatgtgcttaactttttacccttgtag

SEQ ID NO: 219044 - DNA, 1863 bp, Artificial Sequence
  Description of Artificial Sequence: Synthetic coding sequence
atgggacctctaatggttcttttttgtcttcttttcctgtaccccgctgggcattgcccaaaccccggaatttctttgggcgctgttcgcaccggcttccggtttggtcatggggacaaggtgcgttaccggtgttcgtctaatctagtcctcaccggaagctctgaaagggaatgccagggaaacggcgtatggtccggcaccgagcctatatgtcgccagccatattcatacgacttccctgaagacgtggcgcctgcactgggaactagtttctcccacatgttgggagctaccaacccaactcagaaaaccaaggaaagcttgggcaggaaaatccagatccagcggagcgggcaccttaatttgtatctactcctcgactgttcgcagtccgtgtcagaaaacgattttcttatctttaaagaatcagccagcttaatggtggatagaattttctcattcgagatcaatgtgagcgtggctataataaccttcgccagtgagcctaaggtgcttatgtcagttctaaacgataattcccgcgatatgaccgaggttattagctccctggagaatgccaattataaggaccatgagaacggcaccgggaccaacacatacgccgctctcaactctgtatatctgatgatgaataatcaaatgagactgctcggaatggagaccatggcttggcaggaaatcagacacgcaattatcctcctcaccgacgggaagtcaaacatgggtggcagcccgaaaacggcagtggaccatatacgcgagatcctgaacatcaaccagaagagaaatgactatttggatatctatgccattggagtcgggaagctcgacgtggattggcgtgagctcaacgagctggggtcgaagaaggacggcgagaggcatgcttttattttgcaggacactaaagctctgcatcaagtcttcgaacacatgctggacgtgtccaaactcaccgataccatatgcggcgtgggtaacatgagcgctaatgcctccgaccaagagaggacgccttggcacgttaccattaagcccaagtcccaggaaacctgtcgaggtgccctgatctctgatcagtgggttctcactgccgcacattgttttcgggatgggaatgatcactccctttggagggttaatgtcggggacccgaagagccagtggggtaaggaattcctgatcgagaaagcagttatcagcccaggcttcgatgtctttgcgaagaagaaccaggggattctcgagttctatggcgatgatatcgccctcctgaagctggcccagaaggtgaaaatgtccactcacgctcgcccaatatgcctgccatgtacaatggaggccaacctcgcgctccggagaccccagggttccacgtgcagagaccacgaaaatgaactgctgaacaagcagtccgtacccgctcatttcgtcgctttgaacggctcaaaattgaatatcaacctcaaaatgggggtggagtggactagctgcgccgaggtagtaagtcaagagaaaactatgttcccaaatcttaccgacgtgagagaggtcgtcacagatcagtttctgtgctctggcactcaggaggacgagtccccctgtaagggtgagagtggtggcgcagtcttcttagagcgcaggtttaggttcttccaggtggggctcgtgagctggggcctctacaacccctgtctgggttctgctgataaaaattcaagaaagagagcacccagaagcaaggtgccaccacctagggacttccacatcaacctattcaggatgcaaccctggttaaggcagcatctcggtgacgttttgaacttcctgcccctgtag

SEQ ID NO: 219045 - DNA, 978 bp, Artificial Sequence
  Description of Artificial Sequence: Synthetic coding sequence
atgggtacccgatctgcgattgccgctccgaggattctctgtagtcgaggactgaggagcggatccgcccgagcaaccggctcaggcgttgaacgctctccttccgctgctaaccccaccctaatgacgtccttaagaacatggcctcttccatgggctttaccctctcccacctgcctgggtccgcctatacctccaagacggcagcgcattttttcatttgagattaacgtgtctgtcgcaataatcactttcgcaagcgagcccaaggtgctgatgtccgtgctgaacgataactcgagggacatgactgaggttatctcgagtttagagaacgccaactataaagaccacgagaatgggacaggcacgaatacctatgccgcactgaattctgtgtacttgatgatgaataaccagatgaggttactgggtatggaaacaatggcctggcaagaaattagacacgctattatcctgctcacagatggcaagtcaaacatgggtggatcacccaagaccgctgtggaccacattcgggagatccttaatataaatcagaaaaggaacgattatctcgatatctatgccattggggtcggcaagctagatgttgactggagggagctaaatgagcttggaagcaagaaggatggtgagcgtcacgccttcatcctccaggatacaaaggcattgcaccaggttttcgagcacatgcttgacgtcagtaagctaaccgatacgatctgcggtgtgggtaatatgagtgctaacgcaagcgatcaggaaagaaccccttggcacgtcaccatcaagccaaagagtcaagaaacctgcagaggggcactgatctccgatcaatgggtactcactgctgcccactgctttcgggacgggaatgatcatagcctgtggcgggtgaacgttggggacccgaagtcacaatggggaaaggagttcctgatcgaaaaggcctag

SEQ ID NO: 219046 - DNA, 1134 bp, Artificial Sequence
  Description of Artificial Sequence: Synthetic coding sequence
atgacagaagtgatctcttctctagagaatgctaattataaggaccacgaaaatggaacagggacaaatacctatgccgcactgaattctgtgtacttaatgatgaataatcagatgcgactattgggtatggagacaatggcgtggcaggagattcgacacgcaattatcctcctgaccgatggcaaatccaatatgggagggtcacctaaaaccgctgttgaccacatccgggagattctgaatataaatcagaagagaaacgactacctggatatctacgctatcggcgtgggcaaattggatgtggactggagggaattaaacgagcttggcagcaaaaaggacggcgagcggcacgccttcatattacaggatacaaaggcgctgcatcaagtatttgaacacatgttggatgtgtccaaacttactgacactatctgtggggtgggtaacatgtccgccaacgcttctgaccaagagcggacaccttggcacgtgacaattaagccgaagagccaggagacatgtcggggtgcgcttatttctgaccaatgggtcctgactgccgcacactgttttcgcgatggaaacgatcatagtttgtggcgtgtgaatgtaggtgaccccaaatctcaatggggaaaggagttcctcatcgagaaggccgtcatttctccagggttcgacgtattcgctaaaaagaatcagggcattcttgaattctacggggatgacatcgcccttctcaaattggcccagaaggttaagatgtccactcacgcccgtcccatctgtctgccgtgtactatggaggccaatctggcactgagacgaccgcagggctcaacctgccgtgatcacgagaacgaattgctcaataaacagtccgttcccgctcactttgtggccttgaatggctctaagctaaatataaaccttaagatgggggtggagtggaccagctgcgcggaggtggtatcacaggagaaaaccatgtttccaaatctgacagatgtgagggaagtcgtgacggaccaattcctctgttcaggtacccaggaagacgagtctccctgcaaggggggatcaggtgaactaggttctttacaacctcttccatggctgtgctag

SEQ ID NO: 219047 - DNA, 1617 bp, Artificial Sequence
  Description of Artificial Sequence: Synthetic coding sequence
atgagggccctctgtatcagggagacctgtagctcggagctgggattttcaagaaattggtcacgccgtaaagcagggcattgcccgaatccgggtataagtctgggtgcggtcagaaccggttttcggtttggacacggggacaaagtgcgctaccgttgttcctccaaccttgtcctgaccggatcaagcgaaagggaatgccaggggaatggcgtctggtctgggactgaacccatctgtcgtcagccttattcgtatgactttcctgaggatgtcgcacctgcactggggactagctttagccacatgctgggggcaacaaatcctacccagaagaccaaggaccatgaaaatgggacagggaccaacacatatgccgctcttaacagtgtctacttgatgatgaacaaccagatgcggctgctgggaatggaaacaatggcctggcaggagattagacatgccattatactgctgacagacggcaaatcaaatatggggggttccccaaaaacagctgttgatcatatccgcgaaatcttgaacatcaaccagaagcgcaacgattacctggacatatacgctattggggtcggcaagctagatgttgactggcgggaactaaacgagctgggcagtaagaaggatggcgaaaggcacgcatttatattacaagataccaaagccctgcaccaggttttcgagcacatgttggacgtgagcaagcttaccgataccatttgtggagtgggcaatatgtccgcaaacgcaagcgaccaggagcgcaccccatggcacgtcaccatcaagcccaagtcacaggagacctgtcgcggagctctgatttccgatcagtgggttttgacagctgcacattgcttccgagatggaaatgatcactctctgtggagggtgaatgtgggagatccaaagtctcagtggggcaaggaatttctgattgaaaaggcagtgatctcgccaggctttgatgtgtttgctaaaaagaaccaggggatcctcgagttttacggggacgacatcgcccttctaaagctcgcccagaaagtgaagatgtctacacacgcccgtcctatttgtctgccctgtactatggaggccaatttggctctccgcaggccacagggctctacctgccgtgaccacgagaacgagcttctcaacaagcagagtgtgcctgcgcactttgtcgctctgaatgggagcaaacttaatattaacttaaagatgggagtggaatggacatcatgcgcagaagttgtgtcacaggagaaaaccatgtttccaaacctgactgatgtgagagaggtcgtaacagaccaatttctgtgtagtggcacacaagaggacgaatcaccttgtaagggggagtcagggggagctgttttcctagaaaggcggttccggtttttccaggtagggctagtctcctggggcctgtacaatccctgcctgggctccgctgacaagaatagcaggaagcgggcacccaggtccaaggtaccgcctccaagggactttcacattaatctgtttaggatgcagccttggttgcgccaacacttgggggacgttttgaattttcttccactctag

SEQ ID NO: 219048 - DNA, 1617 bp, Artificial Sequence
  Description of Artificial Sequence: Synthetic coding sequence
atgcgggctctatgtatccgggagacatgcagctctgaattgggttttagtagaaattggtccagacgtaaggctggccactgccctaacccaggtataagtctcggagccgtgaggactggtttccgattcggtcatggggataaggtgagatatcgttgtagctccaatctcgtcttaacaggatcttctgagcgggagtgccagggaaacggggtgtggagcggcactgagcccatctgtaggcagccgtactcatatgatttccccgaggatgtcgcccctgcactaggcacctcgttctcacacatgttaggcgcaacgaatccgacccagaagaccaaggaccatgagaatggaaccgggacaaacacatacgcagctctcaactccgtgtatctgatgatgaataaccagatgcgcctcttgggcatggagactatggcttggcaggagatacgccatgctataatactcctcaccgatggtaaatctaatatgggcggatctccaaagaccgcggtggaccacatccgggaaatactgaacattaaccagaagaggaacgattacctagatatatacgcaataggtgtgggaaagctagacgtggattggcgggagctgaacgagctaggttccaagaaggatggcgagcgtcacgccttcatcctgcaggatactaaggccctgcaccaggtgtttgagcatatgctggatgtgagcaaactgacagacacaatttgcggcgtgggcaacatgtcagccaacgcctcagaccaggaacgcactccctggcatgtgactatcaagcccaagtcccaggagacatgtcggggtgctctaatttcagaccaatgggtgctcacagccgcacactgcttccgcgatggaaacgatcattccctttggcgggtgaatgtgggcgatcccaagagccagtggggcaaggaattcttgattgaaaaggctgtgatctctccaggattcgacgtttttgccaagaagaatcagggaatcctcgagttctacggagacgatatagcacttctcaagctggcccaaaaggttaagatgtctactcacgcacgccctatatgcctgccttgtaccatggaagccaacctcgcgttacgaagaccgcagggatcaacttgcagggaccacgagaatgaactattgaacaaacagagtgtgcctgctcactttgtggccctcaacggctccaaactgaacatcaacctgaaaatgggcgttgaatggacctcatgtgccgaggttgtgtcacaggaaaaaaccatgtttcctaacttgacagatgtgcgcgaggtggtcacagaccaattcctgtgctctggtacccaggaggacgagagcccatgtaagggcgagtccgggggtgccgtgtttctagaacgacggttccgcttctttcaggtcggcttggtgtcttggggactgtataatccttgcctgggctctgctgacaaaaacagccggaaacgggctccaaggagcaaagtccctcccccaagggacttccacatcaacctgtttaggatgcagccgtggttacgccagcatctgggcgatgttctgaatttcctgccgctttag

SEQ ID NO: 219049 - DNA, 4992 bp, Artificial Sequence
  Description of Artificial Sequence: Synthetic coding sequence
atgggacccacttccgggccttcattattgctgctgctgctgactcacctccctctcgccctcggatctcccatgtactccatcattacccctaatattctgcggttggagagtgaagagaccatggtcctcgaggcacatgatgcacagggtgatgtgccagtcacagtgacagtgcacgactttccgggtaagaagttggtgctgtccagcgagaaaactgttctcacgcccgcaaccaaccacatgggaaatgttacctttacgatccctgctaatcgggagttcaagagcgaaaaggggaggaacaagtttgtgactgtgcaagcgacattcggaacccaggtcgtcgaaaaggtggtcctggtctctctccagtcgggatatctgttcattcagaccgacaagacaatttacacgccaggctcgacagtcctgtatcgcattttcaccgtcaaccataagttgctgcccgtggggcgaaccgtaatggtgaatattgaaaatcccgagggcatccctgtgaagcaggatagtctgagtagccagaaccagttaggagtactgcctctctcgtgggatatccctgaactggtcaatatgggccagtggaagataagagcctactacgagaattctccccaacaggtattttctactgaatttgaggtgaaggaatacgtactccccagcttcgaagtgatcgttgaaccaactgagaagttctactatatttacaatgagaagggtttagaagtcaccatcactgcaagatttctgtatggcaagaaagtggagggaaccgcattcgttatttttggcattcaggatggggagcaacgcatttccttgcccgagagtttgaaacggatccctatagaagacgggtctggagaggtcgtgctgagtcgtaaggttctcttggacggcgtccagaacccgagggctgaggacctggtgggaaaatctctctacgtgagcgccacggtcatattgcacagcggatcggatatggttcaggccgagaggagcggcatcccaattgtgacatccccttaccagatacactttacaaaaaccccaaagtactttaagccagggatgcccttcgacttgatggttttcgtcaccaatccagatggatcccccgcataccgggtcccagtggcagtgcagggcgaggacacggtgcagtccctgactcagggtgatggggtggccaaactgtccatcaatacccacccctctcaaaagcccctcagtatcacagtgaggactaaaaagcaggagttatccgaagctgagcaggctacccggactatgcaagccttgccatacagcacagtggggaatagcaataattacttgcacctgtcagtgctgcgaacggagctgcgtcccggagagactcttaacgtaaattttctcctccgcatggatcgcgcacatgaggccaagatccggtactatacttatttgatcatgaacaaagggcgtctgctgaaagcaggcagacaggtccgcgagcctggacaggatctggtggttctccctctatctattacaacagactttatcccatcatttagactcgtggcatactacactctgatcggggcttccgggcagagagaagtagttgctgactcggtttgggtagacgtcaaggactcatgcgtaggctctctggtcgtgaagtcagggcagtcagaagatcggcaacctgtccccggacagcagatgactttaaaaatagagggtgaccatggcgcaagggtggtgctggtagccgttgacaaaggagtatttgtgctgaataaaaagaataagttaactcagtcaaaaatctgggacgttgtggaaaaggccgatataggttgtactcccggttcaggcaaagactatgccggtgtgttctccgacgccggtctgacctttacctctagttccggacagcaaactgcccagcgcgctgagttacaatgccctcagcctgccgcaagacggagaagaagcgtgcagttgactgagaaacgaatggacaaggtgggcaagtaccctaaagagttacgcaaatgctgcgaagacggcatgagggagaacccgatgcgattcagctgccagcggcgaaccaggtttatatccctcggagaggcatgcaagaaggtctttctggattgttgcaactacataaccgaacttaggcgacaacatgcgagagcgtcacatcttgggttagcaaggagtaaccttgacgaggacattatcgcagaggaaaatatagtctctcggtcggagtttccagaaagctggctctggaatgttgaagaccttaaggagccgccaaagaacgggataagtaccaaactgatgaacatcttcctgaaggactctatcacgacctgggaaattcttgccgtgagcatgagcgataagaaggggatctgcgtggccgatccattcgaggttaccgttatgcaggattttttcatagatctgaggcttccgtactctgtcgtgaggaatgagcaagtcgaaattcgcgctgttctgtataactacaggcaaaaccaggaacttaaagtgagagtggagttactgcacaatcccgctttttgcagcctcgccaccactaaacgccgacatcagcagactgtaacaatccctcccaaaagttccctgtctgttccttacgtgattgtacccctgaaaacagggctgcaagaggtcgaagtgaaagcagctgtgtaccatcactttatctctgacggagtccgtaagtcacttaaggtcgtgcctgagggaattaggatgaataaaaccgtggcagtccgtaccttagaccctgagcggctgggccgagaaggtgttcagaaggaagatattccacccgcagatttgtctgatcaggttcccgacaccgagagcgagacccgcatacttctacagggaaccccagtcgcgcagatgaccgaggacgctgtcgatgcggaaaggctcaagcatctgatcgtcactccctcaggctgtggcgagcagaacatgataggcatgacccctactgtcatagccgtgcactatctggacgagacagagcaatgggagaagtttggactggagaagcgacagggagccttggagttaattaagaaagggtatacgcagcagctggccttccgtcagccctcatcagccttcgccgcatttgtaaaaagagccccaagcacctggctcactgcctatgtcgtcaaagtcttcagcctcgcggtcaacctaatcgccatcgactcccaggtgctttgcggtgctgtgaagtggctcatattggaaaaacagaagcctgacggcgtattccaggaagatgcgccagtcatacaccaagaaatgataggtggcctccggaataacaacgagaaggacatggcactgactgcttttgtgctcatctcgctgcaagaagcaaaggatatctgcgaggagcaagtgaacagcttgccgggaagtattaccaaggcaggtgattttctcgaggcaaactatatgaatctgcaaagatcctacacggtggccatcgccggatacgctttagcccagatgggacgtttgaaaggacctctactgaataaattcctaaccaccgccaaggacaaaaatcgctgggaagacccaggaaaacagctctacaacgtggaggctacgagctatgcactgcttgcgctgcttcagctcaaggactttgatttcgtaccaccagtcgtacgttggctgaatgaacagcgatattatggcggaggctacgggagcacgcaggccacgttcatggtctttcaggctctcgcacaataccagaaggacgctcccgatcaccaggagctcaacctggatgtctcattacagctcccttcccgttcgtcaaaaatcacgcacagaatccactgggaaagcgccagtctgctgagaagcgaggaaactaaggagaacgagggcttcacagttacagccgaaggcaagggtcagggcacactgagcgtggtgaccatgtatcacgccaaggcaaaggaccagctgacctgtaacaagttcgatttaaaggtgacaatcaagccagccccagaaaccgaaaagcgtccacaggatgcgaaaaacaccatgatcttggagatctgcacccggtataggggagaccaggacgcaaccatgagcatcctagatatcagtatgatgaccggatttgcccctgacacagacgacttaaaacagctggctaatggagtggaccggtatataagtaagtacgaactcgataaagccttcagtgatcggaacacgttgattatctatttggataaggtgtcccatagcgaagatgactgcctggcattcaaggtgcaccagtatttcaacgtagagctcatacagcctggcgcagtgaaggtctatgcatattataacttggaggaatcttgtaccagattttaccaccccgagaaggaggacggcaaactgaataagttgtgccgcgatgaactctgtcgctgcgccgaggagaactgttttattcagaagtcagatgacaaagtgacactggaagaaaggttggataaggcctgcgaaccaggcgtcgactatgtgtacaaaacgcgcctagtgaaggtgcagctcagcaacgatttcgatgagtacattatggctatagaacagactattaaatctggatccgatgaagtgcaggtgggacagcaaaggaccttcatcagccctatcaagtgcagagaagccctcaaacttgaagagaagaagcactatcttatgtggggcctgagctcagacttttggggagagaaaccgaaccttagttacatcatcggcaaggatacctgggtggagcattggcctgaagaggatgagtgtcaggacgaggaaaaccagaagcaatgccaggatctcggcgcatttacagaatctatggtggtgtttggttgcccaaactag

SEQ ID NO: 219050 - DNA, 1794 bp, Artificial Sequence
  Description of Artificial Sequence: Synthetic coding sequence
atgcatcctcctaaaactccgtccggcgctctacacagaaaaagaaagatggccgcttggccttttagccgtttgtggaaggtcagtgatccaattttatttcaaatgacactgatcgccgcattactgccggctgtccttggcaattgtggccctcccccaaccctctccttcgcagcgccaatggacatcaccctaacagagacccgtttcaaaaccgggactactttgaaatatacttgcctgcccggttatgtccggtcccacagcacgcagaccctgacctgtaacagcgacggagagtgggtgtataataccttctgcatttacaagaggtgcagacaccctggcgagctgaggaacgggcaagttgaaatcaaaacggatttatcattcggtagccaaatcgagttctcctgcagtgagggattcttcctgattggatcaactacgtctcgatgcgaggtacaagacaggggtgttgggtggtcgcatcccctacctcagtgcgaaatagtgaaatgtaaaccacctcctgacatcagaaacggcaggcattctggggaagaaaacttctacgcctatggtttcagtgttacctactcctgtgaccccaggttctctctactggggcacgcaagcatcagttgcaccgtggaaaacgaaactatcggcgtatggaggccttcaccccctacttgcgaaaagatcacgtgtagaaaaccggatgtgtctcacggggagatggtgtcaggcttcggccctatttataactataaggataccattgtctttaaatgtcagaagggttttgtgttaaggggaagttccgtgattcactgcgacgcagactctaagtggaatccatccccacctgcctgtgaacctaacagctgcattaatctcccagatattcctcacgcgtcttgggaaacatacccaaggcctacgaaagaggatgtgtatgttgtcggaactgttctccgttaccggtgtcatccaggctacaagcccaccaccgatgagcctactaccgtaatttgccagaagaatctgaggtggaccccatatcaagggtgcgaagccttatgttgcccagaacccaaactgaacaatggagagatcactcagcatcgcaagtcgagacccgcaaaccattgcgtgtatttctatggcgacgaaatttctttctcttgccatgagaccagccgcttctcagctatatgccagggcgacgggacttggtcgcccaggacccccagctgcggcgatatttgtaactttccacccaagattgcacacggtcattataaacagagtagcagctacagcttcttcaaagaggaaatcatctatgaatgcgataaggggtacatcctggtcggccaagccaagttgtcctgcagttattcccattggtctgcgcctgctcctcaatgcaaagctctgtgcaggaaacctgagctcgtgaatgggaggctcagcgtggacaaagatcaatacgtcgagccggagaacgtcacaatccagtgcgattctggatatggggtggttgggccacaaagcattacctgttcagggaataggacctggtaccctgaagtcccaaaatgcgagtgggagacaccagaaggctgtgagcaggtcctgactgggaagagactgatgcagtgtctccccaatccggaggacgtcaaaatggccctggaggtgtataagttgtcgctggagattgagcagttggagctgcagagagatagcgcccgacagagcacacttgacaaagagctgtag

SEQ ID NO: 219051 - DNA, 459 bp, Artificial Sequence
  Description of Artificial Sequence: Synthetic coding sequence
atgcacccgcctaagacccccagcggagccctgcatcgcaagcgcaagatggccgcttggcctttcagcaggctttggaaagtgtccgatccgatcttattccagatgaccctgatcgccgctctgctgcctgcagtgctgggaaactgtggtccccctccaactctcagttttgccgctccaatggacataactttaaccgagacccgctttaaaacaggcaccactctaaagtatacctgcttgcctggatatgtccgatcccactccacccagacattaacctgtaactctgacggcgaatgggtgtacaacactttttgcatctacaaacggtgccggcacccaggcgaattgagaaacggacaagttgagatcaaaacagacctgagtttcggaagccagatagaatttagctgttccgaaggcttctttcttatcggtagcactacaagctag

SEQ ID NO: 219052 - DNA, 759 bp, Artificial Sequence
  Description of Artificial Sequence: Synthetic coding sequence
atgtttttctggtgcgcatgctgcttgatggtggcatggagagtcagtgcctctgatgccgagcattgccccgaacttccgccagtggacaattcaatttttgtggctaaggaggtggaagggcagattttgggaacatatgtatgcataaagggataccatctggtagggaaaaaaaccctgttttgcaatgcgagcaaagagtgggataataccacaactgaatgccggctgggccactgtcccgatccagttcttgtcaacggcgaattctccagttccggacctgtgaatgtgagtgacaagatcaccttcatgtgcaatgatcattatatccttaaaggcagcaaccgctcacaatgtctggaggaccacacttgggcccctccatttccaatctgtaagtctcgggactgtgacccacccggtaatcctgtgcacggatattttgaaggcaataattttactctagggtctacgatctcctattactgcgaggaccggtactacctagtgggcgtacaggagcaacagtgcgtggacggcgaatggtccagcgctttacccgtctgcaagctcatccaagaggcgccaaagcctgaatgtgagaaggcccttctcgcgtttcaggagtccaagaacctgtgcgaggccatggaaaatttcatgcaacaattaaaagaatccggcatgaccatggaggaactgaaatacagcctggagttaaagaaggcagagttaaaagctaagcttctctag

SEQ ID NO: 219053 - DNA, 756 bp, Artificial Sequence
  Description of Artificial Sequence: Synthetic coding sequence
atgtttttctggtgcgcgtgctgtctcatggtcgcctggagagtgtctgcaagcgacgaacactgtcccgagctcccccctgtggacaatagcatcttcgtagctaaagaggtggagggacagattctgggcacctacgtatgtataaaggggtaccaccttgtagggaaaaagaccctattttgcaacgcttctaaggaatgggacaacacaacaactgaatgccgactgggccattgtcctgatcccgtactggtgaatggggagttctcttcatcaggccctgtaaacgtttctgacaaaatcacatttatgtgcaatgaccactatatcttaaagggttccaataggagccagtgtctcgaagaccatacttgggcaccaccttttccgatctgtaaaagcagggattgcgatccacctgggaatccagttcacggttactttgaaggtaataatttcactctgggatcaaccatctcctattactgcgaagatcggtattatctcgtcggagtgcaagaacagcagtgcgtggatggggagtggtctagcgcactcccagtctgcaaactgatccaagaggctccaaaacctgaatgtgagaaggccctgctcgcgttccaggagagtaaaaatctgtgcgaagcgatggaaaactttatgcagcagctaaaggaatcaggaatgacaatggaagaactgaagtactccctggaactgaagaaagcggagctcaaagctaaactgctatag

SEQ ID NO: 219054 - DNA, 759 bp, Artificial Sequence
  Description of Artificial Sequence: Synthetic coding sequence
atgtttttctggtgcgcctgctgtctgatggtagcgtggcgtgtctcagcttccgacgcagagcattgccctgaactgccacccgtggacaacagtatttttgtagcgaaagaagtggagggtcagattctgggcacttacgtttgtataaagggctaccacctggtgggaaagaagactctgttttgtaacgcgtctaaagagtgggacaacaccacgactgagtgtcggctgggccactgtcccgatccggtgctcgttaatggggagtttagcagtagcgggcctgtcaacgtcagtgataagataacctttatgtgcaacgaccactatattttaaagggctccaatagaagccaatgcctcgaagatcatacctgggcgccacctttccccatttgcaaatcgcgagattgcgacccccctggcaatcccgtgcacggatattttgaaggcaataatttcactctgggcagcacgatttcatattattgtgaggaccgttattacctggtgggcgtgcaagaacaacagtgcgtggacggcgaatggagctcagccctgccagtatgtaagctcattcaggaagctcccaagccagaatgtgaaaaggctctactggccttccaggaatcaaagaacctctgtgaagcaatggagaatttcatgcagcaattaaaggagtcagggatgaccatggaagaactgaagtattcattagaactgaagaaagccgagttgaaggctaaactgctgtag

SEQ ID NO: 219055 - DNA, 759 bp, Artificial Sequence
  Description of Artificial Sequence: Synthetic coding sequence
atgttcttttggtgtgcttgttgtctgatggtggcgtggcgggtgtccgcaagcgatgccgagcactgccctgagttgccccctgtcgacaactcaattttcgttgctaaggaggtggagggtcaaatccttgggacatacgtgtgtataaaaggctatcatctcgttggcaagaagacattattttgcaacgcgtctaaggagtgggacaacactaccactgaatgtcgtctcgggcactgccccgaccccgtgttagtgaacggagaattcagcagctcgggcccagtgaacgtttctgataagatcacctttatgtgtaacgaccattacatactgaagggatcaaataggtcccagtgcctagaagatcatacgtgggcccctccctttcctatctgtaagagccgggattgcgatccccctggtaaccctgtgcatggctatttcgaagggaacaacttcaccctgggcagtactatcagttactactgtgaggaccgctactatttggtgggtgtccaagagcagcagtgtgtcgacggagaatggtcttccgctctgccggtctgtaagctgatccaagaagcaccgaagcccgagtgcgaaaaggccctgctggcattccaggagtccaagaacctgtgcgaagctatggaaaacttcatgcagcagctgaaggaaagtggtatgacaatggaggagctcaagtattctctggagctgaagaaagccgaactaaaggccaagcttctgtag

SEQ ID NO: 219056 - DNA, 657 bp, Artificial Sequence
  Description of Artificial Sequence: Synthetic coding sequence
atggtggcctggcgcgtgagtgcaagtgatgaacattgccccgagctccccccagtcgataattcaattttcgtggccaaagaggtggagggccagatcctgggtacgtacgtgtgcatcaagggctaccatctggttgggaagaaaaccctgttttgtaacgcttctaaagagtgggataacaccacaaccgagtgccgcttagggcactgtccggaccctgtcctggtgaatggcgaatttagttcctccggccctgttaacgttagcgataaaatcacctttatgtgcaacgaccactacatactgaagggatcaaataggagtcaatgcctcgaggatcacacgtgggcgcctccgttccctatatgtaaatctatacctcaaacacggccactgccgtttcagccctgttcacctctattcctttttttactgcgccagtccttggccctgtttcctaggctggagtgttctggtcgcattcttgcccattgcaatctacaccttcctggctcatcctcctcccatgcatcagcctcacaggttgccggaatcacaggcgcacaccccagatgggctaatttttgtatattttctagagattgggttagtccctgttggcccggttggtctcagattccggacttgaggtag

SEQ ID NO: 219057 - DNA, 546 bp, Artificial Sequence
  Description of Artificial Sequence: Synthetic coding sequence
atgtttttctggtgcgcctgctgcctaatggtggcttggagggtctctgcatccgacgctgaacactgtcccgagctgcccccagtggacaacagtatatttgtcgctaaggaggttgagggtcaaatactggggacctacgtatgtattaagggctaccatcttgttggtaaaaagactcttttttgtaatgcatccaaggaatgggacaacaccacgacagaatgtagactcggccattgcccagatccggtgctggtaaatggagagttttcatctagcggcccagttaacgtcagcgacaaaatcaccttcatgtgcaacgaccactacattttgaaaggctctaacaggagccaatgtttggaggaccacacctgggcaccaccctttcctatttgtaaatcaagagattgtgaccccccaggaaatccagtgcatggttacttcgagggaaataactttacgttgggtagtacaatttcttattattgcgaggacaggtattatctcgtgggcgtccaggaacagcaatgtgtggattag

SEQ ID NO: 219058 - DNA, 5234 bp, Artificial Sequence
  Description of Artificial Sequence: Synthetic coding sequence
atgaggctgctctggggtttaatatgggcatccagcttcttcacgctgagcctccagaagcctaggctcctactgttttctccttctgtggtgcacctcggggtgccactttcagtgggagtccagctgcaggacgtaccaaggggccaggtagtgaaaggctctgtttttttaaggaacccatcacgtaataatgtgccttgctcgcccaaggtggacttcacattatccagcgaaagagattttgcgctgctgtcattgcaagtaccactgaaggatgccaagtcctgtgggctgcatcagctgctaagagggccagaggtgcaactcgttgctcatagtccgtggctgaaggactctttgtctcgaactacaaacattcagggcatcaacctgctgttctcctcacggaggggccaccttttcctgcaaactgaccagccaatctacaaccctggacagcgggtcagataccgcgtgtttgctcttgaccagaagatgcgcccttcgaccgacacgatcactgtcatggtggaaaactcacacggactcagggtaagaaagaaggaagtgtacatgccatccagtatcttccaggacgattttgtcataccagacatctcagaacccggaacatggaagatctctgcacgcttcagtgatgggctggagtctaactccagtacgcaatttgaggtgaagaagtatgtgctgcctaacttcgaggttaagataactcccggaaagccctatatactcaccgtgccgggacacctggacgagatgcagctggacattcaagccagatatatctatggcaagccggttcagggagttgcctacgtaaggttcggtttactggatgaggatggaaagaaaactttctttcgtgggctggagtctcagactaagcttgtcaacggacagagtcacatctcgctctccaaggcagaattccaggatgccttggagaagctgaatatgggcataaccgacctccagggtctcaggctgtatgtggctgctgccataatcgagtaccccggtggagaaatggaggaggccgagctaacaagttggtatttcgtttcctcacccttcagcctcgatctgtccaagaccaaacgccacttggtgccaggggcacctttcctactgcaggcccttgtcagagagatgtcaggctcacccgcttcaggcatacccgtgaaggtgtccgcaactgtgagctctcccggaagcgtccctgaagtgcaggacattcagcagaacacggacggatctggtcaagtttccatacccataattattcctcaaacaatttcagagctgcagctctcagtgtcagccggttcaccccaccctgcgatcgcgaggctgacagtggccgctcccccatccggaggccctgggttcctgagtatcgaatggccagatagtaggccgcctagggtgggtgacaccctcaacctgaatttgcgcgctgtcggaagtggggcaactttctctcactattactacatgatcttatctagaggccagatcgtgttcatgaacagagaacctaaaagaaccctgacctccgtaagcgtgtttgtcgatcaccatttggctccctccttctattttgtagccttctactatcatggggaccacccagtggctaatagcctgcgtgtcgacgtgcaggctggagcttgcgagggtaaactggaactgagcgtggatggagccaaacagtaccgaaatggagaatccgttaagttacacttggagactgacagcctcgcattggttgcccttggagcgctcgatactgctctctatgcagccggtagcaagtctcacaagcctctgaacatgggaaaggtgtttgaggctatgaactcatacgatcttggctgtggaccgggaggtggcgactctgcccttcaagtgtttcaggccgcagggttagcttttagcgacggagaccagtggaccctgtcccgcaagcgcttaagctgccccaaagaaaagaccacccgtaagaaaagaaacgtgaactttcaaaaagccatcaacgagaaactgggccagtatgcatctcccacagcaaagagatgttgccaagacggagttacacgtctgcccatgatgcgctcgtgcgaacaacgagccgcaagagttcagcaacccgactgccgagaaccatttctctcttgctgccagttcgcagagtccctgaggaaaaagagccgggataaaggccaggctgggctgcagcgcgctctcgagatcttacaggaagaagacttgattgacgaggacgacattcctgtccggagtttcttcccagaaaattggctctggcgtgtcgaaacagttgacagatttcagatcctgactctgtggctgcccgactcattgaccacctgggagatacatggcctgtccttgtctaaaactaagggtctctgtgtcgccaccccagtccagctcagagtgtttcgcgaattccatctacacctgcgactgcccatgagtgtgcggagattcgagcagttagaactcagacctgtactttataattacctggacaagaacctcacagtgtcagttcacgtgtctcctgtggaaggattatgtctcgcgggtgggggagggttggctcagcaggttctcgtccctgccggttctgcgcgtcccgtggctttctctgtcgtgccaactgccgctgccgctgtgagcttgaaggtggtcgcaaggggatcttttgagttcccagtaggcgatgccgtgtccaaagtgctacagatcgaaaaagaaggcgctattcacagagaagagttagtctacgagcttaatcccttggaccatcggggtcgtacattggagatcccgggtaacagcgaccctaatatgatcccagacggagacttcaactcgtatgtacgcgttactgcttccgacccactggacacgctcggctcagagggggctctcagtcccggaggggtggcttccctgctgcggctccccaggggatgtggtgaacagacgatgatttacttagctccgaccttagccgcttccaggtacttggacaaaacagagcaatggtctacactgccacctgagaccaaggaccacgcagtcgatctgattcagaagggttacatgcgtatccaacagttccggaaggctgacggcagttatgccgcatggctgtcacgggactcatctacatggctgacagcctttgtattgaaggttctgtctctggcccaggaacaagttgggggttcccctgaaaaactccaggagacaagcaattggctcctaagccagcagcaagccgacggctctttccaggatccatgtcccgtgctggacagaagtatgcagggcggtctggtgggcaacgacgagactgttgcactcacagctttcgttaccattgccctgcaccacgggttagctgtgttccaggatgagggggcagaaccgttgaaacagcgcgtcgaagcctccatctccaaggctaactcgtttctgggcgagaaagcctcagctggcctgctgggggctcatgcggcagccattaccgcatacgcccttactttaaccaaggcgccagtggacttgttaggcgtggcccacaacaatttaatggctatggctcaggagactggagacaatctatactggggttccgtgacagggagtcagagcaatgcggtgagcccaacgcccgctcctagaaatccatcagaccccatgccccaggccccagctctgtggatagagaccacagcttatgccctgttgcacctgctgctgcacgaaggaaaagccgagatggccgaccaggcggctgcttggcttaccaggcaggggtctttccagggtggttttcgctctacacaggacactgtgatcgcgctagacgccctgagcgcttattggatcgcctcccacacaactgaggaaaggggcctcaacgtcaccctgtcctcaactgggagaaacggctttaaatctcatgccctgcaacttaacaaccggcagatccggggactggaggaggagctgcagttttcactgggatcaaaaatcaatgtcaaagtgggagggaactctaaggggacattgaaagtgctgcgcacatataatgttctggatatgaaaaatactacttgtcaggacttacagattgaggtgactgtcaagggacacgttgagtataccatggaggccaacgaagattatgaggactacgagtatgacgagctgccagctaaagacgaccccgatgcgccacttcagcccgtcacccctcttcagctatttgagggtaggcggaacagaagacgccgagaagcacccaaggttgtggaggagcaggagtcaagggtgcattacactgtatgtatttggcgcaatggaaaagtgggcctctcaggcatggccattgccgatgtgaccctgctctcagggtttcatgcgcttagagctgacctcgagaaacttacctccctgagcgatcgctacgtgagccattttgaaacggagggtcctcacgtcttgctctactttgactcagtgcctacgagtagagaatgtgttgggttcgaggccgtacaggaggtgcccgtgggcttggtccagcccgcatccgctactctttatgactattataaccccgaaaggcgatgctctgtattttatggagcacctagtaagtcacgcttgctggctaccctctgcagcgccgaggtgtgtcaatgtgctgaaggtaaatgccctcggcaacggagagccctcgagaggggcctgcaggatgaagacgggtacaggatgaaatttgcctgttactaccccagagttgaatacggattccaggttaaggtgctgcgagaggatagtcgggcagccttcaggctgttcgaaacaaaaatcactcaagtgctccacttcactaaagatgtgaaagcagcagccaaccagatgaggaatttcttggttcgtgcaagctgtcggcttcgcctggagcccggaaaagagtacttaataatggggctcgatggagccacctacgacctagaggggcacccgcagtatttgctggatagcaacagctggatagaggaaatgccctccgaacgcttgtgccgcagcacacgccagagggctgcttgcgctcagctcaacgacttcctgcaggagtacggcacacaggggtgtcaagttta

SEQ ID NO: 219059 - DNA, 5234 bp, Artificial Sequence
  Description of Artificial Sequence: Synthetic coding sequence
atgaggctactgtggggattaatctgggccagttcttttttcactctaagcctgcaaaagccacgcctcctgctgttctctccctccgtggtacatctaggagtgccactgtcagtgggcgtacagctgcaggacgtgccgagagggcaggtcgtgaaggggtctgttttcctgcggaatccctcaaggaacaatgtcccgtgctcgcctaaggtggatttcacgctctccagcgagagggattttgcactgctgtccttacaggtgccccttaaagacgctaaaagctgcggcctgcatcaattgctacgcggtcccgaagtgcaactggttgcccacagcccctggcttaaggattctttgtctcgcacgacaaatatccaggggattaacctgttgtttagttcgcgcagaggtcatctcttcttacagactgaccagcctatatacaatcctggccagcgagtgaggtatagggtcttcgcattggaccagaagatgagaccaagcacggacaccatcactgttatggtggaaaattcacacgggttgcgagtgcgaaagaaggaagtttatatgccgagtagtatcttccaagatgactttgtgatccccgacatttctgagcctgggacttggaagatctctgctaggttcagcgacggactggaatccaattcaagcacacaattcgaggtgaagaagtatgtgctgccaaatttcgaggtgaaaatcacacctggaaagccatacattctgacagtgcccggtcatctcgacgagatgcaactggacatccaggccaggtatatttatgggaagccagtccaaggcgtggcctatgttcggtttggcctgctcgatgaagacggcaagaagacattctttagagggcttgagagtcagactaaactggtgaatggacagtcacatattagcctaagtaaggccgagtttcaggacgcactggagaaattaaacatgggaattaccgatttgcaggggctcaggctctacgtcgccgctgccataattgagagccctggaggcgagatggaagaggccgaactcacatcatggtacttcgtgtcttctccgttttctcttgaccttagcaaaactaagcggcacctggtgcccggtgctccctttcttttgcaggcacttgtcagggaaatgtccggctcgcctgcttcaggcatccccgtgaaggtgagtgccaccgtctctagcccaggcagtgttcccgaggtgcaagatatacagcagaatactgacgggagcggccaagttagcatcccaataatcatccctcagaccatctcagagctccagttaagtgtctccgctggctccccccaccccgctattgccaggctaacagtagcagctccccctagcggaggcccagggtttctttctatcgagcggccagacagcagacctccacgagtcggggatacactgaatctcaacctgagggccgtaggttctggagcgacgttcagccattattattacatgattctgtctcggggacaaatagtgtttatgaaccgggagccaaaaagaaccctgacgtccgtgagtgtgtttgttgatcaccacctggccccaagcttctatttcgtcgcattctattatcacggagatcaccctgtagcgaactctctccgcgttgatgtccaggccggagcttgcgagggcaaattggagctgtcggtcgacggcgctaaacagtaccgcaacggcgaatcagtgaagctgcatctggagacagactctctcgctctcgtggcactgggcgcattggacaccgccctatacgcagctggaagcaagtctcataaaccacttaacatgggaaaggtcttcgaagctatgaatagctacgatttgggatgcggacccggaggcggagactccgcccttcaagtgtttcaggctgccggattagccttctcagatggcgaccagtggaccctctcaaggaaacggctgtcctgtccaaaagagaaaacaacaaggaagaaacggaacgttaactttcagaaagctatcaacgagaagctggggcagtatgcaagccccactgcaaaacgatgttgccaggacggtgtcacaagactgcctatgatgcggtcctgcgaacagagagctgccagggtccaacaacctgactgcagggagcccttcctgtcttgttgccagttcgccgaaagtctccgcaagaaatctcgagacaaggggcaggcaggtcttcaaagagctcttgaaatcctgcaggaagaagacctgatagatgaggacgacatccctgtgcgtagtttttttcccgagaattggctctggagggttgagactgtggacagatttcaaatcctcactctatggctgcccgatagcctaactacatgggaaatccatgggttgagcttatcgaaaacgaaggggctctgtgtggcaacacctgttcaactccgggtcttcagggagtttcatctgcatttaaggctgccaatgagtgtgcgccgatttgaacagctcgaactcaggcccgtcttgtataattatcttgacaagaatttaacagtgagcgttcatgtgtcccctgtggaaggcctgtgtctcgctggaggcggagggctcgctcagcaagtgttggtccctgccggatctgctcgccctgtggcatttagcgtcgtgcctaccgcggcagccgctgtgtccctgaaagtggtggccaggggttctttcgaatttcccgttggtgatgccgtgagcaaggtgcttcagattgagaaggagggcgctattcacagagaggaactggtgtacgagttgaatcctttggaccaccgtggccgaactcttgagatccctggcaatagcgatccaaacatgatccctgatggcgacttcaattcatacgtgcgagttacggctagcgacccactggatacactggggagcgagggagccctgtctccaggaggtgtggcctccctgctgcgcctgcctcgaggttgcggagagcagacaatgatctatctggcccctacgctcgctgcctccaggtacctagacaagacagagcagtggagtaccctgccgcctgagaccaaggaccacgctgtggatctcattcagaaggggtacatgcgaatacagcagttccgaaaagctgacggctcttacgcagcctggttgtcaagggacagctctacctggctgaccgccttcgttcttaaggtcttgtctttggcacaggaacaggtcggtggctccccagagaaactacaggaaacctcaaactggcttctttcccagcaacaggcagatggatcttttcaggatccgtgtcctgtgttagacaggtctatgcagggcggattggtggggaacgatgaaactgtggccctgactgcgtttgttactattgccctccaccacggactcgcggtgtttcaggatgaaggtgcagagcccctgaagcaacgggtggaggcctctatttccaaggcctcctccttcctcggggaaaaggcctccgcgggacttttgggcgcacacgcggcagcgataaccgcgtacgctctgaccctgaccaaggcgccagtagacctgctgggcgtcgcccataataatcttatggcgatggcccaggagactggcgacaatctgtactggggaagcgtaacaggctcccagagcaacgcagtcagtcctacacctgctccgaggaacccgtcggatcctatgccacaagcaccagctttgtggatcgaaacaactgcatatgccctgctgcacctgctgttgcacgagggaaaggccgagatggctgaccaggctgcagcctggcttaccagacagggatcctttcagggaggcttcaggagtacgcaggataccgtcatagccctggatgccttatctgcctactggatagcctcacacacaaccgaggagagaggcttaaacgttactttgtcttcaacgggaagaaacggattcaaaagccacgctctgcagctgaacaatcggcagattcggggactggaggaagagctgcagttcagtctggggtctaagatcaacgtcaaagtgggcggaaactccaaagggaccctgaaagttttgcgaacctacaacgtattggatatgaagaataccacatgccaggaccttcagatcgaagtgacggtgaaggggcatgtagaatacactatggaggctaacgaagattatgaggactacgaatatgatgaacttcccgcaaaggatgatcccgacgcccctttgcagccagtgaccccacttcagctgttcgagggacggcgaaaccggcgacggcgtgaggcgccaaaagtagttgaggaacaagaatcccgtgtgcactacaccgtttgcatctggaggaatggaaaagtcgggttaagtggaatggccatcgccgacgtgacccttttgagcggattccatgcactacgggctgatctggagaaattaactagcttatccgacaggtacgtgtctcacttcgagactgagggtcctcatgttttgctctattttgattccgtgcctactagtagggaatgtgtgggctttgaagcagttcaggaagttcccgtcgggctggtacaacccgcatcagctacgctgtatgactactataatcccgaacgtcggtgctcggttttttatggcgctccttcaaagagtcggttgctggcaaccctttgctctgcggaggtatgccaatgcgctgaaggtaaatgtcctagacagcgacgagccctcgagagaggtctacaggacgaggacggatacaggatgaagttcgcttgctattatcctcgagtggagtacggctttcaggtaaaggtgctgagggaggactcccgggcagcatttcgactctttgagaccaaaatcacccaggtgttgcactttacgaaggacgtcaaggctgctgccaaccagatgcgtaactttctcgtccgggcttcatgccgtctccggttagagccaggtaaggaatatctcattatggggttggatggcgcaacatatgacctcgagggccatcctcagtacctgctggacagtaattcatggatcgaagaaatgccatctgaacggctgtgtcgctcaactcgacagagggccgcatgcgctcaactaaatgactttctgcaggaatacggaacgcaaggatgtcaggtata

SEQ ID NO: 219060 - DNA, 5234 bp, Artificial Sequence
  Description of Artificial Sequence: Synthetic coding sequence
atgcgcttgctgtggggtctgatatgggcgagttcattcttcactctatcgctgcaaaagccacgtctgctgctcttctccccctcggtggtccaccttggagttcctctgtccgtcggggtacaactccaggacgtcccgaggggacaggtcgttaagggaagcgtttttctgcggaacccatccaggaataacgtaccttgctcccctaaagtggacttcactctgtcttccgaaagagatttcgccctgttgagcctccaggtccccctaaaagacgcgaagtcttgcggtctacatcagctgctgcggggacctgaagtacagttggtcgcacactccccctggcttaaggattcactgagtaggaccacaaacatccagggcataaacctcctgttttcatcacgtagaggacaccttttcctgcaaacagatcagcccatctacaacccaggacagagggtccgctatagggtctttgccttagaccaaaagatgcgaccaagtacagataccatcaccgtcatggttgagaattctcacgggttaagagtacggaaaaaagaagtctatatgccttcatccatctttcaagacgatttcgtcattcccgatattagtgaacccggtacttggaaaatttccgcccgattcagcgacggacttgagagtaactcctctacgcagttcgaagtgaaaaagtatgtgttgccaaattttgaagtcaaaataacccctggtaagccgtacatattaacagtgcctggccacttagacgagatgcagctggacatccaggcaagatacatctatggcaagcctgtgcagggcgtcgcttacgtgcgattcggattacttgacgaggacggaaagaaaaccttttttcgaggtctggagagtcaaactaagctcgtgaatggccaaagccacataagccttagtaaggctgaatttcaggacgctctggagaaactgaatatggggatcactgatctccagggcctgcgtctttacgttgccgctgcgatcattgaataccccggaggggagatggaggaggctgaacttacttcatggtatttcgtgtcttcccccttttctctcgacttaagcaagaccaaacgacatctcgtcccaggcgctccctttctcctgcaggcactcgttcgcgaaatgtcaggtagtcctgccagtggcatcccggtcaaagtctctgctactgtgagcagccccggaagtgtccctgaagtccaggatatccagcagaacacagatggaagcggccaggtgagtattcccatcatcatcccacaaaccattagtgaactgcagcttagcgtaagcgctggttccccacaccccgcaattgccaggctgaccgtcgcggcaccaccatccggcggtcctgggtttttatcaattgaaagacccgattcaagaccccctagggttggggacaccctcaatctgaatctgcgggcagtggggtccggtgcgacattttcgcactactattacatgatattgagccgtgggcagatcgtctttatgaatagagaaccaaagagaacgctgactagtgtttctgttttcgtagatcaccacctcgccccttcattttacttcgtggcattctactaccacggcgaccacccagtggcaaacagtcttcgagtagacgtgcaggcaggcgcatgcgagggcaagcttgaactctccgtggacggtgctaagcagtatcgcaacggcgaatctgtcaaactgcatctcgagactgacagtctcgcactggttgccttgggggcactagacaccgctctgtacgctgctggctccaagagccacaagcccctgaatatgggcaaagtgtttgaggcaatgaacagctacgacctaggttgcggacccggagggggagattcggcactccaggtcttccaggccgctggcctagcgtttagcgatggcgatcagtggacactctcccgcaagcgcctgtcttgcccaaaagagaagacaacgaggaaaaagagaaacgtgaacttccagaaggctatcaatgagaaactcgggcagtacgccagcccgaccgctaagcggtgttgtcaggacggagtcaccaggcttcctatgatgaggtcttgtgagcagagagcagccagagtccagcagcctgattgccgagagccatttctcagctgctgccagttcgccgagtctctgagaaagaaatccagggataaaggtcaggctgggttgcagcgggctctcgagattcttcaggaagaggacttgatagacgaagacgacattcctgtccggagcttttttccggaaaactggctttggcgcgttgaaactgtcgatagatttcagatactgaccctctggctgcccgactccctaaccacctgggagatccacgggttatccctctctaagacaaagggactatgcgtcgctacaccagtccaactgcgggtgtttcgcgagttccacctgcacctgcggctcccgatgtcagttcgcaggtttgaacagctggagttgcggcctgtgctgtacaattacctggacaagaatctgaccgtgtctgtgcacgtgtcacccgtagaggggctgtgtctggccggaggcggtggtttggcgcaacaagttctcgtgcctgccggttcagcgcgaccggtggccttctccgtagtccccacagcagccgctgctgtgtcgctaaaagttgttgcgcgtgggtcttttgagtttccggtgggggatgctgtaagcaaggtgctccaaattgagaaggagggcgctattcacagggaagagttggtgtatgaattgaatccgctcgatcaccggggaagaactttggagatacctgggaatagtgaccctaatatgattcccgatggagactttaatagttacgtacgagtgaccgctagcgacccgctggacactctgggcagcgagggagctctcagtcctggtggcgtcgcttcgttgcttaggttgccgcgtggttgtggcgaacagacaatgatttacctggctccaactctggcagcaagtaggtacctggataagacggaacagtggtctactctgcctcctgagaccaaagaccacgctgtggacctgattcaaaaagggtacatgcgcatccagcagttccggaaggctgatggttcttatgccgcatggttgtctagggactcatcaacgtggcttactgcattcgtcctaaaggttctttctcttgcccaagaacaagtcggcggatcccctgagaagctacaggagactagcaattggctgctgagtcagcaacaggccgatggatctttccaggacccctgccctgttttagatcgctccatgcagggtggactggtagggaatgacgagacggtcgcattgactgcattcgttacaattgcgctgcaccatggactcgccgttttccaggatgagggtgcggagccactgaaacagcgagtcgaggcctccatttcaaaagccaactcgtttctgggcgaaaaggcgtctgcaggacttctgggcgctcacgctgcggctatcaccgcctatgctctgactttgacaaaagcacccgtggacctgctcggggttgcacacaacaatttaatggccatggcgcaagaaactggggacaatctatactggggtagtgtcaccggatcacagagtaacgccgtttctcccacacctgcccctaggaatccctccgacccaatgccacaggctcctgcactgtggatagaaaccacagcgtacgctctcctccatctcctgctccatgagggcaaagccgagatggctgaccaggcggcagcctggctcactcgtcaaggttccttccagggcggtttccgttcaacacaggatacagtaattgccttggatgccctgtcggcgtactggattgctagccatacaaccgaagagcgtggccttaatgtgaccttatcctcgactggcagaaatgggttcaagagccacgctctgcagttgaacaatcgacagatccgcggtctggaagaggagttgcagttttctctgggtagcaagatcaatgtgaaggtggggggtaacagcaaaggtacactgaaagttttacgaacttataacgtcctggacatgaaaaacaccacctgccaggaccttcagatcgaggttacagtaaaagggcatgtcgaatatactatggaggctaacgaagattacgaagactatgagtatgatgagctccccgctaaggatgatcctgacgcccctctccagccagtcactcccttacagctctttgaggggcgaaggaatagaagacgaagagaggcacccaaagtcgttgaagagcaggagtcgagggtgcattatactgtgtgcatctggcggaacggcaaagttggattgtccggcatggctatcgctgacgtcacccttctgagcgggtttcatgccttacgcgctgatctcgaaaagctgacctccctgtccgaccgttacgtgagtcacttcgaaactgaaggtccccatgtgttattatacttcgacagtgtaccaaccagccgagaatgtgtagggtttgaagcggtccaggaggtgccagtggggcttgtgcaaccagcttcggccaccctgtacgattattataacccagaacggagatgctctgtgttctacggcgctccctcaaaatctcgacttcttgctactctgtgcagtgccgaggtttgtcagtgtgctgagggaaagtgccccagacagaggcgagccctcgagaggggtctccaagatgaggacggatatcggatgaaatttgcctgttactatccaagggtggaatatgggttccaggtgaaagtcctgagagaggactctagagccgctttccgcctgttcgaaactaagattacccaggtgttgcatttcactaaggacgtgaaagccgcagcaaatcagatgcgcaatttcctggtcagggcctcttgtcgcctcagactggaaccaggcaaggagtaccttatcatgggactggacggggcaacctacgatctggaaggccatccccagtacctactggactccaacagttggattgaggagatgcccagcgagaggctctgtaggtccaccagacaacgggcagcatgtgctcagctgaacgatttcctgcaggagtacggtacccaggggtgccaggttta

SEQ ID NO: 219061 - DNA, 5235 bp, Artificial Sequence
  Description of Artificial Sequence: Synthetic coding sequence
atgcgacttctgtgggggctcatttgggcaagctctttctttaccttatccctgcaaaagccaagactgctcctgttcagcccctcagtggtccacttaggggtgcctctttcagtgggcgtacagctgcaggatgtcccacgaggccaagtggtgaagggttcagtctttctgaggaacccatcccgcaacaacgtgccctgtagccctaaagtggactttaccttgtcgagcgaaagagattttgccctcctgagcctgcaagtgcctctgaaagatgcaaaatcgtgtggactgcatcaactgctccgcggacccgaagtccagttggtggcccattcaccctggctgaaggactcgctttcgcggacaacaaatatccagggcattaacctgcttttctcttcccggaggggccacctgtttctccagactgatcagcccatctacaatcctggccaacgcgttcggtacagagtgttcgccctcgaccagaaaatgcgcccttctacagacactatcacagtcatggtggaaaactcgcatgggctgcgcgtcagaaaaaaagaggtttacatgcccagttccatctttcaggatgacttcgtgattccagatatctcagagccgggaacttggaagatttccgcacgcttctcagatgggctcgaatcaaatagcagtacacagttcgaggtgaagaagtacgtccttccaaattttgaggtaaaaattaccccaggaaaaccttatatattgacggttccaggacatctggatgagatgcaacttgacatccaagcccgatatatctacgggaagcctgtgcaaggagtagcttacgtgagattcggccttctggatgaggatggcaagaagaccttttttcgaggactggaatcacagactaagctggtgaatggccaaagtcatatttccctttcaaaagccgagttccaggacgctctggagaagctgaatatgggcatcaccgacctccagggattgagactttacgtcgctgccgctatcattgagtctcccggtggtgagatggaagaggcagaacttacgtcttggtatttcgtaagcagccctttctccctggacctgtccaaaaccaaaaggcacctggtgccaggtgcacctttcctccttcaggctcttgtgagggagatgagtggttcccccgctagcgggatacctgtcaaagttagtgccacagtgagctctcctggttctgtgcccgaggtgcaagatatccagcagaacacagatggatctggccaggtaagcattccaatcataatacctcagaccattagcgaattacaactatcggtgagtgccggatcaccacaccccgctatcgccaggctgacagtcgctgcccctccttcggggggacccggattcctgagcatcgaacgtcctgactcaagacctcctcgtgtgggggataccctcaacctgaatctccgtgcggttggctcgggagccacatttagtcactactactatatgattttgtctaggggtcagattgttttcatgaacagagagcccaagagaactctcacgtccgtcagtgtatttgttgaccaccaccttgcccctagcttctatttcgtcgcattttattatcatggagaccatccagtcgcgaactctttacgcgttgatgtgcaagcaggcgcatgtgagggcaagttagagctcagcgtcgacggggctaaacagtaccgaaacggagagtcagtgaagcttcaccttgagactgatagtttagcgcttgtggcgctcggagctctcgacaccgccctctacgctgcaggaagcaagtcgcacaaaccactcaacatgggcaaagtctttgaggcgatgaacagctacgacctgggatgtggacccggaggcggagacagcgcgctgcaagtgttccaagccgcaggattggccttctcggacggcgaccagtggacactcagcaggaagcggctcagctgccctaaagagaagactacaagaaaaaaacggaatgtgaacttccagaaggcgataaatgagaagcttggtcagtatgccagccccacagctaaacggtgctgccaggacggtgttacacggctgcctatgatgcggagttgcgagcagagggccgctagggttcagcaacctgattgccgggagccctttctgtcttgctgccagttcgccgaatctctcagaaaaaaatccagagataagggccaggcaggattacagagggcgctcgagatactccaggaagaggacctcatcgatgaggacgacatcccagtgcgctctttttttcccgagaactggctttggagagtggagaccgttgaccggtttcaaattttaaccctgtggctgccagacagcctcactacatgggaaatccacggactgtccctgagtaagactaaaggtctgtgcgtggctacgccagtgcagcttcgggtcttccgtgagttccacctccaccttaggcttccgatgagcgtgcggagattcgagcagcttgagttgaggccagtcctgtacaactatctggacaaaaatctcactgtgagtgtacatgttagtcccgtggagggactgtgtctggccggtgggggagggttagcacaacaggtgcttgtgccagccggatcagcacggcctgttgcattctccgtcgtgcccacagcagcggcagccgtctctctcaaagtcgttgcaaggggatcattcgagtttccggtaggagatgctgtgtcaaaggtgctgcagatcgaaaaagaaggggcaatccacagggaggaactggtgtacgagctgaatcctctggaccacaggggtcggacgctcgagatcccgggaaatagcgaccccaacatgattccggacggagattttaatagttacgtgcgagtgacagcttctgatccattggatacattgggcagcgagggcgcactctcacccggtggcgtggcaagccttctgagactgccacggggttgcggcgagcagacaatgatataccttgcgccaacccttgccgctagccgctacctcgataaaaccgagcagtggtctaccttgccgcctgaaaccaaagaccatgcggtggatctgatccagaaggggtatatgcgcatacagcagtttaggaaagctgatggatcctatgccgcatggctttccagggattcatctacatggcttactgcattcgttctgaaggttctgagcctggctcaggaacaggtgggtggaagcccagagaagctgcaggagacgtcaaactggctgctttcccagcagcaggccgatggcagcttccaggatccttgtcccgtgctggacagatcaatgcaaggcggtctggtcgggaacgacgagacagtcgccctcactgccttcgtgactatagcgctccatcatgggcttgcagttttccaagacgagggggctgagccactaaagcaacgtgtagaagctagtatctcgaaggccaactccttcctgggggagaaagccagtgctgggctgctgggggcacatgctgcagccattacagcatatgctctcacactgaccaaggccccagtggacctactgggagtcgcccataacaacctcatggccatggcccaggaaacaggcgacaacctgtactggggaagcgtgactggtagccagtcaaacgctgtctctcccacgcctgctccaagaaatccttccgacccgatgcctcaggcccctgcgctgtggatcgagacaaccgcatatgccttgctgcacttgcttcttcatgaaggcaaagctgaaatggccgaccaggcctctgcctggctgactaggcagggcagctttcagggcggttttaggtctacccaggacaccgtgatagcactggacgccctgtcggcatactggattgcctcccacaccacagaggaaagggggctgaacgtcactttgtcctcaacagggaggaacggtttcaagtcacacgccctgcaactaaacaacaggcagatccgtgggctggaggaagagctgcagttcagtttgggttccaagattaacgtaaaggttggtggaaattctaagggcacactgaaggtactgcgcacctataacgttctggatatgaaaaacaccacctgtcaagacttacaaatcgaggtaaccgtgaaagggcacgtagagtacacaatggaggcgaatgaagactatgaggattacgaatatgacgagttgcccgctaaagatgatcccgatgcccctctccaacccgtgacaccactccagttgtttgaagggaggcgcaaccgaagacggcgtgaagcacctaaagtcgtggaagagcaggagtctcgtgtgcattacactgtgtgcatttggcgcaacggtaaagtgggactgagtggaatggcaatcgccgacgttacactcttgtccggatttcacgctctgcgcgctgacctcgaaaaactgacttccctgtcagataggtatgtctcccattttgagacagaggggccacatgtgttgttgtatttcgatagcgttccaaccagcagggagtgcgtcgggttcgaagccgtacaggaggtgcctgtggggctggtccagcccgcaagcgccacactctatgactattacaatcccgaaaggcgatgctctgtgttttacggtgctcctagcaagagccgactgcttgccactctgtgctccgcagaggtgtgtcagtgcgctgagggaaagtgtccgcgacagcggcgagccctcgagagagggcttcaggatgaggatggatacaggatgaaatttgcgtgctattacccaagagtggaatacgggttccaggtaaaggtccttagagaggattcccgcgctgcttttcggctgtttgagaccaagatcactcaggtgttgcactttacgaaagatgttaaggccgctgccaatcaaatgagaaatttcctcgtgagggcgagctgcaggctgagacttgaacctgggaaggagtatctaataatgggcttggatggagctacctatgacttggagggccatcctcagtatctgttagacagtaatagttggattgaggagatgccctcagaacgcttgtgtcggagcacaagacagcgggcagcctgcgcccagctgaacgatttcctgcaggagtacggtacacaggggtgccaagtgtac

SEQ ID NO: 219062 - DNA, 5097 bp, Artificial Sequence
  Description of Artificial Sequence: Synthetic coding sequence
atgcggctgttatggggcttgatttgggctagctcatttttcacactgagccttcagaagccacgtctcctcctcttttcaccgtccgtggtgcacctgggcgtaccactctccgtgggggtgcagctgcaggatgtgccccgtgggcaggtggtgaaggggtctgtttttctacgtaatccaagtaggaacaacgtcccctgtagtcccaaagtagacttcaccctgagctctgagcgcgactttgccctgttgagtctacaggttccactcaaggatgctaagtcttgcggattgcatcagctgctgcgtggccctgaggtgcagctggtcgcccattccccctggctgaaggacagtctgtctcggaccaccaacattcagggaatcaatctgctgttttcatctaggcggggacacctttttctgcaaaccgatcagcctatatataatcccggacagagagtgcggtacagggttttcgccctcgatcagaagatgaggccatcaactgatacgatcacagtgatggtcgaaaactcacatggtctgcgagtgcgcaaaaaagaggtctacatgcccagtagcatcttccaggatgactttgtcattcctgacatttcagaaccaggaacatggaagatcagtgctagattctccgatggactggagtcaaatagttctacccagttcgaagtaaaaaagtatgtgctccctaatttcgaagtaaagatcacacctggtaaaccgtacatcttaaccgtccctggtcacctggatgaaatgcagctagatatccaggctcgctacatctacggcaaacccgtccagggtgtggcctacgtaagatttgggttgctggatgaggatgggaagaagaccttcttccggggtctggagagccagacaaaacttgtgaacggccaatcccatatttctctgtccaaggccgagttccaggatgccctggagaagttaaacatgggcattacagacttacagggcctgagactctacgtcgcggctgccatcattgagtctccaggcggagaaatggaagaggccgagctaacgtcctggtatttcgttagctctccgttttccctcgatctaagtaaaacaaagcggcatctagtgcctggggctcccttcttattgcaggctctggttcgggagatgtctggctctccagcttcgggaatcccggtgaaagtgtctgccacggtttcctcacccggatccgtccctgaggtacaggacatacaacagaatactgatgggtctggacaagtctccatccctataatcattccgcagacaataagtgagctccagctatcggtgtctgcgggatcaccccatcccgctatcgcacggttgacggttgccgctcccccttccggcggtcctggatttctatcaatcgagcggccagattctcgacccccaagagtcggggatacgttgaatttgaacctcagagcagtgggctcgggagcgacattcagccattattactacatgattctttccaggggtcagattgttttcatgaatcgtgaacccaaaagaacactgaccagcgtgagcgtcttcgtggaccaccacctggccccttctttctattttgttgcattttattatcatggagaccaccccgtggctaactccctgcgcgtggatgtccaggcaggcgcttgcgagggcaaacttgagctatccgtggacggtgctaagcagtacaggaatggagaatcagtgaaattacacctggaaaccgacagcctcgctctggtggccctaggcgcactggatacggccctatacgctgcaggtagcaaatcacataaacctctcaacatgggcaaggtgtttgaagctatgaatagctatgaccttggctgcggccctgggggtggtgactccgccctgcaggtttttcaagcggctgggctggcattttctgatggtgatcaatggacgctcagcagaaaacggctctcatgtcctaaggaaaaaaccacgagaaagaagaggaacgtcaattttcaaaaagcaattaacgaaaaactgggtcagtacgcctcccctactgctaagcgatgctgccaggacggcgtgacacgactaccaatgatgaggtcatgcgagcagcgcgctgctagggtccagcaaccagattgtagggagccgtttctttcatgctgtcagtttgcggagagcttacggaaaaagtctcgggacaaggggcaagccggtctgcagcgagccctggagattctgcaggaagaggacctcattgatgaagatgatatacctgtgcgttctttcttccccgagaattggctatggagagtggaaacagtcgacaggtttcagattctcactctgtggctacccgattcgctgacgacctgggagattcacgggctgtccttgagcaagaccaaagggctgtgcgttgccacccctgttcagctacgcgtattcagggaattccatcttcatctccgcctgcccatgagcgtacggcgatttgaacaactggaactcagacctgtcctgtacaactatctggataagaatctaaccgtaagcgtgcatgtgtcccccgtagaggggctgtgcttggccggaggcggtggcctggcccagcaggttcttgtccctgccggatccgcacgccctgtggcctttagtgtagtgcccaccgcagctgcggctgtgagtctgaaggtcgtggctagagggagcttcgaatttccggttggggatgcagtgagcaaggtgctgcagatagagaaggaaggcgcaatccaccgggaggagctcgtgtacgaacttaatcccctagatcacagaggcagaactctggagattcccggtaatagtgatccaaatatgatcccagacggtgatttcaattcttatgtgagggtaaccgctagcgacccgcttgatacgctgggcagcgagggggctctgtctcccggtggcgtggccagtctactccgcctcccacgcggatgcggtgaacagaccatgatctacttagccccaacccttgccgcttctaggtacctcgataaaactgaacaatggtctaccctgccgcctgagacaaaagatcacgcagtggacttgatccaaaagggttacatgcgcattcagcagtttaggaaggctgatggatcttacgcagcctggctgagcagagattctagtacatggctgaccgcattcgtacttaaggtgctgtcgctcgcacaggagcaggttggcggaagccccgaaaagctgcaggaaacctccaactggctgctatctcaacaacaagccgatggaagcttccaggacccatgccccgtgctggatcgatcaatgcagggaggactggtgggtaatgatgagacagtcgctctaacggcttttgttaccattgccctacatcacggactggcagtgtttcaggatgaaggagccgagccactgaagcagagggtggaggcatcaatctctaaagccaacagttttcttggcgagaaggcgtcagccggactgctaggtgctcatgctgctgccattacggcctacgcactgaccttaacaaaagcgccagttgacctgctgggagtcgctcacaacaatttgatggcaatggcccaggaaacgggcgacaatctttactggggctccgtcacgggctcgcaaagtaacgctgttagtcccactcctgctcctcggaatccatcagatcccatgccacaggccccagccctgtggatcgagacgacagcgtatgcgttgctccatctgctcttacatgagggaaaagctgagatggctgatcaggcttccgcttggcttacacgccagggctcttttcagggcggatttcgtagcacacaagacaccgtgattgccctggatgccctttcagcctattggattgccagtcataccactgaagagcgaggcctgaacgttacgttgtcgtctactggtcgcaacggctttaaaagccatgccttgcagcttaataaccgacagattcggggtctggaagaggaactgcaatttagcctgggctccaagatcaatgtaaaagttggcggaaactctaagggaaccctcaaggtactgaggacatataatgtacttgatatgaaaaatacgacgtgccaagatctgcagattgaggttacagtgaaaggccacgtggaatataccatggaggccaatgaggattacgaggattacgagtatgacgagctgcccgcaaaagacgacccagacgcccctcttcagcctgttacccctctgcagctttttgaagggagacgcaatcggaggcggagagaagccccaaaattgaccagtctttcagaccggtatgtgtctcacttcgagactgagggaccccacgtgctgctgtacttcgactccgtgcccacatctagagagtgtgtgggcttcgaagccgtccaagaagttcccgttggactggtgcagccggcatctgcaactctgtacgattactacaacccagagcgacgctgctcggtcttctatggagcaccatccaagagccgcctgctggccaccctgtgctctgctgaggtctgccaatgcgcagaaggcaaatgccctaggcaacgcagagccctcgagagggggctccaggacgaagacggctatcgtatgaaatttgcttgttattatcccagagtcgagtacggtttccaggtcaaggtgttacgcgaggactctcgcgctgccttcaggctgttcgagacaaaaataacgcaggtgctgcattttaccaaggacgtgaaggccgctgcaaaccaaatgagaaacttcctggtccgggcaagctgcagattaaggttggaacccggtaaagagtatctgattatgggtttagacggcgcaacctacgatctagaaggacatccccaataccttctggacagtaacagttggatcgaagaaatgccctctgaacgcctgtgtcggtccacacggcagagagccgcatgcgcccagctgaacgattttcttcaggagtatgggacccaaggatgtcaggtctag

SEQ ID NO: 219063 - DNA, 813 bp, Artificial Sequence
  Description of Artificial Sequence: Synthetic coding sequence
atgtgtccggaggactcactccaggtgccactgaaagatgccaaatcctgcggcctccatcagctcctccggggaccagaggtacagctggtagcccattccccgtggctgaaggattccctcagtaggacgacgaacattcagggcatcaatctgcttttcagcagcagacgaggtcacctgtttctgcagacagatcaacctatctataacccaggtcagcgtgtccgatacagagtcttcgcactggatcagaaaatgcgaccgtccacagatactatcaccgtgatggtagaaaactcccacggcttacgggtccgaaagaaggaagtctatatgccttcctcgatcttccaggacgatttcgtgatccccgacatttcagagcctggtacctggaagatctctgccagattctcagacggcctcgagtctaattccagcactcagttcgaggttaagaaatacgtgctgcccaactttgaagtgaaaattactcctgggaaaccctacatcttgaccgtgccaggccatctcgatgagatgcagctggatatccaggcccgttacatatacgggaagccggtacagggcgtggcatatgtcaggttcggacttttagacgaagacgggaagaaaacctttttcagaggccttgaatctcagaccaagctggtgaacggacagagtcacatatctttatccaaagcagaattccaagacgcgctggagaagctcaacatggggattaccgaccttcaggggctacgcctctatgtggctgcagcgatcattgaaagtccagggggatag

SEQ ID NO: 219064 - DNA, 5097 bp, Artificial Sequence
  Description of Artificial Sequence: Synthetic coding sequence
atgagactcctatgggggttgatttgggcttcaagtttctttacactgtctcttcagaaaccccgtcttctgttattctcgcctagcgtggtccacttaggggtaccattgagtgtcggcgttcagctccaggacgtgcctaggggccaagttgtgaagggcagtgtgtttctgagaaacccttcaagaaacaacgtcccgtgtagccctaaagtagacttcacacttagcagcgaacgcgattttgctttgctgtctctgcaggttcctctcaaagacgctaaaagttgcggactgcatcagctgttgcgtggtcccgaggtccagctcgtggcgcattccccgtggctaaaggactctctgagcagaacaacgaatatccagggcattaatcttctgtttagcagcaggaggggccatctgttcctgcagactgatcagcccatctacaaccccggacagcgagtccgctaccgggtcttcgctctggatcagaaaatgcgcccatcaaccgataccatcactgtcatggtggagaactctcacgggctcagagttagaaagaaggaagtctacatgcctagttccatcttccaagatgatttcgtcatcccagacatcagcgagcctgggacctggaagatttccgccagattctccgatggattagagtcaaattccagtacacagtttgaggtaaaaaagtatgtgctgcctaatttcgaagtgaagattaccccaggcaaaccctacatactgacagtgcccggacacctggatgagatgcaactggacatacaggccagatatatatacggaaagcccgttcagggtgttgcatacgtcagatttggattgctggacgaagatggtaagaagacctttttcaggggactggaatcacagactaaactcgtgaacggtcaaagtcatatctccttgagcaaggcagagttccaagatgcactggagaagctgaatatgggcatcacagatttacagggactcagactctacgttgctgcagccattatcgagtacccaggcggagaaatggaggaggctgaactcacatcttggtactttgttagcagtccattctcactggatctgagtaaaactaagcggcatctggtccctggcgcacccttcttgttacaagctctggtcagggagatgtccgggagccccgcaagtggaattcccgtgaaagtgagcgcaactgtgtcttcccctgggtccgtacccgaagtgcaggacatccagcagaatacagacggaagcgggcaggtctctatccccataatcataccccagacaatcagcgagctgcagctgtcagtatccgccggatcaccccatccggcaatcgcacgactcactgttgccgctccgccatctggagggcctgggttcctgagcattgaatggccagatagtaggccccctcgggtaggggataccctcaacctgaacctgcgagctgtcgggtcgggagccacgttttctcattattattacatgattctctctcgtgggcagatagtgttcatgaatcgcgaacccaagaggacactgacttctgtatccgttttcgtggaccaccatctggccccatctttctacttcgtcgccttctactatcatggggaccatccagtcgccaactctctcagagtggacgtacaggcaggcgcttgcgagggaaaactcgaattatccgtggatggagccaaacagtaccggaatggcgagtccgtgaagctgcatctggagaccgatagtctggccctagtggccctcggggctctagatactgccctgtacgccgcaggtagtaagtctcacaagcccctgaatatgggtaaggtgttcgaagccatgaatagctacgacttaggatgcggcccaggcggtggggactcggccctgcaggtgtttcaggccgcagggctggctttctcagacggcgatcagtggacactgtcccggaagaggctgtcctgccctaaagaaaaaaccactagaaaaaaaagaaacgtgaattttcagaaagctatcaatgaaaagcttggccagtacgcttccccaacagccaaacgctgctgccaggacggggttactaggctgcctatgatgaggtcctgcgaacaacgcgctgctagagtgcagcagcccgattgtcgcgagccttttttgtcctgttgtcagtttgcagaatctctgcgcaagaagagtcgcgacaaggggcaagctggattgcagcgcgctcttgaaatattgcaggaggaagatctcattgatgaggacgacatcccagtcaggtcattcttcccagaaaattggctctggagggtggaaaccgtcgatagattccagatcctgacactttggctgcccgattccctgaccacctgggagatccacggcctcagcctgtctaagactaaggggctttgtgtggcaacgcctgtgcagctgagggtttttagggagtttcacctccatctgcgtttgcccatgtctgtacggaggtttgagcagcttgagctgaggcctgtgctttataattacctggataagaacctcaccgtgtccgtgcacgtcagtcctgtagaaggcctctgtttagcaggtggtggcggtctggcacaacaggttctagtgcctgcaggatctgcaaggcccgtcgccttctccgtggtgcccactgctgctgctgctgtgagcctaaaagttgttgccaggggatcattcgagttccccgtgggagacgccgtgtctaaggtgctccagatagagaaagagggcgctatccatcgggaggagctggtgtatgaattgaaccctctggaccataggggcaggacactcgagatcccaggaaacagcgatccaaacatgatacccgacggcgatttcaattcctacgttagggtgacagccagtgaccctctggacactcttggatcagagggcgcactgagcccgggtggcgtggccagtcttctgagactgcctcgaggatgtggagagcagaccatgatttatctggcacctacgctggcagcctcccgctatctggacaagaccgaacagtggagtaccctgcccccagagactaaagatcatgcggtggatcttatccaaaagggttacatgaggatccagcaatttcggaaggcagatggttcatatgccgcatggctgagccgtgattcatctacatggttgactgcctttgtgctgaaagtcctctctctcgcccaagagcaggtgggcggttcacccgagaagttacaggagacatcgaactggttgctgtcccagcaacaggcagatggaagcttccaagatccttgcccagtcctcgatcggtcaatgcaaggagggctggtgggaaatgacgagaccgtggccctgacagcctttgtgaccatagctttgcaccatgggctagccgtgttccaggacgagggcgctgagccccttaagcagagggtagaggcaagcatctcaaaggcaaactcttttttgggcgagaaagcatccgctggcctgcttggagcccacgctgcagcaattactgcttatgctctgacactgacaaaagcacccgtcgatctgcttggcgtggcgcataataaccttatggccatggcacaagaaaccggagacaatttgtactggggctccgttacaggcagccagagtaacgctgttagccccactcctgctccgagaaacccaagcgatcccatgccccaggctcccgcattatggatcgagactacagcttatgctctcctccacttgcttctgcatgaggggaaagccgaaatggctgaccaggctgcagcatggctgactcggcaggggagtttccaaggaggtttccgcagcactcaagacaccgtaattgccctggacgcactctcagcctattggatagcgtctcatactacggaagagaggggactgaacgttacactgtcctcaacaggacgaaacggctttaagtcgcatgctcttcaactcaacaaccgccagatccggggactcgaggaagaattgcagttctccctcggttcaaagattaatgttaaggtaggcggtaattcaaagggtactcttaaagtcctgaggacctataacgtgttggatatgaagaatacaacatgccaagacttgcaaattgaagtgactgtgaaaggccatgtcgagtatacaatggaggctaatgaagattatgaggactatgaatacgacgaacttccagctaaagatgaccctgacgcacccctgcagcccgtcaccccgctgcagctgttcgagggccgtaggaatcgcagacgtagagaggcaccgaaactgacgtcattaagtgatcgttacgtgtcccatttcgaaaccgaaggaccccacgttctgctgtacttcgatagtgtacccactagccgcgaatgcgtcgggtttgaagcagtgcaggaggtacctgtcggccttgttcagccagcatccgctaccctgtatgattattataaccctgagaggagatgttcggttttctatggcgcaccctccaaatcccggctgctggctacgctatgttcagccgaggtgtgccagtgcgctgaaggtaaatgcccgcgacagagaagagctctggaacgtggattgcaagacgaagacggctacagaatgaaatttgcatgttactatcctcgcgtggaatacggctttcaggtaaaagttttgcgggaggacagcagagcagcttttcggctgttcgagaccaaaattacccaggtgctccacttcaccaaagacgtgaaagcagctgccaaccaaatgagaaactttctggtgcgtgcttcatgtagattgagacttgaacctggcaaagagtacctgataatgggtctggacggggctacatatgacctggagggccaccctcaatacctcctcgactctaattcttggatcgaagaaatgccatcagaacgcctgtgccgctccacacgacagcgagccgcttgtgcacagttgaatgatttcctccaggaatatggtacacaggggtgtcaagtttag

SEQ ID NO: 219065 - DNA, 1536 bp, Artificial Sequence
  Description of Artificial Sequence: Synthetic coding sequence
atggccaagggcctgagcgttcagaatgacaaacatccaggttaccagcctgctctgctgctttccccaggagctcctttgttcgctgacggtccagcctatgctcttctccatcttctcttgcatgaaggaaaggccgagatggctgatcaggcagcggcttggttgacacgacagggcagcttccaggggggttttcggtcgacacaggacacagtaatcgcccttgacgctttgagcgcatattggatagcttctcacacgactgaggaacgtggactcaacgtaacactctcctcgacgggcagaaatgggttcaaatctcacgcgctgcagctgaataaccgacagattaggggtttagaggaggaactgcagttttcgcttggctcgaaaataaacgtgaaagtgggtgggaatagcaaggggacattgaaagtcctccgtacttacaacgtcctggacatgaaaaacacaacctgccaggacttacagatcgaggtgaccgtaaaagggcacgtcgagtataccatggaagccaacgaggattacgaagactatgaatacgatgagctgcccgctaaagacgacccggatgctcctctgcaacccgtgacacctctccagctttttgaaggcaggcggaatagaagaagaagagaagctcctaaggtggttgaagaacaggagagtcgggttcattacacggtgtgcatatggcgtaacgggaaggtgggcctttccgggatggctatcgcagatgtaactctcctgtctggctttcatgcgctgagggctgatctcgagaaactcaccagccttagtgatcgatacgtgtcgcatttcgaaactgaaggcccacatgttcttctctacttcgactccgtacctacaagtcgcgagtgtgtgggcttcgaggctgtgcaggaggttcctgtcgggctggttcaacctgccagtgccaccttgtatgattactataatccggagagacgttgttccgtgttctacggagcgcctagcaaaagtcgcttactggctacgctctgcagcgcagaagtgtgtcagtgtgccgaaggcaagtgtcccagacagagaagagccctggagcgtggcctgcaagatgaagatggctatcgaatgaagtttgcctgttattatcctcgagtcgaatacggcttccaggtcaaagtgctccgtgaagacagtagggccgcattccggttgtttgaaactaagatcacacaggtgctgcacttcacgaaagatgtcaaagcagccgctaatcagatgcgtaatttcctggttagggctagctgtcggctgagactggaaccaggaaaggagtatcttatcatggggcttgatggcgcaacctatgatcttgaagggcacccgcagtatctgctggactccaattcctggatagaggagatgccaagcgagaggctgtgcagatcaacaaggcagcgggcagcatgcgcacagctgaatgacttccttcaggagtacgggacacagggttgtcaggtgtag

SEQ ID NO: 219066 - DNA, 5097 bp, Artificial Sequence
  Description of Artificial Sequence: Synthetic coding sequence
atgcggcttctctggggcctcatttgggcctccagctttttcaccctctcattgcagaagcccagactgttgctgttttcgcctagcgtggtccacctaggggtacccctctcagtcggggtacaactccaggacgtaccgagaggccaggtggttaaaggctctgtgttccttagaaaccccagcaggaataatgtaccgtgctctccaaaagtggattttaccctaagttctgagagagactttgcgctgttatcactacaggtgccactgaaggacgctaaaagctgcggactgcatcagcttctgcggggacctgaggttcagctagttgcccactccccttggctgaaagatagcctaagtcgaactacaaatattcagggtatcaacctgttatttagttcccgacgcggacacttgtttctgcagaccgatcagcctatatataatccaggacagcgggtgcgctaccgcgttttcgcactcgatcagaagatgaggccttccacagacactataaccgtgatggttgagaatagccacgggttgcgcgtaaggaagaaggaggtatacatgccatcctccattttccaggacgactttgtaatccctgacatttccgaacctggaacctggaagatttcagcacgctttagcgatggacttgaatctaatagttctacacaatttgaagtcaagaagtacgtgctacccaacttcgaggtgaagatcacccctggaaaaccctatattctcaccgttcccggacatctcgacgagatgcagctagacatacaggcaagatacatatacggaaagccagtacagggggtggcttacgtgcgctttggccttctggatgaggatggcaagaagacattcttccggggattggagtctcaaacgaagttagttaacgggcaatctcacattagtttgtccaaggctgaattccaggacgcactcgaaaagctcaacatgggtatcaccgatctccaagggttaagactgtatgtggcagctgcaattattgagagtccaggaggtgaaatggaagaggcggaacttacttcttggtactttgtctcatcacctttctctctggatctttcaaaaaccaagcggcatttggtgcccggagcccctttcttactgcaagctcttgtgagagagatgtcaggctctccggcaagcgggattcccgtaaaggtgtctgcaacagtctcctccccgggatccgttcctgaggttcaggacatccagcaaaatacggatggctctgggcaggtgagcattccgatcattatcccgcagaccattagcgaacttcagctgagcgtctctgcgggatctcctcatccggctattgcccgactgactgttgccgcacctcctagcggagggcctggatttctttccattgagcgcccagattccaggccccctcgggttggcgacaccctcaacttaaacctgagagcggtgggttccggcgcaaccttctcccattactattacatgattctttcccgtggtcaaattgtcttcatgaatcgggagccaaagcgaaccctgaccagtgtctctgtgtttgtggaccaccatttggctccgtcattttatttcgtggccttttactaccatggcgaccaccccgtggcgaatagcttgagagtggatgtccaggccggtgcatgtgagggcaaacttgaactgagcgtggacggcgcaaagcagtacaggaatggtgagtccgtgaagctccaccttgaaacggactccctggcccttgttgctcttggagctctggacaccgcactgtacgccgcaggttccaaaagtcacaagccactgaacatggggaaggtgttcgaagccatgaacagttacgatttgggctgtggacccggaggcggtgactccgctctgcaggtgtttcaggctgctggtctggctttttcagatggggatcaatggactttaagcagaaaacgattgagctgtccaaaggaaaagactacacgcaagaagcggaatgtaaactttcagaaagccattaacgagaaactcgggcagtacgccagccccaccgccaagcgttgctgccaggatggggtcaccagattgcctatgatgaggagctgtgagcagagggctgcaagagtgcaacagccagactgccgcgaacctttcctgtcttgctgccagtttgccgaatccctgagaaaaaagagcagggataagggacaggctggcctgcagagagccctcgaaattttgcaggaagaggaccttatagatgaagatgacattccagtccgatcctttttcccagagaactggctgtggcgggtcgaaaccgtcgaccgctttcagatcttgactttgtggctgcctgacagcctcactacctgggagatacacggattgagtctgtcgaaaacaaagggactgtgcgtcgccacaccagtccagctgagagtgttccgggagtttcatctgcacctacggctgccaatgagcgtgaggcgattcgagcagctggaacttcgtcctgtgctctataactatctggacaagaatctgacagtgtctgtccacgtttccccagttgagggtctctgcctggcagggggtggaggactggcccagcaggtgctggttcctgccggaagcgctagacctgttgcttttagcgtggtgccaaccgctgctgcggcagtctctctcaaagtagttgcaagaggatcttttgaattccccgtgggggatgcagtgtccaaggtgttacagattgagaaagaaggcgcaatccaccgcgaggaactggtgtacgaactcaatcctcttgatcaccgaggtaggacccttgaaatcccaggaaacagcgacccaaacatgattccggatggcgatttcaactcatatgtcagagttactgcttccgatccactggacaccctcggctcggagggcgctctctcccctggaggcgtcgcgtcactactgagacttccgagaggctgcggggagcaaactatgatctacctggctcccaccctggccgctagtagatatctggacaagacagagcagtggagcaccctgccacctgaaactaaggatcacgcagtagacctcattcagaaggggtacatgcgcatacagcagttccgtaaagctgatggttcatacgccgcatggctgagtagggactcctcaacttggttaaccgctttcgtccttaaggtgctatcactcgcccaagaacaggtgggtggtagccctgagaagttgcaggaaacaagtaattggctcttgtctcagcagcaggccgatggatcatttcaggacccatgccccgtgctggaccggagcatgcagggtggcctggtaggcaatgatgagacggtcgcacttactgcgtttgtcacaattgctctccaccatggcctcgctgtatttcaagacgagggcgctgagccactgaaacagcgcgttgaggccagcatctctaaagcttcgtcattcttgggcgagaaagcttccgccggattacttggggctcatgcagccgcaattactgcttacgctcttactctgaccaaggcccctgtggatctgctgggagtcgcccataataacctcatggctatggctcaggaaacgggcgataacctctactggggatccgtcaccgggagtcagagcaacgcagtttctccaacacccgcaccaaggaatccctcagatcctatgccccaggcacctgctttatggatcgagaccacagcatatgcactgcttcatctgctccttcacgagggaaaggcggaaatggccgaccaggccgcagcttggcttactcggcaggggtcatttcagggaggcttccgcagcacccaagacaccgtgatcgccctggatgctctgagcgcttattggatcgcttcccatactaccgaagagcgcggactgaatgtcaccctgagctcaacgggccgaaacggctttaaatcccatgccctgcagctcaacaaccgacagattcggggtctggaggaagagttgcagttttcactcggaagcaaaattaacgttaaggtaggcggtaacagcaaaggaactctgaaggtactgcgtacatataacgtgctggacatgaaaaataccacttgccaggacttacaaatagaggtgaccgttaagggacatgttgagtatacaatggaggccaacgaggactatgaggactatgaatatgacgaacttccagccaaagacgaccctgatgcacccctacagccggttacccctcttcagctgtttgaggggaggcgcaatagaagaaggcgcgaagcccctaaacttacctccctgtccgataggtacgtttcccacttcgagaccgaagggccacatgtcctgttatactttgacagcgtgcccaccagtagggaatgcgtgggttttgaagccgtgcaggaggtgccagtgggcttagtgcagcctgcatccgcgaccctgtacgactactataaccccgagcgtaggtgcagcgtcttctacggagcaccgtccaagtcacggctgctggctacactgtgctctgccgaggtgtgccagtgtgccgaaggaaaatgtcccaggcaaagacgggcactcgaaagaggcctccaagacgaggacgggtatagaatgaagttcgcttgttactacccccgagtggagtacggctttcaggtcaaggtcctgagggaagatagtagagcagctttccgactcttcgagactaaaattacccaggtgctgcactttacaaaggatgtcaaagccgctgcgaatcagatgcgaaattttctcgtcagggcgtcctgccgactgagacttgaaccgggaaaagaatacttaattatgggtttagacggggcaacttacgacttggaggggcatcctcagtacctgttggattcaaattcatggatcgaagagatgccctcagagcggctgtgtaggtctacccgacagagagcagcttgcgcacagctcaatgattttctccaggagtacggaacacaggggtgccaggtctag

SEQ ID NO: 219067 - DNA, 5097 bp, Artificial Sequence
  Description of Artificial Sequence: Synthetic coding sequence
atgcggctgctgtgggggttgatctgggcaagcagtttctttaccttgtcccttcagaagccaaggctactgctcttttctccgtcagtcgtccaccttggtgtgccactgagcgtaggggtgcaacttcaggatgtgccaagggggcaggtggtcaaaggttcagtctttctcagaaacccttctcgcaacaatgtgccatgctctcccaaggtggattttaccctgtccagcgagcgcgattttgcccttctgtcattgcaggtgccactgaaagacgctaaatcttgtggcctgcatcagcttctacggggacccgaagtgcaacttgtcgcccacagcccatggcttaaagattctctatcacggacaacaaatatccagggcattaacttattgtttagctccagaagaggccatctcttcctccagacggaccagcctatttacaatcctggtcagagggtgcgctaccgcgttttcgctctggaccaaaaaatgagaccctctacggatactatcaccgtgatggttgagaactctcacggcctccgagttcgcaagaaagaggtctatatgccttctagcatattccaggacgatttcgttatacccgatatcagtgaaccaggcacttggaaaatttccgctcgtttctcagacggcttggaaagtaatagttcgactcaatttgaagtgaagaagtacgttttaccaaattttgaggtgaaaatcacgcctggcaagccctacattttaacggtgcccggtcatctggacgagatgcagctcgatatccaggcgagatacatttatggcaagccggtgcagggcgttgcgtatgttcgcttcggccttctggacgaggacggtaagaagacattctttaggggcctggaatcacagactaagctggttaacggtcaatcccacataagtttatccaaagcggagtttcaagacgctctggagaagctgaacatgggtattaccgacctccagggacttcgtttgtacgtggcagcggctattatcgagtaccccggaggtgaaatggaagaggcagagctgacaagttggtactttgtttcctcccctttttctttagacttgtctaaaacaaaaaggcatctggtccctggtgcccctttcctcctccaagcgctggtacgggaaatgtcaggttctcctgcttctggaatccctgtgaaagtgtcagcaacagtaagctcaccaggctctgtgcctgaagtgcaagatattcagcagaacacagacgggtctggccaggtatccatccctatcatcattccccaaactataagtgagttgcaactttcagttagtgccggaagccctcatccagcgatcgcacgcctcaccgtggctgcccctcctagtggcggaccagggttcctctctatagagcggccagactcccggcctcctagagtgggggatactcttaacctgaatctgcgcgctgtgggtagtggagctacgttttcccactactattatatgatcctctctcgcggtcagattgtgtttatgaatcgtgagccaaagaggacactgacatccgtctcggtgtttgtggaccatcacttggctccaagtttttattttgtggctttttactaccacggtgaccatcctgtagccaatagcctgcgggtggatgtacaggctggggcttgtgagggtaagctggagttgagcgtggatggagccaagcagtaccgaaatggggaaagcgttaagctgcatctggagacggactcactggcactggtcgctctgggcgctctggacaccgcactttacgcagctggatccaagagccataaaccccttaatatgggaaaggtcttcgaggctatgaacagttatgatttaggctgcggtcctggaggcggagattcagctctgcaggtgtttcaagccgcagggctcgccttcagcgacggagaccagtggaccttgtcacgaaagcgcttaagctgccctaaggaaaagacgacccgtaagaaacggaatgtgaattttcagaaagcaattaatgaaaaactgggacagtacgcttctcccactgcaaaacggtgctgccaagacggggtgacaaggctgccgatgatgcgctcctgcgaacaaagggccgctagggtccagcagcctgactgtagagagccattcctcagctgctgccagtttgccgaatccctgcgcaaaaagtcgagagataagggccaagcgggtctccagagagctctggagatcctccaggaggaggatcttatcgatgaagatgacattccagtgcgatctttcttccctgaaaattggctttggagagtcgagactgtcgaccggttccaaatactgaccctctggctgccagactccttaacaacctgggagatccacggcttgagcctgagcaagaccaagggactttgtgtcgccacaccagtgcagctccgggtgtttcgagaatttcacctacacctgcggctacccatgagtgtcagaaggttcgaacagctcgagctgcgacccgtcttatataactatctggacaagaatctgacggtgtccgtgcacgtttctcccgtggaagggctgtgtttagcgggtggtggcggacttgcccaacaagtccttgtgccagcgggatccgcaagacccgtcgctttttctgtggtgcctacagccgctgctgctgtatcacttaaagtagtcgccagagggtcctttgaatttccagtgggagatgcagtgagcaaagtgcttcagatagaaaaggaaggcgcaatccaccgcgaggaactagtgtatgagttaaatcccctggatcaccgtgggaggactctggaaatccccggaaattctgaccccaacatgatacctgacggtgatttcaattcctacgtacgcgtgacggccagcgatcctctggacactttaggctctgagggcgctctttcgccagggggtgtggcctcccttttaagactgccaaggggatgcggcgaacagacaatgatctatcttgcgcctaccctggcagcttcacggtacctggataaaacggagcagtggtctactctacccccagagaccaaagaccacgcagtggatttgattcaaaaggggtatatgcggatacagcagttccggaaggccgacggctcttacgctgcctggctgagccgggatagtagtacgtggcttacagcttttgttctaaaggtgctgtctctcgctcaagagcaagtcggtgggtcacctgagaaactccaggagacttctaattggttgttaagccagcagcaggctgatggcagttttcaagacccctgcccggtgctagacaggagcatgcagggcggactagttggaaacgacgagacggtcgctctgaccgcttttgtgaccatcgcacttcaccatgggctcgctgtgttccaggatgagggagccgagcccctcaagcagagagtggaggcatccattagcaaggctaacagtttcctgggggagaaggcgtcagcaggcctcctgggcgctcacgccgcagccatcactgcatatgccttgaccctgacaaaggccccagtcgatctgctgggagtggcccacaacaatctcatggccatggctcaggagactggcgataacctgtactgggggtccgtaacagggagtcaatccaatgcggtgagtcctacacctgcacctaggaacccatcagaccccatgccccaagcacctgcgctgtggatcgagacaacagcctacgcattactgcaccttctgctgcacgaaggcaaagctgaaatggctgaccaggcagccgcttggttaacccgtcagggatcttttcaaggcggtttcaggtctacacaggatacggtgatcgccctggacgccctgtcagcatactggatcgcaagccatactaccgaggaacgaggattgaatgtgacgttgtcttccaccggcaggaatggcttcaagtctcatgccttgcaactgaataaccggcagattaggggtctggaggaggaattacagttcagccttgggtctaagattaatgttaaagttgggggtaacagtaagggcaccctaaaggtgcttcgaacctacaacgtgcttgatatgaagaataccacatgtcaggatctgcagatcgaggtgacagtgaaagggcacgtggagtacacgatggaagctaatgaggactacgaagattacgagtatgatgaacttccagcaaaagacgaccccgacgccccattgcagccagtaacccccctgcagctgtttgaagggcgacgcaaccgacgcagacgcgaagctcccaagctcacatcgctgtccgaccggtatgtctctcacttcgaaaccgaaggacctcacgtgctattgtacttcgacagtgtacctacaagccgggagtgcgtgggatttgaagccgtgcaggaagtacccgttgggctagtgcagcctgcctccgccaccctgtacgactattacaatccagagcgcagatgttccgtcttctacggagcccctagtaaatctagactgcttgcgaccctgtgttcggccgaagtgtgtcagtgtgcagagggcaaatgccctcgccagcgtcgcgcattagagcgcggtctgcaggatgaagacggataccggatgaagttcgcttgttactacccacgcgtggaatatggattccaggtgaaagtgctgagagaggattcccgagcagcattcaggttattcgaaacaaaaattacacaggtgctccacttcaccaaggatgtaaaggccgcagcaaaccagatgaggaattttctggttagagcatcttgccgcttgcgactcgagcctggcaaagaatacctgatcatggggctggacggtgcgacctacgatctcgaagggcacccgcagtacctgctcgactctaacagctggatcgaggagatgccttctgaacgcctgtgccgcagcacacgacagcgagccgcatgtgcccagttaaacgactttctccaggaatacggtacccagggctgtcaggtttag

SEQ ID NO: 219068 - DNA, 1536 bp, Artificial Sequence
  Description of Artificial Sequence: Synthetic coding sequence
atggcaaaaggactgagtgtgcagaatgataagcacccaggctatcagcccgctctcctgcttagccctggagcccctctctttgccgacggtcctgcttatgctctgttgcacctgctgttgcatgagggcaaggccgaaatggcagatcaggcggctgcttggttgacccggcaaggctcatttcagggcggatttcggtcaactcaggatacagtgattgctttagacgcgttgtcggcatactggattgcatcgcatacaaccgaggaaagagggctcaatgtgaccctatcctcaacaggtagaaacggtttcaaatctcacgcactccaacttaataaccggcagatccgtgggcttgaagaggaattgcagttctcactgggatcaaagatcaacgtcaaagtcggagggaatagcaaaggtaccctgaaggttctgaggacttataacgtcctggacatgaaaaacactacctgccaggaccttcagatagaagtaaccgtcaagggacacgtggagtacaccatggaagccaacgaagactatgaggattatgaatatgatgagctgccggcaaaggatgatccggacgccccactacagcccgtgactccgctgcagctgtttgagggtagacgaaatcgacgccgacgcgaagcccctaaagtagtggaagagcaagaatctagggtgcactatactgtctgcatttggaggaatggtaaagtgggcctgagtggcatggccatcgctgatgtgaccctgctttctggatttcatgccctccgggctgatttggaaaaactcacgtctctatccgacagatatgtgtctcatttcgagacagagggacctcacgtgctcctttatttcgacagcgtgcccacttcacgcgagtgtgttgggtttgaggctgtacaggaggtgcctgtaggcctggtgcagcccgcaagtgctactctttatgactattataaccctgaacgtagatgcagcgtgttttacggcgctccaagtaagagccgtcttctggccacactgtgcagcgccgaggtctgtcagtgtgccgaaggtaagtgccctcgccagcgcagggcccttgaaaggggattacaagatgaagacgggtaccggatgaagtttgcatgctactatcccagagtggaatacggctttcaggtcaaggtgctgagggaagactccagagccgctttccggctgttcgagacgaaaatcacacaggttcttcatttcactaaggacgttaaggccgctgcaaatcagatgagaaatttcctggttagagcctcatgccgcctgcggcttgagcctggtaaggaatatctaattatgggactggatggagccacctacgacctggaaggccatccccaatacctcctagattccaacagttggatcgaagaaatgccgagcgagagactgtgtcgttcgactcggcaaagggctgcctgcgctcaactcaatgattttcttcaagagtatgggacccaggggtgccaggtgtag

SEQ ID NO: 219069 - DNA, 813 bp, Artificial Sequence
  Description of Artificial Sequence: Synthetic coding sequence
atgtgccccgaagacagccttcaagtgcctttgaaagacgcaaaatcctgcgggctgcatcagttgctgcgcggtccagaagttcagctcgtagctcatagcccctggctgaaggacagcctctcccgtacgactaacatccaaggcatcaatctcttgttttcttcaaggcgaggtcatcttttcctgcagaccgaccagcctatctataaccctgggcaacgggtgcggtatcgagtgttcgcactcgatcaaaaaatgcggccatctacagacacgatcactgtcatggtggagaactcccacggtttgcgggtcaggaaaaaggaggtgtacatgccatcatccattttccaggacgactttgtgattccagatatttcggagccagggacctggaagatcagtgccagattctcggacggcttagaatcaaattcctctacccagttcgaggttaagaaatacgtgctgccaaactttgaagtcaaaatcacgcccggtaaaccctacatacttacagttcccggacaccttgatgaaatgcagttggacatccaggccaggtatatttatgggaaaccagtgcagggggtggcatatgtgcgcttcgggcttctggacgaggacgggaaaaagaccttttttagaggtctggaatcccaaaccaagctcgtgaacggccaaagtcacatatcattatctaaggccgagtttcaggacgccctggaaaaactaaacatgggcattacagacctacagggccttcgtttatacgtggccgcagccatcatagagtaccctggcggatag

SEQ ID NO: 219070 - DNA, 5234 bp, Artificial Sequence
  Description of Artificial Sequence: Synthetic coding sequence
atgcgcctcttgtggggcctcatctgggcttccagttttttcaccctctccctccaaaaacccagacttctcctgttttctcccagcgtggttcatctcggcgtacctctgtcagttggggtacagcttcaggacgtgccacgcggacaggtcgtcaagggcagcgtcttcctcagaaacccgtctcgtaataatgttccctgctctcccaaagtagacttcactctcagttctgaacgagatttcgccctgctgtccttacaggtgccgctgaaagatgctaagagctgtggcctgcatcagctcttacggggacccgaagtacaactcgtggcccattcaccgtggctaaaggattctctatctagaaccaccaacatccagggcataaacctgcttttctcttctaggcggggtcatctcttccttcagacagatcagcctatctataacccgggtcagcgggtcagatatcgcgtgtttgcccttgatcagaaaatgcgtcccagtaccgacaccatcactgtaatggttgagaactcacacggattgagagttcgaaaaaaagaagtgtacatgccttcatcgatctttcaggatgattttgtcattcctgacattagtgagcccggaacctggaaaatcagcgcccgattctctgatggcttagagagcaattcctccactcagtttgaggttaaaaaatacgtgctgcccaactttgaggttaagattactcccggaaaaccctacatcctgacagtccccggacacctggacgaaatgcagctggacatccaggcacgatatatctatgggaagccagtgcagggcgtcgcgtatgtgcggttcgggctgctcgacgaggatggcaaaaaaactttcttccgcggtcttgagagccagacgaaattggtcaatggtcagtcccatatctcactcagcaaggctgaattccaagacgctcttgagaaactgaatatggggataaccgacctgcagggactcagattgtatgtggccgcagctatcatagagagtcccggtggggaaatggaggaggcagaactcacatcttggtatttcgtgtcctcgccttttagcctggacttgtcgaagactaagcggcacctagtgcctggagctccttttttactacaggccctggtgagggaaatgtcaggatctcctgcttccggcatccccgttaaggtgagcgctaccgtgtccagtcctggtagcgtaccagaagtccaggacatccagcagaacaccgacggtagtggccaggttagcattccgataattatccctcagaccatcagtgaattgcagttgtctgtaagtgctggcagccctcatcccgctatcgcccgtctcactgtggcagctccaccatcaggaggccctggatttctgtctatagagaggcctgacagccgccctcctcgagtgggcgataccctgaaccttaacctgcgtgctgtggggagtggagctaccttctctcactattattatatgatactctcccgcggacaaattgtgtttatgaatagggagccaaaaagaacactgacaagcgtgagcgtttttgtggaccaccacctggcgcctagcttctactttgtggcattctactatcacggcgaccatcctgtagccaattctttgcgggtcgacgttcaggctggggcatgcgaggggaagctggaactttcagtagacggagctaagcaataccggaacggggagagcgtcaagctgcacttggaaaccgactctcttgccctggtggctctgggggctctggatacagctctgtacgcagctgggtccaaatcacacaaaccactgaacatggggaaggtgttcgaggccatgaattcatacgacctgggctgtggtccgggaggcggagactcagcactgcaggtctttcaggccgctggtctcgctttcagtgatggggaccagtggactctatccaggaaaagacttagctgccccaaggagaagaccacccggaagaagagaaatgtgaattttcagaaagccataaatgagaagttggggcaatacgccagccctactgccaaacggtgttgccaagacggcgtgacacgtctgccaatgatgcggtcctgcgagcagcgggcagctagagtgcagcagcctgactgccgggagcccttcctgtcctgctgccagttcgccgaatcgcttcggaagaagagccgcgataaaggacaagcaggtctccagcgggcacttgagatcttgcaggaagaggatctaatcgatgaagatgatattcccgtcaggtcttttttcccggaaaactggctgtggcgagtggaaaccgtcgaccgctttcagattttaaccctatggctccccgacagcttgacaacctgggaaatacacggtctctccctcagtaagacaaaaggcctgtgtgtcgcgacccctgtacagctcagagtgtttcgcgagtttcacctgcaccttcgcctgcccatgtccgtgcgtcggttcgaacagttggagttacgcccagtgctgtacaattacctggacaaaaaccttacagtgtccgtgcacgtcagccccgttgaaggcttatgtctggccggagggggaggacttgcgcagcaggtgctcgtgcccgcaggaagtgctagacctgtggccttcagcgtggtgccgaccgccgctacagcagtctcactgaaggtggtagccaggggatcctttgaattccctgtgggagatgccgtaagtaaggtgctgcagattgaaaaggagggtgctattcaccgggaggaactggtgtatgaactaaatcccttggaccacagaggccgaactctagagattccagggaactctgatcccaatatgattcccgatggggatttcaatagctacgtgcgggttaccgcctcggacccgctcgatacccttggttccgaaggggcattgagtccaggcggagtggcttcactcctgaggctgccacgcggttgtggagagcagacaatgatctacttggcgccaactttggccgcaagtcggtaccttgataaaaccgagcagtggtccaccttacctcctgagaccaaagatcatgccgtcgacctcattcagaaagggtacatgagaatccagcagttccggaaggctgacggatcatatgctgcctggctcagcagaggaagttctacctggctgacggcatttgtactcaaggtcctgagtctggcccaggaacaggttggcggttcacccgaaaagctccaagagacatccaattggcttctgtctcagcagcaggcagacgggagcttccaagacctgtcgcctgtgatccataggtctatgcaaggcggtttggtggggaacgacgagactgtcgctctgacagccttcgtgaccatcgcactacatcatggcctggctgtttttcaggatgagggcgctgagcccctcaagcagagagttgaagctagtatctccaaggcctccagcttcctaggagagaaggccagcgctgggctgctgggcgcacatgctgccgctattacagcttacgccctgacgctaactaaagcgcctgctgacttgaggggcgtcgcccataataatctgatggccatggctcaggaaaccggcgataacttgtattgggggagcgtcacaggaagccagtccaatgctgtctccccaacccctgccccacggaatccaagtgatccaatgccacaggctccagctctgtggatcgagactactgcatatgcactcctgcacctattactgcacgaggggaaagccgagatggccgaccaggccgcagcatggctcacaaggcaggggagcttccagggcggattcagatccactcaggataccgtgattgcccttgatgcattgtccgcctactggattgccagccatactacggaggaaaggggactgaatgtgaccctctcttctaccggaaggaatggattcaagtcacatgcccttcagctgaataacaggcagatcagaggtctggaggaagagctccagttctcacttggatctaaaatcaacgtaaaagtcggaggaaattcaaagggcactctcaaggtgctgcgaacctataatgtacttgacatgaaaaatacgacctgccaggatctacagatcgaagtgactgtgaaaggccatgtagagtatacaatggaagcaaatgaggattatgaggattacgaatatgacgaattaccagccaaggacgacccagatgctccactgcagccggtgacaccactgcagctgtttgagggcaggagaaacagacggcgtcgagaggcacccaaagtggtggaggaacaggagagccgcgtgcattataccgtatgtatatggcggaacggcaaggtaggtctttcaggcatggccatcgccgacgtaacgctgctctcagggtttcacgctctcagggcagacctcgagaagctgacttccctgagcgaccggtatgtgtcacattttgagaccgaaggaccccacgttctgctgtacttcgactctgttccaactagccgagagtgtgtgggcttcgaggcagtccaagaagtccctgtgggactggtgcagcccgcttcagcaaccttgtacgactattacaatccagaaagaaggtgcagcgtgttttacggcgcaccatccaaatcacgcctgcttgctaccctgtgttcagcagaggtgtgtcaatgcgctgaaggaaagtgccctcgccagcgacgagctcttgagaggggcctgcaggacgaggacgggtatagaatgaaattcgcttgctattaccctcgggtcgaatacggatttcaggtgaaggtccttcgcgaagattctcgggcagcctttcggttgttcgagacaaagatcacccaggttctgcacttcacgaaagatgtgaaagcggctgcaaatcagatgcgtaattttcttgttagggcctcttgccgcttgaggctggaacccggaaaggagtacttaataatgggacttgacggagcaacgtacgatcttgaaggccacccacagtatctcctcgactctaactcctggatagaagagatgcctagtgagcggctgtgccggtccaccagacagcgcgcagcttgcgctcagcttaacgattttcttcaagagtacggaacccagggctgtcaggtgta

SEQ ID NO: 219071 - DNA, 5097 bp, Artificial Sequence
  Description of Artificial Sequence: Synthetic coding sequence
atgaggttgctttggggcttaatatgggctagttccttctttaccctgagcctacagaagccaagactgctgttgttttctccttccgtagtccacctgggggtcccgcttagtgtaggagtacagttacaggacgtgcctcggggacaggtggttaagggttctgtattcctcaggaacccttctagaaacaacgtgccatgcagccctaaagtggatttcacgttgtcgtcagaaagagatttcgctctgctctctctccaggttcccctgaaagatgccaagtcatgtggactgcatcagctgctgcgcggacctgaagtgcagttagttgcccacagcccatggctcaaggattccctatctaggaccacaaacatccaggggatcaatctcctgtttagctctagaagaggacaccttttcctccagaccgaccagcctatttacaatcccggacagagagtgaggtacagagtgttcgctctcgaccagaagatgagaccatcaacggataccataacagttatggtggaaaattctcacggtctgagggtgcgcaagaaggaggtttacatgcccagcagcatattccaggatgattttgttataccagacatttctgaacccggaacttggaaaattagtgctcgctttagtgatggcttggaatcaaacagctccactcagttcgaggtgaaaaaatatgtgctccccaattttgaagtgaagatcacccctggcaagccctatatattgacagtacccggacacctggatgagatgcagctcgatattcaggccagatacatctatgggaagccggttcagggtgtcgcctacgtgcggttcgggctcttggacgaagacggtaaaaagaccttctttcggggtctggagagccagactaagttggtgaatggccaatcgcacatctccctgagcaaagccgaatttcaggatgctttggagaagctcaacatgggcataacggacctgcaggggctaaggctgtacgtcgccgctgccattatcgaatctcccggaggcgaaatggaagaagccgaactgacaagttggtacttcgtgtctagtcctttttctctggacttgagtaagactaagcggcaccttgtaccaggcgcaccatttttgttgcaggctttggttagagaaatgtccggtagccctgccagcggcatacccgtgaaagtgtcggcaacagtgagcagtccaggaagcgtgccagaggtgcaagatatccagcagaacactgacggaagcggtcaggtcagcataccaatcattatacctcagaccatctccgagctgcagctctcggtgtccgccggatctccccatcctgccattgccaggctcaccgtggctgccccacctagcgggggaccaggatttctcagtatcgagcgtccagactcacggcctcctcgggttggggacactctgaatctgaatttaagggccgtggggagcggagcaaccttttcccattattactatatgatattatcccgcggtcaaatagttttcatgaatcgggagcccaagcggactctgacctccgtctcagtgttcgttgaccatcatctcgcaccttcattctacttcgttgccttttactatcacggagaccatcctgtggcaaatagtttgagagtggatgtgcaagccggagcatgtgagggtaagctggagctgtctgtggatggcgctaaacaatacagaaatggagagagcgtgaagttacacctcgaaaccgattccttagcattggttgccctgggcgcactggatacagcgctctatgccgctggttccaagtcacacaaacctcttaatatggggaaagtgtttgaggctatgaactcctatgatctaggctgtgggcctggaggcggagacagcgcgcttcaggtgtttcaggcagctggactggccttcagcgatggggatcaatggaccttgtcccgaaaaagactcagttgtccgaaggaaaagactacgaggaagaagagaaacgttaactttcaaaaggctattaatgagaagctggggcagtacgcctctcccacagctaagcgttgttgccaggatggcgttaccaggttgccaatgatgcgtagctgtgagcagagggcagccagggtccagcagcctgattgccgcgagcctttcctgtcttgctgccagtttgccgaatccctgaggaagaagagcagggacaagggccaggccggactgcagagggctctggaaatcctgcaggaagaggacttaatagatgaagacgatatccccgtgagaagctttttccccgagaactggctttggagagtagaaacggtggacaggtttcagattttaaccctctggttaccagattcccttactacttgggagatccatggtctctccttgagcaagaccaaaggcctctgtgttgctactccagtacagcttagagtctttcgggagttccatctgcacctccggttgcccatgagtgtgcggagatttgaacagctggaactgagacctgtgctatacaactatctggataagaatctcaccgtgagcgtgcatgtgtcacccgtggagggtttgtgtctcgcaggcggagggggactcgctcagcaggtcctggttcccgcaggaagtgctagaccggtcgcctttagcgtggtgcctacagctgctacagctgtgtctctcaaggtcgtcgccaggggtagcttcgaatttcccgtaggagatgcagtctccaaagtcctgcaaatcgagaaggagggcgctattcaccgggaggaactggtgtacgaacttaatcccttagatcatcgaggcagaacactagagatcccaggcaatagcgatcctaacatgatccctgatggagatttcaattcctatgtgcgagtgactgccagcgacccactggataccctgggctcagagggagctctgagtcctggcggtgttgcgtcccttttgcgcctgcccagaggctgcggagaacagaccatgatttatttggcaccaaccttagctgcgtcgcggtacctggacaagacagaacagtggtcaacccttcctccggagacgaaagaccatgcggttgacttgatccagaaaggatatatgcgcatccagcagtttcggaaagctgacggttcctatgccgcttggctctctcgcggtagttctacgtggttgacggccttcgtattaaaagtcttgtcgctcgctcaagagcaagtggggggttctccagaaaaactgcaggagacttcgaactggttgttgagtcagcaacaggctgacggctcattccaagatctatcaccggtgatccatcggagtatgcagggagggctggtaggcaatgatgagaccgtggccctcacagccttcgtcactattgccttgcatcacggcctggcagtgttccaggacgagggtgccgagccacttaagcaacgcgttgaggcttcaataagtaaggctagtagttttcttggcgagaaagcatcagccggactgctgggtgcacatgccgctgccattacggcctatgcgctcacactgacaaaggctcccgctgatttgagaggggtggctcataacaatttgatggcaatggcacaggagacgggggataatctgtactggggtagtgttacagggtctcagtctaatgcagtgtcccccaccccggctcctcgcaatccttcggatcccatgcctcaggcgccagctctttggatcgaaactacagcatatgccctgttgcacctcctgctgcatgagggtaaagcggagatggcagatcaggctgctgcctggctcacaagacagggtagttttcaaggcggatttcgatcgacccaggatacagttatcgccctggatgcgctgagcgcctattggatcgcatctcacacaactgaggaacgcggactgaatgtcaccctcagttccacagggagaaacggatttaaatctcatgctcttcagttgaataatagacagatccgcggactggaggaggagcttcagttcagcctcggatccaaaatcaatgtgaaggtggggggaaattcgaaaggcacgctcaaagtgcttcgcacctacaatgtgcttgatatgaagaacaccacgtgccaggatctacagatagaggtgacagtgaaaggccacgttgagtataccatggaggctaatgaagattacgaggactacgaatatgacgagctgcctgctaaagatgacccagacgcccctctgcaacctgtgactcctctgcagctttttgaagggagaaggaaccggaggcgcagggaggcccctaagttgacatctctttcagatcgctatgtcagtcactttgagacggagggtccccatgttctgctgtatttcgattccgtcccgacatcccgggagtgtgtgggattcgaggcggtgcaagaggttcctgtcggattggtgcagcctgcaagtgcaacactctacgactactataaccctgaacgacggtgttctgtgttttatggggctccatccaagtcacggcttctggccaccctgtgtagcgcggaagtgtgccagtgtgcagaaggaaaatgtccaagacaaagacgcgctctggagcggggactgcaggatgaagacgggtaccgaatgaaattcgcatgttattacccaagggtggaatatggtttccaggtcaaggtgttgcgtgaggattctcgggctgcgtttaggctattcgagacgaagattactcaggtgctccattttacaaaagacgttaaagccgctgccaaccagatgaggaattttctagttcgggcatcctgccgcttgcgtttagaaccaggaaaagagtatctgattatgggactggatggagccacgtacgacctggagggtcatccgcagtacctgcttgactcgaacagttggatagaggagatgccatctgagaggctctgtaggtctaccaggcagcgcgctgcctgtgcccagctgaatgacttcttgcaggaatacggaactcagggatgtcaggtatag

SEQ ID NO: 219072 - DNA, 5234 bp, Artificial Sequence
  Description of Artificial Sequence: Synthetic coding sequence
atgagactgctgtggggactgatatgggcctcctcctttttcactttgtccctccagaagccgaggctgttgcttttttccccgtctgtggtgcacctaggcgtgccactcagcgtgggcgtccagctccaggatgtccccagaggccaggtcgtgaaaggttcggtctttcttagaaatccaagtagaaacaacgtcccgtgctcccccaaggttgacttcaccttgtcatccgaaagggacttcgctctgctgagcctgcaggttcccttgaaagatgcgaagagctgtggccttcaccagctgctccgtggccctgaagttcaactcgtggcgcattcgccatggctgaaggattcactctctcggaccacgaacattcagggcatcaacctactgttctcctcgcgcagaggacacttgtttctccagaccgaccaacccatatacaatcccggacagcgcgtacgatatcgggtgttcgcgttagaccaaaaaatgagaccgagcacagacaccataaccgtgatggtggagaatagccacgggctcagagtgcggaaaaaggaagtctacatgccttcatctatatttcaggacgatttcgtcatccccgacatatccgaaccagggacttggaagattagtgcgaggttttctgatgggctcgagtctaacagcagcactcagtttgaggtgaagaaatacgtactccccaacttcgaagtaaaaatcacaccgggaaagccatatatcctgacagtgcccggacacttagatgagatgcaactggatatccaggcaaggtacatttacggaaagccggtgcagggcgtggcttacgttaggttcggcttgttagatgaggatggcaaaaaaacgtttttccgtggcctggaatcgcagactaagctcgtcaatgggcagtctcacatttcactgtctaaagctgagttccaagacgcccttgaaaaactcaacatgggcataacagacctgcagggcctacgcctatatgtggctgcagctatcatagagagccctggcggtgagatggaggaggccgaactcacgagctggtacttcgtgagcagcccttttagtctggacctgagtaaaacaaaacgacatctggtaccaggcgcacccttccttttacaagccttagtaagggagatgagtgggtcacccgcatctggaatcccagtcaaggtctctgccactgtcagttccccagggtcggtgcccgaggttcaggacatacagcagaataccgacggctccggccaggtgtctattcccattatcatcccccagacaatttcggagttacagctgagcgtgagcgccggaagtcctcatccggcaatcgcgaggcttacagtggctgcccctccctctgggggaccgggatttcttagtatcgagcgcccagacagccgccctcccagggtgggtgacacacttaatctcaaccttcgggcagtgggttcaggtgccactttttctcattactattacatgatcttgtcccggggtcagatagtgtttatgaaccgcgagcccaaacgcactctgacctccgtttctgttttcgtggatcaccacctggccccaagcttttatttcgtggctttttactatcacggcgaccacccagtggcaaactccctacgtgtcgatgttcaggccggagcctgcgaagggaagctcgagctgtccgtggatggtgctaaacagtaccggaatggcgaaagtgtgaaactccatctcgaaaccgatagcttagccctggtcgccctgggcgcactggacaccgccctctacgccgctggttccaagtctcataaacccctgaacatgggcaaggtcttcgaagctatgaatagctatgacctcggatgcggtcctggtggcggagatagtgctttgcaggtgtttcaggcagctgggctggcattcagcgacggggaccaatggacactgtcccgaaagcgcttgtcttgcccaaaggagaaaacgacccgtaaaaaacgaaatgtcaatttccaaaaggctatcaacgaaaagctgggccaatatgcttcacctacagccaagagatgctgccaagacggcgtcactcggctccccatgatgcgctcttgtgagcaacgagctgccagggtgcagcaaccagactgtagagagccgttcctgtcatgctgccagtttgccgagagtctgaggaagaaatcaagggacaaagggcaggcgggtctacagcgcgctcttgagatcctgcaggaggaggatctgatagacgaggatgatatcccagtcagaagttttttccccgagaattggttatggagggtagagacagtggataggttccaaatcctgaccctgtggttgccagatagcctgactacctgggagatacacggtctgtcactctccaagacaaaagggctgtgtgtagccacacctgttcaacttagagtatttagagagttccatctgcacctgaggctccccatgtctgtgagaaggtttgaacaactggagctaaggcccgtcttgtacaactatctggataaaaacctgacggtctcagtccacgtgagtccagtggaaggcttgtgtttggccggaggaggcggactggcccaacaagtcctggtccccgcaggatccgccagacccgtggcgttttctgtagtcccaacggccgcaaccgctgtatcccttaaggttgtcgccagaggatccttcgaatttcctgtgggcgacgcggtgagtaaggtactgcagatcgagaaagagggggcaatccaccgtgaagaactggtgtacgagctgaatcccctcgatcatcgcggaagaaccctggagatccctggtaactccgatccaaacatgataccagatggtgactttaactcatacgtgagagttacggcttctgacccactggacaccctgggatccgagggtgcactgtcaccagggggtgtggcgtccctcctccgtctaccacgtggatgcggagagcagaccatgatctacctcgccccaaccctcgcagcctctcgctatcttgataagacagagcagtggagcactctgcctcctgagacgaaggatcatgccgtggatctgattcagaaaggttacatgagaattcagcagtttcggaaggccgatgggtcctatgcggcttggctcagtaggggtagttcaacttggctaaccgccttcgtacttaaagtcctctctttggcacaggaacaagttggcggttcgcccgaaaagctccaggagaccagtaactggctcctgagtcagcagcaggctgacggctcctttcaggatttgtcccctgtcatccacaggtccatgcagggcggactcgtgggcaatgatgaaactgtggctctaacggccttcgtgactattgccttacatcacggtctggccgtcttccaggatgagggggcagaaccacttaagcagcgcgttgaagcgtctattagcaaggcaagctccttcctgggcgaaaaagcatccgccggtcttctgggcgcacacgccgctgcgattaccgcatacgcattaactctgaccaaggcgcctgcggacctgaggggcgtcgctcataataacttgatggccatggcacaggagaccggggataatctttattgggggagtgttacaggcagccagtcaaatgccgtcagccccacgcctgcccctcgcaacccatcggatcccatgcctcaggcacctgctttgtggatcgagactaccgcctatgcgctgctccacttgcttctacatgaaggcaaggctgagatggctgatcaagccgctgcatggctcacaaggcaaggctcctttcaggggggattccgtagtacccaggacaccgttatcgccctggacgcgcttagcgcctactggattgctagtcatactactgaggaaagaggcctgaacgttacgctgagcagtacaggacgcaacggatttaaaagtcacgccctccagcttaataaccgccagatccggggactggaggaggagctacagttttctctcggcagcaaaatcaacgtgaaagtggggggaaacagcaaaggcaccctcaaggtacttaggacgtacaacgttcttgacatgaaaaacaccacatgccaggaccttcagattgaggtaaccgttaagggtcacgtggaatatacaatggaagccaatgaggattacgaagactacgagtacgacgagttgccagcgaaggacgacccagacgcaccgctgcagccagttactcctctacagctgttcgaagggaggagaaacaggcgacggagggaagcacccaaagttgtagaagaacaggagtcccgggttcactacacggtgtgtatttggcgcaacgggaaagttggactgtctggaatggccatcgccgacgtgacattgctgagcggctttcacgccctaagggctgacctggaaaaacttacgagcctgtctgatcggtacgttagccactttgaaactgaaggccctcacgtcctcttgtatttcgattctgtgcctacatcccgggaatgcgtggggttcgaagccgtccaggaggtgcctgtaggcctggtgcagccagcctcagccaccctctacgattactacaatcccgaacgccgttgtagcgtcttttacggagccccaagtaaatccaggttactggccacactgtgttctgcggaggtatgccagtgtgctgagggcaagtgcccacgccaaagaagggcgctggaacgtggattgcaagacgaagacggctaccggatgaagttcgcctgctactacccgagggtcgagtatggtttccaggtgaaggtgctccgggaagactctagagccgctttcaggctgtttgaaactaaaattacacaggtgctgcactttacaaaagacgttaaggcagcagccaaccagatgaggaattttctggtgcgggcatcttgccgcctgcgactcgagcctggtaaagagtatctcattatgggcctggatggggcaacatacgatttggaagggcacccccagtacctgctcgactctaacagctggattgaagagatgcctagtgaaaggctatgtcggagtactcgccagcgcgcagcctgcgcccagttgaacgacttcctacaggaatatggcacccagggctgtcaggttta

SEQ ID NO: 219073 - DNA, 5234 bp, Artificial Sequence
  Description of Artificial Sequence: Synthetic coding sequence
atgcggctgctgtggggcctgatatgggcgtcctcatttttcacactcagtttgcaaaaacccaggttactgctattctcaccctctgtggttcatctgggagtgcctctctccgtgggggtccagttgcaggatgtgccacgcggacaagtggtgaaagggagcgttttcctgagaaacccttcccggaataacgtgccatgcagtcccaaggtcgactttaccctctcttccgaacgcgactttgccttattatctctacaggtcccactaaaggacgctaagtcatgtgggttgcaccagctcctgcggggtccagaggtgcagctggtagcccactccccatggttgaaggactcattgtcaagaacgacgaatattcagggaattaacctgctattttcttctcgacgcggacatctgttcctccaaacggaccagcctatctacaatcccggacagagagtccgctatagggttttcgcactcgaccaaaagatgagaccgagtaccgacacaattaccgttatggttgaaaatagccatggactgcgtgtgagaaagaaggaagtgtacatgcccagtagcatatttcaggacgactttgttattccagatatctctgaacctggaacctggaagatctctgccaggttctctgacggactcgagtccaacagtagcacacagtttgaggttaaaaaatatgtactccccaactttgaggtgaagatcactcctgggaagccttacatcctaaccgtccctgggcatctggacgaaatgcaactggatatacaggctcgatacatctatggcaaaccggtgcaaggggtcgcctacgtacgattcggactgttagacgaagacgggaagaagactttcttccggggtctggaatcccagaccaaactggtaaacggacagagtcacatttcgctctccaaggcagagtttcaggatgcactcgagaagctaaatatggggattacagacttgcagggccttagactctatgttgctgcagcgattattgagtcaccaggtggtgaaatggaggaggctgagctgacgagctggtattttgtgagcagtcccttctcactggatctgtccaagaccaaacggcatctggtgccaggagcccctttcctgctgcaggccttagtccgggagatgagcggatcccccgcatcgggcatcccggtgaaggtgtcagcaacagtttcatctccgggtagcgtgccagaggttcaagacatccagcagaacaccgatggctcaggacaggtcagcatccccattatcatccctcagaccatctctgagttacagctatcagtgtcagccggtagcccgcacccggcaatcgccaggcttacggttgcggctccaccaagtggtggacccggattcctgagcatcgaacggcctgacagtagacctccaagggtaggagacactcttaatctcaacctgcgagccgtggggagcggcgctaccttctcacactactactacatgattctatcacgaggtcagatcgtcttcatgaatcgtgaaccaaaacggactctaacatccgtcagtgtctttgtggatcaccaccttgcaccgtctttttactttgtggccttttattatcacggggatcaccctgtggctaactcactgagagtggatgtgcaggctggcgcttgtgaaggaaaacttgaactgtccgttgacggcgcaaaacagtatcgcaacggcgaatccgttaaacttcatctcgaaacagatagcttagccttggtagccctgggcgctctggataccgctctctacgctgctggttcgaaaagtcataagccactcaatatgggaaaagtgttcgaagctatgaattcctacgaccttgggtgcggacctggaggtggggactcagcattacaagtttttcaggctgctggactcgccttttccgatggcgaccagtggacactatccagaaaacggttgtcttgtcctaaagaaaaaactacccgtaaaaaacgcaacgtcaattttcaaaaagcaatcaacgagaagctcggtcagtatgcatcaccgactgccaaaagatgctgtcaagacggtgtcacccgcctcccaatgatgaggagctgtgagcaaagagctgcccgtgtccagcagccagactgtagagagccatttctgagttgctgccagtttgccgagagcctacgaaaaaagtcaagggataaaggccaggcaggcctgcagcgggctcttgagattcttcaggaagaagacctcattgatgaggacgatatcccggtgcggtctttttttcccgagaactggctgtggagagtggagaccgtggatcgtttccaaattcttactttatggctgcctgacagcctaaccacatgggagatccatggactgtctttaagcaagaccaaggggctttgcgtggcgactccggtccaactccgagtgtttcgggagttccatctgcatctgcgtctgcccatgtcagtaagaagattcgaacaactagagttaaggcccgtcctgtacaactatctcgacaaaaacctcaccgtgtctgtccatgtgtccccggtggaaggactatgtctggcaggcggaggtgggctggctcaacaagtcttggtgcccgctggctcagccagacccgtggccttcagtgtggtgccgacagcggctgccgctgtgagcctcaaggttgtggcacgcggaagtttcgaatttcctgttggggatgcagtgtccaaggtcctacagattgagaaagaaggagctattcaccgggaagagctggtctatgaattgaatccactcgaccataggggaaggactctggagatccccggtaactccgaccctaatatgatcccagacggcgacttcaattcatatgtgcgggttaccgcatctgaccccctagacacgttagggtcggagggcgcactgagccctggcggagtggctagcctcctgagattgccacggggatgcggagagcaaacgatgatatatttagcccctacactggccgcaagccggtacctggacaaaaccgagcagtggtccacactgcctcccgaaaccaaagaccatgccgtcgacctgatccaaaagggctatatgcgcattcagcaattccgcaaggccgacgggagctacgcagcctggctgtcacgcggttctagtacctggctgaccgccttcgtgctaaaggtcttgtcactggcccaagagcaggttgggggatctcccgaaaagcttcaggagacttcaaattggttgctttcccagcagcaagctgacggctcattccaggaccttagtcctgtgattcaccgatctatgcagggcggtctggtggggaacgacgaaactgttgcgttaacagcatttgttacaattgcactccaccacggcttagccgtgttccaggatgaaggggctgaacccttgaagcagcgcgtcgaagcttctatttccaaggcaaacagctttcttggtgaaaaagcatcggctgggctcctaggggctcacgcagccgctattacagcctacgctttaactctgaccaaagccccagcggatctgagaggggtggcacacaataacctgatggcgatggcccaggaaaccggcgataatctgtattggggcagcgtgaccggctctcagagtaatgccgtctcccccacgcccgctcctaggaaccctagcgaccctatgccccaggctccagcactgtggatcgaaacaacagcatatgcactgctccatctactgctgcatgagggcaaagctgagatggccgaccaggctgcagcgtggctgacccgacagggctcttttcagggcggattcagatccacccaggatacagtgatagcgttggacgcattgtctgcttactggatagcatcacacaccacagaggagagggggcttaatgtgacactgagtagcactgggcgtaatggatttaagagtcacgccctccagctgaacaaccggcaaatcagggggctcgaggaggaattacagtttagtctgggaagcaaaatcaatgttaaggtggggggtaattcaaaagggaccctgaaggttctaagaacgtacaatgtcttggatatgaagaacactacttgtcaggatcttcagattgaggtaaccgtgaaaggccatgtggagtacactatggaggcgaacgaagactacgaagattacgagtatgacgagctccccgctaaggatgatccggacgcccctctgcagccggtgactcctctgcagctttttgagggaaggcggaacaggagacggagggaggcccctaaggtcgtggaagaacaggagagccgcgtgcattacacagtgtgtatctggaggaatggaaaagtggggctgtccggtatggctatcgccgatgtgacactcctgtctggattccatgctctgcgcgctgacctggagaaattgacatccctgtccgacaggtacgtgtctcatttcgagacagaaggccctcacgtcctcctgtatttcgacagtgttcccaccagcagggaatgcgtgggttttgaggctgtgcaagaggtgcctgtcggactcgttcagccagccagcgcaaccctgtatgactactacaacccggaaagaaggtgcagcgtgttttacggcgcaccatctaagagccgcctcctggcaactttgtgttccgcagaagtctgccaatgcgccgagggcaagtgtccacgccagcgcagagcactggaacgaggactgcaggacgaggacgggtaccggatgaagtttgcatgttactatccaagagttgagtatggcttccaggtcaaggttctccgcgaggattcaagggccgcattccgccttttcgaaactaagatcactcaggttctccattttactaaggacgtgaaagctgcagcgaaccaaatgaggaacttcttggtaagagctagctgtaggctcaggctagagcctggcaaggaatacttaattatgggcctggacggcgctacttacgaccttgagggccacccacagtatctcctcgactctaattcgtggattgaggagatgccatcagagcgactttgtagaagtactcgacaacgggctgcttgcgcacagctgaatgacttcctgcaggagtacgggacccagggatgccaggtgta

SEQ ID NO: 219074 - DNA, 807 bp, Artificial Sequence
  Description of Artificial Sequence: Synthetic coding sequence
atgtgtccggaagactcgctccaggttcctctaaaggacgccaagtcttgcggattgcatcagctgctgcgaggccctgaggtacagttagtggcccattctccttggctgaaagattcactttcgcgcactactaatattcaaggcatcaacctgctgttctcctcacgccgaggacacctctttctccaaactgaccagcctatttataaccccggacagagagtgaggtacagggtgtttgcattggaccagaaaatgcgcccttcaaccgatactattacagtgatggtcgaaaacagtcatggactgagagtgagaaagaaagaggtctatatgccatcgtctatttttcaggatgatttcgtgatcccagatatctccgaaccaggtacatggaaaatctctgcccgttttagcgacggcttggaatccaacagcagtactcagtttgaggtcaaaaaatacgtcctgcccaactttgaggtcaaaattacaccgggaaaaccctatattcttacagtgcccggacacttggacgagatgcagctggatattcaggcccgatacatttacgggaagccggtccaaggcgtggcgtacgtgcggttcggactgctggatgaagatggcaaaaaaactttctttaggggactcgagtcccagaccaaacttgtcaatggacagtcacatatctcactatctaaggctgaattccaggatgccttggagaaactgaacatgggaatcaccgaccttcagggactgcgcctgtacgttgccgctgccataattgagtctccctag

SEQ ID NO: 219075 - DNA, 5097 bp, Artificial Sequence
  Description of Artificial Sequence: Synthetic coding sequence
atgcgactgctctggggactgatatgggcatctagtttctttacactcagcctgcaaaagccccgactgctgcttttctccccaagcgtggtgcacctgggtgttcccctgagtgtgggggtccaactgcaagatgtccccagaggccaggtggtgaaggggtctgttttcttgaggaaccccagtagaaacaacgtcccttgctcccctaaggtggattttactctgagttcagagcgtgatttcgcacttctttccctgcaggttcccctaaaggacgccaagtcatgtggtcttcatcagttgttgagggggcctgaggtgcagctggtcgcacattccccatggctgaaagactcactatcccgtaccacaaacatccagggaatcaaccttctctttagctctcgcagaggacacctctttctccagaccgatcagcctatctataacccaggacagcgagtgcgctaccgtgtattcgctctggaccagaaaatgcggcctagcacagataccataaccgtgatggtggaaaattcccacggcctacgcgtgcgtaagaaggaagtttacatgccctcctcaatatttcaagatgacttcgtgatccctgacatttctgaaccaggcacgtggaaaatttcagccagattcagtgatggtctggagagcaattcttccacccagttcgaggtgaaaaagtatgtactgcccaactttgaggttaagattaccccaggcaaaccctacattctgaccgtcccaggacaccttgatgagatgcagctcgacattcaggccagatacatttatgggaagcctgttcagggcgtggcctacgtccgatttggcctcctggatgaagacggaaaaaaaacgttttttcggggtctggagagccagaccaagctcgttaacggacagtcacacatctccctgtctaaggctgagttccaagacgcactagaaaaacttaatatgggaataactgacctccagggcttgaggctttacgtggctgccgctattatcgagagcccaggtggtgagatggaggaagccgagctgacctcctggtattttgtgagctctccgttctcattggatctgagcaagactaaacgacacctggtaccaggtgcccctttcctcctgcaagcccttgtccgcgaaatgagtggctcacccgcatcgggtatccccgtgaaagtctccgcgaccgtgtcatcccctggaagtgtcccagaagtgcaggacattcaacagaacactgacgggtcgggccaggtgagcattccaattatcatcccccagaccatcagtgagctgcagctgagcgtctcggcaggcagtcctcatcccgctatcgccaggctgaccgttgccgctcccccttctggagggcctgggttcttgagcatagagcgacccgactcaaggccaccaagagtcggggatacactgaatctgaacctcagggcagtcggatctggggcaacctttagccactattactacatgatcctttccagagggcagattgtattcatgaatcgcgagcctaaacgcacactgacctctgtgagtgttttcgtggatcatcacctcgccccaagtttctattttgtggcattctactaccacggagatcaccctgtagcaaactctctaagagtggatgtccaggcaggggcttgtgagggaaagctggagctgagcgtggacggcgctaagcagtatagaaacggggagagtgtcaaactgcatctggagacagacagcttggctttagtggccctgggcgctctcgacactgccctttatgctgccggatcaaagagtcacaaaccactgaacatggggaaggtctttgaggccatgaatagttatgacctggggtgtggtccaggcggaggagattctgcgctgcaggtgttccaggctgcaggtctagcgttttcagatggggatcagtggacattgtcgcgcaaacggctttcctgccctaaagagaaaacgacgcgcaagaagaggaacgtaaacttccagaaagcaattaatgaaaagctgggacaatacgcatcacccactgcaaaaagatgctgccaagacggcgtgacacgcttaccaatgatgcggtcctgtgagcaacgcgctgcccgtgtccagcagcctgattgtagagagcccttcctctcttgttgtcagttcgccgaaagcctgaggaagaagagccgcgataaggggcaagcagggctgcagagagctttagagatcctgcaggaggaggatcttattgatgaagacgacatccctgtgcgctctttcttcccagagaattggttgtggagagtcgagaccgtagatcgcttccaaattctgaccctgtggctaccagattccctgaccacttgggaaattcacggactatcattgtcgaagacaaaaggactctgtgtggcaacacccgtccagttgagagtttttagagaatttcacctccatctgcgcctgccaatgagcgtgaggagattcgagcagctggaactaaggccagtgctgtacaattatctcgacaagaatctgacagtcagcgtgcatgtgtcccctgtcgaaggattgtgcctggcaggcggagggggactggctcagcaggtgctcgtacccgcaggctccgccagacctgtagcatttagcgtcgtccctaccgctgcggctgcagtctctcttaaggtggttgcaaggggttcctttgagtttcccgtgggggatgctgtatctaaagtacttcaaattgagaaagagggcgctattcacagggaggagttggtgtatgagttgaaccccctcgaccatcggggaagaaccctggagatcccagggaattccgaccctaatatgatcccggatggcgactttaatagttacgtgagagttactgcttctgaccctctggacactttaggaagtgaaggtgctttatcccctggcggtgtggccagtctcttgcgactgcctagggggtgtggtgaacagaccatgatctatctggcccctaccttagccgctagtcggtatctcgacaagaccgaacaatggagtaccctgccccctgagaccaaagaccacgccgtagacctgattcagaaagggtacatgaggatccaacaatttaggaaggctgacgggagctatgccgcatggttaagtcggggttcgagtacatggctgactgccttcgtattaaaagtcctgagtttggcccaggaacaagtcggagggtcgccagaaaagctgcaggagacatccaactggctgctgagccagcagcaggctgacggctcttttcaagacctgtcacccgttatacaccgctcaatgcagggaggattggtagggaatgacgagactgttgcattgactgcgttcgtgacaatagccctccaccatggtcttgccgtgtttcaggacgagggcgcagaacccctgaaacagcgcgttgaggcctcaattagcaaggcaaattcgttcctcggggagaaggcctcagctggactgctgggtgcgcacgcagctgccattaccgcttacgccctgaccctgaccaaagcccctgcggatctccgcggtgtggcccacaacaacctaatggctatggcgcaggagaccggcgataatctttactggggcagcgttaccggatcgcagagcaatgctgtttcccccacccctgcccctcgcaatccttcagacccgatgccacaggctcctgctttgtggatcgagaccacggcttacgccctactgcaccttctactccacgaagggaaggctgaaatggctgaccaggcggcagcctggctgacaaggcagggatcattccagggaggtttccgctcaacccaagataccgtgattgctctcgacgctctcagcgcatactggattgcatcccatactactgaggagcgagggctaaacgtaacactaagctcgacagggcgaaatggatttaagtcgcatgctttacagctgaataacagacaaatccgaggtcttgaggaagagttgcagttcagtctgggtagcaagatcaatgttaaagttggtggaaacagcaaaggaacccttaaggtcctgagaacttacaacgtcctggacatgaagaacacaacttgccaggacctgcagatcgaagtcaccgtcaagggtcacgtcgaatatacaatggaagctaatgaagattacgaagactacgagtacgatgaattgcccgcaaaagatgatcctgatgccccactacagcctgttaccccactacagctgttcgaggggaggagaaaccgcagaagaagggaggcgcctaaactcacttctctgtccgaccggtatgtgtcacactttgaaacagaaggaccccacgtgctgctatatttcgattcagtcccgaccagtagggaatgtgttgggttcgaagctgttcaggaggtacctgttggactcgttcagcccgcttccgcgacgttatacgactactacaatcccgagaggaggtgctctgtgttctacggcgctcctagcaagtcccgtctcttggccaccttatgctccgcagaggtgtgtcagtgcgctgaagggaagtgtccacggcaacgcagagctctcgagcgcggactgcaggacgaggatggataccgtatgaaatttgcttgttactaccctcgtgtagagtacggtttccaggtcaaagtgctccgggaagattcacgggctgcgtttcgactcttcgagaccaaaatcacccaggtgctccattttaccaaggatgtaaaagcagccgctaaccaaatgagaaactttctcgtgcgggcatcatgtcgtctgcggttagagccaggaaaagagtacttgataatggggctggatggagcaacgtatgatctggaaggccatccccagtatttgctcgactccaactcttggatcgaagaaatgccatcagagagattgtgtcggagtaccaggcaacgcgcagcatgcgcacagttgaatgactttctccaggagtatggtactcagggatgccaggtgtag

SEQ ID NO: 219076 - DNA, 813 bp, Artificial Sequence
  Description of Artificial Sequence: Synthetic coding sequence
atgtgccctgaagattcactgcaggttcctttaaaggatgccaagagctgcggactccatcagttgttgcgaggccctgaagtgcagctggtcgcccatagtccttggctgaaggacagcctctctcgtactaccaatatccaaggaattaatctcctgttttccagcaggagaggccacctttttctgcaaaccgatcagcccatttacaatcccggacagcgagtgcgatacagagtgttcgccctcgatcagaaaatgagaccctcaacagacactattactgtaatggttgagaatagtcacgggttgcgggtaagaaaaaaggaggtctacatgccttcctccatcttccaggatgatttcgtgattccagatatcagcgaaccaggcacctggaaaatatctgctagattttctgacgggctggaatcaaactccagtactcagttcgaggtgaagaagtatgtgctgcctaattttgaggtgaagatcacccctgggaagccctacatcttgacagtccccggacacctagacgagatgcaactagacattcaggccagatatatttatggtaagccagtgcagggagtcgcctacgttagatttggccttctcgatgaagatggtaaaaagacttttttcagagggctcgagtcacagaccaaacttgtcaacgggcagtcccatatttctcttagcaaagctgaatttcaggatgcacttgagaagcttaacatgggaataacagacctgcaggggctgagactgtacgtggctgccgctatcatcgaaagtcctggagggtag

SEQ ID NO: 219077 - DNA, 5097 bp, Artificial Sequence
  Description of Artificial Sequence: Synthetic coding sequence
atgagactgctctggggtttgatctgggcgagcagtttttttaccctctcacttcaaaagccccgattgctgctattctcgccatctgtcgtgcacctcggtgtgccactctccgtgggggtccagttacaggacgtgccacgcggtcaggtggttaaaggatccgtcttcttgaggaatccatcaaggaataacgtcccctgttcaccaaaggttgatttcacactgagctctgaacgggacttcgccctgctctccttacaagtgccgctcaaggacgccaaatcctgcggcctgcaccaactgctgcgcggacctgaagtgcagctcgtcgcgcattcaccctggctcaaagatagcctcagcagaacaaccaatatccagggcattaacctgctgttctctagtaggcggggacatctgtttctgcaaaccgaccagccaatttacaaccccggacagagggtgaggtacagagtgttcgcacttgatcagaaaatgcgcccatctacagacaccattacagtgatggtcgaaaatagtcacggactcagggtgcgtaagaaggaggtgtacatgccaagctcaatatttcaggatgactttgtgatccccgacatttccgaaccgggtacctggaagatcagtgcgaggtttagcgacggactcgagtcgaacagcagtacacaattcgaagttaaaaagtacgtcttgcccaactttgaggtgaaaatcacacctggcaaaccatatatcttgactgtgcctggacacctcgatgaaatgcagttagatatccaggctcgctacatctatggaaagcccgttcagggggtagcctatgttcggtttggattgctcgacgaggacggtaagaagacattcttccgcggacttgaaagtcaaaccaagctggtcaatggacagagccacataagtctgagcaaggcggagttccaggacgccttggagaaactgaacatgggaattacggatcttcagggcttacgactgtatgtggcagcagctatcatcgaaagcccgggtggtgaaatggaagaagcggagcttacttcttggtacttcgtatcctctccttttagcctggatctcagcaagacaaagaggcacctcgtgccaggggctccatttctgctgcaggcactagttagagaaatgagtggttctcccgcttcaggaataccagtgaaggtttccgctaccgtctcctctcccggatcagtgcctgaggttcaggatatacaacagaacacggacggatctggtcaggtgtctataccaatcatcatcccacaaactatcagtgagctccagctctccgtctctgccggtagcccacatcccgcaatcgcacgtctgacagtcgccgctccaccttccgggggtcctggatttttgagtattgagaggcccgactcccggccacctcgcgtcggcgatacactcaatctaaatctgagggcggtgggatccggagctacgttctcccactactactacatgatcctctcaagaggacagatcgttttcatgaatagagaacccaaacgcaccctgacaagtgtttcagtgttcgttgaccaccatttagctccgtcattttactttgttgccttttattaccacggtgatcacccagtggctaatagtctccgagtggacgtacaggccggagcatgcgaaggaaaacttgagttatctgtggatggcgctaagcagtacaggaatggagaatccgtcaaactacacctcgaaacggattcgctcgcactcgtcgctctgggcgctctggacacagccctgtatgctgccggatctaaatctcacaaacccctgaacatgggcaaggtattcgaggcaatgaactcttatgatctggggtgcgggccagggggtggagatagcgccctgcaagtcttccaggccgctgggttggccttctcagacggtgatcagtggaccttaagccgcaaacgcttgagctgcccaaaggagaagactacaaggaagaagagaaacgtcaactttcagaaagccattaatgaaaaactcggacagtatgcctccccaactgcgaaacgctgttgtcaagacggggttaccagactgccaatgatgcgtagttgcgaacaaagggcagctagagtccagcaacctgattgcagagagcctttcctttcatgctgtcagttcgccgagagcctgcgaaagaagtcgagggataaggggcaggcaggtctgcagcgtgccttggaaatcttgcaggaagaagacctcattgacgaagatgatatccccgtccggtcattctttcccgagaactggctgtggcgagtggaaacagtggataggttccagattctgactctttggcttcctgatagccttaccacctgggagatccatggcctgtccctgtctaagaccaagggcttgtgcgtggcaacacctgtacagttgcgtgtttttcgcgagttccacttgcatcttcgattaccgatgtctgtacgcagattcgagcagctggagctgcggcctgtgttatacaattaccttgataagaacttgacggtttcagttcatgtatcccccgtggaaggtctctgcctggccggagggggtggcctggcccagcaggtactggtccctgcgggatccgctcgcccagtcgccttcagcgtggtacccacagccgctacagccgtgtccttgaaggtggtggcgagaggctctttcgagtttccagtgggtgatgcggtgtctaaggtactccagatagagaaggagggggctattcatcgggaagagctcgtgtacgagctgaatccattggatcaccgcggtagaactctagagatccccggaaacagcgaccctaacatgattcccgacggagattttaactcatacgtccgagttacagcttcagatccgttggatacactgggcagcgagggggctctgagccccggaggagtggcgagcctgctcagattaccaaggggttgcggtgagcagacaatgatctatcttgccccaaccctcgcagcctcccgttatctagataagacagaacaatggtcaactcttccccctgagacaaaggaccatgccgtggatttaattcagaagggctatatgagaattcagcagttcaggaaagcagacgggagctacgccgcatggctgtccagaggtagttcaacatggctgacagcattcgtcctgaaggtcctgtccctcgcacaggaacaggtagggggatccccagagaagcttcaggagacaagcaattggttgttgtctcagcaacaagccgatggtagtttccaagatttgtcacctgttattcataggagtatgcaaggcggactggtgggcaatgacgagaccgtagctctcaccgcgttcgttacgattgccctgcaccacggcttggccgtatttcaagacgaaggtgccgagccgctgaagcagcgtgttgaggcctccatcagtaaagccagctcatttcttggggagaaagcttcagccggattattgggagcccatgctgcagccattactgcctacgccttgaccctgaccaaggctccagccgacctgcggggagtggctcataacaatctaatggccatggcccaggagacaggagacaacttatattggggctccgtgaccggaagccagagcaatgcagtgtcccccacacccgcacctcggaacccctcagatcctatgccgcaggctcctgccctgtggatcgaaacaaccgcctacgccctgttacacctcctgctgcatgaaggaaaggctgaaatggcagaccaggccgcagcatggctgacccggcaaggtagctttcagggtggattccgctcaacccaagacactgtcatcgcattggacgccctatctgcgtattggatcgcaagccacaccacagaagagcgtgggctcaatgtgacgctgtctagcaccggcaggaacggcttcaagtcccatgctctgcagctaaacaatagacagataagagggctggaagaggagctgcagttttccctcggctcaaaaattaatgtgaaagtggggggaaattcaaaagggactctcaaggtgcttagaacatataacgtgctggacatgaagaataccacatgccaagaccttcagattgaagtcaccgtgaaaggccacgttgaatacaccatggaggccaacgaggattatgaggactacgagtacgatgagctcccagccaaggacgatccagatgcccctctgcagccagtcacccctctgcagctttttgaaggaaggagaaacagaagaaggcgggaggccccaaaattgacgagcctgtccgatcgttacgtttctcactttgaaactgagggtccccacgtcttgctttacttcgatagcgtcccaacctctagagaatgcgtgggcttcgaggctgtgcaagaagtaccagtgggtctggtacaacctgcatcagcaaccttatacgattactacaacccagagagacgctgtagtgtgttctacggagcgccttccaaatcccggctgctggccacgttgtgtagtgcggaagtatgtcagtgcgctgaggggaagtgtcctaggcagagaagggctttagaacggggtcttcaggatgaggacggatatcgcatgaagttcgcttgttattatcccagagtcgaatatggatttcaggtgaaggttctccgagaggacagtagagccgcttttcgactgttcgagaccaaaattacacaagtgctccatttcaccaaggacgtgaaagcagccgcaaaccagatgcggaacttccttgtgagggcttcatgccggctacgactggaacccggtaaagagtatctaattatgggcttggatggggcaacatatgacctggaaggccatccccaatacttactggatagtaactcttggatcgaggaaatgcctagtgagcgtctctgcagaagcacccgccaaagagccgcttgtgctcaactgaacgactttctgcaggagtatggaacacaggggtgtcaagtttag

SEQ ID NO: 219078 - DNA, 1536 bp, Artificial Sequence
  Description of Artificial Sequence: Synthetic coding sequence
atggccaagggtctgtccgtgcagaacgataagcatccgggataccagccagctctgctgcttagccccggtgcaccacttttcgccgacgggccagcctacgctctgttgcacctgcttctgcacgaaggaaaggctgaaatggccgatcaagcagcagcctggctgacccgccagggaagtttccaaggcggatttcgatcgacccaggataccgtcatcgccctggacgctctgtcagcttattggatcgctagccacacgactgaggagaggggactgaatgtgacgttgtcgtctaccggccgaaatggattcaagagccacgccctgcagctgaataacagacaaatacgaggcttggaggaggagctgcagttttcgctcggaagcaaaatcaatgttaaggttggcggaaacagtaagggaacactgaaagttctaagaacttataatgtgctcgacatgaaaaacacgacatgccaggacctccaaatagaagtgacagtgaagggacatgtggaatacaccatggaagccaatgaggactacgaggactatgaatatgatgagttgcccgctaaagacgacccagacgccccactgcaacctgtgacaccattgcagctcttcgagggccgacggaatagacggagaagagaggcacctaaagttgttgaagagcaggaatctcgcgtgcactatactgtatgtatatggagaaacggtaaggtgggattaagtggcatggcaattgctgatgtgacactgttgtctggcttccatgccctgcgagcggacctggaaaaactcacgtccctttctgacagatacgtaagccactttgagaccgaaggaccccacgtgctgctttattttgattcggtccccacgagcagagagtgcgtgggcttcgaagcagtgcaggaggttcccgtcggtctggtccagccggcatcagccaccctctatgactattataaccccgaaagacgctgtagcgtgttctatggcgcaccatccaagtccagactacttgctactctgtgcagcgccgaagtatgccagtgtgccgaaggcaagtgccctcgccagaggagggccctggaacgaggcttacaggacgaagatggttataggatgaaatttgcctgctactacccacgcgtagagtatggttttcaagtgaaagtgttgagggaggactcacgcgctgccttccgcctgttcgaaacaaagataacacaagtcctccatttcactaaagacgttaaggccgctgctaaccagatgcggaactttctcgtgcgcgcaagttgcaggctccggcttgagcctggcaaggaatacttaattatgggcctcgacggagccacgtacgacctggaaggacatcctcagtacctccttgattcaaatagttggatcgaagagatgccaagtgagagattgtgtcgcagcactcgccaacgagctgcctgtgctcagctgaatgatttcctgcaggagtacggcactcagggatgccaggtctag

SEQ ID NO: 219079 - DNA, 1953 bp, Artificial Sequence
  Description of Artificial Sequence: Synthetic coding sequence
atgggtagtcagtgtcgcggttggcatatgtgcgccctcggctcgcagcagcaagcagatggctcctttcaggacctatctcccgttatccatcggtctatgcagggtggtctggtggggaacgacgagactgtggccctgaccgcattcgtaaccatcgctctccaccacggtctcgcagtgttccaggacgagggagctgaacctcttaaacagagggtggaagcatcaatatccaaagcctctagcttcttaggagagaaagcatcagccggactgctgggagctcacgccgcagcgataaccgcatacgcgctcacacttaccaaggctcccgcagaccttcgcggagttgctcacaataacttaatggcaatggcacaagagacgggcgataatctctactggggaagcgtaacaggttcccagtctaacgcggtttcccctactccggcacctcggaatccatcagatccgatgccccaggccccagcactctggattgagacaacagcctatgctctcctgcatctgctgttgcatgaaggaaaagctgagatggccgatcaagccgcagcctggctcacaaggcaaggcagtttccagggtggctttcgctctacccaagatactgtcatcgccctcgatgccctgagcgcctactggatcgccagccatactaccgaagagcgcggtctcaatgttacactcagttctacaggacgcaacgggttcaagagccatgccctccagctgaataataggcaaatccgtgggctcgaagaggaactccagttctccctcggctctaaaatcaatgtgaaggtgggcggtaattcgaaaggcaccctaaaagtcttgcggacttacaacgtccttgacatgaaaaataccacttgccaggacctccaaatagaagtgaccgtgaaaggacacgtagaatacaccatggaggctaatgaagattacgaggattacgagtacgacgagctacccgctaaggacgatcccgatgcccctctgcagcccgttaccccgttgcagctgttcgagggacggagaaatcgcagacggagggaggcgccaaaggtcgtggaagaacaagaatctcgggtgcactacaccgtgtgcatctggaggaacggtaaggtcgggttgtcggggatggccattgccgacgtgaccttactgagcgggttccatgctcttcgggcagatttggagaagctgacctccctcagcgacagatacgtgagccacttcgagacggagggtccgcacgtcctgttgtatttcgactcagttcctactagtagagagtgtgtgggatttgaggccgtgcaggaggtgccggtgggcctggtgcagcccgctagcgctacactgtacgattattataacccagagcggcgatgcagtgtcttttatggagccccatcaaagtcacgccttctcgccacgctgtgcagcgccgaagtttgtcaatgtgccgagggcaaatgccccaggcagcggagggcccttgagcggggactgcaggacgaagatggataccggatgaagtttgcgtgctactatcctagggtggagtacggctttcaggtgaaagttctgagggaggattctagggcagcatttcgcctctttgagacaaagatcacccaggtgttgcatttcaccaaggacgtgaaagccgctgctaatcagatgcggaactttctagtgcgcgcttcatgtcgattacggttggagccaggaaaagagtatctcattatgggcctggacggagcaacgtatgacctcgaaggtcatccacagtacttactggatagcaatagctggattgaggaaatgccatccgaacgcctgtgccgctctactcgtcaaagggctgcgtgcgcccagctgaatgacttcttacaggagtacgggacccagggttgccaggtgtag

SEQ ID NO: 219080 - DNA, 291 bp, Artificial Sequence
  Description of Artificial Sequence: Synthetic coding sequence
atgcccggtccaacaccctccgggactaatgtcgggagcagcggaagatctcctagtaaggccgttgctgcaagggccgcaggctcaactgtgcgccagcgcaagaatgcatcttgtggtacccggagcgcaggtaggaccacatctgcagggaccgggggaatgtggcgcttttataccgaggattcccctggccttaaagttggtcccgttcccgttctggttatgtccctgttattcatagcaagcgtctttatgctgcacatttgggggaagtatacaagatcatag

SEQ ID NO: 219081 - DNA, 3318 bp, Artificial Sequence
  Description of Artificial Sequence: Synthetic coding sequence
ggtcgcgcaggtgaagtgcgagctctgtcctccggggcacagcgtagaggctcacacttcgttgtgctgtgccggttgccacgaggcagagccagagtcgtgggcgcatccctgtcacatgctcctctgcccctgagatattgctggaaaggacggggtggcgtaagcagacttttctgtagtcagagagctaggatgccgggtagtctgggacgagaagcatcaggcagagcaggaccaacagggtgtggcgctttcgccttcgggttgaggtgtaggtacgttatctccgccccaaaaatcttcagggtcggggcaagtgaaaatatcgtgattcaggtgtatgggtatactgaggcctttgacgctaccatatccataaagtcgtacccagataagaagttctcctatagctctggtcacgtacacctatcttctgagaacaagtttcaaaacagcgccatcctgacaattcagcctaaacagttgcctggaggccagaacccggtatcctatgtctatcttgaagtggtctcaaaacacttcagcaaaagtaaacggatgcctataacctacgacaacggttttctctttatacataccgacaagcctgtttatacacctgaccaatcagtcaaggtgcgggtgtattccctgaatgacgatctgaagccagccaaaagggaaactgttctaaccttcatcgatcccgaaggatccgaagtcgatatggttgaggagattgaccatattggtatcatcagctttccagactttaagatcccgtcgaaccctcgatacggcatgtggacaattaaagccaaatataaggaagacttttctacaaccggcactgcctatttcgaagttaaggaatatgttctgccccattttagtgtcagcattgaacccgaatataatttcattggttacaagaacttcaaaaacttcgagattacaattaaggcaaggtatttctataataaagtagtgacagaggctgacgtttacatcactttcggcattcgtgaggacctcaaagatgaccagaaggaaatgatgcagacggccatgcaaaataccatgctcatcaacggcatcgcccaagtcactttcgactccgagaccgccgtcaaggaattgagctactactctcttgaagacctgaataacaagtacctgtatatcgcggtcactgttatagagtccactggtgggttctcagaggaggcagaaatccccggaattaagtacgtgctgagcccctacaaactgaatttggtcgcaaccccactgttcctgaagcccggaataccctaccctatcaaggtgcaggtgaaagattccctggatcagctggttggtggcgtcccagtgaccctgaatgctcagaccatcgacgtgaatcaagagacttcagatctggatccctctaagtctgtgacccgagtcgatgacggcgtagcctcattcgttcttaacctgccctcgggggtcactgtgctggagttcaatgttaaaactgacgcgccagacttgcctgaagagaatcaggcacgagagggctatagagccattgcgtactcctctttatcacagagctacctatatatcgactggaccgacaatcacaaagcccttttggtcggcgaacatctcaatatcattgtcacccctaagtcaccttatatcgataaaattacacattacaattatcttattttgtccaaaggaaagattatacattttgggacacgcgaaaagttcagcgacgcatcgtaccagtccattaacatccccgtaacacagaatatggtgccaagtagccgattactggtatactatattgtgaccggtgagcagaccgcggagctggtaagtgacagcgtgtggctcaatatcgaagagaagtgcggcaatcagctacaagtccacctgagcccggatgccgatgcctattcacccggtcagaccgtgtctctaaatatggcaactggcatggacagctgggtagcgctggccgctgtggattcagccgtttatggcgtccagcgaggggcaaagaaaccccttgagagggtattccagttccttgagaaaagcgatctgggctgtggagcagggggaggtttaaataacgcaaacgttttccatcttgcaggactgacattcctgacaaatgccaatgctgatgatagtcaggaaaacgatgaaccctgtaaggagatcctgcggccaagacgcactctccagaaaaaaatcgaagaaatcgcggctaagtataaacactccgttgtcaaaaagtgctgctatgatggcgcttgcgtcaataacgatgagacctgcgaacagcgcgctgccagaatatccctcggacccaggtgtatcaaagccttcactgagtgttgcgtggtggcatcacaactcagagccaacattagccataaagatatgcagcttgggaggctccatatgaaaaccctcctcccagtgtccaagcccgaaatcagatcttactttccagagagttggttgtgggaggttcacctcgtgcccagaagaaagcagctacagttcgcccttcccgatagtctaacgacgtgggagatacaaggtgtgggaataagtaatacagggatctgcgtggccgacacggttaaggcaaaggtgtttaaggatgttttcttagaaatgaacatcccgtactcggttgtgaggggtgaacagattcagctgaaaggcactgtgtataactacaggacctcaggtatgcagttttgtgtgaaaatgtccgctgtcgagggcatttgcacctcagagtcgcccgtgatcgaccaccagggaactaaatccagcaaatgcgttaggcagaaggtcgaaggcagcagcagccacctagtgacatttaccgttttgccgttggagattgggctgcataacatcaacttctctttggagacctggttcggtaaagagatactcgtaaagacactccgtgtggtaccagaaggggtcaagcgcgagagctattcaggtgtgaccttggaccctaggggtatctacggtactattagtaggcggaaggagttcccatacagaatccccttagacctcgtcccgaagaccgagattaaacgaatcttgagtgttaagggccttctggtcggcgaaatattgtccgctgtgctcagtcaagaaggaataaatattctgacccacctgcctaaaggctctgcagaggcagagctgatgtctgtagtgccagtcttttacgtattccctggcaaccgcaaatctctcgaacatttctccttttag

SEQ ID NO: 219082 - DNA, 2805 bp, Artificial Sequence
  Description of Artificial Sequence: Synthetic coding sequence
atggctcgacgtagcgtgctgtatttcatcctgctcaatgctcttattaacaaggggcaggcttgcttttgtgatcactacgcctggacacagtggacctcatgcagcaagacatgcaattctggcacacagagtcgacatagacagattgtggttgataaatattaccaggagaatttttgcgagcagatctgttccaaacaggaaacccgtgaatgtaactggcagcgctgcccaataaattgtctactcggcgattttgggccttggtctgactgtgacccttgtatcgaaaaacaatccaaggtcagaagcgtcctcaggccgtcgcagttcgggggacaaccgtgcaccgcgccactcgttgcctttcagccgtgcatcccctccaaactgtgcaaaatagaagaggccgactgcaagaacaaatttaggtgcgactcaggcaggtgcattgctcgcaaacttgaatgcaatggcgaaaacgactgcggtgataattcggacgaacgtgactgcgggaggaccaaagcagtgtgcacacggaagtacaaccccatcccgtctgttcagctcatgggtaacggttttcacttcctagccggtgagcccagaggcgaagttctggacaactccttcaccggcggtatatgcaagactgtgaagtcttcccgtacctcaaacccatatcgcgttcctgccaatctggagaacgtgggctttgaggtccaaactgccgaagacgatctgaagactgacttctacaaggaccttaccagtctgggccacaacgaaaaccagcagggctccttttccagtcagggaggttctagcttctctgtgccaatcttttacagcagcaagagaagcgagaatatcaaccataatagcgcattcaagcaagcaatccaagctagccacaaaaaggattccagtttcatccggatacataaagtcatgaaggtgctcaattttacaaccaaagccaaagatttacacctcagtgatgtgtttctcaaagctctgaatcatctgccattggagtataacagcgctctgtattcgcgaatcttcgacgacttcggcacgcattatttcacttccggctccttgggtggcgtgtatgacttgctctaccaattctcctcagaggaattaaagaatagtggcctgactgaagaggaggccaagcactgcgtcagaatcgaaacaaagaagagggtgttgtttgcgaagaaaactaaagtcgagcatcgctgcaccacaaacaagctaagcgagaagcatgagggctcctttattcagggggctgagaagagcatcagcctaattagaggagggcgttccgagtacggagcagcactcgcctgggaaaaaggttcctccggcctggaagagaaaaccttctccgaatggctggagtccgtcaaagaaaaccctgctgtcatcgatttcgaactggcacccattgtcgatctcgttaggaacataccatgcgccgtgactaagagaaacaacttgaggaaggctctccaagagtacgccgcaaagtttgatccatgtcaatgtgcaccatgtccaaataatgggcgacccaccttgagcggaacagagtgtctgtgcgtctgccagagcggtacctatggtgagaattgtgagaaacagtcaccggactataagagcaatgctgttgacggccaatgggggtgttggagctcctggtcaacatgcgacgcaacgtataaacggtcccggacgcgggagtgtaataaccctgccccacagagaggaggtaagcggtgcgagggcgagaaacgccaagaggaagattgcacgttttccatcatggaaaataacgggcagccctgcatcaatgatgacgaagagatgaaagaggtagatctgcctgagatcgaagcagactcaggctgtcctcagcccgtccctccagagaacgggtttatcaggaacgagaaacagctctacctcgtgggcgaagatgtggaaatcagttgcttgacagggttcgaaacagtcggataccagtattttaggtgcctccccgacggcacttggaggcagggagatgtagagtgccaacgcactgagtgcatcaagccagtagtgcaggaggtcctgacaattacaccgttccagaggttatatcgaatcggcgaaagtattgaattaacatgtccgaaagggttcgttgtcgcaggcccaagccggtacacgtgtcaaggcaactcctggacgcctccgatctctaatagcttgacctgtgagaaggatactcttacaaaacttaagggccactgccagttagggcagaaacagagtggctctgaatgcatctgtatgtctccggaagaagactgcagccatcactctgaggatctctgtgtgttcgacaccgacagcaacgactactttacatccccggcttgcaaattcctcgccgagaaatgcttgaacaatcagcaactgcactttctgcacattgggtcttgtcaggatgggcgacaactcgagtgggggctggaacgcacgcgcttgtccagcaactctactaaaaaagaatcatgtgggtatgacacctgctatgattgggaaaagtgctccgcctccacatctaagtgtgtgtgtctgttaccaccacagtgttttaaaggcggaaatcagctatactgtgtcaaaatggggagcagtacctcagagaagacccttaatatctgtgaagtaggaacaatcagatgtgcgaaccgaaagatggagatccttcaccccggaaagtgtctcgcatag

SEQ ID NO: 219083 - DNA, 2805 bp, Artificial Sequence
  Description of Artificial Sequence: Synthetic coding sequence
atggcacgtcgctctgtgctgtactttatcctgcttaacgccctgatcaacaaaggacaggcctgtttctgcgaccactatgcctggacacaatggacttcctgctccaagacgtgcaatagcgggacacagagccgccataggcagatcgtggtcgataaatattatcaagaaaacttctgcgagcagatttgcagtaaacaagaaacgcgtgaatgtaactggcagcgttgccccataaactgcctgcttggtgacttcggcccatggtcagattgcgatccatgtatcgaaaagcagagcaaagtgcggtctgtccttaggccaagccagttcggaggacagccgtgtaccgccccacttgttgcatttcagccttgcatccccagcaaactgtgcaaaatcgaagaagccgactgtaaaaataaattccgatgcgactctggccgttgcatagcgcgtaagctggagtgtaacggagagaatgattgcggagataatagtgacgaaagagactgcggaaggactaaggcagtctgtaccaggaagtataatcctataccgtctgtccagctgatgggtaacggcttccactttctcgcaggggagcctagaggcgaagtccttgacaactcattcacgggtgggatctgcaagaccgtgaagagcagtcgaaccagcaacccatatcgggtacctgctaatctggagaatgtaggtttcgaggtccagacagcggaggatgacctcaagaccgacttttacaaagatctgacgagtttaggtcacaacgagaaccagcagggatcgttctctagtcaaggaggtagcagtttctccgtgcctatcttttatagtagcaagaggtctgaaaacattaaccacaacagtgccttcaaacaggctatccaagcctctcacaagaaagacagtagctttatccgcattcataaggtcatgaaagtattaaacttcacgacgaaggctaaggacctccatctcagtgacgtattcttaaaggctctgaatcatctgccgcttgagtataactctgctctttattcgagaattttcgacgacttcggcactcactactttacaagcggatctctcggtggtgtgtatgatctgttgtatcagtttagcagcgaggagctgaaaaattcaggattgacagaggaagaggctaaacactgtgtccgcatagagaccaaaaaacgtgttctgttcgccaaaaagacaaaggtggaacacagatgtacaactaacaagctcagcgagaagcacgagggttctttcattcagggagctgagaaaagtatcagcctgatccgcggtggaaggagcgagtacggggctgcactggcatgggagaaggggagctccgggcttgaggagaagacgttctcggagtggctggagtccgtaaaggagaaccctgccgtgattgatttcgagctggccccaatcgtggacctggttagaaacatcccttgtgcagtgacgaagcgcaataatctccgcaaagccctgcaagaatacgcagccaagtttgacccttgtcagtgtgccccatgtccaaataatggccgtccaacactgtcaggcacagagtgtctgtgcgtctgccagtccgggacctacggggaaaactgtgagaagcagagccctgactataagtccaacgctgttgacggccagtggggctgttggtcatcatggagcacgtgcgacgctacttacaagcgtagccgtacccgggagtgtaacaaccctgcaccacagaggggaggaaaacggtgcgagggtgagaagcgtcaggaggaagactgcacattttcaatcatggagaataacggccaaccctgtataaacgacgacgaagaaatgaaagaggtggatctcccagagattgaggcagactccgggtgtccgcagcccgtcccaccggaaaacggcttcattcgcaatgaaaagcagttatatttggtgggagaggacgtcgaaatctcttgtctgaccggttttgagactgtggggtaccagtactttcgatgcctgccagatggtacctggcgccaaggtgatgtcgaatgtcagcgtacggaatgcataaagccagtcgtgcaggaagtgctgaccatcacccccttccagaggctgtaccgtatcggcgagagcatcgagctgacttgtccaaaagggttcgtggtagctggcccttctcgatacacatgccaaggcaactcctggaccccgcctattagtaactccctgacctgcgagaaagacacactcactaagctcaaaggccactgtcagttgggccagaaacagagtggctccgagtgtatctgcatgtcacctgaagaggactgctctcaccatagtgaagacctctgtgtctttgacacagattccaatgactacttcaccagtccagcttgtaagtttttagcagagaaatgcctgaacaatcaacagttgcatttccttcatatcggttcctgtcaggatggaagacagctcgaatggggtctggagaggacccggctctcctcaaactcaaccaagaaggaatcttgcggttacgatacatgctacgactgggagaaatgcagcgcttcaacgagcaaatgcgtgtgcctgctgccccctcaatgctttaagggagggaaccaactgtactgcgtgaaaatgggttcttctacatcagagaaaactttgaacatctgcgaagttggtaccatccggtgcgccaataggaagatggaaatcctgcatcctgggaagtgtctggcgtag

SEQ ID NO: 219084 - DNA, 2532 bp, Artificial Sequence
  Description of Artificial Sequence: Synthetic coding sequence
atgaaagtcatcagcctgtttatcttggtcggcttcataggcgaattccagtctttttctagtgccagctccccagtgaactgtcaatgggacttctacgctccttggtcggagtgcaacggctgcacgaagacccagactcgtcgaaggagcgtggctgtttatggtcaatacggcggtcaaccatgtgttggtaatgctttcgagacacagagttgtgagcctacccgcggatgccctaccgaggagggttgcggggagaggtttcgctgtttctccggacagtgcatttccaagagcctggtgtgtaatggagacagtgactgcgacgaggattccgcggatgaggaccgctgtgaggactccgagcgacgaccaagttgcgacatagacaagcctccacctaatattgagctgaccggcaacggctacaatgagctgaccggccagttcagaaatcgcgtgatcaatacaaagtccttcggcggtcagtgtcggaaggtgttttcaggtgatggcaaagatttttatcggttgagtggaaacgtcctcagctatactttccaggtgaaaatcaacaatgacttcaattacgaattctacaactccacttggtcgtacgtgaaacacacaagcacagaacacacaagcagctcacggaagaggagcttcttccgaagcagcagtagtagttcaaggagctataccagccacaccaacgaaattcacaaaggaaagtcataccaattgctcgtcgttgagaacacagtggaagtcgcccaattcatcaataacaacccggagtttctccagctcgccgaaccattttggaaagagttgtctcatctcccttctttgtacgactactctgcttacaggcgtctgatcgatcaatatggaacccactatctccagtcagggagcctgggaggggagtatagagtcctattctatgtggactctgaaaaacttaagcaaaatgattttaacagcgttgaggagaagaagtgcaaatcgtcaggttggcacttcgtagtgaaatttagtagccacggttgcaaggagctagaaaatgctctgaaggctgcgagtggtacgcagaataatgtgctgaggggtgaacctttcatcaggggaggcggtgccggatttatttcaggtttgtcctacctggagctggataatccagcgggaaacaagcgacgttactctgcatgggcagagtctgttaccaacttgccacaggtcatcaagcaaaaactcacgcccctttacgagcttgtcaaggaggtgccctgcgcatcagtcaagaaactctatctgaaatgggcactggaagaatatctggacgaattcgacccctgccactgtcgaccttgtcaaaacgggggactcgcgacagtggagggcacccactgcttatgccattgtaagccctatacgttcggtgctgcgtgtgaacagggcgtgcttgtgggcaatcaggctggaggggtggatggtgggtggtcttgctggagttcatggagcccttgcgtccaggggaaaaagacccggtccagagagtgcaacaatcctcccccatcaggcggaggtcgttcctgcgtgggagaaactactgagagcactcagtgcgaggacgaagaactggaacatctgcgactgctcgaacctcactgttttccactctccctcgtgccaactgaattttgtccttccccccctgcactgaaagacggattcgtacaggacgaaggaactatgtttcctgtgggcaaaaatgtagtgtacacatgcaacgagggttattccctgataggtaatcccgtagcacgctgcggagaggatcttagatggctagtgggtgagatgcactgtcagaaaattgcctgcgtgttaccagtgcttatggacggaatccagtcccaccctcaaaaacccttctatactgtcggggagaaggttacagtaagctgcagcgggggaatgagcttggaggggcctagcgcctttctgtgtgggtccagcctgaagtggtcacctgaaatgaaaaacgctaggtgcgtccagaaggagaatccactcacacaagccgtaccgaagtgccagaggtgggagaaattacagaacagcagatgcgtgtgcaagatgccttatgagtgcggcccatcattagacgtttgtgctcaagatgaaagatcaaagaggattctgccactcaccgtgtgcaaaatgcacgtcctgcactgccagggtcggaactatactctgactgggagggactcatgcaccttgccagcaagcgccgagaaagcctgcggggcatgccccctgtggggcaagtgtgatgccgagtcatccaagtgtgtgtgtcgagaagccagtgagtgtgaagaagagggtttctcgatatgtgtggaagtaaacggcaaggagcagactatgtccgaatgcgaagccggagccctgcgatgtaggggccagtcaattagcgtcacatctattcgcccttgtgcggctgagacacagtag

SEQ ID NO: 219085 - DNA, 1461 bp, Artificial Sequence
  Description of Artificial Sequence: Synthetic coding sequence
atgaaggtcatttcgctgtttatcctggtaggcttcatcggcgaatttcaatccttttcaagcgcttcctctcccgtgaactgccaatgggacttctatgcaccttggagcgagtgcaatggctgcacaaaaacccagaccaggcgcaggtccgtagcggtgtacggccagtacgggggacaaccctgtgtgggcaatgccttcgaaacccagagttgtgaacccaccagaggttgtcctaccgaggaaggctgcggggaacgctttagatgtttttccggccagtgcatctctaaatctttggtgtgtaatggagactctgactgtgatgaggacagcgcggatgaagatagatgtgaggatagcgagagacgcccatcctgtgatatcgataagccaccgcctaacattgagcttactgggaacggttacaacgagctcacggggcagttcaggaaccgggtgctgttttacgttgattcagagaagctcaagcaaaatgacttcaactcagtcgaagaaaaaaaatgcaagtctagcggatggcacttcgtcgtcaagttctcatcacatggctgtaaggaactggagaacgccctcaaggcagccagcggtacgcaaaataacgtgctgcggggtgaaccattcatccgaggaggtggcgctggctttatttctggcctttcctatctggagctggacaatcctgccggaaataaacgtcgatactccgcctgggccgaatccgtgaccaaccttccccaggtcatcaagcagaaactgacccctctgtacgaacttgtgaaggaggtgccctgcgccagcgtgaaaaaactctacctgaaatgggcccttgaagagtacctggatgagttcgatccgtgccattgtaggccgtgccagaatggcggtctggctactgttgagggcactcactgtttgtgccattgcaagccttacaccttcggcgctgcttgcgaacagggagtcttagtcggaaaccaagccggaggggttgacggcggatggtcttgttggagctcttggtccccctgcgtccaggggaagaagacccgctctagagagtgcaacaatccccctccaagcggaggaggacgctcttgcgtcggagagacaactgaatcgacacagtgtgaagacgaggaactggagcacctccggttgctagagccgcattgttttccactgagccttgtgcccacagagttttgtccctccccacccgctcttaaggacgggttcgtccaggacgaggggactatgtttcctgtgggcaaaaacgtcgtctatacatgtaatgaggggtattctcttattggcaacccagtggcacgatgcggggaagatctgcgttggctggtgggggagatgcactgtcagaacgggaagatctcaaactggatgaaggtaaacgagaccttacttgtggagcaccactag

SEQ ID NO: 219086 - DNA, 1032 bp, Artificial Sequence
  Description of Artificial Sequence: Synthetic coding sequence
atgaaggtgatatcgctcttcatcctagtgggttttattggcgagtttcagagcttctcatctgctagctcacccgtgaattgccagtgggatttttacgctccatggagcgagtgtaacggctgcactaaaacacagacacgccgaagaagcgtggctgtttatggccaatatggcggacagccttgcgttggaaatgcgttcgagacccaatcctgtgaacccacccgtggttgccctactgaggagggttgcggagaacgattcagatgtttcagcggtcagtgcattagtaagtccttagtgtgcaatggtgactcagattgcgacgaggactccgccgacgaggataggtgcgaggactctgaacgtcgcccaagttgtgacatagataagcctcctcctaatattgagcttactgggaacggctacaacgaattgactgggcaattccgaaatcgcgtgatcaacacaaaaagcttcggaggacagtgtcggaaagtgttcagtggcgacggcaaagacttctaccggttatcaggtaacgttctgagttataccttccaggtgaagattaacaatgattttaactacgaattttataactctacatggagctacgtcaaacatacatccacagaacatacgtcttcatctcggaaacggtccttctttaggagctcctcatcctcttcacgcagttatactagccataccaacgagatccataagggaaagagttaccagcttctcgtggttgaaaatacagtcgaggtggcccagttcatcaataataatccagaattcctccagctggccgaacccttttggaaggagctctctcacctgccatctctttacgattactcagcttaccggagattaatagaccagtatggcacacactatctgcagagcggttcattagggggagagtatcgagtgctgttttatgtggactccgagaagctgaagcagaacgacttcaattctgtcgaaaaaaagaaaaagaagaaaaaaaagaaaaaatag

SEQ ID NO: 219087 - DNA, 1755 bp, Artificial Sequence
  Description of Artificial Sequence: Synthetic coding sequence
atgttcgccgttgtgtttttcatactgagcctgatgacttgccagcccggagtcacggcccaggagaaggtgaatcagcgcgttcgacgtgcagcaacacctgctgccgtgacatgtcagctatccaattggtcagaatggacagactgtttcccttgccaagacaagaagtaccgacacagatctctgttgcagccgaacaaattcgggggaaccatatgttcgggggacatatgggaccaagcttcgtgcagctcctcaactacctgcgtacggcaagcgcagtgtggacaagacttccagtgtaaggagaccggcaggtgcctaaagcgccatctcgtgtgcaacggagatcaagattgccttgacggttcagatgaggatgactgtgaagatgttagagcgatagatgaagattgtagccaatatgagccaatcccaggctcccagaaggccgcactgggttataacatcctcacgcaggaagatgcccagtccgtgtatgacgcgtcgtactatggcggacagtgtgaaactgtctacaatggggagtggcgagagttgcggtatgatagtacgtgcgaaagactgtattatggggatgacgagaaatatttcaggaagccttacaatttcctcaaataccactttgaagctttggctgacactggaatttcaagtgagttctacgataatgcgaatgatttactgtccaaggtgaaaaaagacaaatccgatagctttggggtcacaattggcatcggaccagccggatctccattgctcgtgggtgttggcgtaagtcactcacaagatacatcgttcctgaacgagctaaataagtataatgaaaagaaatttatctttacccgcatctttaccaaagttcaaacagctcattttaaaatgaggaaggatgacatcatgctagatgaaggtatgctgcagtccttaatggagctcccagatcagtacaattacggcatgtacgcaaaattcataaacgattatggcacccactacattaccagtggttctatgggtggaatttatgagtatattcttgttattgataaagccaagatggaatcgctggggattacaagcagggacattaccacatgcttcgggggttctctcggaatccagtacgaagacaagatcaatgtgggaggcggactgagcggagaccactgcaagaagttcggaggtggaaagacagaacgcgcaagaaaggctatggccgtcgaagatattattagcagagtgcggggaggctcatccggctggtctgggggactcgcccaaaaccgctctaccatcacgtacaggagctggggccgatccctaaagtacaaccctgtcgtgatcgatttcgagatgcagcctatccatgaagtgcttcggcatacaagtttgggccctttggaggcgaaacgtcagaatctaaggcgggcattggatcagtacctgatggaattcaacgcttgccggtgcggtccatgctttaacaatggcgtgccgatattagaaggaacatcctgtagatgccagtgtcgcctgggctctttgggtgctgcctgcgagcagacgcagaccgagggtgccaaggccgatggttcttggtcatgttggtcctcatggtcagtgtgcagggccggaattcaagagcgaagacgggagtgcgataatcccgcaccccaaaatgggggtgcgtcgtgcccgggtcggaaagtgcagacccaggcatgctag

SEQ ID NO: 219088 - DNA, 1776 bp, Artificial Sequence
  Description of Artificial Sequence: Synthetic coding sequence
atgaagaatagccgcacctgggcttggagagccccagtcgagctgtttttgctgtgtgctgcactaggctgcctgtcacttccgggttcccgcggagagagacctcactcattcgggagcaatgccgtgaataagtcctttgcaaaaagtcgtcagatgagatcagtggacgtgacactcatgcctattgactgtgaactcagcagttggtcaagctggaccacgtgtgatccctgccaaaagaaaaggtatcgctatgcgtatttgctgcaaccttcccagtttcatggagaaccgtgcaatttctccgacaaagaagtggaggactgcgtcaccaaccgtccatgtggctcacaggtccggtgtgaggggttcgtgtgcgcccaaacagggaggtgtgtgaatagaagactcttgtgtaatggcgacaacgactgtggcgaccaaagcgacgaggctaattgccgcagaatttataaaaagtgccagcatgaaatggatcagtactggggcattggcagtctggccagtggtattaatctcttcacaaactcctttgagggtccagtgcttgatcatcggtactatgctgggggatgttccccacattacattctgaacacccgtttccgaaagccttacaacgtcgaatcgtacacgcctcagacacagggaaagtacgaattcatacttaaggagtatgaaagctatagtgacttcgaacgcaatgtcaccgagaagatggcctcaaagtcaggcttttctttcggcttcaaaatccctgggatcttcgaactgggcatatcttcgcagtccgacaggggaaagcactatattcggcgaacgaagaggttctctcatacaaagagtgtgtttctccatgctcgttctgatttggaagtggcccattacaaactgaagcccagaagcctcatgctccattatgaattcttgcaacgggtcaagcgcctcccactagagtactcatacggtgagtatcgggacctcttccgggatttcggtacccattatattaccgaagcagtgctcggaggcatttacgagtatacgctggtgatgaataaggaggcgatggaaaggggggactatacactgaataacgtgcatgcgtgcgcgaagaatgactttaagattggcggtgctattgaggaggtttacgtgtccctgggggtatccgttgggaaatgtcgcggaatccttaacgagatcaaagacagaaataagagggatacaatggtggaagatctggtcgttctggtgcgcggtggtgctagtgaacatattactacgttagcttaccaagagctgcccacagccgatcttatgcaagaatggggcgacgcagtgcaatacaatccagccatcatcaaagtgaaagtcgaacccttgtacgaactggtgactgccacggacttcgcatactcttctacagtgcgccagaacatgaaacaggccttggaggagtttcagaaagaagtatcaagctgtcactgcgccccatgtcagggtaatggggtaccagtgctgaaaggcagtaggtgcgactgcatctgcccagtgggaagccaggggttggcatgtgaggttagttatagaaaaaatacccccattgacgggaagtggaactgctggagcaattggtcatcctgctctggtcgccgaaagactaggcaaagacagtgcaacaatccaccaccacaaaatggcggaagcccatgctctgggccagcgtccgagactctggactgctcctag

SEQ ID NO: 219089 - DNA, 1590 bp, Artificial Sequence
  Description of Artificial Sequence: Synthetic coding sequence
atggatacatgcatgaccctggccttcacactcagcgggaggttcttcatgctactgagtcaatacagatacgcctacctgctgcagccctcccagtttcacggcgagccgtgcaatttctcagataaggaggtggaagactgcgtcacaaatcgcccttgtggaagtcaggttagatgcgaaggattcgtttgtgcccagactggaagatgcgtcaatcggcgtctgttgtgtaatggcgataatgattgtggagatcagtctgatgaggctaattgccgcagaatttacaagaaatgtcagcacgagatggatcagtattggggcattggtagcctcgcttcgggtattaatctgttcaccaactcttttgagggtccggtcctcgatcacagatactacgcagggggatgctcgccacactacatcctcaacacacgcttccggaaaccctacaatgttgagagctacacaccccagacccagggcaaatacgagtttatcctgaaagagtatgaaagttactccgactttgagagaaacgtgacagaaaaaatggcatctaagtcaggattttcattcgggttcaagatccctgggattttcgagctgggcattagttcacagtcagacagggggaagcattacatccgacgaactaaacgattttcccacacaaaatctgtgtttctgcatgccaggagcgacctggaggtggcccactacaagttaaagccaaggagcctcatgctgcattacgaatttctccaaagagtcaagagactgccgctcgagtatagttatggagagtatcgagatctgttccgggacttcggcacacattatatcaccgaagccgtgttgggcggtatttacgagtacacgctcgtgatgaacaaggaggcaatggaacggggagactacacactcaacaacgtgcacgcctgtgcaaagaatgatttcaaaatcggcggagcaatcgaagaggtttacgtctccctgggagtgagtgttggaaaatgtcggggaattctgaacgagatcaaggaccggaataaacgcgacacaatggttgaagatcttgtagtgctcgtacgtgggggagcctccgagcacataacgactctcgcctaccaggagctaccaaccgccgacctcatgcaggagtggggagacgcggtccagtacaatccagcaattatcaaggtaaaggtggagccactttatgagttggtgaccgcgacggatttcgcctactcatctacagtacgtcaaaatatgaagcaggctcttgaagagtttcaaaaagaagtatcatcctgtcactgtgccccatgtcagggtaacggggttcccgtacttaagggcagccgatgcgactgtatctgtcccgttggaagtcaaggtctcgcctgtgaagtgtcgtaccgcaagaatacaccgatagatggaaagtggaattgttggtctaattggtcatcctgctcaggacgtcgcaagaccagacagcgacagtgcaataacccccctccccagaatgggggaagtccatgtagcggtccagctagcgagacgctcgattgttcctag

SEQ ID NO: 219090 - DNA, 1620 bp, Artificial Sequence
  Description of Artificial Sequence: Synthetic coding sequence
atgagatcagtggatgtgacactcatgccgatcgactgcgagctcagcagctggagttcatggaccacctgtgacccctgccagaagaaacgatatcgctacgcatacctgctgcagccttcccagtttcatggggagccctgtaacttctcagataaggaagtcgaggattgcgttacaaatcggccttgtgggtcccaggtgcgatgcgaggggttcgtttgcgcccagacaggtagatgtgtgaatcgacggctgttgtgtaatggagacaacgattgcggtgatcagtccgacgaggctaattgtaggcgcatatacaaaaagtgccagcacgaaatggaccagtattggggcataggcagtcttgctagtggaattaatctctttacaaacagttttgagggccctgtgctggaccatcgttactacgcaggagggtgttcccctcattacattctgaacaccagatttaggaagccatacaacgtggaatcatatacacctcaaacacaggggaaatatgaattcatactcaaggaatacgaatcctattcagatttcgaaagaaatgtcaccgaaaaaatggcctccaaatccggttttagtttcgggtttaaaatcccgggaatctttgagttgggaatttcatcgcagtccgatagagggaagcattacatcagacgaacaaagcgatttagccacaccaagtccgtgttccttcatgcaagatcagacttagaggtggcacactacaagttgaagccacggagtctcatgcttcactacgaatttttgcagcgagtcaagcgtctcccactggaatacagctacggtgagtacagggacctctttagggatttcgggacacactatataactgaagcagtgcttgggggaatatacgagtacaccttggtgatgaataaggaggctatggagagaggcgattacaccctgaataacgttcacgcctgcgccaagaatgactttaaaattgggggagccatcgaggaggtttacgtgagcttgggagtgagcgtgggcaaatgccgtggaatcctgaacgagatcaaagaccgaaataagcgcgatactatggtggaggaccttgtggtgctggtgaggggtggcgcatctgagcacattaccactttggcctaccaggagttacctactgccgatcttatgcaggaatggggagacgccgtacaatacaatcccgctattatcaaggtcaaggtggaacccctctacgaactggtcacggccacagattttgcttactcaagcaccgttaggcaaaacatgaaacaggcactggaagaatttcagaaagaagttagttcatgccattgcgccccttgccagggaaatggtgtccccgtgctcaagggaagccggtgcgactgcatatgcccagtcgggagccaggggcttgcctgtgaggtgtcataccgtaagaacaccccgattgacggcaagtggaattgttggagcaattggtcctcatgttccggtaggaggaagaccaggcaacgccagtgtaacaatccccctccgcagaatggtggaagcccgtgttctggtcccgcttctgaaacgctggactgctcttag

SEQ ID NO: 219091 - DNA, 675 bp, Artificial Sequence
  Description of Artificial Sequence: Synthetic coding sequence
atggccacacatcacaccttgtggatgggactggcgctcctaggtgtcctgggggacctgcaggccgcacccgaagctcaggtctctgttcagcccaactttcagcaagacaagttcctgggacgctggttctcagctgggctcgcctctaatagctcctggcttagagagaagaaggctgccctctctatgtgcaaaagtgtggtcgcaccagccacggatggaggcctaaatctaacatccacatttctcaggaaaaatcaatgcgagactcggaccatgctgctgcagcccgctggtagcctcggctcatactcgtaccgctctccacgagagtggggccttcaccggcctccaggtccctcactgggagccacactggcaggaacaacactgggccagcccccagccgctgagatacacggagtcggggactggggaagcacctatagcgtttccgttgttgaaacggactacgatcagtacgcgctgctctactcccaaggatcaaaaggtccaggggaggatttccgtatggccaccttatattccaggacgcaaacacccagggccgaactcaaagagaagtttaccgctttttgtaaggcccaggggttcaccgaggacacgatcgtcttcttaccacagacagacaagtgtatgaccgaacaatag

SEQ ID NO: 219092 - DNA, 495 bp, Artificial Sequence
  Description of Artificial Sequence: Synthetic coding sequence
atgcttccgcctggaaccgcaactttgctgaccttgctactagccgctggttctttaggacaaaagcctcagagacctagacgtcccgcaagccctatcagtacaatccagccaaaggccaatttcgatgcccaacagttcgcagggacatggctcttggttgccgtgggcagcgcgtgccggttccttcaagagcagggacacagagctgaggcaacaactctccatgtcgctcctcaggggaccgcaatggccgttagtaccttcaggaaactcgatgggatttgttggcaggtacggcaattgtacggcgacaccggcgtgctgggtagatttttactgcaggcgagagatgcaaggggtgcagtgcatgttgtggtcgctgagacggactaccagagttttgcggttctgtatcttgagagagctggtcagttatctgtgaagctctacggtgcgcagggtgtggtcactgatagacccggagtgggatag

SEQ ID NO: 219093 - DNA, 1680 bp, Artificial Sequence
  Description of Artificial Sequence: Synthetic coding sequence
atgagcgcctgtagaagcttcgctgtcgcgatttgtatactcgagattagcattctgactgcccagtacacaacgtcttacgaccctgaactgaccgaatcttcaggatccgcctctcacatcgactgcaggatgagcccatggagcgagtggtctcagtgtgatccatgcctccgccaaatgttccggtctaggtcaatcgaggtcttcggccagtttaacggaaagagatgcacagatgccgtcggagatcggcgacaatgcgtccctactgagccttgcgaggacgccgaggacgactgcggaaatgacttccagtgtagcacgggacgctgcattaagatgagactgcgctgtaacggggacaacgactgcggggatttctctgatgaagatgattgtgaaagcgagcccagacccccttgtcgagatagagtcgtcgaggagagtgaactggcgagaacagccggttatggcataaacatccttgggatggacccacttagtactccctttgataacgagttttacaatgggctttgtaatcgagacagagatggcaacactcttacttactacagaaggccttggaatgtcgcgagcctcatttacgagactaagggcgagaagaattttagaaccgagcactatgaggagcagattgaggctttcaagtcaatcatacaggagaaaacgtccaactttaatgctgctatctctttaaagttcactccaaccgagactaacaaggccgaacagtgttgcgaggagactgcgtcctccattagtcttcacgggaaaggaagtttcaggttcagttatagcaagaacgaaacttatcagctgttcctgagttactcatcaaagaaggagaaaatgtttctgcatgtgaagggcgagatccacctggggaggtttgtgatgcgcaatcgagatgtggtgcttacaaccaccttcgtggacgatatcaaagctctgcccactacctatgaaaaaggggagtactttgcatttctggagacctatggaacccattactcttcatccggatcactcggtggcctgtacgaactgatctatgttttggacaaggcctccatgaaacggaaaggagttgagctgaaagatataaaacgctgcctgggataccacttagacgtcagtctagccttctccgagattagcgttggtgctgaattcaacaaagatgactgtgtgaagcggggagagggacgagccgtaaacataacctccgagaacctgatagacgacgtggtgtcactgattagaggaggcacgagaaagtatgccttcgaactgaaggagaagttacttagaggcactgtcatcgacgttaccgattttgttaactgggcttcgagtattaatgatgcgccagtcctgatctctcagaaattgtcaccgatctacaatttagtacctgtgaagatgaaaaatgctcacctgaaaaaacagaatctggagcgtgccatcgaagactacatcaacgagttcagcgtgcgcaaatgtcatacatgccaaaatggcggtaccgtcattctcatggatgggaaatgcctgtgcgcatgcccctttaagtttgaggggatagcatgcgagattagtaaacagaagattagtgaaggccttcccgctcttgaatttcctaacgagaaatag

SEQ ID NO: 219094 - DNA, 1770 bp, Artificial Sequence
  Description of Artificial Sequence: Synthetic coding sequence
atgggatcgaatctgtctccgcaactgtgcctcatgcccttcatactgggactactttccggcggagtgactaccacaccgtggtctctcgctcaacctcaaggttcgtgttccctggagggcgtagaaattaagggaggttcttttcgcctgctccaagagggacaggcgctggagtatgtgtgtcccagtggattttatccttaccccgtgcagactcgcacatgtaggagcactggaagttggtcgacactgaagacacaggaccaaaagacagtccgaaaggccgagtgccgggctatacattgcccacgcccacacgacttcgaaaatggcgagtactggcctcgaagtccctattataatgtcagcgatgagatatctttccattgttacgacggctacactctgaggggctccgccaaccgaacctgtcaggtaaatgggagatggagcggacaaactgctatctgtgataatggcgctggctactgttccaatcctggcataccgattggaaccagaaaggttggttctcagtatcggctggaagacagtgtgacttatcactgtagccgcggactcactctgcgcggaagccagcggcgtacctgtcaggaaggcggaagttggagtgggaccgaaccctcctgtcaagactcttttatgtacgataccccacaagaagtcgccgaggccttcttgtctagcctgaccgagactattgaaggcgtagatgcggaggacggacacggccctggcgaacagcagaagagaaagatagtgctagacccgagtggaagcatgaacatctatctcgtgctggacggctctgacagtatcggagcatctaacttcaccggggcaaaaaagtgtctagtgaatctcatagagaaggtggcatcgtacggcgtcaagcccaggtatgggcttgtcacctacgccacttacccgaaaatatgggtaaaggtatcggaggccgacagttcgaatgcagattgggtaaccaagcagttgaatgaaattaattacgaggatcataaactcaaatccggtactaacaccaagaaggcccttcaggcagtgtatagcatgatgtcttggccggacgatgtgcccccagaagggtggaatcgaacgagacacgtgatcatcctgatgaccgatggactgcacaacatgggcggagaccccatcacggttattgatgagattcgcgacttgctctatatcgggaaggatcgtaagaaccccagggaggattatctggatgtctacgtgttcggggtcggcccactggtcaaccaggtgaatattaatgctttggcatcaaagaaagataacgaacagcacgtctttaaggtgaaggatatggaaaacctggaggacgtgttctaccaaatgatcgatgagtctcagagccttagcttatgtggcatggtctgggagcaccgaaagggcacagactatcacaagcagccatggcaggcaaaaatttcagtcattcgcccaagcaaagggcacgagtcatgtatgggcgctgtggtaagtgaatatttcgtgctgacagccgcacattgctttaccgtggacgataaggaacactcgatcaaggtgtctgttggcggtgagaagcgggatctggaaatcgaggtggtgctgtttcaccccaactacaacatcaatggtaaaaaagaagctggaatcccagaattctacgactacgatgtggctcttatcaaactcaagaataaactgaaatatggttag

SEQ ID NO: 219095 - DNA, 1770 bp, Artificial Sequence
  Description of Artificial Sequence: Synthetic coding sequence
atgggatctaacctcagcccccaactttgcctgatgccctttatcctgggcctgttgagcggcggagtaaccacgactccctggtcgcttgcccaaccacaagggagctgctctctcgagggtgtcgaaattaaaggaggctccttccgacttttacaggaaggtcaagcactagagtacgtgtgtccttctggattttacccataccccgtgcagaccagaacatgcagaagtacgggcagctggtctaccctcaaaacacaagatcagaaaaccgtgcggaaggccgaatgccgggcaatccattgccctcgtccacacgacttcgagaacggcgagtattggcctagatcaccttactacaacgtgtccgacgagatcagctttcactgttatgatgggtataccttacggggatcagctaacagaacctgtcaggtcaatggcagatggtctgggcaaacagccatctgcgataatggagcgggttattgttccaacccgggaattcccatcggaacccggaaggtcgggtcacagtacaggctggaagattctgtcacctaccactgcagtaggggcctgaccctccggggatcccaaaggaggacctgccaggaaggagggagctggagtggaaccgaaccgagctgtcaggattcatttatgtacgacaccccccaggaggtagctgaggctttcttaagctctctgacagaaaccatagaaggcgtagatgccgaagatggacacggcccaggagaacagcagaaacggaaaatcgtgttggacccctctggaagcatgaatatttacctcgtattggatggatccgatagcatcggggcatctaattttacgggggctaagaaatgcctggttaacctgatcgagaaagtcgcgtcatatggggtaaagccccgttatggtctggtcacctatgccacatatccgaagatctgggtcaaggtcagcgaggcggactcatccaacgctgactgggtaacgaagcagctgaatgagataaattatgaggatcacaagcttaagtccggcactaataccaagaaggctcttcaagcggtatactccatgatgtcctggcccgacgatgtacctcccgagggttggaacagaacccgtcatgtcatcatccttatgactgatggtttgcacaacatgggcggagacccaatcacagtcatcgatgaaattcgcgaccttttgtatataggcaaggatcgcaaaaatcctcgtgaggattacctggatgtatacgtgtttggagtcggtcctctggttaatcaggtgaatattaatgccctcgcatctaagaaagataacgagcagcacgtttttaaggtgaaagatatggagaacttagaggatgtgttttatcagatgatcgacgagagtcagagcttaagcctctgcggcatggtgtgggagcatcgcaagggaacagattaccacaagcagccatggcaggcaaagatctctgtgatccgtccttctaagggtcatgaatcttgcatgggtgccgtcgtaagcgaatactttgtgcttaccgcagcacattgttttaccgtggacgacaaggagcacagtattaaggtatcagttgggggtgagaaacgcgatctggagatcgaggtggtgctgtttcatcccaactacaacattaacggcaagaaagaagctggtatccccgagttttatgattacgacgttgctctgatcaaactgaagaataagctgaagtatggatag

SEQ ID NO: 219096 - DNA, 2295 bp, Artificial Sequence
  Description of Artificial Sequence: Synthetic coding sequence
atgggtagcaatttatcaccacagttgtgcctgatgcccttcatcctgggcctgctgtcaggcggagttacgacgactccctggtccttggctagaccccaggggtcgtgcagtctggaaggagttgaaatcaagggtggctcatttcggcttttgcaggagggacaggcccttgagtacgtttgtcctagtgggttttatccgtatccagtgcagactcgtacatgtcgctctacaggatcgtggtcaaccctgaagactcaagatcaaaaaacagttcgaaaggccgagtgtagggccatccattgccccagaccgcatgatttcgaaaacggggagtactggcctaggagtccctactataatgttagtgatgagatctccttccattgctacgacggctacacactgcgtggcagcgcgaatcgaacatgccaagtcaacgggagatggagcggccagacagcgatatgtgacaatggagcaggctactgtagcaatcctggaatccctattggtactcgaaaggtgggcagccagtatcggctcgaagattctgtgacatatcattgctcccgcggacttactctccggggttcccagaggaggacctgtcaggaaggaggctcttggtcaggaacggagccatcgtgccaggacagctttatgtatgatacgcctcaggaggtggctgaagctttcctatcttctctgaccgagacaattgagggggttgatgccgaagacggacacgggcctggagagcaacagaaacggaagatagtgctcgacccaagtgggagcatgaacatttatcttgtccttgacggcagcgatagcatcggggctagtaatttcacgggggcaaagaaatgcctcgtgaatctcattgagaaggtggcatcctacggtgtaaagccgaggtatgggctcgtcacctatgccacatatccaaagatctgggtgaaagtatccgaggccgatagctccaacgccgactgggtcaccaaacaactcaacgagatcaactatgaagatcacaagctaaagtccggcacaaacactaaaaaggctctccaggctgtgtatagcatgatgtcttggcccgatgacgtccctcctgaaggatggaatagaacccggcatgtgatcatcttaatgacagacggacttcacaacatgggtggcgaccccattacagtgattgatgaaattcgtgatctgctgtatataggcaaggatagaaagaaccctagagaggattacctggatgtatacgtgttcggggtggggcctctcgtgaatcaggtaaatattaacgctctggcgtctaagaaggacaacgaacaacacgtgttcaaggtaaaggatatggagaatctggaagatgtattctaccagatgattgatgagagtcaaagcctttccctgtgcggtatggtctgggagcaccgcaaaggcacagattatcacaaacagccttggcaggccaagatatccgtgatccgcccttctaaaggccatgaatcttgtatgggagctgtggtttccgagtactttgtgctgacggctgcacactgttttaccgtggatgataaagagcattcgatcaaggtgtccgtgggaggtgagaagagggatttggagattgaggtcgtacttttccaccctaattataatattaacggaaaagaagaggctgggatacctgagttttatgactatgacgttgccctcattaaactcaagaataagcttaagtatgggcagaccatccgcccaatatgtttgccatgcactgaaggtaccacgcgtgccttgcgattaccgcctaccactacctgccagcaacagaaagaagagttgctgcccgctcaggacatcaaggctcttttcgtgagcgaagaggaaaaaaaactgacccgcaaggaggtgtatatcaaaaacggcgacaagaaagggtcatgcgagagagacgctcagtacgctcccggatatgacaaagtaaaagacatttcagaggtcgtaacgcctcggttcctttgcacaggaggtgtctcaccatatgccgatccaaatacctgcagaggtgactctggcggaccactcatagttcacaagcgctctaggttcatccaagtaggcgtgatttcctggggcgtggtggacgtctgtaagaaccaaaaacggcaaaagcaagtgccagctcacgccagggacttccacatcaatttattccaggtactaccctggctgaaagaaaagttacaggatgaggatctgggcttcctttag

SEQ ID NO: 219097 - DNA, 2295 bp, Artificial Sequence
  Description of Artificial Sequence: Synthetic coding sequence
atgggaagcaacctctcaccccaactgtgtttgatgcccttcatactgggcctactttctggcggtgtcaccactaccccatggtccctggcaagaccccagggaagctgtagtctggaaggcgtcgaaatcaaggggggaagtttccgtctgctgcaggagggacaagcgcttgagtacgtgtgccccagtggtttttacccctaccccgtccagaccagaacatgccgctctaccgggtcttggtctaccctgaagactcaagaccagaaaacagtgagaaaggctgaatgccgtgcaatccactgccccaggcctcatgattttgaaaatggcgagtactggccgaggtctccctattataatgtgagcgacgagatatcttttcactgctacgacggatacaccttgcgaggatccgcaaaccgcacctgtcaagtaaatggcaggtggtccggtcagacagctatatgtgacaatggtgctgggtactgttccaaccccggtatcccaattggaacaagaaaggtggggtcacaataccggctagaagacagtgtgacataccactgctcccgcggactgactctgcggggttcccaacggagaacctgtcaagagggcggtagctggagtggaacagaaccgtcctgtcaggattcattcatgtacgacacgcctcaagaggtggctgaggccttcctgagcagcctgacagaaacaatcgaaggtgtggacgctgaagatggacatggtcctggagagcagcagaagagaaaaattgttctggacccctcaggttcaatgaacatttatctggtgctcgatggctctgattcgattggcgcatccaactttacgggagctaaaaagtgcctggttaacttaatcgagaaagtcgcctcatatggcgtcaaaccacgctatggcctggtgacatacgccacttacccaaaaatttgggtgaaggtgagcgaggccgattcttcaaatgccgactgggtaacaaagcagcttaatgagatcaactatgaggaccataagctgaagagcggcacgaacaccaagaaggcactgcaggcggtatattccatgatgtcatggcctgatgacgtgccgccagagggctggaataggactcgccacgtaataatcttgatgaccgatgggctgcacaatatgggaggagaccccatcacggttatcgacgaaataagggatttactttatatcgggaaagataggaaaaatccgagagaagattacctcgacgtgtatgtgttcggagtaggccctctagtaaatcaggttaacatcaatgcattggctagtaaaaaagacaacgagcagcatgtctttaaggtaaaggacatggagaatctggaagacgttttctaccagatgatagacgagagccaatccctcagcctgtgcggcatggtatgggagcacaggaaaggaaccgactatcacaaacagccctggcaagcaaagatatcggtgattcgcccttcgaagggtcacgagagctgtatgggggctgtggtatctgagtactttgtgctaacggccgcacactgtttcacggtggacgacaaagagcacagcatcaaagtgtcagttggcggagagaagagagacctggaaatcgaagtggtgctgttccatccaaactataacataaatgggaaaaaggaagctggcattccggagttctatgactatgatgttgcactgatcaaactgaagaataaacttaagtacggacagacgatcagacccatatgcttgccctgtaccgaggggaccacacgagctctgaggctacctcccactactacatgccaacagcagaaggaggagcttttgcctgcccaggatattaaggcattgttcgtctccgaagaggagaagaagcttaccagaaaagaggtgtatattaaaaacggggacaagaaaggttcttgcgagagagatgcacagtatgcccctgggtacgacaaggtgaaagatatcagtgaagtggttacgcctaggtttctttgcacaggcggagtgtccccctacgcagaccccaatacttgtagaggagacagcgggggtcccctgatcgtccacaaacggagccgttttatccaggtcggcgtgatcagttggggagtggtagacgtctgtaagaaccagaaaagacaaaagcaagtcccagcccacgcccgagacttccacattaacttgttccaggtgttgccttggctgaaggaaaaactacaggatgaggatctgggatttctgtag

SEQ ID NO: 219098 - DNA, 2295 bp, Artificial Sequence
  Description of Artificial Sequence: Synthetic coding sequence
atgggatccaatctctcccctcagctctgcctcatgccttttattttgggcctcctgtccggaggtgtaaccactaccccgtggagcctcgcaaggccccagggttcctgctctctggaaggggtcgaaatcaaaggcggaagctttagactgttacaggagggtcaagctttagagtacgtatgcccgagtgggttttatccataccctgtgcaaacacgcacttgccgctccacgggttcatggtccactttgaagactcaggatcaaaaaaccgtccgaaaggccgaatgccgcgctatccactgcccacggcctcacgatttcgagaacggagaatattggccaagatctccgtattacaacgtgtctgacgaaatttcttttcactgttatgatggatatactctgcggggatcggcgaaccggacatgccaggtcaacgggagatggagtggccagactgcgatttgtgacaacggcgctgggtactgcagcaaccccggtattcccattggaacccgcaaggtaggctctcagtatcgtctggaagatagcgtgacttatcactgctctcgcggtttgacacttcgcggtagccagagacgaacctgccaggaaggaggcagctggtcaggtactgagcccagctgtcaagacagttttatgtacgacactccccaggaagtcgccgaggcatttctgtctagcctcacggagactatcgaaggtgtggatgctgaggacggtcacggccctggagaacaacagaagcgaaagatcgtactcgacccaagcggaagcatgaacatttatcttgtgttagatggctctgactccataggagcgagcaatttcactggagcgaaaaagtgtctcgtgaatctcatcgaaaaagtggcgtcttacggcgtcaagcccaggtacgggttagtgacatacgctacctatccaaaaatttgggtgaaggtcagtgaggcagattcaagcaacgcagactgggtcacgaaacagcttaatgaaatcaattatgaggatcataagctgaagtctggcactaatactaagaaagctctgcaagcagtgtatagcatgatgtcttggcctgacgacgtaccacccgaggggtggaaccggaccaggcacgtcatcatactcatgacagatggcctccacaacatggggggtgaccccattactgtcatcgatgagatcagggatctgttgtacatcgggaaagatagaaaaaaccctcgagaagattacctggatgtgtatgtgttcggggtcggccctctggtgaaccaggtgaacattaatgctctcgcctcaaagaaggacaatgaacagcacgtatttaaagtgaaggatatggaaaatctagaagacgtgttttatcaaatgatcgacgagtctcagagtctctccctttgtgggatggtgtgggagcatcgtaagggtactgattaccacaaacagccctggcaggcaaaaatctctgtgattagaccctctaagggccacgagtcctgtatgggcgcagtggtaagcgaatatttcgtcctgacagccgcacattgcttcaccgtggatgataaagagcattcaataaaagtgtcggtcggcggtgagaagcgcgatctggaaattgaagtagtcttgtttcaccccaactacaacattaacgggaagaaagaggctggtatccctgagttctatgattatgatgttgcccttatcaaactgaaaaataagctcaagtacggccaaacaattcgtcctatatgtcttccctgcaccgagggaacaactcgggctctgcgcctgcccccaacaactacatgccagcaacaaaaggaagaactcctgcccgcacaagacatcaaagcactcttcgttagtgaggaagaaaaaaaactgactaggaaagaggtgtacattaagaatggtgataagaagggctcctgtgagcgcgacgcccagtatgcgcctggttatgataaggtgaaggatatttcagaggtggtgacacccaggttcctgtgtaccggaggtgtttctccttacgcagatcctaacacgtgtcgcggagattcagggggacccctaatcgtccacaaaaggtctcgatttatccaagtcggagtcatatcctggggggtggtcgatgtttgtaagaaccagaaacgtcagaagcaagtgccagcccatgctcgcgactttcacataaatctcttccaggtcctaccatggcttaaggagaaactgcaagatgaggatcttggattcctgtag

SEQ ID NO: 219099 - DNA, 2295 bp, Artificial Sequence
  Description of Artificial Sequence: Synthetic coding sequence
atgggatccaatctatccccccagctctgtttgatgccctttatcctgggtctcctgtccggcggtgttaccaccacaccttggagtcttgcacggccacagggaagttgctccctggaaggggtggagattaaaggtgggagtttccggctcttgcaggaaggtcaggccctcgaatatgtgtgcccgagcggattctatccttatcctgtgcagactagaacttgtcgaagcactggtagctggtcaaccctgaagacccaggatcagaagaccgttaggaaagctgaatgccgcgcaatccattgtcccaggccccatgacttcgaaaatggcgagtactggcctcgttcaccttactataatgttagtgacgagatttcttttcactgttatgatggttacacccttaggggaagcgcaaaccgcacttgccaggtaaacggcaggtggtccggccagaccgcgatttgcgacaacggcgctgggtactgttctaatccaggcattcccatcgggacacgcaaggtaggaagccagtatcgcctggaagatagcgtcacttaccattgcagccgcggtctgaccctcagagggtctcagcgcaggacctgtcaagaggggggatcatggtcgggcactgagccctcttgtcaggacagttttatgtacgatacaccccaggaagtcgctgaggcttttcttagctctttaactgagaccatcgagggagtcgacgcagaggatggacatggccctggcgagcagcagaagcgaaaaatcgtcctggaccccagcggcagtatgaacatctatctggttttggacggctccgactccatcggggctagtaatttcactggcgcaaaaaagtgtttagtcaatctgatcgagaaggtggctagctacggtgttaagccccgatatgggctggttacctatgcgacctaccccaagatttgggtgaaggttagtgaagccgattcttccaacgccgattgggtgacgaagcagctgaatgaaataaattatgaggatcataaactgaagtccggcacaaacacaaagaaagcactccaggcagtgtactcgatgatgagctggcccgacgacgtcccaccggaggggtggaacagaacgaggcacgtgattatcctgatgacagacggccttcacaacatggggggtgacccgattaccgtgatcgacgaaattagagatctcctctatatcggaaaggaccggaaaaatccacgtgaagactatcttgatgtttatgttttcggcgtgggtcccctggtgaatcaagtaaacatcaatgcgctggcgagtaaaaaggacaacgagcagcacgtgtttaaggtgaaggacatggagaacctggaggacgtcttttaccagatgatagacgaatcccaatcactgtcactgtgtggaatggtctgggaacacaggaagggtactgactaccataagcagccatggcaggccaagatctctgtgattcgcccatctaagggccatgagtcctgcatgggagccgtggtctcagagtatttcgtgctcaccgcggcacattgtttcaccgttgatgataaagagcacagcatcaaggtgtctgtgggtggcgaaaagagagacttggagatcgaggtcgtgttatttcaccctaattacaacataaacgggaaagaagaggctggcatccctgagttctacgattacgatgtggccctcatcaaactgaaaaataagttgaaatacggccagacaattcggccaatatgccttccatgcacagagggcactaccagggctctgcggttgccccctaccacaacatgtcagcaacagaaggaggagctgctgccagcacaggacatcaaagccttgttcgtctcagaagaggagaagaagttaacccgcaaggaagtatacattaaaaatggtgacaaaaaaggatcatgtgaaagagacgctcagtacgctcccggatatgataaagtgaaggatatatctgaggtcgtgacacccaggtttctgtgcaccggaggtgtctcaccctatgccgaccctaacacctgtcggggagacagtggcggaccactcatcgttcacaagcggtctcgcttcattcaggtgggcgtcatcagttggggggtggttgatgtatgcaaaaatcaaaagcgtcagaagcaggtcccagcacacgctcgagatttccacatcaatctgttccaggtactgccctggcttaaggaaaaactgcaggatgaggatctgggatttctttag

SEQ ID NO: 219100 - DNA, 2295 bp, Artificial Sequence
  Description of Artificial Sequence: Synthetic coding sequence
atgggctccaatctgagcccacagttatgcctgatgcccttcattctgggcctcctttcaggaggcgtgactaccactccatggtcgctggcacggcctcaagggtcttgctcgctggaaggggtcgagatcaagggaggctcatttagactcctacaggaaggacaggctctggagtatgtctgtccatccggtttttatccgtaccccgttcaaacccgaacctgcagatccacaggttcctggagcacactaaaaacccaggaccagaagactgtccgcaaggctgagtgtcgggctatccactgccctaggcctcatgatttcgagaatggtgaatattggccacgatccccatactataatgtgtctgatgaaatttcgttccactgctatgacggctacacactgcgcggttcggccaaccggacttgtcaagtgaatggccgatggtccggacaaactgcgatctgtgacaatggggctggctactgctcaaacccaggaatccccataggcacccgcaaagtgggctcccagtaccgcttggaggatagtgtgacttatcattgctcgaggggcttaacactccggggttctcagagaaggacctgtcaagaaggcggatcatggtcaggaaccgaaccttcctgtcaagactcattcatgtatgacactcctcaggaggtagcggaggcgtttctctcctctctaactgagaccattgagggcgtcgacgctgaggatgggcatggccctggtgagcagcagaagcggaagatcgttctagacccaagtggctctatgaatatttatctggtgctggatgggtccgactcaattggagcgagtaatttcacaggggcaaaaaaatgcttggtcaacttgattgagaaagtagcttcttacggtgtgaagccgcgatacgggcttgtaacttacgcaacttatcctaagatctgggttaaggtttctgaagccgactcctccaacgcagactgggttaccaaacagcttaatgagattaattacgaagaccacaaactcaaatctgggaccaataccaagaaagccctacaggctgtgtacagtatgatgagctggcctgacgacgtccctcccgaagggtggaaccgtacccgccatgtgatcatcctgatgaccgacgggcttcacaacatgggtggggatcctatcactgttattgatgagattcgggaccttctgtatatcgggaaagacagaaagaaccccagggaagactatctggacgtgtacgtatttggggtgggcccacttgttaatcaagtgaatattaatgccttggccagcaagaaagataacgaacagcacgttttcaaggttaaggatatggaaaacttagaagatgtgttttatcaaatgatcgatgaaagccagtctttatcactgtgtgggatggtgtgggagcatcgcaaaggcactgattatcataagcagccttggcaggcaaagatctctgttatccgcccatcaaaagggcatgagagttgcatgggggctgtggtatcagagtatttcgttctgactgccgctcattgctttacggttgacgataaggaacattctatcaaggttagtgttggcggagaaaaacgggacctcgagatagaggttgtccttttccaccctaactataacatcaacggcaagaaagaagcaggaatccccgagttttacgattacgacgttgcgcttataaaattaaagaataaactgaagtacgggcaaactatccgcccaatttgccttccgtgcaccgagggcaccaccagagctctccgactgccgccaacgactacctgtcagcagcagaaagaggagctactcccagcgcaggatatcaaggccctcttcgtgtcggaagaggagaagaaactaacgcggaaagaggtgtacataaagaatggtgataagaaagggtcctgtgagagagatgcgcaatatgctccaggctatgacaaggtcaaagacattagcgaggtcgtgaccccgagattcctgtgcactgggggtgtctccccgtatgctgatcctaatacctgcaggggggattctggcggtccgctgatcgtgcataagcgaagtcgttttatccaggtcggcgtgatctcctggggggtggttgacgtctgtaagaaccagaagcgccaaaagcaagtgcctgctcacgctcgcgatttccatattaacttgtttcaggtgctcccatggctgaaagagaagctgcaggatgaggatctcggcttcctttag

SEQ ID NO: 219101 - DNA, 2295 bp, Artificial Sequence
  Description of Artificial Sequence: Synthetic coding sequence
atgggtagcaacctcagtccccagctatgccttatgccatttatactgggactgctttctggaggggtcaccactactccctggagccttgcacgccctcagggcagctgtagcctcgaaggtgtggaaatcaaaggaggctcttttcggctactgcaggagggacaggcactcgaatatgtttgcccgtcgggattctatccttatccggtgcaaacccgtacgtgccggagcacaggctcctggagtacactcaagacgcaggaccagaagaccgttcgcaaggccgaatgccgcgctatccattgccctaggcctcacgattttgagaacggagagtattggccgcgtagcccatactacaatgtctccgacgaaatcagcttccattgctacgatgggtacactttaaggggcagcgcgaacaggacttgtcaggtcaacggtaggtggtcaggacaaacagctatctgcgataacggtgctgggtactgcagcaatccaggcattccaatcggaacgcgaaaagtggggtcccagtacagattagaggatagcgtcacttaccactgtagcagggggctgaccttgcgtggttcccagcgtagaacttgccaggaggggggtagttggtcaggaaccgagccatcgtgccaggacagcttcatgtatgatacccctcaggaggtcgctgaagcttttcttagctcactgaccgaaaccatagaaggggtggacgcagaagacggtcacggccctggcgagcaacagaagcgtaaaattgtgcttgaccctagcggctccatgaacatttaccttgtacttgatggttcggactcaattggtgcatccaacttcactggcgcaaagaagtgtctagtgaaccttattgagaaagtggcgagttacggggtcaagcccaggtacggcttggtgacgtacgcaacctatcccaagatttgggtgaaagtttcagaggcggacagttccaatgcggactgggtgaccaagcagctcaacgaaattaattatgaggaccacaaactcaaaagtggcacaaacacaaagaaagctcttcaggccgtttactcaatgatgtcctggcccgacgatgttcctcccgagggttggaatcggactaggcacgtgatcatcttgatgaccgacggccttcataacatgggaggtgatcccatcacagtgattgatgagattcgggaccttctctatattggcaaggatagaaagaaccccagggaggactaccttgacgtgtatgtctttggagtaggacccctggttaaccaggtgaacattaatgctctggcctccaaaaaggacaacgagcaacacgtcttcaaggtgaaggacatggaaaatctggaggacgtgttctatcagatgattgatgaatctcagtccctgtccctgtgtggtatggtttgggagcatcgaaaaggcacggattaccataagcagccctggcaggcaaaaatctcggtaattcggccttctaaaggccatgagtcttgcatgggtgccgtcgtcagcgagtacttcgttctcacggccgctcattgctttacagtagatgataaggagcacagcatcaaggtctcagtcggtggcgaaaagagagatctggagattgaggtggttctattccatccgaactataacatcaacggtaagaaagaagcgggaattcccgaattttatgactacgatgtggcactgatcaaattaaagaacaaactcaaatacggccaaacaatacggcctatctgtttgccttgtaccgaaggcacaaccagagctctaagactgcctcctacaactacttgtcagcagcagaaagaggagctactgcctgcacaggacattaaagcactgttcgtgtccgaggaggaaaagaaactgacaaggaaagaggtatatatcaagaatggggataagaaagggtcctgcgaacgagacgcacagtacgcaccaggttacgataaagtaaaagacatctcggaggttgtaacacctagattcctgtgtacggggggagtcagtccgtatgcagatcctaacacctgcagaggggacagtggcggacctcttattgtgcataagcgcagtcgctttattcaggttggcgtgatcagctggggagtggtggacgtatgcaagaatcaaaaaagacaaaagcaggtacccgctcacgctcgagacttccacatcaatttgttccaggttcttccttggttaaaagaaaaactccaggatgaggatcttggattcttgtag

SEQ ID NO: 219102 - DNA, 2295 bp, Artificial Sequence
  Description of Artificial Sequence: Synthetic coding sequence
atgggatctaacctcagcccacagttatgtctgatgcccttcattctgggcctgctcagtgggggagtgaccacaaccccctggtccctggccagaccccagggctcttgttccctcgagggggttgaaattaagggtggctccttccggctcctacaggaaggacaggccctggaatatgtctgtccaagcggtttttacccgtacccagtgcagacccgcacatgcagaagcacaggaagctggtccacactgaagactcaggaccagaaaaccgtaaggaaggccgagtgccgcgcaatccattgcccccgaccccatgatttcgagaacggcgagtactggcctaggtccccctattacaatgtcagtgacgaaatttcattccactgttatgacgggtacaccctcaggggatccgccaaccggacctgtcaggttaatggcagatggagtggacagaccgcaatttgtgacaacggcgcagggtactgttccaatccaggaattccaatagggactcgcaaggtaggctcccagtatcgacttgaggatagtgtaacataccactgcagtcgcggactgaccttacgcggaagccaaagacgcacttgccaggaagggggatcatggagcgggactgagccaagctgtcaggactcattcatgtacgacacgccacaggaggtggcggaggcctttttaagctctttaacagagactatcgagggtgtcgacgccgaggacggacacgggccaggcgagcagcagaagaggaagatcgtcctcgatccctccggcagcatgaatatctacttggtcctggatggctcggatagcataggggcaagtaatttcaccggcgcaaaaaagtgcctggtgaacctgatcgagaaggttgcgtcgtatggggtgaagccccgttacggccttgtaacgtacgctacctaccctaagatttgggtcaaagtttcagaagcagattcctcgaatgctgattgggttacaaagcagttgaacgaaataaactatgaagaccataaactgaaaagtggaacaaacactaagaaggctctccaggctgtttactctatgatgtcctggcctgatgacgtgccccctgagggttggaatcggacgaggcatgtgatcattctgatgacagacggactgcataacatggggggtgacccaatcacagtcatcgacgaaattcgcgacctgctatacatcggcaaagaccgcaagaatccccgtgaggactatttggacgtctatgtgtttggcgtgggccctctggtgaaccaggtaaatatcaacgcgcttgcttccaagaaagataacgagcagcatgtgttcaaggttaaggacatggagaatctcgaggacgtcttttatcagatgattgacgaatctcagtcactctccctgtgcggcatggtgtgggagcacaggaagggtacagattatcacaagcagccatggcaggccaagatctcggtgattcgcccatcgaaagggcatgagtcctgcatgggcgctgtggtctccgaatactttgtgcttaccgccgcacactgctttactgtggacgataaggagcatagcatcaaagtttccgtgggcggagagaaacgagaccttgaaattgaagtggtcctgtttcaccccaactataatattaacggaaagaaggaggccggtattcctgaattttacgactacgatgtagcactgataaagttgaagaacaaactcaaatacgggcagacaataagacccatatgtctcccttgtactgaaggcaccacacgggctctgaggctgccccctactactacgtgccagcagcagaaagaagagttgctaccagctcaagatattaaggcactgtttgtctctgaggaggagaagaagctcactaggaaagaggtgtatattaagaacggggacaagaaaggcagctgtgagagggacgctcaatacgcccctggctatgataaagtaaaggacatctccgaggtggtcacccccaggttcttgtgcaccggcggagtctccccatacgctgaccccaatacttgtcggggtgatagcgggggtcccttaatcgttcacaaacgttctagattcatccaggtgggcgtcatctcctggggcgtggtggatgtctgcaagaaccaaaaacgccagaaacaggtacctgcgcacgcaagggactttcatatcaatctcttccaggtactcccttggctgaaagaaaagctgcaggatgaggacctgggtttcttgtag

SEQ ID NO: 219103 - DNA, 2295 bp, Artificial Sequence
  Description of Artificial Sequence: Synthetic coding sequence
atgggatctaatctgtcccctcagctgtgcttaatgcctttcatcctgggcctgctgtccggaggagtgacgactacaccatggagtcttgccagaccacagggatcctgcagcctagagggagttgagataaaggggggatcttttagacttttacaagaaggccaggctcttgagtatgtatgccctagcgggttctacccataccctgtgcagacgaggacatgcaggtccacaggaagctggtctacactgaaaacccaggaccagaagacagtgcgcaaagccgagtgccgagccatccactgcccgaggccccacgactttgagaatggtgagtactggccacgttccccatattacaacgtgagcgacgaaatctcttttcactgttatgatggctacaccctgaggggcagtgccaataggacatgccaggtgaacggtagatggtcaggccagactgcaatttgtgacaatggagccggttactgctctaaccctggcatcccaattgggacaaggaaagtgggctcccagtatcggttggaagattccgtgacatatcactgttccagggggctgactctccgtgggagccagcgtagaacatgtcaggaaggcggatcatggtccggtaccgagccgagctgccaagactcttttatgtacgacaccccacaggaagtggccgaagcatttctgagttctctcactgagactatcgagggcgtcgacgcggaggatggccatggccctggagaacagcaaaagagaaaaatcgtgttagatccatctgggagcatgaacatttaccttgtcctggacgggagtgattctatcggtgcttccaacttcaccggagccaagaagtgcctcgtgaatttgatcgaaaaagttgcctcttacggagtgaaaccgaggtatgggctggtgacatacgccacctacccaaaaatttgggtaaaggttagtgaggccgattccagtaacgctgattgggtgactaagcagctcaatgaaatcaactatgaagatcataaactcaagagcggtactaacaccaagaaagccctgcaggccgtgtactctatgatgtcctggcccgacgacgtcccacccgaaggttggaatcgcacgaggcacgtgatcatcctgatgactgacgggcttcataatatggggggagaccccatcacagtaattgatgagattagagatctgctttatatcggcaaggaccggaagaacccacgtgaagattacttggacgtgtatgtttttggtgttggtcccctggtaaaccaggtgaacattaacgcattggccagcaaaaaggacaacgaacaacatgtctttaaagtgaaagacatggagaacctcgaggatgtgttctaccagatgattgacgaaagtcagagcttatctctgtgtggcatggtgtgggaacatagaaaggggacagattaccataagcagccgtggcaggcaaagatctccgtgatccgtccttccaaaggccatgaatcatgcatgggcgctgtggtctctgaatacttcgtattgacggctgcacactgcttcaccgtggatgacaaggagcatagcataaaggtgagtgtgggcggtgaaaaaagagacctggaaatcgaggtggtgctgtttcaccctaactacaacattaatgggaaaaaggaagctggaattcccgaattctacgactatgatgtagccctgattaagttgaagaacaagctgaagtacggacagactatccgccctatatgccttccttgtacagaggggacaacgagagccctgcgtctcccgcctaccaccacgtgtcagcagcagaaggaagaacttctccccgcacaggatattaaagcgctcttcgtgagcgaggaggagaagaaactaacccggaaagaggtatacattaagaatggagataaaaagggctcatgtgagagggatgcacagtatgcccctgggtacgacaaagttaaggacatctctgaagttgtgaccccccgattcctctgtactggaggagtgtccccttacgctgaccctaatacatgtagaggtgacagcggcggtcctctgatcgtccataaacgcagcaggtttattcaggtcggtgtgatatcttggggcgtggtggatgtatgcaaaaaccaaaagagacagaagcaggtccccgctcacgccagagattttcacatcaatctgtttcaggtcctgccttggttgaaagagaagctgcaggatgaggatctgggattcttgtag

SEQ ID NO: 219104 - DNA, 2295 bp, Artificial Sequence
  Description of Artificial Sequence: Synthetic coding sequence
atggggtctaacctctcccctcaattgtgcttgatgcctttcatcttggggctgctctcaggtggcgtgactaccacaccatggtctctggcaagaccacagggcagttgtagtctggagggcgtggaaattaagggaggtagctttaggttactgcaggagggacaagcccttgagtacgtgtgtccatcggggttttatccataccctgtccagacaagaacttgtcgtagcactggctcttggtctacgctgaagacccaggaccagaagaccgtgcggaaagccgaatgcagggccatccattgtccaagaccacatgactttgagaatggggaatactggccacgttccccctattacaacgtgtcagacgagattagctttcactgttacgacgggtacaccctgaggggatccgctaacaggacctgtcaagtgaacggcagatggtcaggccagaccgctatttgcgacaatggggctgggtactgttccaaccctggaattcctatcggcacccgcaaagtgggatcacagtatagattagaggacagtgttacttatcactgttcccgcggactgacattaaggggtagccagcgtcggacatgtcaggaggggggatcatggagcggcacggaaccttcgtgccaggactcattcatgtacgatacaccccaggaggtcgcggaggcctttctgagttctctaaccgagacgatcgaaggcgtcgatgccgaagatggacatggcccaggtgaacaacagaagcggaaaatcgtgctcgatccctcagggtccatgaacatttaccttgtgcttgatggaagtgactccatcggagcctcgaacttcacaggagccaagaaatgtctcgtgaacttgatcgaaaaggttgcctcttacggcgtgaaacccaggtacggtctggtcacttatgccacttatccaaaaatctgggtgaaggtcagtgaagcagacagtagcaatgctgattgggtgactaagcagctgaacgaaatcaactatgaggaccataagctaaaatccggcacaaacactaagaaagctttgcaggccgtctactctatgatgtcctggcccgatgacgtacctcctgagggttggaatcgaaccagacacgttatcatcctcatgaccgatggtctccataatatgggaggggaccctatcaccgtaatcgacgagattcgggatctgttatacattggcaaagacaggaagaatccacgagaagactacctcgatgtatacgtgttcggtgtcggcccactggtgaatcaggttaacattaatgctcttgcttctaaaaaggacaacgagcagcatgtcttcaaggtgaaggacatggagaatctagaagatgtgttctaccagatgatcgatgaatctcagtctctgtctctctgcggcatggtctgggagcaccgaaagggcacagattaccataaacaaccctggcaggctaagatttcggtcatccgtccttccaagggccacgaaagctgtatgggggctgtggtctctgagtattttgttcttacggccgctcactgcttcactgtcgacgataaagagcacagcattaaggtcagtgtcgggggagagaaacgcgacctcgaaatcgaagtcgtgctgtttcatccgaactataacatcaatggcaaaaaagaagcgggaattccagagttttacgattacgacgtggcattgatcaaattaaagaacaagctgaaatacggtcagactattagacccatttgtctgccttgcacagagggaacgactagagccctgagactgccaccaaccactacttgtcaacaacagaaagaggagctcctccctgctcaggatatcaaggctctcttcgtcagcgaagaagagaaaaagctaactcgtaaggaggtgtacatcaagaacggagacaaaaagggaagctgtgagcgtgacgctcagtacgccccaggctacgataaagtcaaagatatctccgaagtggtcactcccaggttcctttgtactggaggcgtgagtccatacgcagacccgaatacctgtcggggtgactccggtggcccactgatcgtccacaagcggagtcgattcattcaggtcggcgtgatcagctggggtgttgtggacgtgtgtaagaatcagaagcggcagaaacaagtaccagcacatgcacgcgattttcacatcaatctattccaggtcctcccctggctgaaagaaaaactccaggacgaggacctgggctttttatag

SEQ ID NO: 219105 - DNA, 2295 bp, Artificial Sequence
  Description of Artificial Sequence: Synthetic coding sequence
atgggttcaaatctgagtccccagctgtgcttaatgccattcatcctaggtcttctctctgggggagtcactactactccatggtcactggcacgtccccagggatcttgctcactcgaaggggtcgaaataaagggcggttcctttcggctgctgcaagagggtcaggccctggaatacgtctgtccatccggattttatccatatcccgtgcagaccaggacatgcaggtcaacagggagttggagcaccctgaaaacccaggaccagaagaccgtgagaaaggctgaatgtcgggctatacactgcccaaggccacatgatttcgagaatggtgaatactggcccaggtcaccttactataacgtgtccgatgaaatttcctttcactgttacgatggctacaccctgaggggctctgcaaaccggacatgccaggttaacggaagatggtcagggcaaacagccatatgcgacaacggagcagggtattgcagcaatccgggtatcccaatcgggacacgcaaggtgggaagccaataccgcctggaagactccgttacataccactgcagtcggggactgaccctgagagggagccaaaggaggacgtgccaggagggcggaagttggtcaggcactgaaccttcatgccaggattcatttatgtatgatactccgcaagaagtggcagaagccttcctctcgtcccttactgaaaccatagagggggtggacgctgaggacggccacggccctggcgagcaacagaagcggaagattgtgctagacccctccggaagcatgaacatttatttggttttagatggaagcgacagcatcggcgctagtaacttcactggcgctaagaagtgtctggtgaacctgatcgagaaagtcgcaagctacggcgtgaaacctagatatgggctggtgacctatgctacttatccaaaaatctgggtgaaggtcagtgaagcggactcatcgaatgctgactgggtaactaaacagctgaatgagatcaattacgaagatcataaactaaaaagcgggacgaatacaaagaaagctttgcaagccgtttacagcatgatgtcttggcctgacgatgttcctccagagggctggaataggacacggcatgttattatcctgatgacggacggccttcataatatgggaggagaccctattacagtgatcgatgagatcagggacctgctctatataggtaaggacagaaagaatccacgcgaggactacttggacgtgtacgttttcggtgtcggccctctggtgaaccaggtgaatattaatgcgttggccagcaagaaagacaacgaacagcacgttttcaaggtcaaggatatggaaaacctcgaggatgtgttctatcaaatgattgacgagtcacaatcactttctttgtgtggcatggtctgggagcacagaaaagggaccgactaccataagcagccctggcaggctaaaatatctgtgatacggccttccaaggggcatgaaagctgtatgggagccgtcgtgtctgagtacttcgtcctgaccgctgcacattgtttcaccgttgacgataaagagcattctattaaagtttcagtaggaggggagaaaagggatctcgagattgaagtggtgctgttccatccaaactacaacattaacggcaaaaaagaggccggaataccagagttttatgattacgatgttgcgctaatcaagctgaagaacaaactcaaatatggtcagactattagaccaatttgccttccttgtaccgaaggaactaccagggcgctgagactaccaccgaccacaacctgtcagcagcagaaggaagagctactacctgcccaagatatcaaagcactgttcgtgtcagaggaagaaaaaaagctgacgcgaaaagaggtgtacatcaagaatggggataagaagggctcatgtgaacgggatgctcagtatgctccaggctatgacaaggtcaaggacattagcgaggtagtgacaccaaggttcctgtgcaccggaggcgtatccccctatgcagacccaaatacatgcaggggcgacagtggaggccctctaatcgtgcacaagcgatcaagatttatacaggtaggcgtaatctcttggggagtggtcgatgtttgtaaaaaccagaagcgtcaaaaacaggttcccgctcacgcccgtgactttcatattaacctgttccaggttttaccctggttgaaagagaagttgcaagacgaggatttaggttttttatag

SEQ ID NO: 219106 - DNA, 2295 bp, Artificial Sequence
  Description of Artificial Sequence: Synthetic coding sequence
atgggctctaacctctccccacaactgtgcctgatgcccttcattctcgggctgttgagtggcggagtcaccactactccgtggtcccttgcaaggccccagggtagctgctctctggagggtgttgaaatcaagggcggatcctttcggctcctccaggagggtcaggcactagaatatgtgtgtcccagtggattctacccgtacccggtgcaaacacggacatgtcgctctaccgggtcttggtctacccttaagacacaggaccagaaaaccgtcaggaaagcagaatgcagggcaattcattgccccaggcctcacgacttcgaaaatggagagtactggcctcggtccccttactataatgtctccgatgagatctctttccattgttacgacggctacacactgcggggaagcgcaaacaggacatgccaggtgaacggacgctggtccggccagactgctatttgcgataatggggctggctactgttctaaccccggtatacccattggaactcgaaaggtggggtctcagtatagactcgaggactccgtcacatatcactgtagccgagggctgaccctacggggttcacagcggaggacctgtcaggagggcggatcctggagcggcacagaaccatcttgtcaggattcttttatgtatgacacgcctcaggaagtcgcagaggctttcctttcaagcctgacggaaactattgagggggtggatgccgaagacggtcacgggcctggagagcagcaaaagaggaagatcgttctggatcctagcggatcgatgaatatctatctggtgctagacggttccgactctatcggggcatccaatttcacaggcgctaagaagtgtctggtgaacttaattgagaaggtggcatcttacggcgtgaagcctcgttatggtctggtcacttacgctacctatcctaaaatttgggtgaaagtcagtgaggccgattcaagcaatgcagactgggttaccaagcagctaaacgaaatcaattacgaggaccacaagctgaaatctggcaccaacactaagaaggccttgcaggctgtgtacagcatgatgtcctggcccgatgatgtgccacccgagggttggaatcgcacccggcacgttatcatccttatgaccgatggacttcataacatgggaggcgatccaatcaccgtgatcgatgaaatacgggacctgttgtacattggcaaggataggaagaacccacgagaggactatttggacgtgtacgtattcggtgtggggccactcgtaaaccaagttaacattaatgcactggccagcaagaaggataatgagcagcatgtctttaaagtgaaggacatggagaaccttgaggacgtgttctaccagatgatagacgagtcacaaagtctgagcctgtgcggaatggtgtgggagcatagaaaggggactgactatcataagcagccatggcaggcgaaaatcagtgtcatacgcccttcaaaaggccatgaaagttgtatgggggcagttgtcagcgagtacttcgtgctcaccgcagcgcattgttttactgtggacgacaaggagcacagtattaaggtgtcggtgggaggagaaaagagagatctggaaattgaagtggtattgttccacccaaactataacattaacgggaagaaagaagccggaattcccgaattctacgactacgatgtcgccttgatcaaactgaagaataaattgaagtacggccagacaataaggcccatatgtttgccctgtactgaaggcacaactagggcactgaggcttccacccacaacaacgtgccagcagcaaaaggaagagctgttgcccgctcaggatatcaaggccctctttgtgtccgaagaagagaaaaagctgaccagaaaggaggtgtacatcaagaatggcgataagaagggttcctgtgaacgtgacgcccaatacgccccagggtacgacaaagtgaaggacatttctgaggtcgttacaccccgatttctttgcaccggcggagtttcaccatacgcagaccccaatacctgtaggggcgattctgggggtccactcatagtccataaaagaagccgcttcatacaagtcggggtcatatcttggggggtcgtggacgtttgcaagaatcagaagcggcagaagcaagtgcccgcacacgcgagagactttcacatcaatctcttccaggtgctgccgtggctgaaggaaaagctccaggacgaagatttgggctttttgtag

SEQ ID NO: 219107 - DNA, 435 bp, Artificial Sequence
  Description of Artificial Sequence: Synthetic coding sequence
atggggtcaaacttgtcaccacagctgtgtctgatgcccttcatattggggctgctctccggaggcgtcacaacgacgccctggtccctggcgagaccacagggctcttgttccctcgagggtgttgagattaagggaggcagtttcaggttgcttcaagagggacaggccctggagtatgtgtgcccatccggcttttacccctacccggtgcagacacgtacctgccggtctaccggcagctggtccacgctcaaaactcaggatcagaagacggttagaaaggccgaatgcagagccatacactgtccaaggccacacgacttcgaaaacggagagtactggccacgttctccctattacaatgtgtccgacgagatctccttccactgctatgatggctacacactcagaggcagcgctaatcgtacctag

SEQ ID NO: 219108 - DNA, 3801 bp, Artificial Sequence
  Description of Artificial Sequence: Synthetic coding sequence
atgggaccattgatggtgctgttttgcttgctgttcctttaccccggtctcgcagattccgcaccctcttgccctcaaaatgtcaatatttcaggcggtaccttcacgctcagtcacggctgggcacccggaagtcttctgacttattcgtgtccccagggcctgtacccctccccagccagcaggctctgcaagtcgtccggtcaatggcagactccaggtgccaccaggagcctgtctaaagctgtctgtaagccaggtcattgccccaaccctgggatttctctcggagccgtccggacaggcttcaggtttggtcatggcgacaaagtccgatataggtgctcctccaacctggtgctgacgggctcatccgagcgggagtgccagggcaacggagtgtggagcggaacagagccaatctgcaggcagccatactcgtacgatttccccgaggacgtcgcaccagccttaggcaccagctttagccatatgctgggtgccaccaacccaacgcagaaaaccaaagatcatgaaaatgggaccggaactaatacctatgccgcactcaattccgtgtacctgatgatgaacaatcagatgcggctactgggcatggagacaatggcctggcaggagattcggcacgccataatcttgcttactgacggcaaatctaatatgggaggttctcctaagacggctgtagatcacatccgagagatactgaacatcaaccagaaacggaatgattatctcgacatctacgccatcggggtgggtaaactcgatgtggactggcgtgaattaaatgagctaggatcgaagaaagacggcgagcggcatgctttcatcctgcaggacacaaaggcccttcaccaggtgtttgaacacatgctggacgtgagcaaactaactgataccatatgcggagtaggcaacatgtcagcaaacgcaagtgaccaggaaagaactccatggcatgtcactattaagcccaagtcccaggaaacgtgtagaggggcactcatatctgatcagtgggtgcttacggctgcccactgttttagggatggcaatgaccactccctttggcgcgtgaacgtcggcgatcccaaaagccagtggggcaaggagtttttgatcgagaaggcagtcatctctcccggttttgatgtctttgccaagaagaaccagggcatccttgaattctatggtgatgatattgcccttctcaaactagcgcaaaaagttaagatgagtactcatgctaggcccatctgtttaccatgtacgatggaggccaatctcgccctccggcgtcctcagggatccacctgcagggatcacgaaaacgagcttctcaataagcagagcgtgccggctcactttgtagccttgaatgggagtaagcttaacatcaatctgaagatgggagtcgagtggacttcttgtgccgaggttgtctctcaggaaaaaacaatgtttccaaatttgaccgacgtgagggaagtggtgacggaccagttcctctgcagcgggactcaggaggacgagagcccttgtaaaggggtaaccacaacaccgtggagtcttgctaggccccagggatcatgtagtctcgaaggggtagaaatcaagggagggagttttcgactcctccaggagggacaggcgcttgaatacgtctgtccgagtggcttctacccctacccagtccaaacaagaacctgccgctctactgggtcctggtccactttgaagacccaggaccagaagaccgtccgtaaggctgagtgccgggctatccactgccctcgaccccacgacttcgagaacggtgagtattggcccaggtccccatactacaacgtgtccgatgagattagcttccactgttatgatggatacacgctgagaggatctgctaaccgcacctgccaagtgaatggtagatggagcggccagactgccatatgtgacaacggtgcaggctactgcagtaacccaggcattccaatcggcactagaaaagtgggcagccaatatcgcctcgaggacagcgttacctaccactgttcacggggtttgacattaaggggcagccagaggcgcacatgtcaggaaggaggatcgtggagcggaacagagccctcatgtcaggactcatttatgtatgacactccgcaagaagtagctgaagcgttcttgtcttcactcactgaaactattgaaggcgtggatgccgaggatggacacgggccaggagagcaacagaaaaggaagatcgtgttggacccctccggaagtatgaatatctacttagtactcgacggttccgactccatcggagcctctaacttcaccggcgcaaagaagtgtctcgtaaatctgatcgagaaggtcgcctcctatggagtgaagccgagatacggattggtcacatacgcaacttacccaaagatttgggtgaaagtgtctgaggcagactcctctaacgcagattgggtcaccaaacaacttaacgaaataaactacgaagaccacaagttaaagagcggaacaaacacgaagaaggcccttcaggcagtgtattctatgatgagctggcctgacgatgtgccacctgagggatggaatcggacaagacatgtgattatcctgatgactgacgggctgcacaatatgggaggcgatccaattaccgtaatcgatgagatcagggatttattgtacatcggcaaagatagaaagaatccaagggaggattatctggacgtatacgtgttcggggtgggccctctcgtcaaccaggtaaatattaatgctctggcctctaaaaaagacaatgaacagcatgtgttcaaggtcaaggatatggaaaacttggaagatgtgttctatcaaatgatagacgagtcccagtccctgtctctgtgcggcatggtttgggaacatcgcaagggtactgactaccacaagcaaccttggcaagccaaaattagcgtcattcgacctagcaagggacacgagagctgtatgggagccgtcgtgagcgagtacttcgtgctaacagcggcacattgtttcacagtggatgataaagagcacagcataaaggttagcgttggaggcgaaaaacgtgaccttgagatcgaagtcgtcctctttcatcctaattacaacataaacggcaaaaaggaggcaggtatccccgaattctatgactacgatgttgctctgattaagctgaagaataagttgaaatatgggcagaccattcgccctatatgtcttccatgcactgagggcaccactagggcactgcgactgccccctaccaccacttgccaacagcagaaggaagaattactcccagctcaggacattaaagccctctttgtatctgaggaagagaaaaaactgacacgtaaggaggtctacatcaagaacggcgacaagaagggctcttgtgaacgggatgcacagtacgcacctggatatgacaaagtcaaggacatcagcgaagtggtcacccctagatttctgtgtaccggtggagtgtcaccatatgcagatcccaatacttgtagaggggactcaggcggacctttaatcgtccacaaacgcagtcggttcatccaagtgggcgtcatttcttggggcgtcgtggatgtgtgcaagaatcagaagagacaaaaacaagtccctgcccatgccagagacttccatatcaatctatttcaggtgttgccttggcttaaggaaaagttacaggacgaggacctggggtttctctag

SEQ ID NO: 219109 - DNA, 3801 bp, Artificial Sequence
  Description of Artificial Sequence: Synthetic coding sequence
atgggcccactgatggtcctcttctgcttgctgttcctctatcctggcctggccgacagcgcacctagctgccctcagaatgtaaatatctctgggggtaccttcacgctctcccacggctgggcccctgggtccctgcttacttactcttgccctcagggtctgtacccatctcccgctagcagactgtgcaagtccagcggacagtggcagacccctggcgcaacccgaagcctgtcaaaagctgtgtgtaaacccggtcattgtcctaaccccggtatctctctgggcgctgtgaggacaggcttcaggttcggacacggtgacaaggttcgctacagatgttccagtaatttggtgctcactggctcgagtgaaagagaatgccaagggaatggtgtgtggtcagggacggaacccatctgtcgccaaccttacagctacgatttcccagaggacgtcgcaccggcactcgggacatctttctcccacatgcttggcgcaacaaatcctacacagaagactaaggaccacgagaatggcaccgggaccaacacttatgccgcactgaattccgtttatcttatgatgaataaccagatgagacttctgggcatggaaaccatggcgtggcaggagatacgtcacgccattattctgctgactgacgggaaatctaacatggggggttcacctaagacagccgtggaccacataagagaaatccttaacatcaatcagaaaagaaacgactacctggatatctacgccatcggagtcggaaaactcgacgttgactggcgagagctgaacgaactcggcagtaagaaggatggggaaagacacgcgttcatactccaagacactaaggccctacaccaagtttttgagcatatgctggacgtctccaagctgaccgacactatttgtggagtgggtaacatgagcgcgaacgcctctgaccaggagcgaacaccctggcatgtgactataaaacctaaaagtcaagaaacatgcagaggggctctcatttcggatcagtgggttttaacagccgctcactgcttccgcgatgggaatgatcactccttatggagggtgaacgtgggtgatcccaaatctcaatggggaaaggagttcctcatcgagaaagcggtaatcagccctggattcgatgtgttcgccaagaagaatcagggcattctggagttttacggggacgatatcgcgctcctgaagctcgctcagaaagttaaaatgtcaactcatgccaggccgatctgcctcccttgtactatggaggccaatctggctctgcgtaggcctcaggggagcacttgccgggaccatgagaatgaactcctgaacaagcagtctgtgcccgcacatttcgtcgccctcaatgggagcaaactgaacattaacttgaagatgggagtcgagtggaccagctgtgctgaggtcgtatctcaggagaaaaccatgttcccaaacctcacagacgttagggaggtagtgaccgaccagttcctgtgcagcggtactcaagaggacgagagcccttgcaaaggcgtcaccacgacaccttggtctctggcccgaccccagggatcgtgtagtctggagggcgtcgaaattaaggggggaagcttcagacttctccaagaaggtcaagcactggagtatgtctgcccgagcggcttttacccttaccccgtgcagacaagaacttgccgtagcaccggctcgtggtccaccctcaagacacaggatcagaagaccgtccggaaagccgaatgcagagccatccattgtccaaggcctcacgacttcgaaaatggcgaatactggccaagaagcccttattacaatgtatcagatgaaataagcttccattgctatgatgggtacaccctacgcggttccgccaatcggacatgccaagttaatgggaggtggagtggccagacagccatttgtgacaatggtgcgggatactgctctaacccgggtatccccatcgggactcgtaaagtgggctcccaatatcgactcgaagatagtgtgacttatcactgttctagaggcttgacattgagaggctcgcagcggcgtacttgtcaagagggagggtcatggtccggcactgagcctagttgtcaggattcttttatgtatgatacgcctcaggaggtggctgaggcattccttagctccctgacagagactatcgagggtgtcgatgctgaagatggacacggccctggcgagcagcagaagcggaaaattgttctcgacccaagcgggagcatgaacatctacctcgttctggatgggtctgatagcatcggtgccagtaacttcactggcgctaaaaagtgtcttgtgaacctaatagagaaagtggcttcctacggcgttaagcctcggtacgggctggtcacctacgctacttatccaaaaatttgggtgaaggtgagtgaggcggattcttcaaacgcagactgggtaacaaaacagcttaatgaaattaattacgaagatcataagttaaaatctgggaccaacaccaagaaagcgctccaggctgtgtactccatgatgtcttggccagatgacgtgccccctgagggatggaaccgcacaaggcacgtgattatcttgatgacggatggtcttcacaacatgggtggagatccaattacggtgatcgatgagataagggatctgctctacattggtaaggacaggaaaaatccacgggaggattacctggacgtgtacgtttttggtgtgggtcctctggtcaatcaggtgaacatcaatgccctcgcttctaagaaggacaatgaacagcatgttttcaaggtgaaagacatggaaaatctggaagacgttttctaccagatgattgacgagtcccagtccctaagtctgtgcggaatggtttgggaacacaggaaagggacggactaccataagcagccctggcaggctaagatctctgtgattaggcccagcaaaggccatgaaagctgcatgggagcagttgtctcagagtactttgtcctgaccgcggctcactgttttacagttgatgataaagaacactccattaaggtgagcgtcgggggtgagaagagggatctggagatcgaggtggtgttattccaccctaactacaatattaacggaaaggaagaggctggcatccccgagttctacgattatgatgtggcactgataaagctcaagaataagcttaaatatgggcagacaatccggccaatctgtttgccctgcaccgaaggcacgacacgtgcccttcggctcccgcctaccaccacatgccagcaacaaaaggaagaacttctgccagcccaggacatcaaggcactgttcgtgagcgaggaggagaagaagcttactaggaaagaggtgtacattaagaatggtgataagaagggtagttgtgagcgtgacgcccagtatgcgccaggctacgataaggtaaaggacatttcggaggttgtgacgcctcggttcttgtgtactggaggggttagtccatacgcggatccaaacacatgtcggggagattctggaggcccattaattgtccataagaggagcagattcatccaggtgggtgtcatctcatggggggtcgtcgacgtgtgtaagaaccaaaagcgccagaaacaggtcccagcccacgccagggattttcacattaacctcttccaggtgctgccctggcttaaggagaagctgcaagacgaagatctgggatttctgtag

SEQ ID NO: 219110 - DNA, 3801 bp, Artificial Sequence
  Description of Artificial Sequence: Synthetic coding sequence
atggggcctctgatggtcttgttctgtcttctcttcctttacccgggattggccgactccgcccctagttgtccacagaacgtgaatatcagcggcggtacatttactctgagtcatgggtgggctccgggtagtttactgacttatagttgccctcaaggcttatatccatccccggctagcaggctctgcaagtccagtggccagtggcagacgcctggggctactagatccttgtcaaaggccgtgtgcaagcccggacattgcccaaatcccggtatctctctgggcgctgtgcggactggcttcaggtttggccatggagataaagtgcgctacagatgttccagcaacctggtgctgacaggatctagcgagcgtgagtgccagggcaatggagtgtggtccggcacagaacccatttgcagacagccttattcatacgatttccctgaagacgtggcaccagctctcgggacaagtttttctcatatgcttggcgctactaaccccacacagaaaactaaggatcatgagaatggcactggtactaatacctacgcagccttaaactcggtctatttgatgatgaataatcagatgcgcctgttgggaatggaaacaatggcgtggcaggaaatcagacacgctataatccttctgacagacggcaaatccaacatggggggaagccccaagactgccgtagatcacatccgcgagatcctgaatatcaatcagaagcggaacgactatttggatatctacgcaatcggtgtcggcaagctcgacgttgattggcgggaactgaatgagctcgggtcaaagaaggacggcgaacggcatgccttcatattgcaggacacaaaggccttgcaccaagtgtttgagcacatgttagatgtatccaagttgactgacacgatctgtggggtgggcaacatgtccgccaatgcgagcgatcaggagcggaccccctggcatgtgactatcaaaccgaaaagccaggaaacttgccgtggcgcactgatctctgatcaatgggtgctgaccgctgctcactgctttcgggatggtaatgaccactccctgtggagagtcaatgtgggcgacccaaagtctcaatgggggaaggagtttctcattgaaaaagctgtgatttcaccaggctttgatgtgtttgccaaaaaaaaccaggggatcctggagttctacggcgacgacatcgccctactcaaactggcgcagaaagtaaagatgagtacacacgcacgcccaatttgtctgccctgcaccatggaggccaacctggccctccgtcgccctcagggcagtacttgccgcgaccatgagaatgagttattgaacaagcaaagtgtacctgctcactttgttgccttgaatggatccaaactgaatataaatttgaaaatgggtgtagagtggacatcttgtgcagaggtcgtcagccaggagaagaccatgtttcctaatctgaccgacgtgagagaagtggttactgaccagttcctctgctccgggacccaagaagacgaaagcccttgcaaaggggtcactaccacaccatggagtctggccagaccacagggttcttgcagtctcgaaggtgttgaaattaagggaggatcattcagactgttgcaggaaggccaggctctggaatacgtgtgcccttctgggttttatccttacccagtgcagactcggacctgtaggagcaccggatcttggtccactttaaagacccaggatcagaagaccgtccgtaaggccgaatgccgagccatacactgtcctaggcctcacgattttgagaatggcgagtattggccaagaagcccgtattacaatgtttccgacgagatctccttccattgctatgatgggtataccctaaggggatccgccaaccgcacctgtcaagtgaatggtaggtggtctggtcagaccgccatatgtgacaatggcgctgggtactgcagtaacccgggaattccaattggaactagaaaggttggcagtcagtacaggctggaagatagcgtgacttatcattgcagtagagggctgaccctgcgaggctcacagagaagaacctgtcaagaagggggttcgtggagcggaactgaaccttcttgccaggactcattcatgtatgacacacctcaggaggttgctgaggcatttttatcgagcctgaccgagacaattgagggtgtggacgcagaggacggacacggtcccggtgaacagcagaaaaggaagatcgtgctggacccctccggcagcatgaacatttacctggtactcgatgggagcgactcaattggagcctccaacttcacgggcgcaaagaagtgcctggtgaatctcattgagaaagtggcatcttacggcgtgaagcctagatacgggctggtgacatatgcgacataccctaagatatgggtgaaagtctctgaagctgattcgtccaacgccgactgggtgacaaaacagctcaatgaaatcaattatgaagaccacaagctcaagagcggcaccaacacaaagaaggccctccaggctgtgtacagcatgatgtcttggccggacgatgtcccacccgagggttggaataggacccgccacgttatcattctaatgactgacggtctgcataatatgggaggagaccctatcacagtcattgatgaaataagagatctcctctacattggaaaagataggaaaaatcctcgcgaagattacctcgatgtctatgtctttggcgttgggccattagtcaaccaggtcaatataaacgcccttgcatccaagaaagacaatgaacaacacgtgttcaaggttaaagacatggaaaaccttgaagacgtattttatcagatgattgatgagtcacaaagtctaagtctttgtggcatggtttgggagcataggaaagggacagactatcataagcagccctggcaggccaaaatttccgtgatccgcccttctaagggtcatgagagctgcatgggggcagtggtgtcggagtactttgtgctgaccgctgcacactgctttaccgttgacgacaaggagcatagcatcaaggtgtccgtgggtggggaaaaacgggacctcgagatagaggtcgtgcttttccatcccaattacaacatcaacgggaagaaggaggctggtattcccgagttttatgactatgatgtagccctgattaagttaaagaacaaactgaagtatggtcaaaccatccgccctatttgccttccatgcactgaagggactacacgggctttgcgacttcccccaactaccacatgccagcagcaaaaggaggagctcttgccagcacaagacataaaggcgctgttcgtgtcagaagaagagaagaaactgactcgaaaagaggtgtacatcaagaatggcgacaaaaagggctcctgcgagagagacgcccagtatgccccaggttacgacaaggttaaggatatatctgaggtcgtgacccctaggttcctctgcacaggaggcgtgtcgccctacgctgaccccaacacgtgtcgcggagattccggtggcccattgatcgtgcacaaaagatctcgattcattcaggttggagtgatctcctggggggtcgtcgatgtgtgcaaaaaccaaaagcgccagaagcaggtcccggctcacgcacgcgacttccatatcaatctgtttcaggttctgccttggctgaaggagaaactgcaagacgaggaccttggattcctgtag

SEQ ID NO: 219111 - DNA, 3801 bp, Artificial Sequence
  Description of Artificial Sequence: Synthetic coding sequence
atggggcctctgatggtgcttttttgcctactgtttttgtaccccggtctggccgacagcgccccttcctgccctcagaacgtgaatatcagtggtgggacgttcacactgtcccatggatgggcccctggctcactgctgacttacagctgtccacagggtctgtatccctcacccgctagtcgcctgtgcaaaagttctggccagtggcaaactcccggagccacaagaagcctgagcaaagccgtgtgcaagccaggccattgtcccaatcccggtataagcctgggggctgttagaactggttttaggtttggacacggtgacaaagtgaggtatcgctgttcctccaatctggtgctgacgggctcatcagaaagagagtgtcaaggcaatggggtctggtcaggaacagagcccatctgtcgccaaccttattcttacgactttcccgaggatgtcgctcccgctctcggcacttcatttagccatatgttaggagcaacaaatcccacacagaaaacaaaggaccacgaaaacggtacaggaaccaacacctacgccgctcttaactcagtttatctgatgatgaataatcaaatgagacttttgggtatggaaacgatggcctggcaggagatacggcacgctataattcttttgactgatgggaaatccaacatgggcggttcccccaagacagctgtggaccacatacgagagatcctcaatattaatcaaaaacgcaacgactatctggatatctacgccatcggagtgggaaagctcgacgtcgattggagagaactgaatgaactgggctcgaagaaggatggagagaggcatgcattcattctccaagacaccaaagcacttcaccaggtgtttgaacacatgctggacgtttcaaagctcactgacaccatatgcggagtgggcaacatgagcgctaatgcatcagaccaggagcgcacaccctggcacgtgaccatcaagcccaaaagtcaggagacttgcagaggagctctgatttcagatcagtgggtcttgacagcggctcattgttttcgggatggcaacgaccatagtttatggagggtcaatgtgggcgaccctaaatcccagtggggaaaggaatttctgattgagaaagctgtcattagtccaggcttcgacgtcttcgccaagaaaaaccagggaattttagagttctacggagatgatattgcactgctgaagcttgctcagaaggtaaagatgagtactcatgccagacctatatgcttgccctgcacgatggaggcgaaccttgctctgcgacgaccgcagggcagcacttgcagagaccacgaaaatgagctcctcaacaagcagtcagttcccgcacacttcgttgcattgaatggctccaagctgaatatcaacctgaagatgggggtggaatggaccagctgcgctgaggtggttagccaggagaaaacaatgtttcctaacctgaccgatgtgcgagaagtagtaactgaccagttcctctgctctgggacacaagaagatgagtcaccctgtaagggggtcacaaccacaccctggtccctcgccaggccacagggatcgtgttccctagaaggtgttgaaattaaggggggaagttttcggctgcttcaagagggccaggctctggaatacgtctgtccttctggattttatccctaccccgtgcagacccgaacctgcagatccacaggttcctggtctaccctgaagacgcaggatcaaaaaactgtccgaaaagccgaatgtcgagccatacattgcccaaggccacatgatttcgagaacggagaatattggccgcgatctccctactacaacgtaagcgacgagataagcttccactgctatgatgggtatacactgagaggctccgcgaacaggacatgccaggtgaacgggagatggagcggacaaacagctatctgtgacaacggtgctggatactgttccaatcccggaattccaattggcacgagaaaagtgggtagccagtatcgactcgaagacagcgtgacataccattgcagtagaggattgacactgcgcggatcacagcggaggacctgccaggagggcggatcttggtcagggaccgaacctagctgtcaagatagtttcatgtacgatacgccccaggaggtcgctgaagccttcctgtcatcccttactgaaaccattgagggtgtcgatgcagaagacggccacgggccaggcgagcagcagaaaagaaaaattgtattggatccatctggcagcatgaacatctacctagtactcgatgggagcgatagtattggtgcttctaactttactggagctaagaagtgtctggtgaatctgatagagaaagtggccagctacggggtgaaaccacggtatggtctggtgacatacgctacctatccgaagatctgggtgaaagtctcagaagccgattcatcaaacgcagattgggttacgaagcagctgaacgagataaactatgaggaccacaagcttaagagcgggaccaacactaaaaaggcactgcaggcggtatatagtatgatgtcttggccggacgacgttccacccgagggttggaatcggacaagacatgtaattattctcatgactgacggactgcacaacatgggcggagatccgatcacggtgatcgatgagattcgggatttgctgtatattgggaaagataggaagaacccaagggaagattacctggacgtgtatgtgtttggggtcggtcctctggtgaatcaggtgaacattaatgcgctcgccagtaaaaaagataatgaacagcatgtgtttaaagttaaggatatggagaatctggaggacgtcttttaccagatgatcgacgagtcacaatctctcagcttgtgcggaatggtttgggagcatcggaagggtactgattatcataaacagccctggcaagccaagatctctgtcattcggccttccaagggtcacgaaagctgtatgggagcagttgtcagcgaatactttgtattgactgctgcccactgtttcaccgtggatgacaaagaacactctattaaggttagcgtgggaggagagaagcgagacctcgaaatagaagtggtactttttcatccgaattataatataaacgggaaaaaagaagctggtatccccgagttctacgattacgacgtggccctcataaaactgaagaataagttgaagtacggccagaccatccggcctatatgtctcccttgtacagagggtaccactcgggctttaagactacccccaacaacgacatgtcagcagcagaaggaagaattgttgcccgctcaggacattaaggcccttttcgtttcagaggaggaaaaaaagctgacacggaaagaggtctacataaaaaatggggacaagaaggggagttgcgaacgggatgcacagtacgctcccggatatgacaaggtcaaagatatttctgaggtggtgacccccaggtttctttgcacagggggagtttcaccttatgcagatcctaacacttgcagaggagactctggcggaccgctgattgtgcataagcggagtcgtttcatccaggtgggggtcatctcttggggcgtggtcgatgtgtgcaagaaccagaagcgccagaagcaggtgccagcgcatgcccgagactttcacattaacctcttccaagtcctgccctggctcaaggaaaaactgcaagacgaggatctgggtttcttgtag

SEQ ID NO: 219112 - DNA, 3801 bp, Artificial Sequence
  Description of Artificial Sequence: Synthetic coding sequence
atgggccctcttatggtgcttttctgtctgctgtttttgtatcccggactagccgactctgccccaagttgcccccagaacgtgaatatctctggagggacatttaccctctcacatggctgggctcccggatccttgctgacttacagctgtccgcaaggactatatccaagtcctgcctcgcgcctttgcaaatctagtggacaatggcaaacacctggcgctacaaggtccctgtccaaggccgtctgcaaacccggacattgtcctaatcccggaatttccctgggtgcagttaggaccggatttaggtttggacacggggataaggttcgatacagatgctcctctaaccttgtgctaacgggcagttcagagcgcgagtgccagggaaatggcgtatggtccggaacagagcctatctgtcgtcagccttattcttacgactttccagaggatgtcgctccagccttaggaacttccttttcccacatgcttggagctaccaatccaactcaaaaaactaaggaccacgagaacggaacgggtaccaacacatacgccgctctgaattctgtgtaccttatgatgaataaccagatgcggctactgggcatggagacaatggcttggcaggaaatccgccacgcaatcatcctgctcacagacggtaagagcaatatgggcggtagcccgaagacagctgtggaccacattagggagatcctgaacatcaatcagaagcgaaacgattacctcgacatttacgccatcggggtgggaaaactggacgtcgactggcgagagttgaatgagttgggctctaaaaaggatggcgagcgacacgccttcatcctgcaagacactaaagcactccatcaggtcttcgaacatatgctcgacgtatctaaactcaccgatacaatctgtggggtgggcaatatgtcagccaatgcatcggaccaagagcgcaccccttggcacgtgacgatcaaaccaaagtcccaagagacatgccgcggtgcactaatctccgaccagtgggtcctgaccgctgcccactgttttcgagacggcaacgaccacagtctctggagggtaaatgtgggggatcccaagtctcagtggggaaaggagtttctgatcgaaaaggcagtgatttctcctggattcgacgtttttgccaaaaaaaatcagggcatactcgagttctatggtgatgacattgcgttgctgaaacttgctcagaaggtaaagatgtcaacccacgccaggccaatatgtcttccttgtaccatggaggcaaaccttgctttacgcaggccacaaggtagtacctgcagagaccatgaaaacgaactgctcaacaaacagtcagtccctgcgcatttcgtcgccctgaacggatcgaagttaaacattaatttgaaaatgggcgtggagtggaccagttgcgcagaagtagtgagccaggagaagactatgttcccaaacctgactgacgtgagggaagtggttacagaccagttcctgtgctccgggacccaggaagacgaaagtccctgtaaaggcgttaccaccaccccctggagcctagcaaggccacagggcagttgctcattagagggagtggagattaagggcggatcctttcgccttctgcaagaaggccaagcactggagtacgtctgtccctccgggttctatccatacccagttcagacccgcacttgccggtctaccggtagctggagtactttaaaaacacaggatcagaagactgtcagaaaagcggagtgtcgcgcaatccactgcccacgccctcacgactttgagaacggagagtactggccacggtcaccgtattataacgtgagcgatgagatcagttttcattgttatgacggctatacgctgagaggatctgccaaccgtacatgccaggtcaacggacgatggtctggacaaacagcaatctgcgataacggcgctgggtattgttctaaccccggaattcctattggcactaggaaggtaggtagtcagtatcgcctcgaggacagtgtcacctaccactgtagcagaggattgactctaaggggttctcaacggagaacctgccaggaagggggatcgtggtcaggaaccgagccgtcttgccaggactccttcatgtacgataccccgcaggaagtggctgaagcgtttctctccagtctcaccgaaactatcgagggagtggatgccgaggacggacacggccctggagagcagcaaaagcgcaagattgtgctggatccttcgggcagcatgaatatttacctggtgttagatggtagcgatagcattggcgcttcaaatttcactggcgctaagaagtgtctggtcaacctgatcgagaaggttgcctcctacggcgtcaagcccaggtacggacttgtgacatatgccacgtatccaaaaatttgggtcaaggtctcagaggctgatagtagtaacgctgattgggtgacaaagcagctgaatgaaattaattacgaggatcacaaactgaaaagtggtacaaacaccaaaaaagctctgcaggctgtctactcaatgatgtcatggcccgacgacgttcctcccgagggctggaataggacacgacatgtcataatactgatgaccgatgggctgcataacatgggaggcgacccaattactgtcatagatgaaatccgcgacctactctacatcggtaaggacaggaaaaacccaagggaagattatctcgacgtgtatgtctttggtgtgggcccactggtgaatcaagtcaatatcaatgctctggcatccaagaaagataacgagcagcatgtctttaaagtaaaggatatggagaatcttgaggacgtgttctaccaaatgatcgatgagtctcagtcactctctctatgtggtatggtgtgggagcatagaaaggggacagactaccacaagcagccctggcaagccaaaatttccgtgatccggccttccaagggacatgaaagctgcatgggcgctgtggtatccgaatattttgttttaacagccgcacactgttttacggtggatgataaagaacactcaatcaaagtttcggttggaggtgagaaacgggacctggaaattgaggtcgttttatttcaccccaattataacattaacggcaaaaaagaggcaggaatccctgaattttacgactatgacgtcgcattgatcaagttaaagaataaactgaaatatggacagacaatccggccaatttgcctgccttgtaccgagggaactactagggcgttaagactgccacccactactacgtgtcaacagcagaaagaagagctccttccagctcaggacattaaagccctgttcgtgagcgaagaggagaagaagcttactaggaaagaggtctatatcaaaaacggtgacaaaaaaggatcctgtgaacgtgatgcgcagtatgcgccaggctacgacaaggtgaaggacatctccgaagttgttacacctcgattcctatgcaccggaggcgtgagtccatacgccgacccaaacacatgcaggggagattcaggcggaccactcattgtgcataaacgctccagatttatacaggttggtgtgatctcttggggcgttgtggatgtgtgcaaaaatcagaagaggcagaagcaagtgccagcccacgcaagggacttccacattaacctgtttcaagtgctcccctggctcaaggagaaattgcaagatgaggacctgggctttctgtag

SEQ ID NO: 219113 - DNA, 3801 bp, Artificial Sequence
  Description of Artificial Sequence: Synthetic coding sequence
atgggaccacttatggtacttttctgcctgttattcttatatcccggattggcagatagcgctccctcatgccctcagaacgtgaatatctcgggaggcactttcactctatctcacggatgggccccagggtccctgctgacctacagctgtccacagggtctgtacccatcccccgcttcgcgcctctgcaaatcgtcgggtcaatggcagacaccgggagctactcggagcctttcaaaagcagtttgtaagcccggacactgccccaatccagggatcagtttgggtgcggtccgtactgggttccgattcggccacggtgacaaggtgcggtaccgctgttcctccaacctggtactaacaggttcctctgaacgagaatgtcagggcaacggagtctggtccggcaccgagcccatatgtcgccaaccctactcctacgatttcccggaagatgtggcccctgcattaggtacatcttttagtcatatgctgggagccaccaacccaacccaaaaaaccaaggaccatgaaaacgggaccggcactaacacatacgccgcactgaacagcgtgtatcttatgatgaacaaccagatgcgcctgctgggaatggagacgatggcctggcaggaaattcgccacgccattatcctgctcactgacggcaagagtaacatgggagggagccccaagaccgccgtcgatcacatacgggagatccttaatatcaaccagaagcgtaatgactatcttgacatttatgcaatcggagtgggaaagctggatgtcgattggagggaactgaacgagctgggttcaaaaaaagacggtgagcggcacgcatttatcctacaggacacaaaggccctccaccaggtgttcgagcatatgctggatgtgagcaaactgacagacaccatatgcggcgtgggcaatatgtctgcgaacgcctccgaccaagaacggaccccgtggcacgtcacgataaaacctaagagtcaggagacctgtaggggcgcactcatttctgaccagtgggtcctgaccgcagcccactgctttagggatggaaatgatcacagtttatggcgtgttaatgtgggagatccaaagagccaatggggtaaagagtttctcattgaaaaggcagtgatcagcccaggcttcgacgttttcgccaaaaaaaaccaggggattttagagttttatggagatgacattgcattgctgaagcttgctcagaaagtcaaaatgtcgactcatgcgcgtcccatctgcctgccttgcacaatggaggctaatctggctcttcgcagacctcagggttccacttgccgggaccacgaaaacgagttattaaacaagcagagtgtccccgctcattttgtggcactcaacgggtccaagctgaacatcaatctgaagatgggtgtagaatggacttcctgcgccgaagtggtgtcacaggaaaaaacaatgtttccaaacctgaccgacgtgcgagaagtagtgaccgaccaattcctgtgctcgggcacccaagaggatgagagcccgtgtaagggcgtgacgacaactccgtggtctctggcgaggccccagggctcctgttcgcttgagggcgtcgaaataaagggaggcagcttcaggctattgcaggaaggacaggccctggaatatgtatgtccatcaggattttacccatatccagtgcaaacaaggacttgtcgcagtactgggtcctggagtaccttgaagacacaagaccagaagaccgtacggaaggcggagtgcagggccatccactgcccaagaccacacgatttcgagaacggggagtattggccgcgatctccatactataatgtatccgacgagatctctttccactgttatgacggctataccctgagggggtccgccaacaggacttgccaggtgaacggaagatggagtgggcaaacagcgatatgcgacaatggggcaggctactgcagtaatccgggtattcctattggcacccgaaaggttggatctcagtatagacttgaggactcagtcacctatcattgttcaagagggctgacattgcgcggttcacagcggagaacctgccaggaagggggatcgtggagtggcaccgagcctagctgtcaagactcctttatgtatgacacaccccaggaggtcgccgaggcttttctgagttctctgactgagacaattgagggcgttgacgccgaagacgggcacggtcccggagagcagcaaaagagaaaaattgtgcttgatcccagcggtagcatgaacatctacctggtgctggatggatccgatagcattggggcatccaatttcactggcgctaagaaatgcttagttaatttgatcgagaaggtggcttcttatggcgtgaagcctagatacggcttggtgacctatgccacataccctaaaatctgggtgaaggtttcagaggccgatagttccaatgctgactgggttacaaaacagctgaatgagattaattacgaagatcataaactgaagtccggtaccaacaccaaaaaagcactgcaggctgtgtattctatgatgagctggccagacgacgttccacccgaaggctggaatcgaactcggcacgttattatattaatgacagacggcctgcacaatatgggtggagatcccatcacagttattgatgagatcagagatttactttatatcggaaaagatagaaagaacccgcgagaggattacttggatgtttacgtcttcggcgtaggaccattggtaaatcaagtgaatatcaatgctctggcgagtaaaaaagataatgagcagcacgtcttcaaagttaaggatatggagaacctggaagatgtcttctaccagatgatagacgagtcccagagcctatcattgtgtggaatggtgtgggaacaccggaagggaacagattaccataagcagccctggcaggctaaaatcagcgtgataaggccctccaaagggcatgagagttgtatgggggctgtggtgtccgaatacttcgtgctcaccgcggctcattgtttcacagtggacgacaaagagcactccatcaaagttagcgtgggtggcgaaaaacgtgatttggaaatagaggttgtgctctttcatccgaattacaacataaacgggaagaaggaggccggaattcccgagttctatgattatgacgttgcccttattaagctgaagaataagctgaaatacggtcaaacaatacggcctatttgtctgccctgtaccgaaggcactacaagagcactgcggcttccaccgaccacaacatgtcagcagcagaaggaggaactcctgcccgctcaggacatcaaagccctgtttgtttctgaagaggaaaaaaagctgacacggaaagaagtgtacattaagaacggtgacaaaaagggctcatgcgaacgcgacgcacagtacgcccctggctatgataaagttaaggatatttccgaagtcgtgaccccacgattcttgtgcaccggaggagtgagcccctatgccgatcccaacacgtgtcgtggagacagcggagggccactaattgtgcataagcgaagtcggtttattcaggtcggcgttatctcttggggcgtcgtggacgtttgcaagaaccaaaaacggcaaaaacaagttccagcccatgccagggacttccacatcaacctgtttcaggtgctaccatggctcaaagagaagctccaggatgaggaccttggattcctgtag

SEQ ID NO: 219114 - DNA, 762 bp, Artificial Sequence
  Description of Artificial Sequence: Synthetic coding sequence
atgcattcatgggaaaggctggcggtgcttgtgctgctgggtgcagccgcttgcgccgctcccccaagggggaggattttgggcggaagagaagccgaggcacacgcgcgaccctatatggcgtctgtgcagttgaatggggctcatctgtgcggcggagtacttgtggctgaacagtgggttctctcggcagcccactgtctggaggatgcggcagatggaaaagtacaggttctactgggagcccattcgttgtcacagccagagccttccaagcgcttgtacgacgtgttacgggcagtgccgcaccctgactcgcagcccgataccatcgaccatgatcttctgctgctgcagctttccgaaaaggcaacgttaggtcccgcagtacggcctcttccttggcagcgagtcgaccgggatgtggcccctggcactctgtgcgatgtggcagggtggggtattgtgaatcatgccggacggagaccagattccctccagcatgtgctcctcccagtcttagacagggctacttgtaatcggcgtacacaccacgatggcgctattacggaacgtctcatgtgtgccgagtccaataggcgtgattcatgtaagggggacagcggtgggccactggtatgtggaggtgttctggagggggtggtcacatctggttccagggtgtgcggcaacagaaaaaaaccaggcatatacacgcgcgtggcctcttacgcagcatggatcgactccgttctcgcctag

SEQ ID NO: 219115 - DNA, 993 bp, Artificial Sequence
  Description of Artificial Sequence: Synthetic coding sequence
atgtggctactcgtcagtgtgattctgatttcccgaatctcgagcgttggtggtgaagcgacattttgtgattttccgaagattaaccatggcatactgtatgatgaagaaaagtacaaacccttttcccaggtccccacaggtgaggtgttctactatagctgtgagtacaattttgtgagcccgtcaaagtctttttggacccgaatcacatgcactgaggaaggttggtcccctactcccaagtgcttaaggctctgtttttttccttttgtggagaatgggcactctgagtccagcggccagactcacttggagggggacaccgtgcagatcatctgtaacactggatatagactgcagaacaacgagaacaacatttcatgcgtagagaggggatggagcactccaccgaagtgtcgctcaacagacacctcctgcgtcaatcccccaacagtgcaaaatgcccacatactcagcagacaaatgagcaagtatccctctggcgagagagttagatacgaatgccgctctccttatgagatgttcggagatgaggaggtaatgtgtctgaatggcaactggaccgaaccccctcagtgtaaagactccaccgggaaatgcggcccaccaccacccatcgacaacggagacatcacatctttcccactgagcgtatatgccccagcaagctccgtagagtatcaatgccagaacctgtatcagctggagggaaataagcgaattacctgtcgcaatggtcagtggtctgagccacccaaatgccttcatccgtgtgttattagcagagaaattatggagaattacaacatcgctctgcgctggacagcgaagcagaagttgtatctgcgaaccggggaaagcgcagagtttgtctgtaaacgaggctatagattatcttcccgctcccatacgcttagaaccacctgttgggatggaaagctagaatatcctacctgcgccaaacgctag

SEQ ID NO: 219116 - DNA, 813 bp, Artificial Sequence
  Description of Artificial Sequence: Synthetic coding sequence
atgtggttactcgtgtccgtgatcttaatatctcggatcagctcagtcggcggagaggccatgttctgcgatttcccaaagatcaaccatgggattctgtacgacgaggaaaagtacaaacccttctcccaggttccaactggcgaagtgttttactactcttgcgaatacaattttgtgagcccaagtaagtccttttggacaagaattacgtgcgccgaggagggatggtcacccactcccaagtgcctgcggttgtgtttttttccattcgtggagaatggccactccgagagcagcggtcagacccatctggagggggacactgtgcagatcatctgcaataccggctatcgactgcagaacaatgaaaacaatatttcctgcgtggaacggggatggtctactccacccaagtgcaggtcaactataagcgcggagaagtgcgggcctcccccaccaattgacaatggggacataacatcttttctgttatccgtgtacgcccctgggtcctcagtggagtaccagtgtcaaaatctgtaccagctggaaggaaataaccagattacatgtaggaacggccagtggagcgagcccccaaagtgtttggatccatgcgtcatctctcaggagattatggaaaaatacaacatcaagttgaaatggaccaatcagcaaaagctgtacagcaggacgggcgacatcgtggaattcgtgtgcaaatcagggtaccatccaactaagagtcactctttccgcgcaatgtgtcagaatggcaagctagtgtatcccagctgtgaagaaaaatag

SEQ ID NO: 219117 - DNA, 813 bp, Artificial Sequence
  Description of Artificial Sequence: Synthetic coding sequence
atgtggctgttagtatctgtgatactgatctcacgcatttcttccgttggaggggaggccatgttttgtgactttccaaagattaaccatggaatactgtatgatgaggagaagtataagcccttctcgcaggttcctaccggcgaagtgttttattactcctgcgaatataattttgtgtcgccttctaaatccttttggacccgtatcacctgcgctgaggagggatggtcccctacaccaaagtgtctccgcctctgcttttttcccttcgtcgagaatggccacagtgagagctcaggccaaacgcacctagagggcgacacagtccaaattatctgcaataccgggtatcgtctgcagaacaacgagaataacatcagctgtgtggagagaggctggtcaacaccccctaaatgtaggtccactatctcagccgagaaatgtggccctccacctcccatcgataatggcgacatcacatctttcttgctgtccgtttatgctccagggtcttcagtcgagtaccaatgccaaaatctataccagctcgagggcaacaaccaaatcacatgccgaaatggacagtggagcgaaccccctaagtgtcttgacccgtgtgtcatctctcaggagattatggagaaatacaacattaagttaaaatggaccaatcagcagaagctctactcacggactggggacattgtggaatttgtgtgtaaaagcggctaccacccaaccaagagccattcattcagggccatgtgtcagaatgggaagctcgtctatccaagctgtgaagaaaagtag

SEQ ID NO: 219118 - DNA, 993 bp, Artificial Sequence
  Description of Artificial Sequence: Synthetic coding sequence
atgctgctgctaattaacgtcatcttgactttgtgggtgtcctgtgctaatggccaggtcaagccgtgtgactttccggacatcaaacacgggggtctttttcatgaaaatatgcgcagaccatattttccagtggctgtcggtaagtactactcgtactactgcgacgaacacttcgaaacgccaagtggatcttattgggattatattcattgtacccagaatggatggtcccccgctgtaccctgtttgagaaagtgttacttcccgtatttagagaacggttataatcagaattatggcaggaaattcgtccaaggcaactccactgaagtagcatgccatcccggatacgggttgcccaaggctcagactaccgtcacatgtaccgagaagggttggtcacctaccccaaggtgtatcagagtgcggacgtgcagcaaatctgacatcgagatcgaaaacgggttcatttcggaaagctccagcatatacatccttaataaagagatccagtataagtgcaagccaggctatgccacagcagatggtaatagtagtgggagtattacctgcctgcagaacgggtggtctgctcagcctatctgcatcaattcttcggagaagtgcggaccccctccccctatttcgaacggcgacacgacatccttccttctcaaggtgtatgtaccccagtcccgggtcgagtatcagtgtcaaccttactatgagctccagggttctaactatgttacttgttcaaatggagaatggtctgaaccaccaagatgcatacatccatgcataattaccgaggagaatatgaacaagaacaacataaagctgaagggtagatcagacagaaagtactacgcaaagacaggggacacaatagaatttatgtgcaaactggggtataatgctaacacctccattctctctttccaggctgtctgtagggaagggattgtcgagtatccccgttgtgagtag

SEQ ID NO: 219119 - DNA, 588 bp, Artificial Sequence
  Description of Artificial Sequence: Synthetic coding sequence
atgctcctgttgatcaacgtgatcttgaccctgtgggtgtcatgtgctaacggacaagtaaagccttgcgattttccggacatcaagcacgggggactgtttcatgagaatatgcgacgaccctatttccctgtggcagtgggcaagtattactcctactattgcgacgagcactttgaaaccccctccggctcgtattgggactatatacattgcactcagaatggctggagtccagcggttccttgtttgcgaaagtgttatttcccatatctggagaatggatacaatcaaaattacggcagaaagtttgtccaggggaattcaaccgaggtggcatgccaccccggatacgggctcccaaaggctcagaccacagtgacatgtaccgagaaaggctggtctccgaccccacgatgcatacgggtcaggacatgttctaaatccgatattgagatcgagaacggctttataagtgagagctcctccatttatatcctaaacaaagagattcaatataaatgcaagcccggatacgctacagctgacggtaacagcagtgacatggtcttctgtatttcttactag

SEQ ID NO: 219120 - DNA, 810 bp, Artificial Sequence
  Description of Artificial Sequence: Synthetic coding sequence
atgctattgcttatcaatgtgattctgacactgtgggtcagttgcgcgaacggacaggtgaagccttgcgacttcccggacattaagcatggaggtctgtttcacgaaaatatgcgcagaccttattttcccgtggcggttggtaaatactatagctattactgtgatgaacatttcgaaaccccatccggttcatattgggactacatacactgtacgcagaacggttggagtcctgcggtgccatgcctgcgaaaatgttactttccatatttggaaaacggatacaaccagaattacgggcgaaaattcgtccagggcaattccactgaggtggcttgccatcccggttacggcctaccgaaagctcagactaccgttacatgcactgagaaggggtggtctccaaccccacggtgtattcgagtgaactcttccgagaagtgcgggccacctcctcccatttccaacggcgacacgactagttttctccttaaggtttacgtgccgcagtcaagggttgagtatcagtgtcagccatactatgaactacaggggtccaattatgtgacctgctcaaatggggaatggagtgagcctcccaggtgtatccatccatgtatcataaccgaggagaacatgaacaagaacaatatcaaactgaaaggtcgttccgaccgcaaatattacgctaagacaggggataccatagaatttatgtgcaaactgggctataatgccaatacctctattttgtcgttccaagccgtgtgtagggagggcattgttgaatacccacgttgtgagtag

SEQ ID NO: 219121 - DNA, 996 bp, Artificial Sequence
  Description of Artificial Sequence: Synthetic coding sequence
atgctgctcttaatcaatgtaatcttgaccctctgggtctcatgtgcgaatggccaggaagtgaagccttgtgacttcccagaaatccagcatggaggcctctactataaaagtctgagacggctgtactttccggcagccgcaggccagtcctacagttactattgtgatcagaactttgtgactcccagcgggtcttactgggactacattcactgtacccaggatgggtggtccccgaccgtcccctgtctcaggacatgcagtaagtcagacattgagatcgaaaacggttttatctcggaatccagcagtatttatatcctaaacaaagagatacagtataaatgtaagccagggtacgcaacagccgacggcaacagttctggcagcatcacatgcctgcagaacgggtggtccgcccagccaatatgcatcaagttctgtgatatgccggtgtttgagaactcgcgcgcaaagtccaacggcatgcggtttaagcttcatgacacgctggattacgagtgttatgatggctatgagatttcttacggcaataccacaggaagcatcgtttgtggtgaagacggatggtcacacttccccacatgctacaattcttcagagaaatgcgggcctccaccacccatcagcaatggggacactactagctttctgttgaaagtttatgtccctcaatctagggtggaataccagtgccagagctactacgagcttcagggctccaattacgtgacttgttctaatggtgagtggtccgaaccacctcgctgcatacatccctgcattatcacagaggagaatatgaacaagaacaacattcagctcaaagggaagagcgacatcaagtactatgcaaaaacaggggacaccatcgaatttatgtgtaagttgggttataatgcaaatacctcggtgctctcattccaggccgtttgccgggagggcattgttgaatatcctcgttgtgaatag

SEQ ID NO: 219122 - DNA, 1734 bp, Artificial Sequence
  Description of Artificial Sequence: Synthetic coding sequence
atgctcctcctgattaacgtcatcctaacgctgtgggtttcctgcgctaatggtcaagttaaaccctgcgacttccctgaaattcagcacgggggactctattataaatccctcagaaggctctactttccagctgccgcaggacagtcttacagctattactgcgatcagaattttgtgactccttcgggctcttactgggattatatccactgcactcaggatggttggagcccaaccgtcccatgtcttcgcacctgcagcaagagcgacgtggagatagagaatggctttatcagcgaatcatcatccatttacatcttgaacgaagagacccagtataactgcaagcctgggtacgccaccgccgaaggcaacagctccggcagcattacctgcttgcagaacggttggagcacacagcccatatgcatcaaattctgcgacatgcctgtgttcgagaactctagagcaaaaagcaatggcatgtggttcaaactgcatgatacgctggactacgagtgctacgacggatatgagtcatcatacggtaacactacggacagtatcgtgtgcggggaggacggatggtctcacctgcctacctgttataattccagtgagaattgcggcccaccccctcccatctctaatggagacacaactagttttcctcagaaagtttaccttccctggtctcgtgtcgagtatcagtgtcagtcttattacgaactgcagggcagtaaatacgtaacctgctcaaacggggattggagcgagcccccaaggtgtatttccatgaagccatgcgagttccctgagatacagcatggccacttgtactatgagaacacgcggcgaccatacttccctgtggctacaggtcagtcatatagctactactgtgaccagaatttcgtcacccccagtggaagttattgggattacattcattgcactcaggatggttggcttcctacagtgccttgtctgcgcacttgctccaagagtgacatcgagattgagaacggttttatcagcgagagctcctctatttatattctcaataaagagatccagtataagtgcaagcctggatatgccaccgcagacggaaacagctcggggagcataacatgtcttcagaacgggtggagcgctcaacctatctgtataaagttttgcgatatgcctgtgttcgagaactcgcgagccaagtccaacgggatgaggttcaagcttcatgacacccttgactacgagtgctacgacggttacgaaatttcctacggaaatacaacggggagtatcgtctgtggtgaggatggctggtcccatttcccaacttgctacaactcaagtgaaaagtgcggtcctccccctcctataagtaacggcgacacgaccagttttctactgaaagtgtatgtgccccagtcacgggtcgagtaccagtgtcagagctactatgaactccagggctccaattacgtcacttgctccaatggggagtggagcgaaccgccaagatgtatacacccatgcataatcactgaggaaaacatgaacaagaacaacatccagctcaagggaaaaagcgatattaagtattacgctaaaacaggggacactatcgaattcatgtgtaaattaggctataatgccaatacctccgtactctcatttcaagccgtgtgtcgggagggaatcgtggagtatccacgctgtgagtag

SEQ ID NO: 219123 - DNA, 996 bp, Artificial Sequence
  Description of Artificial Sequence: Synthetic coding sequence
atgcttctgttaatcaatgtgatccttaccctgtgggtgagctgcgccaacggacaggctatgaaaccctgtgagtttcctgaaatccagcatgggcatctttactacgagaacacccggcgtccctatttcccagtggcaaccggccagagctattcctattactgtgatcagaatttcgtcactccatcaggctcttattgggactatatccattgtacacaagatggatggctccctaccgtaccttgtctccgcacttgctctaagagtgacatcgagatagaaaatggatttattagcgaatcctccagcatttatatactcaataaagagatccagtacaaatgtaagccaggctacgccactgcggatggaaactcaagcgggagtattacatgcctgcagaacggatggagcgcacagcctatctgcatcaaattttgtgacatgcctgtatttgagaattcaagggccaaatctaacggtatgcgattcaagctacacgacacattggactatgagtgctacgacgggtatgagatcagctacgggaacacaaccgggtctattgtctgcggagaggatggttggtctcattttcctacatgctataacagctctgagaagtgcggccctcctccaccaatctcaaatggagatactacaagctttttactgaaagtttacgtacctcaatcaagagtggagtaccaatgtcagtcatattatgaactccagggaagcaactatgtcacttgttctaacggtgagtggagcgagccaccacggtgtatccatccatgcatcatcacagaggagaacatgaacaaaaacaacattcagcttaaggggaagagtgacattaaatattatgcaaagacgggagacactatcgagttcatgtgcaaactcggatacaatgctaacacctctgtgctgtcattccaagctgtatgtagagaagggattgttgaatatcccagatgcgagtag

SEQ ID NO: 219124 - DNA, 996 bp, Artificial Sequence
  Description of Artificial Sequence: Synthetic coding sequence
atgcttctgctgataaacgttattcttacactgtgggtgtcttgcgccaatggccaggaagtgaagccttgtgatttcccggaaattcagcacggtggtctgtactacaagagtttgcgccgtctgtacttccctgctgcggctggccagtcttactcctattattgcgatcagaatttcgttacaccttctggctcttactgggattacattcactgtacccaggacgggtggttacccacagttccctgcctgagaacttgtagtaaaagtgacatcgagattgagaatggctttattagtgagagctcctccatctatattctgaacaaggagattcagtacaagtgcaagcccggatatgcaaccgcagacggcaactcatccggctccataacctgtctgcagaacggctggtcagctcagcccatctgtatcaagttctgcgacatgcccgtatttgagaacagcagagccaaaagcaacgggatgaggttcaagctccacgataccttagattacgagtgctacgacggctacgagatttcatacgggaatactactggttccatagtttgtggagaagacggttggtcccatttccccacctgttacaactcctctgaaaaatgtggcccacctccccctattagtaatggtgacaccacaagctttctcctgaaggtttacgtcccccagtctcgggtggagtatcaatgccagtcttactatgaattgcagggctcaaattatgtgacatgctccaatggggagtggagtgagccgcctagatgcatccatccatgtatcatcaccgaagaaaatatgaacaagaacaacattcaactcaaaggcaaatccgacataaagtactacgccaagacgggtgacaccattgagtttatgtgtaagctcgggtacaacgctaatacatctgtgttgtcctttcaggccgtgtgtcgcgaagggatagtggaatatccgcgttgcgaatag

SEQ ID NO: 219125 - DNA, 1752 bp, Artificial Sequence
  Description of Artificial Sequence: Synthetic coding sequence
atgaaacttcttcatgtgtttctcttgtttctatgtttccatctacgcttttgtaaggttacatatacgtcccaggaggacctggttgaaaagaaatgcttagctaagaagtatacacacctgagttgcgataaagtcttctgtcagccctggcagaggtgcattgaaggcacctgtgtgtgtaaactcccctatcagtgtcccaaaaacggcaccgctgtatgcgccaccaacaggaggagttttccaacttattgccagcagaaatcccttgaatgcctacatcccggaacaaaattcctcaataatggcacatgcaccgccgagggcaaattcagtgtatcactcaagcacggtaacactgatagtgagggaatcgtggaagttaagctggtggaccaagataagactatgtttatctgcaaaagtagttggagcatgcgggaagcgaatgtggcctgtctggatttgggcttccaacagggagctgatacacagaggagattcaagctgtctgatctgtccatcaattcaacggagtgtctccatgtgcactgtaggggccttgaaacctcccttgcagagtgcacctttacgaagcggagaacaatggggtaccaagattttgccgacgttgtctgctacactcaaaaggccgattcacctatggatgacttcttccagtgtgttaatggaaagtacatctcccaaatgaaggcttgtgatggtattaacgattgtggcgaccaaagtgacgagttgtgctgcaaagcgtgccaggggaagggtttccattgtaaaagcggtgtctgcatcccttcacagtaccaatgcaacggcgaggttgattgcatcaccggagaggacgaggtgggatgcgctggcttcgcctcagttactcaggaggaaacagagatcttaaccgcggatatggatgccgaaagaaggcgcatcaagtccctgttgccaaagctcagctgtggggtcaagaatcggatgcacattaggcggaaaagaatagttggaggcaagcgcgctcagttaggtgacttgccatggcaggtcgcaatcaaagacgcaagcggaattacatgcggtggcatctacataggcggttgttggatcctgaccgccgctcattgtctgagggcttctaagacacatcgttaccaaatttggacgactgttgtagattggattcacccagacctgaagcgaatagttattgaatatgtagaccgtattattttccatgaaaactataacgcgggtacataccagaacgatatcgctctgatcgagatgaaaaaggatggaaataaaaaggactgtgaactgccgcgatccattcccgcatgcgtgccatggagcccttaccttttccaacctaatgatacctgtatcgtgtctgggtggggccgtgaaaaagataatgagcgggtgttttcgctgcagtggggtgaggtgaaactgatatcgaattgcagcaagttctacggtaaccgattttacgaaaaagagatggagtgtgctggaacatacgatggttccattgatgcctgcaagggcgacagcgggggacccttggtctgcatggatgcgaacaacgtgacttatgtgtggggcgtcgttagctggggggagaactgtggcaaacccgaattccctggagtgtacaccaaggtggcaaactatttcgactggatcagctaccatgttgggagaccctttattagtcagtataacgtgtag

SEQ ID NO: 219126 - DNA, 1776 bp, Artificial Sequence
  Description of Artificial Sequence: Synthetic coding sequence
atgaagctcctgcatgtgttccttctgttcctttgctttcacttgcggttttgtaaggtcacttacacaagccaggaggatctcgttgaaaagaagtgtctggccaaaaaatacacacacctgtcatgcgataaggtgttttgccagccgtggcagagatgcattgagggaacctgcgtgtgcaagctgccctaccagtgcccaaagaacgggaccgcagtctgcgccaccaacaggagatcgttccctacttattgccagcagaaatctctggagtgcctgcacccagggactaagtttctaaacaatggtacttgcacagccgaggggaagttctccgtgtccctcaagcacggaaacaccgacagcgagggaatagtcgaggtaaagcttgttgatcaggacaagacgatgtttatatgcaaatcgagttggtctatgcgggaggctaatgttgcttgtctagatttaggctttcagcagggtgcagacacacagagaagattcaaactgtccgatctgagcattaactcaactgaatgcctgcacgtgcactgccgtggactcgaaacttctctagctgaatgcacctttaccaagcgtcgaaccatggggtatcaggactttgctgatgtcgtgtgttatacacagaaagctgacagcccgatggacgatttcttccagtgtgtcaatggaaagtacatcagccaaatgaaggcttgtgacggcattaatgattgtggcgaccagtctgatgagctatgctgtaaggcctgccagggtaaggggttccactgtaaaagtggcgtgtgcatcccctcgcaataccagtgtaacggagaagtggattgcattactggggaggatgaggtgggctgcgccgctgcccgacacccgaccatccaagggttcgccagtgttactcaggaggaaacggagatattgactgccgacatggatgctgagcgccgtcgaatcaagtctctgctgcccaagctgtcctgtggcgtgaagaataggatgcatattcggaggaaacggatcgtgggcggtaaaagagcacagctgggggatctgccctggcaagtcgccatcaaggacgcaagtggtatcacatgcgggggtatctacattggtggttgttggatcttgaccgcagctcattgtttgcgcgcatctaagacccaccgctatcagatttggaccactgtggtcgactggatccatccagacctgaagcggattgtgatcgagtatgtagatcgaatcatattccacgaaaattacaatgccggaacatatcaaaacgacatcgctcttatcgaaatgaaaaaggacggcaataagaaggactgtgagctgccgaggtccatacctgcctgtgtgccttggagtccttatctgtttcaaccgaatgacacttgtattgtcagtggctggggcagggagaaagataatgagcgggttttttctctccagtggggtgaggtgaagctcatctccaattgctccaagttctatggtaaccgattttacgaaaaggaaatggaatgcgccggaacttacgacggatcgatagacgcatgtaagggcgactctgggggtcctttggtgtgcatggacgcaaataatgtcacctatgtgtggggcgtcgtgagctggggagaaaactgtggtaaaccagagttccctggcgtgtataccaaagttgcaaattacttcgactggataagttatcatgtcgggaggccattcatttcgcagtataacgtgtag

SEQ ID NO: 219127 - DNA, 1731 bp, Artificial Sequence
  Description of Artificial Sequence: Synthetic coding sequence
atgaagctacttcatgtgtttttactatttctttgcttccacctccgtttttgtaaggtgacttatacaagccaagaggaccttgtagaaaagaaatgtctcgccaaaaagtacacccacctttcctgtgacaaagttttttgccaaccttggcagcgctgtattgagggcacctgtgtgtgcaaactgccatatcaatgccctaagaacgggacggcggtctgcgcaacgaaccgtagaagcttccctacctactgtcaacagaagagtttggagtgccttcaccctggcacaaaattcctgaacaatgggacttgcacagccgaaggtaagttctcagtgtccctgaaacacgggaatacagactctgagggtatcgtggaggttaagttggtggaccaagataagactatgttcatctgcaaatcttcttggtccatgcgcgaagctaatgtggcctgcctggaccttgggttccaacagggagccgatacccaacgcagattcaaactctccgacctgtctattaactccacagagtgtcttcacgtgcactgccggggtttagaaacgtcgctagccgagtgcacctttaccaagcggagaactatgggttatcaggatttcgccgatgtggtctgctacacgcagaaggcagattctcccatggacgacttcttccagtgtgtcaatggaaagtatatatcacagatgaaagcatgcgatggcattaacgactgtggagatcaatcagacgaactgtgctgtaaagcctgccagggcaagggcttccattgcaagagtggagtctgtattccctctcagtaccaatgcaatggcgaggtggactgtattaccggagaggatgaagtgggttgtgctgaggaaactgagatcctcaccgccgatatggacgcagagcgtagaagaataaagagtttgcttccaaaactatcttgcggggtgaagaatcgcatgcatattagacggaagagaattgttggaggcaagcgagctcagttaggggacctgccctggcaggtcgcgattaaggacgcaagtggcatcacatgcggtgggatctacatcggcggatgctggattctgacggccgctcattgtttacgtgcctctaaaacccaccggtaccagatctggacgaccgtcgtggattggatacaccctgatcttaaacggatagtgatcgagtacgtggatagaattatttttcatgaaaattataatgcgggaacttaccagaatgacatagccctgattgaaatgaaaaaggatgggaacaagaaagactgcgagctccctcgctctatacccgcatgcgtgccctggagcccttatctcttccaaccgaacgatacctgcattgttagtggttggggcagggagaaagacaatgagagagtgtttagtttacagtggggcgaggttaaactgatttcaaattgctccaaattctacggcaatagattttatgaaaaggaaatggagtgcgctggcacttatgatggctctatagacgcctgtaagggagatagcggcggtcccctcgtgtgcatggatgctaataatgtcacatacgtttggggagtggtgtcatggggagaaaattgcgggaagcctgagttccctggcgtgtacactaaggtggcaaactactttgactggatttcctaccacgtgggaaggccttttatttctcagtataacgtgtag

SEQ ID NO: 219128 - DNA, 966 bp, Artificial Sequence
  Description of Artificial Sequence: Synthetic coding sequence
caggtgacatacacctcacaggaggatcttgtcgaaaagaagtgtctggctaagaaatacacacatttgtcttgtgacaaggtgttctgtcaaccgtggcagcgctgcatcgagggaacttgtgtgtgcaaactgccttatcagtgccccaaaaatggcactgctgtatgtgccaccaatcgacggagttttcccacctactgccaacaaaaaagtttggagtgcctccaccccggtaccaagttcttgaacaacggcacatgcactgccgaggggaagtttagtgtgtcgctaaaacatggaaacactgattcagagggaattgtagaggtgaagctcgtggatcaagacaaaacgatgtttatttgcaagtcaagctggtccatgagagaggcaaacgttgcctgccttgacctaggcttccagcaaggcgctgatactcagcgacgtttcaagctcagcgatttatctatcaactcaaccgaatgcctgcacgtgcactgtagaggattggagactagtctcgccgagtgtacctttaccaagaggcgtacaatgggataccaggactttgcagatgtcgtgtgctacacacagaaggccgactcacccatggacgactttttccaatgcgtcaacggcaagtacatcagtcagatgaaggcctgcgacggtatcaatgactgcggcgaccaaagtgacgagctctgttgtaaagcctgccaggggaaggggttccattgcaaaagtggcgtttgcattccaagccagtatcagtgcaacggagaggttgactgcatcaccggggaggatgaggtcggctgcgcagcattcgcggaactctgcatcgaggagacagagattttgactgccgatatggatgctgaaagacgacgcattaagtctttgcttccaaagctgtcctgcggagtgaagaatcgtatgcacattcgacgaaaaagatag

SEQ ID NO: 219129 - DNA, 1134 bp, Artificial Sequence
  Description of Artificial Sequence: Synthetic coding sequence
atgaagctgttacatgtgttcctgctctttctttgcttccacttacgcttctgcaaggtgacgtacaccagtcaggaggatttagtcgagaagaaatgcctcgcgaaaaaatatacgcacctgagttgcgacaaggtcttctgccaaccctggcagcgctgcattgaaggcacttgcgtgtgtaagctgccttatcagtgccccaaaaatgggaccgccgtatgtgccactaatagaagaagttttcctacttactgccagcaaaagagtcttgagtgtctccatcctggcaccaagttcctgaataacgggacctgcaccgctgaaggaaaattttctgtgagtcttaagcacgggaataccgactccgaggggatcgttgaggttaagcttgtagatcaggataaaaccatgttcatatgtaaatcttcttggagtatgcgagaagccaatgtggcctgcctggacctggggttccaacagggggcagatacccagagacgttttaaactctctgatctcagcataaattccaccgagtgccttcacgtacactgtcggggtttggaaacgtcattagccgaatgcacatttaccaaacggcgtactatgggttatcaggatttcgcagatgtggtgtgctatacccagaaggctgattcccctatggacgacttctttcagtgtgtgaatggaaaatacattagtcagatgaaggcgtgcgacggcatcaacgattgtggagatcagtctgatgagttgtgttgcaaagcctgccagggtaaaggcttccactgcaagagcggggtttgcatcccttcacagtaccagtgtaacggtgaggtggactgtataaccggcgaggacgaggtcgggtgtgctggttttgctagcgtgacccaagaggagactgaaatactgacagccgatatggacgccgagcggcgtaggatcaagtccctgctgcctaaacttagctgtggggtcaagaatcgaatgcacattaggaggaagcggatagtcgggggaaagcgagcacaattaggaaaaatgaagcagatcagtctcgatatctttaaaggcttacaccgggtctacgctattctcgagttctgttgtattattttaaagtag

SEQ ID NO: 219130 - DNA, 405 bp, Artificial Sequence
  Description of Artificial Sequence: Synthetic coding sequence
atggagttcgtcatgaagcaagctctgggcggtgccaccaaggacatggggaagatgttgggcggagacgaagaaaaagatccagatgctgctaaaaaagaggaagaacgccaagaggcactgcggcaggccgaagaggaaaggaaggccaaatacgcaaagatggaagccgaaagggaagccgtgagacaggggattcgagacaaatacggcatcaaaaaaaaagaagagcgcgaggccgaggcccaggcggctatggaagccaacagcgagggctccctcacacgacctaagaaagcaatcccaccaggctgtggcgatgaagtcgaggaagaagatgagagcatcctggacacggtgatcaaatacctgcctggccctctacaagacatgctgaaaaagtag

SEQ ID NO: 219131 - DNA, 405 bp, Artificial Sequence
  Description of Artificial Sequence: Synthetic coding sequence
atggatttcgtaatgaagcaggccctaggaggagccaccaaagatatgggcaagatgttgggaggcgaggaggaaaaagatcccgacgcacagaagaaagaggaagaacggcaggaagccttgcggcagcaggaggaggagagaaaagccaagcacgctaggatggaggctgaacgggagaaagtccggcagcaaattcgtgacaaatatggtctcaaaaaaaaggaagaaaaagaggcagaggagaaggccgctctagagcagccatgtgagggcagtctgacccgaccaaaaaaggcaatccccgctggatgtggtgacgaagaagaagaagaggaagaatctattctggatacggtacttaaatacctgcctgggcctcttcaggatatgttcaagaagtag

SEQ ID NO: 219132 - DNA, 405 bp, Artificial Sequence
  Description of Artificial Sequence: Synthetic coding sequence
atggattttgtgatgaagcaagctctaggaggcgcaaccaaagacatggggaagatgctcggcggagaagaggaaaaagatccggacgcgcaaaagaaggaggaggaacgccaagaggcactgagacagcaagaggaggagcggaaggccaaacacgcgcgaatggaggctgaaagagagaaagtgagacagcaaatcagggacaagtatggactcaagaagaaggaggagaaagaagccgaggaaaaggcagcattggagcagccatgtgaagggtctctgactcggccaaaaaaggccattcccgctggttgcggtgacgaggaggaggaggaagaggaatctatactcgacactgtgctcaaataccttcctggaccgctacaggacatgtttaaaaaatag

SEQ ID NO: 219133 - DNA, 555 bp, Artificial Sequence
  Description of Artificial Sequence: Synthetic coding sequence
atggactttgttatgaagcaggccctcgggggagccactaaggacatgggaaaaatgctcggaggagaggaggagaaagaccctgatgcccaaaagaaagaggaggagcggcaggaagcactgcggcagcaagaggaggaacggaaggctaaacatgccaggatggaagctgagagagagaaagtgcgccagcagatccgggataagtacggcttgaaaaaaaaggaagagaaagaagctgaggaaaaggctgcattgagagggcgaggcggaggaggcaggggcgagcaccccggacatggggcacaaatcccggcacgcgctgcagccggtcacgttcaggaagtgacgcgaccgccagctcccgcatattcaacttgctattacttcttcctggtgctgtcatttttgtttataaggctttccctcaatagcgagggcgagaacttaagctggcccctgcctctttttcccggtcagggactgctcccgctgtcaagtccatcccacctgccctccagccaagggatccacctccacccgacccctaagtag

SEQ ID NO: 219134 - DNA, 234 bp, Artificial Sequence
  Description of Artificial Sequence: Synthetic coding sequence
atggacttcgtgatgaaacaggccttgggtggagcaaccaaggacatggggaaaatgctcggaggtgaggaagagaaggatccggatgctcagaaaaaagaagaagaacgccaggaagctctgcgacagcaagaagaggagcgcaaagcaaaacacgctcgtatggaggccgagcgagaaaaggtgcgccagcagattcgagataagtacgggttaaaaaagaaagaggagtag

SEQ ID NO: 219135 - DNA, 336 bp, Artificial Sequence
  Description of Artificial Sequence: Synthetic coding sequence
atggatttcgtgatgaaacaggcactgggcggtgcaacaaaagatatggggaagatgctggggggtgaagaggagaaggacccagatgcacagaagaaggaagaggaaagacaagaggctctgcgacagcaggaagaggagcgtaaagcgaagcacgcacgcatggaagctgagcgggagaaggtgcgccagcagattagagataaatacggcctaaagaagaaagaagaaaaagaagcagaagagaaggctgctctggaacagccatgtgagggatccctgacccggcctaaaaaagccatacctgccggatgcggggacgaggaagaggagtag

SEQ ID NO: 219136 - DNA, 360 bp, Artificial Sequence
  Description of Artificial Sequence: Synthetic coding sequence
atggactttgtaatgaaacaggctctaggcggagccacgaaggatatgggaaaaatgttaggaggggaggaggagaaggatcctgatgcgcagaaaaaggaagaagagaggcaggaagcgctgcggcagcaggaagaggagaggaaggcaaagcacgcaagaatggaagcggaacgtgagaaggtgaggcagcaaatacgggataagtatgggcttaaaaagaaagaggagaaggaggcagaggaaaaagccgctttggagcaaccttgtgaggggagcctgacgaggcccaagaaggccatccccgctgggtgtggggacgaggaggaggaagaggaggagtcaatattagatacatag

SEQ ID NO: 219137 - DNA, 114 bp, Artificial Sequence
  Description of Artificial Sequence: Synthetic coding sequence
atggatttcgttatgaaacaggctctgggcggagctacgaaggacatggggaagatgctgggtggcgaagaggagaaggacccagacgctcaaaaaaaggaagaggaacgttag

SEQ ID NO: 219138 - DNA, 405 bp, Artificial Sequence
  Description of Artificial Sequence: Synthetic coding sequence
atggatttcgtaatgaagcaggctttgggcggtgctaccaaagacatggggaagatgctggggggagaagaggagaaagaccccgatgcccaaaaaaaggaggaagaaagacaggaagcacttcgtcagcaggaagaggagcggaaagccaaacacgcaagaatggaggccgagagagagaaagtcagacaacagattagagacaagtacggccttaagaaaaaggaagagaaagaagccgaagagaaagcggcactggaacagccttgtgaaggttcattgactagaccaaaaaaggcgatacctgcagggtgcggcgacgaagaggaagaggaggaggagtctatcctggacaccgttctgaagtacctgcccggtccattacaggatatgttcaaaaagtag

SEQ ID NO: 219139 - DNA, 21 bp, Artificial Sequence
  Description of Artificial Sequence: Synthetic coding sequence
atggactttgtgatgaaatag

SEQ ID NO: 219140 - DNA, 2943 bp, Artificial Sequence
  Description of Artificial Sequence: Synthetic coding sequence
atggccacggcggctaccagccctgcactgaaaaggttggatctcagggatccagcagccctatttgaaacacatggggctgaagagattcgtggcttagaacggcaggtcagggccgagattgaacacaagaaggaggagctgaggcagatggttggggagcggtacagagacctgattgaggccgctgatacaatcggccagatgaggcggtgtgctgtaggtctggtggatgcagttaaggccaccgaccagtattgcgctagattgaggcaggcagggagcgccgctcctaggcctccgagggcgcaacagcctcagcagccctctcaggagaaattctattcaatggccgctcagattaagctgttgctcgaaattcctgaaaaaatttggtcctcaatggaggcctcgcagtgcttacacgctactcagctatatttgctttgctgccacctgcactctctgctccagctggacagctctagctcgcgctactcacctgtgctcagcagattccccatacttattaggcaagttgccgcagcctcccattttcggagcaccattctgcatgagagcaaaatgctgttaaaatgtcaaggcgtctccgaccaagccgtagctgaagccctgtgtagcatcatgttgcttgaggaaagttcaccaaggcaagcactgaccgatttcctcctcgcccgaaaagctaccattcaaaagctgctcaaccagcctcaccatggtgccggaattaaagcgcagatttgtagcctggtggaactgcttgccaccacgctgaagcaagcccacgctcttttctatacattgccagaaggcctgttgcctgatccggcactgccttgcggactgctcttctccactttagaaactattactggccagcacccagcagggaaaggaactggggtccttcaggaagagatgaaattgtgctcttggttcaagcacctgcccgctagcattgtggagttccagccaacactccggacattagcacaccctattagccaagaatacctcaaggacacacttcagaagtggatccatatgtgtaacgaggacattaaaaacggcataaccaacttgctgatgtacgtcaagagcatgaagggcctggctggaattcgagacgctatgtgggagctgctaactaacgagtcgactaatcactcatgggacgtgctctgtcggcgactgttggagaagcctctcttgttctgggaggacatgatgcagcaactgttcctggatcggctccagacccttactaaggaggggtttgacagcatcagttcctcatccaaggagttgttagtgtccgcactgcaggagctggagtcgagtacctccaattccccttccaataagcatattcacttcgaatacaatatgtctctgtttctttggtcagagtcgcctaatgacctcccttcggatgcagcttgggtgagtgttgcaaatagagggcagtttgcatcatcgggcctgtcgatgaaggcacaagccatcagtccctgcgtccagaacttttgttctgcccttgactccaaattgaaggtgaagctggacgacttgctggcatatctgccatccgacgactccagcttgcctaaggatgtgtctcctacccaggccaaatctagcgcgtttgacagatacgctgacgccggaaccgtgcaggagatgctgcggacgcagtcagtcgcctgtataaagcacattgtcgactgcattagagccgagctgcagtcaatcgaagaaggtgtacaagggcagcaagatgcccttaatagtgcgaaactgcactcagtattatttatggctaggctgtgtcaaagcctgggcgagctatgcccccacctgaagcagtgcatattggggaaatccgaatccagtgagaaaccagcacgcgaatttcgagccctgagaaagcaggggaaagtgaagacacaggaaatcattcccacacaggcaaaatggcaggaagtgaaggaggtcctattacagcagagtgtgatgggttatcaagtgtggtctagtgcagttgtcaaagttctcatccacggattcacccagagtttgcttctggatgacgcagggtcagtgttggccactgccacctcatgggatgagctcgaaattcaggaggaggccgaaagcggaagcagcgtgacctctaaaatcagactgcccgctcaaccctcctggtatgtgcagtcgtttctgtttagcttatgtcaggagatcaacagggtgggcggacatgcgctgcccaaggtcacactccaagaaatgttgaagtcttgtatggttcaggttgttgccgcttatgagaagctctcagaggagaagcaaatcaaaaaggagggcgcattcccggtgacccagaacagagccctgcaacttttgtacgacctgcgatacctgaacatagtccttacagccaaaggagacgaagttaaatccggacgatccaaaccagactcaagaattgaaaaagtcaccgaccatctggaagcactgatcgatccgtttgatttagatgtatttacaccacatctgaacagcaatctgcacagactcgtccagcggacatccgtcctgttcggtcttgtcaccggaacagaaaaccagctcgcaccacgaagctctaccttcaattcacaagaaccacataacattttgcctctcgcctccagccagatccgattcggattgcttcccctgtccatgacaagcacacggaaggctaaaagcacgcgtaacatcgagacaaaggctcaagtcgtgcctccagcaaggagcaccgctggtgatccaaccgtccccggatccctgttccgccaactggtctctgaggaggataacaccagtgctcccagcctctttaagcttgggtggctcagttcaatgaccaagtag

SEQ ID NO: 219141 - DNA, 2823 bp, Artificial Sequence
  Description of Artificial Sequence: Synthetic coding sequence
atggccacagctgccacttctcccgctcttaagaggctggatctaagagatcccgctgccctgtttgagactcacggtgccgaggagatcagaggcttggaaagacaggtgagagcagaaatcgaacacaagaaggaggaactaagacagatggttggtgagaggtatagggacttgatagaggccgcagacacaatcggccagatgcggaggtgtgctgtcggactggtggatgccgtcaaggcaacagatcaatattgcgcgaggcttcgccaggccggtagcgccgcacccaggcccccacgcgctcaacaacctcagcagccctcacaggaaaaattctatagcatggctgcgcaaattaagctgctgctagagatcccggaaaagatctggagtagcatggaggctagccagtgcttgcacgcaactcaactgtacctgctttgctgtcacctgcacagtctgctccagctggattcctctagttctaggtattctcctgtactatcacgctttcccattcttataaggcaggtagcagcagcaagccattttcggagcacaatattgcatgaatctaagatgctgctgaaatgtcaaggggtcagcgaccaggccgtagcggaggctctgtgctccattatgttgcttgaggaaagctccccacgtcaggctcttaccgattttctgcttgcacgcaaagctaccatacagaagttactgaatcagccccaccacggtgcagggatcaaagcccagatctgctccctggtggagctcttggcaaccacactgaagcaggcgcatgcactattctataccctacctgaaggcctgctgcccgatcccgctctgccctgtgggctcctgtttagtacactcgagaccataacaggtcagcaccctgcaggaaagggtactggcgtactgcaggaagaaatgaagctgtgcagctggttcaagcacctccccgcttccattgtcgagttccagcccacccttcggaccctcgcacaccccattagccaggagtatctgaaggacacactgcaaaagtggattcacatgtgtaatgaagatatcaagaatgggatcactaacctgctaatgtacgtgaagtctatgaagggactggctggcatcagggatgccatgtgggagcttctcactaacgagtccacgaatcattcctgggatgtattatgtaggcgccttctggagaagcccctgttattctgggaagacatgatgcagcaactgtttctagatcgactacagaccctgacgaaggaagggttcgatagtatttccagctcctctaaagaactgctggtttcggctttacaggagcttgagtcctcaacctccaacagtccatcaaataagcacattcatttcgagtacaatatgtctctttttctgtggtcagaaagccccaacgacctgcctagcgatgcagcctgggtgtctgtggccaataggggtcagttcgccagcagtggcctgtcaatgaaagctcaggcgatctctccgtgtgtgcagaatttctgctcggctttagattccaagttgaaagtcaaattggatgatctactcgcctatctgccgagcgacgattccagcctgcccaaagacgtttccccgacacaagccaagtcttccgctttcgatcgatacgccgacgccggtactgttcaggagatgcttcgcacacaaagcgtcgcctgtattaaacatatcgtggactgtataagagccgaactccagtccatagaagagggtgttcagggccagcaggacgccctgaactctgctaagctgcatagtgtgttgtttatggcaaggttgtgtcaaagtctcggggagctgtgtccccacctaaaacagtgtatcctgggtaaaagtgaatcttctgaaaaaccagccagagaattccgggctctgcgcaagcagggcaaagtcaaaactcaggagatcatacctactcaggcaaagtggcaggaagttaaggaagtcctgctacagcagtcagtcatgggatatcaggtttggtcaagtgcggtcgtcaaggtgttaatacatggctttacacagtctctcttgctggacgacgccggttctgtgctggccacagccactagctgggatgagctggagatacaagaggaagcagaaagtggctcatctgtgacctccaaaattaggctgcctgcccaaccatcttggtacgtccagtcctttctcttttctctttgtcaggagatcaatcgagtcggagggcacgctcttcccaaggtaaccctgcaggagatgctgaaaagttgtatggtgcaggtcgtggcagcatacgagaagctcagcgaagaaaagcagatcaaaaaggagggggcttttccagtgacccagaatagggcactgcagcttctgtacgatctgcggtacctgaacatcgtcttaacagcaaagggtgacgaggtcaagtccgggagatccaagccagactctcgaatagaaaaagtaaccgatcatttggaagccctaatcgatccttttgatctggacgtgttcacacctcatttgaactccaatctgcatagacttgtccagaggacaagtgttctcttcggattggttaccggcaccgaaaatcagctggcccctcggtcatcaacgttcaatagccaggagccacacaatatcctgcctctcgcctcatcccagatccgttttgggttgcttccgctctcaatgactagtaccagaaaggcaaaatcgacccgcaacatcgagaccaaggcccaatatgatgcgaattgctag

SEQ ID NO: 219142 - DNA, 2214 bp, Artificial Sequence
  Description of Artificial Sequence: Synthetic coding sequence
atggagaaaagcaggatgaacctgcccaaggggccagacacgctgtgcttcgataaggatgagttcatgaaggaggatttcgatgtcgatcactttgtgtccgactgtcggaaacgcgtgcagctcgaagagttgagagatgaccttgagctgtactataagttgctcaagacggccatggtggagctgatcaataaggactatgcagattttgtaaacctgtctactaatctggtcggaatggacaaggctcttaaccagctttccgtacccctgggccaattaagggaagaagtcctctctctgaggagtagcgtgtcagaggggattcgcgctgtcgatgagcgtatgtcaaagcaggaagacataagaaagaagaaaatgtgcgtcctgcgattaatccaggtgattaggtcggtggagaagattgagaagattctgaatagccagtcaagcaaagaaacatctgcccttgaagccagctcacccctgctcactgggcaaattctggaaaggattgctaccgagtttaatcagctacaattccacgctgtgcagagcaaggggatgcccttgctcgataaggtccgaccccgtattgccggtatcactgcaatgctgcagcagagccttgaaggtctgcttctggaaggtttgcagacctccgacgtcgacatcatccgccattgtctgaggacctacgccacaatcgataagaccagggacgcagaagcactggtgggccaggtgctcgtaaaaccatatattgatgaggtgattatcgaacagttcgtggagtctcatcctaatggcttacaagtgatgtacaacaagctcctggagtttgtgccccatcattgccggctgctgagagaggtgacaggcggtgcgatttcctctgaaaaaggcaatacagtgcccggatacgacttcttggttaattccgtgtggcctcagatcgtccagggccttgaagagaagctgccctcgctctttaatcctgggaaccctgacgcattccatgagaagtatacaataagtatggatttcgtgcggaggttggagcgccagtgcggcagccaggcaagtgtgaagcgactgcgagcacaccctgcataccactccttcaacaaaaagtggaacctgcccgtgtatttccagattcgttttcgagagatcgctggatctttagaagccgctctgaccgacgtccttgaagacgccccagctgagtccccttattgtctgttagcgagtcatcgcacctggagttccttgcgcaggtgttggtcagatgagatgttcttgccactgttggtccatcgcttgtggcggctgacgttacagatcctagcccgttactctgtgtttgttaacgagctaagcctccgccctatttcaaacgaatcccctaaagaaatcaaaaagccccttgtcaccggatctaaggaaccatccatcacacagggcaatactgaggatcaagggtccggaccctccgaaacgaagcctgtcgttagcatcagcaggactcagcttgtctatgtcgtcgccgacttggacaaactgcaggaacagctgccggagttactggagatcatcaaacccaaattagagatgattgggtttaagaactttagctccataagcgccctcgaggactcccagtcctcgttctctgcgtgcgttccttcactcagctccaaaataatccaggatctgtcagattcctgctttggatttcttaagtccgctctggaggtccccagactctacaggcggacaaataaggaggttccaacgactgcatcttcctacgtcgacagtgcacttaaacccctgtttcagttgcagtccgggcacaaggataagctgaagcaggcaattatccaacaatggttagagggcactctgagtgaatcaacccacaaatactatgaaacagtgagcgatgtgctgaactcagtgaaaaagatggaagagtccctgaagcgtcttaaacaagcacggaaaacaacccccgcaaatcctgttggtccaagcgggggaatgtctgacgacgataagatcagattacagctcgcactggacgtggagtacctgggagagcagatccagaagcttggactccaggcctccgatatcaagtccttctcggcccttgcagagctggtggctgccgctaaggaccaggccactgcagaacagccgtag

SEQ ID NO: 219143 - DNA, 2217 bp, Artificial Sequence
  Description of Artificial Sequence: Synthetic coding sequence
atggagaaaagccgcatgaatctgcccaaaggccctgataccttgtgctttgataaggacgaattcatgaaggaagacttcgacgtggatcactttgtgtcagattgtcggaagcgcgtccagctagaagaactgcgtgacgacctggagctgtattacaaactcctcaagaccgccatggtcgagctgatcaataaggactatgccgattttgtcaacttatctaccaacttagttgggatggacaaggccttgaatcagttgtcagtgcctttagggcagctgagagaggaggttctgagcctgagatcttctgtctccgaggggattcgagctgtcgatgagcgaatgagcaagcaggaggacatcagaaagaagaaaatgtgtgtcctgaggctcattcaggtcattcgaagtgtggaaaagatcgaaaaaattttgaacagtcagtctagcaaagagacttcagcattagaagctagcagcccattattaacaggccagattctggagaggattgctaccgaatttaatcagctccagttccatgccgtgcaatcaaagggtatgcccctgctcgacaaggtgcggcctcgaatcgctggcattactgccatgctgcaacagtcattagagggtctgctcttggaggggctgcagaccagtgatgttgacatcattagacactgcctccgcacctacgccaccatagacaagacccgcgatgccgaagccctcgtgggccaagtgctcgtcaaaccgtacattgacgaggtgatcatcgagcaattcgtagaatcacatccaaatgggttgcaagtgatgtataacaaattgctcgagttcgtccctcatcactgcagacttctcagagaagtgaccggcggagcaatttcatccgagaagggaaatactgttcccggatacgacttcctggtcaacagcgtttggcctcagattgtacaaggattggaagagaaactaccaagcctgtttaaccctggtaatcccgatgcatttcacgagaagtataccatatctatggatttcgtacgtagattagagcggcagtgtggcagtcaggcctctgtgaaaagacttcgtgctcacccggcatatcattctttcaacaaaaagtggaacctgccggtctactttcagatacggtttagggagattgccggttccctcgaggctgcgctgaccgacgttctcgaggacgccccagccgagagtccatactgtctactcgcctctcatagaacgtggagttccctcaggagatgttggtctgacgagatgtttctgccattgctggtgcatagattgtggcgactgaccctccagatactggccagatatagtgttttcgtgaatgagctttccctgagacccatttcgaatgagtcccctaaggaaattaaaaagcccctggttactgggagcaaagagccaagtatcacacagggtaatacggaggatcagggctcagggcctagtgaaaccaagcccgtggtgtcgatctcccgaacccagttagtgtatgtcgtcgctgacctcgataagttacaggaacagctaccagagttactggaaattatcaaaccgaaactcgaaatgatcggcttcaagaacttctccagtataagcgccgcattagaggatagccagagttcattctccgcttgtgtgcctagcttgtcatctaagatcatccaggacctgagcgactcttgcttcggttttttgaagagtgctcttgaagtaccaagactctacaggcgcaccaacaaggaggtgcctaccaccgcttcttcttatgtggatagcgctctcaaacccctattccagttgcagtctggccacaaggataaactcaagcaagctatcattcagcagtggcttgagggaactctaagcgaatccactcataagtactacgagacagtcagtgacgttctgaacagcgtgaagaagatggaggagagcttaaagcgcctgaagcaggctcggaagactaccccagcgaatccagttgggccatcaggaggaatgtcagacgacgataagatccgcctccaacttgctctggacgtggagtatttgggagagcagatccagaagctggggctacaggcgagtgatatcaagtccttttccgcactcgcggaactcgtagccgctgcaaaggatcaagccacagccgagcaaccctag

SEQ ID NO: 219144 - DNA, 2040 bp, Artificial Sequence
  Description of Artificial Sequence: Synthetic coding sequence
atggttgaactgattaataaagactacgcagattttgtaaatctttcgactaacctggtggggatggacaaggctctcaatcagctgagtgtgcccctgggccagttgagagaggaggtgctctcgctgcgatcgagtgtgtctgagggaataagggctgtcgatgagcgtatgagtaagcaggaggacatcagaaagaaaaagatgtgtgtcctgagactcatccaagttatcagatcagttgaaaaaattgagaagatcctgaatagtcagtcaagtaaggaaacctcagcgctcgaagcttcatcccctctcctcaccggccagattctggaacgaatcgcaaccgaattcaatcaattgcagttccacgctgtgcagtcaaaggggatgcctctgcttgacaaagtgcggccaagaattgctggaatcaccgccatgttgcagcagagcctggaaggccttttgctcgaaggcctgcagacatctgacgtggatattattcggcactgtctgagaacatacgccactattgacaaaacacgcgacgcagaggctttggttggtcaagttttagtaaagccatacatcgatgaggtgattatcgaacaattcgtagaatcgcatcccaacggactgcaggtaatgtataataagctcttggaattcgtacctcaccattgtcgactgttgcgggaggttacagggggagccatttcatctgaaaaaggaaatacagtcccaggatatgattttctggtgaatagcgtctggcctcagatcgtccagggcctagaggaaaagctgccctccctgtttaatcccggaaaccccgatgcatttcacgagaaatacacaatcagtatggacttcgtgagaagacttgagcgtcagtgcggttcacaggcgtcggtgaagcgattgagggctcatccagcctaccatagctttaacaagaaatggaaccttcccgtctattttcagattcgttttagagagatagcaggatctctggaggcagctctgacggatgtgctggaagatgcccctgcagagtctccatactgcctgctagcctcccatcggacctggtcgagcctacggagatgttggagcgatgagatgttcctgcccctgttggtgcatcgcctgtggcggctgacattgcagattctcgctaggtactcagtatttgtgaacgaactctccctccgcccaatctctaacgagtctcctaaggagattaaaaaacccctagttaccggcagcaaagagccctccatcactcaaggcaacacggaggaccagggatcgggtcccagcgaaactaaacctgtcgtatcaatttcaaggacccagcttgtgtacgtcgtagccgatctcgataagttgcaggaacagttacccgaacttctggagatcattaagcccaaactcgaaatgattggctttaagaacttctcatctatttctgccgcactggaggactcacagtcctccttctccgcttgtgttccaagcctcagtagtaagatcattcaagatctttctgatagctgttttggcttcctgaaatccgctttggaagtcccacggctgtacaggcggaccaataaggaggttccgacaactgctagcagctacgtcgactctgcattaaagcctctctttcagctgcagagtgggcacaaagacaagcttaagcaggccataattcaacagtggctggagggaactctttccgagtcgacccacaagtattatgagacagtctctgatgttctcaattccgtgaagaagatggaagaatctctgaaacgtctcaagcaggcacgcaaaactacacccgctaatcccgtcgggccatccgggggaatgtccgacgatgataagatcagactccagcttgctctcgacgtggagtatcttggcgagcaaattcagaaactgggtttgcaggcttccgacatcaaatcctttagtgcccttgcagaactagtggccgcagctaaagatcaggccacagccgagcagccctag

SEQ ID NO: 219145 - DNA, 1869 bp, Artificial Sequence
  Description of Artificial Sequence: Synthetic coding sequence
atgagtaagcaggaagacatccggaaaaaaaagatgtgcgtcttgcggctgatccaggttataagatctgttgaaaaaatagagaagattttaaacagccagtcgagtaaagaaacaagtgcgctcgaggcttcttctcctctactcacaggccaaattcttgagcgcatcgccacagagttcaaccagttgcagttccacgccgtccagtccaaaggcatgccacttctggataaggtaaggccccgtattgccggaattacagccatgctgcagcagagcctcgagggtctcctcttggagggcctgcagactagcgatgttgacattattcgtcactgcctcaggacatacgctacgatcgacaagactcgcgatgccgaagccttggtcggacaggtgctggtcaagccatacatcgacgaagttataatcgagcagtttgtagaaagtcaccctaatggactgcaagtgatgtacaataaactcctggagtttgtgccacaccattgccggctgcttagggaggtgaccggcggagctatatcctccgaaaaggggaacaccgttcctggctacgatttcctggtaaattctgtctggcctcagatcgtgcaagggcttgaagagaagctccctagcctgtttaatcccggaaacccggatgctttccacgagaagtatactatcagcatggatttcgtgagacgtctggagcgccaatgtggatcacaagcttctgtgaagcggctaagagcacaccctgcataccacagttttaataaaaagtggaacctcccagtatatttccagatccgatttcgagagattgccggttctcttgaggcagccctgaccgacgtgctggaggacgcccctgctgagagcccatattgcctcctggccagccacaggacctggagttcactccgtcgctgttggtcagacgaaatgtttctgcccctgctcgtacataggctctggaggcttactctccagatactggccagatattctgtctttgtaaacgagttatctttgaggccaatctccaatgagagtcctaaggagatcaaaaaacctctggtgacaggaagcaaagaacctagtatcacccaggggaatacagaggatcaaggatcagggccatcagaaactaaacccgtggtttccatcagcaggacgcaactggtgtacgtggtggcggacctcgataagcttcaagagcagcttcctgagctgctggagattatcaaacctaagctggagatgattgggttcaaaaacttcagctctattagcgcagcacttgaggacagccaaagttctttcagtgcatgcgtgcctagcctatcatctaaaattattcaagatttgtctgatagttgtttcggcttcctgaagtcagcccttgaggtgccgaggctttataggagaaccaacaaagaggtgcccaccacagcttcctcatacgtcgactccgctctgaaaccgctgtttcagctgcaatctggccacaaggataaacttaagcaggccataattcagcagtggctggagggaaccctttctgaatctactcataaatattacgaaacggtctccgatgtattaaattcagtgaagaagatggaagaaagcctcaaaagactgaagcaggcacgaaagaccacacctgccaatcccgtgggaccatcggggggtatgtcagatgatgacaagatccgcctgcagcttgctctggacgtggagtacctgggggagcaaattcagaaactcggacttcaggcatcagacattaaaagtttttccgctttggcggagctcgtcgccgctgctaaagatcaagccactgctgagcagccttag

SEQ ID NO: 219146 - DNA, 1284 bp, Artificial Sequence
  Description of Artificial Sequence: Synthetic coding sequence
atggggttcgccatggaggatactgaggatatctcccaaaaccacttcgggcatctgtgtatcttcaagtggggtcactggaaaaaggatctcaagtacactatcagtatggacttcgtccggaggctggagcgccaatgtgggagccaagcctccgttaaacgactgagggcccaccccgcatatcactcattcaataagaaatggaatcttcccgtgtacttccaaatacggttccgtgagatagcaggaagtcttgaagccgctttgacagatgtactggaagacgcacctgcggagagcccttactgtttgttggcaagccacagaacatggagctccctcagacggtgctggtcggacgagatgttcctaccgctgctagtgcatcggttatggcggttgaccctacagatccttgcgaggtatagcgtgttcgtgaatgagctttctctcagacccatatccaacgaatcaccaaaggaaataaaaaagcctttagtgaccggaagtaaagagccatctatcacacaaggaaatactgaggatcagggcagtggtccatccgagactaagcctgtagtttccatttctaggacacagctcgtatatgttgtcgctgaccttgacaagctgcaggagcagctccctgagctgctggaaataattaagccgaaacttgagatgatcggtttcaagaatttttcatccatctcagccgcactcgaggattcccagagttccttttctgcatgcgttccgtccctgagctccaagattatccaggacctatcagactcatgtttcggcttcctcaagagtgctctggaagtgcccaggctttaccggcgtacgaacaaagaggtgccaactactgcctcctcctacgtggatagtgcactcaaaccactattccagcttcagagtggccacaaggataagcttaagcaggcaatcatacagcagtggctggagggcacattgtctgaaagtacacataagtactacgagaccgtgagtgatgtacttaactccgttaaaaagatggaagagtctttgaaacgcttgaaacaggccaggaagaccactccagccaatcctgtaggtcctagcggcggaatgtcagacgatgataaaatcaggcttcagctggcgcttgatgtggaatatttgggagaacagattcaaaaacttggcctccaggcctctgacattaagtctttctccgccctagctgagttggtggccgctgctaaagaccaggcaacagccgaacagccatag

SEQ ID NO: 219147 - DNA, 2487 bp, Artificial Sequence
  Description of Artificial Sequence: Synthetic coding sequence
atggccgaggcagctttacttctcttaccagaggcagcagcggaacgcgacgcgagagaaaaattggccctgtgggacagaagaccggataccaccgcacctctcaccgatcgccagacggattccgtcctggaactgaaagcggctgctgaaaacttaccggtacctgcagagctgccgattgaggatctgtgcagcctgactagtcagtctttaccaattgaactaacttccgtcgtgcccgaaagcactgaggacatcctcctgaaaggttttactagtctgggcatggaggaagagagaattgagactgcccagcagtttttctcttggttcgcaaagctccagacgcagatggatcaagatgaggggaccaagtatcgccagatgagagactatctgagcggttttcaggaacagtgtgacgcaattttaaacgacgtaaactcagcactgcaacacctcgagagtctccagaaacaatacctgttcgttagcaacaagacggggacactacatgaagcctgtgaacagcttctgaaggaacagagcgagctggtggaccttgccgagaacatccagcagaaacttagctattttaacgagctcgaaacgataaacacaaaattaaactcccctacgctgtctgttaactccgatgggtttattccaatgctggcgaaactcgacgactgtataacttatatatcaagccatcctaactttaaggactatcccatttacctgctcaagtttaaacaatgtctgtcaaaggcactccacctgatgaagacttataccgtcaacactctccagacattgacaagccagcttctgaagcgtgatccctcctccgtgcctaacgccgataacgcattcacgctcttctacgttaagtttcgggcagcggctcctaaggttcgaaccctgatcgagcaaatcgaattaagaagcgagaagatccccgagtatcagcagctcttgaacgacatccaccagtgttaccttgaccaaagagagcttttattgggaccaagcatcgcttgtactgtggccgagttaactagccagaataaccgcgatcactgtgcccttgtgcgatccgggtgcgcgttcatggtccatgtgtgtcaggacgagcatcaactgtacaacgagtttttcaccaaacccacctccaaattagatgaattactcgagaaactgtgcgtgagcctctatgacgttttccgacctctgataattcatgtaatccacttagaaacactcagtgagctgtgtggcattctcaaaaacgaggtgctggaggatcacgtgcagaacaacgccgagcaacttggcgcttttgccgcaggcgtcaagcaaatgctggaagatgtgcaggaacgccttgtctaccgcactcacatctatattcagaccgacataaccgggtacaagcctgccccaggggatcttgcttatcccgataagctggttatgatggaacaaatcgcccaaagtctgaaagacgagcagaaaaaggtacctagcgaggccagtttctcagacgtgcacctggaagaaggagagagcaacagcctgaccaaaagcgggtccaccgagagtctcaatccgagaccacagaccacaatatctcccgctgacctgcatgggatgtggtacccgacggttcgcagaacccttgtgtgtctgtctaaattgtacaggtgcatcgaccgcgcagtctttcaaggactgtcacaggaagccctgtccgcatgtattcagtctctgctgggtgccagcgagagtatcagcaagaataaaacccaaatcgacgggcagttgttcctaatcaaacacctgctgattctgcgtgagcagatcgcacccttccacaccgaatttactattaaggagatctctttggacctcaagaagacccgggatgccgcattcaagattctgaatcctatgaccgtgcccaggtttttccggctgaattcaaataacgcactcatcgagtttctgctcgagggaacaccggagattagagaacattatcttgactcgaaaaaggacgttgacaggcatctgaagtcagcctgtgaacagttcatccagcaacaaacgaagctgttcgtggaacaacttgaggaatttatgactaaggtttctgcactcaagacaatggcctctcaaggcggacctaaatacactctgagtcagcagccctgggctcagccagcgaaggtgaatgacctagctgccaccgcctataagacaattaagactaaactacctgtgacgctccgtagcatgagcttatacctgagcaataaggatactgaatttattctgttcaaacctgttcgcaataatattcagcaggtgttccagaagttccatgctctgttaaaagaggaattttcccctgaggacatacagatcatcgcctgcccatccatggagcagctcagtctgctgttgttagtaagtaaatag

SEQ ID NO: 219148 - DNA, 2370 bp, Artificial Sequence
  Description of Artificial Sequence: Synthetic coding sequence
atgggtaccaaaatggcagacctggattcaccacctaagcttagcggagtccagcagccgtctgaaggcgtgggcggaggtcgctgctctgagatttccgctgaactcatcaggtccctaaccgaactgcaagagttagaagctgtctacgagcgcctctgcggcgaggaaaaggtggtggagcgagagctggacgcattgctggaacagcaaaataccatcgaaagcaagatggtgactctgcatcggatgggccctaatttacaactgatagaaggagatgctaaacagctggcgggtatgattacatttacctgcaacctggcagagaatgtgtcttccaaggtgcggcagctggacctggcaaaaaaccgcctgtatcaagctatacagagagccgatgatatcctcgatctcaagttctgtatggatggggtgcagaccgccttacgcagcgaagactatgagcaggccgcagcacatacacaccgttacctgtgtttagacaaaagcgtcatcgagcttagccgacagggcaaggagggctctatgatcgacgcaaacttgaaacttctccaggaagccgaacagaggcttaaggccatcgtggcggagaaatttgctatagcgactaaggagggggacctcccacaggttgaaagatttttcaaaatcttcccgctgctgggcctgcacgaagaggggctgcgcaagttttccgagtacctgtgcaagcaagtggctagcaaggctgaagagaacctgctgatggtcctgggcacagacatgtctgatcgcagggccgcagttatcttcgctgacaccctgactttattatttgagggaatcgcccgaatcgtcgaaactcaccagcccatcgtcgaaacatactatggcccaggcaggctgtacacattgattaaatatcttcaggttgaatgtgataggcaggtggagaaggtcgtcgataaatttattaagcagagggactatcatcagcagttccggcatgtgcagaacaatttgatgaggaattcaaccaccgaaaagatcgagcccagagaactcgatccgattctgactgaggtgacactgatgaatgctaggagcgagttgtacctgaggtttctgaaaaagcgcatctccagtgatttcgaagtgggagactcaatggctagcgaggaggtgaagcaggagcaccaaaagtgtctggacaagttactgaataactgtcttctctcttgcactatgcaggaacttatcgggctgtacgttacaatggaagagtattttatgcgagaaactgtgaataaggcagtagccttagacacctatgagaaaggccagcttacaagctctatggtcgacgacgttttttacatagtcaaaaagtgcatcggtagggctctctcctcctcaagcatcgattgcctctgtgcgatgatcaaccttgctaccaccgaactggaatctgattttcgagatgtcttatgtaataagctgcgcatgggctttcctgcgacaacattccaggacatccaacggggagtcaccagtgccgtgaatataatgcacagcagcttacagcagggcaagttcgatacaaaaggaattgagtccacagacgaagcaaaaatgagcttcttggttaccctgaacaatgttgaggtctgcagcgaaaacatcagtacactgaagaagactctagagagtgactgcacgaagttattcagccagggaatcgggggagaacaggcgcaggctaaatttgactcatgcttatccgatctggccgctgtgagcaataaattccgcgatctgcttcaggaagggctcaccgaacttaattcgaccgctatcaaacctcaggttcagccgtggatcaactccttctttagcgtctctcataatattgaggaagaagagtttaatgactatgaagcaaatgacccttgggtccagcaattcattttaaatctcgagcagcagatggccgagttcaaggcttcactctcaccagtgatctacgattctctgactggcctgatgacttctctcgtggctgtcgaattagaaaaggtggtgctgaaatctacatttaatcgcctgggtggactgcagtttgataaggaactgagatcgctcattgcctacctgacgaccgtcaccacctggaccattcgtgacaaatttgccagactgtctcagatggccactattcttaacctggagagagttactgagatactagattactggggcccaaactcaggcccactcacttggcggctgactcccgcagaggtacgtcaggtgctcgccttgcggattgactttcgctccgaggacattaagcggctgcgactatag

SEQ ID NO: 219149 - DNA, 2295 bp, Artificial Sequence
  Description of Artificial Sequence: Synthetic coding sequence
atggctgacctcgactcgccacctaagctgagcggagtacaacagccttccgaaggcgtcgggggaggtcggtgcagtgagatcagcgccgaactgattcgaagcctcaccgagctgcaggaattagaggccgtctacgagcggctgtgtggtgaggagaaagtcgtcgagagagaacttgacgcactgctcgaacaacagaatacaatagaatctaagatggtgacgctgcatcggatgggaccgaatctccaacttatagagggggatgctaagcagcttgccggaatgataacgtttacatgcaatttggccgaaaacgtgagctccaaagtccggcagctcgatctggccaagaaccgactttatcaagctatccagcgcgcagacgacatcttggaccttaaattctgtatggacggtgtccagacagcccttcggtcggaggattatgaacaggccgctgcgcatacccacagatatctctgcctagataagtcagtgatcgaattgagcagacagggcaaagagggttcaatgattgatgcaaacctgaaactccttcaagaggcagagcagcggctgaaagccatagtggctgaaaaatttgccatagcaaccaaagaaggagacttgccccaggtggaacgattttttaagatctttccgttgctgggattgcatgaggaggggctgagaaaattttcagagtacttgtgtaagcaagtggcatccaaagctgaagaaaatcttctaatggtgcttgggaccgatatgtctgataggcgcgctgccgtgatcttcgccgacactctgacgctactgttcgaggggattgcccgtatagtggaaacccaccagccaatcgtagaaacatactatggcccaggacgcttgtacacactgataaagtatttgcaggtcgaatgcgatcggcaggtggagaaagtcgtggataagttcatcaagcagagggattaccaccagcagttccgacacgtccagaacaacctgatgcgcaatagcaccacagagaagattgagccacgcgagctggatcccattctcacagaagtgaccctgatgaacgcaagatccgaattatacctccgatttctcaaaaaaagaatcagtagtgattttgaagtgggtgactcgatggcgtctgaggaggttaaacaggaacaccagaagtgcctcgataagctgcttaacaactgcttgctgagctgtacaatgcaggagctgatagggctgtacgtgaccatggaagaatattttatgcgggaaacagtgaataaggccgtggccctggatacttacgaaaaggggcagctcacctcatccatggtcgatgatgtgttctatatcgtcaagaagtgtataggacgtgcactctcctccagtagcatcgactgtctgtgtgccatgattaatttggcgacaacggaactagagtccgatttccgcgatgtgctctgtaataagctcaggatgggtttccctgctactacttttcaggatatccagcgaggggtaacctcagctgttaacatcatgcactcttcgctccagcagggtaagttcgatactaaaggtatagaaagtacagacgaggctaaaatgtccttcctatcagactgtacaaaactctttagccaggggatcggcggagaacaggcccaggcaaagttcgactcttgtttgtcagacctggcagcagtgtctaataagtttcgggaccttctgcaagagggactgacggagctgaattctaccgccatcaaaccccaagtgcagccgtggattaacagcttcttctccgttagccacaatattgaggaagaggagtttaatgactatgaggccaatgacccttgggtacagcagtttatcttgaacctggaacagcaaatggccgagttcaaagccagcctctcacctgtcatctacgattcactgacaggattgatgacgagcctggtggctgtcgagctggagaaggttgtgctgaagagtactttcaaccgcctcgggggtctgcaatttgataaagagcttagatccctaatagcctacctcacaacagtgactacttggacgatacgggataagtttgcacgcctgtcccagatggccaccattctcaatctagaaagagtgactgaaatacttgattattggggaccgaactccggacccttaacctggcgacttacccctgccgaagtgcgccaggtccttgctttgcgcatcgactttcgctcagaggacataaaacggctccgtttatag

SEQ ID NO: 219150 - DNA, 1014 bp, Artificial Sequence
  Description of Artificial Sequence: Synthetic coding sequence
atggccgatctcgactcaccccctaaactcagcggcgtccagcaaccttccgaaggcgttggaggaggcaggtgcagtgaaatctccgcggagctcattcgttcactcactgaactgcaggaactagaggccgtttacgagagactgtgcggggaggaaaaggttgtagagcgggagctggacgccttgttggagcagcagaatacaatcgagagcaaaatggtgaccttgcacaggatgggcccaaacctgcagctgatcgaaggggatgccaaacaactggcaggtatgatcacatttacttgtaacctagccgagaatgtatcgtctaaggtcaggcagctggacctggccaaaaaccgcctctaccaagccatccaacgcgcagatgatatactcgatctcaagttttgtatggacggcgtgcagactgctttgagatctgaggactatgaacaggcggcagctcacacacaccgatacttgtgcttggacaaatcagtaattgagctcagcaggcagggcaaggagggcagcatgatcgacgctaacctgaaacttctacaggaggctgaacagaggctgaaggcaatcgtcgccgagaagtttgcaatagcaacaaaggagggagatctgcctcaggtcgaaagattttttaagatttttcctttattggggcttcatgaggagggccttcgtaaattttctgaatatctttgcaagcaggtagcctccaaggccgaagaaaatctcctgatggttctgggtaccgacatgtctgatagacgtgcggctgtgatatttgccgatacattaacattactgtttgaggggatcgctagaatcgtcgaaacgcatcaacctattgtggagacgtactacgggcctgggcgactctacactctgatcaaatacctacaggtcgagtgtgataggcaggttgagaaggtcgtcgataagttcatcaagcaacgggactatcatcagcaaaacttcgtgttctctttcttttag

SEQ ID NO: 219151 - DNA, 1344 bp, Artificial Sequence
  Description of Artificial Sequence: Synthetic coding sequence
atgcgaaattccacgacagaaaaaatcgagccaagagagctcgaccctatcttgaccgaggttaccctcatgaacgcgaggagcgaactctatttgagattcctcaaaaaacgcatttcaagcgacttcgaggtgggggactctatggcgagcgaggaggtgaaacaagaacatcaaaaatgtctagacaaactccttaataattgtctgctctcatgtaccatgcaggagctgatcggcctctacgtgacaatggaggaatactttatgcgggaaactgtgaataaggctgttgcacttgacacttacgagaaaggacagttaacatctagcatggtcgatgacgtcttctacattgtcaaaaagtgcatcggacgtgcattgtctagctctagtattgattgcttatgtgcgatgatcaacctggcgaccaccgagctggagtccgactttcgcgatgtgctttgcaacaagctccgtatgggctttccagcaaccaccttccaagatattcagcgcggagttacttcagccgtgaacatcatgcactcctctcttcagcagggtaagtttgacaccaaaggaatcgagagcaccgacgaggcaaaaatgtccttcttggtcaccctgaataacgtggaggtgtgttcagagaacatctccacattaaaaaaaactcttgaatccgattgcactaagctgttttctcagggcatcggaggcgaacaggcacaggccaagttcgactcctgcctgagcgatcttgccgctgtgtcaaataaattccgcgaccttcttcaggaaggcctgaccgaactgaactcaacagctatcaagccacaggtacagccttggattaattctttcttttcggtcagccataacattgaggaagaagaattcaacgattatgaggccaacgacccgtgggtacagcagttcatcctcaacctggagcagcagatggccgagtttaaagccagtctctctccagtcatctacgactcccttacaggactgatgactagtctcgtcgctgtagagctcgagaaagtggtgcttaaatctacgtttaaccgtctgggaggcctgcagttcgacaaggaactgcggtctctgatagcctatctgactactgtgaccacttggaccattagagataagttcgcccgactgtcgcagatggccacaatcttaaatctcgaaagagtgaccgaaattttggactattggggcccaaacagcgggcctttgacatggcgcttaactccggctgaggtgaggcaggtcttagctctgcgcattgacttccggtcagaggacattaaacggctccggctgtag

SEQ ID NO: 219152 - DNA, 2583 bp, Artificial Sequence
  Description of Artificial Sequence: Synthetic coding sequence
atgggatgggtcggcggacgcaggagagatagcgccagcccaccaggcaggagtcggtccgctgctgatgacattaatcctgctcccgctaatatggagggagggggaggaagtgttgccgtagcgggtctgggggctcggggaagcggcgcagccgctgcgactgtgagggagctgctccaggacggatgttattctgattttctgaatgaggatttcgacgtgaagacgtataccagccaatccattcaccaagctgtgattgccgagcagttggccaagctggcccagggtatcagccaattagaccgagaactgcatctgcaggttgtagcccgacacgaggatctgctggcccaggctaccggaatcgagtccctggagggggttctccagatgatgcaaaccagaattggtgccctgcagggcgcagttgaccgaatcaaagccaaaatcgtggagccctacaataaaatcgtggctcgcaccgctcagttggccaggcttcaagtggcctgcgatctgctgagaagaatcattcgcatcctcaacctgtccaagcggctgcagggacaactgcagggaggctctcgtgaaatcactaaggccgctcagtccctgaatgagttggactatttgtcacagggtatagacctctccgggattgaggtgattgagaacgacctcctgtttattgcgcgagcccgactagaggtggagaaccaggccaagcgattactggagcagggtctcgagacacagaaccctacacaggtcggaacagcactacaggtattctataaccttggcacgttgaaggatacaattacaagcgtcgtggatggttactgtgcaacacttgaagagaatatcaattctgccctggacatcaaggtactgactcagccttcccagagcgccgtgcggggagggcctggtaggtctacaatgcctacacccggtaataccgctgcactgcgagccagcttttggactaatatggagaaactgatggatcacatatacgctgtctgcggccaagtgcaacaccttcagaaggttcttgcgaaaaaaagagaccctgtttcacacatttgttttatagaggaaatcgtcaaagacgggcagcctgagatcttctacacattttggaactctgtgacacaagctctaagttcacaatttcatatggctaccaattctagtatgttccttaaacaggcattcgaaggagagtaccctaaactcctgagactttataacgatttatggaaacgtctccagcagtacagtcagcacatacagggtaatttcaatgcaagcggaacaaccgacctgtatgttgacctgcagcatatggaggatgatgcgcaggacatcttcattcccaagaagccggactacgatccagaaaaagcactgaaagattcgctgcaaccttacgaggccgcatatctgagcaaatccttatcccgacttttcgatccaatcaatctggtgtttcctcccggtggcaggaacccccctagctccgatgaattggacggaatcattaagacaatcgcgtcagaattaaacgtggcggctgttgatacaaacctgactctcgctgtgtcgaagaacgtggccaagactattcaactgtactccgtgaaatctgaacagttgctgtcaacacaaggcgacgcatcccaggtcataggccctcttacagaggggcagagaaggaacgtcgccgtggtcaacagtctgtataagctacatcagagtgttacaaaggtcgtctcttctcagtcctctttccccctggccgctgagcagacaatcatctcagctctgaaggccattcacgcgttgatggagaacgctgtacagccgcttctgacttctgtgggcgatgcaatcgaggcaataatcatcacaatgcaccaggaggatttcagcggcagtctgtcctcatccgggaagcctgacgtaccttgtagcctttacatgaaggagctgcaggggtttattgccagggtaatgtcagattatttcaagcatttcgagtgtctggacttcgtgtttgacaataccgaggcaattgcacaaagggcagtcgaactctttatccgacacgcatcacttatccgtcctctgggagagggcggaaaaatgagactcgctgccgattttgctcagatggagctggccgtgggcccattctgccggagggtgagtgatctgggaaaatcttatcgcatgttgcgcagctttaggcccctgcttttccaagctagcgagcacgtggcaagttcacctgccttgggtgatgtgattcccttctcgatcatcattcagttcttgttcactagagcgcctgctgaactcaagagtcccttccagcgcgctgagtggtcccatacaagattttcacagtggctggacgatcatccgagcgagaaagatcgcttactgttaatccgaggagccctcgaagcctatgtgcagtcagtcagatcccgggaagggaaggaatttgcccctgtataccccattatggtgcagctgctacagaaggccatgtccgccctgcagtag

SEQ ID NO: 219153 - DNA, 2520 bp, Artificial Sequence
  Description of Artificial Sequence: Synthetic coding sequence
atgggttgggtgggaggccgacggcgagacagtgccagcccacccggaagaagcagatccgcagcagatgatattaatccagctccagccaacatggaaggcggaggcggatcagtggctgtcgctggcctgggagcacgaggaagtggcgcagccgctgctactgttcgcgagctcctgcaggatggatgctattccgatttcctcaatgaggacttcgacgtcaagacatataccagtcaaagcatccaccaggctgtcattgccgagcaactcgctaagcttgctcaaggaatcagccaacttgaccgggagctgcacttgcaggtggtagcacgccacgaggacctgctagcgcaggctacaggcattgagtcccttgaaggcgttctgcagatgatgcaaaccagaatcggtgccctccagggggctgtcgatcggatcaaggctaagattgtggagccctacaataaaatcgttgccaggacagcacagctggccagactgcaggtcgcctgtgacctactgagacgtatcatccggatcctgaacctatctaagcggcttcaggggcaactgcagggagggagccgcgaaattacaaaagctgcccagagcctcaacgaactggactatcttagccaggggatcgacctgtcaggtatcgaagtgatcgagaacgacctgttatttattgcaagagccaggttagaggtggagaaccaggccaagcggctgctggaacagggactggaaacacagaatcccactcaagttggcacagccctgcaggtattctacaacctgggcaccctgaaggacaccatcacctctgtggtggatgggtactgtgccactctcgaggaaaatatcaactccgccttggacatcaaagtacttacccagccaagccagtctgcggtgagaggcggacccggacgctccaccatgcctacacctggaaataccgccgcactgcgggcaagcttttggacgaatatggagaaactgatggaccatatatatgctgtatgtggtcaggtgcagcaccttcagaaggtgttggcaaaaaagcgcgatcccgttagccatatatgtttcatagaggaaattgtaaaggatggccaacctgaaattttttatacattctggaactccgtaactcaggcccttagttctcagttccatatggccacaaattcatcaatgtttctcaagcaggcttttgagggggagtaccccaagctactgaggctttacaacgacctctggaagaggctgcagcagtactctcagcatattcaaggcaactttaacgcctcgggtactacggatctgtatgtcgacctgcagcacatggaggacgatgctcaggatattttcattcccaagaaaccagattacgacccggaaaaagccttgaaggacagcctgcaaccttatgaggcagcctatttgagcaagagcctgagccgactttttgatccaatcaatttggtctttccccctgggggtcgcaacccaccgtcatccgacgaactggatggtataatcaaaaccattgcctcagaattaaacgtggccgctgtcgataccaatctaacactggccgtgagcaaaaatgtagcaaagactatacagctgtattccgtcaagtctgaacaactcttatctacccagggtgacgcctcgcaggtcatcggccctctcacagagggtcagcggcgaaatgtggccgtggtgaacagcttgtataaactgcaccagtccgtcaccaaagctatccacgctttaatggagaacgccgtacagcccttactgacatccgtgggcgacgcaatagaagccatcatcatcaccatgcatcaagaggactttagcggaagcttgagttcctccggcaagccagatgttccgtgcagtctgtacatgaaagagctgcagggctttatagcaagagtcatgagcgattacttcaaacatttcgagtgtctggattttgtctttgacaatacggaagcaatcgcgcagagagcagtggaattgttcatacggcacgcttcactgatccggcctctgggcgaagggggaaaaatgagactcgcagctgactttgcccagatggaactcgctgttgggcctttctgcaggcgagttagcgatctgggtaaaagctaccgaatgcttcggtcgttcaggccccttttgttccaggcctccgaacatgtcgcctcttctcccgcacttggtgacgtgattcctttttctattattattcagtttcttttcacacgcgcacctgccgagcttaaaagcccgttccagagggccgagtggagccatacacgattctcccaatggcttgacgatcatccatccgagaaagataggctattgctcatcagaggagccctggaggcttatgtgcagagtgtgaggagtcgtgaagggaaagagtttgcacctgtgtaccctatcatggtgcagctccttcagaaagccatgtctgcattacagtag

SEQ ID NO: 219154 - DNA, 2472 bp, Artificial Sequence
  Description of Artificial Sequence: Synthetic coding sequence
atggggtgggtggggggaagacgacgggatagtgcctctccaccaggaaggagccgcagtgcggctgatgacattaatccagcccctgctaacatggaggggggaggcggaagcgtggccgtggctggcctgggggctcgcggttcaggagccgcagccgcaacggtccgggagctgctgcaggatgggtgttacagtgatttcctgaacgaagacttcgacgttaaaacttacacaagccagagcattcaccaagcggtgatcgccgagcagctagcaaaactggcccagggaatcagccagctcgaccgcgagctgcacctccaagtcgtggccaggcacgaggatctgctcgcccaggcgacaggaattgaaagtcttgagggggtgttacaaatgatgcagacacgcatcggagccttgcagggagcagtggaccgtatcaaggcgaaaattgtagaaccctacaataagatagttgctcgcacagcccaattagctaggttgcaggtggcgtgcgacttgctgaggaggatcatccgcatccttaacctgtctaagcgactccagggccagctgcagggcggttccagggagattacaaaagccgctcaatccctcaacgagctcgattacttgtcacagggcatagatctcagcgggattgaggtgatagagaacgatctgctgttcatcgccagagctcggcttgaggttgagaatcaagcaaaaagactactggagcagggtctggagacgcagaatcctacgcaagtcggtacggcactgcaggtgttctacaatctaggtacactaaaagatacgattacatccgtggtagatggctactgcgccaccttagaggagaacataaattcagctctcgatattaaggtcttaactcagcctagccagtctgccgtacgcggtgggccaggcaggtctaccatgcctacccccggaaacacagccgcattacgtgcctccttctggaccaacatggaaaaactgatggaccacatctacgccgtgtgcggacaagttcagcacctacaaaaagtcttggcgaagaagagggatcctgtgagtcatatctgcttcattgaagagattgtcaaagatggtcaaccagagatattttacacattttggaactctgttactcaggcgctcagttcacagttccacatggctaccaactcgtccatgtttctgaaacaggcatttgaaggggagtatccaaagctcctcaggctgtataatgacctttggaaaaggctccaacagtatagccagcacattcagggcaactttaacgccagtggaaccaccgatctgtacgtagatttacagcacatggaagatgacgctcaagacatcttcattccaaagaaacctgattacgatcctgaaaaagcgctaaaggattccctgcagccttacgaggccgcatacctcagcaagagcttgtccagactgttcgaccccattaacttagtgtttccaccagggggaaggaatcctccttcaagcgatgaactagacggcatcattaagacgattgcttctgaacttaacgttgctgctgtagataccaatttgaccctcgctgtgtccaaaaatgtggcgaagacgatccaactttatagtgttaaaagcgaacagctcttatctactcagggcgatgcctctcaggtgattggccctctgacagaggggcagcggagaaacgtggcggttgtgaactcgctttacaaactccatcagagtgtaacaaaagttgtatcctcccaaagtagcttcccccttgcggctgaacagaccattatctcagccctgaaagccattcatgcactgatggagaatgccgtgcagcccctgctgacctctgtgggagatgctatcgaggccatcattatcactatgcatcaggaggactttagtggctcactgtcctcttccgggaaacctgatgtgccgtgcagcctgtacatgaaggaacttcaaggctttatcgcacgggtgatgagcgattacttcaaacattttgaatgtcttgatttcgtgttcgacaacacagaggctattgctcagagggcggtagagctgttcatcaggcacgccagcctcatccgccctctaggagagggaggaaagatgcgcctggccgctgacttcgcgcagatggaactagctgtaggccctttttgtaggcgcgtctccgacctcggaaagtcttaccgaatgttgaggagctttaggcccctactgtttcaggcaagcgagcacgtggcatcatcccctgctttaggtgatgtcataccgttttctattatcatccagttcctcttcaccagagctccggcagaactgaaaagtccttttcagagggccgagtggagccatactcggttctcacagtggctcgacgaccatccatctgagaaggatcggctgctgctcattagatag

SEQ ID NO: 219155 - DNA, 2067 bp, Artificial Sequence
  Description of Artificial Sequence: Synthetic coding sequence
atgcgtggcaggttcgcacatgcccagtactccagatgtctccgcggtccatgtctggccgaggtcgcagcaggcggaggcacgcgatccgctatggctgaaggatctggagaggtcgttgctgtcagcgccactggtgccgctaacgggctgaacaacggtgccggagggacaagtgccacaacttgtaaccctctctctaggaaactgcacaagatcttagaaacccgactggacaatgacaaagagatgttggaagcccttaaggcattgagtacattctttgtggaaaattctctcaggaccaggcgtaatctgcgtggcgatattgagcgcaagtctctcgccatcaatgaggaatttgttagcatattcaaagaagtgaaggaggagcttgagtccatttccgaggacgtgcaagccatgtccaactgttgtcaggacatgacctctcggctgcaggccgctaaagaacagactcaggacctgatagtgaaaactactaagctccagtccgagtctcagaagctggagatacgggcacaagtggcagatgccttcctgtccaaatttcaactaacctctgacgaaatgagcctcctgcgcggaactcgtgaaggaccgatcaccgaggactttttcaaagctcttgggagggtgaagcagatccataacgacgtcaaggttctgcttcgcacgaatcagcagactgccggtcttgagataatggaacaaatggctttgctgcaggaaacagcttacgaaagactctaccgctgggcgcaaagtgaatgtagaacgctgactcaggagtcctgtgacgtgtctccagtgttgacccaagctatggaggccctgcaggaccggcctgtcctgtacaagtatactctcgacgaattcgggaccgctcgacgttccacagtggtacgtggctttatcgatgccctcactagggggggacccggagggacaccacgccctatcgagatgcatagccatgacccactgcgctacgtcggggacatgttagcatggcttcaccaggcaactgccagtgaaaaggaacatcttgaggcactgcttaagcatgtgaccacacagggcgtggaagaaaatatccaggaggtggtgggacatattacagagggggtgtgccgcccactgaaggtgcgaatcgagcaggtcattgtcgccgagcctggagccgtgcttctctacaaaatttccaatctgctaaagttttaccaccataccatctcaggcattgtgggtaacagcgccacggccctgctcactaccatcgaggaaatgcatttactgtccaaaaagattttcttcaattctttgtccttacacgccagtaagctgatggataaagtcgaactacccccacccgacctgggccctagctctgcactgaaccagaccttgatgctccttcgtgaggttttagcctctcatgactcttcagtggttccactggatgccaggcaggcggactttgtgcaggttctgtcttgcgtcctcgatccattgttgcagatgtgcaccgtgagtgcctcaaatttgggtaccgctgatatggccacatttatggtgaactccctctacatgatgaagaccacccttgcgcttttcgagtttaccgaccggagattggaaatgcttcagttccagatcgaagctcacctcgacaccttgatcaatgagcaggcttcctacgttctgacccgtgttgggctctcttatatttacaacactgtgcagcagcacaaacctgagcagggtagtctggcaaacatgcccaacttggacagcgtgacacttaaggcagcaatggtccaattcgaccgatatctgtccgccccagataacctacttatccctcaactaaacttcctacttagcgcaacagtgaaggaacagattgttaagcagtcgactgaacttgtctgtcgggcatatggggaagtgtacgccgctgtgatgaatcccattaacgaatataaggaccctgagaatatcttgcacagatcgccgcaacaggtgcaaactctgctgagctag

SEQ ID NO: 219156 - DNA, 1848 bp, Artificial Sequence
  Description of Artificial Sequence: Synthetic coding sequence
atggctgaggggtccggagaggtggtcgctgtcagcgccacgggggctgctaacgggcttaataatggtgccggagggaccagtgccacgacgtgtaaccccctgtcacggaagctgcataaaatcttggaaacaagactagataatgacaaggaaatgctcgaggccttgaaggccctgtctacattctttgtggaaaactcgctgcgaacccggcgaaatctccgcggagacatcgagaggaagagtctcgccatcaatgaagaatttgtgagcattttcaaggaagtgaaggaagaactggagtccatttccgaagacgtccaagccatgtcaaactgttgtcaggatatgacctctcgcctgcaggctgccaaggagcagacccaggacttaattgtcaagacaaccaagttgcaatccgagagccagaaactggaaattagagctcaagtagccgacgcctttctttctaagttccaacttacatcagatgagatgtctctactccgcggaacccgtgagggacccatcacggaagacttcttcaaggctctcgggagagtgaaacagatccacaacgacgtcaaagtgctcttacgcacaaatcaacagacagccggactggagatcatggagcagatggccctgctgcaggagactgcctacgagagactctatcgatgggctcagtcagagtgcaggacactaacacaggagtcctgcgacgtgagccccgtcctgacgcaagctatggaagctctgcaggaccgaccagtgctctataagtatacacttgatgagttcggcacagcgaggcgatcaactgtggtgcgaggattcattgatgcacttaccaggggcggacccggaggtacacccagaccaatagagatgcactcacacgaccctctacggtatgtcggcgatatgctggcatggctgcatcaggcaacagccagtgagaaagagcatctcgaggcacttctgaagcatgtcacaacacagggcgtggaggagaacatccaggaggtggtcggtcacattactgaaggtgtttgtagaccactaaaggtgagaatcgaacaagtcattgtggccgagccaggagcagtcctcctgtataagatcagtaatctcctcaagttctaccaccacacgattagcggcattgtaggaaattcagccaccgcattactaaccaccatcgaggagatgcacttgctgagcaagaaaatttttttcaacagcctttctctgcatgcctcaaaactgatggataaggtggagcttccaccccctgatctgggccctagttcagcactgaatcagacacttatgctcctccgggaagtgctcgcctcacatgattcctcagtcgtgccactggatgccagacaagcggattttgtccaggttttgtcttgcgtcctggatccacttctacagatgtgtaccgtgagcgcctccaacctgggcacggcagacatggccacatttatggtcaattctctatacatgatgaagactacgctggctttgttcgaatttaccgatcgccgactggagatgttgcagttccagatagaggcccacctggacacactcataaatgaacaagcgtcctacgtgctgacccgcgtgggcctctcatacatctataatacagtacaacaacataagcctgagcaggggtcactcgcaaatatgcccaatttagactccgtgaccctgaaagcagcgatggtgcagtttgaccggtacctaagtgctcctgataatctcctgataccccagcttaattttctgttgtctgcaacggtgaaacggcctcccaacggcccttag

SEQ ID NO: 219157 - DNA, 1974 bp, Artificial Sequence
  Description of Artificial Sequence: Synthetic coding sequence
atggctgagggcagcggggaggtggtcgctgtgtcagccactggcgcagctaacgggttgaataatggggcagggggaacctccgccaccacgtgcaatccactctcgcgaaagctccacaagattttggaaactaggctcgataatgataaggagatgctcgaggccctaaaagccttgagcaccttttttgttgagaactctcttcgaacacgtaggaacctaagaggcgatattgaaagaaaatcactcgcgatcaacgaggagttcgtatccatatttaaggaagttaaagaggaattagaatctatatccgaagacgtgcaggcaatgagcaattgctgtcaggacatgacaagcagactgcaggctgccaaggaacaaactcaggatctgattgtgaaaaccacaaaattgcaaagcgaatctcagaaacttgaaatcagggctcaagtggccgacgcctttctttccaaatttcagcttacttctgacgaaatgtctctgcttagggggactcgagaggggcctattacagaggacttttttaaagccctaggccgagttaagcagatccacaacgatgtcaaagtgctgctaagaacaaatcaacaaacggcagggttggaaataatggagcagatggcgctccttcaggaaacggcctacgaaagactatatcgatgggcccaatcggaatgtcggacactgacacaggagtcttgtgacgtgagtcccgtgcttacccaggcgatggaagctcttcaagacagacccgtgctgtacaaatacacgttagatgaattcggaacagcccgtaggagtaccgtcgttagagggtttattgatgctttaacaaggggcggaccaggtggaacaccacgacccatcgagatgcacagccacgatcctttacgctacgttggggacatgctagcgtggctgcaccaggcaaccgcgtccgagaaggaacacctggaagcactgttaaaacatgtgacaacccagggggttgaagagaacatacaggaggtagtcggccacatcaccgaaggggtgtgcaggccactgaaagtcagaatcgagcaggtgattgttgcagagcctggggcagtgctgctctacaaaatatctaacctcttgaaattctatcaccacacgatttccggtatcgtcgggaattcagcaaccgctctgctcactacgatcgaagagatgcacctgctctctaaaaagattttcttcaactcgctctctctccatgccagtaaactgatggacaaggtcgagctgccaccccctgacctgggtcccagttcagcactaaaccagactctcatgctgctgcgcgaggtcctagcctctcatgactcatccgttgtgcctcttgacgcgagacaggctgattttgttcaggtgctgtcttgtgtcctggacccactgctccagatgtgtactgtctccgcatcaaacctcgggaccgctgacatggcaacatttatggtgaactccttgtacatgatgaagactaccctggctttgttcgaatttactgaccggcgactcgaaatgctccagttccaaattgaagcccacctggatacactaatcaatgaacaggctagttatgttctgacacgtgttggcttgtcatatatctataatactgtgcaacaacataaacctgagcagggtagcctggccaacatgccaaatctggattcggtgactctaaaagcggcaatggtacaattcgaccgctacctctcagcccctgataatttgctgattccacaattgaatttccttctgtccgccactgttaaagagcagatcgtaaagcagagtacggagctggtgtgccgagcctacggcgaggtgtacgccgcagtgatgaaccctattaacgaatataaggatccagagaacatcctgcatagatccccacagcaggtgcagaccctattatcctag

SEQ ID NO: 219158 - DNA, 2313 bp, Artificial Sequence
  Description of Artificial Sequence: Synthetic coding sequence
atggattttagtaaatttctcgctgacgattttgatgtaaaggagtggattaacgcagcttttcgcgcaggatcaaaggaggctgcctctgggaaggccgatggccacgccgcaacgctggtgatgaaactacagttattcatccaggaagtaaatcacgctgtggaagagacgtcgcatcaggcactgcagaatatgcctaaggtattgagggatgtagaggccctaaagcaagaggcaagctttctgaaggagcagatgattctcgttaaggaagacatcaaaaagttcgaacaagatacctcacagtccatgcaagttctagtagaaatcgatcaggtaaaatcccgcatgcagctggctgccgagtcactgcaggaggccgataaatggtccaccctgagcgccgacatcgaagagactttcaagacccaggatattgcagtgatttctgctaagctgaccgggatgcagaactcactgatgatgctagtggacacgccagactacagcgaaaagtgcgtccaccttgaggccttgaagaaccgactcgaggctctcgcctctccccagatcgtagcagcttttacttctcaagccgtggaccaatccaaagtgttcgtgaaggttttcacagagatcgaccgcatgcctcagctcttagcctattactacaagtgtcataaggtgcagctcttggccgcatggcaggaactctgccagtccgatctgtctctcgatcgccagctgaccggactgtacgatgcgttgctgggtgcttggcacactcagatccaatgggccacacaagtctttcagaagccgcatgaggtcgtgatggtcctgttgatccagacgctcggcgctctcatgccttccttgccctcatgcctcagcaatggggtggaacgcgcaggccctgaacaggagcttacccgtctgttagagttttatgatgccactgcgcatttcgcaaaaggcttagagatggcacttttgcctcatcttcacgagcacaatttagtgaaggtgacagaactcgtggatgccgtctacgacccatataaaccctatcaactcaagtacggagatatggaagaaagcaacctcctcattcagatgtcagctgtccccctggagcatggcgaagtgatcgactgcgttcaagagttgtcgcactccgtaaataagttattcggactcgcctctgcagccgtcgatcgatgtgtaagatttactaatgggctgggaacatgcggcctgcttagcgcccttaagtccctgtttgctaagtacgtatcagattttaccagcaccctgcagtccatcagaaagaagtgtaagctcgaccacatacctcccaactccctgttccaggaggattggaccgcgtttcagaactctatccgcatcattgcaacctgtggcgagcttctgcgtcattgcggagactttgagcagcagctagccaaccggatcctgtccacagccggtaagtacctgagcgactcctgtagcccacgaagcctcgcgggatttcaagagagcatcctcacagacaagaagaatagcgctaaaaatccttggcaggaatacaattacctgcagaaagataaccccgctgaatacgcttccctcatggagatcctctatacgctaaaggagaaagggtccagcaaccacaacctgctggcagctcccagggccgcacttacacgcctgaatcaacaagcacatcagcttgctttcgacagtgtgttcctgcggattaagcaacaactactgctcatctcaaaaatggattcgtggaatactgctgggattggtgaaacgcttaccgacgagttgcccgctttttccttgacacctctcgagtatatcagcaacatcggtcagtacattatgtccctccctctcaatctggagccattcgtgacacaagaggatagtgcgctggagttggcactccatgctggcaagctgccatttccaccagagcagggagacgagctgcctgaactggataatatggctgataattggcttggcagcattgctcgtgctacaatgcaaacgtattgcgacgccattcttcagatccctgagctttccccacatagcgccaagcagttggcgactgatattgactacctcatcaacgtaatggatgccctaggcctgcaaccgtcaagaactttacagcatatcgttacgctgctcaagactaggcccgaggattacaggcaggtttccaagggtctgccaaggcgcttggccacaaccgtggcaactatgaggtctgtaaattactag

SEQ ID NO: 219159 - DNA, 1839 bp, Artificial Sequence
  Description of Artificial Sequence: Synthetic coding sequence
atggctaccgccgcaaccatcccttcggtggctaccgccacggcagcggctttaggcgaagtcgaggacgaaggtctcctggcctcattatttcgtgacagattccccgaggcccagtggcgcgagcgtcccgatgtgggccgatacctgcgtgaactgagcggctccgggctggagagactgcggcgagaaccagaacggttagccgaggaacgcgcacagctgctgcagcagactcgcgatctggcattcgccaattacaagacttttatccggggagccgagtgtaccgagaggattcaccggctgtttggtgacgtcgaagcctcactaggacgcctccttgaccgcctcccatcatttcagcagagctgccggaactttgtgaaggaagccgaggagattagctccaaccggcgaatgaacagtctgaccttaaaccggcacactgagatccttgagatactggagatcccgcagcttatggacacttgtgtgaggaacagctactatgaagaggctctggaattagccgcttatgtccggcgacttgaacgcaaatactcttcaatccccgtaattcaggggatcgtaaatgaagtccgccagagcatgcagctaatgctttcccaattgatccagcaacttcgtaccaatatccagcttcccgcatgcttgcgggtgattggttacctcaggagaatggacgtgttcaccgaggctgaactcagggtgaaatttctgcaggcgcgagacgcatggcttaggagtatattgaccgccatccccaacgacgacccttacttccatatcacaaaaacaatcgaagccagtcgggtgcatctctttgacatcattacccagtacagagccattttctccgacgaagaccctctgcttccccctgcgatgggggaacacaccgtcaacgagagcgcaatcttccacgggtgggttctacagaaagtatctcagttcctccaggtgctggagacagatttgtatcgaggcatcggaggacatttagattcgctgctaggccagtgtatgtactttggattgtcattctccagagtaggggcagatttccgcggacaactcgcccctgtgtttcagcgcgttgctattagcacctttcagaaagccatacaggagacggtggagaaatttcaggaagaaatgaattcatatatgctcatcagtgctcctgcaattttaggaacctcaaatatgccagcagcagtgcccgcaactcagccgggtacgcttcagcctcccatggtgctgttagactttccacctctcgcatgcttcctcaacaatatcctggtggctttcaacgacctgcggctgtgctgccccgtggcactggcacaggacgtgaccggagccctggaggacgcacttgcaaaggttactaagataatactggcttttcatcgcgctgaagaagccgcattctctagtggcgagcaggagctttttgtacaattttgcaccgtgtttcttgaggaccttgtgccatatctgaatcggtgtcttcaagtgctgttcccacccgctcagatcgcccagacattgggcatcccaccgacacagctgtccaaatatggcaacctgggccacgtcaatatcggcgctatccaagagcctctggctttcatactcccgaaacgtgagactctgtttacgttggatgaccaggcattgggaccagagttgacagctcccgctcccgagccgccagccgaagagccacgccttgagcccgctggacctgcatgccctgaaggcggacgggcagaaacccaagcagagccgccatcagtgggaccatag

SEQ ID NO: 219160 - DNA, 2109 bp, Artificial Sequence
  Description of Artificial Sequence: Synthetic coding sequence
atggagtccccatccgcgcctccgcatcgctggtgcatcccttggcagcgtctcttgctgactgcatctcttctgactttttggaacccaccgacaactgcaaaattgacgatcgagtccaccccgttcaatgtggcggagggtaaagaggtgttactccttgtgcacaatctgccccagcacctcttcggctacagctggtacaaaggagagagagtcgatggtaaccgccagataatcgggtacgtcattggtactcaacaagcgactcccggtccagcctatagtggcagggaaattatctaccccaacgcatccttgctcattcagaatatcatccagaacgatacaggcttctacacccttcatgtaattaaaagcgatctggtcaacgaggaggccaccgggcagtttcgagtttatcccgagctccctaagccctcgatatccagtaataactcgaagccggtcgaagataaggacgccgtagcgttcacttgtgaacccgaaacgcaagacgctacctacctttggtgggttaataatcaatctcttcctgtcagccccagactacagctctcaaacggcaacagaaccctaacgctgtttaatgtgactcggaatgacaccgcaagctacaagtgtgaaacgcagaaccccgtctcggccagacggagcgattctgtgatcctgaacgtgctgtatggcccagacgccccaacgatcagccctttgaacactagctatcgatcaggtgagaatctcaatctgagctgtcacgccgcatccaatcctcctgcacagtactcttggtttgtcaacggcactttccagcagtccacgcaggaactgtttattccgaatattaccgtgaacaacagcggcagctacacatgtcaagcccataactcggacacagggctgaaccggacaaccgtgaccactatcaccgtatatgcagagccgcctaaaccatttattacatctaataacagcaatcccgtggaggacgaggacgcagtagccctcacgtgtgaacctgaaattcaaaacaccacctacctgtggtgggtgaataatcaatcactgccagtgtcccctaggctccagctctctaatgacaatcggaccttgaccctcctgagtgtgacccggaatgacgtcggtccgtacgagtgtgggattcagaataagttgagcgttgaccattccgaccctgtaattctgaatgtgctttatggccctgacgacccgacgatctcccccagctatacatattatcgccctggcgtgaacttatctctgagttgccatgccgctagcaatcctcctgcacagtactcttggcttatagatggaaatatccagcagcatacacaggagctgttcatctctaatatcaccgaaaaaaatagtggcttatatacatgtcaggccaacaactccgcatccggccacagtcgtactaccgtgaagacgatcacagtgtccgccgagctgccgaagccctcgatttcatccaataacagtaagccggtggaagataaagacgctgtggcttttacctgcgagcccgaagcccagaacactacctatctgtggtgggtgaatggtcaaagcctcccggtgtcgccgagactgcagctgagcaatgggaatcgtacactgacactgttcaacgtgactcgtaacgatgccagggcgtacgtgtgtggcattcaaaattccgtctccgctaatcgcagcgaccccgtgacattggacgtgctgtacggcccagacacccctattatcagtcctccagattcctcctatttgtccggagccaatttgaacctctcctgtcacagtgctagcaacccgtccccgcagtattcatggcggataaacggcatccctcagcagcatacgcaggtgttgtttattgctaaaatcactcccaacaacaacgggacctatgcatgctttgtgtctaacttggctaccggcagaaataattctatcgtcaagagtattacagtgagcgcttctggcactagccctgggctgagtgcaggagccactgtgggcattatgatcggcgtgctggtgggagtagcacttatatag

SEQ ID NO: 219161 - DNA, 981 bp, Artificial Sequence
  Description of Artificial Sequence: Synthetic coding sequence
atgatggcctacatgaaccctggtccacactactctgtgaacgcactcgccctgagcgggccaagcgtcgacctcatgcaccaagccgtcccttatccttctcctccactggccctagacccccctaggagacagcgccaggaaaggaccgtttacacagaatctcagcagaaggtgctcgagttttacttccagaaagaccagtacccaaattatgaccaaagactaaacctggccgagatgctatcccttagggagcagcagttacaagtatggttcaagaatagacgggcaaaactggccagagagaggcgcctccagcagcagccgcaaagggtcccaggtcaaaggggaagaggggcaagagccgctcccctcgtgcccgtcgcagcagctagcttccctggcggacccgagttcccccagggcagaggatcctggatttcccctcagccaggcccatggggcgtcctgcctgccgcagagccaaagatctactccctgcccaggacctggggcggtcctgaatgtggtactcaggagggcctgaaggcggtcccggctccaggacctggccctatcccagcgcctatccctggcccagcccagatccctggacccgtaccaggacctgcgcctaatttgggcccaatgtcagggcctctgtccgtatctatcccaggccctattcccgctcccatcagctgtcccggaccaatccccgatcctgtattgggacgcactctgatgccgggacctgggtccctaccgacaccagcgccaggagcgctttggccccagtcgccctacgcctccaatttatctcccgacacccaactctatccagatttcacgaagctcctgcccctcctcgacagatttgaggaaagctcactgtctactacgacgagccagtataaagaagaagacggctttgtggataagaaccacagtgtacctaggagccttctggacctttag

SEQ ID NO: 219162 - DNA, 900 bp, Artificial Sequence
  Description of Artificial Sequence: Synthetic coding sequence
atgatggcgtacatgaatccgggtccgcactatagcgtcaatgcactagctctttctgggcctagtgtcgatctcatgcatcaagctgtgccctatccgtcagcgcctaggaaacagcggagggaaaggaccacttttacccgaagccagctcgaggagctcgaggccttgtttgccaaaacacagtacccagatgtgtacgctcgggaggaggtggctctaaaaatcaacctccccgagagccgggtgcaggtgtggtttaagaaccggcgagccaagtgccggcaacagcgacagcaacagaagcaacaacagcagcccccagggggacaggctaaggctaggccagccaagagaaaggcaggtactagcccccgtccgagcacagatgtttgtcccgatcccctgggcatcagtgactcatactcccccccactgcccggtccaagcgggtctccgacaactgcagtagccacagtatctatctggagtcccgcaagtgagtccccactgccggaggcccagagagccggattggtggcaagcgggccatctctcacttctgctccatatgctatgacttatgcacccgcatctgcgttctgctcttctccctcggcctatggaagtccttcatcatacttctccgggctcgacccgtacttgtctccaatggtgcctcagttgggcggacccgctctgtcacctctcagcggaccttcggtaggaccttccctggcccagagccctacctcactgtcagggcaaagttatggcgcatatagtccagtagactcactggaattcaaggatcccacgggaacttggaaattcacatataatcctatggatccgctcgattacaaggaccaatctgcatggaagttccagatactttag

SEQ ID NO: 219163 - DNA, 900 bp, Artificial Sequence
  Description of Artificial Sequence: Synthetic coding sequence
atgatggcctatatgaaccccggaccccattacagtgtgaatgccttggctctcagcggaccaagtgtggacctgatgcaccaagcagtgccttaccccagcgctccacggaagcagaggagagagaggacaaccttcacccggtctcagttggaagagttggaggcactttttgctaagactcaatatcctgacgtatacgcacgtgaagaggtcgccctgaaaattaatctccctgaatcaagggtccaagtgtggttcaaaaacagacgagctaagtgccgccagcagcggcagcagcagaagcaacagcaacagcctcccggaggccaggccaaggcacgtcctgccaaaaggaaggcagggacctcaccccgaccctccacagatgtttgccctgatccactgggaattagtgattcttattcccctccactcccaggcccttccggctctccaaccactgcagttgccacagtgtcaatttggagccccgcatcagagtcccccctgcctgaggcacagagggctgggctcgttgccagcgggccaagtctgacttccgccccttacgctatgacttacgcacctgcctcagccttttgcagctccccaagcgcatacgggagtccatcctcctacttttccggactggacccatacttgtctccaatggttccacagctggggggacccgcactttcaccccttagtgggccatccgtgggcccttctctagcacagtcacctacctcactaagtgggcagtcctacggcgcttacagccccgtggactctctggaatttaaagacccaacaggaacttggaagtttacatacaatccaatggatccccttgattacaaggaccagtccgcttggaaattccagattctgtag

SEQ ID NO: 219164 - DNA, 900 bp, Artificial Sequence
  Description of Artificial Sequence: Synthetic coding sequence
atgatggcctacatgaatcccggtccgcattacagcgtgaatgcactggcactctccggaccatctgttgacctgatgcatcaggccgtgccgtatccctccgcccctcggaagcaacgaagggaacggaccacctttaccagatctcaactagaggaactcgaggctctgttcgcgaaaacacaatacccagacgtctacgctagagaagaagtggcgctcaagatcaacctccccgaatctagagttcaagtttggtttaaaaatcggagagcaaaatgccggcagcagagacaacagcagaaacagcaacaacagccacctggaggccaggccaaggccagacctgccaaaagaaaggctggaacttctcctagaccatccactgacgtctgtcccgatcccctgggcatctctgattcatacagcccacctctgccaggtccatctggatcacctactaccgcagtagcaacagtgtcgatctggtctccggctagcgagagccctcttcccgaagcacaacgtgcgggtctggtagcctccggcccatctcttaccagcgctccctacgctatgacatatgccccagcgtccgccttttgttcgagcccctccgcctacggctctccatcaagttattttagcgggctggatccctatttatccccaatggtcccccagcttggcggaccggctctgagcccgctatccggcccttccgttggtccatcactggctcagagccccacatctctctcgggacagagttacggtgcttattctccagtcgattctctggagtttaaggaccctaccggcacatggaaatttacttacaaccctatggacccgctggactacaaggaccagtcagcctggaaattccagatcctgtag

SEQ ID NO: 219165 - DNA, 3678 bp, Artificial Sequence
  Description of Artificial Sequence: Synthetic coding sequence
atggccgcagtgcttgagagtttattgcgcgaggaagtgtccgtggctgcagtggtccgttggattgctaggtcgacacaggggagtgaggacaatgctggcgaagccgctgctctaagcagcctgcgagcactgagaaaagagtttgttccatttctgttaaatttcctcagagagcaatcttctagggtgctgccccaagggccaccaacccccgctaagactccaggggcttctgccgctttacccggtcgccctgggggtccccctcgcggaagccgcggagccaggtcacaactcttcccacccactgaagctcagtcaactgcggctgaggcacccctcgctcgacgcggtggtcgccgacgagggcctggcccagcgcgtgagagggggggtaggggccttgaggaaggtgtttctggagagagcctgcctggagccggtgggagacgactgcggggtagcgggtccccttcccggccaagtctgactctgagtgatccacccaacttgagcaacctcgaggagtttccacccgttgggtcagtgccaccgggtccaacagagactcagcttagctgtcgacgttgggtgccgcgacggctgtggggggtgagtcacagttccagcgctctgcgctccggtgcgcctgggtgccgtactaaaccctcaagaagaatcaacccaaccccggtgtccgaagaaagaagcctgtctaaacctaaaacctgctttacaagccctcctatatcatgtgtgcccagcagcaaacagctgcaacagagcccaacaccaacctgtcccaccccggaactggggtctccattaccaagtcgaacagggagtctcacagatgagcctgcagatccagcacgggtctccagcaggcagcggttggagctggttgctctcgtgtactcgtcgtgcattgccgaaaacttggtgcctaacctgttcctcgagcttttctttgtcttccagctgttaactgcaagaagaatggtgaccgccaaggatagcgatccagaactgtccccagctgtgctcgacagcctggaaagtccactcttccagagcattcatgactgcgtctttttcgctgtccaggtgctggagtgccacttccaggtgctgagtaaccttgataaaggcactctcaaactgctagccgaaaatgaaagactgttgtgtttttcccctgctctacaaggcaggctgagggcggcttatgaaggatccgtggctaaagtgtctttggtaatgcctccttctacccaggctgtttcctttcagccagagaccgataacagggccaatttctccagcgaccgcgctttccacaccttcaaaaagcagagagacgtattctatgaagtcctaagggagtgggaggaccaccacgaggagccaggttgggatttcgagaaagggcttggcagccgaatcagggcgatgatgggccaattgtccgcagcatgctcccacagccatttcgttcggctttttcagaagcagcttctccagatgtgccagagtccgggaggagcagggggtactgttcttggcgaagcacctgatgttctgtccatgctgggcgcagacaagctgggcaggctttggaggctgcaggaacgcctgatggccccacagtcatcaggaggaccatgtccccctcctacgttccctgggtgtcaaggattctttcgggacttcatactgtccgcttcaagctttcaattcaaccagcacctgatggacagcctgtccctcaagatacaagagctgaatgggcttgctctgccacagcacgagccgaatgacgaagacggtgaatccgacgttgactggcagggagagaggaagcaatttgctgtagtcctcctttccctccggctcctggctaagttcttaggcttcgtggcgttcctgccctatcggggaccagaacctcctcctaccggtgagcttcaagattctatactggcgctgcgctctcaggtccccccagtactcgatgtaagaaccctgctacagagaggtttgcaggctagacgtgcggtgctgacagttccttggttggttgagtttttgtcatttgccgatcacgtggtcccgctgttagaatactaccgggacatttttactctgctgctgaggttgcacagaagcttggtcctgtcacaggaatctgagggtaaaatgtgcttcttgaataagctgctgctgctagctgttctaggatggctgtttcaaatccccactgtgcctgaggatctgttcttcttggaagaaggcccttcatacgcctttgaggttgacacagtcgcgcctgaacatggcttggacaatgccccagtggtcgatcagcagctgctgtacacttgctgtccgtacattggagagttaaggaagcttctcgcttcgtgggttagcgggtcttctggcagaagcggaggatttatgcgcaagatcaccccaactaccacaactagcctgggcgcacaaccgagccagacatcccagggacttcaggcgcagctcgctcaggcgttctttcacaaccagccacccagtttaaggcggaccgtcgaattcgtcgcggagcgaattggtagtaattgcgtgaaacatatcaaggccacactcgtggccgacctggtcaggcaagcagaatcattacttcaggaacagctggttactcagggagaagagggcggagatccagcgcagctgctggaaatcctgtgcagccagttgtgcccccacggggcacaggctctggctctggggagggaattctgtcagagaaagtctcctggagctgtgcgcgctctattgcccgaggagactcccgctgctgtgttgagttccgccgagaacatcgcagtcgggctggctaccgagaaagcttgcgcatggctgtccgccaatattaccgccctgatccggagggaagtcaaggcagccgttagtaggaccctgagggcgcagggcccagagcccgcagccagaggagagcggagggggtgctcaagggcctgtgagcatcacgctcccctcccttcacatctgatctctgagatcaaggatgttctctcgctggccgtgggaccccgtgatccagatgaaggagtgtctcctgaacatctggaacagctgctcgggcagctgggacaaactttgagatgtcgccagtttctttgccccccagcagagcagcatctagccaagtgttccgtggagttagcatccctgctggtcgctgaccagattcccattttagggcctcctgcccaatacaggctagaaagggggcaggcccgtcggctccttcatatgctgctgtcactttggaaggaagatttccaaggacccgtcccccttcagttgctgctgtccccgaggaatgtgggtctgctggccgatacccgtccccgtgagtgggaccttctcctgttcctgttgcgcgaacttgtcgaaaagggccttatggggcgaatggaaattgaggcgtgccttggatcgctgcaccaagcccagtggcctggggatttcgccgaagagctcgcgacactctctaatctgttcctggctgagccacacctgcctgagccccagctcagggcttgcgagcttgtgcagccaaacagaggtacagtcttggcccagagctag

SEQ ID NO: 219166 - DNA, 3684 bp, Artificial Sequence
  Description of Artificial Sequence: Synthetic coding sequence
atggccgcagtgctggaatccctgctccgggaggaggtttcagttgctgctgtcgtacggtggatagctcggtcaactcaaggttccgaagacaatgcgggagaagccgctgcactaagtagtcttagagcgttaagaaaggaatttgtgcccttccttcttaacttccttagggaacaatcttcacgggtccttcctcaggggccacctactcccgctaaaacacctggggcttctgccgctctgcctgggagaccaggcggacctcctcggggatcacggggagccaggtcccaactgtttcctccgactgaggcacagtccaccgcagcagaagccccactggccaggagagggggtcgaagaagaggccctggccctgcacgggaacgtgggggacgcggattggaagagggcgtaagcggggagtcactgcctggcgctggtgggcgtcgcctgcgtggcagtggctcccccagtagaccaagtttgacgctgagcgacccaccaaatctgagtaatctggaggagtttccaccagttggctcagtgcctccaggcccaaccggaacaaagcctagtcgacgaattaaccccactcccgtatcagaagagaggtcactctctaaaccgaaaacatgttttacatcccccccaatctcttgcgttccctcctcgcagccgtccgcactcgacacctctccttggggcttaggattaccaccgggatgtaggtccctgcaggaggaacgtgagatgctgaggaaggaacgctccaagcaactccagcagtctccaacgcccacatgccccactcctgagctcgggtcccctcttccctccagaacaggcagtctgacagatgagcccgctgaccccgcacgtgtttcttctaggcagcgcctggaacttgtggcactcgtgtactcctcctgcattgcagagaacctcgtgcccaatctgtttttagagctttttttcgttttccaactgctgacagctagacgcatggtgaccgcgaaggatagcgaccccgagctcagtcccgcagttctcgacagtctcgagtctcctctgttccagagcatccacgactgtgtcttcttcgccgtccaggtgctcgagtgtcacttccaggtgctttcaaacttggacaagggcacgctcaaactgctcgcagagaacgagagattactgtgcttttccccagcactgcaagggaggctgcgtgctgcttacgaaggatccgtagccaaggttagcctggtgatgccccctagtacccaggccgtgtccttccagccggaaacggataacagagcgaacttttcatctgatcgagccttccacacctttaaaaagcagagggatgtcttctatgaagtgttaagagagtgggaggatcaccatgaggaacccggatgggactttgaaaaaggtctaggtagcaggattagagctatgatgggccagctctcggccgcttgcagccattcacatttcgtgaggttatttcagaagcagctcttacagatgtgtcagagccctggtggcgctggtggcacagtgctgggtgaggcgcctgatgtactctccatgttgggtgcggataagctaggtcgtctgtggagactccaggagcgactgatggctccacagtcaagcggcggtccctgtcctccacctacgttcccaggctgtcaaggtttctttagagattttattctgtccgccagctcgtttcaatttaatcagcacttaatggactctctaagtctgaaaattcaggaactgaatgggctggctcttcctcagcacgaaccaaatgacgaggacggcgaatctgacgtcgattggcagggcgagcgcaaacagttcgcggtggttctgctctctctacgcctcctggctaagtttctgggattcgtggcctttcttccttacagaggacccgaaccaccgccaactggcgagctccaggatagtatcctggcccttaggtcacaggtccccccagtcctagatgtacgcaccctcctgcagagaggcctccaagcaaggagagctgttctaaccgtgccatggctggtggaatttctctcctttgccgatcatgtggtacctctgttggagtactaccgggatatttttactctcctgcttagactgcaccgttctcttgtgctgtcccaggagagcgaggggaaaatgtgcttcctgaacaagctgctgctacttgcagtcctgggctggctgttccagataccaactgttcccgaagatctgtttttccttgaagaaggtccatcctacgccttcgaggtcgatacagtcgctccagaacatggcctcgacaacgctccagtggtggatcaacaattattgtatacatgctgtccttatattggggaacttcgaaagctcttggcctcatgggtgtcaggtagcagtggacgctctggagggttcatgagaaaaatcaccccgacaacaaccaccagcctcggggctcagccctcacagacctcccaggggctacaagcccagctggcacaagccttctttcacaaccagcctcccagtctgcgcaggacagtggagttcgtggccgagagaataggaagcaattgcgtgaagcacattaaggccaccctcgtggctgatttggttagacaggctgagtccctcctacaggagcagctcgtgacgcagggcgaagaaggtggtgatcctgcgcagctcctggaaatcttgtgctcccaactttgcccacacggggcacaggccttggcactgggcagagaattttgtcagagaaagtcgcccggagccgtgagggctctgctacccgaggagacaccggcagccgttctgagttccgcagagaacatcgcggtcgggctggccacagagaaagcctgcgcctggcttagcgcaaacattaccgcccttattcgccgagaagtgaaggctgcagtcagcagaacactgagggcacagggcccagagcctgcagcacgcggtgaacgacgcggttgctctagagcgtgtgaacatcacgcccctttgccttcgcatctgatctccgaaatcaaagacgtgctttccctggccgttggtcctagggacccagacgagggcgtttcaccggaacacctggagcagctcttgggccagctgggtcaaaccctgcgttgtcggcagtttctgtgtcctcctgccgagcagcacttggcaaaatgctctgtggagctggcatccctgttggtcgctgatcagatcccaatactggggcctcccgctcagtaccggctcgaacgtggccaggccaggcgactgctacacatgctgctctccctgtggaaggaagatttccagggaccggtccctttacaactcctgctctcccctcgcaatgtggggctgttagcagacacaaggccacgagaatgggatctgctgttatttctcctccgcgagttagtcgaaaaaggcctcatgggaagaatggagatagaagcttgtcttggcagcttgcaccaggcccaatggcccggagactttgctgaggaattagctacgctctcaaacctatttctggccgaaccacacctgcctgagccccaattgcgggcttgcgaactggtacagcccaacagggggacagtcttggctcaaagctag

SEQ ID NO: 219167 - DNA, 2697 bp, Artificial Sequence
  Description of Artificial Sequence: Synthetic coding sequence
atggcgttaattatggagcctgtgagtaaatggtctccctctcaagtggtagactggatgaaaggcttggacgattgtttacaacagtacatcaagaactttgagcgggagaagatttccggggaccagctccttcgcatcacacatcaggagctggaagatcttggcgtgagcaggatcggccaccaagagttgattttggaagctgtggatcttctgtgtgccctaaactacggcctcgagactgagaatctgaagacgttgtcacacaagctcaacgcatcagcaaagaatttacagaatttcattacaggtcgccgaaggtctggacactatgatggaaggactagcagaaagctaccaaacgacttcttgacctctgtggtcgatctcatcggggcagctaaaagtcttctggcatggctggatcgttcaccattcgccgcagttacggattacagtgttacccgcaacaacgtcattcagctgtgcctcgagctgacaactatcgttcagcaggattgcacagtgtatgaaacagaaaataaaatattacatgtgtgcaaaaccctatccggcgtttgcgaccacatcatcagcttatcatcggacccactggtcagccaatctgcccacttggaggtgattcaattagccaatatcaagccaagcgaagggttggggatgtacatcaaatccacctatgatggactgcacgtcattacgggcacaacagagaatagcccagctgacaggtgcaagaaaattcatgccggtgacgaggtgatccaggtgaaccatcagaccgtagtgggctggcaactcaaaaacttggttaatgcactcagggaggatccttcaggggtaatccttacactcaaaaagaggccccaatcaatgttaacgtctgcccctgcgttgctcaagaatatgaggtggaagcctttagccctgcagcctctgatcccccgtagtccaacatcatcagtggcgacacccagtagtactatctcaacgcccacaaagagagactcctctgcccttcaggacctgtacataccgcctcccccagcagaaccatacattccacgcgacgaaaagggaaacctgccttgtgaggatctgagaggccacatggtcggaaagcccgttcataaaggtagcgaatctcctaactcctttcttgaccaggaatatcgaaaacggttcaacattgtcgaagaggatactgtgctctattgctacgagtatgaaaagggtcgctcgtcctcacaaggcaggcgcgagtctactccaacttacggtaagctccggcctatatccatgcccgttgaatacaattgggtgggcgactacgaagaccccaataaaatgaagcgcgattcacggagagagaactccctgcttcgttatatgagcaacgaaaagattgcccaagaggaatacatgtttcaaaggaactccaaaaaggatacgggtaaaaagtctaagaagaagggcgacaaatctaattctcctactcattacagcttgctgccatcgttgcagatggatgcccttaggcaagacattatgggcacacccgtaccagagaccaccctctaccacacttttcagcagagctccctccaacacaagtctaaaaagaagaataaggggcctatcgccggaaagtctaaaagaagaattagctgcaaagacctgggccgaggggactgtgaagggtggctatggaaaaaaaaggatgctaaatcctacttttctcagaaatggaagaagtactggtttgttttgaaagacgcctccctttattggtacatcaacgaggaggatgagaaagcggaaggctttatctccctccctgagttcaagatagaccgtgcctctgagtgcagaaaaaagtacgctttcaaggcctgtcaccctaaaatcaagtctttttacttcgcagctgagcacctcgacgatatgaaccggtggctcaacagaattaatatgctgacagccggatacgctgaacgggaaaggatcaagcaggaacaggattactggtcggaaagcgataaggaggaagcagatacgcctagcacccctaagcaggatagcccccctcctccatatgatacttatcctcgccctccatccatgtcatgtgcctctccctacgtggaggctaaacattcacgcctgtcctccacggagacatctcagagtcaatcctctcatgaggagtttcggcaggaggtgaccggctcctctgctgtctctcctatcaggaaaacagcatctcagagaaggtcctggcaggatctcatagaaactcctctgacctcttccggactgcattacctgcagacactgcctctggaggactctgtgttctcagacagtgcggcaatctcccccgaacacaggcgacagtcgacattaccgacacaaaaatgtcaccttcaggaccattacggcccttacccactggcggagagcgaaaggatgcaggttctcaatggaaacggtggaaagccaaggtcatttactctgccacgagacagcggtttcaatcattgttgtctcaatgcccctgtgagcgcctgtgatccgcaagacgacgtgcaaccaccggaagtcgaagaagaggaagaagaggaggaagaggagggcgaggcagctggggaaaacattggagaaaagtcatag

SEQ ID NO: 219168 - DNA, 3105 bp, Artificial Sequence
  Description of Artificial Sequence: Synthetic coding sequence
atggcattgattatggagccagtgtctaagtggtctccatctcaggtggtggactggatgaaaggcctcgacgactgcctgcagcaatacatcaagaatttcgaacgggagaaaatctcaggcgatcagttgctcaggatcacacaccaggagttagaggatctgggcgtgagtagaatcggtcaccaggaactcattctggaggcagtggacctgctgtgtgcactaaactatggtctggagactgaaaatctcaagacactctcgcataaactaaacgcctccgcaaagaacctgcagaatttcatcaccggcagacggcgatctggccactatgatggtcggacatccagaaagctgcccaatgactttctgacttctgtcgtagatctgataggagcagccaaaagtttgctcgcatggctggatcggtctccatttgcagctgtcaccgactacagcgtgacgcgcaacaatgtcatacaactgtgtctggagctgacgacaattgtgcagcaggactgcacggtctatgaaacagaaaataagatcctgcacgtgtgcaagacactgagtggcgtgtgcgaccacattatctccctaagcagtgacccccttgtgagccagtctgcccatctggaggttatacagctggcaaacatcaagccatctgaaggcttaggcatgtacatcaagtctacctacgacggccttcatgtgatcacggggaccaccgaaaattctcccgcagaccgatgtaaaaaaatccatgccggagacgaagttatccaagtaaatcatcagaccgtggtgggttggcagctgaagaacctggtgaatgcactgcgagaagatcctagtggcgtaattttgaccctgaagaagcggcctcagtctatgcttacctccgctccagctttgctgaaaaacatgcgctggaagccacttgctctgcagccgctgatccctcgcagccctacatccagcgtggctaccccatccagtaccatatcaacaccgacaaaacgcgactcctctgctctccaggatctgtatatcccaccacctccagcagaaccatacatacccagagatgaaaaagggaatcttccatgtgaagatctgagaggccacatggtgggaaagcctgtgcataaggggagcgagtcaccaaacagctttttagaccaggaatataggaagagatttaacatagtagaagaggacaccgtgctgtattgctacgagtacgagaagggtaggtcttcgtcccagggtaggcgggagtctacacctacctatggcaaactgcgacctatcagtatgccagttgaatacaactgggtaggagactatgaagaccctaacaaaatgaagcgggactctcgcagggaaaactccctcctgcggtatatgtcaaacgagaagattgcgcaggaggaatacatgttccaaaggaactccaaaaaggacaccgggaagaagagcaaaaaaaagggagacaagtctaattctcccactcattactccctcttaccatcgctccaaatggatgcattgcgtcaggacattatggggactcccgtccctgaaaccacactgtaccacacatttcaacagtcttccctgcaacacaagagcaaaaagaagaataagggacctatcgctgggaaatctaagagacgcatcagctgtaaagacctcgggaggggcgactgcgaggggtggctttggaagaagaaagacgccaagagctacttttcacagaagtggaaaaaatactggttcgtactcaaggatgccagcctctattggtacatcaacgaggaagatgagaaggccgaaggatttattagcctccccgagttcaaaattgacagggctagcgagtgcaggaaaaagtatgcttttaaagcctgtcatcctaagataaagagcttctacttcgctgctgaacatctggacgatatgaatcggtggctaaaccggatcaacatgctgactgcaggttacgctgagcgggaacgtatcaagcaggagcaggactactggagtgagagcgacaaggaggaagctgacaccccttcaaccccaaaacaggactctcctccgccaccttatgacacctatccaaggccaccatcaatgtcttgcgcatccccttacgtagaggcaaaacactcccggttatctagcacagagacgtctcaatcccaatcttcccatgaggagttcagacaagaggtgaccgggagttccgccgtgagcccgattcgaaagaccgcatcccagcgcaggagttggcaggaccttatcgaaactccgttgacgagctccggcctgcattatctccagaccctgccactggaagattcagttttttcggattccgccgctatctcgccagaacacagacggcagagcactcttcctactcaaaaatgtcaccttcaagatcactacgggccatatccactggctgaatcagaacgtatgcaagtactcaacggaaacgggggaaagccacgaagttttaccttacctagggacagcggctttaaccactgctgtctgaatgcacctgtcagcgcttgcgaccctcaggacgacgtccagccgcctgaggtggaagaggaggaggaagaagaagaggaggagggggaggcggctggcgagaacatcggcgaaaagagtgagagccgcgaggagaaattgggcgatagtctgcaagacctctacagggccttggaacaggcatctcttagcccactgggcgaacatagaatcagcacgaagatggagtataaattatccttcattaagagatgcaatgacccagtgatgaacgaaaaactccatcgactccgcatcctgaaaagtacactgaaggcacgtgaaggcgaggttgcaatcattgacaaggttttggataaccccgatctgacatcaaaagagtttcaacaatggaagcagatgtacctcgatctgtttttggatatctgtcagaacacgacctccaacgatccattgagcattagcagtgaggttgatgtcatcactagcagtctggctcacacccatagttacattgagacacacgtctag

SEQ ID NO: 219169 - DNA, 3015 bp, Artificial Sequence
  Description of Artificial Sequence: Synthetic coding sequence
atggctcttattatggagccagtgagcaaatggtccccttctcaggtggtcgactggatgaaaggacttgacgactgcttgcaacagtacattaaaaattttgagagagagaagatttctggcgatcaattacttagaattactcatcaggaactcgaagatctcggggtgtctcgaattggtcatcaggagctgatacttgaggctgtggatctactgtgtgctctgaattacggcctggaaacagagaacctaaaaaccctgagccataaactcaatgcctcagcaaagaatctccagaactttattactggcagaaggaggagcggccactatgacggcagaacatcccgcaagctacctaatgactttctcaccagcgtggtggacctgatcggggctgctaagtcgctgctggcctggctggatcgaagccctttcgcagcagtgacagattatagcgtaacccggaacaatgtgattcagctatgcctagagctcacaaccattgtgcaacaggactgtactgtctatgaaactgagaacaaaatactgcacgtctgcaagaccctctccggtgtctgcgaccacattatcagcctgtcgagcgaccccctggtgtcacagtcagcccacctggaggtgatacagctcgcgaatataaaacccagcgagggcctcgggatgtatatcaaaagcacgtacgacggactgcatgtgattaccgggaccactgaaaactcgcccgctgatcggtgcaagaagattcatgctggcgacgaagtcatccaggtgaatcaccaaacggtggtgggctggcagcttaagaacctggtgaacgctctgcgcgaagacccctctggcgttatactcaccttgaagaagcgcccacagtctatgttgacttccgccccagctctactcaaaaacatgcgttggaagcctttggcattgcagccgctgattcccaggagcccaacctcctccgtagcgactccatcaagtaccattagtacacctaccaaaagagacagctcagccttacaggacctttatataccacctcctcctgccgagccctatatacccagggatgagaaagggaacctcccctgcgaagaccttcggggacacatggtggggaaacccgtacataagggatccgagtcacccaacagtttcctggaccaggaataccgcaagcgcttcaacatagtggaagaggatacagtgctgtactgttacgagtatgaaaagggcagatcttctagtcaaggaaggagggagtctactcctacatatgagaattctttgctcagatacatgagtaacgagaaaatcgctcaggaggagtacatgttccaaagaaatagtaaaaaggacaccggaaagaagagcaaaaagaaaggtgataagtccaacagcccaacccactatagcctgctgccctcattacaaatggacgcactcagacaggacataatgggaacacctgttcctgagacaaccctctaccacacctttcagcaaagcagcctccagcataagtcaaagaagaagaataaaggacctatcgctggtaagtctaagcgcagaattagctgcaaagatttgggcagaggggattgtgaaggttggctatggaagaagaaggatgctaaatcttacttctcacagaagtggaaaaagtattggtttgtgctgaaagatgcgtctttatactggtacattaatgaggaggatgagaaagccgagggctttattagcttgcccgagtttaagattgacagggccagcgagtgcaggaagaagtacgcgtttaaggcctgccatcccaagatcaaatctttttatttcgctgccgagcatctagatgatatgaaccgctggctgaaccggattaatatgctgaccgcaggctacgcggagcgggaacgaattaagcaggagcaggattattggagcgagtctgataaagaggaggccgatacgccctctacaccgaagcaggattctcctccacctccttacgacacgtatccacggcctccttccatgtcctgtgcaagcccctatgttgaagccaaacacagcagactttctagcaccgaaacctcgcagtcgcagtccagtcacgaagagtttcgacaggaggtgacgggcagttctgccgtgtccccaattcgaaagacagcatcacaaaggagaagctggcaggatctcatcgagacacctcttacctcaagcggacttcattacctacagaccctgccgctggaagacagtgtcttcagtgactcagcggctatttcacccgagcatcggcgtcagagtaccctgcctacacagaagtgccatttacaggaccactacggtccatacccgctagctgagtctgaacgtatgcaagtattgaatgggaatggtggtaaaccgagaagttttaccctgccccgtgacagtggcttcaatcactgttgtctgaacgcccctgtgtccgcctgtgatccacaggatgatgtccagcccccagaagttgaagaggaagaggaggaggaggaggaagagggcgaagcagctggagagaatattggggagaaaagcgagtcaagagaggagaagctgggggactctctgcaggatctttatcgggctctggaacaggcctctctgagtcctcttggagaacatcggatttcaacgaaaatggagtacaagttatcattcattaaacgttgcaacgatcccgttatgaacgaaaagctccatcggctgagaattctgaagtccacgttgaaagccagagagggagaagtggcaatcatcgacaaagtcctagacaaccctgacctgacaagtaaagagtttcagcagtggaaacagatgtacctcgacctgtttctggatatctgtcagaataccacaagcaacgatcccctctccatctcctcagaggtggatgtcataaccagctccctggctcacacacatagctacattgagacccatgtgtag

SEQ ID NO: 219170 - DNA, 2550 bp, Artificial Sequence
  Description of Artificial Sequence: Synthetic coding sequence
atggcacttataatggaacctgttagcaagtggagtcccagccaggtcgtcgattggatgaagggactggatgattgcctgcaacaatatataaaaaattttgagcgcgaaaagatttccggggaccagctgcttaggattacacatcaagaactggaagacttgggggtatcacggattggacatcaggaactcattctcgaggcggtagacctgctgtgtgctctgaactacggcttggagacggaaaatctgaagaccctgagccacaaactgaatgcgtcggccaagaatttgcagaacttcattacagggagacgcagatctggtcactatgacggacggacatctcgaaagctcccgaacgactttcttacaagcgttgtcgacctgattggtgctgctaaaagcctactcgcctggcttgatagatccccctttgccgctgtgactgattatagcgttaccaggaacaatgtaattcagctgtgcctcgagctcactaccattgtgcagcaggactgtacggtatacgagacagaaaataagatcttacacgtgtgcaagactctgagtggggtctgtgatcacatcatcagcctaagctccgacccgctggtgtcccaatctgcccacctggaggtaatccagctcgccaatatcaagccctcagagggactgggcatgtacattaagtccacctacgatggattgcacgtgataactggcactaccgaaaactcccccgctgatagatgtaaaaaaattcacgccggagatgaagtaattcaggtgaaccaccagaccgtacctctgattccccgttctccaacatcgtcagtggcaaccccctcctccaccatctcaacacctacaaagcgcgactcgtcggcactgcaggacctatatatcccaccaccacctgccgagccatacattcctagagacgaaaagggaaacctgccttgcgaggatttgcgagggcatatggtgggcaagccagtacacaagggtagcgagagtccaaattcttttctagaccaggagtaccgtaaaaggtttaatattgtagaagaagacacagtcttatattgttatgagtatgagaagggcagatcctccagtcagggacgcagagaatccacgccaacatatgggaagctgagacctattagtatgccagtggaatacaactgggtgggagactacgaggatccgaataagatgaagagggattcaaggcgtgaaaattccctcctccgttacatgagcaacgagaaaattgctcaagaggaatacatgttccaaaggaattccaagaaggatactggcaagaagtccaaaaaaaagggcgataagtctaacagtcccacacactactccctactaccgtcgctccagatggatgctctgcggcaggacatcatgggaacccctgtcccagagactacattgtaccataccttccagcagtcaagcctccaacataaatccaaaaagaagaataaggggcctatcgcaggcaagtctaaaagaaggatctcctgtaaagacttagggcgaggggactgcgagggctggctgtggaaaaagaaggacgccaaatcatacttctctcagaagtggaaaaaatattggttcgtcctcaaggacgcctcgctctactggtatatcaacgaggaggatgagaaggctgagggtttcataagcctgcctgagtttaagatagacagagctagtgagtgtcgaaagaaatacgccttcaaggcctgtcatcccaaaattaagagcttctactttgctgcggagcacctggacgatatgaaccgctggctgaatcgtatcaacatgttaacagcagggtacgctgaacgggagcgtattaagcaggaacaggactattggagtgaaagcgataaagaagaggcggacaccccttccaccccaaagcaggattccccaccacccccatatgacacctatccacggcctccatctatgtcttgcgctagcccctatgtggaggccaagcactcacgcctctcttccacagagacatcccagtcccaatcatcccatgaggagttcaggcaagaggtaacaggtagctccgctgtctctcctatccggaagacggcaagtcagcgcaggagctggcaagatctcattgaaacccctctcacatctagcggcctgcactacctgcagactctgccgttagaggattccgtgtttagtgattctgctgccatctcccccgagcaccggcgacaaagcacactgcctactcaaaagtgtcaccttcaggaccattatgggccttatcctctggctgagagcgaacgcatgcaggtcctgaacggaaacgggggtaagccacgcagtttcactctccctcgcgacagcggatttaaccattgctgtctgaacgccccagtgtcagcctgcgatcctcaagacgacgtacagcccccagaagtggaggaagaagaagaagaggaggaagaggaaggagaggcagctggagagaatatcggtgaaaagtcctag

SEQ ID NO: 219171 - DNA, 414 bp, Artificial Sequence
  Description of Artificial Sequence: Synthetic coding sequence
atggacgatagtgacacaccaacgtattatctacagatcgaaccccaggacggttgtcatcccggtgattcggtggagagatctgtgacttgcctaccgagcgcctctgacgaaaatgagaatcagcttgatggtgacgggcacgaacacctgacctcttccgacagtgcgatgggaaaacctcaggtgtctgaacaggatagccttaacaataacgagtcctgtactctttcctgcgaggtggctgccggtgaaaacttacaaaatacgctgtgcgaggcatctcgcgacgaacaggccttcttgggaaaggacaagaagatcccaggcaaaaggagcccccgaagtaagaaaggcactgctaaaaaaataccccctgattccagaatcctgttcccaggagggggactatag

SEQ ID NO: 219172 - DNA, 1851 bp, Artificial Sequence
  Description of Artificial Sequence: Synthetic coding sequence
atggacgactcggatacccctacgtactacctgcagatcgaaccacaggatggctgccaccccggtgactccgtggaaaggagcgtgacttgtctgccgtctgcatcggatgagaatgagaatcagctagatggcgatggccatgagcatctgacttccagcgactctgcaatgggtaaaccgcaggtttcagaacaggactcactgaacaacaacgagtcttgcacactaagctgtgaggtggccgcaggagaaaacctgcagaacacattgtgtgaggcctctcgtgacgagcaggctttcctgggcaaagacaaaaagattccgggtaagagaagtcctcgaagtaagaagggcacggcgaagaagatcccaccaggcctcttttccggtgacatcgcgccactcatgcaagagaaggttctgagcgcagtcacttatgcagtcgacgatgaggaggctgcagaggtgaatgcaaatgagcaacctgaggcgcctaaactggtgctgcagtccttgttctctctgatccgcggagaagtcgaacagctggactcccgggcactccccctttgcctgcaccagattgcagagagctatttccaggaggaggattatgaaaaagcgatgaagtttatacagttggagcggctctaccatgagcagcttctcgctaatctgagtgccatccaagaacagtgggaaaccaagtggaaaacggtgcaacctcacacggtgacagccctgcggaactctgaaaaggggtttaatggcgaagatttcgaacgactaaccaagatttgcgcaacgcaccaagacccgctgctgtctaagcacaagatcgctgcagtggagaagtcccaggaacgcaaatgtagcacgcagcttctcgtctccgaagaccccaaggagggaggcgcaacaacaaaagagagtgaatccaagacgtgccttggcacagagtccagcaaggagagccagcatactgtggaacctctcggtagttcaccgtgctgccaccagatggacgtccaaactgattctccctccctgtcagtcactgccggaaaggatcacatggaggaactcctatgttccgccgaagcaaccctagcactacacactcagtcaagcgagaccgctggaagtccttccggccctgattcatccgaagacgcatgtgaggacgactcaagactgcaacttgcacagacggaagcctgccaggacgtggctcgcatagaaggaatcgcggaagacccaaaggtctttctgtcctccaaatctaagacggagcccctcatatcacccggatgtgaccggattcccccagccctaataagcgagggcaagtatagccaggcacaacggaaggagttgcgcctgcccctgcgggatgcctcagaagccctgcccacggatcagctcgagaacaatgagctcaatgagctccagcagcctgacctgactgactctgacggaaagtcaccacaggcgcaggctgactctgatggaagtgaaaatgtcctttgtggcaacaaccaaatcagtgacctgggtatccttctcccagaggtgtgcatggcccctgaagaaaagggagacaaagatgatcagctgaacaaagagacagaagattacctgaatagtctgttggagggctgtctgaaagacacagaagatagtctgagttacgaggacaaccaagatgacgactccgatttgctacaggacttgagccccgaagaggcgtcttatagcctccaagagaatctgcccagcgacgagtcttgcctaagtctcgatgacctcgcaaagcgaatcgagatcgctgaggttaatcagcgctag

SEQ ID NO: 219173 - DNA, 2178 bp, Artificial Sequence
  Description of Artificial Sequence: Synthetic coding sequence
atggacgactctgacacacccacatattacttgcagatcgaaccgcaggatggctgccatcctggtgactctgtggagcgatccgttacctgtcttccctccgcctctgatgaaaacgaaaaccagttggacggggacggacacgaacacctcacgagcagcgactctgccatgggtaagccccaggtgtccgagcaggactcactgaacaacaacgagtcatgtaccttgtcatgcgaagtggctgccggagaaaatttgcagaacacactgtgcgaagcttctcgagatgagcaggcgtttctggggaaagataaaaagattccgggtaaaaggtctcctcgcagcaaaaagggcacggctaagaagatacctcctggtctattctccggagatatagcaccactgatgcaggagaaggtgttaagcgccgtaacctatgcagtggacgatgaggaggcagcagaagtgaatgcgaatgagcagccagaggctccgaagctggttctgcagtctctctttagtcttatccggggtgaagtggagcagctagactcccgcgcactgccgctgtgcctccaccagatagccgaatcctatttccaggaggaagactacgagaaggccatgaaatttattcagttagaacgcctctatcatgagcagctccttgcaaacttgagcgctatccaagagcaatgggaaaccaagtggaagaccgtccagcctcatactgtgacagccctcagaaacagcgagaaaggctttaatggcgaagacttcgaaagactgactaaaatatgcgcaacacatcaggatccactgttgagtaagcataaaatcgccgcagttgagaaatcccaagaacgcaagtgctccacacagttgctcgtgtccgaagaccccaaggagggaggggctacgacgaaagaaagtgaatcaaaaacctgtttgggcactgaatccagcaaagagtctcagcatactgtcgaacccctcgggtcctcaccatgctgtcatcaaatggatgtgcagacggatagtccatcactgtccgtcactgccggaaaagatcatatggaagagttgctgtgttcagctgaagcaacactagccctgcacacacagtcctcggagacggcaggcagcccttcagggcctgattcatccgaagatgcctgtgaagacgactccagacttcagctcgcccagacggaagcttgtcaggacgtggccaggatagagggcatcgcggaggaccctaaagtgttcttgtcttctaaatcaaaaactgagccgctgatcagtccagggtgcgatagaattccacctgccctgattagcgaggggaagtacagccaagcccaaaggaaggaattgaggctgccactgagagacgcgtccgaggcactacccactgaccagctggaaaataacgaactgaatgaattgcaacaacctgaccttactgatagtgatggtaaatctcctcaagcccaggccgatagcgacggatcagagaatgtcttatgtgggaataatcagatatctgacctgggaatactgttgccagaggtttgcatggcgcctgaagaaaaaggagacaaggatgaccagctgaataaggaaaccgaggactatctaaacagtcttctagagggctgcctcaaggataccgaggactccctcagttacgaggataatcaagacgacgactccgatctgctgcaggatttgtcgccagaagaggcaagttacagcctgcaggaaaatctgccctctgacgaatcctgtctctccttagatgacctggccaagagaattgaaattgccgaggtagtgcctactgaaggcctcgtgagcatcctcaaaaagcggaatgacaccgttggcgaccaccctgcgcaaatgcaacataagccaagcaaaagacgggtgcggtttcaagagattgacgattctctggaccaggacgaggtgggcggtgggtcatgtatccttctggtgctgttatgcatcgccaccgtctttctgtccgtgggtgggaccgcgttatattgtaccttcggagacatggagtccccagtctgcactgacttcgccgacaacatggatttctactacaccaagctcctgcagggtgtggctgagcttaaacattggatctacttatcctag

SEQ ID NO: 219174 - DNA, 3057 bp, Artificial Sequence
  Description of Artificial Sequence: Synthetic coding sequence
atgaaaatgtggctgcttgtgagtcatttggtgatcataagcattacaacttgtctcgccgaatttacttggtaccgcagatatgggcatggcgtctccgaggaagataaaggattcggacccatcttcgaagagcagcctatcaataccatttaccctgaggagagcctggaagggaaggtgagcctgaattgccgcgcaagggctagcccttttccggtctacaaatggaggatgaataatggcgatgtcgacctgaccagtgatcgatatagcatggtggggggaaaccttgtgattaacaacccagacaaacaaaaagatgcagggatttattattgcctggcgtcaaacaattatggaatggtgagatccaccgaagccacactgagctttggttacctcgatcccttcccaccagaagagcgaccagaggtgcgcgttaaagagggcaagggcatggtcttgctttgtgaccccccttatcacttccccgatgacttgtcctatcggtggctacttaacgagttccctgtttttataacgatggataaaagacggttcgtgagtcaaacaaacggaaatctgtacatagccaatgtggaggctagtgacaaggggaactattcatgcttcgtatcgtcaccgagcataacaaagtccgtcttcagcaagttcataccccttatccctattccagagaggacaaccaagccctacccggcagatattgtagtccagttcaaagacgtgtacgctctaatgggtcagaatgtaacgctggagtgctttgccctgggtaatccggtaccagacattcgctggcgcaaagtgctggagccaatgccctcgaccgccgagatcagcaccagcggagctgtcctcaagattttcaatatccagctagaggatgagggaatctacgagtgcgaggctgaaaatatccgcggaaaggataaacaccaagctcgtatatacgttcaagcttttccagaatgggtggaacatattaatgacaccgaagtcgatatcgggagcgacctatactggccatgcgtggcaacaggtaagccgatcccaactatccgctggctcaagaacgggtatgcttaccataagggcgaactgcgcctatacgatgttacatttgagaatgcaggcatgtatcagtgcattgccgaaaatacctacggcgctatttacgcaaatgccgaactgaagatcctggccctagcccctactttcgagatgaacccgatgaagaagaaaatcttagcagctaagggcggaagagttataatcgagtgtaagcctaaggcggctccgaaaccgaaattctcctggtcaaaggggacagagtggctcgtgaactcaagtcgaatcctgatctgggaggatggttccctggagatcaacaacatcacgcgcaacgacggtggcatatatacctgctttgccgagaataacaggggaaaggcaaactccaccggaacattagtcatcacagatccaacaagaatcatcctggcacctataaacgcagacatcactgtgggagagaacgcaaccatgcagtgcgctgctagcttcgatcccgctcttgatctgacatttgtgtggtctttcaatggttatgttattgatttcaacaaagaaaacatccattaccagcgaaatttcatgcttgactcaaacggagagttactgatccgcaacgcccaactgaagcacgctggacgctatacgtgtaccgcccagaccattgtggataactcttcagcgagtgccgaccttgttgtccgcggaccacctggaccgccagggggactgcggatcgaggacatccgagctacctcggtggccttgacatggagcagaggaagcgacaatcatagcccaatctccaaatacaccatccaaactaaaaccatcttaagtgacgactggaaagatgctaaaacagacccacctattatagaagggaacatggaagcggctagggctgttgatctgattccctggatggagtacgagtttcgcgttgtcgctacaaatacactggggcgaggagagcccagcatcccttccaaccgaatcaaaacagatggagcagctcctaacgtggcgccaagcgacgtcggcggaggaggtggacggaaccgggagctcaccatcacatgggctcccttatcccgtgaataccactacggcaataattttgggtacatagtcgccttcaaaccttttgacggggaagagtggaaaaaggtgactgtgaccaatcccgacacaggaagatacgtgcacaaggatgaaaccatgtcccctagcactgcttttcaggtgaaggtgaaagcattcaacaacaaaggggatggcccatattcacttgtagcagtgataaactccgcccaggatgcccctagcgaggccccaacggaggtgggggtgaaagtgttaagctcctccgaaatttcggtacattgggagcatgttctggaaaaaatagtggaaagctatcagataaggtattgggcagcacatgacaaagaggaagccgcaaatcgtgtccaagtgacaagccaggaatattcagcccgtctcgagaatctcctacccgatacccagtattttatcgaagtaggcgcttgtaattcagctggatgcggacctccttcagatatgatagaggccttcacaaaaaaagcaccaccttcccaaccccctcgcatcatttctagtgtgcggagtggttctagatatattatcacctgggaccacgttgtagccctcagtaacgaaagcacagttacgggatataaggtgctatatcgtcctgacggacagcacgacggcaagctctatagcactcacaaacattcaatcgaggtgccaattcctagagacggagagtacgtggtcgaagtccgggctcactccgatggcggagacggagtggtctcacaggttaagatctccggagcgcctaccctgagcccaagcctattgggactgcttctgcccgcttttggcattctggtctaccttgaattttag

SEQ ID NO: 219175 - DNA, 3024 bp, Artificial Sequence
  Description of Artificial Sequence: Synthetic coding sequence
atgaaaatgtggctgcttgttagtcatctcgttataatcagtatcacaacatgcctcgccgtcagcgaggaagacaaaggcttcgggccaatcttcgaggaacaacctattaacacaatttatcctgaagagtccctggagggtaaggtctctctgaattgcagggcgcgagctagcccattcccggtgtataagtggagaatgaacaacggcgacgtggacctgacgtctgacaggtactccatggtagggggaaacctggtgatcaataaccccgataaacaaaaagatgcgggtatatactactgcctggcctctaataattatggaatggtacgttctaccgaagctaccctctccttcggttacctggatcccttcccgcctgaggaaagaccagaagtgcgcgtgaaagagggaaagggcatggttttgctctgcgatccaccctatcatttccctgacgatttaagttacaggtggttattaaacgaatttcctgtgttcatcacaatggacaagagacgatttgtgtcgcagactaatgggaatctgtatatcgctaacgtggaggcaagcgataagggtaactatagttgttttgtttctagcccctccatcacaaaatccgtgttcagcaaattcatcccattaatacccatccctgaaagaaccaccaagccataccctgcagacatcgtggttcagtttaaggatgtgtatgccctcatggggcaaaatgtcaccctagaatgtttcgccctcggtaatccagttcccgacatacgttggcggaaggtcctggagcctatgccatctaccgccgaaatcagtacttcaggcgctgtcctgaagatcttcaacatccagcttgaagatgagggaatctacgaatgcgaggcagagaacattaggggcaaggacaagcaccaggccaggatctatgtgcaggccttccctgagtgggtggaacacattaatgacacagaggtggacattggaagcgacttatactggccatgcgtcgcgaccggaaaacccatccccaccattcggtggcttaagaacggctacgcctatcataaaggcgagctcaggctgtacgatgtaacgtttgaaaatgctggcatgtatcagtgcattgctgagaatacgtatggcgcaatttatgccaatgcggaactgaaaattcttgcgctagcccctacattcgagatgaatcccatgaagaaaaagatcctagccgcaaaggggggaagggtaatcattgagtgcaaacctaaggcagctccaaaacctaaattttcatggtcaaagggaacggagtggctagtgaatagtagccgcatcttgatttgggaggacggatctcttgaaatcaataatatcactcggaatgacgggggtatctatacctgctttgcagagaacaataggggaaaggcaaattctactggaacactcgtgatcaccgacccaaccagaattatcttggcaccaattaacgccgatatcactgtaggcgagaatgcaacaatgcagtgcgctgcaagttttgacccggctctggacttaacctttgtctggtccttcaatggctacgtgattgactttaacaaggaaaacatccactaccagcggaactttatgctagattcgaacggggaactactgataagaaacgctcagcttaagcacgccggtagatatacctgcactgctcagaccattgtcgataatagttccgcctctgcagatctcgtggtgcgaggacctccaggccctcccggtggcctacgcattgaggatatacgcgctaccagtgtggccctaacctggagccggggtagcgataatcatagccctatcagcaagtacacgatccaaaccaagacaatactgagtgatgactggaaggatgcaaaaacagacccccctattatcgaaggtaatatggaggcagcgagagcggtggaccttattccttggatggaatatgaattcagggtggtagctactaacaccttggggaggggtgaacctagtatcccctctaacaggatcaagacggacggcgctgctcctaatgttgccccttcagatgtcgggggtggtgggggacgcaacagagagctcacaatcacatgggctcccttgtcaagggagtatcactatggcaataacttcggatatatcgtggccttcaaaccattcgatggtgaggaatggaaaaaagttaccgtcactaatccagacaccggccgttatgttcacaaggatgaaaccatgtctccatcaaccgcgtttcaggtcaaagttaaggcatttaataacaagggggacggtccctattcattagtggccgtgataaacagcgctcaggacgcaccttctgaggcccctaccgaggtaggggttaaagtgctctcctctagtgagatttccgttcactgggaacacgtgcttgagaagattgtggagtcctatcagattagatattgggcagcccatgataaggaggaagcggctaatagggtgcaggtcacgagccaggaatactccgctcgcctcgagaatctgctgcctgatacccagtacttcatagaagtcggagcctgtaacagcgctggctgcggacccccatcagatatgatcgaggctttcactaagaaggccccacccagtcaaccccctcgaatcattagctccgtgcgatcgggatcccgctacattataacgtgggatcacgtggtggcccttagcaacgaatctacggtcacgggctataaggtcctctatcgtccagatggacagcatgacggcaaactctactcaacccacaagcatagcatcgaggttcctatacctcgggacggcgaatacgtcgtggaagtgagagcacactcagatggaggtgatggggttgtaagccaggtgaagatcagcggagctcccacattgtctcccagcctgctgggacttctgctccctgcattcgggatcttggtatatctcgagttttag

SEQ ID NO: 219176 - DNA, 1884 bp, Artificial Sequence
  Description of Artificial Sequence: Synthetic coding sequence
atgaaaatgtggctgctggtctctcacctagtgattatatctatcaccacgtgcctcgctgagttcacgtggtatcgaagatacgggcatggcgtatccgaagaagacaagggattcggcccaatctttgaagagcagcctataaatacgatctacccagaagagtcccttgaggggaaggtttcattgaattgtcgagccagagcttctccttttcccgtgtataagtggcggatgaataatggagacgtagacctgacgtcagatcgatatagtatggttggcggaaatctggtaatcaacaatcctgacaaacaaaaagacgctggaatatattattgtctggcttccaacaattatggtatggtgagatccactgaagccacactttccttcgggtatctggacccatttccaccggaggagagacctgaggtaagagtcaaggagggcaagggtatggtactgttgtgcgatccaccatatcactttcccgatgatctatcttatcgatggctcttaaacgagttcccagtgttcattactatggataaaagaagatttgtgtctcagacgaacgggaatctttacattgccaacgtcgaagcaagtgacaaagggaactactcctgcttcgtttctagcccctctattacaaagtctgtcttttctaaatttatccctctcatccctatccctgagaggaccacaaagccataccccgcagatattgtggttcagtttaaagatgtgtacgctctgatgggtcagaacgtgacccttgagtgcttcgccctagggaatccagtccctgatatacgatggcggaaagtgctggagcccatgccatctacggccgagatctctacttcgggagctgtgctgaaaatcttcaatattcaactggaagacgaagggatttacgaatgcgaagcggagaacatcaggggaaaagataaacatcaagcacgaatttacgtgcaggcctttcccgagtgggtagaacacatcaatgacaccgaagttgacatcggatccgacctctattggccttgcgtagccactggtaagccaatccccacgatcaggtggttaaagaacggctatgcttaccacaagggtgagctcagattatatgacgttaccttcgaaaacgctggcatgtaccaatgtatcgcggagaacacatatggcgcaatatatgcaaatgcagaactgaaaatcttggctctggctccaacctttgagatgaatccgatgaaaaagaagattttggccgctaaggggggtcgggtgatcatcgagtgcaaacctaaggcagcaccaaagccaaagttttcgtggagtaagggaaccgagtggctggtcaactcctctagaatcctgatctgggaagacggctccctcgagataaacaacattaccaggaatgacggaggcatatatacctgctttgccgaaaacaaccggggaaaggctaactcaaccgggacgctcgtcatcactgaccccactcgaataatcttggcgcctattaatgctgatattaccgtgggcgaaaatgcgaccatgcagtgcgcagccagctttgaccctgcgcttgacttaacattcgtgtggtccttcaacgggtacgttattgattttaataaggaaaacatacattatcagagaaacttcatgttagacagcaatggagagctcttgataaggaacgcacaactgaaacacgcaggtcgctacacatgcacagctcaaacaattgtcgataactctagcgcaagcgccgaccttgtggtgagaggaaaaaacaggaaaggtggagaaaaaaatatggtggacagcttccttccagtatgcgcgagtttgccaccaacgtggtag

SEQ ID NO: 219177 - DNA, 1884 bp, Artificial Sequence
  Description of Artificial Sequence: Synthetic coding sequence
atgaagatgtggctcctggtgtcccacctggtgatcatatccatcacaacatgtttagccgagtttacttggtaccggagatacggacacggggtgtcagaggaagacaagggctttggacctatctttgaggagcaacccatcaatacgatctacccagaggagagcctggaggggaaggtgtctcttaactgtagggccagggcttcacctttccccgtttataagtggaggatgaataacggcgatgtggatctcacgtctgaccgctacagcatggtggggggaaatctggtcatcaataaccctgacaagcagaaggatgccggaatttactactgtttggcaagtaataactatggaatggtgaggtccacagaggcgacacttagctttggatacctggacccattccctccggaggagcgacccgaggtacgggtaaaggaaggcaaagggatggtcctgctgtgcgaccctccgtaccacttcccggatgacctaagttatcgttggcttttgaacgagtttcccgtcttcatcaccatggacaagaggagattcgtgtcacaaaccaatggtaacctgtatattgctaacgtcgaggccagcgacaaaggcaactactcctgctttgtgtcatccccaagcattactaagagcgtgttctccaagttcataccacttatccctattccagagcgtacaacgaagccgtaccctgcagacattgtggtgcagttcaaagacgtttacgcgttaatgggacagaacgtcacactggaatgcttcgccttgggaaatccggtccccgatataagatggcggaaggtcctggagccaatgccaagtactgccgagatttctacctcgggtgccgttctgaaaattttcaacatccagctggaggatgagggtatatatgagtgtgaagccgagaatatcagaggaaaggacaagcaccaagctcgaatatacgtgcaggcattcccagaatgggtggaacacatcaacgacacagaagtggacattggaagtgatctgtattggccttgtgtagcaactggaaagcccatcccgacgatcagatggttgaagaatggctacgcctatcacaagggtgagctcagactgtatgatgtgacattcgagaatgctggaatgtaccagtgcattgccgaaaatacatatggtgctatttacgccaatgcggagctgaagatcctggccttagctcccacatttgaaatgaatcccatgaaaaaaaagatcttggctgccaaggggggaagggtgattatcgagtgcaagcccaaggcggcacccaagccaaaattctcatggagcaagggaaccgaatggctggtcaactcatccagaatcttaatctgggaggatggatcccttgaaattaacaacatcacccggaatgacgggggaatctacacatgctttgccgagaataatcggggaaaggccaattccaccgggaccctagtcattacagaccctacccggattatactggctcccatcaacgccgatattacagtcggcgaaaatgcgacaatgcagtgtgcagcatcctttgaccccgctctagatctaacctttgtctggtcttttaacggctatgtcattgatttcaataaagagaacattcactaccaaagaaacttcatgctggacagcaatggggagctgctaattcggaacgcccaactgaagcacgctggaaggtatacatgtacagctcagacaatcgtggataatagctccgccagcgctgacctggtcgtgcgcggaaagaatagaaagggaggagagaaaaatatggttgatagtttcttgccagtctgcgctagccttccacccacttggtag

SEQ ID NO: 219178 - DNA, 1884 bp, Artificial Sequence
  Description of Artificial Sequence: Synthetic coding sequence
atgaaaatgtggctgctggtctcccacttagtgatcatttctataacaacctgcctggcagagtttacatggtatcgccgatacgggcatggagtctcagaagaagataagggattcggccctatctttgaagagcaaccgattaacacaatctaccccgaagagagcctggaggggaaggtttcgttgaattgtagagccagggcttctccttttcctgtgtataaatggagaatgaataatggtgacgtggacctgaccagcgaccgctattctatggtaggcggtaatctggttatcaataaccccgacaagcaaaaggatgccggtatctactactgcttggcctccaataattatgggatggttcggagcacggaggcaacactaagctttggctatttagaccctttcccacccgaggagagaccggaagtgcgcgtgaaagaagggaagggaatggttctgctgtgcgatccaccttatcattttcctgatgatctgagctaccgctggctcctaaacgagtttcccgtcttcatcacgatggataagcgcaggttcgtgtcgcagactaatggaaacctgtacattgccaacgtagaggccagtgacaaggggaattacagttgcttcgtatcttcacctagcattacaaagagcgtgttttccaagttcatccctctgatacctattcccgagaggaccacaaagccatatcccgctgacatcgtcgtgcagttcaaggacgtgtacgcattaatgggccagaacgtcactctagagtgctttgcactaggcaatccagtgccggatatcaggtggaggaaggtcctcgaaccaatgcctagcactgctgaaatcagtacctcaggcgcagtgttgaagatcttcaacatccagcttgaggacgaaggcatatacgaatgcgaggctgaaaacatcagaggaaaagataaacatcaagccagaatctacgtgcaggcgttccccgaatgggtagagcacattaatgataccgaggtggatatcgggagtgacctttactggccttgcgtggctaccggaaaaccaattcccacaataaggtggctgaaaaacggttacgcctatcacaagggagagcttcggttgtacgatgtcacctttgaaaatgcaggaatgtaccaatgcattgctgaaaacacctatggggctatctacgccaacgccgagctgaaaatcctggccctggccccaacattcgagatgaatcccatgaagaaaaaaatcctggctgccaaggggggtcgcgttatcatcgaatgtaagcctaaggccgcacccaaacccaaatttagttggtccaaagggacggagtggctggtgaatagttctcggatcctgatatgggaggacggaagcctcgaaataaacaatatcacccgaaatgatgggggaatatatacttgttttgccgaaaataaccgaggaaaggccaactcaactgggacactcgttatcacggaccccacacggataatactggccccaattaacgctgacatcacagtgggggaaaacgccacaatgcagtgcgctgcaagctttgatcctgctctcgaccttaccttcgtgtggagttttaacggatatgtgatagatttcaacaaggaaaatattcactatcagcgtaatttcatgcttgactcaaacggtgagctcctcatccgcaacgcccaactgaagcacgccggaagatatacatgcacagcacagacgatagtcgacaatagtagcgcttctgcggatttggtggtgcggggaaagaacaggaagggtggggagaagaacatggtggattcctttttgccggtctgcgcttcgctccctcccacttggtag

SEQ ID NO: 219179 - DNA, 258 bp, Artificial Sequence
  Description of Artificial Sequence: Synthetic coding sequence
atgaaaatgtggctccttgtaagtcacctagtaatcatcagcataaccacgtgccttgctgaattcacttggtatcgtaggtacggtcacggcgtgagtgaagaggataagggctttgggccaatttttgaagagcagcccatcaacaccatctaccctgaagagtccctcgagggaaaggtttcattaaattgccgagcaagagcttctccattccctgtgtataaatggcgaatgaacaacggtgatgtcgattag

SEQ ID NO: 219180 - DNA, 3057 bp, Artificial Sequence
  Description of Artificial Sequence: Synthetic coding sequence
atgaaaatgtggctgcttgtcagccacctagttatcattagcatcacaacatgtctcgccgaatttacctggtacagacgctatgggcacggcgtcagcgaagaggataaggggttcggcccaattttcgaagagcagcccatcaatacgatttacccagaggaaagcctggaagggaaagtgtccctgaactgtcgcgcacgtgcatcgccttttccagtttacaagtggaggatgaataacggcgacgtcgacttgacatctgatcgctattccatggttggaggcaacctggttatcaacaaccccgataagcagaaggacgccggaatctactattgcctcgcatctaacaactacggcatggtcaggagtacggaggccacactgtcgttcggatacttggatcctttcccccctgaggaacgccctgaggtgagagtgaaagagggaaagggcatggtcctgctgtgcgaccctccataccatttccccgatgatctgtcttatcggtggctcctgaacgagttccccgtgttcatcacgatggataaaaggcggtttgtgtctcaaactaatggaaacttgtacattgcaaatgtggaggcctccgataaaggcaattatagctgttttgttagtagcccatccattacaaagagcgtgttctcgaagttcatacctctgatccccatccctgaacggaccactaagccttaccctgccgacatagtggtgcaattcaaagatgtgtatgcccttatggggcagaatgtgacattggaatgcttcgctctgggaaatccagtgcccgatattagatggaggaaagttctggagccgatgccctcaactgcagagatttcaacttccggagctgtgctgaagatcttcaacatccaacttgaagacgagggcatctacgagtgtgaggcggaaaatatccgtgggaaggataagcaccaagccagaatctacgttcaggcctttccagagtgggtcgagcacatcaatgatactgaagtcgacataggtagcgatctctattggccatgtgtggctaccggaaagcctatacccacgattaggtggctgaaaaatgggtacgcataccacaagggcgagttaaggttatacgacgttacttttgagaacgcaggaatgtaccagtgtattgccgagaacacatacggagccatctacgccaacgcagaattaaaaatcctggccctcgcccctacatttgaaatgaacccaatgaaaaagaagatcctggcggctaaaggaggcagagttatcatcgagtgtaaacctaaagcggcaccgaagcccaaattctcatggtcaaaaggtactgaatggttggtgaatagctcccggatcctgatctgggaggacggcagcctggagattaataatatcactaggaatgacggcggaatctacacttgctttgccgagaacaacagaggcaaagccaactctaccgggactctggttattactgatccgacaagaatcatcctggctcccatcaacgccgatatcactgtgggtgagaatgccacgatgcagtgcgcggcttccttcgaccctgccttggatcttacattcgtttggtcctttaacgggtatgtcatcgacttcaacaaagagaacattcactaccaaagaaatttcatgcttgactcaaacggtgaattactcattaggaatgcacagctgaagcacgctggtcgatatacttgtacagctcaaactattgtggacaactcgagcgcaagcgccgacctcgtggtgcgcggtccacctggcccacccggaggactacggatcgaagacattagagccactagtgtcgccctgacgtggtcgcggggaagcgacaaccattcccccatatccaaatacaccatccaaaccaagacaattctgagtgacgactggaaggacgccaagacagacccccctattatcgaggggaatatggaggccgcaagagctgtagacctgattccatggatggaatacgagttccgggttgtcgccacaaacaccctgggcagaggggagcctagcattccatccaaccgcattaagacagacggggctgcaccaaatgtggctcctagcgatgtggggggaggcggaggtcgtaaccgggagctcaccattacatgggccccactgtccagagaataccattacggaaataactttgggtacattgtagcttttaagccattcgacggcgaggagtggaagaaggtgacagtgacgaacccggacactggtaggtacgtacataaggacgaaactatgagcccaagcacagcatttcaggttaaggtgaaagccttcaataacaaaggcgatgggccttattccttggttgccgtcataaactcagctcaggatgcgccaagtgaagcccctaccgaggtgggcgtgaaggtcctgtcttccagcgagatctccgtccattgggagcacgtgctggagaaaatcgtcgaaagctaccaaatcaggtactgggccgctcatgataaagaagaggccgctaacagagtccaggtcacatcccaggagtacagtgctagactagagaatctgctgccagacacccagtatttcatagaggtcggggcttgtaacagcgcaggttgcggcccaccttcggatatgattgaggcctttaccaaaaaggcacctccctcccaaccccctcggatcataagctctgtacgcagtggttctcggtacatcatcacctgggaccatgtcgtggccctgagtaacgagtccacagtaacaggatataaagtgctctatcggccagatgggcagcatgatgggaaactgtattctacccacaaacacagcattgaggtccctatccccagggatggcgagtacgtggtcgaggtcagagcccattccgacggtggtgatggggtggtctctcaggttaagatctcaggcgcaccgacactttccccttctctcctgggactgctccttcctgcttttggcattctcgtctaccttgaattttag

SEQ ID NO: 219181 - DNA, 192 bp, Artificial Sequence
  Description of Artificial Sequence: Synthetic coding sequence
atgaagatgtggcttttggtctctcacctggttattatcagtatcaccacatgcctggccgagtttacttggtatcgcagatacggccatggcgtgagtgaggaggataagggtttcggccctatctttgaagaacagcccataaataccatttatcccgaggagtcactcgaaggtaaggtttctctgtag

SEQ ID NO: 219182 - DNA, 273 bp, Artificial Sequence
  Description of Artificial Sequence: Synthetic coding sequence
atgaaaatgtggcttctagtgtcacacctcgtgattattagcataaccacctgtctggccgagttcacatggtatcgcaggtacggccacggcgtgtctgaagaagataaaggatttgggccaattttcgaggagcagccgataaacacaatttaccccgaagaaagcctcgagggcaaagttagccttaactgccgtgcgagagcctctcctttccccgtctacaagtggaggatgaataatggtgacgttgatctgacatccgatcggtag

SEQ ID NO: 219183 - DNA, 222 bp, Artificial Sequence
  Description of Artificial Sequence: Synthetic coding sequence
atgaaaatgtggctccttgtcagtcacctggtgatcatttccatcactacctgccttgccgaatttacttggtatagacggtatgggcacggcgtttccgaggaggataaggggtttggccctatcttcgaggagcaaccaatcaataccatatacccggaagaatccctagaggggaaagtgtcgctcaattgtcgggctcgggcttcgccattcccatag

SEQ ID NO: 219184 - DNA, 3123 bp, Artificial Sequence
  Description of Artificial Sequence: Synthetic coding sequence
atggggactgccacacgaagaaagccacatctgctgcttgttgctgcggtggccctcgtaagctctagtgcatggtcttccgcactgggcagccagactaccttcggcccagtcttcgaggatcagcccctctctgtgctgtttcctgaggagtctaccgaggagcaggtcctgctggcctgccgcgctagggccagccctcccgcaacctatagatggaaaatgaatggcacggagatgaaactggagcccggttcccgtcatcagctggttggaggtaacctagtcatcatgaaccccacaaaggcccaggacgctggggtttaccagtgtctggcttccaatccagtaggtaccgtggtgagccgcgaagcaattctgcggttcggctttctgcaggagttctctaaggaggaacgggaccccgtgaaagcccatgaaggatggggagtgatgttaccttgtaacccccctgcccactaccccggactgtcatataggtggctgctcaatgaattccctaacttcattcccactgacggaaggcatttcgtgtctcagacgactggtaatctctacatcgcaagaacgaatgccagtgacctgggcaattatagttgcctggctacaagtcacatggacttctctacaaagtctgtctttagcaagttcgctcagttgaatctggcagccgaagatacaaggttattcgcgccttcgataaaagccagatttccggctgagacatacgccttagtaggacagcaggtgaccttggagtgcttcgctttcgggaaccccgttccccgaatcaaatggcggaaggtcgatggttcactaagtccccagtggacaactgcagaaccaaccttgcaaatccccagcgtgtcttttgaggatgaagggacctatgaatgtgaggccgaaaattctaaaggaagggatacagtgcagggccgaatcatagttcaggctcagccggaatggcttaaagtgatcagcgataccgaggccgatatcggctctaaccttcgctggggctgcgcagctgcaggcaaacccaggccaactgtccgctggctgcgcaatggtgagcccctagccagtcagaatagagtcgaagtgctggccggtgatctcaggttcagcaaactgagccttgaggattctggcatgtaccaatgtgttgccgaaaataaacatggcaccatctatgcctctgcagagttggctgttcaggcattagctcccgactttcgcctgaacccagttagaaggctcatcccggctgcgagaggtggggagatcctgattccctgtcagcctagggcagctcctaaggctgtagtcctgtggagcaaaggtaccgagattctggttaactcttcccgggtcaccgtcaccccggatgggactctcatcatcaggaacatttcaaggagcgacgaggggaaatacacctgcttcgctgagaactttatgggcaaggcgaactccacaggaatcctgtccgtgagggacgcaaccaagattactctggctccgagctcggccgatataaacttgggcgataacctcaccttacaatgtcatgcttcacatgacccgacgatggacctcacatttacctggacattggatgattttcctatcgacttcgataagcccggaggccattacagaagaacgaacgtcaaagaaacaatcggggatttaacaatactgaacgcccagctgagacacggaggtaagtacacatgcatggcccagacagtcgtcgatagcgcctctaaggaagcaaccgtgctcgttagaggtccaccaggcccacccggaggggtagtcgtacgcgacattggagatacgaccatccagctttcctggtcaagagggttcgataaccactctcctatcgccaaatatacgctgcaggcgaggacccctcctgcagggaaatggaaacaggtgcgaaccaatccagccaacatcgaaggcaacgcagagacagctcaggtcttaggactgaccccatggatggattacgaattccgagtgattgcttccaacatattgggcactggcgaaccatcaggaccttcttctaaaattcgaacccgggaggcggcaccttccgtggcaccatccggcttgtccggtggtggcggagcgccaggcgagttgatcgtgaactggacgcctatgtctcgggagtatcaaaatggcgatggcttcggatatcttctttcattccgtagacagggatctacacactggcagacggcaagagtgccaggagccgatgcccagtacttcgtctactcaaacgagagtgtgaggccgtatacccctttcgaagtcaagatccgatcctacaatcgcaggggtgacggacctgagtctctcacagcgctcgtgtattctgccgaggaagagcctagagtagccccaacaaaggtttgggccaaaggagtatcctcatccgagatgaatgtgacctgggagcccgtacagcaagatatgaatgggatcctgctggggtatgagattcggtactggaaggccggtgataaggaagccgctgccgatcgcgtgaggacggcagggctcgacacgtcagcaagagttagtgggctgcaccccaatacgaagtaccacgttaccgttagagcctacaacagggcagggactgggccagcaagtcccagcgcaaacgctaccaccatgaagcctccaccgaggcgccctcctggcaacatatcctggaccttttctagctccagtctgagcattaagtgggatcccgttgttccctttagaaacgaatccgccgtgacagggtataagatgttgtatcagaatgacctgcaccttacgccaacattgcacctgacaggcaagaactggatagaaatccccgtccctgaggacatagggcatgctttagttcagatcaggacgactggtcctggcggagacggcatacctgccgaggtgcatatcgtgcgtaacggtggaacctctatgatggtagagaacatggctgtgcggcctgcaccacatccgggtacagtgatctcacatagcgtggctatgctcattctcatcgggtctttggagctatag

SEQ ID NO: 219185 - DNA, 3087 bp, Artificial Sequence
  Description of Artificial Sequence: Synthetic coding sequence
atgatgttcccatggaaacagctaatactgctctccttcattggctgcctgggtggtgaacttctgttgcaaggccctgtgttcataaaggaacccagcaatagcatctttcccgtggggagcgaagataaaaaaatcactctgcactgcgaggcgagaggcaatccatccccacattatcggtggcagttgaacggctctgatatcgatatgtcaatggaacaccgatacaagctgaatggcggaaatctagttgttatcaatccaaaccggaactgggataccggcacgtaccaatgctttgccactaacagcttgggaactattgtgtcaagagaagccaaacttcagttcgcgtatttggaaaacttcaagacgaaaatgcgctctactgtgtccgtccgggaaggccagggcgtggtattgctgtgcggacccccaccccactccggagagctgtcctacgcatggatcttcaatgaataccccagcttcgttgaggaggattcacggcgtttcgtctcacaagagacaggacatttgtatatttctaaggtcgagccctcggatgttggaaattacacctgcgtggtgaccagcatggtgacaaatgcccgtgtacttggatctcccaccccgctggtactgcgcagcgatggagttatgggcgagtacgaacccaaaatcgaggtgcagttcccggaaaccttacccgctgccaagggcagcactgttaagctggagtgttttgccctcggcaatccaattcctcagatcaattggaggcggtcagacggcctgcccttcagtagcaagatcaagcttaggaagttttctggggttcttgaaatcccgaattttcagcaggaggatgcagggtcctacgaatgcattgcagaaaactccaggggcaagaacgtcgccagggggaggctgacctattatgccaagccgcattgggtacaattgatcaaggatgtagagattgccgtcgaagacagtttgtactgggagtgtagagcatccgggaaaccgaagccgtcatacagatggctgaagaatggagccgcactggtacttgaagaaaggactcaaatcgaaaacggggctctaacgattagcaacttgagtgtgacggatagcggtatgttccagtgtatcgcagaaaacaagcatggcctggtttatagctctgctgagctgaaggttgtcgcaagcgcccctgacttttccaagaatcctatgaaaaagcttgtccaggtgcaagttgggagcctggtcagtttggattgcaagcccagggcatcacctagggcactcagcagttggaagaagggtgatgtctccgtccaggagcacgagaggatctccctgttgaatgacggcggactaaaaatcgcaaacgtaacgaaggccgacgccggaacctacacttgtatggctgagaatcagtttggaaaggctaatggtactacccatctcgttgtgactgagcctacgagaatcacgctggccccatcaaacatggacgtgtcagtgggggagagtgtcattctcccatgtcaggtgcagcatgacccattgctggatattatcttcacctggtacttcaacggggcactcgctgattttaagaaagacggctctcatttcgagaaagtgggaggctcctcaagtggagaccttatgatccgaaacattcagctgaagcactctggcaagtatgtgtgcatggtgcagactggcgtggactccgtgtccagcgctgccgacctcattgtgagaggctcccccggtcccccagagaacgtgaaggtcgatgaaataacagacacaacggcacaactcagttggaaggaggggaaggataaccactcaccagttataagttattctatccaagctagaaccccctttagcgtgggctggcagaccgtaaccactgtccccgaggtcatcgacgggaagacccacacagccactgtcgtggagctgaacccgtgggtggagtatgaattcagagtcgtcgcgtccaataaaatcggtggcggtgagcccagcctccccagtgagaaggtaagaactgaggaggctgtcccagaggtcccccctagtgaggttaatggcggagggggatctaggagcgagttagtcattacatgggatcccgtgcctgaggagctacaaaatggtgaaggtttcggctacgtcgtcgcttttcgtccgttaggtgtaaccacctggattcagaccgtcgttacgtcacccgacaccccaaggtacgtttttcgcaacgaatctattgtcccgtactcaccgtacgaggttaaggtcggcgtgtacaataacaagggagaagggcctttctctcccgtaacgacagtctttagcgcggaagaagagccgaccgtggccccatcacaggtcagcgccaacagtctgagcagctcagaaattgaggtgtcgtggaacactattccctggaagctgtcaaacgggcacctgcttggatacgaagttcgctactggaatgggggaggtaaggaggaatccagttcaaagatgaaggtggctgggaacgaaacatctgccaggctgagaggcctgaagtcgaacttggcctactacactgcagttcgtgcgtacaatagcgcgggagcagggcctttttccgctaccgtcaacgtgacaacaaagaaaacacccccatcacagcctcccggtaacgtggtgtggaacgctactgacaccaaggttctcctcaactgggagcaagtgaaagcaatggagaatgagtctgaggtaacaggatacaaggttttctatagaacatcatcccagaacaatgtgcaggtgttgaatacaaataagacatctgctgaactcgtgctaccgattaaagaagattacatcattgaggtgaaagcaacaacagatggaggagatggaacctcgtccgaacagatccggattccccgaatcacttccatggatgcacgaggttccaccagcgcaatctcgaatgtgcaccctatgtctagctacatgcccattgtgctgtttctgattgtgtacgtgctgtggtag

SEQ ID NO: 219186 - DNA, 2424 bp, Artificial Sequence
  Description of Artificial Sequence: Synthetic coding sequence
atgggagagtatgagcctaagattgaagtgcagttcccagagacagtcccaaccgccaagggagctaccgtaaaactggagtgtttcgcactaggcaaccccgttcctaccatcatttggcgcagagctgatgggaagccgattgccaggaaagctcggagacataaatccaacggcattttggaaatccctaatttccaacaggaggacgcagggctttatgagtgtgtagcggagaatagtcgaggtaaaaatgtcgcccgaggtcagctgactttctatgcccagcctaactggatacaaaaaataaacgatatccacgtggccatggaggagaatgtgttctgggagtgcaaggccaacggtcggcctaagcctacttacaagtggctcaaaaacggcgagcccctactcactcgggatcgaattcagatagagcagggtaccctcaatatcactattgtgaatctgtcggacgcaggtatgtaccagtgtctggccgaaaataagcacggggtcattttcagcaatgcggaactgtccgtgattgccgtcggccctgatttttcccgaacactactcaaacgggtcactctggtcaaggtgggaggcgaagtggttatcgaatgcaaacctaaggcttcccccaagcccgtttatacatggaagaaaggacgcgatatcttaaaggagaatgagagaataacgatttccgaggacggcaacttaagaatcattaatgtgaccaaatctgacgccggtagctacacgtgtatagcgacaaatcactttggaactgcaagcagcacaggcaacctggtggtaaaagatccaacgcgggtaatggtgcctccatcaagtatggatgttaccgtaggggaatcgatcgtgctcccatgtcaggtgacgcacgaccattccctggacatcgtctttacctggtcttttaacggacacttgatcgactttgatcgtgatggtgaccactttgaacgagtaggagggcaggattctgccggtgacctgatgattagaaatatccagctgaagcatgcagggaagtatgtctgcatggtccagaccagtgttgatcgtctgtccgctgcagccgacctgatagtgagaggccctcccggaccgccagaagctgtgactatcgatgaaataaccgacacaacggctcaattatcctggcgcccaggcccagacaatcatagtccgataaccatgtatgtcattcaggctcggaccccattctccgtaggatggcaggctgtgagtacagttccagaactcatagatggcaagacctttactgccaccgtggtgggcctcaacccatgggttgaatacgagtttaggacagttgcagccaacgtaataggcatcggagagcccagtcggccatcagagaaacgacgcacagaggaagcactgcctgaggtcactcccgctaacgtttccggagggggtggctcgaagtcagagctggtgattacttgggagacagtgcctgaggagctccaaaatggtagggggttcggctatgtggtggccttccgcccatacgggaagatgatctggatgctgactgtgttagcctcggccgatgcttcccgctacgtgtttcgtaatgaatccgtccaccctttcagtccattcgaggtgaaggttggcgtgtttaataataaaggtgaaggacctttttcccccacgactgtggtgtacagtgctgaagaggagcccacaaagcctccggcaagtatctttgccaggtccctgtcggccaccgatatcgaagtattttgggccagccctctagaaaaaaaccgcggacggatccagggctatgaagtgaagtactggcgccatgaggacaaagaagagaatgccagaaaaattcggacagtggggaaccaaaccagcactaagattacaaacttgaagggatccgttctttaccatctagccgtgaaggcctacaacagcgcgggtacaggaccttcatctgccacggtcaacgtgaccactcgtaaacctcctcctagccaaccaccgggaaatattatttggaattcctcagattccaaaattatcttgaattgggaccaggtcaaggctttggataatgaaagcgaagtgaagggatataaggtgctctaccgctggaaccgtcagtcttctacctcagtcatcgaaactaacaagacaagcgtggaacttagcctaccttttgatgaggattatatcattgagattaagccattcagtgacggaggggacgggtcctcgtctgagcagatcaggataccaaaaatttcaaatgcttacgccaggggtagcggagcctctacctccaacgcctgtacactctctgcgataagtactattatgatcagccttacagcccgtagctcgctgtag

SEQ ID NO: 219187 - DNA, 2097 bp, Artificial Sequence
  Description of Artificial Sequence: Synthetic coding sequence
atggaggaaaacgtcttttgggaatgcaaggccaatggcagacccaaacctacatataaatggctgaagaatggagaaccactcctgacaagggatcggatacagatcgagcagggcaccttgaacataacgattgttaacctgagtgacgcgggtatgtaccaatgtctggctgaaaacaaacacggagttatcttttccaacgccgaactctcggtgattgctgtcgggccagatttctcgagaacactgctcaagagggtgacgctggtcaaggtgggcggagaggtcgttatagaatgcaagccgaaggcctctcctaaaccagtgtatacatggaagaagggccgagacatcctgaaggagaacgaacggataaccatttccgaggatggaaatttgaggatcatcaatgtgacgaaatctgatgcgggatcctacacttgcattgccactaatcacttcggaaccgcctctagcactggcaacctggttgtgaaggaccccacacgcgttatggtccctcctagcagtatggacgtcaccgtcggagaaagtattgtccttccatgtcaggtgactcacgatcatagtctggacattgtttttacatggagtttcaatgggcacctcattgactttgatagggacggagaccatttcgagcgagttggaggacaggactccgccggtgacctgatgatcagaaatattcagttgaagcacgcaggtaagtatgtgtgtatggttcagacttcagtggaccgactctcagccgctgccgatctgatcgtgaggggtccacccggacctcccgaggcggtcacaatcgacgagattacagatactacagcgcagctgagctggagaccaggccctgacaatcacagtcccattacaatgtacgtgattcaggctaggaccccattttccgttggttggcaggctgtgtcaacagtaccagaactgatcgatggtaaaacattcacagctacagttgtgggcctcaacccctgggtggagtacgagtttcgcacagtcgctgcaaacgtcataggcattggagagcctagtagacccagcgaaaagaggcgaactgaggaggcactaccagaggtgacaccagctaatgtgtcaggtggcggtggcagcaagtccgagttggtcatcacatgggagaccgtgccggaggagttgcagaacggcagaggcttcgggtacgtcgtcgctttccgcccatacggaaagatgatttggatgctgaccgtcctcgcaagtgcagacgcttctcgttatgttttccggaacgagtcagtgcatccattttccccttttgaggtcaaagttggtgtgtttaacaataagggagagggacccttctcccctaccacggtggtatactctgctgaggaagaacccacaaagcccccagcttccatttttgcccgatcactgtccgctaccgatatcgaggtgttctgggcgtctccgcttgaaaaaaatcgtggcagaattcagggttatgaggtgaagtactggaggcacgaagataaggaggagaatgcaagaaagatccgcactgtcgggaaccagaccagcaccaagattacgaatctaaaaggtagtgttctgtaccatctggcagtgaaggcatataattctgcaggtactggtccatcttccgcaactgtgaatgtgaccacacgtaaacctcctccatcacagcccccaggcaatattatttggaactcttccgattccaagataatcttgaactgggaccaggtgaaagctctggataacgagagcgaagtaaaaggatataaagtgctttaccgttggaatcgtcaatctagcactagcgtgatcgaaactaataaaacctccgttgagctgagcctgcctttcgatgaggattacattatcgagatcaagcccttcagcgatgggggtgatggctctagctcggaacaaattcggatccccaagatttccaacgcctacgccagagggagcggagcttcaacgtctaacgcttgcactctctccgctatcagcaccatcatgatctccctcacagcgaggtctagtctatag

SEQ ID NO: 219188 - DNA, 3081 bp, Artificial Sequence
  Description of Artificial Sequence: Synthetic coding sequence
atgcgcctaccttgggagctgctggtgcttcagtctttcattttatgcctcgcagacgactccactctccacggacctatattcatacaagaaccttcaccagtaatgtttcctctggactcagaggagaagaaggtgaagttgaactgtgaggttaaggggaacccaaaacctcacataagatggaagttgaatggcaccgacgtggacaccggcatggactttcggtattccgtagtggaaggctccctgcttattaataatcccaataagacacaggacgctggcacataccaatgtaccgccaccaattctttcggaacaatcgtgagcagggaagcaaagttgcagttcgcttacctggacaacttcaaaacaaggacgcggtccactgtgtcagtgcgacgaggccagggcatggttcttttgtgcggtccccctccacattcaggcgagctgtcctatgcctggattttcaacgaatatccatcctaccaagataatcgccgtttcgtcagtcaagagactggtaatctgtacattgccaaagtggagaaatcagacgtgggaaattacacatgcgtggtgacaaataccgtcacaaaccacaaagtattgggaccacctaccccactgattctgcggaatgatggcgtcatgggtgaatatgagcccaaaatcgaagtgcagttccccgagaccgtgccgacggccaagggtgccacggtcaaattggaatgtttcgctctgggcaaccccgtgccgaccattatatggcgcagggcggacggtaagcctattgcacgcaaggctcgccgacacaaatccaatgggattctggaaatacccaatttccagcaggaggacgccggattatacgagtgcgtggccgaaaattctcgtggcaaaaatgttgcacgaggacagctaaccttctatgcgcagcccaactggatccaaaaaattaacgatatccacgtggcaatggaggaaaacgttttttgggaatgtaaggctaacggacgccctaaaccaacatataaatggttgaagaatggcgagcccctcctcacgcgggatagaatacaaatcgaacaaggcactctgaatataaccatcgtcaacctttctgatgcaggcatgtaccagtgcctcgccgaaaacaaacacggggttattttcagtaacgccgaacttagcgtcatagcggtgggacccgacttcagccggaccctcctcaagcgagtgactctggtcaaagtgggaggagaggtggtgatcgaatgtaagccaaaggccagccccaagcctgtctacacgtggaagaaaggccgtgacattcttaaagaaaacgaaagaatcacgatatcagaggacggcaacctcaggattattaatgtaactaaatccgatgctggttcctacacatgcatcgctactaaccactttgggaccgcctcaagcactggaaacctggttgtgaaggatcccactcgcgtgatggtccctcctagctccatggatgtaacggttggcgagtccattgtgctgccctgtcaagttactcacgatcattcactcgacatagttttcacttggagttttaacggccacctgatcgattttgaccgagacggcgatcacttcgaaagggtcgggggacaggactcagcgggtgatctaatgatccgcaacatacagttaaaacacgccggaaagtatgtctgcatggtccaaactagcgtggatcggctgtccgccgcagccgatcttatcgtccgtggtccacccggtcctccagaagccgtcacaatcgatgaaatcacagacacaacagcccagctatcttggcgccctgggccagacaatcacagccctatcaccatgtatgtgatacaggccagaacacccttctctgtaggctggcaggcggtttccactgtcccggagttgatcgacggaaagacctttaccgcaacagtggtcgggctcaacccctgggtggagtatgagttccgcaccgtggcagcgaatgtgatcggaattggtgaaccatcgagaccaagcgagaaacggagaacagaggaagctctgcctgaggtcacgccagccaacgtgtccggcggaggagggtcaaaatcagaactagtgatcacatgggagaccgtacccgaggaattacagaacggtcggggattcggttacgtggtcgcattccgcccatacgggaaaatgatttggatgctgactgtcctcgcatctgcggacgcttcccggtacgtgtttcgcaatgagtctgtacaccctttttcccccttcgaggtgaaagtaggagtgttcaacaataagggagagggacctttctcccctacgactgtggtctactctgccgaggaagagccgaccaaaccgccagcctccatttttgcaagaagtttgagcgctacggatattgaggtgttttgggcctcgccgttggagaagaacagaggaagaatccagggctacgaggtgaaatactggagacatgaggataaggaggaaaatgctcgtaaaattcgcacggtgggaaaccagacaagcactaagataacgaacctgaaggggtccgtcctgtaccacctagccgtgaaagcctataattccgccggtactggacccagctctgccaccgtgaacgtcactactaggaagcctccaccatctcagccccctgggaacataatctggaattcctccgattctaaaataatcctaaactgggatcaggtgaaggccctggacaacgaaagcgaggtaaaggggtacaaagttctttatcggtggaatcgtcagtcttccactagcgtgatagagacaaacaagacaagtgtggaactgagcctgccctttgatgaggattacatcatagagatcaaaccgttctctgacggtggagatggcagcagctcagagcaaatccggatcccgaagatcagcaatgcctacgcccgaggctccggtgccagtacttccaacgcttgcacactatccgctatttcaactatcatgataagcctgacggcccgaagttccctgtag

SEQ ID NO: 219189 - DNA, 3081 bp, Artificial Sequence
  Description of Artificial Sequence: Synthetic coding sequence
atgaggctgccctgggagctgctggttcttcagtcattcattttatgtctggccgatgacagtacattgcacggacctattttcatccaggagccgtcccccgtaatgtttcccttggatagcgaagagaagaaggtgaaactgaactgtgaggtcaaaggtaacccgaagccccatattagatggaaattaaatggcaccgatgtagacacgggaatggatttcaggtactcagtagtggagggcagtctcctaataaataaccccaacaaaacccaggatgctggcacttaccaatgtaccgctactaacagttttggaaccatcgtctctcgagaagctaaactccagttcgcctatcttgacaattttaagacacgtactagaagcaccgtgtcagtgcgccgtggccaggggatggtcctactgtgcggacctcctccacacagcggggagctctcctatgcgtggatcttcaacgagtacccttcgtaccaggacaatcgacggttcgtgagtcaggagactggtaacctgtacatcgcaaaagtcgaaaaaagcgatgtcggcaattacacctgcgtcgtcactaatacggttaccaaccataaggtactcggaccacccacacctctgatcttgcgtaatgacggggtgatgggtgaatacgagccaaagattgaagtgcagtttccagagacagtgcccaccgccaagggcgcaactgtcaagctggaatgttttgcccttggcaacccagtgcccactataatttggagacgagccgatggcaagccaatagcaaggaaagcacgcagacacaagtccaatggcattcttgaaatcccgaactttcagcaggaggacgctggactctatgagtgtgtggctgagaattctagaggcaagaacgtggccaggggtcagctgaccttttatgcacagcccaactggattcaaaagatcaatgatatccacgtggcgatggaggaaaatgtgttctgggagtgtaaggctaatgggcgaccaaaaccaacctataagtggctgaaaaacggagaaccccttttaacacgggatcggattcagattgagcaaggaacgctaaacattactattgtcaacctctccgacgccggaatgtaccagtgtctcgcggaaaacaagcacggagtaatattcagtaatgcggagctcagcgttatcgcggtggggcctgattttagccgtaccttattgaagcgcgtgactctggttaaggtgggaggggaagttgtgattgagtgcaagcctaaggcttcccctaagcctgtgtacacctggaaaaaaggtcgggacattctgaaggaaaacgaaagaatcaccatttcagaagacgggaaccttagaattataaatgtgaccaaatccgatgcaggctcgtatacttgcattgccaccaatcatttcggtactgcaagcagcaccggcaacctggtggtcaaagaccccacgagggtcatggtcccaccaagctctatggacgtgaccgtcggagagagcattgtgctgccatgccaggttacccatgatcactccctcgatattgtgttcacctggtcgtttaatgggcatctcatcgatttcgaccgagacggggaccattttgagcgcgtgggcggtcaggactcggctggcgatctgatgattaggaacattcagctgaaacacgctggtaagtatgtttgcatggtgcagacttctgttgataggctgtcagctgccgctgacctaatagtacgcggacccccagggccaccggaggccgttaccattgatgagattaccgacacaactgcacagttatcctggcgccctgggccagataatcattcccccataaccatgtatgttattcaagctaggaccccattctccgtgggctggcaggccgtgtcgactgtgcccgagctcattgatggcaagacctttacagctactgtggtgggcctgaatccatgggtggagtacgagtttcgaacagtggcggcaaacgtgattggcattggtgaaccttctaggccttccgagaagagacgcacagaggaagcactgcccgaggtcacacccgctaacgtgtcagggggagggggttctaagagtgagctggtgatcacatgggagaccgtgccggaagaactgcaaaacggtagagggttcggctatgtcgtggcctttcgaccatacgggaaaatgatttggatgttaaccgttctggcgtcagccgatgcctccagatatgtttttcggaatgaatctgtgcatccattctctcctttcgaggttaaggtgggtgttttcaacaacaaaggcgaaggcccattctccccaaccaccgtcgtctactcagccgaagaggagccgaccaaacccccagcctccatatttgccaggagtctaagtgccactgacatcgaggtcttctgggcgtccccgctggagaagaatagggggcgtatccagggctatgaggttaaatactggcgacatgaagataaggaggaaaacgcgcgaaagatacggacggttgggaatcaaactagcaccaagatcaccaacctcaaagggtcagtgctgtatcacctggccgtgaaggcatacaactctgctggcacaggcccttcttccgctaccgtcaatgtgactacaaggaagcctcctccatcccagcctcctggcaatatcatctggaactcctcagattctaagattatcctcaattgggaccaggtgaaagccctcgacaacgaatcagaagtcaaaggatataaggtgttgtatcgctggaatagacagtctagcacttcggtgatcgagaccaacaagacttccgtcgagctatccctgccctttgatgaagattatattatcgagatcaagcccttctccgacggcggagatgggtcctcctccgagcaaattcgaattccaaagataagtaacgcctatgcaagaggcagtggcgcaagtactagcaatgcttgcacccttagcgccatatccactattatgatctctctgaccgcaagaagctcgctctag

SEQ ID NO: 219190 - DNA, 351 bp, Artificial Sequence
  Description of Artificial Sequence: Synthetic coding sequence
atgagactaccttgggagctcctggtactccagtccttcatcctatgcctggccgatgattccaccttacatggcccaatctttattcaggagccttctcccgtgatgttccctttggatagcgaagagaagaaggtcaaactgaactgcgaggttaaaggcaatccgaaaccacatattaggtggaagctgaacggtaccgatgttgacacgggcatggacttcagatactcagtggtggagggaagtcttctgataaacaaccctaacaagacacaagacgccggaacttaccagtgcactgcgacgaactcttttggcacaattgtcagccgcgaggcgaagctatag

SEQ ID NO: 219191 - DNA, 3081 bp, Artificial Sequence
  Description of Artificial Sequence: Synthetic coding sequence
atgaggctgccctgggaactccttgtgcttcagtctttcattctatgcctcgccgacgattccactctgcacggtccgatcttcatccaggagccttctcctgtgatgtttccgctggattccgaggaaaagaaggtcaagctaaactgtgaggtcaagggcaaccccaaacctcatataagatggaaactgaatggtaccgatgtggacaccggtatggattttcgatatagcgtcgtagaaggcagtctcttaatcaataaccccaataaaacacaggatgctggaacctaccagtgcaccgccacaaattccttcgggactatcgtctcaagagaggcgaaactgcagttcgcatatctggacaactttaaaaccaggacccggagcaccgtgagcgtcaggcggggacagggcatggttctattgtgtggcccaccgcctcacagcggtgagctcagctatgcttggatattcaacgagtaccctagttatcaggataatagacgctttgtgtcccaggagactggcaatctgtacatcgcgaaggtagagaagtctgacgtaggcaattacacctgtgtggtgacgaatacggtgacgaatcataaggtacttgggccaccgacacctctcatactgaggaacgatggtgtgatgggcgagtacgagccaaagatcgaggtccagtttcctgagactgtccctaccgcaaaaggagccaccgtcaagctggagtgtttcgccctgggaaacccagtgccaactataatctggcgcagggccgatggaaagccaattgctcgtaaagcgaggcgccataaatcaaatggaatcttggaaattccaaattttcagcaggaggacgcaggtctctatgaatgcgtcgccgagaattcccgaggaaagaacgttgctagaggacagctgacattctacgcccagcccaactggatccaaaaaattaatgatatccacgttgccatggaagagaatgtattctgggagtgtaaggctaatggcagaccaaagccaacttacaagtggctgaagaacggggagccgctattgactcgcgaccgaatccagatcgagcaggggaccctgaatattactatcgtcaacctgagcgatgcaggcatgtaccaatgtctggcagaaaacaaacacggggtcatattcagcaatgcggagctgtcggtgattgcggtggggccagattttagccggacactgttgaagcgggtcaccctggtgaaggtgggaggggaagtcgtcattgagtgtaaaccgaaagccagccccaagcctgtatacacgtggaagaaggggagagacatccttaaagagaacgaaagaattacaataagcgaggatggcaacttgcgcatcatcaatgtcactaaatccgatgccggtagctacacatgcattgcaacaaaccactttggcacagcaagttccaccggcaacctggtcgttaaagacccaaccagggtgatggtccccccatccagcatggatgtcaccgtgggcgagtctatcgtgcttccatgccaggtcacacatgatcacagcctcgatattgtgttcacctggtcgtttaacggacacctgatagacttcgatcgcgatggagatcacttcgagagggtcgggggacaggattctgcaggcgatctcatgattagaaacatccagcttaagcacgctggtaaatacgtatgcatggtccagactagcgtggacagactcagcgccgctgctgatctcattgtccgcggtccgcctggtccacccgaagcggtcactattgacgagataacagatacaacagcccaattatcttggcggcctggcccagataatcactcgcctataacgatgtacgtgatccaggcacgtactccctttagtgtcggatggcaagctgtgagtacagttcctgaactgattgacggtaaaacctttacagctacagttgtgggcctcaatccttgggtggagtacgaattccgtacagtagccgcaaacgttatcggcatcggtgaaccttcgcgtccctccgaaaaaaggagaacggaggaggcactcccagaagttacacctgcaaatgtctctgggggaggcggatcgaaaagcgagcttgtcattacctgggagactgtccccgaggagctgcagaatggtcgcggttttggttacgtggtagctttccgtccttacgggaagatgatatggatgctgactgttctggccagtgccgatgctagtaggtacgtctttcgaaatgaaagcgtacatcctttctcaccctttgaagtgaaggtgggagtttttaacaataagggtgagggccctttcagtcctactacggtcgtttacagcgccgaggaggagcctaccaagccaccagctagcatctttgctcggtccctgtcagccacagatattgaggtattttgggctagccccctcgaaaaaaatcgtggacgaatacagggttatgaggtaaaatactggcgacatgaagacaaggaggaaaatgcgcgaaagatccgtacggttggaaatcagacctccaccaagattactaacttgaaggggtctgttctgtaccatctcgccgtgaaggcgtataattctgcaggtaccggaccgtcatcagctactgtgaacgtgaccaccagaaaaccaccaccctcccagccacccggaaatattatctggaactccagtgattctaaaattatactgaattgggaccaggtaaaagcattagacaatgagtctgaggtgaaggggtataaagtgctgtacaggtggaatcgtcagtcaagtacgagcgtcatcgagacaaacaaaacctctgtagagttgtctctacccttcgacgaagactatattatagagatcaagccgttcagtgatgggggtgacggtagctcctctgagcagattcggatccctaaaatctcaaatgcatatgctaggggatcaggagcctctacaagcaacgcgtgcacactgagcgctataagcaccattatgatctcattaaccgcccgaagcagcctttag

SEQ ID NO: 219192 - DNA, 2097 bp, Artificial Sequence
  Description of Artificial Sequence: Synthetic coding sequence
atggaggagaacgtcttctgggagtgcaaggcaaatggcaggcccaagccaacctataagtggcttaagaatggcgagccccttttgacaagagatcggatacaaatcgagcagggaactcttaacatcactattgttaacctatctgacgctggaatgtatcagtgcttggccgaaaacaagcatggagttatcttttctaacgccgagctgtctgtaatcgcagtggggccagatttctcaagaacactactgaaacgcgtgaccctggtgaaagttggcggtgaggtcgttatcgagtgtaaacccaaagcctctccgaaaccagtttatacctggaagaagggaagagacattctaaaagaaaatgagcgaattaccatcagcgaggacggaaatctgcggatcatcaatgtgacaaaatccgacgcgggttcctacacttgcatcgcgaccaatcatttcgggacagcttctagcactggcaatctggtggttaaggacccaacaagagtgatggtgcctccttcatccatggatgtgaccgtaggagagtctattgtgctgccgtgtcaggtgacacatgatcacagcctggatatcgtattcacctggtccttcaatggacatctcattgactttgaccgagacggtgaccacttcgaacgcgtgggcggtcaggacagtgctggcgatctgatgatcaggaacatccagttaaagcacgcaggcaagtatgtctgcatggtccagacatcagtagaccgcctctctgctgcggctgacttaatagttcggggtcctccagggccacccgaagccgtcacaatcgacgagataaccgacacgactgctcaactctcatggcgaccaggcccagacaatcattcccccattacaatgtatgttatccaggcgcgtacgcctttctccgttggatggcaggccgtgagtacagttccggaacttattgatggtaagacctttactgccacagtagtcggactgaacccatgggtcgaatatgagtttcgaaccgttgcggctaatgtgatcgggatcggagagccttcacgcccttctgaaaagcggcgtaccgaggaggccctccctgaagtaacacctgctaacgtgagcgggggaggaggttccaaatctgagttggtgattacatgggagaccgtgcctgaagaactgcagaacggtagaggatttggttacgttgtggccttccggccttacggaaagatgatctggatgttaacagtgctggcttccgccgacgcctcccgctatgtgttcaggaatgagagcgtccatccttttagtccatttgaggtgaaagtgggagtgttcaacaacaagggggagggacctttttctcctacaaccgttgtttattctgcagaggaggaaccaaccaaacctcctgccagcatattcgctcgctcattatcggctacagatatcgaggtgttctgggcctctcccctggagaagaatcgcggacgaatccaggggtacgaggttaagtattggcgacatgaggataaggaggagaacgccagaaagatacggacagttgggaaccaaacatcaaccaaaataactaacttaaaaggtagtgttttgtaccacctggcagtgaaggcttacaatagtgccggaacagggcctagttccgcaaccgtgaacgtaacaacacgaaagccacctccctcacagccccctggtaacattatctggaacagttctgatagcaaaataatcctgaactgggatcaagtgaaggccctggacaatgaatcagaggtgaagggttataaagttctgtatcggtggaaccgtcagagctctacatcagtcatagagacaaataagacatccgtcgagctctcactacccttcgacgaggattatatcattgaaatcaaacccttcagcgatggaggggacggtagcagctctgaacaaattaggatccctaagatttcaaatgcctatgcgagaggcagcggcgcaagcacatccaatgcttgcacattgtcagctatcagcacaatcatgatatcactcaccgccagaagttccctgtag

SEQ ID NO: 219193 - DNA, 165 bp, Artificial Sequence
  Description of Artificial Sequence: Synthetic coding sequence
atgagactgccttgggaactgctggtcctccagtcttttattctttgtctagctgacgactccacgttgcatgggcctatcttcatccaggaaccatcccctgtgatgtttcctttagattctgaggaaaaaaaggtgaagctgaattgcgaggtgaaaggatag

SEQ ID NO: 219194 - DNA, 3303 bp, Artificial Sequence
  Description of Artificial Sequence: Synthetic coding sequence
atggcctcatcatggaagctgatgctgttcctttctgtcaccatgtgcctgtctgaatactcgaagtctctgccgggattaagcacatcctatgcagcgctacttaggatcaagaaaagctcttcatctagtctcttcggatccaaaacacgacctagatactcttcacccagcctgggcacactctctgcctcttcccccagctggctaggcgctgcgcaaaactactatagccccatcaatctctaccattcgagcgacgcctttaaacaggacgaatccgttgactatggacccgtgtttgtgcaggagcccgatgacattatctttccaactgactccgacgaaaaaaaggtggccctgaactgtgaagttcgcggaaaccctgtcccatcttatcgctggttacgcaacggaacagagatcgacctggaatccgactatcgctattctttgatagacggcaccttcattatctcaaacccgtccgaagctaaggattccggacactaccagtgcctggcgaccaacacagtggggtccatcttgagccgtgaggcaaccttacaatttgcctacctgggcaacttttctggtagaacaagatccgccgtcagtgttagggaaggacagggcgttgttttgatgtgttctccccctccacactccccagagataatttattcatgggtcttcaatgagttcccatccttcgttgctgaggattctaggagatttatctcacaggagactggcaatctgtatatcagcaaagtgcaaacttctgatgtgggttcttatatctgcctggtgaagaacaccgtgaccaacgcgagagtcttgtccccccctaccccgctaacactacgcaatgacggcgttatgggggagtatgaacccaaaattgaagtgcacttcccctttacggtcaccgccgcaaagggaactaccgtgaagatggagtgcttcgccttgggcaacccggtgcctaccatcacatggatgaaggtcaacggttatattccgtctaaggccagactgcgcaaatcccaggccgtgctggagatcccaaacgtgcagctggacgatgcgggaatttacgagtgccgggctgagaactcacgagggaagaacagttttcgcggtcagttacaggtctacacctacccgcattgggttgaaaaactcaacgacacccagcttgactcaggctcccccttgcgatgggaatgtaaagctaccggcaaaccacgaccgacttacaggtggcttaagaacggtgttccacttagcccacagagccgcgtggagatggtcaacggagtgttaatgatccacaatgtgaaccagtccgatgccggaatgtatcaatgccttgccgagaacaagtatggcgctatttatgcatcagctgagctcaagatcctggctagtgctccaacgtttgcccttaaccagttgaagaaaactatcatcgtgactaaagaccaggaggtggtgattgagtgtaagccgcagggctcacccaagcctactatttcctggaagaagggcgacagagcggtgcgtgagaataaaagaatcgccatcctacccgatggatccctgaggatcctgaacgcatctaagagcgatgagggcaagtacgtgtgccgcggagagaatgtgttcggatcagccgagattattgctagtctgagcgtaaaggaacccacacgtatagaactgactcccaagcgaacggagctgactgtgggggagagcatcgtcctgaactgtaaggctatccacgatgctagtctggacgtaacattctattggaccctgaagggtcagccgattgactttgaggaggagggaggccattttgagtccattcgagctcaggcctcctcagccgatctgatgataaggaacattctgctcatgcacgctggcaggtatggatgcagggtccaaactaccgctgactctgtatctgacgaagctgagctactggtccgcggacccccaggcccaccgggtattgttatcgtggaagagattaccgaatccactgcaaccctgtcctggtctcctgcagctgataatcactcccccatttcctcatacaacctacaggctcggtcccctttcagcctaggatggcaaaccgtgaagacagtccctgaaatcatcacaggagacatggagagtgcgatggcagttgatctgaatccgtgggttgagtatgagtttcgcgtggtcgcaaccaatccaatcggaacaggagacccttctactccatcccgcatgattcgcactaatgaagcagttccgaagacggctcctactaacgtaagtggccgatccggcaggaggcacgaattggttatagcctgggaacccgtgagtgaagaatttcagaatggtgagggatttggatacattgtagccttcagacccaacggcacccggggatggaaggagaagatggtgacctcctccgaagcaagtaaattcatctaccgcgatgagagtgttccacctctcaccccatttgaagtaaaagtcggggtttacaacaacaagggcgatggccctttctctcagatagtggtgatctgttccgccgagggcgagccatccgccgctcctactgatgtgaaggccacatcggtgtctgtgagcgaaatcttggtggcctggaagcacataaaagagtcgttgggccgtccccagggcttcgaggttggttactggaaagacatggaacaagaagatacagccgagactgtgaaaactcgaggcaatgaaagtttcgtaatcctgacaggactggagggcaacacgttgtaccactttacagtcagagcttacaatggggcaggctatggtcctcccagctccgaagtgtcagccaccactaagaaatcccccccaagtcaggctccatcaaatctgcggtgggagcaacagggcagccaagtgagtctggggtgggaacccgttatccctctggccaacgaatccgaagtcgtcggatataaggttttctatcggcaggaagggcactcaaactcacaagtgattgagacgcagaagctgcaggccgtggtgcctctgcccgatgcaggagtatacattattgaggtacgggcttactcggaggggggagatggaacggcttcttcgcagatccgcgtgccctcctattccggcggaaaaatcacttcggcacagagcacactgcacagcctctctacaagcagctctagtgtgactctcctgctggccctgatgatccccagcacatcctggtag

SEQ ID NO: 219195 - DNA, 3081 bp, Artificial Sequence
  Description of Artificial Sequence: Synthetic coding sequence
atggcttcttcgtggaagcttatgctttttctgtccgtgactatgtgtctgagcgagagcgtagactacggtcccgtgtttgtccaggaaccagatgatatcatctttcccacagactcggacgaaaaaaaagtcgctcttaattgtgaggtccggggtaaccccgtccccagctatcgatggctgcgaaacgggaccgaaattgacttagaatccgattacagatactcgctcatagacggcacatttatcattagcaatccaagcgaggctaaagactccggccactatcagtgcctggcaaccaatactgtgggatcaatcttgtcacgtgaagcgacacttcagtttgcctatctgggcaacttcagtggcagaacccgctccgctgtgtctgtgcgggagggccagggtgtggtcctgatgtgttctcccccaccacatagtccagaaatcatttatagctgggtgtttaacgagttcccgagctttgtggcagaagattccaggcgcttcatcagccaggagacaggcaacttgtacattagcaaagtccaaacgtctgacgtgggatcatacatttgcctcgtgaaaaatacagtgaccaatgcccgagttctgagtcctccaacacccctcactctgaggaatgacggtgtgatgggggagtacgaaccgaaaatagaagtgcattttccttttaccgttactgctgccaaagggaccacggtcaaaatggagtgctttgcattgggtaatccggtcccaaccatcacctggatgaaagtcaatggatacatcccaagcaaggcccgactgcgcaagtctcaagcagtactggagatccccaacgtccagttggatgatgctggcatctacgaatgtagagccgagaactccagagggaagaattctttcagaggacaattgcaagtctacacatatccacattgggtcgagaaattgaatgacacacagctggacagcggctcacccctgcgctgggagtgcaaagcgaccggaaaaccacgccctacctatcggtggctgaaaaacggagtccctttatctcctcaatcaagagtggagatggtaaatggcgtactaatgatccataacgttaaccagtcagatgcagggatgtaccagtgtttagctgagaacaagtatggagccatctacgctagcgccgagctcaagatcttagctagtgcacccaccttcgccctgaaccagctcaagaaaactattatagtgacaaaagaccaagaggtagtgatcgagtgcaagccccaggggtcccctaagccaaccatatcctggaagaagggagatcgcgcagtgcgagaaaataagaggatcgcaatcttacccgacggatcccttcggattctcaacgctagcaagtcggatgaagggaaatacgtttgtcgaggggagaatgtcttcggaagcgcggaaattatcgcatctctgtcggtgaaagaacctaccaggatagagctcacacccaaacgtaccgagcttacggtcggcgaaagcattgtgctcaattgcaaggcaatccacgacgcgtccctcgacgtgaccttctactggacactgaagggacagccaattgactttgaggaggagggaggacattttgagagcattagagctcaggctagctcagcagacctaatgatccggaacattctcttgatgcacgcagggaggtacggatgccgcgtgcagaccaccgccgacagcgtgagtgatgaggctgagttgctcgttcgcggaccgcctggccctcccggtatcgtgatcgtcgaagagataaccgaaagcacagcaaccctgtcgtggagccccgctgctgacaaccactctcccatatcctcatataacctgcaagctcgcagcccattcagtctgggttggcagaccgtgaagacagtgcccgagattataaccggcgacatggaatcggccatggctgtggacctgaacccatgggtggaatatgagtttagagtggtggccaccaacccaataggcaccggcgacccttctacaccttctaggatgatccgcacaaatgaggcagtgcccaagactgccccaactaatgtgtcagggaggtccggacgcagacatgaactggttattgcctgggagcctgtgtccgaggaatttcagaatggagaaggctttggctatattgtggcctttcgaccaaacgggacccggggttggaaagaaaaaatggtcacaagttcagaggcttccaagtttatctaccgcgatgagtcagtgccccctctgaccccatttgaggtcaaagtcggcgtctacaacaacaagggtgatggcccattttcacaaattgtcgtgatttgtagtgctgagggagagccatcagctgctccaaccgacgtcaaggcaaccagcgtgtctgtgtccgagatactggtagcatggaagcatattaaggaatccctgggacgccctcagggcttcgaagtgggctattggaaggatatggagcaggaggacactgcagagactgtaaaaacgcgcggaaatgaatctttcgtcatcctgaccggacttgagggcaacactctgtatcatttcacggtgagagcttacaacggggcagggtacggtccaccaagttcagaagtaagcgcaaccacaaagaaatcccctcccagtcaggccccttccaacttacgctgggagcaacaggggtctcaagtttcactcgggtgggagccagtgatccccttggcgaacgagagcgaggttgtgggctacaaggtgttctataggcaggaggggcatagcaatagccaggttattgaaacccagaaactgcaagccgttgtgcctctgccagacgcaggcgtgtacattattgaggttcgggcatacagcgagggaggcgatggaacagccagttctcaaatccgcgtcccgtcctactcgggcggaaagataacatctgcccagagcactctgcactcgctatcaaccagtagttctagcgtgaccctcctgctggctctgatgattccttccacttcgtggtag

SEQ ID NO: 219196 - DNA, 3303 bp, Artificial Sequence
  Description of Artificial Sequence: Synthetic coding sequence
atggcctcatcctggaaacttatgctatttctctctgtgaccatgtgtctttctgaatactcaaagagcctccccggtctgagcacaagctacgcagctctgctgcgaatcaagaaatcttctagctcaagcttatttggtagcaagaccaggccacgctattcttccccctcacttggaacactctcagcctcatcccctagttggttaggggctgctcaaaattattattctccgattaacttataccactctagcgacgccttcaaacaggatgagtcagtcgactacggacccgtgttcgtccaggagcccgatgacattatttttcccacagacagcgacgagaaaaaggtggcgctcaattgtgaagtgcggggtaaccccgttcccagctatcgctggctccgcaatgggacagaaattgatctggaatcagattatagatattcactgattgatgggaccttcatcatctccaatccttccgaggctaaagattccggtcactaccaatgtttggcaactaacaccgtgggctctattctttcccgggaagcaacactccaattcgcctatctcgggaatttctccggcagaacacgatcagctgtgagtgtgcgcgaaggacagggcgtcgtgttaatgtgctcaccacctcctcactcccccgaaatcatctactcatgggtgttcaacgaattcccaagtttcgtggccgaggattcaaggcgcttcatatcccaggagactgggaatctctacatttccaaagtgcagacttccgatgttggcagttacatctgcctggtgaaaaatactgttactaatgcccgagtgctgagtccaccaactccgcttactctccggaatgacggtgtaatgggagagtacgagccaaagattgaggtacacttcccattcactgtgaccgctgccaaggggacaacagtgaaaatggagtgtttcgccttaggcaatcccgtgccaacaatcacttggatgaaagtcaacggctacataccctccaaggccagattgcggaagtcacaggccgtcctcgaaatcccaaacgtgcaattggatgacgcgggtatctacgagtgtcgagccgaaaattcacgaggcaaaaactcctttcgagggcaattgcaagtctatacctacccccattgggtggagaagcttaacgacacacaattagactcaggctcgccactgaggtgggagtgcaaagccaccgggaaaccacgcccaacttacagatggctcaagaacggtgttcccctttctccccagtctcgggtcgaaatggtgaatggggttctgatgattcacaacgttaaccagagcgacgcaggcatgtaccagtgtcttgctgagaacaagtatggcgctatttacgcatctgcagaacttaagatactcgcatccgccccaacctttgcactgaaccagcttaagaaaacaataattgttaccaaggatcaagaagtggtaatcgagtgtaagccacagggctcgcctaaaccaacaatatcatggaaaaagggtgatcgcgcagtgcgggaaaacaaacggatagcaattttgccagatggatccctgcgcattctgaatgcttctaagtccgatgaaggaaaatatgtttgcaggggtgagaatgtgtttgggtcggctgagatcatcgcctctcttagtgtaaaagaacccacaaggatcgagcttaccccgaaacggactgaactgaccgtcggggagtcaatcgtgctgaactgcaaggctatccacgatgctagcctcgacgtcacattctattggactctgaaagggcaaccaatcgactttgaagaggaaggcggacacttcgagtctattcgcgctcaggcatcttctgccgatctcatgattaggaacatcctgttaatgcacgcgggacgctatgggtgccgggtgcagaccactgctgactcagtgagtgatgaggccgagttactggtgcgtggtcctcctggtccgcctggtattgttattgtagaggagatcacagagtccactgccacactaagttggtctccagcagccgataatcacagcccaatcagttcctataatctgcaggcccgtagccctttctcattgggatggcaaactgtaaagaccgtccctgagatcatcaccggggatatggaatccgctatggccgtcgatctgaacccatgggtggagtacgagttccgtgtggtcgccactaacccaataggtacaggggacccaagtacaccgagccggatgataaggactaacgaggccgtccctaagaccgccccaaccaatgtctcggggagatctgggcgacggcacgagttagtgattgcatgggagcctgtatctgaagaattccagaacggcgagggatttggctacatagttgcattcagaccaaatgggacaagggggtggaaggagaagatggtgaccagtagcgaggcaagcaagtttatttatcgcgacgagagtgtgcccccattgaccccgtttgaagtgaaagtcggcgtgtataacaataagggcgatggcccattttctcaaatagtggttatatgctccgctgagggtgagccttctgccgctcccactgacgtcaaagctacatccgtaagcgtatcggagatcctggtagcttggaagcacatcaaagagtctttgggtcgccctcagggcttcgaggtcggctattggaaggatatggaacaggaagatacagccgaaaccgtgaagactcggggtaatgagagtttcgtgattctgactggactggaggggaacacactgtaccactttactgttagggcctacaacggcgctgggtatggccctccgtcctccgaggtctcggccacaacgaaaaagtccccacctagccaggctccgtctaatctccggtgggaacaacagggttcccaggtgtcgctcggttgggagccagtgattcctctggcaaatgaatctgaagtcgtgggctataaagttttttataggcaggaggggcatagtaattcgcaggtcattgagactcagaaactgcaggccgtggtcccacttcccgatgccggagtttacattatagaggttcgagcttatagtgaaggcggtgacggcaccgctagttctcagattagggtgccgtcttacagtgggggaaaaatcacatctgcacagagcacgcttcactcactgtctacatccagctcaagcgtcactctcctcctcgcacttatgataccgtcaacaagctggtag

SEQ ID NO: 219197 - DNA, 3303 bp, Artificial Sequence
  Description of Artificial Sequence: Synthetic coding sequence
atggcttcctcttggaagcttatgttgtttttgtctgtgactatgtgtctgtctgagtacagcaagagccttccaggtctgtccactagctacgccgctctgctgagaattaaaaagtccagctctagtagccttttcggtagcaaaaccagaccacgctattcctccccgtcacttggaaccctaagtgcctcctccccctcctggctgggtgctgctcagaactactattctcccataaacttatatcactcctcagatgcctttaagcaggatgaatccgtggactacggaccagtgttcgtgcaggagccagatgatattattttccctaccgattccgatgagaagaaggtagccctaaattgtgaagtccgcggaaatcccgtaccaagctatcgatggcttagaaacggaacagaaatagatttagagtctgactacagatattcattgatcgatggcacatttatcatctcgaatccgagtgaagccaaggattccggtcactaccagtgtttagcgaccaacaccgtgggctccattctgagtcgtgaagccactctccagttcgcatacttgggaaatttttctggccgaacacgcagcgccgtctccgtgagagaaggccagggggtggtcttgatgtgttccccaccccctcacagcccggaaataatctactcctgggtgttcaacgaatttccctcatttgtcgctgaggactctagacgctttatctctcaggagactggaaacctgtatatatccaaggtgcaaacatcggatgtcgggagctacatttgtttagtgaaaaatacggtcaccaacgcaagagtactttcgccacctacaccccttactctgcgcaatgatggagtcatgggagaatatgaacccaaaatagaagtccactttcccttcacagtcaccgccgctaaaggaaccaccgtgaagatggaatgttttgcactcggaaatcccgtacctactattacatggatgaaggtgaatggatatatccccagcaaggctcgtttgagaaagagccaggcggtgctcgaaatccccaatgtgcaactcgacgatgcaggaatttacgaatgcagggcagaaaattcacggggaaaaaattcattcagaggccagcttcaggtttacacgtacccgcactgggtggaaaagctgaatgacacccagctggattcgggctccccactgagatgggaatgcaaagccaccggtaaaccgcgaccaacttataggtggcttaagaatggcgtgcccctgtccccccagtctagagtggaaatggtgaacggagttctcatgatacacaacgtaaatcaatctgacgccggaatgtaccagtgcttggcagagaacaaatatggcgctatatatgcctcagctgaactgaagatccttgcgtccgctccgaccttcgctctcaatcagctcaagaaaaccattatcgttacgaaagaccaggaggtggtcattgagtgcaagccccagggctctcccaagccaaccatttcctggaaaaagggcgaccgggcagtgagggagaacaagcgcatcgccatcctgccagatggatctttacgcatcctcaacgcgtccaaatccgatgagggcaaatacgtttgcaggggagaaaacgtctttggttcggccgagatcatcgctagcctgtccgtcaaggaacccacccggatcgaactgacacctaagagaactgagctcactgtgggcgagagtatagtgctaaattgtaaggccatccatgacgccagcctagacgttacgttttactggaccttaaaaggccagccaattgacttcgaagaggagggagggcatttcgagagcatccgggcacaggccagttctgccgatcttatgattaggaacattttgctaatgcacgctggcaggtatggatgtcgggtccagacaacggccgattccgtgagcgacgaagccgaactccttgttcgtggacctccaggacctccgggtattgttattgtggaggagattaccgagtcgactgccacgttgtcatggtctcctgccgctgataaccactcaccgatatcatcttacaatctgcaagcgaggagcccttttagtctgggatggcagacagtaaagaccgtgccggaaatcattacgggtgatatggagtctgcaatggctgtggacctgaacccttgggtcgagtacgagtttagggtcgtcgccactaaccccattggtacgggagacccatctacaccttcccggatgattcggacaaatgaggctgtgcccaagactgcaccgactaatgtcagcggaaggtcggggcgtcgccacgaactggtgatcgcgtgggagcccgtgtcagaagagtttcaaaacggcgaaggctttggatatattgttgctttccgccctaatgggacacggggttggaaggagaagatggtcacgagctccgaggctagcaagtttatctacagggacgagtccgtcccgccacttactccgtttgaggtgaaggttggggtttataataataagggggacggccctttttcacagatcgtggttatatgctccgcagagggcgagcctagcgccgctccgactgatgtcaaagctaccagcgtgtcagtgagcgaaatcctggtggcctggaagcacataaaggagtcactggggagacctcagggttttgaagtcggttattggaaggatatggaacaggaggatactgcggagacagtgaagacaaggggaaatgaaagctttgtgatcctcaccggcctcgaaggcaatactctctaccattttaccgtgcgggcatataacggggctggttatggaccaccatccagtgaggttagcgccacaaccaaaaagtcaccccctagtcaggccccttctaatctgcggtgggagcagcagggcagtcaggtgagtcttggctgggaacctgtgatacctctggccaatgagtccgaagtggtgggctacaaggttttttatcgccaggagggtcactccaacagccaggtgatcgaaactcagaaattacaggccgttgtaccgcttcctgatgccggtgtttacattattgaggtgagagcatactctgagggaggagacggcaccgcctcttcacagatccgggtgccgtcctacagcggagggaagattactagcgcacagtccacgctgcactcactgagcacctcctcctcatcagtgacactcttgctggctctcatgatcccatcaacaagctggtag

SEQ ID NO: 219198 - DNA, 2736 bp, Artificial Sequence
  Description of Artificial Sequence: Synthetic coding sequence
atggcttcaagctggaagcttatgctgttcctctctgtcactatgtgcctgagcgagtactctaaaagcctccctggtctgagtacatcctacgccgcactgctgagaataaagaaaagctccagcagttcactgtttggatccaaaacaagacctcgctactcaagcccatcgctgggaacactgtccgcctcgagcccatcatggttgggggcagcccagaattattactcaccaattaatctgtatcatagtagcgacgcgttcaagcaggatgaaagcgttgattacggaccggtgttcgtgcaggagcctgatgatatcatctttcctactgacagcgatgagaaaaaagtggctctgaactgtgaagtgaggggcaatcccgtgccttcttatcgctggctgaggaacggaactgagattgaccttgaatctgactatagatactccctgatcgatggtacctttatcatctcaaatccctccgaggctaaggactcagggcactatcagtgtttggctacaaacacagttgggagtatcctctctcgagaggcgacgctccagttcgcatatctgggtaatttttctggaagaacccgcagtgcggtctctgtgcgcgaggggcagggagtggttctcatgtgctctcccccaccacactcaccagagatcatttattcttgggtcttcaatgagttcccgtccttcgtggcagaggattctaggagattcatttcacaggagacaggcaacctgtacatcagcaaagtccaaactagcgacgttggctcatatatatgtctggtgaagaatacggtgacaaacgcgagggtgttgagccctcccacacctctgaccctccgaaatgacggggttatgggcgagtatgaacccaaaatcgaggtgcacttccctttcactgtgactgcggctaaaggcaccactgtaaaaatggagtgtttcgcccttgggaacccagtgcccaccatcacatggatgaaggttaacggctacatcccaagcaaggctcgtcttcgaaagtcccaggctgttctggagattccaaatgtacagttggatgatgctggaatctatgagtgccgtgcagagaactcacgcggaaaaaactctttccgagggcagctccaagtgtacacatatcctcactgggtggagaaactgaatgacacacagctcgatagcggtagcccgcttcgatgggaatgcaaggcgaccggtaaacctaggcccacctaccgatggctgaagaacggcgtcccactctcccctcagtccagagtggagatggtgaacggtgtgctgatgatccacaacgtgaaccagtcagatgcgggaatgtatcaatgccttgctgagaacaaatatggtgctatttacgcctccgctgaactgaagatcctagcttctgctccgacttttgccctcaaccagctcaaaaagactatcatagtgacaaaagaccaggaggtggtgatagagtgcaaaccacagggctcacccaagccaaccatatcttggaagaagggggatagggccgtgagagagaacaagagaatagcgatcctacctgacgggagcctcagaatactgaatgcttctaagtccgacgaaggaaaatacgtctgtaggggggagaatgtgtttggctcagcagagattatcgcatcactgagtgttaaagagcccactaggatcgagctgacccccaaacgtaccgagctcactgttggggagtctatagtcctgaattgtaaggccatccatgatgcatcccttgatgtgactttctattggaccctgaaaggccagcccatagacttcgaggaagaaggcggacacttcgaatcaatcagagcacaggcctccagcgcggacctgatgattcgcaatatcctcctaatgcatgccggtcggtacggatgcagagttcaaactaccgcagatagtgtctctgatgaggctgagttgttggttcgcggacctccaggtcccccaggtattgtgatagtggaggagattaccgagagcaccgcaacactgtcctggagccccgcagctgataatcacagtccaatttcatcttacaacctccaggccagatctcctttctctctggggtggcagaccgttaagacggtgccagagatcatcacgggagacatggaaagcgccatggccgtggatctcaacccttgggtggaatacgagttccgcgttgtggcaaccaatcctatcggtacaggtgacccaagcaccccttcccgcatgatcaggactaatgaggccgtgcccaaaacggcaccaacgaacgtatcgggcaggagcggtcgccgtcatgaattagtgatcgcttgggaacccgtgagcgaagagtttcagaacggcgaaggtttcggatacatcgtggcgtttcgtccaaacggcacgagggggtggaaagagaagatggttacttctagtgaggcatcaaagttcatctacagagacgaaagtgtgcctcctcttaccccattcgaagtaaaggtgggggtgtataataataaaggcgacggacctttcagccagattgtcgtcatttgttcagcggagggcgagcccagcgcagcgccaacagacgtaaaagccacttcagtgagcgtgagcgaaatcctcgttgcatggaaacatatcaaggagagccttgggaggccacagggcttcgaggtgtag

SEQ ID NO: 219199 - DNA, 3087 bp, Artificial Sequence
  Description of Artificial Sequence: Synthetic coding sequence
atgcgcttgctgtggaaactcgttatcctgctccctctcatcaatagcagtgcaggcgatggcttattgtctaggcccatattcacccaagagccacacgacgtgatctttcccttagacctgtctaaaagcgaagtaatattaaactgcgcggcaaatggctacccaagcccacactacaggtggaagcagaatgggacagacatcgactttacaatgtcctaccactaccggctcgacggaggcagcttggccattaattctcctcacaccgaccaggacatcggcatgtaccagtgcttggccacaaatcttttgggcaccattttgtctaggaaggcaaagctccagttcgcctatatagaggacttcgagacgaagactcgatctacggtctctgtccgggaaggccagggcgttgtcctactctgcggcccacctccacacttcggcgacctgagttacgcttggacttttaacgacaacccgctttatgtgcaagaggataacagacgctttgtcagccaggagaccggaaatctgtatatagcaaaagtggaaccaagtgacgtgggcaactacacctgtttcattactaacaaagaggcccagaggtcggtgcaaggcccaccaacgccacttgtgcagaggaccgacggcgtgatgggagagtacgagcctaaaattgaagtgaggttcccagaaaccattcaggctgcaaaggactcatccgtgaagctggaatgtttcgctctcggaaatcccgtacctgatataagctggcgccgactggacggcagtcccctgcccggtaaggtcaagtatagtaagagccaagcgattctggaaatccctaatttccagcaggaggatgaggggttttacgagtgcattgcttcaaacctgcgcggaagaaatctcgcgaaaggccaacttattttctacgctccccctgaatgggagcaaaagatccaaaacacccacctttccatctacgacaatctgctgtgggagtgtaaggcctccggcaaacccaacccttggtatacatggctcaagaacggcgaacgcttaaatccagaagaacgtattcagatagagaatggaacgctgattatcacaatgttgaacgtgtccgattccggcgtgtaccagtgtgcggcagaaaacaaatatcagatcatctatgccaacgcagagctcagggtcttggcgtctgctccggatttttctaagtcacccgttaagaagaaaagctttgtacaagttggaggcgatatcgtgatcggatgcaagccaaacgcctttcctcgtgccgctatttcttggaagcgtggcacggaaactcttagacagtctaagcgtatctttttgctggaagacggcagtctgaagatctacaacatcacccggtccgacgccggttcttacacttgcatagccacgaaccagtttggcacagcaaagaacaccggctccctgatcgtaaaggaaagaaccgtaattacagtgcctccaagtaagatggatgtcaccgtaggagagagcattgtgctgccatgtcaagtgagccacgacccttcaattgaagtggtttttgtgtggttctttaacggtgatgtgattgacctgaagaagggcgtcgctcactttgaacgaatcgggggagagagcgtgggagacctgatgataaggaatattcagctccatcactccggcaaatatttatgtacggtccaaaccactctggagtctctgtctgccgtggccgacataattgtgcgcggaccacccggaccacctgaggatgtgcaagtcgaggacatctccagtacaacaagccagctgtcatggcgagcagggcctgacaataacagcccgatccagatctttactatccagacaagaacacccttctccgtcgggtggcaagccgtggccaccgtgccagaaatcctgaatggcaaaacctacaatgctactgtagtggggctgagcccatgggtggagtacgaattcagggttgtagccggtaacagtatcggaattggcgaacccagcgagccctccgaattgttgcggactaaggcgagcgtgcctgtcgttgccccagtgaatattcacgggggaggaggctcccggtcggagcttgtgatcacctgggagtccatccctgaggagctgcagaatggggaaggctttggctacatcatcatgtttaggcccgtcggatctacgacctggtccaaggaaaaggtgagctcagttgaatcgagtaggttcgtctatcgcaatgaaagcatcatccccctgtcgccattcgaggtgaaggttggggtgtataataacgagggcgaaggctccctgagtactgttaccatagtgtactccggggaggatgaaccccaactcgcccctcgaggcacaagtcttcaaagtttctcagcatccgagatggaagtgagctggaatgccatcgcctggaatcgaaacactggacgtgtgctgggttacgaggtgctgtactggactgacgactccaaggaatccatgattgggaaaattcgcgtgagtggaaatgtgactacaaaaaacattacgggtctgaaggccaataccatctactttgccagcgtgagggcatataataccgccggtacagggccttcgagcccgcctgtgaatgtcaccacgaaaaagtcacctccaagtcaaccccctgccaatattgcctggaagttgaccaactccaagctgtgcctgaactgggagcacgttaagactatggaaaatgagtctgaagttctggggtacaagattttatataggcagaaccgccagtcgaaaactcacatcctggaaactaataacactagtgctgagctgctggttccctttgaggaggattacctcatcgagataaggacagtgagcgatggcggagacggcagtagcagtgaggagatccgcattcctaaaatgtcgagcctgtcttcccggggaattcaattcctagaaccaagcacccactttcttagcatcgtcatcgtcattttccattgttttgctatccagcctctgatatag

SEQ ID NO: 219200 - DNA, 3087 bp, Artificial Sequence
  Description of Artificial Sequence: Synthetic coding sequence
atgcgtctgctgtggaagttggtgatcctgctgcccctaatcaacagcagcgcaggggacgggctcttgtctcggccaatctttacacaggagcctcatgatgtgatattccccttggacctgtctaagagtgaggttatcctcaactgcgctgcaaatggatatcccagtccacattatagatggaagcagaacggaacagatatcgatttcacaatgagctaccactacaggctggatggagggtccctagctataaactccccccacaccgaccaggacatagggatgtaccaatgcttggccactaacctgttggggaccatcttgtcacggaaggccaagcttcagtttgcctacatagaggattttgaaacaaaaactcggtctactgtctctgtgcgcgagggccagggcgttgtgctgctgtgtggacctcccccacattttggtgatctgagctatgcctggacatttaatgataatccactgtacgtgcaagaggacaatcgtcgattcgtgagtcaggagacaggtaacctctatattgccaaggtcgaaccttccgacgtcggtaattacacctgctttatcactaataaggaggctcagaggtctgtgcagggtcctccaactccgcttgtgcaacgcaccgatggagttatgggcgaatatgagcctaaaattgaagtgagatttccagagactattcaggccgctaaggacagctcagtgaagctcgagtgtttcgccttgggaaatcccgtgccggatatttcctggaggagactggatggatctccactcccaggaaaggtaaaatactccaaatctcaggctattttggagatccctaacttccagcaggaggatgagggcttctacgagtgtattgcttccaacctgaggggacgcaacctcgcaaaaggtcagttgattttttacgctccacctgagtgggagcagaagatacagaacactcatctctcaatctacgacaatttactctgggagtgtaaggcatccggaaagcccaatccttggtacacatggctgaaaaacggcgagcgcctgaatccagaagaacgaatccaaatcgagaacggcaccctgatcatcactatgctcaacgtcagtgattcaggagtgtatcaatgtgctgcagaaaacaaataccagattatctacgcaaatgcagagctgcgcgtgttagcctccgcaccagactttagcaaatctcctgtaaaaaaaaaaagtttcgtgcaggtgggcggagacatcgtgattgggtgtaagcccaatgcttttccgcgagcagccatttcttggaaacgcggaactgagacactacgtcagtctaaaaggattttcttactcgaggacggatccctgaagatttacaacattaccagaagcgatgcgggatcatatacttgcatcgctaccaaccagttcggaacagcaaagaatacaggatcactcattgttaaagaacggacggtcattaccgtgccaccctcgaagatggatgttactgtgggcgagtcaattgtgctgccctgccaggtgtcacacgacccctctattgaggtggttttcgtttggttctttaatggcgacgttattgatctaaagaaaggcgtggcccatttcgagaggatcgggggtgaatctgtcggcgacctgatgatccggaatattcagctccaccatagcggaaagtatctctgcactgtacagacaaccttggaatctctgagtgccgtggcggatattattgtgaggggccctcccggtcctcccgaggatgtgcaggtcgaagatatttcttcaaccacatcccaattatcttggcgagccggaccagataataacagcccgatccagatattcacaatacaaacaagaaccccgttcagcgtggggtggcaggccgtcgctaccgtgcccgagatactcaacggaaaaacctataatgccaccgttgtggggctatccccatgggtggaatacgagttccgagtggtggccggaaattccattggcatcggcgagccaagtgagccttcggaactgcttcgcactaaggcctccgtaccagtggtggcacccgtcaatattcacggcggtgggggatctcggtctgaactggtcattacctgggagagcatcccggaagagctgcaaaacggggaggggttcggctacatcattatgtttaggccagtgggaagcacaacatggtccaaagaaaaagtgtcttctgtagagtcctccaggtttgtgtataggaacgaaagcatcataccgctttcgccttttgaggtgaaagtcggcgtatacaacaacgaaggagagggaagtctatctaccgttacaatcgtgtacagcggtgaagacgaacctcagctggccccaagaggaacttctctgcagtcattcagtgcgtcagagatggaggtgtcctggaatgccatcgcatggaatcgtaacacggggcgagtactgggctatgaagttctctactggacagacgactccaaggagagtatgatcggcaaaatccgcgtcagtgggaatgtcacaaccaaaaacattacggggctaaaggctaacacaatctacttcgcaagcgtgcgcgcttacaacacagcaggtactggtccatcctccccccctgtcaacgtgactaccaagaagagtcctccctcccaacctcctgccaacatcgcttggaagcttacgaactccaagttatgtttaaactgggagcatgtgaagactatggagaatgagtccgaagttctagggtacaaaatcttataccgtcagaaccgacagagcaagacccatatcctcgaaaccaataatacttcagccgagctgctggttccatttgaggaggactatctgattgaaatcaggaccgtgtccgacgggggagacggatccagtagcgaagaaattcgcatccccaaaatgagctccctaagctcacggggtatccagtttctcgaaccaagcacacacttcttgagcattgtaattgtgatttttcactgtttcgccatccagcccttaatttag

SEQ ID NO: 219201 - DNA, 2871 bp, Artificial Sequence
  Description of Artificial Sequence: Synthetic coding sequence
atgagctatcactataggctggatggagggtctttagccataaatagcccccatacagatcaggatataggtatgtaccaatgtctggccactaatctgcttggtaccattctgtccagaaaggccaaactccagtttgcctacatcgaagattttgagacaaagacccgctcaacggtttcggttagagaagggcaaggggtggtgctgctgtgtggtcctccccctcacttcggagacctgtcctacgcgtggaccttcaacgataacccgctctatgtccaggaagacaacagaagatttgtgagccaggagactggtaacctgtacattgctaaagtggagccctctgatgttggcaactatacatgtttcatcactaataaggaggcccagaggtctgtgcaaggccctccaaccccccttgtccagcggactgacggcgtgatgggcgaatatgaaccaaagattgaggtgcggttcccagaaaccatccaggccgcaaaggattcatcagtgaagctggaatgcttcgctctcggcaatcctgtcccggatatcagctggcggagactagatggcagccctttgcccggtaaggtgaaatacagcaaaagccaggcaatactggagattcctaactttcagcaggaggacgaaggtttttatgaatgtattgcctccaatctaaggggcagaaatcttgccaaggggcagttgatcttctatgcccctccagagtgggaacagaaaattcagaatacgcacttatctatttatgacaatctcttgtgggagtgtaaggcttcggggaagcctaatccctggtatacctggttgaaaaacggcgagaggctaaatccagaagagaggattcagattgaaaacggcacactcatcattaccatgctcaacgtcagtgactctggtgtgtaccaatgtgcagccgagaacaaataccagatcatctacgctaatgccgagctacgggtgttggcctcagcccctgatttctccaagtctcccgtgaaaaagaagtccttcgtgcaggttgggggagacattgtgatcggatgtaaacccaacgctttcccacgcgcagccatttcatggaaaaggggcaccgagacacttcgccagagtaaacgtatctttctgctcgaggacggttcgttgaagatatacaacatcaccagaagcgatgccggatcatatacgtgcatcgccacaaaccagtttggcactgctaaaaataccggctcactcatagtgaaagagaggaccgttattactgtgcctccgagtaagatggatgtgaccgtgggcgaatcgatagtactgccttgccaggtgtcacatgatccctcgatcgaggttgtcttcgtgtggttttttaacggggatgttatcgatctgaagaaaggcgtggcgcacttcgagcgaatcggaggggagagcgtgggggacttaatgatacgaaatattcagctgcatcattccggtaaatacctctgcactgtgcagactaccctggaaagcctttcagcggtggctgacatcatcgtaaggggtcccccagggcctcctgaggacgtgcaagtcgaggacatcagctccactacctcgcagttatcatggcgggctgggccagacaacaactcgcccattcagatatttaccatccagacaaggacacctttttccgtcggctggcaagccgtggcgacagtccccgagattctgaatggtaagacttataacgcgactgtggtcgggctgtccccatgggtcgaatatgagttcagagtcgtagcgggaaactccataggtatcggggagccttccgaacctagcgaattacttaggacaaaagcctctgtacctgtggtcgccccagtgaacattcacggagggggaggctcccgatccgagctggtgattacctgggaatccatccctgaagagctgcagaatggggagggattcggatatattatcatgttccgccctgttggaagtacaacctggtcaaaggagaaggtatctagtgtcgagtcatctcgctttgtttaccgaaacgagtcaatcataccactgtcaccatttgaagtgaaagtgggcgtgtataacaatgagggagagggtagcctttctactgtgacgattgtatatagtggggaagacgagccccagttagctcctcgcggtacgtccctgcaatcgttctccgcttcagagatggaagtctcctggaacgccattgcgtggaatcgtaacacagggagggtgcttggctacgaggtgctttattggacagacgatagcaaagaaagtatgatcggaaaaattcgggtgtccggcaacgtgaccaccaagaacattactggcctgaaggctaataccatctattttgcgtctgttcgggcttataatacggctggcaccggaccgtctagtcccccagtgaatgtcaccacaaagaaatctccaccctcgcaaccgcctgctaatatagcatggaaactgaccaatagcaagctttgcttaaactgggaacatgtgaaaaccatggagaatgaaagcgaggtcctgggctacaagattctgtataggcaaaaccggcagagcaaaacccacatactggaaactaataacaccagtgctgagctcctggttccattcgaggaggattatcttatagagatcaggaccgtctctgacggtggcgacggctcctctagcgaggagatccgaattccaaagatgagctccctctcctcaagagggatccagtttctcgagccctccacgcatttcttgtccatcgtgatcgttattttccactgctttgccattcagcccctcatctag

SEQ ID NO: 219202 - DNA, 3996 bp, Artificial Sequence
  Description of Artificial Sequence: Synthetic coding sequence
atgcaggccgctccacgggctggctgtggcgctgcgctgctgttgtggatcgtgtcgagctgcctgtgccgcgcatggaccgcgccatctacctcccagaagtgtgacgagccgctcgtgtctggactccctcatgtcgcattcagctccagttctagtatctccggatcctattcgcccggttatgccaaaattaataagcggggtggcgcaggaggctggtccccatctgattctgatcattaccaatggcttcaggtggacttcggaaacagaaaacaaatttctgcaatcgctacccagggcagatattcatcctctgattgggtgacccaatatcggatgttatactctgacactgggagaaactggaaaccgtaccatcaggatggcaacatctgggcgttccctggaaatattaactctgacggagttgtcaggcacgaattgcagcatcccattatcgcacgatatgtgcgaattgtgcccttggactggaatggtgaaggtaggatcggcctgcgcatagaggtgtatgggtgctcttactgggcagacgtgattaactttgacggccacgtggttttgccatatcggttcaggaacaagaaaatgaagacactgaaagatgtaattgcgctcaactttaagacttctgagtcagagggcgtgatcctgcatggcgaggggcagcagggggattatattacactggagctgaaaaaagccaaactagtgctgtctcttaacctgggatccaaccaactgggacccatctacggtcacactagcgtaatgaccggaagcttactcgacgaccaccattggcacagtgtagtgattgagaggcaaggcaggtcaatcaatctgacattagacagatctatgcagcacttcagaaccaacggtgagttcgattacctagatctcgattatgaaatcactttcggcggtatccctttctctggtaaaccgtcaagtagctcacgcaagaatttcaaaggctgcatggaatccatcaactataatggcgtcaacattaccgatctagctcgacgaaagaagctggaaccaagtaatgttggaaacctgagtttttcatgcgtggagccctacacggtgccagtcttctttaatgctacctcatatttagaggtcccaggacggctaaatcaagacctgttcagcgtgagcttccagtttcgcacttggaacccgaatggactcctggtgtttagccacttcgccgataatcttggcaacgtggaaatcgatcttaccgagtccaaggttggcgtccacatcaatattacccaaactaaaatgagccaaatcgacatctcgtcaggcagcggtttaaacgatggccaatggcatgaggtcagatttcttgccaaagagaattttgcaatcctcacaatcgatggggatgaagcgtccgccgtcaggaccaactccccgctgcaagtcaaaaccggcgagaaatactttttcggaggtttcctcaatcagatgaataatagctcccactcggttcttcagcccagtttccaggggtgtatgcaactcatccaggtggacgatcaactggtcaacctgtacgaggtcgcccagcgaaaacccggatcatttgctaacgtaagcatcgacatgtgcgctatcatcgatagatgtgtcccaaatcattgcgaacacggcggaaagtgtagtcaaacatgggacagtttcaaatgtacctgtgacgagactggatattccggggctacgtgccacaattccatttacgagccttcttgtgaagcatacaagcatctgggacagacttccaactactattggatcgatcctgatggcagcgggcctctgggaccactcaaggtatattgtaatatgaccgaagataaggtttggaccatcgtgagtcacgacctgcagatgcaaacacctgtggtcggctacaatccggaaaagtacagcgtcacccagctcgtgtacagcgcgtcaatggatcagatttccgcgattaccgatagtgctgagtactgtgagcaatatgtctcctacttttgtaagatgtctagactgcttaataccccagatgggagcccttatacttggtgggtgggcaaggctaatgagaaacactattactggggaggctcagggccaggtatccaaaagtgcgcttgcggaattgagaggaattgtaccgacccaaagtactactgtaactgtgacgcagattataaacagtggcgcaaagacgccggattcctgagttataaagaccacctgcctgtatctcaagttgtcgtaggcgacactgatcgacagggttcagaggccaagcttagtgtagggcctttgaggtgccagggagataggaattactggaatgccgcaagctttcccaacccttcttcataccttcacttttccactttccagggggagacaagcgcagacatttcattctacttcaagacattaacgccgtggggtgtgttcctggagaacatgggcaaggaagacttcataaaactggagctgaaaagcgcaacggaagtgagtttttcatttgacgttggtaacgggcctgtggaaatcgtggtgcggagtcctacccccttaaatgacgaccagtggcaccgtgtgaccgcagaaagaaatgtcaagcaagcatctctgcaggtggacagactaccccagcagatccgaaaggcccctaccgagggccatacccggttggagctgtatagccagctgtttgtggggggtgccggtgggcagcaaggatttcttgggtgcatcagatctttgagaatgaacggagtgacacttgacctggaagaaagagccaaggtcaccagtggatttatttctgggtgctcaggccattgcacatcgtacgggaccaattgcgagaatggcggaaaatgcctggaacggtatcacgggtattcctgcgactgtagcaatacagcctacgatggaacattctgcaataaggatgtcggggcattctttgaagagggtatgtggctgcgttacaacttccaggcacccgctaccaatgccagggatagcagctccagggtcgacaatgccccagaccagcagaactcacacccagatctggctcaggaggagatcagattctccttcagcacaactaaggctccatgtatcctgctttacatttccagctttactaccgatttccttgccgtgctcgttaaacctaccggttccctgcagattagatataacctcggcggtaccagggaaccgtataatatcgatgtggaccatcgtaacatggcgaacgggcagcctcattctgttaatatcacgcgtcacgaaaagacaattttcctaaaattagaccactatccatctgtctcctaccacctcccctcaagctccgacacattgtttaattcccctaaatccctcttcctcggcaaggttatagagaccggcaagatcgatcaggagatccataaatacaatactccaggattcaccggttgcttgtctagagtgcaattcaatcagatcgcacctctgaaggccgcactgcgacaaacaaatgccagtgctcatgtacacatccagggtgagctggttgaaagtaactgcggcgcaagccctctcaccctgtcacccatgtcaagtgccactgatccttggcatcttgatcatctggattcagcctcggccgattttccatacaatcctggccaggggcaggcaatacgcaacggcgtgaacaggaattctgctattatcggtggcgtgatagcagtggtgatattcactattctttgtactctcgttttcctaattcgctatatgttccgacataaggggacctatcacactaacgaggccaagggtgctgaatcggcagagtcagccgacgccgctataatgaacaacgatcccaatttcaccgaaactatcgacgagtccaaaaaggagtggctgatatag

SEQ ID NO: 219203 - DNA, 1173 bp, Artificial Sequence
  Description of Artificial Sequence: Synthetic coding sequence
atgaatggcgtgactctagatctggaagaaagagccaaggtgacttccggattcataagcggctgcagcggtcactgcacctcttacggtaccaattgcgaaaacgggggtaaatgcttggaacggtaccacgggtactcgtgcgattgttccaacactgcttatgatgggactttttgtaataaggatgtcggtgctttttttgaagaggggatgtggctgcggtataacttccaagccccagccaccaacgctagagacagttcttcaagagtggacaacgctccagatcaacagaacagtcaccctgacttagcccaggaggaaatccggttctcattctctactaccaaagcaccctgcatcctcctgtatatatccagcttcactaccgatttcctggcagttcttgtcaaacctaccggcagccttcagatcaggtacaaccttggagggacccgagagccgtataacatcgatgtagaccaccggaatatggcaaacgggcagcctcattcagtaaatatcacacgacacgaaaaaacaatttttctcaagctggaccattacccctcggtgtcataccatcttcctagctcctctgacaccttgttcaatagtcccaaaagtttgttcctgggtaaggtcattgagactggcaaaatagatcaggagattcacaaatacaacaccccaggctttacgggatgtctatcccgggtacaatttaaccagatagcaccgctgaaggccgcacttcgtcagaccaacgcatcagcgcatgtgcacatacaaggggaactggtggagagtaattgtggtgcgtcgccgctgacactctcacctatgagcagtgctaccgacccttggcaccttgatcacctggatagcgcttccgccgatttcccctacaatcccggacagggccaagccatccgtaatggcgttaatcgtaacagtgccatcatcggcggtgtgattgccgtggtgatcttcacgatcttgtgcactctggtgttcctaattaggtacatgtttcgtcataagggaacttatcatacgaacgaggctaagggcgcagaaagtgcggagtctgcagatgcagctatcatgaacaatgacccaaactttactgagaccatcgatgagtctaagaaagagtggctgatttag

SEQ ID NO: 219204 - DNA, 1353 bp, Artificial Sequence
  Description of Artificial Sequence: Synthetic coding sequence
atgtccgatatggaagatgacttcatgtgtgacgacgaggaggattatgatttagaatacagcgaggattctaacagtgaacccaacgtcgacctggagaaccaatactacaactccaaagctcttaaagaggacgaccccaaggccgcactgagcagtttccagaaagtgctggagctcgagggcgagaagggtgagtggggcttcaaagcacttaagcagatgataaagattaattttaaactgaccaattttcctgaaatgatgaaccgctataagcaactgctgacttatatcagaagtgcagttacccggaactattccgagaaatccatcaacagtatccttgattacatttcaacatcaaagcagaattctgattttctgtgtcagatggacctcctgcaggagttctacgaaactaccctggaagccctcaaagatgctaagaacgaccgtctgtggtttaaaaccaacaccaagttagggaaactgtaccttgaacgggaagaatacggaaaattgcaaaagattctacgacagttacaccagagctgccagaccgacgacggagaggatgatctgaaaaagggtacccagctgctcgaaatctatgccctcgagattcaaatgtacaccgcacagaagaataacaagaagctgaaggccttgtacgagcagagcctacacataaaatcggccatccctcacccgctcatcatgggggtcatacgtgaatgcgggggaaaaatgcacctgcgggagggcgaattcgagaaagctcacaccgacttctttgaagcattcaaaaattatgacgagagcggatcacctagacggaccacctgtctgaagtacttagtacttgccaacatgctgatgaagtcagggatcaatcctttcgactctcaggaggccaaaccctataagaatgatccggaaatcctggcgatgacaaatttggtgagcgcttatcagaataacgatattactgagttcgagaaaattctgaagactaaccactctaacatcatggatgacccattcattagagagcacatcgaggagctcctacgaaacattagaacgcaggttctcatcaagctaattaagccctacacacgcattcacataccctttattagcaaagagctaaatatcgatgtggccgacgtcgaatctctgctcgtacagtgcattctggacaataccatccacggtcgaattgatcaagtcaatcagcttttggaactcgaccaccagaaaagggggggagcccgatataccgctttagacaaatggactaaccagttaaatagtttgaaccaagctgtggtctctaagctagcctag

SEQ ID NO: 219205 - DNA, 1332 bp, Artificial Sequence
  Description of Artificial Sequence: Synthetic coding sequence
atgagcgatatggaagacgactttatgtgcgatgatgaagaggactatgatcttgagtacagtgaggactcgaactcagagcctaatgtcgacctggaaaaccaatactacaattccaaagcattgaaagaagacgatcccaaagctgctctgagctccttccaaaaagtccttgaactggaaggcgagaagggagagtggggctttaaggccctaaagcaaatgatcaagattaacttcaagctcactaactttccagagatgatgaacagatacaagcagctattgacatacatcaggtcagccgtaacccgcaattatagcgagaagtccatcaactcaatcctcgactatatatcaacgagtaaacaaatggaccttttgcaagagttctacgaaacaacgctggaggccctgaaggacgcaaaaaacgatagactgtggtttaagacaaataccaagttagggaagctgtacctcgaacgagaagaatacgggaagctgcagaaaatcttaagacagctgcatcagtcatgtcagaccgacgatggcgaggacgacctcaaaaagggtacccagttactggaaatctatgctttagaaatccagatgtacaccgcccaaaaaaacaacaagaaactaaaggcactgtatgaacagtccctgcacatcaaatccgctatcccacacccattgattatgggcgtcatcagagaatgtggtggcaagatgcatctcagagagggggagttcgagaaagcccacactgactttttcgaagcctttaaaaactacgatgaatcggggagcccgcgtcgaacaacctgtctcaaatacctggtcctggccaacatgctcatgaaaagcggaattaacccttttgattcacaggaggcaaaaccctataagaatgatcctgagattttagccatgaccaacctcgtaagcgcataccagaataacgacataacagaatttgaaaagattttgaaaactaatcactccaatatcatggatgatccatttatccgggagcatatcgaagaattgctccgcaatatccgaactcaggtcctgatcaagcttatcaaaccgtacactaggattcacattccctttatctccaaggagttaaacatagacgtggctgatgttgaatccctcctcgttcagtgcatactggataacactatccatggacggatagatcaagtgaatcaactcttggagcttgaccaccagaaacgcggaggagcgaggtacaccgcccttgataagtggactaatcaactgaattccctgaatcaggcggtggtgtctaagctggcctag

SEQ ID NO: 219206 - DNA, 1272 bp, Artificial Sequence
  Description of Artificial Sequence: Synthetic coding sequence
atggcaagcgccctggaacagttcgtgaattcagtgcgccagctaagcgcccagggacaaatgacccagctgtgcgagcttattaacaagagtggggaattgctggccaaaaatttgtcgcacctggatactgtcctgggagccttagacgtgcaggaacactccctgggagtcctggctgtcctctttgtgaagttttccatgccttctgtccccgattttgaaactctgtttagccaagtgcagctgttcatcagcacttgcaatggcgaacacataaggtacgccactgatacttttgctggactttgccatcaacttaccaatgccctggtggaacgcaagcaacccctcagaggtataggaatcctcaaacaggctatcgataaaatgcagatgaacactaatcagctgacttcaatccacgcggacctctgccaactgtgtttgttggctaaatgttttaagcctgcactgccttaccttgatgtcgacatgatggacatctgcaaagagaacggggcatacgacgccaagcattttctgtgttattactattacggtggcatgatatataccgggttgaagaactttgagagagccctctatttctatgaacaggctatcacgaccccagcaatggccgtgtcacacattatgctagagtcttataaaaaatatatcctggtgagcctgatcctactggggaaagtgcagcagctgccgaagtataccagccagatcgtcgggagatttataaaacctttatccaatgcctaccatgaactcgcgcaggtttatagcactaacaaccccagcgaactacggaatcttgtcaacaagcattccgaaacctttactagagacaataacatgggcctcgtaaaacagtgtcttagtagcctgtataagaaaaatatccagcggctgaccaagacattccttacactgtctctgcaggatatggcttcccgtgtgcagttaagtggccctcaggaagcggagaagtatgttctccacatgattgaggatggagagattttcgcaagcatcaatcagaaggacggcatggtaagcttccatgataaccctgagaagtacaacaatcctgccatgctgcacaacatcgatcaggagatgctgaaatgcatcgaattagacgagaggctcaaagctatggatcaggagatcaccgtgaatccacaatttgttcagaaatccatgggctcccaagaggacgattctgggaataagccctcatcttattcttag

SEQ ID NO: 219207 - DNA, 960 bp, Artificial Sequence
  Description of Artificial Sequence: Synthetic coding sequence
atggcgtccgctcttgagcagttcgtcaatagtgttagacaactatctgcacaggggcagatgactcagttgtgcgagctgatcaacaaaagcggagaattgctcgccaagaatttgagtcacctcgatacagtgctcggggctctcgatgtgcaggagcattccctcggggtcttagcggtgctgtttgtgaagttttctatgccttctgtgcccgatttcgaaactctgtttagtcaggtgcagcttttcatttccacatgtaatggggaacatatcagatatgccaccgatacctttgccggtctttgtcaccagctaacaaatgcgctggtggaacggaagcagccgctgcggggaatcggaattctgaaacaagccatagataagatgcagatgaacacaaaccagcttactagcattcatgccgacctttgccagctctgccttctggccaaatgcttcaaaccagcacttccttatctggacgtggacatgatggatatatgcaaagagaacggggcttacgatgccaaacacttcttgtgttattattactatggcggaatgatttacactgggcttaagaactttgaacgtgcgctatacttttacgagcaggcgatcacaactcctgccatggccgtttcacacatcatgttggagtcttacaaaaaatatatcctggtgagtctcattcttctaggaaaagtccaacagctgcccaaatacacaagccagatcgtcgggcgttttataaagagacagtctctggccatgctggctagacttgtcttgaacagttggccccaagctgtgctgctgagactgccacccagggtgctcggccttcagcccctgagcaatgcttaccacgagctagcccaggtctatagcacaaacaatcccagcgagctgcggaatctggtgaacaagcactccgagaccttcactcggtag

SEQ ID NO: 219208 - DNA, 834 bp, Artificial Sequence
  Description of Artificial Sequence: Synthetic coding sequence
gcttcacccttttgggtgagctggttgtacggctcccccctgcctgctccaccacttcctgggggagcaaggagtggcacctgcgcccctatcctggtgttgcagaacgctgccgaggctttggccagacaaatgacgcagctctgtgaactgattaacaagtcaggcgagctgcttgctaagaatctgagccatttggacactgtacttggcgcactggacgtacaggagcatagtctcggagtgcttgctgtcctgtttgttaagttctcaatgccttcggtgccagacttcgaaaccctattcagccaggtgcaactctttatctccacgtgcaacggcgagcatatccgttacgcaactgatacattcgccggattatgccaccagttaaccaatgcactggtcgaacgaaagcagccactgcgagggatcggcattctaaaacaggcgatagataagatgcagatgaacaccaaccagctcacctcaatccacgccgatctgtgtcaattatgtttactggcaaagtgttttaagccggcactgccatatctggatgtggatatgatggacatctgtaaagagaacggcgcttacgacgctaagcactttctctgttattactactacggcggtatgatttacaccggcctcaagaacttcgagagagccctgtacttttacgaacaggcgattactacccctgccatggcagtctctcatattatgctggaatcctataaaaagtatatactggtgtctctgatcttgctcggcaaggtgcaacagttgcctaagtacacctcgcaaatagtcggcaggtttatctag

SEQ ID NO: 219209 - DNA, 1212 bp, Artificial Sequence
  Description of Artificial Sequence: Synthetic coding sequence
atgactcagctgtgcgagctgatcaataagagcggtgaactcctagccaagaatctcagtcatttagacactgtgttgggggcactcgatgtgcaggagcacagtctgggagttctcgccgtgctgtttgttaagtttagtatgccatcagtgcctgattttgaaacgctgttttcacaggtgcagttgtttatttctacgtgcaatggagaacatatccggtacgcaacagacacatttgccggtttgtgtcatcagcttacgaacgccctggtggagagaaagcaacctctccggggaattgggatccttaagcaggcaattgacaagatgcaaatgaacaccaaccagctcacaagcattcacgccgatttatgtcagctgtgcctgttggcaaagtgcttcaagcccgcacttccctacctagatgttgacatgatggacatctgtaaggaaaatggggcatacgatgccaagcatttcctatgctattactactacggtggtatgatctacacaggactgaagaactttgaaagggccctgtacttctatgagcaggcaatcaccacccccgcaatggcagtgtctcacatcatgctggagagctacaagaagtatattttggtatcactgattctgctgggtaaggtgcagcagctgcccaaatacacaagccagatcgtgggcagattcattaagcccctgtccaatgcctatcacgaattagcccaggtctattcaacaaataatccttccgagctcagaaatctggtgaacaagcattcagagactttcaccagagataataacatgggcctggtgaagcagtgcctcagctcgctgtataaaaaaaatatccagcgactcaccaaaaccttcctgaccctgtccctgcaagatatggcatcccgagtgcagctcagcggtccacaagaagcagagaaatatgtattgcacatgattgaggacggggagattttcgcaagcatcaaccagaaggacggtatggtgtcatttcacgacaacccagagaaatataacaaccccgctatgttacataacatagaccaagagatgctgaaatgtatcgaattagacgagcggctgaaagccatggatcaggagataaccgtgaacccccagtttgtgcaaaaatcaatggggtctcaggaggacgactctggcaacaagccatccagttactcgtag

SEQ ID NO: 219210 - DNA, 1614 bp, Artificial Sequence
  Description of Artificial Sequence: Synthetic coding sequence
atggctgcccagtgcgtgaccaaggtggccttaaacgtctcatgcgctaacctactcgacaaagacatcgggagtaagtctgacccattgtgcgtgctgttcctaaacacttccggtcaacagtggtatgaagtagagcggaccgagaggatcaagaattgccttaaccctcaattctctaagacattcataattgactactactttgaagtggtgcagaagctcaagtttggcgtgtatgacatcgataacaagacaattgagctgagcgacgatgatttcctaggcgaatgtgaatgcacactgggtcagattgtgagttcaaagaagctgacaaggccactggtgatgaagacaggtagacctgcgggtaagggttcaatcacaatatccgctgaggagatcaaagacaatagggtagtgctgttcgagatggaggctcgtaagctagataataaagacctgttcggcaagagcgacccatatctcgaattccataagcagaccagtgatggcaactggctgatggttcataggaccgaggttgtaaaaaacaatctcaatccagtgtggaggcctttcaagattagtctcaatagtctgtgttatggagacatggacaagaccatcaaggtagaatgttacgactatgacaacgatggctcacatgatctgattggtacgttccagacaaccatgaccaagctcaaagaagctagcaggtccagccccgttgagttcgagtgtattaatgagaaaaagagacagaaaaaaaagtcttataagaattccggagtcatctccgtgaaacagtgcgagatcaccgtggaatgtacttttctcgactacatcatgggcggttgccagctgaactttactgtcggggtggattttacaggatctaatggtgatccaagatctcctgacagcttacactatatctcaccaaacggggtgaacgaatatctgactgctctctggtccgtgggtctggtgatccaggattacgacgccgacaagatgttcccggcatttggcttcggcgcacaaatccctccacaatggcaggttagccacgagtttcccatgaatttcaacccaagtaatccctactgtaatggcatacaaggtatcgtggaggcctaccgcagctgtctccctcaaataaaactttatggcccaaccaacttttcacccatcattaaccacgttgctagatttgccgctgcagctacccaacagcagaccgctagccagtactttgtgctgctgatcataaccgacggagttatcacagatctcgatgagaccaggcaggctattgtgaacgctagccggttgcctatgtcaataattattgtgggagtgggcggagccgacttctctgcgatggaattcctggatggagacggagggtcccttagatcccccctgggagaggtggccatccgggacattgtgcagtttgtcccctttcggcaatttcagaatgctccaaaggaagccctagcgcaatgtgtactggctgagataccccagcaagtggtcggctactttaacacctacaaactcttaccaccaaaaaaccccgctactaaacagcagaagcagtag

SEQ ID NO: 219211 - DNA, 420 bp, Artificial Sequence
  Description of Artificial Sequence: Synthetic coding sequence
atggcagctcagtgcgttacaaaagtggctcttaacgttagctgtgccaatcttctcgataaggacattgggagcaaaagcgaccccttgtgtgtcctctttttgaacaccagtggccagcagtggtatgaagtggagagaaccgagcgcattaaaaattgtctgaacccacagttctctaaaaccttcatcattgactactatttcgaggtcgtgcagaaactgaagtttggagtctacgacatcgacaacaagaccattgaactgtccgacgacgatttcctgggggagtgcgaatgcaccctgggccagattgtcagttctaagaaactcactaggccgctcgtaatgaagacagggagacctgccggaaaaggcagcatcaccatcagtgctgaggagatcaaggataatcgctag

SEQ ID NO: 219212 - DNA, 30 bp, Artificial Sequence
  Description of Artificial Sequence: Synthetic coding sequence
atggccgctcagtgcgtaaccaaagtgtag

SEQ ID NO: 219213 - DNA, 1614 bp, Artificial Sequence
  Description of Artificial Sequence: Synthetic coding sequence
atggccgctcagtgcgtcacaaaagtggcattgaacgtgtcatgcgcgaacctgttagataaggacatcggatctaagagtgatccactgtgtgtgttgttccttaacacatccggccagcagtggtatgaggtggaaaggactgagcgcataaagaattgcctcaaccctcagtttagcaagacctttatcattgattactacttcgaggtcgtccagaagctaaagttcggggtgtacgacatcgataataagactatagaactcagcgacgacgacttcctgggtgagtgtgaatgtactctgggccagattgttagcagtaagaaacttacgaggcctctggtgatgaagaccggaaggcctgccggtaagggatcaatcaccatatcagcagaagaaatcaaggataatcgcgtggtgctgtttgagatggaagccagaaaactggataacaaagatctctttggcaaaagcgacccgtacttagaatttcataagcagacttctgatggcaattggctgatggtgcacagaaccgaggtggtaaagaacaatctgaatccagtctggcggccatttaaaattagcctcaactctctgtgttatggcgacatggataagaccattaaggtagagtgttacgattatgacaacgacggctcccatgaccttattggtaccttccagacaaccatgacaaaactcaaagaggcatcaaggtcttcccccgtcgagtttgagtgcatcaacgagaagaaaagacagaagaagaagagttataagaactctggagtgatcagtgtgaaacaatgtgaaattacggtggaatgtaccttcctggattacataatgggcggatgccagctgaattttactgtcggcgttgacttcacagggtcaaatggggatccgagaagcccagactcattacattacatcagccccaacggggtcaacgagtatctgaccgccctgtggagcgtcggcctggttattcaggattatgatgctgataaaatgtttcctgcattcggcttcggcgctcaaatccctcctcagtggcaagtgagccatgagtttcccatgaattttaacccttcaaacccctactgtaacgggatacaggggatcgtcgaggcctaccgcagctgcctgccacagataaagctgtacggtcctaccaactttagccctatcatcaaccacgtcgccaggtttgccgctgcggctacacagcagcaaaccgcctcccagtacttcgtcctgctaatcatcactgacggtgtaataacagatcttgacgagaccagacaggccatcgtgaatgccagtcggttaccaatgagcattatcatcgtgggtgtcggcggagctgatttctctgctatggagtttttggatggggatgggggatctctccgctcgcctctgggtgaggtcgcaattcgcgatatcgtgcaattcgtccctttccgtcagttccagaatgctccaaaggaggcattagctcagtgtgttctcgccgaaattccccagcaggtggtcggctacttcaatacttataagctgttgcctcctaagaacccggcaaccaagcagcagaaacagtag

SEQ ID NO: 219214 - DNA, 240 bp, Artificial Sequence
  Description of Artificial Sequence: Synthetic coding sequence
atggctgcccagtgtgtcaccaaagtcgcactcaatgtctcctgcgcaaatctgttggacaaggacatagggtcaaaatcggaccccctgtgcgtgctgttccttaatactagtgggcagcagtggtacgaagtggagaggacagagagaatcaagaactgtctcaatccccagttttctaagacttttattattgattactatttcgaagtggttcaaaagctcaagttcggagtctag

SEQ ID NO: 219215 - DNA, 408 bp, Artificial Sequence
  Description of Artificial Sequence: Synthetic coding sequence
atggctgctcagtgtgttaccaaagtcgctctcaatgtgtcatgcgctaatttgctggataaggacattggttccaagtcggaccctctatgtgtgctgtttctgaatacatccggccagcagtggtacgaggtggagagaaccgaacgcattaaaaattgcctgaatccacagttttccaagacatttatcatcgactactactttgaggtcgtgcagaagctcaagttcggagtgtatgacattgataataagactatagagctgagcgatgatgacttcctcggcgagtgtgaatgcacgttaggacagatcgtgtcatccaagaaattgactcgaccactggtcatgaagaccggaaggcccgcaggcaaaggctccattacgattagcgctgaagagatttag

SEQ ID NO: 219216 - DNA, 705 bp, Artificial Sequence
  Description of Artificial Sequence: Synthetic coding sequence
atggcagcccagtgtgttacgaaagtggcgctcaacgtcagctgcgccaacctgctggataaggacatcggcagtaagtccgaccctctgtgcgtgttgttccttaatacttccggccagcagtggtacgaggttgagaggaccgaacggattaagaattgtctgaatccacaattttccaaaacgtttatcatcgactactactttgaagtagtccaaaagctcaagttcggggtctacgacatcgataacaagactattgagctctccgacgacgatttcttaggagaatgcgaatgcaccctcgggcagatagtgagtagcaagaagctgacacgacccctggtgatgaaaaccggtaggcctgccggaaaaggctccataaccatctctgccgaggaaatcaaggataaccgagtagtattgttcgaaatggaagcgaggaagctagataataaggacctgttcggtaaaagtgacccttatctggagttccataaacagacctccgacggtaattggttaatggtccacagaacggaagtggtcaagaataacctaaatccagtgtggagaccgttcaaaatttccctgaactcactgtgttatggggatatggacaaaacaataaaagtggagtgttacgactatgataacgacggcagccatgatctcatcggaacatttcagaccactatgacgtag

SEQ ID NO: 219217 - DNA, 462 bp, Artificial Sequence
  Description of Artificial Sequence: Synthetic coding sequence
atggcggctcagtgtgtcaccaaggtggcactgaacgtctcttgcgccaacctcctggacaaggatattgggtctaagagtgaccctctgtgtgttttatttttaaatacaagcgggcagcaatggtatgaggttgaacgtacagagcggattaagaactgcctaaatccacaattttcaaaaaccttcattatcgactattactttgaggtggttcaaaaactgaagttcggcgtttacgatatcgacaataagaccattgagctgagcgatgatgattttttgggcgagtgcgagtgcactttagggcagattgtttcttctaaaaaactaaccaggcctttggtcatgaaaacagggagacccgctggcaaaggttctatcaccataagcgctgaggaaataaaggacaacagagtagttcttttcgagatggaggcaagaaaattagataacaagtag

SEQ ID NO: 219218 - DNA, 1782 bp, Artificial Sequence
  Description of Artificial Sequence: Synthetic coding sequence
atggaacagccagaggatatggctagcctgtcagagttcgattcgctcgccggttcaatccccgcaacaaaagtcgagattactgtcagttgcagaaatcttctggacaaggacatgttttccaagtctgacccgctttgcgtaatgtatacacagggaatggagaacaagcaatggcgggaatttggaaggaccgaggtaattgataacacgttaaatcccgatttcgtgcgcaaattcattgttgactacttttttgaggagaaacagaatcttcgattcgatctttacgacgttgactcaaaaagccccgatctcagtaaacacgattttctcggccaggccttctgtactctgggagagatcgttggctcgcccggttctcgccttgagaagcctctgaccatcggcgcatttagcctgaacagccgcacaggtaaacccatgccagccgtcagcaatggaggcgtgccgggtaagaaatgcgggacgatcatcctatccgcagaagaactcagtaattgcagggatgtagcaacaatgcagttttgtgccaacaagctggataaaaaagatttcttcggaaaatccgatcccttcctggtattctataggtcgaacgaagacgggaccttcaccatatgtcataagacagaagtgatgaagaacactctcaatccagtttggcagaccttcagtataccagtccgcgcactctgtaacggggattacgatcggaccatcaaggtcgaggtgtacgactgggaccgcgatggctcacacgacttcatcggggagtttactactagttatcgcgaactcgccagaggccagtcccagttcaacatctacgaggtcgtgaatccaaaaaagaaaatgaagaaaaaaaaatacgtgaactccggaacagtgactctgctcagctttgccgtggagtccgagtgcactttccttgattacattaagggaggaacgcagatcaattttaccgtggcgatcgactttacagcatccaatgggaacccctcccagagcacctcactccattatatgtccccctatcaactgaacgcctatgccttggccttgacagccgtcggggagattatccaacactacgactcagacaagatgtttccagccctgggctttggcgctaagcttccccctgatggaagggtgtcccacgaattcccactgaatgggaaccaggagaatcccagttgttgcggaattgacggaattctggaagcctaccatcggtcccttaggaccgtgcagttatacgggccaacaaattttgcaccggtggttacacacgtggctcgcaacgccgcagccgtgcaggatggtagtcagtactctgtgctgctgattataaccgatggggtaatttctgatatggcccagacgaaggaggcaattgtgaacgccgcaaagctgccgatgtctattataatcgtgggagtcggacaagccgagtttgacgccatggtggaattggatggggatgacgttcgcatcagctctagggggaagctggctgagcgcgatattgtgcagttcgtccctttccgagactacgtggaccggacaggtaaccatgtcttgagcatggcgaggcttgccagagatgtcctcgcagagattcctgatcagttagtaagttatatgaaggcccaggggattagaccacggccaccccctgcagctcctacacactcaccaagtcaatctccagcaagaactccaccggcatcaccattgcatacgcacatttag

SEQ ID NO: 219219 - DNA, 906 bp, Artificial Sequence
  Description of Artificial Sequence: Synthetic coding sequence
atgaaaaaaaagaagtacgtcaatagcgggactgtcacactgctgagctttgcagtggaaagtgaatgcacattcctggactacattaaaggtggtacacagatcaatttcaccgttgctattgactttacagcctccaacggcaacccctcccagtcaacgtccctacactacatgtccccctatcagttaaatgcatacgctttggctctgacagccgtcggagagataatccagcattatgattccgataagatgttcccagccctgggttttggggcaaaactgccacctgatggcagggtgtcccacgaattcccgctgaacggcaatcaggaaaacccctcttgctgcggaatcgacggaattttagaagcttatcatcgcagcctcaggactgttcaactgtatgggcctactaatttcgcccctgttgttacacacgtggcacgaaatgcagctgcagtgcaggatggaagccagtactctgtgctcctgatcattacggacggcgtgatctccgatatggcccagacgaaggaagctatcgtcaacgctgccaaactgcctatgtcaattataatcgtgggtgtaggacaggctgagttcgacgctatggtggaactggacggggacgacgtgaggatctcgtccagaggcaaactggcggagagggatatcgtgcaatttgtcccttttagggactatgtggatagaacaggtaaccacgtgttatcaatggccaggcttgccagggacgtcctggctgagatccccgaccagctcgtgagttatatgaaagcacagggcatccgacccaggccacccccagccgcaccaacacatagcccatcccaatcccctgcgaggactcctccagctagccctctgcacacccacatttag

SEQ ID NO: 219220 - DNA, 1515 bp, Artificial Sequence
  Description of Artificial Sequence: Synthetic coding sequence
atggttctggccgacctgggacgcaaaattaccagcgcacttagatctctctctaatgcaaccattattaacgaagaggtgttaaacgctatgctcaaggaggtgtgtacagctctgcttgaagccgacgttaacatcaaactggttaagcagttacgggagaacgtaaaaagtgctattgacctcgaggagatggcttccggactgaataagagaaagatgatacagcacgcggtgtttaaggagctcgttaagctggtggatcctggtgtcaaggcctggacacccactaagggaaagcagaatgtcatcatgttcgtaggcctgcagggaagcggaaaaactacaacctgctccaagctggcctactactaccaaaggaagggttggaagacctgtcttatctgcgccgatacgttccgtgcaggagcgttcgaccagctaaagcagaatgctacaaaggctcgcattcctttctatggcagctacactgagatggaccctgtgatcatcgccagcgaaggggtggaaaagttcaagaatgagaatttcgaaatcatcatcgttgatactagtggcagacataaacaagaggattctttgtttgaggagatgctgcaggtcgccaatgccattcagccagacaacatagtctacgtcatggatgctagcattggccaggcatgtgaggcccaagcaaaggcttttaaggataaggtggatgtcgcttcggtgattgtcacgaagctagatggccacgcaaagggtgggggagcactgtctgccgtcgccgcaacaaagtccccgattatattcataggcacgggagaacatatcgacgatttcgagccctttaagacacaaccctttatcagcaagctccttgggatgggtgatatcgagggtctaatagacaaagttaacgagcttaagttagacgataacgaagccctgatcgaaaaacttaagcatggacagttcacgctgagagacatgtacgagcaatttcagaacattatgaagatgggacctttcagtcagattcttgggatgataccagggtttggaaccgactttatgtctaaaggcaacgaacaagagagtatggctaggcttaagaaacttatgaccataatggactcgatgaatgaccaagagctcgacagtacagatggcgcaaaagtttttagcaaacagcccggtagaatccagcgcgtagcgaggggaagtggagtttccaccagagacgtacaggagctcttgacacaatacacaaagtttgcccaaatggtgaaaaaaatgggtggcattaagggactctttaaggggggtgacatgagtaaaaacgtgagtcagagtcagatggctaagctgaatcagcagatggctaaaatgatggaccctagagtgctgcaccacatggggggaatggccggtttgcagtctatgatgaggcaatttcagcagggtgccgctgggaacatgaaaggaatgatggggtttaacaatatgtag

SEQ ID NO: 219221 - DNA, 1674 bp, Artificial Sequence
  Description of Artificial Sequence: Synthetic coding sequence
atgtctgacccagaaatgggctgggtgcctgaaccaccaactatgaccctgggtgcatccagagtagagcttagagtctcctgccacggcctcctagacagagatactctgactaagccccatccctgtgttctgctgaaactctactctgacgagcagtgggtagaggtggagagaacagaggtcctcaggagttgtagtagccctgtttttagcagggttctggctttagagtactttttcgaggagaagcagccactacagttccacgtattcgatgcagaagacggggcaacaagccccagaaatgacacattccttggctccactgaatgcactttgggccagattgtgagccagaccaaagtgaccaagcccctgctgctgaaaaacggcaagacagctggaaaatctacaatcacaatcgtggccgaggaggtgtccggcaccaacgactacgtccagctcacctttcgagcctacaaattggacaataaggatttgttctctaaatctgatcctttcatggaaatttataagacgaatgaggaccaaagcgaccagttggtgtggcgtacagaggttgtcaagaataaccttaacccttcatgggagccttttagactgtccctgcactctttatgctcctgcgatgtccaccggccacttaagttcctggtgtacgactacgatagtagtggcaaacatgattttatcggggagtttacctccaccttccaggagatgcaggagggtacagcaaatcctggtcaggaaatgcagtgggactgcatcaacccaaaatatagggataaaaaaaagaactataaatcttccggaactgtggtgttagcacaatgtactgtggagaaagtacacacatttttagattatataatgggcggatgtcagatcagcttcacagtcgcgatcgatttcactgcaagcaatggagatcccagatctagtcaaagtctgcactgtttaagtcccaggcaaccgaaccattaccttcaggccctgcgggcagttgggggaatatgccaggattacgattctgacaaacgattccctgcttttgggtttggggctaggatccctcccaactttgaggttagccatgacttcgctatcaattttgatcctgaaaatcccgaatgtgaggaaatctcaggagtcatagcctcatataggagatgcctgccacagatccagttgtatggtccgactaatgtggcgccaataataaatcgtgtagcagagccagctcagcgagaacaaagtacaggacaagctacgaagtattccgtgctcctcgtacttaccgacggggttgtgtctgatatggccgagacccgtacagccattgttcgtgcaagtcgtctgccaatgtcaattatcatcgtcggggtcggcaatgctgatttttcagacatgaggttgctggacggggatgacgggccattgagatgcccccgaggcgtgccagccgctcgggacatcgtacaatttgttcctttcagagacttcaaagatgccgctcccagtgccttggcaaagtgtgttcttgcagaagtcccaagacaggtcgtcgaatactatgctagccaagggattagtccgggagcaccacgcccttgcactctggccaccaccccatccccttcaccatag

SEQ ID NO: 219222 - DNA, 1839 bp, Artificial Sequence
  Description of Artificial Sequence: Synthetic coding sequence
atggccttcaaagaacacggcaagattaccagctgctgcataccgggaccaattaactcatcccgtgccggtgccggtgctggcgcatccgggtggagctcaaaaggagtgcgagccagagccagggagcctgagaggggcgcacccgaccgggaaccatctgatatgtcagatccagaaatggggtgggtccccgagcctcccaccatgacgctgggggctagcagggtcgagttgagggtctcgtgccacggactccttgacagggatacgttgaccaagccccacccatgcgtgctcttgaagctgtattctgacgaacagtgggtagaggtggaacggaccgaggttcttcggagctgctcctcacctgtcttcagccgtgtgctcgcactcgaatatttttttgaggagaagcagcccttgcaatttcatgtgtttgatgccgaagatggcgcaacctcgcctcggaatgatactttcctcggatctacggagtgcaccctaggtcagatagtttctcagacaaaggttaccaagcctctgctgttgaagaacggaaaaactgcagggaaatccaccattacaatcgtggccgaggaggtgagcggcacaaacgactacgttcagcttactttccgagcttacaaactggataataaggacttattcagtaagtcggacccattcatggaaatttacaagaccaacgaagaccaatcggatcagcttgtctggagaacagaggttgtgaaaaataatctaaacccgagctgggaacccttccgtctgtctctgcactctctctgcagttgcgacgttcaccgccctttaaaattcctggtctatgactacgattcatccggtaaacatgacttcatcggcgagtttacatcaaccttccaggagatgcaggagggtactgccaaccccggacaagagatgcagtgggattgcatcaatcctaagtatcgggacaagaaaaagaattacaaatcatccggaactgtggtgttggcccagtgcaccgttgaaaaagttcatacttttctggactatatcatgggaggatgccagatcagcttcaccgtggcaatcgactttaccgcgagtaacggcgaccctcgctcctcacagagtctccactgtctcagtcctcgtcagcctaatcactaccttcaggccctacgcgcagtaggaggtatttgccaggactacgactccgataaacgatttccagctttcggcttcggtgccaggattcccccaaattttgaggtttctcatgacttcgcgattaactttgatccagagaatccagagtgtgaggagatcagcggcgtgatcgctagctacagacggtgtctgccgcagatacaactgtacggtccgacaaatgtggctcccatcatcaatcgagtcgctgaacctgctcagcgagaacaatccaccggccaggcaacaaaatacagcgtactcctcgtcctgactgacggagtggtgagtgacatggcggagactcggaccgctattgtccgggcttcccgacttcccatgtctattattattgttggtgtcggtaatgcagacttctcagacatgcgccttcttgacggagatgacgggccactgcggtgtcctagaggagtccccgcagcacgcgatattgtccagttcgtgccgtttagggatttcaaggacgccgctcccagtgcccttgccaaatgcgtgctggccgaggttccacggcaagtggttgaatactacgcaagccaagggatttctcctggcgcaccacggccttgtacactcgccactactccgagtccatctccctag

SEQ ID NO: 219223 - DNA, 159 bp, Artificial Sequence
  Description of Artificial Sequence: Synthetic coding sequence
atgtccgacccagagatgggatgggttccagagccgccaaccatgacgttaggtgcgtcacgcgtggaacttagagtcagctgccacggactgttagacagagatactcttacaaagccccatccctgcgttctgctgaagctgtactcagatgaatag

SEQ ID NO: 219224 - DNA, 396 bp, Artificial Sequence
  Description of Artificial Sequence: Synthetic coding sequence
atgtctgatccagaaatggggtgggtgcctgaacctcccactatgacgcttggcgcttctagagtcgaactgcgcgtctcttgccacggcctactggatagggatacccttaccaaaccacatccttgtgttcttctcaagctctattccgacgaacagtgggttgaagtagaaaggaccgaagtgctgcgctcatgctcatcccctgtcttcagtcgggtcctagctctggagtacttcttcgaagaaaaacaacccctgcagtttcacgtgtttgatgccgaagacggtgcaaccagccctagaaacgacacatttctcggtagtactgagtgcacgttgggacagattgttagccagacaaaagttacaaaacctctcctgctgaaaaactag

SEQ ID NO: 219225 - DNA, 681 bp, Artificial Sequence
  Description of Artificial Sequence: Synthetic coding sequence
atgtccgatcccgagatgggatgggtgccggaacccccaacaatgactctgggagcatcgagagtggaactacgtgtgagctgtcatgggctcttggatagggacaccctgactaagccccacccgtgtgttctgctcaaactgtacagcgacgaacaatgggtggaagtcgagcgcactgaggtgttgcgctcttgctcatcacctgttttttctagagtgcttgccttagagtacttctttgaagaaaagcagccacttcagtttcacgtcttcgacgccgaagatggggctacatccccaaggaacgacacattcctgggctccaccgagtgcacgctggggcaaattgtctcccagaccaaggtcaccaagcccctgcttttaaagaacgggaagaccgccggtaagagcaccatcaccattgtcgccgaagaagtgagcggcacaaatgattatgtgcagctgacattccgcgcttacaagctggataacaaagatctgttttccaaatctgatccctttatggaaatctacaagactaatgaggatcagtccgatcaactggtctggcgaacggaggtggtgaagaataatctaaacccaagctgggaaccatttagactgtcccttcacagcttatgcagttgcgacgtgcatagaccgctaaagttcctttag

SEQ ID NO: 219226 - DNA, 318 bp, Artificial Sequence
  Description of Artificial Sequence: Synthetic coding sequence
atgagtgacccagagatgggatgggtgcccgaacccccaactatgaccctcggcgcatccagagtggaactacgcgtgtcctgtcatggcctcttagaccgcgataccctcacaaagccccatccatgcgttttactcaagttgtattcagacgaacaatgggtcgaggtggaaaggactgaagtgctgagaagttgtagcagtcccgtgttttcccgggtgctggccctggagtatttttttgaggaaaaacagcctctccaatttcatgtgttcgatgccgaagacggagctacttcgcccagaaacgacacatag

SEQ ID NO: 219227 - DNA, 426 bp, Artificial Sequence
  Description of Artificial Sequence: Synthetic coding sequence
atgagtgatcccgagatgggttgggtgcctgaaccgcctactatgaccttgggagcctcaagggtcgaactcagggtttcctgccacggtctcctggatcgcgataccttgaccaagcctcacccgtgtgtactgctgaagttgtacagtgacgagcagtgggtcgaagtcgagcggacagaagtgctgagatcttgctcttccccagtcttttctcgcgtgctggccctggaatatttctttgaggagaaacagcctctgcagttccacgtgtttgacgccgaagatggagctacaagtccaagaaacgatacatttctggggtctactgagtgtacactggggcagattgtatcccagaccaaggtgacaaaaccactgttgcttaaaaacgggaaaacagcaggtaagagcactataacgtag

SEQ ID NO: 219228 - DNA, 450 bp, Artificial Sequence
  Description of Artificial Sequence: Synthetic coding sequence
atgtccgatcccgagatgggctgggtaccagagcctcctactatgactttaggagcctcgagagtcgaattacgggtttcctgtcatggccttttggatcgggacacacttacaaagccgcacccttgcgtgctgttgaaactgtattctgatgagcaatgggtagaggtggagcgcaccgaggtgctccgctcctgctccagtccggtttttagccgagtcctggcactggagtatttctttgaagagaagcagccgttacagttccacgtgtttgatgctgaggatggagccaccagtcccaggaacgataccttcttgggttcaaccgagtgtactctcggacagatcgtctctcagacaaaggtgaccaagccactacttcttaagaacggtaaaactgctggaaaaagcacgattacaatcgtggccgaagaggtatctggttag

SEQ ID NO: 219229 - DNA, 1902 bp, Artificial Sequence
  Description of Artificial Sequence: Synthetic coding sequence
atgtccgcaggctcggaacgcggagcggctgccaccccagggggtctgcctgcaccctgcgccagcaaagtggagctaagacttagttgtagacacctcctggatagggatccactgacaaagtctgacccctctgtcgccctcctccagcaggcccaggggcagtgggttcaggtgggtaggactgaggtggtcaggagcagcctgcacccagtatttagcaaagtgttcactgtggattattattttgaagaagtgcaaagactgaggttcgaagtgtacgatacccatggacccagcggcttcagctgtcaggaagatgattttcttgggggaatggagtgtacacttggccagcctgcccaaaaatggctcctgcaggtggtcatgcgggtctcagtcgacgtattagggcctgccggacactgcgccaagcactttctctgctgcacagaatcgagccatctggctcgaacaggcccttccttccttctgagatacgacgacctttgcctcccatgggctaccgcgggtgccgtccgatggtggacatgtcgagggggacatacgcaaggttggcagatcgtcgcccagaaaaaagtgactcgcccactgctgctgaagtttgggcgtaatgcaggcaagagcaccatcaccgtgattgcagaggacattagtggcaataacgggtacgtcgaattgagctttagggcgaggaaattggacgataaggacctcttctctaagagcgatccattcctagaattgtacagggtgaatgacgaccaaggcttgcagctagtgtaccggacagaggtcgttaagaacaatctcaatcccgtgtgggaagcattcaaggtgagcctgagttcgctctgctcttgcgaggagactaggcccctcaaatgcctcgtttgggactatgatagcaggggtaagcacgacttcattggggaatttagcacgacctttgaggaaatgcagaaggcgttcgaagaagggcaggcccaatgggattgcgtaaacccaaagtacaagcaaaaaagacgcagttacaagaattcaggagtggtcgtcctggcagatctcaagtttcatcgagtgtactcgttcttggactatattatggggggttgccagatccactttaccgtggccattgattttaccgcttcaaacggcgaccccaggaatagttgctctctacattatatcaacccatatcagcctaatgaatacttgaaggctttggtaagcgttggcgagatatgccaagactacgactctgataagcggttcagtgccctgggatttggggcacgtatcccacccaaatacgaagtatcacatgacttcgccatcaactttaacccagaggacgatgaatgcgaaggaatacaaggagtcgtagaggcctatcagaactgtctgccacgggtgcagctgtacggtccaaccaacgtggctcctatcattagtaaggtggctcgcgtggcagcagcagaggaatctactgggaaagccagccagtactatatactactgatactgaccgatggagtagttacagatatggcggatacacgggaagcgatagttagggcctcccgcttgcccatgtcgattatcatcgttggggtgggcaatgctgacttcaccgatatgcaggtcctcgatggcgatgacggagtgttgcgtagtcccagaggggagcctgcgctgcgggacatcgtgcaatttgttcccttccgagagttgaaaaatgcgtcacccgctgccttggccaagtgcgtccttgccgaggttcctaaacaggtggtggaatattattcccacaggggattgccgcctaggagtctaggagtccctgccggagaagcctcgcctggctgcaccccctag

SEQ ID NO: 219230 - DNA, 1677 bp, Artificial Sequence
  Description of Artificial Sequence: Synthetic coding sequence
atgagcgcagggtcagaaagaggggctgcggctacacccggaggactgccagctccgtgcgccagtaaagttgaactgcgattaagttgcagacacctgcttgatcgggatcctctcaccaagagcgatcctagcgtcgccctgctccagcaagcacaaggccagtgggttcaggtgggtaggaccgaggtcgtgcggagctcacttcatcctgtgtttagtaaagtgtttactgtcgactactattttgaagaggttcagcgcctgcgcttcgaggtctacgatacacatgggccttccgggttctcctgccaagaggacgatttcttaggcggtatggagtgcaccctgggccagatagtcgctcagaagaaggtgacccgacctcttctgctgaagttcggaagaaacgcaggtaaatccaccattacagtgatcgccgaggatatctcgggcaataatggttacgtcgagctctcatttcgggcaaggaagctggacgacaaggacctgttctctaagagcgacccatttctagagctttatcgagtcaacgatgaccaggggctgcagctggtgtatcgcacagaggtcgtaaagaataacctcaaccccgtctgggaagctttcaaagtctcactgagctcactgtgttcctgtgaagagacgcgccctctgaagtgcctcgtgtgggactatgacagcaggggtaaacatgatttcatcggcgaattttctactacattcgaggaaatgcagaaagcatttgaggaaggtcaggctcagtgggattgtgttaatccaaaatacaaacaaaaacgcagatcatataaaaattccggtgtggtggtgcttgcagatctcaaatttcaccgtgtgtatagctttctcgactacatcatgggagggtgtcagatccacttcacggtcgccatcgatttcacggcatccaatggggacccgagaaactcatgctcccttcactatatcaacccatatcaacccaacgagtacttgaaagcgctggtctcagtcggagaaatttgccaggattacgactcagacaaacggttcagcgctctggggtttggcgcacgaatcccaccaaaatacgaggtctctcatgactttgccattaactttaatcccgaggacgacgaatgtgagggcatacagggggtggtcgaggcctatcagaactgtttgcccagagtgcagctgtacggcccaacaaatgttgcaccaatcatctccaaggttgctagggtggcggctgccgaagagtcaacggggaaggccagtcagtactatatcctgctgatcttgactgacggcgtagtgacagatatggccgacacacgggaagccatcgtgcgggcatccaggctgcccatgagcatcattatagtgggggtggggaatgctgatttcactgatatgcaggtactggatggtgatgatggggtacttcgttcccctaggggtgaacccgctcttagggatattgttcagtttgtgcccttcagagaactgaagaatgccagtcctgctgccctggccaaatgtgtccttgccgaggtccccaagcaagtggtggagtattacagccatcggggactgcctcctaggagtctcggagtaccggcaggagaggccagtccagggtgtaccccatag

SEQ ID NO: 219231 - DNA, 825 bp, Artificial Sequence
  Description of Artificial Sequence: Synthetic coding sequence
atggcctccgactctggaaaccaaggaaccctgtgtaccctggagtttgccgtccagatgacttgtcagagttgcgtcgatgcagtcaggaagagcctgcagggtgtcgctggcgtgcaggacgtggaggtccatctagaggaccaaatggtcctggtgcatacaactctgccctcacaggaggttcaggctctgctggaaggaactgggcgtcaggcggttctgaaaggcatgggctcaggccaattgcagaatcttggcgcagccgttgccattctgggagggcctggcacagttcagggggtagtccggttcttacagttgaccccagagcgatgtctcattgaagggacaatcgatgggctggaacctggcctacatggccttcacgtacatcaatacggcgacctgaccaacaattgcaacagttgtggaaatcatttcaatccggacggagcctctcatggtggccctcaggactcggatcggcaccgaggcgatctgggcaacgtgagggccgacgccgatggacgggcaatcttcagaatggaggacgagcagttgaaggtatgggatgtcattggcagatccctgattatcgacgagggcgaggacgatctgggccgaggcggtcatcccctatcaaaaattacaggcaacagcggggaacgcctggcatgtggaatcatagccaggtcagcgggactcttccagaaccctaaacagatttgttcgtgtgacggactcaccatttgggaagagagaggcaggcctatcgccggtaagggcaggaaggaaagcgcccaaccccctgcacacctgtag

SEQ ID NO: 219232 - DNA, 1365 bp, Artificial Sequence
  Description of Artificial Sequence: Synthetic coding sequence
atggcgctgcagttgggacggctatcatcaggtccctgttggcttgtggcaagaggaggttgtggcggacccagagcgtggtcacagtgcggagggggtggtctgcgcgcatggtcccaaagatctgccgcaggcagagtctgcaggccccctggacctgcagggacagagcagtccagaggcctagggcatggatctacctctaggggcggaccctgggtaggtacagggctggcagccgcactcgcagggttagtgggtctggctacggccgcttttggacatgttcagcgcgcagaaatgcttcctaagacctccggaaccagagccaccagtcttggtagacctgaggaggaagaggacgagctcgctcaccgctgctcatcatttatggccccacctgttacagacctcggggagcttagacggcgacctggtgatatgaagaccaaaatggagcttctgattcttgagacccaagctcaggtgtgtcaggctctggctcaggtggacgggggagcaaattttagcgtggaccgctgggagaggaaggaagggggaggcggaatctcctgtgttctgcaggacggatgcgtgtttgagaaagctggagtctcaatctccgttgtgcatggaaacttgagtgaagaggccgctaaacaaatgcgatccagaggcaaggtgctcaagaccaaagatggtaagctgcctttctgcgcaatgggcgtctcgtcggtgatccatcctaaaaacccacacgcacctaccattcacttcaattatcgatactttgaagtggaggaagctgatgggaataagcagtggtggttcgggggaggctgtgacttgacacccacctatcttaaccaagaagacgcagtacatttccacaggacactcaaggaagcttgtgatcaacacgggccagacttgtatccgaaattcaagaagtggtgtgacgactattttttcatagctcatcgcggagagcgaaggggtattggaggaatattttttgatgatttggacagtccaagcaaggaggaggtgttccgctttgtgcagtcctgtgccagagccgtggtcccttcatacatccctctggttaagaagcattgtgatgacagctttacaccccaggagaaactgtggcagcaactccgtcgaggtcgctacgtcgaattcaacttgttatatgatagaggaaccaaatttggcctcttcactccaggctccaggatcgagtccattctcatgtcgttacctctgactgctcgatgggaatacatgcatagtcctagtgagaacagcaaagaggccgaaattttagaggttctgcgccatcctagggattgggtccgctag

SEQ ID NO: 219233 - DNA, 1026 bp, Artificial Sequence
  Description of Artificial Sequence: Synthetic coding sequence
atgggggtagcgaccaccctccagccacctaccacctccaaaactttgcagaagcagcacctggaagccgtgggagcttatcagtatgtgctcacgttcctgttcatggggccatttttctccctgctcgtgtttgttctccttttcacaagtttgtggcccttttctgtcttttatcttgtatggctctacgttgattgggatacacctaatcaggggggtcggcgtagtgaatggattcgaaatcgagcaatctggcgtcagttacgagactattaccctgtgaagcttgtgaaaacagccgaactgccaccagatagaaactacgtgctgggagcgcacccccacgggattatgtgtaccgggttcttgtgtaacttttccacagagtccaatggattttcacagttatttccaggcctccgaccttggcttgctgtgctggccggattgttctatctgcctgtatacagggattacatcatgtctttcggactctgccccgtgagccggcagtcactggacttcatcctcagccagcctcagctggggcaggccgttgtgataatggttggaggagcgcatgaagccctgtactccgtcccaggagaacattgtctcacgctgcagaagagaaaaggattcgtgcggctggcactccggcatggagccagtctggtccccgtctactccttcggtgaaaacgatatcttcagactaaaagcgttcgcgactggttcatggcagcattggtgtcaacttacctttaagaagctcatggggttcagcccttgcatattttggggacgcggactgttctccgctacctcttggggattgctgccctttgctgtgcccattactactgtggtgggcaggcctatccctgtgccccagagactacatcccacagaggaggaggtcaaccactaccacgccctctatatgaccgccttagagcagctctttgaggagcataaggagtcttgcggagttccagccagtacttgtctgacattcatctag

SEQ ID NO: 219234 - DNA, 930 bp, Artificial Sequence
  Description of Artificial Sequence: Synthetic coding sequence
atggccagtaagagttggcttaactttcttacttttctctgcggctccgctatcggatttctgttgtgctcacagctgttcagcatcctgctgggtgagaaggtggatacccagcccaatgtgctgcacaacgatccacatgcccgacacagcgatgataatggtcaaaatcatttggaaggccagatgaatttcaacgccgactcctctcagcataaagacgaaaacacagatatcgctgaaaacctctaccagaaggtccggatactgtgctgggtgatgacaggacctcagaatctcgagaaaaaggcaaagcatgtaaaggcaacatgggcacaaagatgtaataaggtgctcttcatgtcatccgaggaaaataaagacttcccagcagtggggctgaaaacgaaagaaggaagagatcagctctattggaaaactatcaaggcgtttcagtacgtgcatgagcactatctcgaagacgctgactggttcctgaaagccgacgacgacacctacgtaattttggataatctcaggtggctactttctaaatacgacccggaagagcccatctattttggtagaaggttcaaaccctacgtgaaacagggctatatgagcgggggtgccggatacgtcttatctaaagaggccctgaaaaggtttgtcgatgccttcaaaacggataaatgtactcatagttcatccatagaggacttggctctcgggcgatgcatggaaatcatgaatgtggaagctggcgatagtcgagatacaattggaaaggagactttccacccatttgtacccgagcaccacttgattaaagggtacctccccaggactttctggtattggaactacaactattacccgccagtggaggtgagcctggagatcttattgttgtgtcagtacctagactag

SEQ ID NO: 219235 - DNA, 303 bp, Artificial Sequence
  Description of Artificial Sequence: Synthetic coding sequence
atggcctctaaatcatggctcaattttttaacttttctttgcgggagcgccattggctttctgctctgttcccagttgttttcaattctgcttggggaaaaggttgacacacaaccaaatgtgctacacaatgatccacatgctcggcattcagacgataatggacagaatcacctggaggggcaaatgaatttcaacgccgactcttcacaacataaggacgaaaacaccgatatcgccgaaaatctttatcagaaagtgagaatcctctgctgggtcatgactggcccacagaatctgtag

SEQ ID NO: 219236 - DNA, 396 bp, Artificial Sequence
  Description of Artificial Sequence: Synthetic coding sequence
atggcctccaagagttggctcaattttcttactttcctgtgtggatccgccatcggcttcctgctctgcagtcagctgtttagcattctcctcggcgagaaagtggatacccagccaaacgtcctgcacaacgatccccacgcccgtcacagcgacgataatggtcagaaccacctggagggacaaatgaattttaatgcagactcctcccaacataaagacgaaaacaccgatatcgccgagaatttgtatcaaaaagtgaggattctatgctgggtgatgactggccctcagaacctggagaaaaaggcgaaacacgtcaaggccacatgggctcagcgctgtaacaaggtgctgttcatgtcatctgaagagaataaggacttcccggcttag

SEQ ID NO: 219237 - DNA, 1092 bp, Artificial Sequence
  Description of Artificial Sequence: Synthetic coding sequence
atggcatccaagagctggctcaactttttgacttttctctgcggaagcgccatcgggttcctcctttgttcccagttgtttagcattttgctgggtgagaaggtcgacacgcagccaaatgtgctccataatgacccacacgccaggcattccgacgataatgggcagaatcacctagaaggtcagatgaactttaacgccgactccagccagcataaggacgaaaacacagatattgcagagaatctgtatcagaaagtgcgcatcctgtgctgggtgatgacgggaccccagaatctggagaagaaagcaaagcacgtgaaagccacatgggcacaaagatgcaacaaggtgctttttatgtcttctgaagaaaataaagacttcccagccgtgggtctgaagaccaaagaaggtcgcgatcagctctactggaaaacaatcaaggctttccagtacgtgcatgagcactaccttgaggatgccgactggttcctcaaggctgatgacgacacgtatgtcatactggacaacctgagatggcttctgtccaagtacgaccccgaggagccgatctatttcggtcgacgttttaagccatatgtgaagcagggatacatgagcgggggtgccggatatgtcttgagcaaagaagctttgaagaggtttgtggacgcatttaagaccgataagtgtacacactcttcatccatcgaagacctggcactgggacgctgcatggaaattatgaatgttgaggctggtgattcaagagacacgattggtaaagaaacatttcatccatttgtgcctgaacaccacctgatcaaaggatatctgcctaggactttctggtattggaactataattattatccgccagtcgaaggtcccggatgttgttcagatctagccgtttctttccactacgttgatagcaccactatgtacgaactggagtacctcgtgtaccacctacgtccatacggatatctctatagataccaacccaccctccctgaaaggatacttaaggagattagccaggcaaataaaaatgaagacacgaaagtgaagctgggcaatccctag

SEQ ID NO: 219238 - DNA, 549 bp, Artificial Sequence
  Description of Artificial Sequence: Synthetic coding sequence
atgcctcgggtcgtgcctgaccagagaagcaagtttgagaacgaagagttcttcaggaaactttctcgtgaatgcgagatcaaatatactggtttccgcgatcgccctcatgaggagcgtcaggcccgttttcaaaatgcttgccgggatgggaggagtgaaattgcgttcgtggccaccggtacgaacctttcattgcagtttttccccgctagctggcaaggcgagcagcgccagacgccaagccgggaatacgtggatctcgagagggaggccggaaaggtttatcttaaggcgccaatgatcctgaatggcgtctgcgtgatctggaagggatggattgaccttcagagactggatggaatggggtgtttagagttcgacgaggaacgcgcacagcaggaggatgccctggcccagcaggcattcgaggaggcgagaaggaggaccagagaatttgaagaccgtgataggtcacaccgcgaggagatggaggtgagggtctcacaattactggccgtgacaggcaagaaaaccaccagaccctag

SEQ ID NO: 219239 - DNA, 564 bp, Artificial Sequence
  Description of Artificial Sequence: Synthetic coding sequence
atgccacgcgttgtgcccgatcaaagatccaaatttgaaaacgaggaattcttcaggaagctaagtcgggaatgtgaaattaaatacactggcttcagggatcgccctcacgaagaacgtcaggctcgcttccaaaatgcgtgtagagatggcaggtctgagattgcttttgtggctaccggaacaaacctgtctctgcagttctttcctgcatcctggcagggtgagcaacgacagacacctagcagggaatatgtggacctggagcgagaggcaggcaaggtgtacctgaaggctcccatgattctgaacggcgtgtgcgtaatctggaagggatggatcgaccttcagaggctcgacgggatgggttgcttggaattcgacgaggagcgcgctcaacaagaggacgcgctggcccagcaggcgtttgaggaagcacgaagacgaacgcgcgagttcgaggacagagatcggtcccatcgggaggagatggaggccaggcgacagcaggatccttcccccggaagtaatttgggagggggagacgatcttaagttaagatag

SEQ ID NO: 219240 - DNA, 1788 bp, Artificial Sequence
  Description of Artificial Sequence: Synthetic coding sequence
atggtcggagttcctggcgctgcagccttccagctgggtccagagaaacgcgttccagccatgccgggttccccagtagaggtgaagatacagagcaggagcagtccacccaccatgccaccactcccccctatcaaccccggtggtcctagacctgtttcttttactcctaccgccctgtctaatggcattaaccacagtccccctaccctcaacggagctcctagccctcctcaaaggttctcgaacggtcctgcctctagcacctcatcagcattaacaaatcaacagctccccgcaacctgcggggctcgacagctatcaaagttgaagcggtttctcaccactttacaacagtttggcaatgacatctcccctgagatcggagagaaggtgcgcactctcgtactggcccttgtcaatagtactgtgacgattgaggaattccactgcaagctgcaagaagccaccaatttccccctgcgcccatttgttattccatttctcaaagccaacctccctctgctgcaacgcgagcttctgcactgcgctagggccgctaaacaaactccaagtcaatacctcgcacagcacgagcatttattgctgaacacctctatagcctctccagctgattcatccgaactgctgatggaggtgcatggtaatggtaaacgcccaagcccagagcggagggaggagaactcctttgatcgggatacaatcgcccctgaaccccctgctaagcgcgtgtgtaccatttccccagcacctaggcattcacccgctctgaccgtgcctctgatgaacccagggggacagttccacccaacccctcccccacttcagcattataccctagaggacattgccaccagccacttatatcgcgaaccaaacaagatgctggaacatcgggaggtgagagaccgacaccattccttgggtcttaacgggggttaccaggacgagcttgtagaccataggttaacggaaagggagtgggcagacgagtggaagcacctggaccatgctctgaattgcattatggagatggtggagaagaccagacgaagcatggcggtcctgcgccgttgccaggagtcggacagggaggaactgaattactggaagcgcagatataacgagaataccgaactgaggaaaaccgggaccgagttggtgtcacgccagcactcacccggttcagcggactctctcagtaatgacagccagcgcgagtttaattcgcgccctggaaccgggtacgtccctgtggaattttggaaaaagacggaggaggccgtgaacaaggtgaagatccaggctatgagcgaagtgcagaaagccgtagccgaggcagagcagaaggcattcgaagtgatagctacagagcgcgctcgcatggaacaaacaatagcagacgtaaagcggcaagcagctgaagatgccttcctcgtcataaatgagcaggaagaatctacagagaattgttggaattgtggaaggaaagccagtgaaacatgttcaggatgtaatatagcccgttactgcggcagcttctgtcagcataaagactgggagcgtcatcatcgcctctgtggacagaatttacacgggcaatcccctcacggacaaggtaggcctctccttcctgtgggccgaggctcttcggctcgatcggctgattgttctgtgccatcacctgctttggacaagacttctgcaacgactagcagatcgtcaacaccagcatctgtcactgctatcgacaccaacggtttgtag

SEQ ID NO: 219241 - DNA, 1815 bp, Artificial Sequence
  Description of Artificial Sequence: Synthetic coding sequence
atggccaaggagtcagggatctccctgaaagaaatccaagttctggcccgacaatggaaagtgggaccagaaaagagagttcctgctatgcctggttcacctgtggaagtaaaaatccagtcgagaagtagcccgccaacgatgcccccattgcctcccattaaccctgggggacctagaccggtctccttcaccccgacggcgctctctaacggcataaatcactctccacccactctgaacggagcaccatcaccgcctcagagattttctaacggccctgcatcttcaactagtagcgctctgacgaaccaacaattaccagctacatgcggcgctcggcagctcagtaaattaaaacgctttctgaccactctgcagcaattcggcaatgatatcagcccagaaataggcgagaaagtccgaaccctggtgcttgccttggtgaactccaccgtgaccatcgaagagtttcactgcaagctgcaggaggcaactaacttcccactccggcctttcgtgatccccttcttgaaagcaaatctccccctgcttcagagggaactgctacactgcgctagagccgctaagcagacgccaagccaatatctcgcgcagcatgaacatcttttgctgaatacttcaattgcttcacctgcagactcaagcgagttgctcatggaagtgcacgggaacggaaaaagaccgagcccagagcgcagggaggagaattcttttgacagagataccattgctccagagcctccggcaaagcgtgtctgtacaatatccccagcgccaagacatagtcctgcgttgactgtcccactgatgaaccctggcggacagttccacccaacacctccgccactgcagcattataccttggaggatattgctacatcacatttataccgcgagcctaataagatgcttgagcacagggaagttcgagacagacaccatagtctggggctgaacgggggatatcaggacgaactggtggatcaccggctgaccgagcgagagtgggccgacgagtggaagcacctcgatcacgcgctgaactgcatcatggaaatggtggagaagacgcgcagaagtatggctgtgctgaggcgttgccaggaatccgacagggaggaactgaactactggaagcgtcggtacaatgagaatactgaactgcgaaagaccggcacggagcttgtctctcggcaacatagccctggttcagccgacagccttagcaatgactctcagcgagagtttaattcacggccaggtaccggctatgtgcctgtagagttttggaagaaaactgaggaggccgtaaataaggtgaagatccaagctatgtctgaggtccagaaagccgtcgctgaagctgaacaaaaggcattcgaagtcatcgccaccgagcgcgcacgcatggaacagaccattgccgacgtgaagagacaggcggctgaggacgcatttcttgtgatcaacgaacaggaagagtcaaccgaaaactgctggaactgcgggaggaaagcctcagagacgtgttccgggtgtaatatcgcgaggtactgcggcagtttctgccagcacaaggattgggagagacaccaccggctctgtgggcaaaacctgcatgggcagtcacctcatggtcagggcagaccactcctgccagtggggagggggagcagtgccaggagtgctgactgcagcgtgccttctccagcccttgataaaacatccgcaaccacaagcaggtctagcacacccgctagcgtcactgctatagacactaacggtttgtag

SEQ ID NO: 219242 - DNA, 1815 bp, Artificial Sequence
  Description of Artificial Sequence: Synthetic coding sequence
atggcaaaggagagtgggatttccctcaaggagatccaggtgcttgctagacagtggaaagttggcccagagaagagagtgccggcaatgccaggcagcccagtggaggtaaaaatccagagccgtagtagtcctcccacaatgcctccgcttcctccaattaaccccggtggcccacggccagtgagtttcactcctaccgcactgagcaatgggattaaccattctcctccaaccctcaacggggcaccatcaccacctcaacgcttttctaacggtccagccagttccacttcctcggcattgactaatcagcagctcccagccacgtgtggggctcgacagttgtcaaagttaaaaaggttcctgacaacattgcagcagtttggcaatgacatctctccggaaattggtgagaaggttcggactttggtgctggctctcgtgaacagtaccgtgacaatcgaagagtttcactgcaaactgcaggaggcaacgaacttccctttacgaccttttgtgatcccttttctgaaggctaatctgccccttctacagagagagctgctacattgcgctagggctgccaaacagacaccctctcagtacctcgcacagcacgagcatctcctcttgaacactagcatagcgagtcctgcggactcatctgagcttctgatggaggttcacgggaatggtaaacggccatcacctgagcggagggaggagaatagcttcgatcgggacacaattgccccagagcctcccgctaagcgtgtgtgtaccatctcaccagcccctagacattcgcctgcactgactgtgcctctcatgaatccaggaggacagttccacccgacacccccaccgttgcaacactatacattagaggacattgcaacaagccacctatacagagagcccaataaaatgctagaacatcgcgaggttcgcgatcggcaccactcgctgggcctgaatggcggatatcaggatgaactggtagatcacaggttgaccgagagagagtgggctgacgagtggaagcatctggaccatgccctaaattgtattatggaaatggttgagaaaactcggaggagtatggctgtgctaagacgctgccaggagagtgatagggaagaactcaactactggaaacgcaggtataacgagaacactgagctgaggaagacaggaaccgagctcgtgtcgcggcaacactccccgggttcggctgactccctgagcaatgatagccagcgtgagttcaattctaggcctgggaccggctacgtgcccgtggagttctggaaaaagaccgaggaagcggtgaacaaggttaagattcaggctatgtccgaagtgcaaaaagcagttgcagaagcagaacagaaggcatttgaagttatagccacagagcgagctagaatggaacaaacaattgctgacgtgaaacggcaagccgcagaagatgctttcttggtcatcaatgagcaggaagaatccacagagaattgctggaattgcggacgtaaagctagtgagacatgctctggatgtaacatagctcggtattgtgggtccttttgccaacataaagactgggaacggcatcaccgcctgtgtggccagaatctccacggccagtccccacacggccaaggaaggccgctcctgccagtggggcgaggctcgtccgccagatcagccgattgttcggttccatcacctgctctggataaaacctcagccaccacatcaaggagcagcacccccgcttctgtcacagcgatcgataccaacggcctctag

SEQ ID NO: 219243 - DNA, 792 bp, Artificial Sequence
  Description of Artificial Sequence: Synthetic coding sequence
atgcctggaagccctgtggaggtgaagatacagagccggtcttccccccctactatgcccccattgccccctatcaaccccggaggaccgcgaccagtgagttttactcctaccgctctctctaacgggatcaaccattcccctcccactttaaacggcgcaccgtcccctcctcagcgatttagcaacggacccgcatcatccacctcttctgcactgactaatcagcagttgccagccacctgtggagcacgacagctttccaaactcaagcgtttccttactaccctccagcagtttgggaatgacataagccccgagataggcgaaaaagtacgcacacttgtgctggctttagtgaatagcaccgtcaccattgaggaattccattgcaagctgcaagaggccactaatttcccattgcgcccttttgtaataccattccttaaagcaaatctcccgctccttcagagagagctgctgcactgtgccagggccgctaaacagactccttctcagtatcttgcccagcacgagcacttgttgctaaacacatccatcgcttcacccgcagattctagtgagctgctgatggaagtgcacggaaacggaaaaagaccctcacccgagtcatgcattattcaccttaaatcgatgggtgtcgcttctagacacgagtatttttccggcaccctccagatgcctgcccaccctgtcagaaactccacactggaaaatctctgggtggactgctctcgcagcctgaggtcgaccgtcttaccattcccctag

SEQ ID NO: 219244 - DNA, 1728 bp, Artificial Sequence
  Description of Artificial Sequence: Synthetic coding sequence
atgcccggaagccccgtggaagtgaagatccagagtcgtagcagtcctcccactatgcccccactgcctcccatcaatcccggaggacccaggcccgttagctttacgccgacagccctgagtaacggaatcaatcactcgccaccaactctcaacggagccccatcgccccctcagagattctccaacggcccagcaagttctactagcagtgcccttactaatcagcaacttccagccacatgcggagctaggcagctatccaagttaaagcggttcttgacaacccttcagcagtttgggaacgacatatctcctgagatcggggagaaggttaggaccttggttcttgccctggtgaacagcactgttactatcgaggagtttcattgcaaactgcaggaggctacgaatttccctctccggcctttcgtgatcccctttttgaaagctaacctacctctgctgcagcgggagctgctccactgcgcacgggcagccaaacaaacccccagtcaatacctggcacagcacgagcatcttctgctgaacacctccatcgcgagccccgctgacagcagtgaactgctgatggaagtgcatgggaatggaaagcgacccagcccagagcgcagagaagaaaattcatttgatcgcgatacgatcgctccagagccgcctgcgaaaagggtctgcactatcagtccagccccaagacactctccagcgctgacagtaccattgatgaatcctgggggacagtttcatcccactcctccgccactgcagcattacactctggaggacatagcgacaagccacttgtatcgggagcccaataagatgctcgaacaccgcgaggtcagagatcgccaccactctctcggcctgaatggcggttaccaggacgagctggtggaccaccggctcactgagagggagtgggccgatgaatggaagcacctggaccatgccctgaattgtattatggaaatggttgagaagaccagacgaagtatggcagtgcttcgcaggtgccaggaatctgatagggaagagctgaattactggaagcgacgctacaacgaaaacacggagctccgcaaaactgggaccgagctggtgagtaggcaacatagcccaggatctgctgactcactgtcaaatgactcccaaagagagttcaatagcaggcccggaactggctacgtacccgttgagttctggaagaagacagaggaggccgtcaataaggtgaaaatacaggctatgtccgaggtgcagaaggccgtagcggaggcggagcagaaagccttcgaggtgattgcaacggaacgcgctagaatggaacagaccatcgcagacgtaaagcggcaggccgcagaagacgccttcctcgttattaacgaacaggaagagagcactgagaactgctggaactgcgggaggaaggctagtgagacttgcagtggttgtaatattgctcgctactgcggttccttctgtcaacacaaggactgggaaaggcaccacagactgtgcggccagaatctacacgggcagtcacctcatggccagggtaggccactgttaccagtgggcaggggctcttctgcaaggagcgctgattgttcagtgccatcacccgctctggacaagacaagcgctactactagcagatcttccacaccggcttctgtgaccgcgatcgacactaacggactctag

SEQ ID NO: 219245 - DNA, 1137 bp, Artificial Sequence
  Description of Artificial Sequence: Synthetic coding sequence
atggaggtacatggtaatggcaaacgccctagtccagagcggagggaagaaaatagctttgacagggatactatcgcgcctgagccccctgcgaagagagtgtgtaccattagcccggcaccacgccattctccagccctcacagttcccctcatgaaccctggcggtcagtttcatcctaccccaccgccactccaacactacacacttgaggatattgccacctcccatctgtacagagaaccgaacaagatgcttgaacaccgagaggtacgtgaccgacaccactctttagggctgaatggcggttaccaggacgagttggtggaccaccgtctgaccgagagagagtgggccgacgagtggaagcatctggatcacgcactcaactgtatcatggagatggtggagaagactcgtcgctcaatggccgtacttcgtaggtgtcaggagtctgatagagaggaactcaactattggaaacgacgatacaacgaaaatacagagctgaggaagactggcacggaactcgtgtctaggcagcattcccctggatctgcggacagcctcagtaatgacagtcagagagaatttaattctcgccctggaaccggatacgtgccagtggaattctggaagaagacagaagaggccgttaacaaagtgaagatccaagcaatgtccgaggtgcagaaggctgttgccgaagcagagcaaaaagcctttgaagtaatcgccacagagagggccagaatggaacagacgattgctgatgtgaagagacaagctgctgaagacgcttttctggttatcaatgagcaggaagaaagtaccgaaaactgctggaactgtgggaggaaggcatccgagacatgctctggttgtaacatagcacgctattgtgggagcttttgccaacacaaggattgggagcgccaccacaggttgtgtggacagaacctgcatggacagagcccacatggccaggggaggcccctactgccggttggacggggatcttctgcccgttcggccgattgttcagttccaagtcctgccttggacaaaacttctgcaacaacgagtcgttcttcaacgcccgcatctgtaactgccatcgacactaatggcctgtag

SEQ ID NO: 219246 - DNA, 546 bp, Artificial Sequence
  Description of Artificial Sequence: Synthetic coding sequence
atggtaggggtgcctggggcagcagccttccagctgggccctgaaaaacgtgtgccggcaatgccaggaagccctgttgaggtgaagatacaaagccggtctagccctccaacaatgccgccactccctcctatcaatcctggtggccctcggccagttagttttaccccaacagctttgtccaatgggataaatcatagcccaccaactctcaacggtgccccaagccctccccagcgatttagtaatggccctgccagctcaacttcttccgcgttgaccaaccaacagttgccggcaacttgcggagcaaggcagctatccaaactaaaaaggttcctaaccacattacagcaattcggaaacgatatctcaccagagatcggggagaaggtgagaacactggtgctggccctggtgaactctactgtcacaatcgaagagtttcattgcaaattgcaagaagctacgaacttccccttgcgaccctttgtaataccttttctaaaagcaaaccttccactgctgcagagagagctgctgtag

SEQ ID NO: 219247 - DNA, 243 bp, Artificial Sequence
  Description of Artificial Sequence: Synthetic coding sequence
atggctaaagaaagtgggatctcgctgaaggagatccaggtgctggctaggcagtggaaggtgggaccggaaaaaagggtcccagctatgccaggatcccctgttgaagttaagatccagagcaggagtagcccacccaccatgccaccactgccccctatcaatcctggcggacctcggcctgtgtcgttcacacctaccgccctgtctaacgggatcaatcacagccctcctactctgtag

SEQ ID NO: 219248 - DNA, 459 bp, Artificial Sequence
  Description of Artificial Sequence: Synthetic coding sequence
atgtctgaggtgcaaaaggcagttgctgaggctgaacagaaagcctttgaagtaatcgccaccgagagggcacggatggaacagacaatcgctgatgtgaaacggcaggcagctgaggacgccttcctcgtcatcaacgagcaggaggagagcaccgaaaattgctggaattgcggacggaaagctagcgagacctgctccggctgtaacatcgctaggtattgcggaagcttttgtcaacataaagactgggaacgtcaccatcggctgtgcgggcagaacctgcatgggcagtcgccacacggacagggacgccctctgctccccgtggggagggggtcaagcgcacggagcgcggactgttccgtacctagccccgcattggataaaaccagcgcgacaacttcccgctcctcgacacccgcaagcgtgaccgctattgatactaatggcctatag

SEQ ID NO: 219249 - DNA, 1962 bp, Artificial Sequence
  Description of Artificial Sequence: Synthetic coding sequence
atgcccgcttcaaggttaagggatcgggctgcctcctctgcctccggtagtacatgtggatctatgtctcagacacaccctgtacttgaaagcggcctcctcgcctctgctggttgcagtgcacccaggggccctaggaaaggcggtccagctcccgttgataggaaggctaaggcaagtgcaatgcccgatagtcccgctgaagtgaagacgcagcctcgatccacaccccctagcatgcctcccccaccaccagctgcatcccagggagccacaaggcccccttccttcacgccccatacccacagggaagatggcccagcgactctcccacatggccgattccacggttgtctcaagtggagcatggtatgcctcctgatgaacggctcttcccactcccctacggctattaacggcgctccctgcacccccaatggattcagtaacggtccggcaacttcttccactgccagtctctctacccagcacctgcctcccgcttgcggcgcaaggcaactatccaaactcaaaagattcttaactacccttcagcagtttggctccgacatttcgcctgagattggcgaaagagtcaggactctcgtgttagggctcgtgaatagcaccctgactatagaagaattccattcgaaactgcaggaagcgacaaatttccctttgcgccctttcgtgattccgtttttgaaagcgaatctgcctcttttgcagagagagctgctgcactgtgcccgactcgccaaacagacacccgctcaatacttggcccaacacgagcagctgttacttgatgcctccgcctcctcccctatcgacagttctgaacttctgcttgaggtgaacgagaacgggaagcgaagaacgccagacagaacaaaggagaatgggtccgaccgcgacccattacatcctgaacatttatcaaaacgaccgtgcaccctcaaccccgctcagaggtatagcccttctaacggcccacctcaacccacacctccaccccactaccgtttggaagacatcgctatggctcaccatttcagagatgcatacagacatccagatcctagagagctcagggagcgccacagaccactggtcgtgccaggctcacgtcaggaagaagtgattgatcataagctgaccgagcgggaatgggccgaagaatggaaacacctgaacaacctgctgaactgcattatggacatggtcgagaagactaggcgtagtcttacagttctgcggcgatgtcaggaggccgatagagaagagttaaatcactgggcccgtcgctattccgacgcagaggatacgaaaaagggtcccgctcctgctgccgcacgccctaggtcttcaagtgctggaccagaaggcccacagctggatgtgcccagagagttcctgccaagaaccctgacagggtatgtgccagaggatatttggagaaaggcagaagaagcggtgaatgaggtgaagcggcaggccatgagtgagctgcagaaggcggtgtccgatgctgaacgcaaggctcatgagctcatcacaactgagcgagccaaaatggaacgggctcttgctgaggcaaaaaggcaggcaagcgaggacgccctcactgtaatcaaccaacaagaggatagctccgagagctgctggaattgtggtagaaaagcatcagaaacctgctccggttgtaacgctgccaggtactgcggttccttttgtcaacaccgggattgggaaaagcatcaccacgtgtgcgggcagtctctccagggacctacagcagtagttgccgaccccgtgcccggacccccagaagctgctcattcgctcggtcctagtctaccagtgggagccgcatccccatcagaggctggaagtgcaggtccgtctaggccgggttctccaagtcctcccggaccactggatactgtacccaggtag

SEQ ID NO: 219250 - DNA, 1704 bp, Artificial Sequence
  Description of Artificial Sequence: Synthetic coding sequence
atgcccgatagtcctgcggaagttaagactcagccgagatcaacaccaccttccatgccgcctcctccccctgcagcgtctcaaggtgcaacacgtccaccttctttcacacctcatacattgatgaacgggtctagccattcccccactgcgatcaacggagcaccctgcacgcctaacggcttctcaaatggacccgcaacttcgagtactgcctcactgagcacgcagcatctgcctccggcttgcggtgctcgccaattaagtaaactgaagaggtttctaacaaccctgcagcagttcggatctgacatctcgcctgagataggggagagagttcgtactctggtgttgggcctggtgaactctaccttaacaattgaagagttccattcaaagctgcaagaggctacgaatttccctctccggccattcgtgattcctttcctgaaagccaaccttcctctcctccagcgggaactcctgcactgtgcccgtttggcaaaacagacaccagcgcagtacctggcacagcatgagcaactgctgctggacgcctccgcctccagtcctattgacagctccgagctgctgctcgaggtaaacgaaaacggcaagaggcgaacaccagacaggacgaaagaaaatggttccgacagggaccccctgcacccggaacatctgtctaaacgcccttgtacgctgaatcccgctcaacggtattcgccgtccaacggaccgcctcaaccgaccccaccccctcactatcggcttgaggacatagccatggcacaccactttagagacgcttatagacaccctgacccccgtgagctgagagagaggcacagacccctggtcgtgcccggaagccgtcaggaggaggttattgaccacaaattgacagaacgtgagtgggccgaagaatggaagcatttgaataatttgttaaattgtataatggacatggtggagaaaactaggcgctccctcactgtcctgagacgctgtcaggaagctgacagggaggagttaaaccattgggcaagacggtacagcgatgctgaagacaccaagaagggtccagcacctgcggctgcacggcctaggtcctcttctgccggtcccgaggggcctcagcttgacgttcctagggagttccttcctagaaccttaactgggtacgttccagaagatatttggcggaaggccgaggaggctgtaaatgaagtgaagcggcaggccatgtcagagttgcagaaggcagtgagtgacgcggagaggaaggcacatgaattgattacaacagagagagctaagatggaacgcgcactcgccgaggccaagcgccaggcctctgaagatgctctgaccgtaatcaaccagcaggaggattcctcagagtcatgttggaattgcggacgtaaagcctcagagacctgttctggctgcaatgctgcgcgatactgtggatctttctgtcagcatcgggactgggaaaagcatcatcacgtctgtggccagtccctccaaggcccaacggccgtcgtcgctgatccggtgcctggcccaccagaagcggctcacagcctgggcccatcgctaccagttggcgctgcctcaccttcagaggctggaagcgcgggtccctcaagacctggctctcccagccccccaggcccactggacactgtccccagatag

SEQ ID NO: 219251 - DNA, 1704 bp, Artificial Sequence
  Description of Artificial Sequence: Synthetic coding sequence
atgcccgatagcccggcagaagtaaagacacagccacggagcacccctccatcgatgccgcctccaccccctgccgcttcacagggcgctacgcgccctccttcgtttacccctcacaccttaatgaacggatcatcacactcccctacagccatcaatggggcaccctgtacacctaatgggttctccaacggaccagctacaagctccacagcatcgctgagcacacagcacctcccacctgcttgtggcgctcggcaactatcaaaacttaagaggttcctaaccacgctgcagcagttcgggagtgacatctccccggagataggggagagagtgcgaaccctagtcttggggctggtgaactcaacccttactattgaagaattccactcaaaactgcaggaagccacaaacttccccttgcggcctttcgttataccatttctcaaagcgaatctgcccctgctgcaacgggagcttctgcactgtgcgagacttgcgaagcaaactcctgctcagtaccttgcgcagcacgagcaattactacttgatgctagtgcctcgtcaccaatcgatagttccgagctcctcctggaggttaacgagaatggcaagcggcgaacccccgatagaactaaggagaacggctcagacagagacccacttcaccccgaacacctgtccaagaggccctgtaccctcaatcccgctcagcggtacagccccagcaacggtcctccccagcccacccccccaccgcactaccgcctggaggatatcgccatggcccaccattttagggatgcctataggcaccccgatcccagagagctgagagagcgccatcgacctctggtcgttcctggctccaggcaggaagaagtgatagatcataagctgactgagcgagaatgggcggaagaatggaagcatcttaacaacctgctgaattgtattatggacatggttgagaagaccagaagatccctgaccgtgctccggagatgtcaggaagctgaccgagaagaactgaaccactgggctcggaggtatagcgacgcggaggacactaaaaagggccctgccccagccgctgcccgaccccgttcaagctcagccggtcccgaaggcccacagttggatgttcctagagaattcctgccccgaactctgacaggatatgttccagaggacatctggcggaaagcagaagaagccgtgaatgaggtaaagcggcaggccatgagtgagcttcagaaggccgtgtcggatgctgagagaaaggctcacgagcttatcaccacagagcgcgctaaaatggaacgcgcattagcagaagccaagaggcaggctagtgaggacgccctgaccgttattaaccagcaggaggatagctctgagtcctgctggaattgtggacgcaaagccagcgaaacatgctccgggtgcaatgctgccaggtactgtggcagcttctgtcaacaccgcgactgggagaaacaccatcacgtgtgtggtcagagcctccaaggccctacagccgtagtcgctgaccctgttccaggaccacctgaggcagcgcatagccttggcccttctctgccagtgggcgctgctagcccgagtgaggccggatctgccggtcccagccgacctggatctccatcacccccaggcccattagatacggtgccaaggtag

SEQ ID NO: 219252 - DNA, 1848 bp, Artificial Sequence
  Description of Artificial Sequence: Synthetic coding sequence
atgcctgctagtcgcctgcgcgatagagccgctagtagcgcatctggcagtacttgtggatctatgagccagacgcaccccgttctcgaatcggggttgcttgcttctgccggatgctccgctcccagaggaccaagaaagggcggtcccgcacccgtggaccggaaggccaaggcctctgccatgcctgatagcccggctgaagtcaagactcagccaaggtctacaccaccctccatgcctccaccgcctcctgctgcttcccagggagccacccggccacctagcttcaccccccacaccctgatgaacggaagttctcacagccctactgccattaatggtgcaccctgcacccccaacgggttttcaaacggaccagccacatcgagcaccgcatctctaagcacacagcacttgccccctgcctgtggagcccgacagctgtctaagcttaaaagattcctgaccacgttgcaacagtttggaagcgacatctctccagagattggggagcgggtaaggactctggtgctcggccttgtgaactcaactttaactattgaggagttccatagtaaactgcaggaggcaacgaacttccctctgcgtccttttgtgatacctttcctaaaggcaaacttgcccctgctgcaacgggagctcctgcactgtgctcgccttgcaaagcagaccccagcccagtatctcgcccagcatgagcaacttctactggatgcatcggcctcttcgcccattgactctagtgaactcttgctggaggtgaatgaaaatggaaagcgccgtacaccagaccgtactaaagaaaacggctctgatcgcgatcccttgcaccctgaaaggtacagccctagcaacgggccacctcagccaactcccccaccccactatcggctggaggatatcgcaatggcccatcacttcagagatgcctatcgtcatcccgatccacgggagctgcgggaacgacacagaccattagtggtgcctggttctagacaggaagaagtgattgaccacaagctgacagagagggagtgggctgaagaatggaaacatctcaataacctactgaactgcattatggacatggtggaaaagaccagaagatcattgaccgttctgcggagatgccaagaagccgaccgggaagaactgaaccactgggcgcgtaggtactcagatgccgaagatactaagaaaggcccagcccctgcggcagcacgacctagatcctcctccgccggaccagaggggcctcagctggacgtgcctagggaattcttgccgcgaaccttgacgggatatgtgcccgaggacatctggagaaaagcggaggaagccgtcaatgaggtgaaacgtcaggcaatgtcggaattgcagaaggccgtcagtgatgctgagcgcaaggcccatgaactgattaccacagaacgagctaagatggaaagagctttagccgaagccaaaagacaggccagcgaagacgccttaaccgttatcaaccagcaggaagattcttccgagagctgctggaactgtgggcgaaaagctagtgagacatgcagtgggtgcaatgccgctagatattgtgggtctttttgccagcatagagattgggagaaacatcaccacgtctgcggacagtccctccagggcccaacagcagtggtggccgaccccgttcccggtccccctgaggccgctcattccttgggacctagtcttcccgtaggcgctgcatccccttctgaggctgggagtgctggtccgtcccgcccaggctctcctagccccccaggtccactggacaccgtgcctcgctag

SEQ ID NO: 219253 - DNA, 1734 bp, Artificial Sequence
  Description of Artificial Sequence: Synthetic coding sequence
atgcccgcatcaaggctgcgcgaccgtgcggcatcctcagccagcggttcgacatgtggctccatgtctcagacacatcctgtgttggaaagtggtctgctcgcaagcgccggatgctctgccccacgcggacccagaaagggaggccctgtaatgaatggttcttcccacagccccaccgctattaacggcgctccatgtacacctaatggcttcagcaatggacccgctacttccagtaccgctagcctgtccactcaacatctgcctccggcatgcggcgctcgccaactctctaagctgaaacgctttctgacaaccctgcaacagtttggttcggacatttcgcctgaaattggtgaacgtgttcggacgttggtcttggggctcgtcaatagtactctcaccattgaagaatttcatagtaaacttcaggaagctacaaatttccccctaagaccattcgtgatcccatttctgaaggccaatttaccacttctccaacgcgagctgttacactgtgcaagactcgccaagcaaaccccggctcagtatcttgcccagcacgagcagctgctgctcgacgccagcgcaagcagccctatcgatagctccgaactcctccttgaggtcaacgaaaacggcaaacgaaggacccctgatcgaaccaaggaaaacggatccgacagggatccactacacccagagcatctcagtaagcggccatgcacccttaatcccgctcaaaggtactctccctccaacggccctcctcaaccgactcctccacctcactaccgcctggaggatatagccatggcccaccactttcgtgatgcatacagacaccccgatcctagagagctgcgcgaacgtcacaggcctctggtagtccccggatcaaggcaggaagaggtgattgaccataaactgacagaacgggaatgggccgaagagtggaagcatcttaacaacttattaaactgcatcatggacatggtcgagaaaacaagacggtcactcaccgtcttacgacgatgccaagaggcagaccgtgaagagttgaatcactgggccagacgctattcagacgcagaggacacgaagaagggccctgctccagctgcagctagaccccgaagttcaagtgccggaccagagggccctcagcttgacgttcctcgagaattcttacccagaaccctaaccggatatgtgccagaagatatatggcgcaaggccgaagaagcagttaacgaggtgaagagacaggccatgtcagaactgcagaaggcagttagcgacgcagaacggaaggcacatgaactaatcacaaccgaacgcgctaagatggagagagcactagctgaggccaagcgccaagcctccgaggatgccctgaccgtgattaaccagcaggaagactccagcgaaagctgctggaactgcggacggaaagcaagcgaaacgtgtagcggttgtaacgctgcccgatattgcggtagtttttgccagcatcgggattgggagaaacatcaccacgtctgcggtcagtccttgcaaggacccacagcagtagttgcagaccctgtgccgggaccccctgaggcagcccatagcctgggtcctagcctaccagtgggggcagcgtcaccaagtgaagctgggtccgcaggtccctccagaccaggaagcccctcacctcccggtcctctggacacagtacctcggtag

SEQ ID NO: 219254 - DNA, 558 bp, Artificial Sequence
  Description of Artificial Sequence: Synthetic coding sequence
atggcagcccagaaggatcagcaaaaagacgccgaggctgagggcctgtctggcacaacgctgttgccaaagctgataccctccggtgccggtagggaatggcttgaacgccgaagagctacgatccgcccttggagtaccttcgtcgaccaacagcggttttcccggccaaggaatctaggagaactgtgtcagaggctggtgcggaacgtcgagtactaccagtctaattacgtgttcgtctttctcggcttgatcctatactgtgttgttaccagtccaatgctgctagtcgctctggcagtcttcttcggcgcatgttatatcctctacctgcgcactctggagtctaagcttgtcctcttcggcagagaagttagccctgctcaccagtacgcattggcaggcggaatatccttccccttcttctggctggcgggtgcagggagcgccgttttctgggtgcttggggcaactctggtcgttataggcagtcatgctgcgtttcaccagatcgaggccgtggacggggaggaactgcaaatggaacctgtctag

SEQ ID NO: 219255 - DNA, 3147 bp, Artificial Sequence
  Description of Artificial Sequence: Synthetic coding sequence
atgaaccgcttccgagtctccaaattccgccacactgaagctaggccaccaaggagagagagttggatctctgacatccgcgctggaacggcccctagctgtcggaatcacataaagtcttcatgtagtttaatcgctttcaacagcgacaggcctggcgtgcttggcattgtgcctctgcagggccagggcgaggacaaacggagagtggcccacctcggctgccacagcgaccttgtcactgacctcgacttctccccgtttgatgatttcctgctggcaaccggatcagccgaccggacagtgaaactctggaggctgcccggaccaggtcaagctctccctagtgcaccaggcgtggtgttaggcccagaggacctgccagttgaggttcttcagttccatccgacgtcagacggcattttagtttctgcagccggaacaacagtcaaagtgtgggacgcagctaagcagcaacctttgacagaactcgccgctcatggcgatttggtccaaagtgcagtatggtccagagatggagctctcgtgggcacagcgtgcaaggacaaacaactgagaatctttgacccacgaaccaagcccagggcaagtcagtccacgcaggcccacgaaaatagtcgggactctagattggcttggatgggtacgtgggaacatttggtgtccactgggtttaatcagatgcgcgagagggaagtgaagctctgggatacacgtttcttttcctcagctctagccagcctgaccttagatactagccttggttgcctggtacccctgttggacccggacagcggcctactggtactcgccggaaaaggggagagacaactgtactgttacgaagtggttccgcagcaacctgccctcagtccagtcacacaatgtgtcctagaatccgtactgcggggagcagcgctcgtgcctaggcaggcactggctgtcatgtcatgcgaggtacttagggttctgcaactttctgataccgcgattgtaccaatcggttatcacgtcccacggaaggcagtcgagtttcacgaagaccttttccctgacacagctggatgtgtcccagctaccgatccccactcctggtgggccggtgacaatcagcaggtccaaaaagtgagcctgaatccagcctgcagacctcaccccagcttcacgtcctgccttgttcccccagccgaaccgctaccagacacagcccagccagctgtcatggaaacacccgtaggagatgctgatgcttccgagggattttcgtcccccccaagttccctcaccagtccttctacaccttcgtcccttggcccatcactctccagtacgtccggcatcgggacctcgccatctctgcgtagcttgcagagtctcctggggcctagctccaaattccgccacgcgcaaggaaccgttctgcacagggactctcacatcaccaatctcaagggactcaatcttaccactcctggcgaaagtgacggattttgcgcaaataagctgagagtcgccgtacctttgttatccagtgggggacaggttgcagtgctggagctccggaagcccggacgtttaccagatactgccctgccgactcttcagaatggcgcagcggtaacagacctcgcatgggacccgtttgacccacatcgcctggctgtggctggtgaggatgcaaggattcgtctttggagggtgcctgcagagggacttgaggaggtcctcaccactcctgagaccgtgctcactggccatacagaaaagatttgtagccttagattccaccctctggctgccaacgtgttggcgtcatctagctacgacttaactgtcaggatttgggatctccaagccggtgccgatcgtctcaagctgcagggccaccaagaccagatcttctccctagcttggtctccagatggccaacagctggccacagtatgcaaggacggtcgcgtgcgcgtgtacagaccgcgatcaggtcctgaacccctgcaagaaggaccgggaccgaagggaggcagaggcgctagaattgtgtgggtctgtgacggaagatgtctattggtgagcggctttgacagtcagtctgagcgccaactccttctgtacgaagcagaagccttagctggagggcctttagccgtgctcggcctggatgttgcaccctcaacgcttctcccctcatacgatcccgatactggactggtcctgctgaccggaaagggtgatactagggttttcctgtatgaattgctgccagaatctcctttcttcttagagtgcaactccttcacttcccctgatccgcacaagggactggtgctgttgcccaagaccgaatgtgacgttcgagaggtggagctaatgcggtgccttcgccttcgtcagagctcactcgaacctgttgcttttagactgcccagagtgcggaaagagttctttcaggatgatgtcttccccgatacagccgtgatctgggagccagtcctctccgctgaggcttggctgcagggcgctaacggccagccgtggctcctgtccttgcagccaccagatatgtcacctgtcagccaagcaccaagggaggctccggctcggagggctcctagtagcgcacagtacctggaagagaaaagcgatcagcagaaaaaagaggagttactgaatgccatggtggctaaactggggaacagagaggatcctctgccacaagactctttcgagggcgttgacgaggacgagtgggctaaataccttgcccaaatcatagtaatgggagtccaagtggtaggtcgtgcatttgccagagcgctgaggcaggagttcgcagccagtcgggcagctgccgatgccaggggacgggcaggccatcgaagcgcagcagcttccaatctgtcagggctttcactccaggaggcccagcagattctcaacgtgagtaaattatcccctgaggaggttcagaagaactatgagcacttatttaaagtgaatgacaagtccgtgggtggatccttttatctgcagagcaaggtcgtcagagccaaggagcgcctggatgaagaattgaaaattcaggcacaggaagatagagagaaagggcagatgccccacacctag

SEQ ID NO: 219256 - DNA, 2778 bp, Artificial Sequence
  Description of Artificial Sequence: Synthetic coding sequence
atgaaccgttttagggtgtcgaagttccggcatacagaggccagaccgccacgccgagagtcgtggatctctgacattcgagcagggactgctcccagttgccggaaccatatcaagagctcatgttctttaatcgcatttaactccgacagacctggagtcctgggcattgtgcctctccaagggcagggcgaggacaaacgccgtgtagcccacctggggtgtcactctgacctggtaacggacttggacttttccccctttgatgactttcttttggccacaggcagcgccgatcgaaccgtcaagctttggcgactgcccggaccgggtcaggctttgccgtcagctcccggtgtggtcttgggcccagaagatctcccagtggaggtcctgcaatttcaccctaccagtgatggcatcctggtgtcggcagctggcactactgtgaaagtgtgggatgccgctaaacagcaacccctgactgagctggccgctcatggggacctggtccagtccgcagtttggagtcgcgatggcgcacttgtcggcaccgcctgtaaagacaagcagctcaggatattcgacccacgcacaaaacctcgcgcttcccaaagcacacaggcccacgagaatagtcgggatagcagacttgcatggatgggtacctgggagcatctggtgtccactggtttcaaccaaatgcgcgaacgcgaagtgaaactttgggatacgagattcttttcttccgccctggcttctttgacccttgacacgtccctcggctgcctcgtcccgttgctcgatcctgacagtgggctcctggtgctggccggaaagggagagcgccaactttactgttatgaagtcgtgcctcagcagccagctctgtcgcctgtgactcagtgcgtgctggagtctgttctgaggggggctgctttggttccacggcaggcacttgccgtcatgtcctgtgaggtgctgagagttctgcagctatctgataccgcaatcgtccctatcgggtatcacgtgccacggaaggccgtggaattccatgaggatctatttccagatactgctggatgtgtgcctgctactgatccccatagctggtgggccggagataaccagcaagtgcagaaagtctccctgaaccccgcatgccgaccccacccgagcttcaccagctgcctggtgccccctgccgagccacttccagacacagctcaacccgctgtcatggagaccccggtaggggatgccgatgcaagcgaggggttctcttccccaccctcctccctgacgagtcccagcaccccctcatccctgggaccaagcctgtcttcaacttctggtatcgggacatccccctccctgaggtccctccagtccctgctggggccaagctccaaattcagacacgctcaagggaccgtgctgcatagagactcccacatcaccaacctgaagggactgaatctgaccaccccaggtgaaagcgatggcttttgtgccaacaagctgcgggttgcagtccccctgctgagcagtggcggacaggttgctgtgttggagctccggaagccaggccgtttgcctgacaccgctctgcctacacttcagaatggggctgccgtcacagaccttgcttgggatccattcgacccccatcggctggctgtcgcgggtgaagatgcgagaattaggctgtggcgtgtccctgctgaagggttagaagaggtgctaaccacacccgaaaccgtgctcacggggcacacggagaaaatttgttccctcagattccacccactggcagccaatgtgctagcttcaagttcttatgacctgactgtgaggatttgggatctgcaggccggtgcagataggcttaagttgcagggacaccaggaccaaatttttagcctggcatggagtccggacgggcagcagctggccaccgtctgcaaggacggtcgggtcagggtgtatcgcccacgctccggccctgagcctctccaggagggtccaggccctaaagggggaagaggagccaggatcgtgtgggtgtgtgacggcagatgtctgctggtctcagggtttgactctcagtccgagaggcaactgctgttgtacgaagccgaagcactggcgggagggcctctggctgtgttggggcttgatgtagcgccatcgactttactacctagttatgacccggacaccgggctggtcctgctgaccgggaagggagatacgcgggtgtttctgtacgaactactgccagagtctccctttttcctggagtgcaatagcttcacttcacccgatccccataaagggctagtactgttgccaaagacggagtgcgacgtacgggaagtggaattgatgaggtgccttaggctaaggcagagttccctggagccagtcgctttccgtctacccagggttagaaaagaattctttcaggacgatgtgttccctgacacggctgttatatgggaacctgtgttgtctgccgaggcgtggctgcagggcgctaacggccagccctggctgctgagtttgcagcctcccgatatgagtcccgtgagtcaggccccacgcgaggccccagccaggcgggctccctcttctgcccagtacctggaagagaaaagcgaccagcaaaagaaggaggagctgttaaacgccatggttgccaagctaggcaatcgcgaggacccgctgccccaggactccttcgaaggcgttgacgaggacgagtgggattag

SEQ ID NO: 219257 - DNA, 1104 bp, Artificial Sequence
  Description of Artificial Sequence: Synthetic coding sequence
atgaaccgtttccgcgtgagtaagttccggcatactgaagcaagacctccgcgacgcgaggacaaacagctgagaatttttgaccctcgtaccaagccacgggctagccagtccactcaagcgcatgagaacagcagagacagtcgacttgcctggatgggcacctgggagcaccttgtgagcactggctttaaccagatgcgcgaacgggaggtgaaactttgggacacaagatttttcagcagcgcactggccagcctcaccctggacacctctctaggttgcctggtccccctgctggatccagattctggcctgttggtattggctggcaaaggagaaaggcagctttactgttatgaggtcgtgccgcagcaacccgcacttagccccgttacgcagtgcgtcctggaatcagtactgcggggtgcagccttagtgcccaggcaggccttggccgttatgtcatgtgaagttctcagggttctgcaactttcagacaccgcaatagtgcctattgggtatcacgttcctcgaaaggcggtcgaattccatgaggatctattcccggatacagcgggatgtgttccggctaccgacccccattcttggtgggctggggataaccagcaagtacagaaggtgtcccttaatcccgcttgtaggccacatcccagtttcacttcctgtctggtgccacccgcagagccactgccagatactgcgcagccggcagtgatggagacaccggttggggacgctgacgcgtccgaagggttctcatcccctccttcaagcctgacctccccctcgacaccaagttcacttggaccatccttgtcaagcacctctggaataggcacgtctccgtcacttcgcagcctccagagccttctagggccttccagcaagttccggcatgcacaaggcactgtgctgcacagagactcccacatcaccaaccttaagggcctgaatttaacaacacccggagagtctgacggcttctgcgccaataagttacgagtcgcagtgcctctgctgtctagcgggggtcaggtggctgtgttggaaatgcgtgaaaagcgccacagagaggtgtag

SEQ ID NO: 219258 - DNA, 2523 bp, Artificial Sequence
  Description of Artificial Sequence: Synthetic coding sequence
atgaaccggttcagggtaagcaagttccgccacaccgaagcacgtcctccacgtcgcgaatcctggatatcagatatcagagcaggaacggccccatcatgccgtaatcatattaagtcctcctgctccttgatcgcctttaactcagatcggcctggggtcttggggattgtacccctgcaggggcagggagaggacaagcgacgcgtcgcccacttaggctgtcactctgaactcgccgcacacggggatttggtgcagtcagccgtgtggtcacgcgatggcgctttggtggggacagcgtgcaaggacaagcaactcagaatttttgatccccgaacaaagccacgcgcaagccaaagtactcaggcacacgaaaattcccgcgattcacgtctcgcctggatggggacctgggaacacctggtctctacagggtttaaccagatgcgtgaaagagaagttaagctgtgggacacgcgattcttcagttccgcccttgcctctcttaccttggacacatccctgggctgcctggtgcctctgttagacccagatagcgggcttctggttctcgcagggaagggagagagacagctatattgctacgaggttgttccacagcaacccgctttatcaccagtcacccagtgtgtgctcgagagcgttctgagaggggcagctctcgttcctagacaggccctggccgtgatgtcttgcgaggtactgagggttctccagctctctgacactgcaattgtccccatcggatatcacgtgcctcgaaaggcggtggagttccacgaggatttgtttcctgatacagccggttgcgtgcctgctaccgatccccactcgtggtgggccggagataatcagcaggtgcagaaagtctccctcaaccctgcctgtcgcccacatccatcattcacatcttgtctggttccgccagccgaaccactgcccgacactgcacaacccgctgttatggagacccccgtaggtgacgcagatgcaagtgaggggttcagtagcccaccatcgtccctcacctccccctcgacaccatcaagcttgggaccaagcctgtctagtacgtccggcattggcacctcgcctagcctcaggagtctccagagtctacttgggcctagcagcaaattccgtcatgcccaagggacggtcttacaccgtgattctcatatcaccaatctcaaaggcctgaacctgacaacccccggagagtctgacggattttgcgcgaacaagctgagagttgcggtccccctcctctctagtggaggtcaggtggccgtgttggagctgcgaaagccaggaagattgcccgatacggccctgcccacactgcagaacggcgcagctgtcaccgatttggcttgggatccttttgacccacataggctggctgttgccggagaagatgcaagaatacgcttatggcgggtgccagctgaaggtctcgaggaagtgctgaccacacctgaaacggtgttgaccggccataccgaaaagatatgctctcttcgtttccaccccctcgccgcaaatgtgctcgccagcagttcctacgatttgaccgtccgtatttgggacctacaggctggagctgaccggctgaaacttcagggtcatcaggatcagatttttagcttggcttggagcccagacgggcagcagcttgccacagtatgtaaggacggcagggtgcgggtgtaccgcccaagatcaggcccagaaccgttgcaagagggcccaggaccaaaaggaggccgaggggctcgcattgtgtgggtgtgtgacgggcgatgcctcctcgtgtccggtttcgactctcagtctgaacggcagttacttctttatgaagctgaagcgcttgccggaggccctttagcagtgctgggcttagacgtagccccatctaccctcctcccaagctacgaccctgatactgggctagtgctcctgacaggcaagggagatacaagggtgttcctgtatgaactcctgccagaatcacccttcttcctggaatgcaactcatttacatcaccagaccctcacaagggcctcgttctcctgcccaaaacagagtgcgacgtgagggaggtcgaacttatgagatgccttaggctgcgacaatcctcactcgaacctgttgcatttcgtctgccacgtgtgcgaaaggagttcttccaggacgatgtgtttccagataccgccgtgatttgggaacccgtcctgagcgcggaagcttggctacagggggctaacggccaaccctggttactgagccttcagcctccagacatgtcacctgtttcccaggctcctcgggaagcccctgctcggagggcaccgagtagcgcgcagtacctcgaagaaaaaagcgatcagcaaaaaaaggaggaacttctgaatgctatggtcgccaagctcggaaacagggaggacccactgccccaggattctttcgaaggggtcgacgaggacgagtgggactag

SEQ ID NO: 219259 - DNA, 2118 bp, Artificial Sequence
  Description of Artificial Sequence: Synthetic coding sequence
atgggcacttgggagcatctcgtgtctactggcttcaatcagatgcgggagagggaggtcaaactgtgggacacccgcttttttagcagcgcactggcctccctgactctcgatacgtcgttgggctgcttagtgcccctgttggaccccgactccggacttcttgttctggccggtaagggtgagaggcagctttattgttatgaagtggtgcctcaacagcctgcattgtctccggtgacacaatgcgtgctggagtccgtcctgagaggcgcagcactggttcccaggcaggctctggccgtgatgagctgcgaagttctgcgcgttcttcagctcagcgataccgcaatcgtgcctattggctaccacgtcccaagaaaagctgtggaatttcacgaggacctgtttcccgataccgcaggatgtgtgcctgcgaccgatcctcactcttggtgggccggtgacaaccagcaagtgcagaaggttagtctgaatccagcatgtcggcctcacccttctttcacatcctgtttggtgcctcccgcagaacccttaccagacactgcccagccagcagttatggagacgcctgtcggtgacgctgacgcttcggaaggattcagcagccctccatcgtcattgacatcccctagcacgccctccagtctgggcccaagtttgtcatcaacttccggcatcgggacttctccctcactgaggtctttgcagtccctgctcgggccatcctcgaagttcaggcacgcccagggaacagtgctgcaccgggactcacacatcacaaatctgaagggtttgaatcttaccacacctggcgagagcgacggtttttgcgcaaataagctccgcgtggccgttccactgctttcttcaggaggccaggtggcagtgctggaattacgtaagcccggacgactcccagataccgctttgccaacacttcagaacggtgccgcagtcacagatctggcctgggatccattcgacccccatcgcctcgcagtggctggtgaggacgctcgtatcaggctgtggcgggtcccagcggagggcctggaggaagttctgactactcccgaaacagtccttaccggccacactgagaaaatctgttctctgagattccatccattggccgcaaacgtgctcgcctcatcttcctacgacctgaccgtgcggatttgggacctccaggcaggcgcagatcggctcaagctgcaaggccaccaagaccagatcttctcactggcttggagccccgacggacagcagctagcgactgtttgtaaggacggcagggtacgggtgtaccgaccccgatccgggcctgagccgctgcaagagggaccgggtcctaaaggcggacgcggagcacgaattgtgtgggtgtgtgatggcaggtgtctcctggtgtcgggcttcgactcacagagtgaaagacagcttctcctgtatgaagccgaggctctagcgggaggtcccctggctgttttgggacttgatgttgccccatccaccctgttgccctcatatgatcccgacaccggtttagtgctgttaacaggcaaaggggacacaagggtattcctgtatgagcttctgccagaaagcccctttttcctcgaatgtaattcgttcacttctcctgaccctcacaaagggttggtactgttgccaaaaaccgagtgcgacgtgagagaggtagaacttatgagatgtttgcgccttcgccaaagcagtctggagcccgtcgcgttccgcctgccgagggttcgcaaagaatttttccaggatgacgtgtttccagataccgcggtcatctgggagcctgttctgagcgcagaggcttggttacaaggggctaatggccagccctggctcctgagccttcagcccccagacatgtccccagtgagccaggcgcctcgcgaggccccagccaggcgagcacccagtagtgcccagtacttggaggaaaagagcgaccagcagaaaaaagaggagttgctgaatgctatggttgccaagctgggcaaccgcgaagacccattaccccaggactcatttgagggggtagatgaggacgaatgggactag

SEQ ID NO: 219260 - DNA, 1386 bp, Artificial Sequence
  Description of Artificial Sequence: Synthetic coding sequence
atgtctcggcaagtggtcagatcttctaaatttcgccatgtctttgggcagcccgcaaaggcagaccagtgttacgaggacgtcagagtgagtcagaccacctgggatagtggcttttgtgctgtgaacccaaaattcgtcgccctgatatgtgaagctagcggtggcggtgcgtttttggtactgccgctgggaaagactgggagggtcgataagaacgcccctacagtctgtgggcatacagcgcctgtgcttgacatcgcatggtgcccccataatgacaacgtaatcgcttcgggctccgaagactgtactgtgatggtctgggagattccagacggcggattgatgctgcctcttcgcgagcccgttgtgaccctcgaaggccacaccaagagagtagggattgttgcctggcacaccacagcccaaaatgtcctcctgtctgccggatgtgacaatgtcattatggtatgggatgtcggaactggcgctgctatgctgacacttggaccggaagtgcaccccgataccatctattctgtggattggtcacgtgacggtggactaatctgtacgagctgcagggacaaacgcgttcgcatcattgagcctagaaagggaacggtggtggctgaaaaagaccgccctcacgaagggacaaggcctgtccgcgctgttttcgtgtcagagggcaagattcttactacaggcttctcaagaatgtccgagcgtcaggtcgctttatgggacaccaagcatctggaagaaccacttagcctgcaagagttggacacaagctccggagtactgttgcccttttttgatcctgataccaatatcgtgtacctgtgcggaaagggagattctagcattcgctatttcgaaattactagtgaggcaccgtttctacactacctgtcaatgttttccagtaaagagtctcaaagaggaatgggctacatgcccaagagggggctcgaggtgaacaaatgcgagatcgctcgattctacaagcttcatgaacgcagatgcgagcctattgctatgaccgttcctcgaaagagcgacctgtttcaggaggacctctacccccctactgccggtccggacccagccttaactgccgaagaatggctaggcggacgggacgcaggacctctgctgatctctctaaaagacgggtacgtgcctccaaagtcacgagaattgagggttaatcgaggacttgataccggacgcaggagagccgctccggaggctagtggtaccccctcttccgatgcggtgtctcgcctggaggaggaaatgaggaagttgcaggccactgtgcaggaactccagaaaaggctggaccgtctggaggagactgtgcaggctaaatag

SEQ ID NO: 219261 - DNA, 1443 bp, Artificial Sequence
  Description of Artificial Sequence: Synthetic coding sequence
atgacagtcacaaagatgtcatggcgccctcagtatagaagctccaagttccgcaacgtgtatggcaaagtggccaatagggagcattgcttcgatggaatcccgattaccaaaaatgttcatgacaatcatttctgtgctgtgaacaccaggtttctggccattgtcacagaaagtgccggtggcggtagttttctggtgattcccctcgagcagacgggcagaatcgaacctaattacccgaaagtctgcggtcaccagggaaacgttctcgacattaagtggaacccatttattgataatatcatagcctcttgttccgaggatacgtcggtgcgaatatgggaaatacccgagggcggactcaagcgcaacatgaccgaagccctgctcgaacttcacggccattccagaagggttgggctggttgaatggcatccaactacaaacaatatcctgttttctgccggttacgactataaagtgcttatttggaatctcgatgtcggcgaacctgtcaagatgattgattgccatacagatgttatcttgtgcatgagctttaataccgacggcagcctcctcactactacttgtaaggataaaaaactgcgcgtgatcgagccaagatctggcagagtgctgcaggaggccaattgcaagaaccatcgagtaaaccgtgttgtgtttttaggaaatatgaagcgactgctgaccactggcgtttcccgatggaataccagacagatcgctctctgggaccaggaggacctcagtatgccattgattgaagaggagatcgacggcctgtcaggtctcctctttccattttacgatgcggatacccacatgttatacttagcaggtaagggagacggtaacatccgttactatgaaatttcaaccgaaaagccctatctttcatacctaatggaattccggagtccagccccacagaaaggactgggcgtgatgccaaagcacggcctggatgtgtctgcatgcgaagtatttcggttttataagcttgtgaccctcaaaggcctaatcgagccaatctccatgattgtgcctcgccgttccgatagctatcaggaagacatttatcccatgacacccggaactgaacctgctctcactcctgatgagtggctggggggaattaatcgagatccagtgcttatgagtttaaaggagggctacaagaagtcctccaagatggtatttaaggctcctattaaggagaaaaagagtgtcgttgtgaatggcatcgatctgctggaaaacgttccacctagaacagagaatgagctgttgagaatgttctttagacagcaggatgagatacgcagactgaaagaggaattggcccagaaggatatccgcatacgacagttgcagttagaattaaaaaatctacgcaactcgcccaagaattgctag

SEQ ID NO: 219262 - DNA, 1269 bp, Artificial Sequence
  Description of Artificial Sequence: Synthetic coding sequence
atgctcgatctagaagtggtcccagaaagaagcctgggaaacgaacagtgggaattcacgctgggcatgcctctggcacaagctgtggctatcctgcagaagcactgcagaattataaaaaatgtccaggtcttatacagcgagcaatctccactgagtcacgaccttatcttaaacctgactcaggacgggatcaagcttatgtttgatgctttcaaccagaggctgaaggtgatcgaggtctgcgatctgacaaaggtgaagctcaagtattgtggtgtccatttcaattcgcaggccattgcaccaactatcgaacaaatcgaccaatcttttggtgcgacacacccgggagtgtacaactctgcggaacagttatttcacctgaattttcgtggcttgtctttctctttccagctggactcatggactgaggcgcctaaatacgaacccaacttcgcgcacgggctggcctctttgcaaatcccgcatggggcaacagtgaaaaggatgtatatctattccgggaacagcctgcaggacaccaaggcacctatgatgccactgtcttgcttcctcgggaacgtttacgcggaatcagtagatgtcctgagggacggaacagggccagccggattgcgccttcgactcctagcggctggctgtggtccgggtctcctggccgatgctaagatgagagtttttgagcgttccgtctattttggtgacagctgtcaggatgtgctttctatgctgggctctccccacaaggtattctataaatcagaagacaagatgaagatacactcaccatcacctcacaagcaagtcccaagcaaatgtaacgattatttctttaattacttcactctgggagtggacatcctcttcgacgctaatacccacaaagtcaagaaatttgtgctgcacacaaactacccaggccattacaatttcaatatttaccacagatgcgagtttaaaatccccctggccatcaaaaaggagaacgcagacggccagaccgagacctgtaccacttacagcaagtgggacaacattcaagaactgctcggccatcccgtcgagaagcctgtagtcctacatcgatcatctagccccaacaatacgaacccgttcgggtctactttctgctttgggctgcagagaatgatttttgaggtcatgcagaacaaccacatcgcctccgtgacactgtatggcccaccaaggcctggttcccatctgagaaccgcggaactgccctag

SEQ ID NO: 219263 - DNA, 1470 bp, Artificial Sequence
  Description of Artificial Sequence: Synthetic coding sequence
atgtcttttagaaaggtggttcggcagtccaagtttcggcacgtctttggtcagcccgtcaagaatgatcaatgctacgaagacatccgggtctcacgtgtgacctgggactcaacattctgtgccgtaaatccaaagtttcttgcggttatagtggaagcctctggcggaggagcttttcttgtgttacccttgagcaagacaggtagaatagacaaagcctaccctacagtctgtggccacactgggcctgtgcttgatatcgattggtgcccacataacgacgaagtaatcgcttctggtagcgaagattgcaccgtcatggtttggcagatccccgagaacggattgacctccccactgacagagccagtggtggtgctggaaggccacaccaaaagggtggggataattgcatggcatcctacagcacgcaatgtgctgctgtccgccggatgtgacaacgtggtactaatttggaacgtgggaacggccgaggagctgtacaggctggattctcttcacccagatctgatttacaacgtgagctggaatcataacggatcactcttctgcagcgcttgcaaggacaagtccgtacgcattatcgatcctcggaggggcaccctggtagccgagcgtgagaaggcacatgagggcgcaagacctatgcgcgctatttttctggccgacggaaaagtctttactacaggtttttcaaggatgtctgagaggcaactggccctttgggacccagagaacctcgaggagccaatggccttgcaggagctggacagcagcaacggggcactactgcccttttacgaccctgacactagcgtagtctacgtctgtggcaagggggacagctcgatcagatatttcgaaatcaccgaagaaccaccttacatccactttctgaacacttttacttctaaggaacctcagcgtggcatggggtccatgcccaagcgcggactggaggtctccaaatgtgagattgccagattctataaactccacgaacgtaagtgtgaacccatcgtcatgacagtgccccgtaaaagtgatttatttcaggacgacttgtatcccgacactgcgggacccgaggccgctctggaagctgaagagtgggtctctggcagagatgccgaccccatactgatctctctccgcgaggcatacgtaccttctaagcagagagacctaaagatatcccgtagaaatgtcctgtcggatagcaggcctgccatggcccctggctcatctcacctcggggcacccgcaagtacaacaacggcagctgacgccacccccagcgggagcctggcaagagccggagaggccggaaagttagaggaagtgatgcaggagctacgcgctctgagagccctggttaaagagcagggcgaccggatctgtcggctggaagaacaactcgggaggatggagaacggtgacgcttag

SEQ ID NO: 219264 - DNA, 864 bp, Artificial Sequence
  Description of Artificial Sequence: Synthetic coding sequence
tgtttcctgctgcctagagggagagaccccgagcctccagaagccggtgctgctgcaccctgcgccccaggggctcccgacatgagcttccgcaaggtggttagacagagtaaatttagacatgtgtttgggcagccagtgaagaatgatcagtgttatgaggacatcagggtctccagagtaacctgggacagcacattttgcgctgtgaatcccaagttcctcgccgtgattgtggaggccagtggcggaggtgcgttcctggttttgccattatccaaaaccggcagaatcgataaggcttatcctaccgtgtgcggacatacaggacccgtactggacattgattggtgtcctcataacgatgaagtgattgcttccgggagcgaagattgtacagtgatggtgtggcaaatcccagaaaacggactaacaagccctctgaccgagcctgtggtagtgctggagggccacacaaagcgtgttgggatcatcgcctggcatcccaccgcccgtaacgtactcctgagtgcaggctgcgataatgtggtgctgatctggaacgtcggtacagctgaggagctgtatcgcctggactccctgcaccctgatctgatttataatgtgtcttggaatcataacggaagtctgttctgcagcgcttgcaaggacaaaagcgttagaattatcgatcctcggagaggtacactagtcgctgagagagaaaaggcccatgagggagcgcgaccgatgcgcgcaatttttctggcagacggaaaggtttttaccactgggttttctcgtatgagtgaaagacagttggcgctatgggaccccggagttcggagattttgtttggcctag

SEQ ID NO: 219265 - DNA, 1470 bp, Artificial Sequence
  Description of Artificial Sequence: Synthetic coding sequence
atgtctttcagaaaggtcgtcagacagtccaagtttagacacgtgttcggccagcccgttaaaaatgaccaatgctacgaagacattcgagtgagccgggttacctgggatagtaccttttgtgctgtgaatcccaagttcctggctgtgatcgtagaggccagcggcggtggcgcattcctcgtgttgccgctttcaaaaaccggcaggattgacaaagcttatcccactgtgtgtggacataccggcccagtgttggatattgactggtgtccacacaatgacgaggtaattgccagcggaagcgaggactgcaccgtcatggtttggcaaattcctgagaacggactgacatcacctttaaccgagccagtggtggtcctggagggccacaccaagagggtaggaattatagcttggcatcctacagctcggaatgtattgctgagtgcgggttgcgacaacgttgtgctgatctggaacgtaggcacagccgaggaattgtacaggctggatagccttcaccctgacctgatctacaatgtgtcttggaaccacaacggaagtctcttctgttcagcttgcaaagataaatcagtgaggatcattgacccgaggcgaggtactcttgtggccgaacgggaaaaggcccacgaaggcgctaggccaatgcgcgctatattccttgccgatgggaaggtatttaccactgggttttccagaatgtcggagagacagctagcactgtgggaccctgagaatctagaagagcccatggctcttcaggaattggacagctcaaacggggctctcttgcccttctacgacccagacacaagcgtggtgtacgtctgcggcaaaggggacagttcaattcgttacttcgaaataaccgaggaacctccctatatccacttcctgaacacgtttacgagcaaggagccacagagaggcatgggaagcatgccaaagagaggattggaggtgtccaaatgcgaaatcgccaggttttacaaacttcacgaaagaaaatgtgagccaatagtaatgacagtcccgaggaaaagtgacttgtttcaggatgatttgtatcctgacacagccggtccggaagcagcgttggaggcagaggagtgggtgagcggcagggacgccgaccctatcctcataagcctcagagaagcttacgtcccttcaaaacaaagagacctgaagatctcgcggaggaatgtcctgtctgatagccgaccagctatggccccagggagcagccatttgggagctcccgcatccaccaccaccgctgcagacgctacccctagcggcagtttagcccgagcaggcgaggccggaaaattggaggaggtaatgcaggaactccgggctctccgtgcacttgtgaaagaacagggagaccgcatctgccgcttggaagaacagcttggaagaatggagaatggtgacgcctag

SEQ ID NO: 219266 - DNA, 870 bp, Artificial Sequence
  Description of Artificial Sequence: Synthetic coding sequence
atgtccttccggaaggtggtacgccagagtaagtttaggcacgtattcggccagcctgtcaagaatgatcagtgctacgaggacatccgagtctcccgcgtcacttgggactctactttttgcgcagttaacccgaagtttctcgccgtaatcgtggaagcttcaggcggaggtgcctttttggtactgcccctgagcaaaaccgggagaatcgataaagcctatccaactgtatgcgggcatactggccctgtacttgacattgattggtgccctcataatgatgaggtcatcgcgtcagggtccgaggattgcacagttatggtttggcagatccctgagaatgggttgacttcccccttaactgaaccagtggtcgtgctcgagggccacaccaaaagggtgggcattattgcatggcacccaactgccaggaatgtgcttctgtccgccggatgcgacaacgtggtgctgatatggaacgttggtacagcggaggaattgtatagactcgacagcctgcatcccgatctcatctataacgttagttggaatcataacggcagtctcttttgctcagcctgcaaagataaatccgtgcgaatcatagatcctaggcggggtacactcgtagccgaaagggaaaaagcacacgagggcgcacgcccaatgagggcgattttcctagcagacgggaaggtgtttacaactggattctccagaatgtcagagcgccagctggctctgtgggaccctgtcagcggccagccggagggcgctaatctgaggctgggaccacatccaggacctggcaggcaggggagtccctgggggggtctgtggttcctggccagtctccccggaacgtag

SEQ ID NO: 219267 - DNA, 552 bp, Artificial Sequence
  Description of Artificial Sequence: Synthetic coding sequence
atgtcattccggaaagtggtgcggcagtctaaattccgccatgtgttcggccagcccgttaaaaacgatcagtgttatgaggacatccgtgtttcgcgcgtaacctgggatagcaccttttgtgctgtcaatcctaagttcctggctgttattgtggaggccagcggaggcggagcctttctggttcttcctctgtctaaaaccgggagaattgataaggcatacccaactgtatgtggccataccggaccagtcctcgacattgactggtgtccccataacgatgaggtgattgcgtcagggagtgaggattgtactgtcatggtgtggcagattccagaaaatggactcacatctccgctaacagaacccgtagtagtgctggaaggccacaccaaaagagtgggcattatagcttggcatcctacggctcggaacgtcctcctctctgccggtctgcatcgtccccctttctgtgccccacctccgcacggccctctgcacactagccagcagcctttacaggggccacatgataaatgggagagttag

SEQ ID NO: 219268 - DNA, 1425 bp, Artificial Sequence
  Description of Artificial Sequence: Synthetic coding sequence
atgaggagagtggtcaggcagagtaaatttaggcatgtttttgggcaagctgtgaaaaatgaccaatgctatgacgatatccgggtgagtcgtgttacctgggactccagtttctgtgccgtaaaccccagatttgtcgcaatcataatagaggcgagcgggggaggggcatttctcgttttgcctctgcacaagacgggcaggatcgataaatcataccctacagtttgtggccacactgggcctgttctcgacatagattggtgtccacacaacgaccaagtgatcgcttccggttccgaagactgcacagtgatggtgtggcagattcctgaaaatgggctgaccttgtctctgacagaacctgtggtaattctcgaagggcactccaagagggtcggcatcgtcgcttggcatcccaccgcgagaaatgtcttgctgagcgctggatgcgacaatgccattatcatctggaatgtaggcaccggggaagcgctaataaaccttgacgatatgcactcggatatgatctataatgtgagctggaaccgcaatggaagtctcatttgtacagcttctaaagacaaaaaagtccgcgtgatcgatcctcggaagcaggaaattgtggcagagaaagaaaaagcccatgaaggagccagacccatgcgtgccatcttcctggccgacggtaacgtgttcaccacaggcttttcaagaatgagcgaacgtcagctagcactgtggaatcctaaaaacatgcaggaaccaatcgcattgcacgagatggacacatccaatggtgtcctactgcctttttatgatccagatacttccattatctatttgtgtggcaaaggagatagctcaattcgatatttcgaaatcactgatgagtcaccgtacgtacactaccttaatacattctctagcaaagaaccacagaggggcatgggctacatgccgaagcgcggactagacgttaataaatgcgagatcgcccgtttttttaagctccacgagcggaaatgtgaacccatcattatgaccgtgccccgtaaaagtgatctgttccaggatgatttatatcccgatacggccggtccagaagccgctcttgaagctgaagaatggttcgaaggcaagaatgccgaccccattttaataagtttgaagcatggatacatcccaggaaagaaccgtgatctaaaggtcgtgaagaagaatatcttagattcaaaacctacagctaacaagaagtgtgacctgatttctattcctaaaaaaactacagacaccgcttctgttcagaatgaagccaagctggatgaaattctcaaggagatcaaaagcatcaaagataccatatgcaaccaggacgagaggatatccaagctagagcagcaaatggcaaagatcgctgcttag

SEQ ID NO: 219269 - DNA, 1584 bp, Artificial Sequence
  Description of Artificial Sequence: Synthetic coding sequence
atgtatggtccaggctcgcagttagggaagagtgggaataattcctgggccaaggaaagggggtgctctattgcttgtcagggaagtttgaccagcgccaggttacacgccccaagcatcggcgaaaggccactcagtcacatgcggtggaaggacaccatgagacgcgtggtaaggcagtcaaagttccgccatgtgtttggtcaggcagtgaaaaacgatcagtgctacgatgatattcgagtcagccgggtcacttgggactccagcttctgcgctgtgaaccccagatttgttgcaatcataattgaggcttctggagggggtgcttttttggtgttacccctgcacaaaactggacgcattgacaaatcctacccgaccgtatgcgggcatactgggcctgtcctggacatcgattggtgtccccataatgaccaggttatcgcctctgggtcagaggattgcacggtaatggtgtggcagataccagagaatgggctgacactgtctctgacagagcctgtcgtcattcttgagggacacagcaaaagggtgggtatcgtcgcctggcacccaactgccagaaacgtgctgctcagcgccggatgcgataacgccataatcatctggaatgtcggtacaggagaagcattgattaatttggatgatatgcatagcgatatgatttataacgtaagctggaaccggaatggatctctcatttgtactgcatcaaaggacaagaaggttcgcgtcatcgatccacggaagcaggaaattgtggctgaaaaggagaaggctcacgaaggtgcccgtcccatgagagcaatattcctggccgatgggaacgtgtttactaccggtttctccagaatgtcagagcggcagctggccctgtggaacccaaagaatatgcaggagcctattgccctgcatgaaatggacacgagcaatggagtcctgctgccattctacgaccctgacaccagcattatttacctttgtgggaaaggcgatagtagcatcagatatttcgaaatcaccgatgaaagcccctacgtccactatctaaacactttctcaagcaaggaaccgcagcgcggaatggggtacatgcctaagcgcggacttgatgtgaataaatgcgagattgccagattttttaagttgcatgagagaaagtgtgaacccattataatgaccgtgccccgtaagagcgacttattccaggacgatctgtaccctgataccgccggtccagaagccgcactagaggccgaggagtggttcgaaggtaagaatgccgatccgattctgatctcactaaagcacgggtacatcccgggaaaaaatcgcgacttaaaagtggtgaaaaagaacatcctcgattctaagcctaccgccaacaagaaatgcgaccttatctctatccctaagaagaccaccgacaccgcttcggtccaaaatgaagccaagctggacgaaattctaaaggagatcaaaagcatcaaggacacaatttgtaatcaggatgaacgaatatccaagctagagcagcaaatggctaaaatagctgcttag

SEQ ID NO: 219270 - DNA, 1425 bp, Artificial Sequence
  Description of Artificial Sequence: Synthetic coding sequence
atgcgacgtgttgtgcggcaaagcaagttccgccacgtgttcggccaggcagtaaagaatgatcagtgctacgacgatataagagtgtcacgtgtcacgtgggatagctcattctgtgcagtaaaccccaggttcgtggccataatcatcgaagcctccggaggcggagcttttcttgtactccctctacacaagacaggcagaattgataagtcctatccgactgtgtgtggacacactggaccagtcttagacatcgattggtgtccacacaacgatcaggtgatcgcttcgggaagcgaggactgcaccgttatggtgtggcagatccctgagaacggtctgaccctctctctcacagagcccgtcgtaatcttggaaggtcattcaaagcgcgtgggaatcgtggcatggcatcctacagcgcgaaacgtgctgttgagcgccggatgcgacaacgctataattatttggaacgtgggaacaggcgaggcgctgataaatcttgacgacatgcattcagacatgatttataatgtgagttggaatcgaaacggctcactaatctgcactgcgtctaaagacaaaaaagtccgggtaattgatcccagaaagcaagaaatcgtcgccgaaaaagagaaagcccatgaaggggctaggccaatgcgagcaatatttttggccgacggaaacgtctttaccactgggttcagcagaatgtcagagcggcagctggcgttatggaaccctaaaaatatgcaggagcctatcgctctccacgagatggacacatctaacggagtcctgctgcccttctatgacccagatactagcatcatctacctgtgcggcaaaggcgatagtagcatccggtatttcgaaattactgacgagagcccatatgtgcattatcttaacaccttctcgagcaaggagccgcagcggggtatggggtacatgcctaagaggggactggacgttaacaaatgtgagatcgccaggttcttcaaactgcacgagcggaagtgcgaaccgattattatgactgtacctcggaagagcgacttgtttcaggatgatctttaccctgacacagccggacccgaagctgccctggaggctgaggaatggtttgagggaaaaaatgccgacccaattcttattagcttgaaacacggctatattcccggaaagaaccgagatctgaaagttgtgaagaaaaacatcctggactccaaacccaccgcgaacaaaaagtgcgatctgatatcaatcccaaagaagaccactgacaccgcaagcgttcaaaatgaggctaagctcgacgagattctaaaagaaataaagtctataaaagacacgatctgcaaccaagatgagcgcatttccaaactggaacaacagatggcgaaaattgcagcttag

SEQ ID NO: 219271 - DNA, 489 bp, Artificial Sequence
  Description of Artificial Sequence: Synthetic coding sequence
atgcggcgagtggttcgccaatcaaaattccggcacgtgtttggtcaggccgtgaaaaacgatcagtgttatgatgacatacgtgtgagcagagtcacttgggattcaagcttttgtgcggttaacccaaggttcgtcgctataattatcgaagcgagtggaggtggcgctttcctggtcttgccactgcataagactgggagaatcgataaaagttaccctaccgtgtgcggacatactggcccagtcctggatatcgactggtgtcctcacaatgatcaggtgattgccagcggctccgaggactgtactgtgatggtctggcagattccggaaaacggcctcaccctgagcctgaccgagccagtcgtcatcttggaaggtcatagcaagcgcgtcggtatcgtggcttggcatcctactgccaggaacgtgctccttagcgccggttgtgataatgccatcattatttggaacgtgggcacttag

SEQ ID NO: 219272 - DNA, 498 bp, Artificial Sequence
  Description of Artificial Sequence: Synthetic coding sequence
tctaaagagccacagaggggtatggggtatatgccaaaaaggggcctggatgtgaacaagtgtgagatcgctaggttctttaagttacacgagaggaagtgcgaaccaatcatcatgaccgtacctcggaagtctgatctttttcaggatgacctctacccggacacggctgggcctgaagccgcattagaagcagaggaatggttcgaggggaagaacgctgacccaattcttatatctctcaaacatgggtatattccaggtaagaaccgcgatctaaaagtcgtaaagaagaatatactggatagcaagcctacagctaataagaagtgtgatttgatctcgatcccaaaaaagacgaccgataccgccagcgttcagaatgaagctaagctcgatgagatacttaaagagattaaaagcatcaaagacacaatttgcaaccaggatgagaggatttctaaattggaacagcagatggcaaagatcgctgcctag

SEQ ID NO: 219273 - DNA, 546 bp, Artificial Sequence
  Description of Artificial Sequence: Synthetic coding sequence
atgaggagagtcgtccgacagtctaagtttagacacgtgtttggccaggctgtgaaaaatgatcaatgttacgacgatattcgtgtgtctagggtaacatgggattcctccttttgtgctgtgaaccctcgctttgttgctataatcattgaggcatccggcggaggtgccttcctggtactgccccttcataagacgggcaggatagacaagagctacccgaccgtgtgtggacatactggaccagtgctggatatcgactggtgcccacacaatgatcaggttatagcctcgggaagtgaagattgtactgtaatggtgtggcagattcctgaaaatggactgaccctgtcgctgacagaaccggtagtaatcttggagggtcacagcaagagagtgggtatagtggcctggcatccgaccgctaggaatgttctactgtccgccggatgcgataacgccatcatcatctggaatgtcggaacaggtgaagccctgataaatcttgacgatatgcacagtgatatgatatacaatgtctcctag

SEQ ID NO: 219274 - DNA, 1443 bp, Artificial Sequence
  Description of Artificial Sequence: Synthetic coding sequence
atgcgctggaaagataccatgcgtcgagtggtccgccagagtaaattccgacacgtctttggccaggccgttaaaaatgaccagtgttacgacgacatcagggtgtccagggtaacttgggactcgagcttttgtgccgtcaatcctcgctttgtggctataatcatcgaggcgagcggcggtggcgcttttctcgtgctccccctgcacaagaccggcagaatcgacaaaagttatcctaccgtttgcggccatactgggcctgtattggacatcgactggtgtccgcacaatgaccaggtgatagcctctgggagtgaggattgtacagttatggtctggcagattccagagaatgggctcactctttctctgaccgagcccgttgtaattcttgaaggtcacagcaagcgggtggggatagtcgcttggcaccccaccgcacgcaatgtcctgctgtccgccggttgcgacaacgccattatcatttggaatgtcgggaccggggaggccctgattaacctcgacgatatgcatagcgacatgatctataacgtgtcttggaacagaaacggctccctgatctgcaccgcttctaaggataagaaagttagagtcatcgaccctagaaaacaggaaattgtggcagagaaggagaaggcgcacgaaggggcaagacccatgcgagccattttcctcgctgacggtaatgtctttaccaccggattttcccgcatgagcgagaggcagttggcattgtggaaccctaaaaacatgcaggaacccattgcactgcacgagatggatacgtctaacggcgtcctgttgcctttctacgaccctgatacatccatcatctacctgtgcggaaagggggattcctctattagatacttcgagataaccgacgagtctccttacgtgcattatctcaacaccttctcgtcaaaagaaccccagcggggtatgggttacatgccgaagaggggtttagatgtcaacaagtgtgagatcgccaggttctttaagctccacgagagaaaatgcgagcctatcatcatgaccgtgccaaggaaaagcgatttgttccaggatgatctataccctgacacagccggacccgaagccgctctggaggctgaagaatggttcgagggaaagaacgctgaccctattctgatcagcttaaagcatggatatatccctggcaaaaacagagacctaaaagtggttaagaagaatattttggatagtaaacccactgccaacaagaaatgcgacctgatatctattccaaagaaaacaaccgacacggcctccgttcagaacgaagccaaacttgacgaaattttgaaagagattaagtccattaaagataccatatgcaaccaggacgagagaatctccaaactggaacaacagatggcaaaaatcgccgcatag

SEQ ID NO: 219275 - DNA, 510 bp, Artificial Sequence
  Description of Artificial Sequence: Synthetic coding sequence
atgcgcagggtcgtgaggcagagcaagtttagacatgtgttcggccaggcggtgaagaacgaccagtgttatgatgacattagggtgagccgtgtgacctgggactcttcattctgtgcagtgaaccctcggttcgtggcaataatcatcgaggcctcaggtggaggcgcttttctggtgcttcctctgcacaagacaggacgcatcgataaatcataccctaccgtctgcggccacacagggcctgtattggacattgattggtgtcctcataacgatcaggtcatcgctagtggcagtgaagactgtacagttatggtctggcagatcccagagaatggactgactctttctctgaccgaaccagtcgtgatcctggaagggcattccaagcgggtgggaatagtggcttggcaccccactgcgcgtaacgttttgctctctgcgggatgtgataatgctataatcatttggaatgtggggaccggggaagcccttatcaacctctag

SEQ ID NO: 219276 - DNA, 456 bp, Artificial Sequence
  Description of Artificial Sequence: Synthetic coding sequence
atgaggagggtagtcaggcagtccaaatttcgccacgtgttcggacaggccgtcaagaatgatcaatgctatgatgatattagagtctcacgagttacttgggactcttcgttctgtgcggtgaatcccagatttgtggctattattatcgaggccagtggcggaggagcctttctcgttctccccctgcacaagactgggcgaattgataaatcatatcctaccgtctgtggacacactggccctgtcttggacattgactggtgtccacataatgatcaggtcattgctagcggcagcgaggactgtaccgtaatggtgtggcagattcctgagaacggcctgacactgagcctgaccgaaccggtggtgatactggagggccactctaaaagagttggcattgtcgcttggcaccccactgcacgaaatgtattgctgtctgccggtgggtag

SEQ ID NO: 219277 - DNA, 492 bp, Artificial Sequence
  Description of Artificial Sequence: Synthetic coding sequence
atgagacgtgtggtccgccagagtaagttcagacatgtgtttggccaggctgtcaaaaacgaccagtgttatgatgacatccgggtttctagggttacatgggattcttctttctgcgccgtcaatcccagattcgtggcaattatcatcgaggcttcaggcggaggggcttttcttgtgctacctttacacaaaaccgggaggattgacaagtcttatccgactgtgtgtggacacaccggaccagtactggacatagactggtgcccacataacgatcaggttattgcatctggctcagaagattgcacagtgatggtgtggcagattccagaaaacggactgacgctgagtctaaccgagcctgtggtaattttggaggggcacagcaagagggttggaatcgtggcttggcaccctacagctaggaacgttctattgtctgcaggctgtgacaatgcaattatcatctggaatgtgggcaccggctag

SEQ ID NO: 219278 - DNA, 1578 bp, Artificial Sequence
  Description of Artificial Sequence: Synthetic coding sequence
atgtcgtggcaccctcagtataggagctccaaatttcgccatgttttcggaaagcctgcaagcaaggagaactgctatgattccgtgccaatcactcgttcagtccacgataatcatttctgcgctgtgaacccccatttcatagccgtggtgaccgagtgcgccggaggaggagcctttttagttatcccattgcaccagactggcaagctggacccccactaccccaaagtctgcggccatcgcggaaatgtgctcgatgtcaagtggaatcccttcgatgacttcgaaattgcctcatgctctgaagacgctacaatcaagatctggtccatccctaaacagctattgacacggaatctgactgcgtacaggaaagaactggtggggcatgcgaggagagttggattagtggaatggcacccaactgcggcaaacatattgttcagcgcagggtacgattataaggtgatgatctggaacctggataccaaggagtctgttatcacctcccctatgtccacgatctcttgtcaccaggacgtcattctgagtatgtcctttaacactaacggctctctgcttgctactacttgcaaggatcgaaagattagagtgatagatcctagggccggaacagtcctgcaggaggcttcctataagggccatagagccagcaaggtactttttcttggtaatttgaaaaagctcatgagtactggcacctcacgatggaacaatagacaagtggctctgtgggatcaggacaatctgtccgtgccattgatggaggaggacctagacggaagcagcggagtgctgtttcctttttatgatgcagacacttccatgttatacgtggtgggtaagggtgacggcaatattaggtattacgaagtgtcagccgataaaccacatcttagttatctgaccgagtacaggtcttacaaccctcagaagggcataggtgtcatgcctaagcgaggtcttgacgtatcttcctgtgagatttttcggttctacaagctcatcaccaccaaatccttaatagagcctatctccatgatcgtccctaggcgctctgagtcgtaccaagaggacatatacccccctactgcaggggctcagccatctctgactgcgcaagagtggctctcgggcatgaatcgtgacccaatcttggtgagcctgagacctggaagcgaacttctgagaccccatccactgccggcagagcgccctatcttcaactcaatggctcccgcatctccacgattgctgaaccagacggagaaattggccgctgaggacggttggcgcagctcctccctgctggaggagaagatgccgaggtgggctgccgagcacaggttagaggagaagaagacctggcttaccaatgggttcgacgtgtttgaatgccctccccctaagactgagaacgaactgctgcaaatgttttaccgccagcaggaagagataagaagactgagggagttgctaacacagagagaggttcaggcaaagcagctggagctggaaattaagaacttacggatggggagtgaacagctctag

SEQ ID NO: 219279 - DNA, 1578 bp, Artificial Sequence
  Description of Artificial Sequence: Synthetic coding sequence
atgtcttggcacccacagtatcgcagctctaagttccgacacgtgttcggcaaaccagcaagtaaggagaactgctacgattccgtgccgataacacgaagcgtacacgataatcatttttgcgccgtcaacccacacttcattgccgtggtcaccgagtgtgccggtggcggagcatttttggtgattccccttcatcagaccggaaagctggatccccactaccctaaggtttgtggccatcgcggaaacgtgctggatgtgaaatggaatccgttcgatgatttcgagatagcttcttgttctgaagacgcaacaatcaaaatttggtcaattccaaagcagctccttacacgaaatctaaccgcttaccggaaggaactcgtggggcatgccagaagggtggggctggtggagtggcacccaactgcagccaacatccttttcagtgctgggtatgattacaaggtgatgatttggaacctggatacgaaggagagcgtcataacctccccaatgagtacaatttcctgtcatcaagatgtgattctgtctatgtcttttaacacaaatgggtcactgttggctactacgtgcaaagaccgcaaaatccgtgtgattgatcctcgggctgggaccgtgctgcaggaagcttcatacaaaggccacagggcatctaaagtcctcttcctagggaaccttaagaagctaatgtctactgggaccagcagatggaataacaggcaggtggccctatgggatcaggacaacttgtcagtgcccttaatggaagaagatctcgatgggtcgagcggtgttctcttcccattttacgatgctgatacatcaatgttatacgttgtggggaaaggcgatggaaatattcggtattatgaagtcagtgctgataaaccacacctgtcttatcttacagaataccgatcttataacccccagaaggggattggcgtcatgccaaagcgcggactggacgtgtccagctgtgagatttttcggttctataagctgatcactaccaagagcctaatcgaacccatttctatgattgtgcccaggcgcagtgaaagctatcaggaagatatatacccacctacggctggggctcagccttcactcacagcccaggagtggcttagtgggatgaatcgggacccaatcctggtgtcattgcgcccaggctcagagctgctaagacctcaccccctgcctgcggagaggccaatattcaattcaatggccccagcatcacccagattgctcaaccaaaccgagaaattagcagccgaagacggctggagaagcagctctctgctggaggagaaaatgcccaggtgggcggcagagcaccgcctggaagagaagaagacttggctgacgaatggattcgacgttttcgagtgtcctcctcccaagaccgagaatgaactccttcagatgttttataggcagcaggaggagattaggaggcttcgtgaactactgacccagcgcgaggttcaagctaagcagctcgagctcgaaattaaaaaccttagaatggggtcagagcagctttag

SEQ ID NO: 219280 - DNA, 1443 bp, Artificial Sequence
  Description of Artificial Sequence: Synthetic coding sequence
atgacggttaccaagatgtcctggagaccccaatacaggtcgagcaagttcagaaatgtatacgggaaagtggctaatagagagcactgctttgatggaatcccaattacgaaaaacgtgcacgacaatcacttctgtgcagtgaatactcgcttcctcgccattgtgactgaatctgcgggtgggggttcatttctggttatcccgctagaacagacagggagaattgagcccaactacccaaaagtatgcgggcaccagggaaatgtcctcgatatcaagtggaacccgttcatcgacaacataatcgcttcctgttccgaggacacctctgttaggatctgggaaattcctgaggggggtttgaaacgcaacatgaccgaggctctactagagctgcacggccactcgcgcagagtcggattagtggagtggcatcccactacaaataatattttgttcagtgcgggatacgattacaaggtgcttatctggaacctggacgtcggcgaaccggtgaaaatgattgattgccacactgacgtgattctgtgtatgtcttttaatacagacgggtcactgttgacaaccacgtgtaaagacaagaaactgcgtgtgattgagccaaggtccggtagggttctgcaagaagccaattgcaagaaccacagggtcaatagggtggtgtttttaggaaacatgaaaagactgctaacgacgggtgtttctcggtggaatacgagacagatagcactgtgggaccaggaagatctgagcatgccactgatcgaagaggagatcgatgggctgtccgggttgctatttcccttttacgatgcggatacacacatgttatacctggccggaaagggcgacggtaatattcggtactacgaaatctcaactgagaagccctatttgtcttacctgatggagtttcgcagcccagccccacagaaggggttgggcgtcatgccgaagcatgggctcgacgtctccgcctgcgaggtgttccgtttctacaagctggtaacactcaaggggctgattgaacccatcagcatgatcgtccctcgcagaagcgatagctatcaggaggacatttaccccatgaccccgggtaccgagcccgctctgactcctgacgagtggttggggggtatcaatagagaccccgtcctgatgtccctcaaggaggggtataagaaatcaagtaaaatggtgttcaaagcccctatcaaagaaaagaaaagtgtcgtggtgaacggcatagacctgcttgagaatgtgccccctcgtacggagaacgaactattacggatgttcttcaggcagcaggacgaaattcgcaggctgaaggaagaactcgcacagaaggacatccgcatccggcagctccagctggagcttaaaaacttacgtaactctcctaaaaactgctag

SEQ ID NO: 219281 - DNA, 1428 bp, Artificial Sequence
  Description of Artificial Sequence: Synthetic coding sequence
atgtcctggaggccgcagtacagatcctctaagtttaggaacgtctatggcaaagtcgctaaccgcgagcactgcttcgatgggatcccaattaccaagaacgttcatgataatcatttttgtgccgtgaacactaggtttttggcaatagtgacagaaagcgctggaggcggatcatttctcgtgatccctctagagcagaccggcagaattgaacccaattatcccaaagtgtgtggtcaccagggtaatgtgctggatatcaagtggaacccattcattgacaacatcatcgcgtcatgttccgaggatacatccgttcgtatatgggagatccctgagggtggactcaagaggaacatgaccgaggctcttcttgaactccatggccacagtcgccgagtggggctcgtggagtggcatcccaccacgaataatattctgttctcggcagggtatgactataaggtgctaatctggaacctagatgtgggcgagcctgtcaagatgatcgattgccataccgatgtcatcttatgtatgagtttcaacactgacggctctctccttaccacaacctgcaaggataagaagcttcgagtcatagagccaaggtctggaagagttcttcaggaggctaattgcaaaaaccaccgggtgaatagagtggtctttttaggcaatatgaagagattactcaccaccggcgtcagtcggtggaacacgcgccaaatcgccctttgggaccaggaagatctgagtatgcctctgatagaggaagagattgatggcctgtccggcctcctgtttccattttacgacgccgatacacatatgctctacttggctgggaagggcgacggcaacatccgatactatgagattagtaccgagaaaccgtatctaagctacctcatggagtttcgaagtcccgctcctcagaaaggcctgggggtgatgccaaaacatgggctggacgtgagcgcttgcgaagtcttcagattttacaaattggttactctgaaggggcttattgaaccgatctccatgatcgtcccccgtaggtctgattcataccaagaagacatctacccaatgacccctggtactgaacctgccttgacacctgacgaatggctgggcggtataaacagagaccctgtgctgatgagcctgaaagaaggatataaaaagagctccaagatggtcttcaaggccccaatcaaagagaagaaatcagtcgtcgtcaacggcatcgacctgctggaaaacgttcccccaaggacggaaaatgaactcttgaggatgttctttcgtcagcaagacgagatcaggagactgaaagaagagttagcccagaaggatatcaggatcagacagctgcagctcgaactcaagaacctcaggaactcccctaagaattgctag

SEQ ID NO: 219282 - DNA, 1428 bp, Artificial Sequence
  Description of Artificial Sequence: Synthetic coding sequence
atgtcatggcggcctcagtataggtcctccaagtttcggaacgtttacggaaaggttgctaatcgcgagcattgtttcgacggtattccaatcacaaaaaatgtccacgataatcatttttgcgccgttaatactaggtttttggcgattgtgacagagtctgccggaggcggaagcttcctcgtgatcccccttgaacagactggcaggatagaaccaaattaccctaaggtgtgcggccaccaggggaacgtgctggacattaagtggaacccctttatagacaatattatcgcgagctgctcagaggacacatctgtgcgaatctgggagattccagaagggggacttaaacgaaatatgaccgaagcattactggaactgcacgggcactcaagaagagtgggactggtcgaatggcatcccacaacaaataacatcctgttctcggctggctacgactacaaggtgttgatctggaacctggatgttggcgagccggtcaaaatgatcgattgccacaccgacgtgatactgtgcatgagctttaatactgatgggagcctgctgacaaccacttgtaaagataagaagctcagggttatagagccaaggtccggtcgagtgttgcaggaggccaattgcaaaaatcaccgggtgaatagagtggtgtttcttggcaatatgaagcgtctcttgacgaccggcgtcagtcggtggaacacacgccagattgccttgtgggatcaagaagacctttcaatgcctttgattgaagaagagattgacggtctatccggacttctgtttccgttctatgatgctgacacccacatgctgtaccttgccggaaagggggacggcaatattcgttattatgagatttccacagaaaaaccttacctaagctacctgatggaatttcggtccccggctcctcaaaaggggctaggggtgatgccaaaacatgggctcgacgtctctgcttgcgaggtgttccggttctacaagttggtgactctcaagggcctgatagagcccatttctatgatcgtgcctcgtcgcagtgattcttaccaggaagacatataccccatgaccccaggaactgaaccagccctgacccctgatgagtggctcggtggcataaaccgcgacccagtcctcatgtctttgaaggagggttacaagaagagctctaagatggtctttaaagctcccatcaaagagaagaaatctgtggttgtcaatggcatagatctgctagagaacgtccctccacggaccgagaacgagcttctgaggatgttcttccgccagcaagacgaaatccgccgtctcaaggaggagttggctcagaaggatattagaatccgccagctgcaactggaacttaaaaacctgcgcaattcccccaaaaattgttag

SEQ ID NO: 219283 - DNA, 4992 bp, Artificial Sequence
  Description of Artificial Sequence: Synthetic coding sequence
atggcgacggatggcgcatcgtgtgagcccgatctttccagggccccagaagacgccgctggagcagctgctgaggcggcaaagaaagagttcgatgtggatactttaagcaagtcagagctacgtatgctgctgagcgtaatggagggtgagctggaggccagagatctggtcattgaggcactccgagcgaggcgaaaagaagttttcattcaggagcgctatgggaggttcaatctgaacgacccattcctggccctgcagcgagattatgaggcaggagccggtgacaaagagaaaaaacctgtctgtactaatccattgagcattctcgaagcggtcatggcacattgcaagaagatgcaggaaaggatgagcgctcaattggcggcagcagaaagcaggcaaaaaaaattggagatggaaaagctgcaactgcaggccctcgaacaagaacacaaaaaattagcagctcgtctggaggaggagaggggaaagaataagcaggtcgtgctgatgcttgtcaaggaatgcaaacagctcagcgggaaagttatcgaagaggcacaaaagctggaggacgttatggcgaagctggaggaggagaaaaagaagacaaatgaattggaggaggagttaagcgcagagaagagacgaagcaccgagatggaagcacagatggaaaagcagctgagtgagttcgacacagagcgggaacagctgcgggctaaactgaatcgtgaggaggcacatacgactgacctgaaagaagaaattgacaaaatgaggaagatgattgagcagctgaagcggggaagtgactctaagcccagtctgagtctgcctaggaagacgaaggatcgccgtcttgtcagcatcagcgttggaacagagggcacggtcaccaggtccgttgcatgccaaacagacctcgtgactgagaacgccgatcatatgaagaagttgccactgacaatgccggtaaagcccagcaccggctcccccctggtgagcgccaatgccaagggatccgtgtgtactagtgcaaccatggctcgcccaggaattgatcggcaggcttcatatggcgatctgatcggggctagcgtgcccgctttcccaccaccttccgccaacaaaatagaagaaaatgggccttctacaggatccacccccgaccctaccagttcaacgcccccacttccctccaacgctgccccacctactgctcagacccctggcatcgccccacaaaactctcaggcacctccaatgcacagtctgcatagtccttgcgccaatacttcccttcacccaggactgaatccccgtatccaggccgctagattccgatttcagggcaatgccaacgacccagaccagaacgggaataccacacagtcacctcctagtagagacgtgtcacccaccagtcgggacaatctcgtggctaaacagctcgctagaaatacagtgactcaggcgttatcccgcttcacctcgccccaagccggagctccttctagaccgggagtgcccccaactggcgacgtaggtacacatcctccagttggacgcacaagcctgaagactcacggcgtggcccgtgtcgatcgtgggaatccaccacccattccccctaaaaagcctggcctgtcacagacaccttccccaccccaccctcagcttaaagttatcattgactcatctagggccagcaacaccggagccaaggtcgacaataagacagtagcctctaccccttcatctctgccccagggcaacagggtgatcaatgaggagaatttgcctaagtccagttcaccacagctgccacctaagccgagcatcgacctgacagtggcgcctgcgggatgcgccgtgtctgcactcgccactagtcaagtaggcgcttggccagccgcaacaccaggtctcaaccagcccgcatgcagtgactcctctcttgtgatccctactaccatagctttctgcagctccatcaacccagtgagcgcatccagctgtcgccctggcgcatccgatagtctactggtaacagcatctggttggtctccttctcttacacccctgttgatgagcggtggacctgcccctttagcaggcaggccgaccttgctacagcaagccgctgctcagggaaatgtcaccctgctctccatgctgctgaacgaggaaggcctggacatcaactattcctgcgaggatggccatagcgcattgtactccgcagccaaaaatggccatacggattgtgtgcgccttcttctatccgctgaggcccaggttaacgctgccgacaagaacggatttacccctctgtgcgctgcagctgcgcagggtcacttcgagtgtgtcgagctgcttatctcttacgacgcgaacatcaaccatgctgccgatggcggacaaacacctctgtacctcgcgtgcaaaaacggcaataaagagtgtatcaagctgctactggaagctggcactaaccggagcgtcaaaactactgatggttggacacctgtccatgccgcagttgataccggtaatgttgatagcttgaagctgcttatgtatcataggatcccggcacacggcaactcctttaacgaagaggaatccgaatctagtgtcttcgatctggatggtggcgaagaatccccggagggaatctctaagccagtcgtgccagccgacctgattaatcacgctaaccgtgagggctggacggctgcacatatcgccgctagcaaaggcttcaaaaactgccttgagatcctatgccgccacggtgggctagaacctgagagacgcgataaatgtaacaggaccgtccatgacgtcgctaccgacgactgtaagcacctgcttgagaatctcaatgcattaaagatcccgctcagaatctccgtcggcgaaatcgagccaagcaactacgggtccgatgaccttgaatgtgagaacaccatttgtgcacttaatattcgcaaacagacttcttgggacgacttcagtaaggccgtgtcgcaggccctgaccaatcatttccaagcaatctcatccgatggctggtggtcgctggaggatgttacctgcaacaacactacagacagcaacattggactcagtgctcgctccattaggtcaattacgttaggtaacgtcccctggagcgtggggcagtcttttgcccaatctccctgggatttcatgcgcaagaacaaggccgaacacatcactgtcttgttgagcggtcctcaagagggctgtctgtcctcagtcacctatgcctcaatgatccccctgcaaatgatgcagaactacttgaggcttgtggaacagtaccataatgtcatcttccacggcccagaaggttcattgcaggactacattgtgcaccaattggctctgtgtctgaaacaccggcagatggccgcaggatttagttgcgaaattgtccgggctgaggtcgacgccggtttttcaaaagaacaacttctggatttattcatctccagcgcctgtcttatcccagtcaagcagagccccagcaagaagaaaataattattattctggagaacctcgaaaaatcttctttgtcagagctcttgcgcgacttccttgctcccctcgagaataggtccaccgaaagtccatgcacctttcagaagggcaacgggctgtcagaatgctactatttccacgagaactgcttcctgatgggcaccattgccaaagcttgcctccaagggagtgatctcttggtccagcagcatttcaggtgggtacaactccgttgggacggagaacctatgcagggcctgctacaacggtttctgcggcgaaaggtggtgaacaaattcaagggccaagcacctagtccttgtgaccccgtgtgcaagatagtagactgggctcttagtgtgtggagacagctgaactcctgcttagcaagattaggaacgccagaagccctgttggggcctaagtattttttgtcttgtccagtggtgcctggccacgcccaggtgaccgttaagtggatgtctaaactctggaacggcgttattgctcctcgagtccaagaggcgattctcagtagagcaagtgtaaagcgacagccgggattcggtcagaccaccgccaaaaggcatccgagtcagggacagcaggcagtagttaaagctgccctgtccattctcctgaacaaagctgtgcttcatggttgccccctgcctcgggctgagttagaccaacataccgctgactttaaaggtgggagcttccccttgagtatagtgtccagctataacacgtgcaataagaagaaaggagagtccggggcttggcgcaaagtgaatacgagccccagaagaaagagcggcagattttctctgccaacatggaataaaccggacctgtcaactgaggggatgaagaacaagactattagccagctcaattgtaatcggaacgcgtcactctccaaacagaagagtcttgagaacgatctatctctcaccctgaatcttgaccaaaggctgtccctggggtccgatgacgaggccgacctggtcaaagaacttcaaagtatgtgcagcagcaaatcggagtccgatatctcaaaaatcgctgacagtcgcgatgatcttcggatgttcgatagctccggcaataatcctgtattatctgccacaataaacaacctccgcatgcccgtgtctcaaaaggaagtgagcccactttcttcacaccagacaacagaatgttcaaactctaagtcaaagactgaattaggcgtgtcccgagtgaaatcttttctgcccgtccccaggagcaaagtcacacagtgtagccaaaataccaagcggtcaagttcctcttcaaataccagacaaatcgaaatcaacaataattcgaaggaagttaattggaatctgcacaagaacgagcacctggagaaacctaacaagtag

SEQ ID NO: 219284 - DNA, 249 bp, Artificial Sequence
  Description of Artificial Sequence: Synthetic coding sequence
atgtcagcgacctggacactgagccccgagccactccccccatctacaggccctcctgtgggtgctggactggatgcggaacaacgcactgtatttgcatttgtgctgtgccttctggtcgtgttggtgctgctgatggtgagatgcgtgcgtatccttttggatccttatagcagaatgccagcctcatcctggaccgatcacaaagaggctctagaacggggacagtttgactacgcactggtttag

SEQ ID NO: 219285 - DNA, 969 bp, Artificial Sequence
  Description of Artificial Sequence: Synthetic coding sequence
atgtcacctaacttcaaactccaatgccacttcatacttatctttctgacagcactccggggagagagccggtacctagaactccgggaggcggcagactacgacccattcctgcttttcagcgccaatctgaagagagaactggctggtgagcagccgtaccggcgtgccctacggtgtctggatatgttgtctcttcaagggcagttcacatttaccgctgaccgaccccagcttcactgcgccgctttcttcattagcgaacccgaggagttcatcactatacactacgaccaggtgtccattgattgtcagggtggagacttcctcaaagtcttcgatggctggatcctaaaaggcgagaagtttccaagctctcaggaccatcccctgccttccgctgagcggtatattgacttctgtgagagtgggctaagccgcagatctatccgtagcagccaaaacgtcgccatgatattctttcgggtgcacgagcctggcaacggctttaccctgacaatcaagactgatcccaatttattcccttgcaacgtaatttcccagactccaaacggcaagtttactctagtcgtgccacaccagcataggaattgcagcttcagtatcatttaccctgtggtcattaaaatctctgacctcactctggggcatgtcaacggactacagctcaagaagtcgtccgcgggatgcgaaggcatcggggacttcgttgagctcctgggtgggaccggcttggacccctctaaaatgacgccccttgctgatctgtgttaccccttccacgggccagcgcaaatgaaggtagggtgcgacaataccgtggttcggatggtgtcttcaggtaaacacgttaatcgcgtgactttcgagtacagacaacttgagccctacgagctcgagaaccctaacggcaatagcatcggcgagttttgtctgagcgggctgtag

SEQ ID NO: 219286 - DNA, 723 bp, Artificial Sequence
  Description of Artificial Sequence: Synthetic coding sequence
atgtcccccgaagttcatcagagcaatgtcggttggtgtcgcttagtgaccgccgcatataattactttcacgtcacaaattttttctggatgttcggtgaaggttgctacttacacactgcaattgtgttaacttactcaactgatcgactaagaaagtggatgttcatatgcattggttggggcgttccattcccaatcatcgtggcctgggcaataggcaagttgtactacgacaacgaaaagtgctggtttggaaagagacccggtgtctatacagactatatataccaaggacccatgattctggtgctgctcattaacttcatcttccttttcaatattgttcggatcttgatgaccaaactgagggcttctaccacctctgagaccattcagtaccggaaggccgtaaaagccactctcgtcttgctgccacttcttgggattacttacatgcttttttttgtcaatcctggagaagacgaggtcagccgggtcgtctttatctacttcaactctttcttagagtcttttcaggggttttttgtctcagttttttactgtttcttgaatagcgaagttaggtccgctatcaggaaacggtggcatcgctggcaggacaaacattctattagggcacgtgtggcacgggcaatgagtatacccactagcccaacccgcgtgagctttcactccataaagcagtccacagctgtgtag

SEQ ID NO: 219287 - DNA, 1248 bp, Artificial Sequence
  Description of Artificial Sequence: Synthetic coding sequence
atggggggacatccgcagttgaggcttgtaaaggccttgctactccttggtctgaatccagtctccgcatctctgcaggaccagcattgcgagtccctatcattggctagcaacatctccggattacaatgtaatgcatccgtggacctaattggcacgtgttggcccaggtctcctgctgggcagctggtggttcgtccctgtcccgcatttttctatggggtcaggtataatactactaataatggatacagggaatgcctcgctaacggctcctgggccgctcgggtgaattacagcgagtgtcaggaaatcttaaatgaggagaaaaagagcaaagtgcactatcatgtggctgtcatcatcaactatctgggtcattgtataagtttagtggccctgctggtggcctttgttttattcctgcggctgcgttcaatccgctgtctgaggaacatcattcactggaacttaatttctgccttcatattaagaaatgccacctggtttgtggtacagctgacaatgagccccgaggttcaccagtctaacgtagggtggtgccggctggtgaccgccgcatacaattattttcatgtcaccaattttttctggatgttcggagagggctgctacctgcacaccgctattgttctgacatactccactgatcgccttcgcaagtggatgttcatttgcattggttggggggtgccctttccaattatagttgcgtgggccatcggaaaactatactacgacaacgaaaaatgttggtttgggaagagaccaggagtgtataccgattacatctaccaggggcctatgattttggttctgcttatcaacttcatctttctgttcaatatagtgcgtatcctgatgacaaagctgcgagcctcaactacatccgagaccatccagtatcggaaggccgtgaaggccacccttgtgcttcttcctttactcgggattacctacatgcttttcttcgttaatcctggcgaagacgaggtcagccgcgtggtttttatctactttaactccttcctggagagtttccaaggctttttcgtgagcgttttctattgctttttgaattccgaagtccggagcgcaattcggaagcgctggcatagatggcaggacaagcatagtattcgggcaagagtggccagagctatgtctattccaactagtcccacccgcgtgtcatttcatagcattaagcagtcaacagctgtgtag

SEQ ID NO: 219288 - DNA, 858 bp, Artificial Sequence
  Description of Artificial Sequence: Synthetic coding sequence
atggtgtctgctaccatccctcagaagaagtccaaggttcattatcatgtggcagtcatcatcaattacctgggtcactgtatctctctggttgcactgttagtggcctttgtcctgttcctccggctacggagtattcgatgcctccgcaacattattcattggaatctcattagcgcattcatccttcgcaatgcaacctggtttgttgttcagctgacgatgtcccctgaggtacaccaatcgaatgtgggatggtgtaggcttgtcaccgccgcatataactactttcatgtaacgaatttcttctggatgttcggggagggctgctatctccatacagctatcgtgcttacatatagcaccgacagacttcggaaatggatgttcatatgcattggctggggcgtcccgtttccaataatcgtggcttgggctatcggcaagctttactatgacaacgaaaagtgctggttcgggaaacgaccgggagtgtacacagactatatttaccagggacctatgatccttgttctccttataaatttcatctttctgttcaacatcgtgagaatcctcatgaccaagctcagggctagtacgacatctgagacaatccagtacagggccagcctctgtctatgtagcaccgtgagctccattgtgcgcagtgttctcccatccggaaggggtggcactggtggcaggacaagtacacgcagtgtccccgaatggccagtgccctgccccagcccacctccgcagcctgtctccgctttcaccgcttcctcaagtccacagcaatctgagctggccggtcatggtgcagcccctaaggagttgtggttgggtggatag

SEQ ID NO: 219289 - DNA, 1206 bp, Artificial Sequence
  Description of Artificial Sequence: Synthetic coding sequence
atgggcggtcacccacaactgaggctggtgaaagctctgctgttgctgggacttaacccggtctccgcctcattgcaggatcagcactgtgagtccttgagcctagccagcaacattagcggcttacagtgcaacgcgtccgtggatttaataggcacctgctggcccagatcaccagctgggcagcttgtcgtgcggccatgtcctgcttttttttatggagtgcggtacaatacaacgaacaacggctacagggaatgtctggccaatgggtcctgggccgctcgcgtgaattacagcgagtgccaggaaattcttaatgaagagaaaaagtctaaagtacactaccatgtagccgttatcatcaactacttgggacattgcatatctctggttgcactcctcgtggcgttcgtgttgtttctgcgcctgcgtagtatcaggtgcctgagaaacatcattcattggaatctgatctcagcttttatcttgagaaatgctacttggtttgtggtccagctcactatgagcccagaggttcaccagagtaatgtggggtggtgtcggcttgtgaccgcggcttataattacttccatgtgaccaacttcttctggatgttcggggaaggttgctatctgcacacagccattgtgctgacgtacagtacagaccgcctccgcaaatggatgtttatttgtatcggctggggagtaccgttccctatcattgtggcctgggctataggaaaactgtactacgacaatgagaagtgctggtttggcaaaaggccaggcgtctacaccgattacatttaccaaggaccgatgatacttgtacttctcatcaactttatatttctgttcaatatcgtgcgaatactgatgaccaaattacgggctagtactacttcagagacaatccagtaccggaaagccgtcaaggccacactagtgctgttgcctctccttggcataacatatatgttattctttgttaacccaggcgaagatgaggttagccgcgtggtctttatttacttcaattcattcctggagagcttccaggtccggtccgctatccgaaaacggtggcacaggtggcaggacaagcacagtattagggccagggtggcacgagcaatgagcatcccaacaagtcctacccgggtttcctttcatagcattaagcagtctaccgctgtctag

SEQ ID NO: 219290 - DNA, 1128 bp, Artificial Sequence
  Description of Artificial Sequence: Synthetic coding sequence
atggggggtcacccccagctgaggctggtgaaggctctgctgctgctgggattaaacccagtctccgcctccctccaggaccagcactgtgaaagcctgtctctggcgagtaatatctccgataacggctatcgggagtgtctcgccaacggttcctgggcagcacgagtgaactatagtgaatgtcaggagattctgaatgaggagaagaaatcgaaagtccactaccacgtcgccgtgatcatcaattatctcggacattgcatttccctcgtggcccttctcgttgcctttgttctattcctgcgcctccggtccattcggtgcctaaggaatatcattcattggaaccttatctccgcctttattcttcgcaacgccacttggttcgttgtgcagttaaccatgtccccggaggtccatcagagcaacgtggggtggtgtcgacttgttacggcagcgtataattatttccacgtaaccaatttcttttggatgtttggggagggatgctacctgcataccgcaatagtgttgacctatagcactgaccgactccgaaagtggatgtttatttgcatcggctggggggtcccctttcctattatcgtagcatgggcaatcggaaagctctactatgataacgaaaaatgttggttcggcaagcggcctggcgtgtataccgattacatttaccagggcccaatgatcctggtgcttctcatcaatttcatcttccttttcaacatcgtgaggattctgatgaccaaactgcgggctagcaccacttccgagactattcagtaccgcaaggcagtgaaggctaccctcgtgctgctcccactgcttggaatcacctacatgctcttcttcgtgaaccccggagaggacgaagtttcgagagtggtgttcatctattttaacagcttcttggaatcatttcagggattctttgtttcagtcttttattgcttcctgaatagcgaagtgcgaagtgccattcggaagcgctggcatcgctggcaggataagcacagcattcgcgctcgggttgccagagccatgagcattccaacatctcctacccgagtctcgttccacagcattaaacagagcaccgcggtgtag

SEQ ID NO: 219291 - DNA, 1335 bp, Artificial Sequence
  Description of Artificial Sequence: Synthetic coding sequence
atgggcggacatcctcagctccggctggttaaggccctgctgctcttaggcctcaatcctgtttccgcttcccttcaagaccaacactgcgagagtctctcgctagcatccaacatctccgggttgcagtgtaacgcctccgtagacttaatcggtacttgctggcccagaagcccggcagggcaactggtggtgcggccatgccccgcatttttttatggcgtgcggtacaacaccaccaacaacggctatcgcgaatgtctggcgaacggctcctgggccgctcgcgtgaactattcagaatgtcaggagatcctgaatgaagagaaaaagagcaaggttcattaccacgtcgcagtcataattaattatttggggcactgtataagcctggttgcgcttctcgtggctttcgtgctgttcctgcgactgcgccctgggtgcacccattggggtgaccaggccgacggcgctttggaggttggtgctccctggtcgggagctcccttccaagtcaggcgctcaatccggtgtctgcggaacattatccactggaacttgattagcgccttcatcctgagaaacgctacatggttcgtcgtccagctcacaatgtcgcccgaagtgcatcagtccaacgtcggttggtgccgtctcgtgaccgccgcatataactactttcacgtgaccaattttttctggatgttcggggagggatgttatctgcacactgcaatagtgctgacgtattcaacggacagactcaggaagtggatgttcatttgtattggctggggcgtgccgtttccgatcattgtcgcttgggcgatcggcaaactttactatgataacgagaagtgttggtttgggaagcgcccaggcgtgtataccgattatatctaccaaggcccaatgatattggtgttattgatcaactttatctttctgtttaatatcgtccgaattcttatgaccaagctgcgtgctagcacaacatccgagaccatccagtacagaaaagccgtcaaggccactttggtgctgttgcccttgttggggatcacgtacatgcttttctttgtcaatcccggtgaggacgaggttagtcgcgtcgtattcatttatttcaactccttcctggaaagctttcaagggttctttgtgagtgtgttctattgcttccttaactcggaagtgcggtctgctatcagaaagcgctggcaccgctggcaggataaacacagcatacgcgctcgtgtggccagggctatgtctatccccacatcgccgacaagagtttcattccacagcataaaacagtccactgccgtatag

SEQ ID NO: 219292 - DNA, 114 bp, Artificial Sequence
  Description of Artificial Sequence: Synthetic coding sequence
gtatacaccgattacatctattttaatagctttttggaatctttccaggggttctttgtgtccgtgttttactgcttcctgaactcggaagtcagatccgctattcggaagtag

SEQ ID NO: 219293 - DNA, 1206 bp, Artificial Sequence
  Description of Artificial Sequence: Synthetic coding sequence
atgggtggacaccctcagctgagacttgtgaaggccctgctcctgctgggcctgaaccctgtgagtgcatccctccaagatcagcattgtgagtcattgagcctggccagcaacattagcggcctccagtgtaacgccagtgtcgacttaatcgggacatgctggccacggagcccagcaggtcaactcgtagttcggccttgtcccgcttttttctatggcgtaaggtacaatacaaccaataatggctaccgcgagtgcttggccaatggttcttgggctgcacgagttaattattccgaatgtcaggagatcctgaatgaagagaaaaagagcaaagtgcactaccacgtcgctgttattattaattaccttggacattgcatctccctggtggctttgctcgtcgcttttgtcctcttcctccggctccgttcgatccggtgtctgagaaacataattcactggaatctgatctcagcattcattcttaggaacgcaacctggtttgtagtccagctgaccatgtcccccgaggtccaccagtccaatgttgggtggtgtaggctcgttacagcagcctacaactacttccacgtcacaaacttcttttggatgttcggcgaaggctgttacctgcatactgcgattgtcctgacatacagcactgaccgtctgcggaaatggatgttcatatgtatcgggtggggcgtcccattccctattatagtggcatgggctataggtaagctttactatgataacgagaagtgctggtttgggaagcgcccaggtgtctataccgattacatctatcagggacctatgattttggtgttactgatcaattttatatttctgtttaatatcgtgagaatacttatgaccaaactcagagcttctaccacatctgaaactatccaatataggaaggcggtgaaggcgaccttagtgctcctgcctctgctgggaatcacatacatgctatttttcgtcaaccccggagaagacgaggtcagcagagttgtgttcatctacttcaacagctttttagaatccttccaggtccggagcgcaatccgcaaaagatggcaccggtggcaggataaacacagtataagggcgagggtggccagggcaatgtccatccctacaagccccaccagagtgtcctttcactcaattaagcagtccaccgctgtatag

SEQ ID NO: 219294 - DNA, 1194 bp, Artificial Sequence
  Description of Artificial Sequence: Synthetic coding sequence
atgggtagggagccctggcctgaggaccgcgatctcggattcccacaacttttctgccagggcccttactcatattgcaataccacgctggaccagattggcacctgttggcccagaagtgcagccggtgccctggtagaacgcccttgccccgagtactttaacggcgtcaaatataacaccaccagaaacgcctaccgggagtgccttgagaacggaacgtgggcgtccaagattaattattcacagtgtgagccaatcctggatgataagcagagaaaatacgacctccattataggatcgcactggtggtaaattacctggggcactgcgtctccgtggccgcacttgtggccgctttcctcttgtttctggccctgaggtcaatccgctgtctgagaaatgttattcattggaatctgattactaccttcatcctgagaaatgtgatgtggttcctgctccaacttgtggatcatgaagttcacgagagcaatgaggtgtggtgtaggtgtatcaccactatctttaactactttgtggtgaccaatttcttttggatgtttgtggaaggatgttatctgcatactgcaatagttatgacctacagcactgagaggcttagaaagtgcctgttcttgttcatcggatggtgtatcccttttcctataatcgtagcatgggccatagggaaactgtactatgagaatgaacagtgctggttcggcaaagagcccggtgacctggtggactatatctatcaagggcctattatcctcgtcctgctcatcaatttcgtgtttttgttcaacattgtccggattctgatgaccaaattgcgcgcaagtaccacaagtgagacgattcagtaccggaaagcagtaaaagcgaccctggtcctgttaccgctcttaggaattacttacatgctatttttcgtcaacccaggggaggacgacctgtcacagatcatgtttatatatttcaactcctttttgcagtctttccagggattttttgtcagtgtattctactgtttcttcaacggtgaggtccgttccgcagtgaggaagaggtggcaccgctggcaagatcaccactccctccgtgtgccaatggctcgagccatgtcaattcctacttctccgactcgtatcagcttccactcaatcaaacagacggcagcggtttag

SEQ ID NO: 219295 - DNA, 1317 bp, Artificial Sequence
  Description of Artificial Sequence: Synthetic coding sequence
atgcgaggaccatctggccctccagggctactgtacgttcctcatttgctgctgtgtctcctgtgtttgttaccaccgccattgcagtatgcagcaggccagagccaaatgccaaaggatcagcctctgtgggccctcttggagcaatactgtcacaccatcatgacactaactaatctgtctggcccttacagttattgcaacactacactggaccagatcggtacttgttggccgcgtagcgcagcgggtgcgctcgtcgagcgcccttgccccgaatatttcaacggcgtcaaatacaacaccacaagaaatgcttatagagagtgtttggaaaatgggacttgggcttccaaaatcaattactcccaatgcgagcccatcctcgacgacaaacagcgtaagtatgatctgcattacagaatcgctttagttgtgaattatctgggacattgcgtttcagtggctgcccttgtcgcagctttcctcctgtttcttgcattgaggagcattcggtgtctgaggaacgttattcactggaatctgataacgacattcattctccggaatgtgatgtggttcctgcttcagctggtggaccatgaggtgcacgagtccaacgaagtgtggtgtcggtgtataacaaccatcttcaactacttcgttgtgacaaacttcttttggatgttcgtcgagggctgctacctgcataccgcgatcgtgatgacctattcaaccgagcggctcaggaagtgtctcttcttgtttatcggttggtgcatcccctttcccatcatcgtggcgtgggcgataggaaaactctattacgagaatgaacagtgctggttcgggaaagaacccggagacctagtcgattacatctaccagggcccaatcatcttagtgctcctgattaactttgtctttttattcaatatcgtaaggattctaatgaccaaactccgggcatccacaacgtcagagactattcaatacagaaaagccgtaaaagctaccctagtactgctgcctttgctgggcataacttatatgctcttcttcgtgaaccccggagaggacgacctgtctcagatcatgtttatttacttcaattcttttctgcagtctttccaaggctttttcgtgtcagtcttctattgcttttttaatggcgaggtccggtcggctgtgagaaagagatggcataggtggcaggatcatcacagcctgcgcgttccaatggcccgtgccatgtctataccaacctcaccaacacgaatctctttccattctatcaagcaaactgccgctgtgtag

SEQ ID NO: 219296 - DNA, 1236 bp, Artificial Sequence
  Description of Artificial Sequence: Synthetic coding sequence
atggatgccgctctcctgcactccctgctggaagcaaattgcagccttgcccttgcagaggagctcctattggacggctggggaccccctcttgacccggaagggccttattcttactgtaacaccacacttgaccagatcggtacctgctggcccaggtcagccgcaggggcactggtggagcgcccatgccccgagtacttcaacggcgtcaaatacaacacaacacgtaatgcttaccgcgaatgtttggaaaacggcacatgggcctcaaagatcaactattctcaatgtgaacccattctcgatgataagcaacgtaagtatgatctgcattaccgtatcgccctggtcgtcaattatcttggacattgtgtaagcgtcgcggctctagtggctgcgtttctgctgttcctagcgcttcgcagcatcaggtgcctccgcaacgttatacattggaacttaattacaacatttatcctgcgaaacgtgatgtggttcctcctccaactggtggaccacgaggtgcacgaatctaacgaggtttggtgtagatgcattactactatttttaactactttgtggtaacaaatttcttttggatgtttgtggaaggctgctacctgcacacagcgattgttatgacctactccacggagcggctcagaaagtgcctgttcctctttattgggtggtgcattcctttccctataatagtggcctgggccattgggaagctgtactatgaaaacgaacagtgttggtttggcaaagaacctggagacctggtcgattacatttatcagggaccaataatcctggtgctgctgatcaactttgtgttcctatttaacatcgtacggatactgatgactaagcttcgcgcttcgaccacctctgaaactatccagtatcgaaaggccgtcaaagctaccctggtgttactgcctctgcttggtatcacttacatgttattctttgttaatcccggagaagacgacctaagtcagataatgttcatttattttaatagcttcctgcagtcctttcagggtttttttgtttccgttttctactgctttttcaacggggaagtgcgatctgccgtgagaaagaggtggcaccgttggcaggatcaccattccctccgggttccaatggccagagctatgtctatccctaccagcccgactcgcatttctttccattccataaagcagacggccgctgtgtag

SEQ ID NO: 219297 - DNA, 1113 bp, Artificial Sequence
  Description of Artificial Sequence: Synthetic coding sequence
atggacgcagcccttttacatagtctccttgaggcaaactgtagtctggcactcgcagaagaactgctccttgacggctggggcccacccctggatcccgaggggccatatagctattgtaatacgacactggatcaaattggaacatgctggcctcgctccgctgccggagctctggttgaaagaccatgtccagaatactttaatggtgtgaaatacaatactacccgcaacgcctatcgcgagtgcctggaaaatgggacatgggcctcaaagatcaactatagccagtgtgagcctattctcgatgataagcagaggaaatacgatctgcattatcgcattgcactagtggttaactatctggggcattgcgtgagcgttgcagcactggtggctgcgtttctcctgttcctagccctgcgtagtatcagatgcctgagaaacgtgatccactggaacctgattacaactttcatcctgaggaacgtgatgtggtttttgctgcagctggtggaccatgaggtccatgagtccaatgaagtctggtgcaggtgcattactacaatcttcaactactttgtggtgacgaattttttttggatgttcgtggagggatgttacctccacaccgccatcgtgatgacatattctaccgaacgattgcgcaagtgtctttttctgttcataggctggtgcattcccttcccaatcattgtggcttgggcaatcggcaagctgtactacgagaacgaacagtgttggtttggaaaagaacccggagacctggtcgattatatataccagggaccgatcatcttggtgctcctgattaatttcgtgtttttattcaacattgtgcggattctcatgactaaactgcgtgcatctacaacttctgaaacaattcagtacagaaaggctgttaaggccacactggtcctgctccccttgttgggcatcacctatatgctgttttttgtgaatcctggagaggacgatctgtcccagatcatgttcatctatttcaactcttttcttcagagctttcagggtttctttgtaagtgtgttctactgcttctttaatggggagggtcttgagcctgtttag

SEQ ID NO: 219298 - DNA, 468 bp, Artificial Sequence
  Description of Artificial Sequence: Synthetic coding sequence
atgtatcggcataagaattcctggcggctggggctgaagtacccaccatcatcaaaggaggaaacccaggtgccaaagacactgatttccggactgcccggaaggaaatccagctctcgcgttggtgaaaagttacagtccgctcacaaaatgcctctgagtcccggactactgctgctgctgctctccggggcaaccgctaccgctgccctgccgctggagggaggccctaccggccgtgactcagaacatatgcaggaggcggcaggaatccggaagtcctcgctgctgacctttcttgcatggtggtttgagtggaccagccaggcgagtgccggacccctcataggtgaggaggctagggaagtggcaagacggcaggagggtgcacctccccagcagagtgctcggagagaccgaatgccatgtcggaactttttttggaaaacctttagcagttgcaagtag

SEQ ID NO: 219299 - DNA, 318 bp, Artificial Sequence
  Description of Artificial Sequence: Synthetic coding sequence
atgccgttatcccccggattgctgcttctcctgctgagtggtgccacagcgaccgcggctttgcccctcgaagggggaccgaccggacgggacagtgaacatatgcaggaggctgctgggatcagaaaaagcagcttgctcacttttttggcctggtggtttgaatggacctcccaggcctcagccggacctctgatcggtgaggaggcacgcgaagtggccagaaggcaggagggcgctccaccacagcagagcgcccgacgagatcggatgccctgtcggaacttcttctggaagaccttcagcagttgcaagtag

SEQ ID NO: 219300 - DNA, 1332 bp, Artificial Sequence
  Description of Artificial Sequence: Synthetic coding sequence
atggccgctagccctcacaccctgtcctcccgcctgctcacagggtgtgtcgggggatctgtctggtacctggagagaagaactattcaggatagcccacacaagtttctgcacctgctcagaaacgtcaacaaacagtggatcacttttcaacacttttcattcctaaagagaatgtatgttactcaattgaatcgttcccataaccagcaagtgagaccaaagcctgagcccgtggcatctccattcctggagaaaacctcctcaggacaagcgaaggccgaaatttatgaaatgcggcctctgtcccctccttcgctcagtctatctagaaaaccgaatgagaaagagctgatcgagctggagcctgatagtgttatcgaagatagcatcgatgttggaaaggagactaaggaggagaagcgttggaaagagatgaaattacaggtgtatgatctccccggtattctggcgagactgagcaagattaagctgaccgccctggtggtatctacgacggcagctgggttcgctctcgctcctgggccatttgattggccatgtttccttttaactagtgtcggcactgggctggcaagctgtgccgctaattcaatcaaccagttcttcgaggttcccttcgattccaacatgaaccggacaaagaatcggcctcttgtaagaggacagatctcacccttgttggcggtgagcttcgccacctgttgtgccgtgcctggggttgcaatcctaactttgggcgtgaaccccctgaccggtgccttgggattgtttaacatctttctctacacgtgttgctatacccccttgaaacgaatcagcattgctaacacgtgggtcggcgctgtggttggggcaatcccccctgtgatgggctggaccgccgctacaggttccttggatgccggtgcgttcctgttaggaggcattctctactcttggcaattccctcatttcaacgccctgtcctggggactcagggaggattacagcagagggggatattgcatgatgtcagttacacaccctggcctttgtagaagggtggccctgagacattgtctggctctgcttgtcctgagcgccgcagcccctgtgctggatataactacatggaccttccctattatggcactcccgattaacgcctacattagttatctgggattcagattttatgtggatgcagatagacgatcctctagacggcttttcttttgcagtctttggcatttaccattgctcctcctcctcatgctgacgtgtaagaggccctcgggcggtggggatgccggacctcccccttcttag

SEQ ID NO: 219301 - DNA, 399 bp, Artificial Sequence
  Description of Artificial Sequence: Synthetic coding sequence
taacgcaacgtgaataagcagtggattacttttcagcacttcagcttcctgaaaagaatgtatgtcacgcaattaaatcgctctcacaaccaacaggtgaggccaaaaccggaacccgtggcatcaccatttctcgaaaagacctcctcgggccaggccaaagccgaaatttatgagatgcgccctctgtcgccaccgtcgctatccctgagccggaaaccaaacgaaaaggagctcatcgagttggaacccgactccgtgatcgaagacagtattgacgtggggaaagagacaaaggaggagaagcgatggaaagagatgaaactccaggtgtacgatctgccagggattctcgcccgtctctccaaaatcaagctaacgggtaccctctttttttag

SEQ ID NO: 219302 - DNA, 756 bp, Artificial Sequence
  Description of Artificial Sequence: Synthetic coding sequence
atgatatgccaggagttttggctggattaccctaagtctaattcccagttcttcgaggtaccatttgactcaaacatgaatcgcaccaaaaacagaccgcttgtcaggggccagatatccccactgctcgcggtgagctttgctacttgttgtgccgtgcccggagttgccatcctcactctcggcgtgaatccattgacaggggctctcggcctgtttaacattttcttgtacacctgttgctacactcccctcaagagaatctccatagccaatacctgggtgggagccgtggtcggggctattcccccagtgatggggtggactgcagctacaggcagcctagatgcgggtgcttttctgctgggcggaatattatacagctggcagttcccacacttcaatgccctgagctggggcctgcgtgaggattactcgagaggcggttattgcatgatgagcgtaacccaccccggattgtgcaggcgggtggcacttcggcattgcctcgcattgcttgttctgtcagcagctgcccctgtcttggacataaccacctggactttccctatcatggccctacccataaatgcatacatatcatacctaggattccgtttctatgttgatgccgaccgccgttcctctagaagattgttcttttgctcgttgtggcatctgccattgctactgctgctgatgcttacctgcaagaggccatcaggcggaggcgacgccggacccccaccttcttag

SEQ ID NO: 219303 - DNA, 681 bp, Artificial Sequence
  Description of Artificial Sequence: Synthetic coding sequence
atgaaccggaccaagaataggccacttgtacggggacaaatctcccctctgttggccgtttccttcgctacatgctgtgccgtgcccggtgtggcaattctgaccctgggggtcaatcccctcaccggcgcattgggtctattcaacatttttctgtatacatgttgttataccccgctcaaaagaatctccattgctaacacgtgggtcggcgctgtcgttggggctatccctccagtgatgggctggaccgccgctacgggctcactggacgccggagccttcctgctagggggaattttgtatagctggcagtttccccacttcaacgcactgagttggggtctgagagaggattactccagagggggatactgcatgatgtctgtgacacaccccggtctctgccgacgggtcgccctccggcactgccttgcactgcttgtgctcagcgcggctgcaccagtccttgatatcacaacctggacctttccaattatggcccttcctatcaacgcctacatctcatacttggggttcagattctatgtcgacgctgatcggcgatcaagtcgccgtttgtttttctgtagcttgtggcacctcccactcctgcttctgcttatgctcacttgtaaacgtccttctgggggaggggatgccggaccacctccttcctag

SEQ ID NO: 219304 - DNA, 831 bp, Artificial Sequence
  Description of Artificial Sequence: Synthetic coding sequence
atgggcggactctggaggccagggtggagatgtgtaccattttgcggctggcggtggatccacccaggaagtcccacacgggcagctgaaagggtcgaaccctttctgaggccagagtggtccggcactggaggcgcagaaagaggtctgcggtggcttggcacctggaagaggtgcagtctgagggccagacatccagccctccagccccctaggaggccgaaaagtagcaatccattcactcgagcacaagaagaggagcggaggaggcagaataaaaccactctgacttacgttgctgctgtggccgtgggcatgctaggcgcttcatacgccgcagtccccttgtaccgactgtactgtcagactaccggactggggggatctgcagttgctggacacgcttcagacaagatagagaacatggttcctgtcaaagacagaattattaaaatctcctttaatgcagatgtgcacgcatccttgcagtggaatttcaggcctcaacaaactgagatatacgttgttcccggagaaacggccctcgccttttatagggctaaaaacccaacagataaacccgtgattgggattagcacctacaacatcgtgcctttcgaagccggtcagtacttcaataaaattcaatgtttttgctttgaagaacagaggctcaaccctcaggaggaggtggatatgcctgtgtttttctacattgatcccgagttcgccgaagacccacgtatgattaaagtggacctgatcacactaagctataccttttttgaagcaaaggagggccacaagctccctgtacccggatacaattag

SEQ ID NO: 219305 - DNA, 1233 bp, Artificial Sequence
  Description of Artificial Sequence: Synthetic coding sequence
atgcagcgcctgttattcccgccattaagggcattgaagggcagacagtatttaccactactggcgcctcgcgctgcaccacgggcacaatgtgactgtattcggaggccgctgcggcctggacagtattcgaccatttccgaagttgcgctgcagagtgggcgtggcacggtgtctcttccttcaaaggccgcagagcgggttgtcggtcgctggttgttagtgtgcagcgggacggtggctggggctgtcatccttggaggcgtgactagactaaccgagtctggactctctatggtcgactggcacttaataaaggagatgaagcctcctacttcacaagaagaatgggaggccgaattccaaagataccagcagttcccagagtttaagatcctcaaccacgacatgaccctaacagaattcaaattcatttggtacatggaatactcgcataggatgtgggggaggctcgttggacttgtgtacatcctccccgcagcatacttttggagaaaggggtggttgagtcggggaatgaagggtagggtgctggccctgtgtggattggtgtgtttccaaggtctgctcggatggtatatggtcaaaagcgggctagaagagaagtcggattcacacgatatacctcgagtgtctcaataccgtctcgccgctcacctcggcagtgccctagtcctgtattgtgcctctttatggacttctctgtctctcctgctgccacctcacaaactccctgagacacaccagctcctgcagttgagacggttcgcccacggaactgctggtctggtgttcctaaccgctctgtcgggagctttcgtggctggactggacgcaggccttgtctacaattcgtttcctaaaatgggcgagagttggatccccgaagacctctttaccttttctcccatcctgcgcaatgtctttgaaaaccccacaatggtgcagtttgaccaccggatcctgggcatcacgtcagttacagctatcacggtgctttacttcctctcacggcgaataccgctcccgagaagaacaaagatggccgctgtgaccctattggcgctcgcatatacacaggtgggcctgggcatcagtaccctgctcatgtacgtgcccactcctctcgccgcaacccaccagagcggcagcctggccttgctcacaggcgcattgtggctaatgaatgagcttaggagggttcctaagtag

SEQ ID NO: 219306 - DNA, 1167 bp, Artificial Sequence
  Description of Artificial Sequence: Synthetic coding sequence
atgcaacgcctgcttttcccccctttacgggctttaaagggtaggcagtatcttccgttactggcaccacgggcagctccgagggcacaatgcgattgcattcggagaccactgcggccaggccagtactccactatctctgaggtcgccctgcagagcgggcgagggacagtgagcctcccatctaaagctgcagaaagagtagttggcagatggctcttagtgtgttccgggaccgtggcaggagcagttatcctgggtggggttacacggctgactgagagtggtctctccatggttgactggcatttaatcaaagagatgaaacctccaacatcgcaggaagaatgggaggcagaattccaacgctatcagcagtttccggaattcaaaattcttaatcatgacatgaccctgactgagttcaaattcatatggtacatggagtacagccatcgtatgtgggggcgtctggtcgggctggtgtacattctgcccgcagcatacttttggaggaaaggctggctgagcaggggcatgaagggcagggtgctggccttgtgcggtctggtctgcttccagggattgctgggatggtatatggtgaagtctggcctggaggagaaatccgattcacatgacatccctcgggtgtctcagtatcgccttgcagcacatcttggaagtgctctggtattatactgcgcttctctttggacttcactgagcctgcttctgccgccacacaaattgccagaaactcatcaactgctgcagctccgacgattcgcgcatggaaccgccggtctcgtctttctgaccgcactctctggtgcattcgtggccggactcgacgcaggcctggtatacaatagctttcctaaaatgggtgagtcatggatccccgaggaccttttcactttctctcccattcttcgcaatgtgttcgagaatcccaccatggtgcagttcgaccaccgcatcctgggtattacgagcgttacagccatcactgtcctgtacttcctctcccggagaattccacttcctcgtaggaccaagatggctgccgtgacgttacttgcgctggcttacactcaggggcctgttctgtttaactttaccttcaaaatttcggacttggacgagggaatccgcaacatatag

SEQ ID NO: 219307 - DNA, 192 bp, Artificial Sequence
  Description of Artificial Sequence: Synthetic coding sequence
atgcccggtctcgtggattccaatcccgcacctcccgaatcccaagagaagaagcctcttaagccctgttgcgcttgtccagagacgaagaaagccagggacgcctgtattattgaaaagggcgaggagcactgcgggcacctcatcgaagcacacaaggaatgtatgcgcgctctcggttttaaaatctag

SEQ ID NO: 219308 - DNA, 192 bp, Artificial Sequence
  Description of Artificial Sequence: Synthetic coding sequence
atgccagggctggtcgattcaaatcccgcaccccctgaaagccaggagaagaaaccccttaaaccttgttgtgcctgtcccgagactaagaaggccagggatgcgtgcatcatagaaaagggggaagaacactgtggacatctcattgaagcccataaggagtgtatgagggcgttggggtttaagatttag

SEQ ID NO: 219309 - DNA, 297 bp, Artificial Sequence
  Description of Artificial Sequence: Synthetic coding sequence
atgcccggtttggtggattcgaacccagcgccaccagagtcccaggagaaaaagccattaaagccctgctgtgcttgtcctgagaccaagaaggccagagatgcttggtttcggggacgcgtgagcgtggatcttagcaggagtttagtgccagggaacgacggtgaacgtggcgagcgtcaggcgagcacaacgcattcatttctgcagataataatcgagaaaggcgaggaacactgtgggcacctgattgaggcacacaaagagtgtatgcgggctctgggttttaagatctag

SEQ ID NO: 219310 - DNA, 192 bp, Artificial Sequence
  Description of Artificial Sequence: Synthetic coding sequence
atgcccggtttagtagatagcaaccctgccccacctgagtcccaggaaaaaaagccattgaaaccttgttgtgcctgtccagaaaccaaaaaggccagagacgcatgtataattgagaaaggggaggaacactgtggccacctgatcgaggctcacaaggaatgcatgagagctctcggctttaagatatag

SEQ ID NO: 219311 - DNA, 1098 bp, Artificial Sequence
  Description of Artificial Sequence: Synthetic coding sequence
atggccctgttgctgtgctttgttctgctgtgcggcgtggtagacttcgcacggtctctgagcatcactacccccgaagaaatgatcgaaaaggccaagggtgagaccgcgtacttgccgtgtaagtttacgctcagccctgaggaccagggccctctcgatattgaatggctcatcagccctgcggataaccaaaaggtcgatcaggtgatcatcctctactccggagataagatttacgatgactactatcccgaccttaaagggcgagtccactttacttcaaacgacctcaaaagtggcgatgcttccattaacgtaacgaaccttcaactgtccgatattggtacctaccagtgcaaggtgaagaaggctcccggtgtggccaacaagaagatacatttagtggtcctcgtgaagccttccggcgctagatgctacgtggacggctctgaggaaattgggagcgactttaagatcaagtgtgaaccgaaggaggggtcgcttccacttcaatacgagtggcagaaacttagtgattctcagaaaatgccaaccagttggcttgccgagatgacttcaagtgtaatctccgtcaagaacgcctcttctgagtattccggaacctattcgtgtactgtacggaacagggtgggtagcgaccagtgcctgctgcgtttgaatgtcgtgccacctagcaataaggcagggctgatcgcaggcgctattattggcactcttctcgccctcgcgctgattgggttaatcatattttgttgtcgcaaaaaacgcagagaggaaaagtacgaaaaggaggtgcatcatgacatcagggaggacgtcccacctcctaaatctcgaacttctactgccaggagctatataggtagcaaccacagtagtctggggtctatgagcccatcaaatatggaaggttattcaaaaactcagtacaatcaggtccccagcgaggatttcgagcgcactccacagagtcccaccctccctccggcaaaagttgcagcgccaaacctgtctcggatgggggctatccccgtcatgattcctgcccagtctaaggacggatccatagtgtag

SEQ ID NO: 219312 - DNA, 975 bp, Artificial Sequence
  Description of Artificial Sequence: Synthetic coding sequence
atggccttgcttctatgttttgtgctgctgtgtggcgtcgtggatttcgctcgctcactttctataacaacccccgaggaaatgattgagaaggctaaaggagagacagcttacctgccttgtaaattcactctgtctcctgaggatcagggacctttagacattgagtggctgatctccccagcggacaaccagaaggtagatcaggtgatcatcctgtattcaggcgacaaaatctatgacgactactatcctgatcttaagggacgcgtgcattttacatccaatgatctgaaatccggagatgccagcataaatgtgactaacttacagttatctgatatcggaacctaccagtgcaaagttaaaaaagcacccggagttgccaacaaaaaaatccacttagtagtgctagtgaagccgagcggcgcaaggtgctacgttgatggcagtgaggagataggttctgattttaaaattaagtgcgagcctaaggaaggttcactgcctctgcagtatgagtggcaaaagctctccgacagccaaaagatgcctacatcttggctcgctgcatctaacaaggccggtcttatcgctggcgctattatcggaacgctcctcgcactggctttgattgggttgattatcttctgttgtcgtaaaaaaagaagggaggagaagtatgagaaggaggtgcaccatgacatcagggaggatgtccccccaccgaaaagccggacttccaccgcgaggtcatacatcgggagcaatcacagctccttgggtagtatgtcaccatcgaatatggagggatactccaagacccaatacaatcaggtaccctccgaagatttcgaaagaactccacaatcccccacactgcccccagccaaagtggcagcccctaatttgtcccggatgggcgctatccccgtcatgattccagcacagtctaaggacggatcaattgtttag

SEQ ID NO: 219313 - DNA, 603 bp, Artificial Sequence
  Description of Artificial Sequence: Synthetic coding sequence
atggccctgctcctgtgtttcgtgttactctgtggggtggtggacttcgctaggtctttgtccatcacaaccccagaggaaatgatcgagaaggcaaaaggtgagacggcatacctcccctgtaaatttactctgtctccagaagatcaggggccattggacatagaatggctaatttctcctgctgacaatcagaaggttgaccaggtgatcatactatattctggggacaaaatttatgatgattactaccccgatttgaaggggcgtgtgcacttcactagcaacgatctgaagtcaggcgatgccagtatcaacgtgactaatttgcagctgtccgacattgggacttatcagtgtaaagtcaaaaaagcaccgggagtcgctaacaagaagatccatctagtggtacttggcaagatgtgtcatctgcaaagagctgtgagacctctccccgaggccacctctgccgtcatcattcacccatggggcccttgcttgctgcctacatggaaagacattcccagactctccatcactaagtatcaagttaagactctgaacgccctgctgagagtccgcctcagtcacctgctcagatag

SEQ ID NO: 219314 - DNA, 759 bp, Artificial Sequence
  Description of Artificial Sequence: Synthetic coding sequence
atggctcttctgctctgcttcgtccttttatgcggagttgttgattttgcaagatctcttagtattactacacctgaagaaatgatcgaaaaggcaaagggggagacagcttaccttccgtgtaaattcacactgagtccagaagatcagggaccactggatattgagtggctgatttcccccgctgacaatcagaaagtggatcaggttatcatcttgtactcaggggacaagatctatgatgattactaccccgatttgaaggggcgagttcacttcacgagtaacgacctgaagagtggggacgcctccatcaacgtgactaatctccagctgagtgacataggcacatatcagtgcaaggtcaagaaggcacccggtgtagcaaataagaagatccacttggtagtgcttgtaaagccatccggagcgcgatgctacgtagacggttccgaagaaataggcagcgactttaaaatcaagtgcgagcctaaagagggctccctcccgctgcagtatgagtggcagaagttgtcagactcccagaagatgccaacttcttggctggctggcaagatgtgtcaccttcagagagccgtgcgacccctgcccgaggccacctccgctgtgatcatacatccctggggtccgtgcttgttacctacatggaaggacataccccgtctgtccattaccaaataccaggtgaaaaccctgaatgctctcctgagggtgcggttgtctcacctgttgaggtag

SEQ ID NO: 219315 - DNA, 1059 bp, Artificial Sequence
  Description of Artificial Sequence: Synthetic coding sequence
atggcactactattgtgttttgtgctgctgtgtggtgtcgtagatttcgctcgctccctatcaatcactacccccgaagagatgattgagaaggccaagggggaaacagcctacttgccatgtaagtttacactatccccagaagatcaggggcctctggacatagagtggttgatatctccagcggacaaccagaaggtcgaccaggtcatcatcctgtattctggtgataaaatctacgacgactactacccagacctcaaggggagggttcatttcactagcaacgatctgaaaagcggagacgcaagcataaatgtgactaatctccaactgagtgatattgggacctaccaatgtaaggtcaagaaagctcccggagtggctaacaagaaaattcacctcgtagtcctggtgaagccttctggggctcgatgttatgtggatggctccgaggagatcggcagcgattttaaaattaagtgtgagcctaaggagggatcacttccactgcagtatgaatggcagaagctgtcggattcccagaaaatgcccacgtcttggttggccgagatgacatcttctgtaatctctgtgaaaaacgccagctctgagtattctgggacatacagttgcactgtgcggaacagggtgggttccgatcagtgcctgctgaggcttaatgtggtgcccccaagtaacaaggccggtctgattgccggagccatcataggcaccctgttggctctggccctgatcgggctgatcatcttctgctgccgcaagaagcgccgagaggaaaaatacgaaaaagaggtgcaccacgacatcagagaggatgtgcccccacccaagtctcgaacctccacagctcgcagttatattggctccaatcacagtagcctaggtagtatgagcccttctaacatggaaggatactccaaaacacagtataaccaagtgcccagcgaagacttcgagcgaacacctcagagccccacactgcccccagcaaagttcaaatacccatacaaaaccgatggaataacagtggtctag

SEQ ID NO: 219316 - DNA, 270 bp, Artificial Sequence
  Description of Artificial Sequence: Synthetic coding sequence
atggccctgctgctctgctttgtcctactttgtggagttgtggactttgcgaggtctctcagcatcacaacccctgaggagatgatagagaaggccaagggagaaacagcctatctgccttgtaaatttaccctatctccagaggatcaaggtcctctcgacatcgaatggctcatttccccagccgacaaccaaaaagtggatcaagtgggacggtgcgctacaagtaaggagccctatgtacactgtcaaaagctccatcgacagtag

SEQ ID NO: 219317 - DNA, 900 bp, Artificial Sequence
  Description of Artificial Sequence: Synthetic coding sequence
atggaggagttcgactcagaagatttttcaacctcggaagaggacgaggattacgtgccgagtggcggagagtattcagaagacgacgtgaacgaactggtcaaggaggatgaagtcgacggggaagagcagacccagaaaacacaggggaaaaagcgtaaggcacagtctatccccgcacggaagaggaggcaggggggactgagtctggaagaggaagaggaagaggatgccaattctgaatcggaagggagttcttctgaggaggaggacgacgcagccgagcaggagaaggggataggaagtgaggatgccagaaagaagaaagaggatgaactctgggccagctttttaaacgatgtggggccaaaatctaaggtccctccgtctactcaggtgaaaaaaggcgaggagactgaagagacaagttcctctaagcttctggtgaaagctgaggaactagagaaacccaaagagacagagaaggtcaagattacaaaggtcttcgattttgccggagaagaggtccgagtcacaaaggaagtcgatgccacgtctaaagaggcgaaatccttttttaaacagaatgagaaggagaaacctcaggccaatgtgcccagcgcgctgccgagccttcccgcaggaagcggcttgaagcgtagtagcggaatgtcgagcttgctggggaagatcggtgccaaaaagcagaagatgtctacgctagagaaatctaagttggattgggaatccttcaaagaagaagagggcattggagaggaacttgccatccataatagagggaaggagggctacatcgagaggaaggcgttcctcgacagggtggatcacagacagtttgagattgaacgggatctccggctcagcaaaatgaaaccatag

SEQ ID NO: 219318 - DNA, 675 bp, Artificial Sequence
  Description of Artificial Sequence: Synthetic coding sequence
atggaaaaactcctctgctttctagttttgacgagcctttcacatgcgtttggtcagacagacatgtcgcggaaagcgttcgtcttcccaaaagagtcggataccagttacgtgtcactcaaggcccctctcaccaaaccgttgaaggcctttaccgtttgcctccatttctatacagaactgtcttccaccagaggatactctatattttcctatgccacaaagagacaagacaacgagatcctcatattttggtccaaagatattggatattcattcacagtaggaggatctgagattctgttcgaagtgcccgaggttaccgtggcccctgtgcatatctgcacatcatgggaatctgcctcaggcatcgtagagttctgggtcgacggcaagccccgagtccgaaagtctttgaaaaaaggatatactgtcggagctgaagcttccatcattctggggcaagaacaggactccttcgggggaaactttgaggggtctcagtctctcgtgggagacatcggtaacgtgaatatgtgggattttgtattgtcccccgatgaaatcaataccatctacctaggcggtcctttctctcctaacgtgctcaactggcgcgcactcaaatacgaggtgcaaggtgaggtatttacaaaacctcagttatggccctag

SEQ ID NO: 219319 - DNA, 309 bp, Artificial Sequence
  Description of Artificial Sequence: Synthetic coding sequence
atggagaagctgctctgcttcctcgtactcacctctcttagccatgcattcggacagacagacatgagtcggaaggccttcgtgttcccgaaagagagcgacacctcatacgtgtctctaaaggctccgctcactaaacctctgaaggcctttacagtctgcctccacttttacaccgaactctcatctactcacgagatcaacacaatttacttgggagggccatttagcccaaacgtcctgaattggcgcgcattgaaatacgaagtacagggggaagtgttcactaagccacagctttggccatag

SEQ ID NO: 219320 - DNA, 309 bp, Artificial Sequence
  Description of Artificial Sequence: Synthetic coding sequence
atggaaaagttgttgtgcttccttgttcttaccagcctgagccatgcatttggtcaaactgacatgtccaggaaagcctttgtcttccccaaggagagcgatacctcatatgttagcctaaaagctcccctgaccaaacctctgaaagcattcaccgtctgtcttcatttctacaccgagttgtcttctacccacgagattaacactatttatctcggtggacccttcagtccgaacgtgcttaattggagggcactgaaatacgaggtgcaaggggaagtatttactaagccccagctctggccttag

SEQ ID NO: 219321 - DNA, 309 bp, Artificial Sequence
  Description of Artificial Sequence: Synthetic coding sequence
atggagaagctgctgtgttttctggtgctgacaagtctgagccatgcgtttggccaaacagatatgtcaaggaaggcatttgtgttcccaaaagaaagcgacacgtcttacgtatcgctgaaggctccgctcactaagccgcttaaggcctttaccgtgtgtctgcacttttacaccgagttatcttctacccatgagattaatacaatttatctggggggaccgttcagtcctaacgttctaaactggcgggcacttaagtacgaagtacagggggaagtatttacgaagccccagctgtggccctag

SEQ ID NO: 219322 - DNA, 276 bp, Artificial Sequence
  Description of Artificial Sequence: Synthetic coding sequence
atggagaagctactctgttttctcgtactgacatcactgtcacacgcttttggacagacagatatgtctcggaaagccttcgtgttcccgaaggagagtgataccagctacgttagcctgaaggcaccccttaccaaacccctgaaagctttcactgtgtgcctgcatttttacacggagttatcaagcactagaggccctaacgtactgaactggcgggcattaaagtacgaggtccagggtgaggtctttactaaaccacagctgtggccctag

SEQ ID NO: 219323 - DNA, 141 bp, Artificial Sequence
  Description of Artificial Sequence: Synthetic coding sequence
atgtgggacttcgttttgtccccagatgagattaacaccatataccttggtggcccattctctcccaatgtgctcaactggcgcgctcttaagtatgaggtccaaggagaggttttcaccaaacctcagctgtggccttag

SEQ ID NO: 219324 - DNA, 1146 bp, Artificial Sequence
  Description of Artificial Sequence: Synthetic coding sequence
atgcccttttccaactcacacaatgccctgaaactgaggttcccagccgaggacgagtttcccgatctgagtgctcacaacaaccacatggcaaaggtccttactcccgaactctacgctgagctcagggctaaatcaaccccttccggatttaccctggacgacgtgatccagacaggagtggacaatcctggtcatccatatattatgacggttggatgcgtcgccggagatgaagagagttacgaagtatttaaggatctgttcgatccaatcatcgaagatcgacacggcggatataagccgtctgatgagcacaagaccgatcttaatcccgacaacctacaggggggagatgacctggaccccaattatgtactgtcatcccgcgtgagaaccggtcggagcataaggggcttttgcctacctccgcattgcagccgtggcgagcgtagagctatagagaagcttgccgtggaagctcttagtagtctagacggggacttggccggacgttattacgccttaaagtcaatgactgaggcagagcagcaacagcttatcgatgaccactttctgtttgataaacctgtgagtcctctgttattggctagcggcatggcgagggattggcccgacgccagaggaatctggcataacgataacaagaccttcctggtatgggtgaatgaagaggaccacctccgtgtcatttccatgcaaaaaggcggaaacatgaaggaagtgtttacacgattttgcacgggattgacccagattgagacacttttcaagtcaaaggactacgagttcatgtggaacccgcatctaggatatattttaacttgccccagcaacctgggcacgggactccgagctggtgtgcatattaaactgcccaacctgggaaagcatgagaagttctccgaagtattgaagcgcttacgcctgcaaaagagaggaacagggggtgtggataccgcggctgtgggcggtgtgtttgatgtgagtaacgccgatcgactgggattttctgaggtggagctggtccagatggtggtggacggcgtcaaactcctgatcgaaatggagcagaggctggagcagggacaggccatcgatgatctgatgccagcccagaaatag

SEQ ID NO: 219325 - DNA, 1041 bp, Artificial Sequence
  Description of Artificial Sequence: Synthetic coding sequence
atgcccttcagtaactctcacaacgccctcaaattgcgcttcccagccgaagatgaatttcccgacctgtcagcgcataacaaccacatggcgaaagtactgacacctgagctctatgcagagctgcgtgcaaaaagcactccgtcgggctttacattagacgacgtgattcaaaccggagttgacaatccagggcacccatacatcatgacggttggatgtgtggctggcgatgaagaatcttatgaagtgttcaaggacctgttcgaccctattattgaagacaggcacggaggctataaaccatctgacgagcacaaaacagacttgaaccctcctcgaggagctccaagaatcgaaaagcttgccgttgaggcactgtcctccctggacggagacctggccggaagatactatgcccttaagtccatgacagaagcggagcagcagcagttgattgatgaccattttctgttcgacaaaccagtgtcccccctacttcttgcctcaggaatggctagggactggcctgatgcacgcggaatctggcacaatgataacaaaactttcctagtgtgggtaaacgaggaggatcatctgagggtgatcagcatgcagaagggaggcaacatgaaagaggtgttcacccggttctgtaccggtctcacccagattgaaaccctgtttaagtccaaggactacgaatttatgtggaacccccatctaggctatatattaacttgtccttcgaacctgggtacgggcctgcgggctggtgttcatattaagcttcccaacctgggcaaacatgagaagttttccgaggtgctgaaacggctgagactccagaagaggggaaccgggggagttgatacggctgcagtaggaggagtttttgacgtcagcaatgctgaccggctaggttttagtgaggtcgagctggtgcagatggtggtcgatggggtgaagctattaattgaaatggaacagcgcttagagcagggtcaggctatagacgatctgatgccagcccagaagtag

SEQ ID NO: 219326 - DNA, 654 bp, Artificial Sequence
  Description of Artificial Sequence: Synthetic coding sequence
atgccatttagcaacagtcacaacgcccttaaactccggtttccagctgaagatgagtttcccgatctctccgcccataacaaccacatggccaaggttctcactcctgagttgtacgccgaacttcgcgctaaaagcaccccaagtggtttcacactcgatgatgtaatccagactggtgttgacaaccctggacacccctacattatgacagttggatgtgtggcaggagacgaggagtcctatgaggttttcaaagacctcttcgaccccattattgaggatcggcacggaggctataagccttcagacgaacacaaaacggacttgaacccagacaacttgcagggcggtgatgacctggaccctaactatgtgctttcctcacgagttaggacgggacgaagtatccggggattctgtctgcccccacactgctctcgaggggagaggcgggcaattgagaaattggcagtcgaagccctgtcctccctcgatggcgatctcgctggccgttactacgctctgaagtctatgaccgaggcagagcagcagcaattgatcgacgaccattttttgtttgataaacctgtcagcccgctgctcttggcaagcggcatggcacgcgattggccggacgccagaggcatctag

SEQ ID NO: 219327 - DNA, 447 bp, Artificial Sequence
  Description of Artificial Sequence: Synthetic coding sequence
atggcagggcctttctctcgactactttcagctcgacctgggctcaggttactggctcttgccggagccggttccctggcagccggtttcttgctacgcccagagcccgtgagagccgcaagtgaaaggaggcggctgtatccacccagcgcggagtacccagacctgagaaagcacaacaattgtatggcctcccacttaacacccgcagtgtatgctcgcctctgtgataagactactcccactggatggacactggatcagtgtatacagaccggagtggataatcctggtcacccattcattaagactgtgggaatggtagctggggatgaggagacctacgaggtgtttgccgacctttttgatccagttattcaggaacggcacaacgggtacgaccctagaactatgaagcatacaacagatctagatgcatccaagtag

SEQ ID NO: 219328 - DNA, 1254 bp, Artificial Sequence
  Description of Artificial Sequence: Synthetic coding sequence
atggctggccctttttctaggttactaagcgctcgccctggactgagactgctggctttggctggcgctggcagtctcgctgcaggtttcctcctcagacctgaaccggtgagggctgccagcgagagaagacgtctgtaccctccttccgctgagtaccccgaccttcggaagcacaataattgtatggcctctcacctgactcccgctgtctatgcccgtctctgtgacaaaaccacaccaacaggctggactctggaccagtgcattcagacaggcgtcgacaaccccggacacccatttataaagactgtggggatggtcgcaggcgatgaggagacgtatgaggtattcgccgatctgtttgacccagtgatccaggagcggcacaatggttacgacccccgtaccatgaagcacactaccgacctagatgctagcaagattcggtcaggctactttgatgaacgctacgttctgagttcacgagttaggacaggtcggtctattcggggtctaagcctgcctccagcttgtacccgtgctgagcggagggaagtcgaaagagtggtggtcgacgccctgtctggtttaaagggggacctagcgggaagatattaccggttgagtgagatgaccgaggccgagcagcaacagctcatcgatgaccacttccttttcgacaagcctgtgtcaccgctgcttaccgcagcgggaatggctcgtgactggcccgacgccagggggatctggcacaacaacgaaaaatcctttctgatctgggtcaatgaagaagaccacacacgcgtgatcagcatggaaaaaggcggaaatatgaagagagtcttcgagagattttgtagaggactgaaagaagtggaacggcttattcaggaaagaggctgggagtttatgtggaatgagagactgggctatattctcacctgcccctcaaatctgggcacaggattgcgggctggggtacatatcaagttaccactgctcagcaaagactcaagattccccaagatactggaaaacctcagactccagaaacgcggaaccggaggagtggatacagctgccactggtggtgttttcgacatcagtaacctcgacagactagggaagagcgaagtggaactggtgcagctggtaatcgatggagtgaattatctgatcgactgtgaacgccgtttagagcgcggtcaggatattcgcattcccacacctgttatccataccaagcattag

SEQ ID NO: 219329 - DNA, 1347 bp, Artificial Sequence
  Description of Artificial Sequence: Synthetic coding sequence
atggccggacctttcagccggcttttatctgctcggcctggcctgcgactcctagccctggccggtgccggatcacttgctgccggttttttgttacgccctgaacctgtacgcgctgccagcgagaggcgacgcctctatcctcctagccagacatggccaacaggacagcttcccggaaattgtacacgctccagacgcttgtgccctcccagcatggtgacaggctaccccctgcccagcgcggagtaccctgacctccgcaagcacaacaattgcatggcaagccacctcacacccgctgtgtatgcgaggttgtgtgacaagacaactcctactgggtggacccttgatcagtgtattcagaccggcgtagataatcccggacacccctttataaaaacggtgggaatggttgccggtgatgaagaaacgtacgaagtgttcgctgacctgttcgatcccgtgatccaggagaggcacaacggctatgatccacgaactatgaaacacactactgacctcgacgcatcaaagatcagaagcggctatttcgacgagagatatgtcctgtcatccagggtgagaacgggtcgatccattaggggcctttcccttccacctgcttgcacacgcgctgaacgcagggaggtggagagggtcgtcgtggacgccctgagcggcctgaagggggacttggctggtcgttactaccgcctctccgagatgaccgaagccgaacagcagcagcttattgacgaccacttcttatttgacaagcctgtttcccctcttctgaccgctgcgggaatggctcgcgattggccagacgctagaggcatttggcataataacgaaaaaagctttctgatctgggtcaatgaagaggaccacacccgcgtcatatcaatggagaagggtggcaacatgaaacgcgttttcgagcggttttgcagaggattgaaagaggtggagaggctgatccaggagcgcggttgggaattcatgtggaatgagcgactcggctatatactcacctgcccaagcaacttggggaccggactgcgcgctggtgtgcatattaaactgccactgctttctaaagatagtcgatttcccaaaatcctcgaaaacctccgattacagaaacggggtacaggtggggtggacaccgcagccacgggcggagtatttgacatctccaatttggacagactaggcaagagcgaggtcgagctcgtgcaactggtaattgacggagtgaactatcttatcgattgtgaacgcagacttgaacggggtcaggatatccggatccccaccccagtgatccacacaaagcattag

SEQ ID NO: 219330 - DNA, 1254 bp, Artificial Sequence
  Description of Artificial Sequence: Synthetic coding sequence
atggctggaccgttcagtcggctgctctccgcacggcctggacttcgcctgcttgcgctagcaggagccggttctctcgccgcaggtttccttctgcggcctgagccggtacgcgcagcttccgaaaggagaaggttgtatcccccaagcgcagaatatcccgatctccggaagcataacaactgcatggcctcacacctaactcccgctgtctacgccagactatgtgacaagacgaccccaaccgggtggacactggatcagtgtattcaaacgggggtcgataacccagggcatccttttattaaaacagtcggcatggtggctggtgatgaggaaacttacgaagtgtttgccgacctgtttgatccagttatacaggaaagacacaatggctatgatcccaggaccatgaagcacactaccgacttagatgcctcaaaaattagatctggctacttcgacgagaggtacgttctttcttcacgagtgcgcacgggcaggagtatacgaggattatccctgccaccagcgtgcacacgcgcagagaggcgcgaggtggaaagagtcgtggttgacgctcttagtggcctgaagggcgacctcgcaggcagatattatcggctctccgagatgactgaggcggagcagcaacagctcattgacgaccactttttgttcgataagcccgtgtcccccctgttaaccgccgcaggcatggccagagactggcctgatgccagggggatctggcacaataacgaaaaatccttccttatctgggtaaacgaagaagatcacaccagagtcattagcatggagaagggcggtaatatgaagcgcgtgtttgaacgtttctgtagagggctgaaagaagttgagcggctaatccaggaacggggatgggagtttatgtggaatgagcgcctgggatacatcctcacttgccccagtaatctgggaacaggcctgcgcgcaggggtccacatcaagttgcctctgcttagcaaagactcccgctttccgaagattctggaaaacctgcggctgcaaaagagaggaaccgggggagttgataccgccgctactggcggagtttttgacatatcaaatctggatcgactgggtaaatctgaggttgagctcgtgcagttggtcattgatggcgtgaactacctcatagattgcgagcggagacttgaaagaggccaggatatccgaatccccacacctgttattcatacaaaacactag

SEQ ID NO: 219331 - DNA, 765 bp, Artificial Sequence
  Description of Artificial Sequence: Synthetic coding sequence
atggccggacccttttcacggctgttaagcgcacggcctggcctcagactcctcgcactggccggagcgggttcgctggcggcaggcttcctcctgagacccgagcccgtacgggcagcgagcgaacggagaaggctgtatccgccttcggccgagtatccggacttgcgaaagcacaataattgtatggcgtcacacctcacccccgcagtgtatgcacggctctgtgacaagacgaccccaaccggttggacactggatcagtgtatccaaaccggcgtcgacaacccgggtcaccccttcatcaagacagtggggatggtagcaggagacgaggagacttatgaggtgtttgcggatctgtttgaccccgtgattcgtggcctctccctgccccctgcctgcactagagctgagcgtcgcgaggtggaaagagtggttgttgacgcgctcagtggactcaagggcgacttggcgggaaggtactaccgcctcagcgagatgacggaggccgagcagcagcagcttatcgacgatcatttcttattcgacaagccagtgagccccttgctcacagctgccggaatggctcgcgactggccagacgcaaggggaatttggcacaacaacgaaaagagtttcctcatctgggtgaatgaagaagaccatacccgagtgatcagcatggagaaaggcggaaacatgaaacgcgtttttgagcggttttgcagggggctcaaggaggtggtagttggaatcaaatag

SEQ ID NO: 219332 - DNA, 1254 bp, Artificial Sequence
  Description of Artificial Sequence: Synthetic coding sequence
atggccggacctttctcccggctgctgtccgcgcgtcccggactgcgtctgttggctctcgcaggagccggttctctggctgccggattcctactgcgtccagagcctgtgcgcgcagcctcagagaggcggcgtttataccctccatctgcagagtatccggatctgcgaaagcacaacaactgtatggcatctcacctgactcctgcagtgtatgcccgattatgcgacaaaaccacaccaaccggctggaccttagatcagtgcatccagaccggtgttgacaaccccggacaccctttcatcaagacggtgggcatggtggctggggacgaggagacctacgaagtgttcgccgacttgttcgatccagtcatccaggagcgccataacggctacgatccaaggaccatgaagcacaccactgatctagatgcatccaaaattcgatctggatattttgacgagcggtacgtcttatccagcagggttaggacaggcaggtccattaggggtctgtccctcccccctgcttgtacaagggctgaacggagggaggtagagcgtgtggtcgtcgacgctctgagcgggctgaagggagatctagccggacggtactatcgattaagtgagatgacagaggctgaacagcaacagctgatagatgatcatttcctgttcgataaaccggtgtcaccccttttgaccgctgctggcatggcacgcgactggcctgatgcaaggggaatttggcataacaacgagaaaagcttccttatatgggtcaatgaggaggatcacacccgggtgatatccatggagaaaggtggtaatatgaagagagtgttcgaacggttttgtcggggtcttaaggaggtggaaagactcattcaagaaagaggctgggagtttatgtggaacgagcgcttaggctatattttgacctgcccgagcaacctcgggacaggcctgcgggcaggcgtccatatcaagctgcccctgctgtctaaagactccaggtttcctaagatactggagaatttgaggcttcagaagcggggtactggaggtgtggatacagcagccactgggggagtcttcgacatctctaacctcgaccgactagggaagtcagaagtggaactggtgcagctcgtcatcgacggcgtgaactacctgatcgactgtgaaagacgcctcgaaagaggccaggacattcgcattcccacacccgtgatacacacgaaacactag

SEQ ID NO: 219333 - DNA, 441 bp, Artificial Sequence
  Description of Artificial Sequence: Synthetic coding sequence
atgcccgtaaaggtacgcacggggaggagcatccgaggactctccctgcccccagcttgtacgagagcagagcggagagaggtggaacgcgtggtagtagatgctctgtccggtcttaaaggggaccttgccggtagatactatcgattatctgagatgactgaagccgagcagcagcagctgatagatgaccattttctttttgataaaccggtgtcgcctctgttgactgcagccggaatggcacgagactggcctgacgcccgagggatctggcacaacaacgagaagtctttcctgatatgggtgaacgaggaggaccatacacgggtcatatccatggaaaaaggtggaaatatgaagagggtgtttgagaggttctgcagggggctaaaggaagttcgggaggactgtgtgggagagctgggtgggaggacttag

SEQ ID NO: 219334 - DNA, 507 bp, Artificial Sequence
  Description of Artificial Sequence: Synthetic coding sequence
atgaaacataccacggacctggatgcctctaagattcgctccggatactttgatgagagatacgttttaagtagtagggtcaggacagggaggagcattcggggactctcattgcccccagcctgtaccagagcagaacgtagagaggtggagagggtggtggttgatgctctcagtgggcttaagggcgacttggctggaagatactacagactgagcgagatgactgaggctgagcaacagcagctgatcgacgatcactttctgttcgataagccggtcagtccactgctaaccgccgcagggatggctagggactggcccgatgcacgaggcatctggcacaataatgagaaatcattcctgatctgggtgaacgaggaagatcatacaagggtgattagtatggaaaaggggggtaatatgaagagggtcttcgagcgtttctgtaggggcttgaaggaagtgagggaagactacgtcggggaattaggcggaagaacatag

SEQ ID NO: 219335 - DNA, 312 bp, Artificial Sequence
  Description of Artificial Sequence: Synthetic coding sequence
atggcaggtcctttctcccggttgctgtccgcacgcccaggcctgcgcttgctcgccttagccggagcaggctcccttgcggcaggcttccttttgcggcctgaacctgtgcgcgctgcatccgagagacggaggttatacccccctagcgccgagtatccggacctccgaaagcataacaactgcatggcctcacatctgacaccggcagtgtatgccaggctctgcgacaaaacaacacccacaggatggacattggatcagtgcattcagacaggggtggacaacccaggccaccctttcattaagtag

SEQ ID NO: 219336 - DNA, 390 bp, Artificial Sequence
  Description of Artificial Sequence: Synthetic coding sequence
atggccggacccttctctcgccttctgtcggcacgccctggcctaaggctccttgcactggccggagcaggatcgctggctgccggatttctcctgcgccctgagcccgtcagggctgctagtgagaggaggcgactataccccccaagtgcggaatacccagaccttaggaagcacaataattgtatggccagtcaccttacgcctgccgtatacgcacgtctctgtgacaaaaccacaccgacgggctggacactagatcagtgcattcaaactggcgtggacaatcccggtcatcctttcatcaagacagtcggaatggtggccggtgatgaagaaacttacgaggtcttcgccgatctcttcgaccctgtcatacaagagagatag

SEQ ID NO: 219337 - DNA, 1017 bp, Artificial Sequence
  Description of Artificial Sequence: Synthetic coding sequence
atggccggacccttttcacgactgctctctgcacgtcctggactgaggctcctcgcgcttgctggagcgggttcgctagcagcaggattttgctccgatcggaacctgtatgaattgccagtgaacgatggcggatgtattccgagggagcagtcccagacctggccaacggggcagttgcctggcaactgcactagaagtcgccgactctgccctcccagtatggtaacaggctaccctctgccatccgcagagtatcctgacctgaggaaacacaataattgtatggcatcacatctgactcccgcagtgtatgcacggctctgcgataagaccacccccactggatggacacttgatcagtgcatccagaccggcgtcgataatcctggacaccccttcataaaaaccgtcgggatggtggccggtgacgaagagacctatgaggtctttgctgacctgttcgatcctgtgattcaagaacggcataacggctacgatcctagaacgatgaagcacactaccgacctcgacgcgagtaaaattagatccggctactttgacgaaagatatgttctgagctctagagtgcgcaccgggaggtccatcaggggcctctccctgccgcctgcctgcaccagagccgagcgaagagaggtggagcgtgtcgtcgtcgacgctctgagtggacttaagggcgacctggcgggaaggtattatagactgagtgagatgacggaggccgagcagcagcagctgattgacgatcattttctgttcgacaaacccgtgtcacctctgcttactgcagccggtatggctcgagattggcctgatgccagagggatttggcataacaacgagaaaagttttcttatttgggttaacgaggaggatcacacacgcgtgatctctatggaaaaggggggaaacatgaagagggtcttcgagagattttgtcggggactcaaggaggtccgcgaggactacgtgggtgaactggggggtaggacgtag

SEQ ID NO: 219338 - DNA, 1254 bp, Artificial Sequence
  Description of Artificial Sequence: Synthetic coding sequence
atggctgggccattttccaggctcctcagcgctaggccaggtctccggctacttgcgctggccggagccggatcacttgccgcagggttcctgctgaggcctgagcccgtgcgcgcagcttccgagcgaagacggctgtatccaccttcagccgagtacccggacctgcgcaagcacaataactgtatggcttcccatcttactcccgcagtgtacgccaggctgtgtgacaagaccactcccacaggctggactctggatcagtgcatccagacaggcgtggataacccaggacaccctttcattaaaactgttggaatggttgctggggatgaagagacctacgaagtgttcgctgatctgttcgatcccgtgatccaagagcgccacaacgggtacgaccccagaaccatgaaacatactaccgacctggacgccagcaagatcagaagcggctactttgacgaaaggtatgttcttagtagccgggtgagaactggccgatctatcaggggtttgtcgctgcctccggcttgcaccagagctgagcggagagaggtggaacgcgtagttgtggatgccctgtctggcctgaagggcgatttagctggaagatattacagacttagtgaaatgactgaggccgaacaacagcagctcattgacgatcacttcctgttcgacaagccggtttctcctctcctgactgccgctggtatggccagggactggcccgacgcacgaggcatatggcacaacaacgagaagtcgttcctcatctgggtgaacgaagaggatcatacaagggtgatctccatggaaaaaggcggaaacatgaaaagggtcttcgagaggttctgccggggactaaaagaagttgaaaggctgattcaggagaggggctgggaattcatgtggaatgagaggttagggtacattctgacctgcccctctaatctgggaacaggcctgcgcgcaggagtccatatcaagttacccctcttatccaaggacagccgttttccgaagattcttgagaatcttcgcttgcagaaacgcggtacaggtggagtggacactgcagccacaggtggagtatttgacatatcaaacctggacagactgggaaaatccgaggttgagttagtacagctagtaatcgacggagtaaactacctcatcgattgcgagcgaagactcgagcgaggacaggacatccggatacccacaccagtgatccacactaaacattag

SEQ ID NO: 219339 - DNA, 774 bp, Artificial Sequence
  Description of Artificial Sequence: Synthetic coding sequence
atggtcaccgggtacccactgccgtccgctgagtaccccgacttgcgcaagcacaacaattgtatggcatcacacctcacccccgctgtttacgctcggctctgtgacaagacaactccaacgggttggaccctggaccagtgcatacaaaccggtgttgataatccaggccacccatttatcaagacagttgggatggtggccggagacgaggagacctatgaagtgttcgccgacctgttcgacccagtcattcaggaaagacacaatggctatgatccaaggacaatgaagcatacaactgatctggatgcctcaaaaatccggtctgggtattttgatgaacggtacgtgctgagctcccgggtgagaacaggacgttctattcgcggactttctttacccccagcctgtacgcgagcggagcggcgagaagttgaacgagtggtggtagatgctctctcagggctcaagggtgatctcgcaggtcgttactacagactgtcagagatgactgaagctgaacaacagcagttgattgacgatcacttcctgttcgacaagccggtgtcaccactccttaccgccgcaggaatggccagagactggcccgacgcccgaggcatttggcacaataacgaaaagtcttttctaatttgggtaaatgaagaggaccataccagggtgataagcatggagaagggtggaaacatgaagagagtctttgaacgcttctgtaggggccttaaggaagtggttgtggggatcaagtag

SEQ ID NO: 219340 - DNA, 726 bp, Artificial Sequence
  Description of Artificial Sequence: Synthetic coding sequence
atggccggtcccttctcgcgcctgcttagcgcacgcccagggctgagacttctcgctttggcaggcgctgggtctctggccgctgggtttctgttgcgaccggaaccagtacgcgctgcgagcgaaaggagacggctgtatccgccaagcgctgagtatcccgacctccggaaacacaataactgcatggcatcacaccttactccagcagtgtatgcaaggttatgcgataagaccacgccaactggctggacgctggaccagtgtattcagactggcgtggacaatcccggacacccttttattaagacggtgggtatggtggcaggcgatgaggaaacctacgaggtgttcgctgatctatttgatccggtgattcaggaaagacataacggatatgaccctaggacaatgaagcacacaacggatctcgacgcctccaaaatccgtagtggctatttcgacgaacgctatgtcttaagttccagagtcaggaccggtagaagcatccgaggcctttcactgccacctgcttgcacccgcgcagagcgtcgtgaggttgagcgggtggttgtggacgccctatcaggtctgaaaggagacttggcaggcaggtattacaggctgtctgaaatgacggaagccgaacaacaacagcttatagacgaccatttcctgtttgataagccagtctcaccactccttacggctgccggaatggcctag

SEQ ID NO: 219341 - DNA, 1260 bp, Artificial Sequence
  Description of Artificial Sequence: Synthetic coding sequence
atggcgagtattttcagcaaattactgaccggacgcaacgcctctctgcttttcgcgaccatgggaacaagtgtactcaccactggatacttgctgaatcgacaaaaggtttgtgcggaagtccgcgaacagcctaggttgttccctccatccgccgactacccagatctgcggaaacacaataactgtatggcggagtgcctgacccctgccatctatgctaagttgcggaacaaagtcacacctaatggatacacattagaccagtgcatacagaccggcgtggacaaccccggtcaccccttcatcaagaccgtggggatggtcgctggcgacgaggaatcgtatgaggttttcgccgacctgtttgaccctgttataaaactccgacacaacggatatgaccccagagtgatgaaacatacaacagacctcgatgcatcaaagattacacagggacagtttgacgaacattatgtgttgtcgagccgggtacgtacaggaaggagtatccgaggtcttagcctcccacctgcatgcaccagagctgaaagaagggaagtggaaaatgtagccataacggccctcgagggtctcaagggagaccttgcgggaagatactacaagctgtctgaaatgaccgaacaggatcagcaacgtttgatcgatgaccactttctcttcgacaagcctgtctcaccactgttgacctgtgcgggtatggctagggactggccggacgccagaggcatctggcataattatgataaaaccttcctgatctggatcaatgaagaggaccataccagagtcatatctatggaaaaagggggaaatatgaaacgagtgttcgagagattctgcagggggctgaaagaggtggagcggctgatacaggaacggggatgggagtttatgtggaatgaaaggttgggatacatcctgacctgcccttccaacctcggcacgggcctgagagcgggtgtgcatgtccgaataccaaaattaagtaaggatccacgcttttctaagatcctcgagaacttacgactgcagaaaagaggtacgggcggagtagataccgcggctgtcgctgatgtctacgacatatccaatattgacaggatcggcagaagcgaggtggagctcgtccagatcgtcattgacggggttaactacctggtggattgtgaaaaaaaacttgagagaggccaagacattaaggtcccgccacctctgccgcagttcggcaaaaagtag

SEQ ID NO: 219342 - DNA, 1260 bp, Artificial Sequence
  Description of Artificial Sequence: Synthetic coding sequence
atggcgtccatatttagcaagctgttgacgggtagaaacgccagcttgctgttcgccaccatggggaccagtgtactgacaacaggctacctattgaatcgacagaaggtgtgtgcggaagttcgcgaacagcctcgcctgttccccccttctgctgactatcctgacctgagaaaacacaacaattgtatggctgagtgtcttactcccgctatttatgccaagttgcgcaacaaggtcactcctaatggatatactctcgatcaatgcattcaaacgggcgtggataaccccggacatcctttcatcaagactgtcggcatggtcgcgggtgacgaagagagctatgaagtgtttgccgatttgtttgatcccgtgatcaaactgcgccacaacggctacgacccacgggttatgaagcataccacagacctcgacgcaagcaagatcacgcaaggccagttcgatgaacactacgtgttgagctcccgggtgcgaaccgggaggtcgataagaggcctgtccctgccacctgcctgcactagggccgagaggcgggaggtggagaatgtggcaatcactgcgctcgagggcctgaaaggggacttggctgggagatactataagctttcagagatgaccgagcaagatcagcagagactgattgacgatcatttcctctttgacaagcctgtttccccgctgctaacatgtgccggtatggcaagggattggccagacgcacggggaatttggcacaattatgacaaaacttttctgatttggatcaatgaagaagatcataccagagtcatctctatggagaagggagggaacatgaaaagggtgttcgaaagattctgtcggggactgaaagaagttgaacgactgatccaggaacgaggatgggagttcatgtggaacgaacgcctcggatacattttgacctgcccgagcaacctgggtactggacttcgggcaggggtgcacgtgaggattcccaagctttccaaggatccaaggtttagcaagatcctggagaacctgagactgcaaaagaggggcaccggaggtgtcgacactgccgctgtcgccgacgtgtacgacattagtaatatcgaccgtataggtagaagtgaagtagagcttgttcagattgtcattgatggtgtgaattatcttgtggattgtgagaagaaactcgaaagagggcaggacataaaagtgccgcctccactcccacagtttgggaaaaagtag

SEQ ID NO: 219343 - DNA, 1260 bp, Artificial Sequence
  Description of Artificial Sequence: Synthetic coding sequence
atggcctctattttcagtaagctattgactggacggaacgcctccctgctgttcgcaaccatggggactagcgtgctgactaccggctacctgcttaatagacagaaagtatgcgctgaggttcgggagcaaccgaggctcttcccgccatcggcagattacccagatttgcgcaagcataacaattgtatggccgaatgtttgacacctgccatctatgctaaactcagaaacaaggtcaccccgaatggctacactctcgaccaatgtattcagacgggtgttgataacccgggtcacccattcattaaaaccgtggggatggtagccggagacgaagaaagttatgaggtgttcgcagatctgttcgatccagtcattaagctgcggcacaatgggtacgaccctagagtaatgaagcatactaccgatctagatgccagtaagattacccagggccagttcgatgagcactacgtgttgtctagtagagttcgcaccggcagatcaatcaggggattgagtctgccacctgcttgtactcgggctgagcgcagagaggtagagaacgtcgccataactgccctcgagggattgaagggcgatttggctggcagatattataagctgagtgagatgacggagcaggatcagcagaggcttattgacgaccatttcctgttcgataaacccgtgtctccactgttgacctgtgcaggcatggcaagagattggcccgacgccaggggcatctggcacaattacgataaaactttcctcatttggataaacgaggaagaccacactagggtcatctcgatggaaaagggtggaaatatgaaacgggtgttcgagcggttctgcagaggtttaaaagaggttgaacgactgattcaggagcggggatgggaattcatgtggaatgagcgattgggttacattcttacgtgcccaagtaatctgggcaccggtctccgtgcaggggtgcatgtgagaatccccaagctgtctaaggatcccagatttagcaaaatcctcgaaaacctacgactacagaagcggggtactggtggcgtggacaccgctgccgtcgccgacgtttacgacatttcgaatattgaccgcatcggaagatcagaggtggaactcgttcagatcgtcatcgatggcgtgaattacctcgtggactgcgaaaaaaaactggagcgagggcaggatatcaaggtacctcctcctcttccccaattcggtaagaaatag

SEQ ID NO: 219344 - DNA, 513 bp, Artificial Sequence
  Description of Artificial Sequence: Synthetic coding sequence
atggcctctattttttctaagctcctcactggacggaacgccagtttactgttcgccacaatgggaacaagcgtccttactaccggctatctgctaaacagacagaaagtatgtgctgaggtgcgggagcaaccgagactgtttcctccttcggctgactaccccgatttgcgcaagcataacaactgcatggccgagtgcctgaccccggctatttatgccaaattgaggaataaggttactcccaatgggtatacgctggaccagtgtatccagactggagtcgacaatccagggcatcccttcatcaagacagtgggaatggtggccggagacgaggagtcctatgaggtgttcgccgacttattcgaccccgttatcaaactgcggcataatggttatgacccccgtgttatgaagcataccacggaccttgatgcttcgaagatcacacagggccagtttgatgagcactatgtgttgagtagcagggtgcgtactggcaggtcttag

SEQ ID NO: 219345 - DNA, 1098 bp, Artificial Sequence
  Description of Artificial Sequence: Synthetic coding sequence
atgggagttcctaggcctcagccttgggcgcttggcctgcttctgttcttgctgcccggtagccttggagcagaaagtcatctctctctgttgtaccatcttactgcggttagttccccggcacccggaacccccgctttctgggtgtctggttggctgggaccacaacagtatcttagttataatagtctgaggggtgaggccgaaccctgcggggcttgggtgtgggagaatcaagtgagttggtattgggagaaagagactacagacctgaggatcaaagagaagttgtttctcgaggcttttaaagctctcggtggcaagggtccctacactctgcagggactcctcggctgtgagctgggacctgataacaccagcgtgcccaccgcaaagtttgcgctgaacggcgaagagttcatgaatttcgatcttaaacaaggaacatggggtggtgattggccagaagccctggcgataagccagaggtggcagcaacaggacaaagcggctaacaaagaactgacctttctcctcttctcatgtcctcatagactgcgggagcacctcgagcgcggtcggggtaatctagaatggaaggagcccccttctatgagattgaaggcaagaccatcgagccccggattctccgtcttaacatgtagcgctttttctttctacccacctgagctccagctgcggttcctgaggaacggtctggccgctggaactggccaaggagatttcggccctaattcagacggcagtttccacgcctctagtagcctgaccgtcaagtctggtgacgaacatcattactgctgcatagtgcaacatgctggtctggcacaacctctgagagtggagctagaaagtcctgccaaaagcagtgtcttggtcgtcgggatagtaatcggggtattgctgctgactgctgctgctgtgggaggggcactgctctggagaagaatgcgctccggcctgcccgcaccgtggatcagcctgagaggggatgacactggggtgctgctccctacccccggtgaagcacaggatgcagatctgaaagatgtgaatgtgatccccgctactgcgtag

SEQ ID NO: 219346 - DNA, 7329 bp, Artificial Sequence
  Description of Artificial Sequence: Synthetic coding sequence
atggccgagaatctgcttgatggaccaccgaaccctaagcgggctaagctgtcaagtcctggcttctcagccaatgattccaccgatttcgggagcctctttgacttggagaatgatcttcctgacgagctgattcccaatggcggtgaattggggctgctcaattcaggcaaccttgtgccggacgcggcatcaaaacacaagcagctctctgagcttctcaggggtggatcaggctcctcaatcaacccgggtattgggaacgtgagtgctagcagcccggttcagcaggggttgggaggccaggcccagggacagcccaattcagcaaatatggcttccctgagcgctatgggcaaatcacctctgagccaaggggatagctctgcccctagcttgccaaagcaggcggcttccacatcaggacccacacctgctgcgtctcaggctctgaatccacaggcccagaagcaggtggggttagcaacatcatctccagccactagccaaaccggcccaggcatctgcatgaatgcgaactttaaccagactcaccccggtcttctcaactccaactctggacactcacttataaaccaggcgtcccagggccaggcacaagtcatgaacggctcactaggggcagcgggtagaggaaggggcgcaggtatgccataccccactcctgcgatgcaaggtgcgtccagcagtgtattagccgagactcttacccaagtaagcccccagatgacaggccatgctggattaaatacagcacaggcaggcggtatggcaaaaatgggaatcactggcaatacctctccatttggacagcctttttcacaggctggtgggcagcccatgggagcaacgggcgtgaacccccaacttgcaagcaagcagtcaatggtcaactctttaccaaccttccctacagacatcaaaaatacctcagttaccaacgtacccaacatgtcccaaatgcagactagcgtgggaattgtacccacccaggcaatcgcgacaggccctaccgctgaccccgagaaaagaaaattgatccagcagcagctcgttctgctgctccacgcccataagtgccagcgcagagagcaggccaacggagaggtacgagcttgtagtctccctcattgccgaactatgaaaaacgtgctaaaccacatgacccattgccaggccggaaaggcctgccaggttgcccactgtgctagctcccggcagatcatctcccattggaagaattgtaccaggcacgactgtccagtgtgcctccctttgaagaacgcctcagataaacggaaccagcaaactattctggggtctcccgcttccgggattcagaacacaattggaagcgttggtacgggccagcaaaatgcaactagcttaagtaacccaaaccccattgacccctcgtccatgcagcgagcatatgccgcactcggtctgccctacatgaatcagccgcagactcaactccaacctcaagtgccaggtcagcagccagctcaacctcaaactcatcagcagatgaggactctgaatcctttgggaaataaccctatgaacattcccgctggcggtattacaacagaccagcagccgcctaacctgataagcgagtcggccctgcctaccagtctaggagcaactaaccctttgatgaatgatggaagcaacagcggaaacatcgggactctgagtactatccctactgcagcccctccttcctctactggcgtaaggaagggctggcatgaacacgttacccaggatcttagaagccatttggttcacaaactggtccaggccatattccctactcctgacccagccgcactgaaggatcggagaatggagaatcttgtggcttatgccaaaaaggtggagggcgatatgtatgagagtgccaattccagagatgaatactaccacctcctggccgaaaaaatatacaaaatccagaaagagctcgaggaaaagagaagaagccgcctacataagcaaggcattttaggaaatcaacccgcactcccagcacctggagctcaaccccctgtgatccctcaggctcagccagtgaggccaccaaatggccctctgagcctgcctgtcaaccgtatgcaggtcagccaaggcatgaactcgttcaaccccatgtcacttggaaacgtacagttacctcaggctcctatgggtcctcgagcagcaagtcccatgaaccacagcgtccagatgaactccatgggtagcgtgcccggtatggccatcagtccctcacgtatgccccagccgccaaatatgatgggggcacatacaaataatatgatggctcaagctccagctcaatcccagtttctgccccagaatcagtttccgtccagttccggggctatgagcgtgggcatgggccaaccccctgcacagacgggtgtgagccaaggacaggtgcccggagccgctctgcccaatccactaaatatgctgggccctcaggcctcccagttaccctgtcctcccgtgacccagtcacctctgcaccccactccaccccctgcgtcaaccgctgcagggatgccaagtttgcagcacacaactccgccaggcatgactccgccacagcccgctgccccaacgcaaccgagtactcccgttagtagcagcggccagaccccgacgcctacaccaggaagtgtaccctctgccacgcagacccaatcgacaccgaccgttcaggccgctgcccaggcacaggtgactccccagccacagacccctgtgcaaccgccatcagtggcgacacctcagtcctctcagcagcaaccaacacctgtccatgcacagccacctggcacgccgctgtcgcaggccgctgcctccatcgacaacagagtaccaacaccctccagcgtagctagcgctgaaacaaatagccagcaaccgggacctgatgtgcctgtcctggagatgaagacagaaacgcaagcagaagacactgaaccagatcccggtgaaagtaagggagagcctcgatccgagatgatggaggaggacttgcagggtgcctcacaggtgaaagaggaaactgacatcgctgaacagaaatctgagccaatggaagtggatgaaaagaagccagaggtgaaagttgaagtgaaagaggaagaagagagctctagcaacggaactgcgagccaatccacttcgccatcccaaccacgcaagaaaatttttaagcccgaggagctgaggcaggccttgatgcctaccctggaagcattataccggcaagatccagaaagcttgccattccggcagcctgtcgatccgcagctcttgggaattcctgattattttgatattgtcaaaaaccccatggatctgtccactataaagagaaaacttgacacggggcagtaccaggagccatggcagtacgttgacgatgtttggctgatgtttaataacgcctggctgtataataggaaaacatcaagggtttacaagttctgctctaagttggccgaagttttcgagcaagagatcgaccccgtcatgcagagtctgggttattgctgcgggcgtaagtacgagttcagcccacagaccctgtgctgctacggaaagcagctttgcaccattcccagggacgccgcttactattcctaccagaacaggtaccacttctgcgagaaatgctttactgaaattcaaggcgaaaatgtgactctgggcgatgatccctcccaacctcagactacaatctcgaaggatcagttcgaaaaaaagaagaatgacacgctcgatccagagccgtttgtggactgcaaggagtgcgggcgaaagatgcaccagatttgtgtgcttcactacgacataatctggccttccgggttcgtatgtgataactgtctgaagaagacaggacgaccaaggaaggaaaacaagttctctgccaaacggttgcagacaacaaggcttgggaaccaccttgaagatcgggtaaacaagttcctacggcgacagaatcacccagaggcgggagaagttttcgtgagggtggttgcctcatcagacaagaccgtggaggtgaagccaggaatgaaatcacggtttgttgattctggggagatgtctgaatcatttccctaccgaactaaagctttgtttgcctttgaggagatcgatggggtggacgtatgcttcttcggcatgcatgtgcaggaatatggctccgactgcccaccccctaacacccggagggtatacatttcctatttagattccatccatttcttccggccacggtgtctacgtactgccgtgtatcacgaaattttgatcgggtacctagagtacgtaaagaaattaggatacgtgactgggcacatttgggcctgccccccatccgagggcgacgattacatctttcattgccacccaccagatcagaaaattcccaaaccaaagcgcctgcaagagtggtataagaaaatgctcgataaggctttcgctgagaggatcattcatgactataaagacatctttaaacaggcaaccgaggacagactgacatcggcaaaggaactgccatactttgaaggggacttctggccaaacgttctcgaggagtcaattaaagagcttgagcaggaagaggaagaacgcaagaaggaagagtccacggcggcatctgagaccactgaggggagtcaaggagattcaaagaacgccaagaaaaagaataataaaaagactaataagaacaagagttcaatctcgcgggcaaacaagaaaaagcccagcatgcctaacgtctctaacgatctgtctcagaagctgtatgccacaatggaaaagcacaaagaagtgttcttcgttatccatctgcacgcaggacccgtgataaacaccctcccaccaatcgtagacccagaccctctgctgtcctgcgacctgatggatgggagggatgcctttctgacattggcgagggacaaacactgggagtttagttcccttcggcgtagtaaatggtcaacgctgtgcatgctcgttgaactgcacacgcagggccaggatcggtttgtttacacatgtaatgaatgtaaacatcacgtggagacaaggtggcactgtacagtgtgtgaggattacgacctgtgcataaattgttacaatacgaagtctcacgctcataaaatggttaagtggggtctgggtctggacgacgaagggtcgtcacagggagaaccccagagcaagtcccctcaggagtccagacggttgtccatacagcgatgtatacagagtctagtacacgcctgccagtgtcgaaacgctaattgctctctgccaagctgtcaaaaaatgaagagggtggtacagcacaccaagggttgtaaaagaaagaccaacggaggctgccctgtttgtaagcaacttatagccctatgctgttaccacgcgaagcactgtcaagagaacaaatgtccagtacctttctgcctgaacattaagcacaaactaagacagcagcaaattcagcaccggctgcagcaggctcaacttatgagacggagaatggctaccatgaacaccagaaatgtgccgcaacaaagtctgccctcacctacctctgcgccaccgggaacccctactcagcagccctctaccccacagacacctcagcccccagcacaaccacagccatcaccggtctctatgtcccccgctggtttccctagcgtggcgaggacgcagcctcctactactgtgtcgacgggaaaaccaacctcacaagtccccgcacctccaccgcctgcccaaccacctcctgccgctgtcgaagccgcaaggcagattgagcgcgaagcccaacagcaacagcacctgtaccgtgttaatatcaataattccatgcccccaggcagaacagggatgggaacccctggttcacagatggctcccgtgtccctgaacgtgccacgacctaaccaggtgtccggcccagtgatgcccagcatgcctccaggacagtggcagcaggccccactgccccagcagcaaccaatgccgggactccccaggccagtgatcagcatgcaggcccaggccgcagtagcaggcccacgcatgcctagcgtgcagcctcccagaagcatcagtccatccgcattgcaggacttactcagaaccctgaaaagcccctcatctcctcaacagcagcaacaagtgctcaacatactgaagagtaaccctcagctgatggccgcttttataaaacagagaacggctaagtatgtcgccaaccagccgggaatgcaacctcagcctggattgcaaagccagcctggcatgcagccccagcccggtatgcatcagcagccctcccttcagaatctgaacgctatgcaggcaggcgtccctcgccctggcgtgccgcctcagcagcaggctatggggggtctgaatccccagggccaggccctgaacatcatgaatccaggacacaatccaaacatggcctctatgaaccctcagtaccgcgagatgctccggaggcagctgctccagcagcaacaacaacagcagcaacagcagcagcaacagcagcagcagcagcagggttcagcagggatggctggcggtatggctggccatgggcagttccaacagccccaggggccagggggatacccacctgctatgcagcagcaacagaggatgcagcaacacctacctttacaaggatccagcatgggccagatggctgcccagatgggacagttggggcagatgggacagccaggactgggcgcagattccacacctaatattcaacaggccctgcagcagcgcatcctgcagcagcaacagatgaagcagcaaatcggaagccctgggcagcctaacccaatgtcgcctcagcaacacatgctgtcagggcaaccgcaggcgagccaccttccagggcagcagattgctacaagcctttcaaatcaggtcagaagcccggctccagtgcagtcaccacgcccacagtctcaacctccgcatagctccccatcacctcgcatccagccacagccaagcccccatcacgtgagcccccagacgggatccccccaccctgggctggcagtaacaatggccagtagtatcgatcaggggcatttaggtaatcccgaacagagcgctatgctgccacaattgaataccccaagtcgatctgcacttagtagtgagctctctcttgtgggggacacaaccggtgacacactggaaaagtttgtcgagggtctctaa

SEQ ID NO: 219347 - DNA, 2934 bp, Artificial Sequence
  Description of Artificial Sequence: Synthetic coding sequence
atgcatgtgcaagaatacggctctgattgcccacccccaaacacacggcgtgtgtacatctcttacctagactcaatccatttcttcagacctaggtgccttcgaaccgcggtgtaccacgagatccttataggctatctggagtacgttaagaaactcggctacgtgaccggacacatttgggcctgcccaccatccgaaggggatgattatatcttccattgtcacccgcctgaccagaaaatccctaagcctaagcgattgcaagaatggtacaagaagatgttggacaaagccttcgcggagagaatcatccatgattacaaagacatcttcaagcaggccacagaagaccgccttactagcgcaaaggaattaccttatttcgagggcgatttctggccaaatgtgttggaggaaagcatcaaggaactggagcaggaagaggaggaacgcaagaaggaagaaagtactgcagcttctgaaacaacagaggtgttttttgtgatacaccttcatgcgggaccagtcattaatactcttccgccaattgtagatccggatcccctattgtcttgcgatttaatggatgggagagacgccttccttaccctggcgagagataaacactgggaattctcaagtttgcggcgtagtaagtggagtaccctgtgcatgctcgtagagttacatactcagggtcaagacagatttgtgtatacttgcaacgaatgtaagcaccatgtggagactaggtggcactgtacagtctgcgaagactatgatctgtgcattaactgttacaatacaaaatcgcatgcccacaagatggtgaaatggggtcttggcttagatgacgaaggcagctctcagggtgaacctcaatctaagtccccacaggagagcaggaggctaagcatccagagatgtatacagtcccttgtccatgcttgtcagtgcagaaacgccaattgctcacttccttcatgccagaagatgaagcgggttgtccagcacactaaagggtgcaaacgaaagacaaacggaggctgtccagtatgtaaacagctgatcgccctgtgttgctatcacgccaaacactgccaggagaataagtgcccggtcccattctgcctgaacataaaacacaaactgaggcagcagcagatacagcacaggctccagcaggcgcagttgatgaggagacggatggccacaatgaacacccgtaatgtgccccagcaatctttgcccagccctacatctgcccctcccggaacaccaacccagcagcccagcacgcctcagactcctcagccacccgcacagcctcagccttcaccagtgtcaatgtcacccgcaggcttcccgtctgttgcacgcacccaaccacccaccaccgtctctactggaaagcccacctctcaggtaccggcacctccccctcctgcccagcctccaccggctgcggtggaagctgcgcgacagatcgaaagagaagcgcaacagcagcagcatctgtatagagtcaacatcaataatagcatgcctcccggacggacaggcatgggcacacctggatctcagatggcccctgtttcgctgaatgtacctcggcctaatcaagtgtcaggccctgtaatgccctccatgccccctgggcagtggcaacaggcaccgctgccacagcagcagcctatgccaggattaccgcgtccagttatctcaatgcaggcacaggcggctgtggctggaccacgtatgccctcagtgcagccacccaggagtataagtcccagtgctctccaagacctgctgagaacactgaagtctccttcctctcctcagcagcagcagcaggtactgaatatactgaagtctaaccctcaactcatggctgcattcatcaagcaacgcacagccaagtatgtggccaatcagcccggtatgcaaccacagccaggcctgcaatcccagccaggtatgcagccccagcccggtatgcaccagcagcccagcctgcaaaacctgaacgctatgcaggcaggtgtccccaggcctggcgtcccaccccagcaacaggcaatgggtggactgaacccacagggccaagcactcaacatcatgaatccaggccacaatccaaacatggcgtccatgaaccctcagtaccgcgagatgctgaggcgtcagctgctgcaacagcagcagcagcaacaacagcagcagcagcagcagcagcagcagcagcagggctccgcaggtatggcgggtggaatggcaggacatggccagttccagcagcctcaggggccaggaggatatcctcctgccatgcagcagcagcagcgtatgcagcaacatctgcccctacagggctcttccatgggccaaatggctgcccagatgggccagctgggccaaatgggtcaaccaggacttggagcagattccacaccaaacatacagcaggctctgcagcagaggatactgcaacaacagcagatgaaacagcagatcggctcaccagggcagcccaacccaatgagcccccagcagcacatgctgtctggccaacctcaggccagccacctccccggacagcagattgcaacttccctgtccaaccaggtgcggtcgcccgctcccgtgcaaagtccacggcctcagagtcagcccccacattccagccccagccccagaattcaacctcagccatcgccacaccacgtgtctccacagactggtagcccacatccaggactcgccgtcacgatggccagttctattgaccaggggcacctgggaaatccagaacaatcggccatgcttcctcagttgaacaccccatcccgttcagccctctcaagcgagctgagcctggtcggcgacacgactggcgacaccctggaaaaatttgtagaggggctttag

SEQ ID NO: 219348 - DNA, 7214 bp, Artificial Sequence
  Description of Artificial Sequence: Synthetic coding sequence
atggccgaaaaccttttagacggcccacccaatccaaagagggccaagctgtcctctccaggtttcagcgcaaatgacagcaccgattttgggagtctatttgacctggagaacgatctgccggatgaactgatccccaatggtggagaactaggcctgctgaatagcgggaacctggttcccgacgccgctagtaaacataagcaattgtccgagctgttacgtggcggttccggttcgagcatcaacccgggaatcgggaacgtgagtgcttcttctccagtacagcaagggttaggtggacaggcacaaggccagccaaattcagcaaacatggcgtccctgtcagccatgggtaagtcacccctgagtcaaggcgattcctccgccccaagcctacctaagcaggccgcatccactagcgggccaacacccgctgccagtcaggctctgaacccgcaggcacagaaacaggtcggactcgccacctcctctcctgcgacttcacagaccggcccaggtatctgcatgaatgctaatttcaatcaaacccacccaggactgctgaattcaaactccggccatagcctgatcaatcaggcatctcagggacaggcccaggttatgaatggcagtctcggcgctgcaggacgagggcgaggtgctgggatgccctacccaaccccggcaatgcagggcgcttcttcgtcagtgctggccgaaacactgacacaggtaagccctcagatgacgggtcatgcaggactcaacacagcacaagcgggtgggatggcgaaaatggggatcaccggaaatacatcgcctttcggccagccttttagtcaagcgggaggccagccaatgggggcaacgggcgtcaatccacagctggcatccaagcagtccatggttaattccctgcctaccttccccacggatatcaaaaacacttccgtgacaaacgtacctaatatgagccagatgcagaccagcgtgggcatcgtgccaacccaagcaattgcaaccgggcctactgcagatccagaaaaacgcaaactgattcagcagcaactggtgctgctgcttcacgcccataaatgccaacggagggagcaggcgaacggcgaagtcagagcctgctccctgccccactgcagaactatgaaaaacgtcctgaatcacatgacacactgccaggcgggaaaagcatgtcaggcgatcttgggttcacctgctagtggcatacagaacactatagggagcgtaggcacaggacaacagaacgctaccagtctctctaacccgaatcccatcgacccttccagtatgcagagagcgtatgctgccttgggactgccctatatgaatcagccacaaacgcagttgcaacctcaagtgcccggtcagcagcccgctcagccccaaacccatcagcagatgcgcacactgaatcccctcggtaataaccccatgaacatccctgccggaggaattacgaccgatcaacagcccccaaatctcattagtgagtcagctctgcccacttctctgggcgctacaaaccctctgatgaatgacggaagcaattccggaaatattggcacattatcaaccataccaacggccgctcctccgtcgtcaacaggcgttcgcaagggctggcacgagcacgtaacacaggacctgcgctcacacctggtccacaagttggttcaggccatcttccctactcccgaccccgctgccctgaaagacaggcggatggagaatttagttgcctacgcgaaaaaagtggagggcgatatgtacgagagcgcgaatagtagggatgagtactaccatctgctcgcagagaaaatttacaagattcagaaagaactcgaggagaaacgacgcagtaggctgcataagcagggcatcctcgggaaccaaccagcgcttcccgcaccaggagcccaacctccagtaatcccccaagctcagccagtgaggcctcccaacggacctttgagcctgccggttaatcgcatgcaggttagccagggaatgaatagcttcaaccctatgtccttgggtaacgtgcagctgccacaggcacccatggggccacgcgcagcgagccccatgaatcattccgttcagatgaattccatggggtcagtgcctgggatggctatctccccaagccgaatgccacagcctccaaatatgatgggggcacacacaaataatatgatggcccaagcacccgctcaaagccagttcctgcctcagaatcagttccctagtagctctggggcaatgtctgtggggatggggcagccccctgcacagacaggggtgtcacagggtcaggttccgggtgccgctctacccaatcctctcaatatgcttgggccacaggccagccaactaccttgccctcccgtgacacagtctcccctccaccccacgccgccaccagcttctaccgccgcaggaatgccttcacttcaacataccactcctccaggcatgaccccaccacagcccgcagcccctacgcagccttcaactcctgtgtccagcagtggccagactcctactccaactccaggaagcgtgccaagtgcaacccagacacagtctaccccaaccgtacaggccgcagcgcaggcccaagtgacccctcagccacaaactcccgttcagcccccttctgtcgccacgccccagagctcacaacagcagccaaccccagtccatgcgcagccgcctggcactcccttatctcaagctgcggctagcatagataatagagtcccaaccccttctagcgtggccagcgccgagacaaactcccagcagccgggtcccgacgtcccagtcctcgagatgaagacagaaacccaggctgaagacacagagccagaccctggggaaagcaaaggagaacctcgttccgagatgatggaggaagatctccagggagcgtctcaagtgaaagaggagactgacatcgccgagcagaagtctgaaccgatggaagtcgacgagaaaaagcctgaggtcaaagtggaggtgaaggaggaggaagagagctcatccaacggcaccgcgtctcagtctacgtcacctagtcagccccgaaagaagatattcaagcccgaggaacttcgccaggcgcttatgccgactctagaggccctttatcgccaggaccctgagagcctaccattcagacagcctgtcgatcctcagttgttgggtatccctgactatttcgatatcgtgaaaaatccgatggatctgagcactatcaaacgaaagctggataccggccagtaccaagagccttggcagtacgttgacgatgtatggttgatgtttaacaacgcatggctctataacaggaagaccagccgggtgtataaattttgctctaaactagccgaagtcttcgagcaggagattgatccagtcatgcagtcactgggttactgctgcggaaggaaatatgagttctcccctcagacactgtgttgttacggcaaacagctctgtacaataccacgggatgctgcatactacagctatcagaatcggtaccacttttgcgaaaaatgttttacggaaatacaaggcgaaaacgtgacactgggcgacgatccgtctcagccccagaccacaatcagtaaagatcagtttgagaaaaagaagaatgatacccttgatccggagccattcgtcgactgcaaagagtgcggcaggaagatgcaccagatctgcgtgctgcactacgatatcatttggcctagcggctttgtgtgtgacaactgtctgaagaagaccggaaggcctcgtaaggagaataaattttccgccaaaaggctgcagactaccaggctaggtaatcatctcgaagatcgcgtgaataagttccttcgacggcagaatcatccggaagcaggagaggttttcgtgagggttgttgcctctagtgacaaaactgttgaagtgaaacctgggatgaaatcacgctttgtcgacagcggagaaatgtccgagagttttccatataggaccaaagcattgttcgcatttgaagaaattgatggcgtggatgtttgctttttcggaatgcatgttcaagagtacgggtccgactgtccccctcccaatacacggagggtgtacatcagctatctggattccatccactttttcaggcctaggtgtctcaggacagccgtctatcatgaaattctaatcggatatctggaatatgtgaagaagttgggttacgtgactggccatatctgggcttgtccgccaagtgagggtgatgactacatcttccattgccatccaccagatcagaaaattcctaaacccaagcgccttcaggagtggtataagaagatgcttgataaagcctttgcagaacggattatacacgactataaggatatctttaaacaggccacagaggataggctcacctcagccaaagagcttccatattttgaaggggacttctggccaaatgttctggaagagagcatcaaagagctggaacaagaagaagaggagcgaaaaaaagaagaatcaacagctgcgagtgaaacaaccgagggcagtcagggggactcaaagaatgccaaaaagaagaataataagaaaacaaataagaataaatcctctatcagtcgggcaaacaagaaaaagccttctatgcccaacgtgagtaacgacctgtcacaaaaactatacgccacaatggagaagcacaaggaagtgttttttgtgatccatctgcacgctggaccggtaataaataccctccctccaatcgtggatccagacccgctgctgtcatgtgaccttatggacggcagggatgcattcctcacgttggcaagggataagcactgggagttttctagccttcgcagatcaaagtggagcacgctttgcatgctcgtagaactgcatactcaggggcaagataggttcgtttacacctgtaatgagtgcaagcaccacgtagagaccagatggcattgcaccgtttgcgaagactatgatttatgcattaattgttacaacactaagtcacatgcccacaagatggtcaaatgggggctggggctggacgacgagggtagctcccagggcgagcctcagtctaaatccccacaagaaagccgacgccttagtatacaacggtgcatccagagtctggtccatgcctgccagtgtagaaacgccaactgttctttgccctcatgtcaaaaaatgaaaagagtggtgcagcataccaaagggtgcaaaagaaaaacaaatggcggttgtcctgtgtgtaagcagctgatcgctttgtgctgttatcatgctaagcactgtcaggagaacaagtgccctgtccctttttgcctcaacatcaaacacaaactccgccagcagcaaattcagcaccgattacaacaggcccagttaatgagaaggaggatggccactatgaatacccgcaacgtgccccagcaatcgttgccatccccaactagcgcaccacctgggactcctactcaacagcctagtaccccacaaactccacaaccacctgcccagccccagccttcccctgtgtctatgagtcctgccggatttccctctgtcgctaggactcagccacctaccaccgtatccactggaaagccaacatcacaggtgcccgctcctccccctcccgctcagccacctcctgcagccgtggaagccgctaggcaaatcgaaagagaagcccagcagcagcagcacctatatcgggtaaacatcaacaattctatgcctcctggcagaaccggaatgggcacaccaggctctcagatggccccagtttcacttaacgtccctagacccaatcaggtgtcaggtccagtcatgccaagcatgccccctggccagtggcagcaagcgccactcccccagcaacaacctatgcctggtttgcctcgccctgtgattagcatgcaggcacaggcggctgtagccggtccgagaatgccttccgtgcagccccctcgttcaatttctccgtctgcccttcaagacttgctgcgaacactcaagtccccatcttccccacaacagcagcagcaggtgctcaatatcctgaagtcaaatccacagctgatggccgcattcataaaacagagaactgccaagtatgtcgccaatcaaccaggcatgcagccccaaccaggcctgcagtcgcaaccagggatgcagccccagcccggaatgcatcaacagccctccctacagaacctgaacgctatgcaggcaggagtgcccagacctggagtaccccctcagcagcaggctatggggggactgaatccccaggggcaagccttgaacatcatgaatcccggacataaccccaacatggcctccatgaacccccaatatcgcgagatgctcaggagacagctcttgcagcaacaacagcaacagcagcagcagcagcaacaacaacagcagcagcagcaagggagcgctggaatggcaggcggaatggctggacacggtcaattccagcagccccaaggacccggtggatatcccccagctatgcagcaacaacaacggatgcagcaacacttgcccctacaaggtagcagcatgggacagatggcagctcagatgggccagctgggacaaatgggtcagccgggtttaggagccgactctactcctaatatccaacaggcactgcagcagaggatcctccagcagcagcaaatgaaacaacagataggctccccaggccagccgaatcctatgtccccccagcagcatatgctaagcggacagcctcaggcctctcacctacctgggcagcagattgcgacatcgctcagcaaccaggttagaagcccggcacccgtgcagtcgccccgaccgcagagccagccccctcactcctcaccctccccgcgaatccagccccaaccctctccccatcacgtgtcaccccagacgggctccccccatccaggcctcgcagtgaccatggccagctctatcgatcaaggccatttagggaacccggaacagagcgccatgcttcctcagcttaacaccccctcgaggtctgcactgagctccgaactgtccctggtgggagataccacgggcgataccttagagaagtttgtcgagggcttgta

SEQ ID NO: 219349 - DNA, 7418 bp, Artificial Sequence
  Description of Artificial Sequence: Synthetic coding sequence
ctgcggggtgccgtagcggttgccgagatctggccccctccccctcccccagggctgaggccacccagtccctctgcacctgcccgtcccctcgcagcaagggcccgatccagtccatcccaacccgctggacccccaactcctgtccgggcactcgcgggacccgctgccagggcaaggggatgtttcagagaacaggtaaagatggccgagaatctgttggacggccctccaaacccaaagagagctaaactcagttcgccagggttctccgctaacgactcaaccgactttggaagtctgttcgacctggagaacgatctccccgatgaactcatccccaatggcggagagttaggccttctcaactctggcaaccttgtgcccgatgcggcatcaaaacacaagcaactctctgaacttttaaggggagggtcgggctctagcatcaaccctggaattgggaatgtaagtgccagctccccggtgcagcagggcctaggcggtcaggcacagggacagccaaattctgctaacatggcttccttgagtgccatgggaaagtcacctctttcacagggggattctagtgcacctagccttcccaaacaggccgcatctacttccggccctacccccgctgcttctcaggccctgaaccctcaggctcagaagcaagttggtctggctacatcaagccccgctaccagccaaactggaccagggatttgcatgaacgcaaactttaaccagacacatcctggtctgctgaattccaatagtgggcactccctgattaatcaggcttctcaggggcaggctcaggtgatgaacggctcgcttggcgcagcaggtcggggaagaggcgcagggatgccctatccgaccccagctatgcagggcgctagtagcagcgttctcgccgagacactgactcaagtcagtccccagatgacaggccacgcagggctcaataccgcccaagcaggcggaatggcaaagatgggaatcacagggaataccagcccttttgggcagccatttagccaagccggtggacagcctatgggagcaacaggtgtgaacccacagcttgcttccaagcagagtatggtcaactcattgcccaccttccctaccgacatcaagaacacaagtgtgactaacgtgcctaatatgtcccagatgcagacgagcgtcggaattgttcccacacaggcgattgccaccggacctactgccgaccccgagaaaaggaaactgatccagcaacagctggtgctccttctgcatgcccacaaatgccaacggagagagcaggcaaatggcgaagtgagagcctgctccttgccacactgtcgtacaatgaaaaatgttctgaaccacatgactcattgccaggccggaaaagcttgtcaggcaattctgggcagtcccgcttcaggaatccagaatacaattggcagtgtggggaccggacaacaaaatgccacaagcctgtctaaccctaatccaattgacccaagcagtatgcagagggcttatgcagccctggggcttccttacatgaaccagccgcaaactcagctccagcctcaggtgcctggccaacagcccgcacaaccacagacccatcagcagatgagaaccctgaatccactcgggaacaatccgatgaatattccggctgggggaattaccaccgaccagcagccccctaacttgatatccgaaagcgccctccccactagcctgggagcgacaaaccccctaatgaacgacgggtcaaactccggcaacatcgggactctttcaactattcctactgccgcacctccatcaagcacgggagtaagaaagggatggcacgagcatgtgacacaggacttgcggagccatctagtgcacaaactggttcaggcaattttcccaaccccagaccccgcagccctaaaagaccgtagaatggaaaatctggttgcctacgccaagaaggtggagggtgatatgtacgagtcggccaactctcgggatgaatactatcacctgctggccgagaagatctacaagatccagaaagagctagaggagaaaaggcggtctcgacttcacaagcagggaatccttggaaaccagcctgcgctgccagcacctggggctcaaccgcctgttatccctcaggctcaaccagtcagacctcccaacggccctctgagcttacctgtgaataggatgcaagtcagtcaggggatgaattcatttaaccccatgtccttaggaaatgtgcaattgccacaagcccctatgggcccaagggctgcgagcccgatgaaccactcggtgcaaatgaacagtatgggcagcgtgcccggaatggccatttccccctcacggatgcctcagcctcctaacatgatgggggcacacacaaataacatgatggcgcaggccccagcccagtctcaattcctacctcagaatcagtttccgagttcttccggagctatgtccgttggaatgggacagccaccggcacaaaccggagtgtctcagggtcaggtgcccggagccgcactgccaaaccccctgaatatgttaggtccacaggcctcccagctgccttgtcctcccgtcacccagagcccattgcacccaacacctccccctgcctctactgctgccggtatgccaagcctacagcacacaacgccccctggcatgacacctcctcagcccgcagcaccaacacagccatccacgccagtgtcgtcatctggacagaccccaacgccaacaccagggagcgtaccctccgctactcagacccagtctacacccacagtacaagcagctgcgcaggcgcaggttactccacaacctcaaacccctgtccaacctccatcggtggccactcctcaatcatcccagcagcagcccacccccgttcacgcgcagcctccaggaacgcccctttctcaggccgcagccagcattgacaaccgcgtgcctactccttcatccgtagcctccgccgaaacaaattcccagcagcccggtcctgacgttcccgtgttggagatgaaaactgaaacacaagcggaggacacagagcctgacccaggggaaagtaagggcgaacccaggtcagaaatgatggaagaggatcttcaaggagcttcccaagtgaaggaggaaaccgacattgctgagcagaaatccgagcctatggaggtggacgagaagaaacccgaggtaaaggtggaagttaaagaggaagaagaatcctcgtccaacggaactgcttcccagtctacatcaccctctcaacctaggaagaaaatctttaagccggaagagctgaggcaagcactcatgccaacactggaggcactgtaccggcaggaccctgaatccctgcctttccgtcagcctgtggacccacagctgcttggcatcccagactatttcgacatcgtgaagaatccgatggacctatctacaattaaacggaaactggacacagggcagtatcaggagccatggcagtacgtggacgacgtctggttaatgtttaataacgcctggctgtataaccgcaaaacatctagggtctacaaattttgttcaaaattggccgaagtcttcgaacaggagattgaccctgttatgcagagcctcggatactgctgcggcaggaaatacgagttttcgccgcaaactctctgctgctatggtaaacagctttgtacaatacctcgggatgcggcatattatagttaccagaatagataccacttctgcgagaaatgcttcaccgaaatccagggtgagaacgtgacactgggagatgacccgagccagccgcagaccacgatctccaaggatcagttcgaaaagaagaaaaacgacaccctggacccagaacctttcgtggattgcaaagaatgtggtcggaaaatgcatcagatctgtgttctgcattatgacattatttggcctagtggtttcgtgtgcgacaattgcctaaaaaagacaggcagacctcgaaaggaaaataaattttctgctaagcgactgcagaccactcggctgggcaaccacctggaggatcgcgttaataagttcctgagacgccagaaccatcccgaggctggcgaagtgtttgttagggtggtcgcatccagcgataaaaccgtggaggtgaagccgggtatgaaaagcagattcgtggacagcggcgagatgagcgaaagctttccttaccggaccaaagccttatttgcttttgaggaaattgatggagtggacgtatgtttttttggcatgcacgtccaggaatatggttctgactgtccacctcctaataccagacgggtgtatatttcttatctggattcaatacattttttccgacctcgatgtcttcgtactgctgtgtaccacgagatcctgattgggtatctggagtacgtgaagaaactcggttatgtcacggggcacatttgggcgtgccccccatcagaaggcgacgattatatctttcactgtcaccctccagaccagaaaattcccaaacccaagaggctgcaggaatggtacaaaaaaatgctggacaaggcctttgctgaacgtatcattcatgactataaagatatctttaaacaggctactgaggataggttgacgtcagcaaaagaactgccttatttcgaaggggacttctggccgaatgtactcgaggaatccattaaggaactagaacaggaggaagaagaacgaaagaaggaggaatctactgccgcaagtgaaacgaccgaaggaagtcagggcgacagtaaaaacgctaaaaagaaaaataacaaaaagacaaataaaaataaatcctccatcagccgtgcaaataagaaaaaacccagcatgcctaatgtcagtaacgacctgagtcagaagctatatgctactatggaaaaacataaggaggtgtttttcgtgatacacttgcacgcgggtccagtaattaacaccctgccacccattgtcgaccctgacccactcttgagttgtgacctaatggatggtagagacgctttcttaactctggcccgagataaacactgggagttctcctcactgagaaggagcaagtggtcaacgctgtgtatgctcgtggagctgcatacacagggccaggaccgcttcgtgtatacctgtaacgaatgcaaacatcacgttgaaaccaggtggcactgcacagtgtgcgaggactacgacctgtgcattaattgctacaacacaaagtctcacgcacacaagatggtcaagtgggggctcggactcgatgacgaagggtcctcccagggtgagcctcaatcgaagagccctcaggagagccgaagactgtctatacaacggtgtatccagtcactggttcatgcctgtcaatgtcggaacgctaactgctccctccccagctgccagaagatgaagcgggtggtacagcacaccaagggatgcaagcgcaagaccaacgggggttgtcctgtatgcaagcagctgatcgctctgtgctgctaccatgcaaagcactgtcaggaaaacaaatgccctgtccctttctgcctgaacattaagcacaaactgagacaacagcaaatccagcaccgactgcagcaagctcagctgatgcgaaggcggatggccacaatgaatactagaaacgtccctcaacagtccctgccttcgccaacatctgccccacccggaacccctacacagcagccatcaacaccacagactccacagcccccagctcagccccaaccctcacctgtgtcaatgtcaccggcaggattcccgtccgtggcaagaacacagcccccaaccacagtgtccaccggaaagccaacatctcaagtgcccgcaccaccacccccagctcaaccgcctcctgcggctgtggaagcagccagacaaatcgagcgggaagcccagcagcagcagcacctttaccgcgtgaatattaacaacagtatgccacctggacggaccggcatgggcacccccggaagccaaatggcgcctgtatctctcaatgtacctcgtccgaaccaggtctccgggcctgtcatgccgtcaatgcctcccggacagtggcagcaggctcctttgccccagcaacaacctatgccaggcctgccacggccagtgatcagcatgcaggcccaggccgcagtagccggacctcgcatgccttccgttcagcctcctagaagtatctccccaagcgcattacaagatctacttcgcacacttaaaagccccagctcccctcagcagcagcagcaggttctgaatatactgaaaagtaaccctcagttgatggcagcttttattaagcaaagaacagctaaatatgtggctaatcagccagggatgcagccccagccaggtctgcagtcacagccaggcatgcagccccaaccgggtatgcaccaacaaccgagtctgcaaaacctaaacgcgatgcaagctggcgtacctcgtcccggagtgccaccacaacagcaggcaatgggcggtctgaacccacaaggccaggcccttaacattatgaacccaggccacaatcctaatatggcaagtatgaacccacagtatcgggagatgctgcgaaggcaactgctgcagcagcagcagcagcaacagcaacagcaacagcaacagcagcagcagcagcagggtagtgcagggatggcaggtggcatggctggacacggacagtttcagcagccccaaggccctggaggttatccacctgcgatgcagcagcagcagaggatgcaacagcacctcccgcttcagggatcatcgatgggtcagatggccgctcagatggggcagctggggcagatgggacaacccggactgggagctgattccacccctaacatccagcaggccttgcaacaacgaatactgcagcagcaacagatgaagcaacagatcggtagtccagggcagccaaaccccatgtcgccacagcagcatatgctgtcaggacagccacaggctagccacttgccaggacagcagattgctacctcattgagcaaccaggtcaggtcgcccgcaccagtgcagagtcctcgaccacaaagccaacccccacacagttctccatccccaaggatccagccgcagcctagtccccatcatgttagcccacaaaccggctctccccaccctggcctcgccgtaactatggccagctcgattgaccagggccatctcggcaatccagagcagtcagcgatgctcccccagcttaacactcccagcaggagcgcactgtcttcagagctgagcctggtcggcgacactaccggcgacaccttagagaagttcgttgagggattgta

SEQ ID NO: 219350 - DNA, 1782 bp, Artificial Sequence
  Description of Artificial Sequence: Synthetic coding sequence
atggctactagtaacaaccctaggaagtttagcgaaaaaatcgcactgcacaaccaaaaacaggctgaagaaactgcagcgtttgaggaggtgatgaaagacctgtccttgacgcgagctgcgagactgcagcttcagaaatcacaatacctccagctgggaccctccagaggtcaatactacggcggatccctcccaaacgtcaatcagatcgggtccgggactatggatctgccattccagacaccgtttcaatctagcggtttagacacttcccggaccaccagacatcacggcttggtcgaccgcgtgtaccgggagcgaggtcgattgggttctcctcaccggcgtccgctgagcgttgataaacacggcaggcaggctgattcctgcccatatggaacaatgtacctgagcccgccagctgatacttcctggaggagaacaaatagcgattcagccctgcatcagtcaaccatgactccaacgcagccagaaagcttcagttccggctctcaggacgtacaccaaaagcgagtgctgttgctgaccgtccccggaatggaggagactacgagcgaagccgataagaacctgagtaagcaggcatgggacacaaagaaaactggcagccggccaaagagttgcgaggtacccggtatcaacatcttcccatctgcggatcaagagaataccactgcattgatccctgcgacacataataccggtggcagtctaccagacctgactaacattcatttcccttcccctttgcctacccccctcgatcccgaggaacctaccttccccgctctgtctagctcaagttcaactggaaacttagcagctaatctcacccacctgggcataggaggcgctggccaagggatgtctacacccggttcttcaccgcagcacaggcccgctggggtaagtcctctttccttgagcaccgaagctcggcgacagcaggcgtctcccacactctcaccattgagccccattacacaggctgttgcaatggacgctctgagtctcgagcagcagcttccatatgctttttttacccaggcgggttcgcagcagccccctcctcagccacaacccccaccgcctcccccacccgcttctcaacagcctccccctccaccacccccacaggctcccgtgcgcctgcctcccggaggacccctgctgccatctgcctcccttacccgcggaccacagcccccaccccttgccgtgacggtgccatctagcctccctcaaagtcccccagagaatcctggccaaccatctatggggatcgatatcgcatccgcccctgccctgcagcaatatcggaccagcgccggatctccagcgaaccagtctcccaccagcccggtgtctaaccagggattcagccctgggagctctccccagttagaacagttcaacatgatggagaatgcgataagctcttcctcattatatagccctggcagcacgctcaattactcacaggcagccatgatgggtttgaccggatcgcacggctctctcccagatagccagcagcttggttatgccagccacagtggcattcctaacattattctcaccgtcaccggtgagagtcccccatctctctccaaagagcttacctcacacaggggacatctgcctgacggcccacctgtctccggacacgctggcaccctacctctgtcgcgacctgacggcgcaagccctgcaaggggccgaccatgcagcgtgcccaggcagaggcctagtttatag

SEQ ID NO: 219351 - DNA, 1905 bp, Artificial Sequence
  Description of Artificial Sequence: Synthetic coding sequence
atggccacctccaataaccctagaaaattctctgagaaaatagctcttcataaccaaaaacaggcggaagagacagcggcatttgaggaggtcatgaaggatctatctctcaccagagcagcccgattacaattacaaaagtctcagtatctgcagctagggcctagtaggggccagtactacggcggatccttacccaacgtcaatcagataggatcaggaaccatggatctgccttttcagacaccgtttcagagctcaggcctagatacttctcgcactacccgacaccatggtctcgtggaccgagtttatcgggagcggggtagattgggcagcccgcaccgtcggccactcagcgtcgataagcatggtagacaggcagattcctgcccttacggcactatgtacctgagtccccctgctgacacttcctggaggagaactaattccgattccgctctgcaccagagcacaatgacaccaacccaacccgagtccttttcctcaggatcccaagatgtgcaccagaagcgcgtgctgctgctaactgtgcccggaatggaagaaacaacttccgaagctgataaaaacctctccaagcaggcgtgggataccaagaaaaccggatcgcggccaaaaagctgcgaggtcccaggtataaatattttcccatccgccgatcaggaaaacacaacagctctgattccggctacacacaacacaggaggatccctccctgacctcacgaatatccactttccgtctcctctccctacaccgctggacccggaggagccaacattcccagcattgagttctagtagctctactggcaatctggcagctaatctaacccatctgggcataggtggcgctggacagggaatgtccacaccgggatcatccccacaacatcgccctgccggtgtatccccattgtcgctgtcgacagaagctagaagacagcaggcgtccccaaccctctcacccctgtcacctattacccaggccgtcgctatggatgccctcagccttgagcagcaactgccatatgctttctttacacaggccggttctcagcagccgccacctcaacctcagccaccacctcccccaccaccagcttcacagcaaccaccacccccacctccccctcaagcccctgtccgacttcctcctggcggacccttactccctagcgccagtctcacgagaggcccacaacctcccccattggccgtcacggttccaagcagcctaccgcagtcaccccctgagaacccagggcagccctcgatgggcatcgatattgcatctgcacctgctctgcaacaatataggacctccgctggcagccccgcaaatcagtctccaacctctcccgtgtctaaccaaggatttagccctggctcaagcccacagcatacatcaacgctaggcagtgtcttcggggatgcctactatgagcagcagatggcagcacgccaagctaacgccctatcgcaccagctggaacaattcaacatgatggaaaacgccatttctagctcctccttatacagccctggttccacgcttaactattctcaggccgcaatgatgggtctgacaggcagccacggttcactccctgactctcagcaattaggttacgcaagccattcaggaatacccaatatcattttgacagtcaccggagagtcgcctccatcgctgtccaaagaattgacctcttcactggctggggtgggggacgttagttttgattcggactcgcagttcccgcttgatgaattaaagatcgaccctctcaccctagacggattacacatgctcaatgacccagacatggtgcttgcagaccctgcgaccgaagacaccttcaggatggatcgcctttag

SEQ ID NO: 219352 - DNA, 1953 bp, Artificial Sequence
  Description of Artificial Sequence: Synthetic coding sequence
atggccacctcaaataatcctcgcaaatttagtgagaagatagcccttcacaatcagaaacaagcagaagaaacggcggctttcgaggaggtgatgaaggatttgtctcttaccagagctgctcggctacaactgcagaagagtcaatatcttcagctgggacccagccgcggacaatactacggaggctctctgccgaacgtgaaccaaattggctcaggtaccatggacctgccctttcagccttctggctttctcggagaggcactcgcggctgctcccgtctcgctgaccccttttcagagctcaggcctcgatacctctcggacaaccagacaccatggtctggtggatcgggtttaccgagagagggggcgactggggagcccccaccgaaggccattgagcgtggataagcatggtaggcaggctgactcgtgtccctatggcacaatgtatctgtctcccccagccgatacaagctggaggcggaccaatagcgattccgccctccatcagtcaaccatgacccctacgcagcccgagagtttcagtagtggatctcaggacgtgcaccagaaacgcgtactactgctgactgtccccggtatggaagagaccacgagcgaggcagacaaaaatctgagtaagcaggcctgggacaccaaaaaaacagggagtcgtcctaagagttgcgaagtgccaggcattaacatatttccctccgcggatcaggagaacactacagcactgataccagcgacgcataacactgggggaagcttgccggatctgactaacatacacttccctagccctctccctacccctttagaccccgaagaaccgacattccccgcactttcatcaagctcttcgaccgggaaccttgctgccaacttaacccacctggggatcggcggagcaggtcaaggaatgagtacccccggaagctccccgcagcatcgcccagccggagtgtcacctctgtcactttctaccgaggccagacgtcagcaggcctctccaacgctttccccattaagccctatcacccaggccgttgctatggatgctttgtcactggagcagcagcttccctatgcgttcttcactcaggccggatcacagcagcctcctccccagccacaacccccacccccaccccctccagcatcccagcagccaccgcctcctccacccccacaagctcccgtcaggctcccacccggagggccactactgccaagtgcctccctgaccaggggacctcagccacctcccctcgctgtgacagtgcctagctctttaccacagagtcctcctgagaaccctgggcagccttcaatggggattgacatcgcctccgctcctgcactccaacaatatcgtacatcagccggatctccggcaaaccagtcccccacatctccggtgagtaatcagggattttctcccggtagttcaccacagcatacctcaaccctgggaagcgtgtttggggatgcatactatgaacaacaaatggccgcacgacaggccaacgccttaagccatcagttggaacagttcaacatgatggagaatgccattagcagttccagtctctattcacctggctccacgcttaattacagccaagctgccatgatgggactaactggctcccacggaagcctcccagactcacagcagctggggtatgcctctcattcaggtatccctaacataatcttaactgtaactggcgaatctccccctagcctgagtaaggagctgacatcaagtctcgcaggcgtcggggatgtctctttcgacagcgattcacagttccccctggatgaactcaagattgatccattgacactcgacgggctacacatgctcaatgatcctgacatggtactggctgatccggcaaccgaggataccttcaggatggaccggttatag

SEQ ID NO: 219353 - DNA, 2082 bp, Artificial Sequence
  Description of Artificial Sequence: Synthetic coding sequence
atggcgacttccggagctaacggccctggtagcgcaactgcctccgcgtccaacccgcgtaaattcagcgagaaaatcgcgttacagaagcagcgtcaagcggaggagaccgccgcattcgaggaagtgatgatggacattgggtcaaccaggctgcaggcgcaaaagctgagacttgcttatacccgctctagtcattatggcggatcactccctaacgtgaaccagattggatccggcttggccgagttccagagtccgctgcacagcccactcgatagctcacgcagtaccaggcatcatggtctggtcgaaagggttcaacgcgacccgaggagaatggtaagcccactccggagatacacacggcacatcgacagctctccttactcgcccgcttatctgtctcctcctcccgagagttcttggcgccgaacaatggcatggggcaatttcccagccgagaagggccagttgttccgcctgccatccgccctaaatcggacgagctctgattccgcactgcatacgagtgtgatgaacccaagcccccaagatacatacccgggaccaacaccacctagcattttgccctcacggagaggcggaattctggatggggagatggatcctaaagtgccagccatcgaggaaaacctgctggatgataagcatttgctgaaaccttgggacgccaagaagttgtcttctagcagctcaaggccccgttcgtgcgaagtacccggaatcaacattttccctagcccagaccaacccgctaatgtgcccgtgcttcctcccgctatgaacaccggcggttcactccccgatttgacaaatctgcactttccccctcctttaccgacacccctggaccccgaagagactgcctaccctagcctaagcggtggtaatagcacaagtaacctaacccatactatgacccacctggggatatccagaggcatgggactcgggcctgggtacgacgcgcctgggcttcactcccccctctcccacccatccctccagagcagtttgagcaaccccaacttacaggccagtctatcctccccgcagccgcagttacagggctcccatagccatccctctctgcctgcctcttctctggctcgacacgtcttacctaccacaagcctcgggcatccctcgctgtccgctcctgctttgagcagttcatcctcatcaagctccacatcctcccctgtgcttggtgccccatcctaccccgcaagtacgccgggagcgtcccctcaccatagacgggtacctctgagccccctcagtcttctcgcagggcctgcagatgccaggcggtcacaacagcagttaccaaagcagttctcgcccactatgtcccctacactgagctccattacacagggcgtgccactcgatacctccaagctctctaccgaccagcgtctgcctccttatccatattcctcaccatcactcgtgctgccaactcagccgcatacacctaagagcctgcagcagcccggattgccaagtcaatcttgctcagtgcagagttcagggggacagcctcccggtcggcagtcacactacgggacgccgtacccccctggaccctcaggacacggtcagcagtcctaccaccgacccatgagcgactttaacctggggaatcttgagcagttctcaatggagtcccccagcgccagccttgtcctggatccgccaggcttcagtgagggccctgggtttcttggcggtgaaggacctatgggaggcccacaggatccccacaccttcaaccatcagaatctgacccactgctcccgacatggttcgggtcccaacataattctgacgggcgattccagcccaggcttcagcaaagaaatcgccgctgccctagcgggtgttccaggctttgaagtttcagcggctggcctggagctaggtctcgggctggaggatgaactccggatggaaccacttggactggaaggcctgaacatgctgtctgacccctgtgccctgttgcctgatccagccgttgaggagtcctttagatctgaccggcttcagtag

SEQ ID NO: 219354 - DNA, 1860 bp, Artificial Sequence
  Description of Artificial Sequence: Synthetic coding sequence
atggcagcgtcccccggatccggctctgctaatcctaggaagttctccgagaaaatcgccctccacacacaaagacaggcggaagagacccgggcttttgagcagctgatgaccgacctgactttgtcaagggtgcagttccagaaattgcagcagctgcggcttacacagtatcatggcggatccctgccgaatgtgtcccagctgagatcttccgcctctgaattccagccctctttccaccaggcagacaacgtccggggaactcggcatcacggccttgttgagagaccatcacggaatcgtttccacccgctgcacagacggtcaggagataagcctgggagacaatttgacggctctgcctttggggcaaactactcgtcgcagcctctcgacgaatcgtggcctcggcagcagccaccctggaaggacgagaaacaccccggattcaggctgacatcagcactgaacagaacaaatagtgattccgcactgcacacttcagctttgagcactaagccccaggatccttacggcggaggaggtcagtccgcctggccagccccttatatgggcttttgcgacggagaaaacaacggtcacggcgaggttgccagctttccaggaccattgaaggaggaaaaccttctcaatgttccaaagccactgcctaaacagctatgggaaactaaagagatccaatccctttccggccgtccaagaagttgtgatgttgggggtggtaatgccttcccacacaacggacagaacctgggacttagcccctttctcggcaccctgaataccggcggatctctcccagaccttacgaacctgcactattcaacccccctgccagcaagcctggacacaacggatcatcatttcggctcgatgtccgtggggaactctgtgaacaatattccggctgctatgacacatctcggaattagatcctcgagcggtcttcaatcatctcgcagtaacccatccattcaggcaacactgaataagaccgtcctgtccagttccttaaacaatcacccacaaactagtgtgcccaacgccagtgccttacatccatcgctgaggctgtttagcctatctaatccaagcctgtcaactacaaatttatcagggccatccaggcggcgacagccccctgtaagtcctctgaccttgagccccggaccggaagcgcaccaggggttttcacggcagctgtccagcaccagcccactcgccccataccccacaagtcaaatggtgtcatctgatagatcacagcttagcttcctgccgacagaggcccaagctcaggtaagccctccacccccttacccagcccctcaggagctgactcagccactcttgcagcagcctcgtgctcccgaggcccctgcacagcaacctcaagccgcaagctctctgcctcagtcagattttcagttattgccagcccaaggtagctctctaacaaacttttttccagatgtgggatttgaccagcagtcaatgcgacccggaccagcatttccgcagcaggtccctctggtgcagcaaggcagccgggagttgcaagactcatttcacctgcgccctagcccctactcaaattgtggctccctgccaaacaccatcctccccgaagacagctccacaagcctctttaaggatctcaacagtgcactggccggtctcccagaagtgtccttgaacgtagacacccctttccctttagaggaggaacttcaaatagagcccctcagcctggacggcctgaatatgctaagcgactcctccatgggacttctcgatccaagtgttgaggagactttccgcgcagacagactatag

SEQ ID NO: 219355 - DNA, 1857 bp, Artificial Sequence
  Description of Artificial Sequence: Synthetic coding sequence
atggccgctagcccaggtagcgggtccgctaaccctcgtaagttttccgagaaaattgccctgcacacacagaggcaggccgaggagacaagagcattcgagcagctgatgaccgatttgactttgtcgagggtgcagttccagaaactacaacagctgcgtttgacccagtatcacggagggtccctgcccaatgtgtcccagcttaggtcatctgcatctgaattccaaccctctttccaccaggccgataacgtaagaggcactcggcaccacggtctggtggaaaggccgagtcggaaccggtttcaccctctgcaccgaaggagtggagataaaccgggtcgccagtttgatggatctgcgttcggcgcaaactactcttctcagcctctggacgaatcctggccccgacagcagccaccatggaaggacgaaaagcatcccggatttcgacttacttccgccctgaacaggaccaactctgacagtgcgctacacacatctgccctctccacaaagccccaggacccatacggagggggagggcagtcagcctggccggctccttacatggggttctgtgatggggaaaataatggtcacggagaggtagcatcttttcccggacccctcaaggaggaaaatttactgaatgtccctaagcccttgcctaaacaactgtgggaaacaaaagaaattcagtctctctccggcagacctaggagctgtgacgtggggggaggtaacgcctttcctcacaacggtcagaacctgggcctctccccctttctcgggacacttaataccggtgggtctctgccagatctgactaacttgcactactccactcctctccctgctagtctggatacaaccgatcaccacttcgggagcatgagcgttggcaattcggttaacaatattcccgcagcgatgacccatctcggcattcggagtagctcaggactccaatctagcaggtccaaccctagcatacaggctacactcaacaaaactgtgctgtcctcatcactcaacaaccatccgcaaacgtccgtgccaaatgccagcgcactgcatcccagcctcagactgttttccttatctaatccgtctctatcaaccacaaacctgagcggccctagtaggcgccgacaacctccagtgtcccctctcactttgagcccaggaccagaagcccatcaaggattctctcggcaactcagctccacctctcccctggcaccataccctacatcacagatggtgtcttcagaccgatcacagttatcttttttaccgacagaggcccaggcccaggtgtcccctccccctccctatcccgcacctcaagagctgacccagccgcttctgcagcagccaagggctccagaagcacccgcacaacaacctcaggcggcaagtagccttccgcagagtgatttccaactgctccctgcccaagggtcatcgctgacaaatttttttcctgacgttggcttcgatcagcagtctatgcgccctggtccagctttcccacagcaggtgcccctggtgcagcaagggagcagggaattgcaagatagcttccacctgcgccctagcccttacagtaactgcggatcattgccaaatactattctaccagacagctcaaccagtttgttcaaggaccttaactccgcgctggccggtcttccggaggtctcgctgaacgttgacacacctttccccctcgaggaggagctccagatcgagcctctctccctggacggactgaatatgcttagtgattcatctatgggccttctggatccttccgtggaagagacatttagagccgatcggctgtag

SEQ ID NO: 219356 - DNA, 1749 bp, Artificial Sequence
  Description of Artificial Sequence: Synthetic coding sequence
atgaccgacctaactttatcgcgggtgcagtttcagaagcttcagcagctaagactgacccagtaccatgggggatctctccccaacgtgtcccaactgaggagcagcgcttccgagtttcagccatccttccatcaggcagataacgttcggggaacaaggcatcatggtctggtggaacgaccttcccgtaatcggtttcatcctctgcacagaaggagtggcgacaaaccgggtcgtcaattcgacggcagtgctttcggtgctaactactcttcccagccgctggatgaatcgtggccccgacagcaacccccttggaaagacgagaaacatcctggctttaggctgacgtccgctttgaaccggactaattctgatagtgccctgcacacgtctgccctttctacaaaaccccaggatccgtatgggggaggcggtcagagtgcgtggcccgctccctatatgggattttgtgacggggagaacaatggtcacggcgaggtggcctcctttccaggtcccctgaaagaggagaatctgcttaacgtgccaaagccactccccaaacagttgtgggaaaccaaggagattcagagtctgtcaggcagaccaagatcctgtgacgtcggtggcggtaatgcctttcctcacaacggtcagaatctgggcctgtcaccatttctgggcactctgaataccgggggatctctacccgatttgacaaatctacactactcaacaccgctacctgcctcactggatacaaccgatcaccatttcgggtctatgtctgtcgggaattctgtgaacaacatccccgcagccatgactcacttaggcattaggtcctcatcaggccttcagagcagtaggagcaacccttcgatacaggccacactgaacaaaacggtgttatcttctagtctgaacaatcatcctcagacaagtgtgcccaacgcgtctgccctgcatccctcattgagactgttttctctgtccaatccttccctcagcacaaccaacctgagcggacccagccgtagacggcagccgcctgtgagtcctttgaccttaagtcccggaccagaagcgcatcagggcttctcccggcagctgtcttccactagccctctcgccccttacccaactagccagatggtgtcatcagataggagtcaactgtccttcctgccaaccgaggcccaggcccaggtcagtccaccccctccttatcccgctccccaagagctgactcagcccttgctgcagcagcccagagctcccgaagccccagcacaacagcctcaggccgcatcctccctgccccagtccgacttccaactcttgcctgcccagggatccagtctcacgaattttttccccgatgtcggatttgaccaacagtccatgcgcccaggccctgcctttccacaacaggttccccttgtgcagcagggcagcagggaactgcaggattcatttcatcttaggccctccccttactccaactgtgggtcactgccaaataccatcctcccggatagctcaaccagcttatttaaggacctgaattctgcgctggctggactgcctgaggtatcactcaacgtcgacaccccattccccctggaggaggagctgcagattgagcctctgtctcttgacggtttaaacatgctgagtgattccagtatggggctgttggatccctctgtggaggaaaccttccgggcagacaggttatag

SEQ ID NO: 219357 - DNA, 672 bp, Artificial Sequence
  Description of Artificial Sequence: Synthetic coding sequence
atgacttggcgacatcatgtcaggttacttttcacggtgtcactcgccctgcagattattaatctgggcaacagttatcagcgggagaagcacaatgggggacgggaggaagtaaccaaagttgccactcagaaacacaggcagtctcctttgaactggaccagctctcatttcggtgaagtgacgggctcagcagaaggctggggacctgaagagcctctgccctactctagggccttcggtgaaggggcaagcgctagacccagatgctgccgtaacgggggtacatgcgtcctcggttccttctgcgtgtgtcccgctcatttcacagggaggtactgtgaacatgatcagaggcggagtgaatgtggagccctagagcatggggcatggaccttgcgggcttgtcacctgtgtcgctgcatcttcggagcattgcattgcctgcccctccaaacacccgatagatgcgatcctaaggactttctggcgagtcacgctcacggcccttctgctggtggagccccttcccttctgctactcttgccatgtgccctcctgcaccggctattgaggccagacgcacctgcccacccaaggtctctggttcccagcgtattgcaaagagaaagacggccatgcggtcggcctggcctcggccacagactgtag

SEQ ID NO: 219358 - DNA, 2511 bp, Artificial Sequence
  Description of Artificial Sequence: Synthetic coding sequence
atgacggcaaccgtggaaaatctcaccttccagaaggataccctggggaacgcggtggataagaatcgcagacacggctcgacagagccattggtcctcgcttggtcttcccagttccgacggctcacatggggctgtgccctggatgcgctgcacaggtccccttgcgtggctgcctcgcagcacggagtgacgcatctcatccggtcttcccgcacgccacactcaacccgctgtagaaaagaagacgctcagccaggccatcatggtaacggggcagctagtgtcaccgcgcaggccaggggccagagatccgtgctccaggtcccgcttcccgttcctcgatcctgcctgttctctgaatcgttcgtcgtttccgtgagctcgcagtcccgctttcttgctagtgtgcccggaacaggtgttcagcgtagtacggccgctgacatggctgcaagcacggccgctggcaaacaaagaatcccaaaggtggctaaagttaagaacaaggcacccgctgaagtccaaattacagctgaacagctgttaagagaagccaaggagagggaattggaactgctgcctccaccaccgcagcagaagattactgacgaagaagagctcaatgattacaagctgcggaagcggaaaacatttgaagataatatcagaaaaaacaggactgtgatcagtaactggattaaatatgctcaatgggaggaaagcctgaaggagatccagcgggcaagaagcatctacgaaagagccctggacgttgactatcgaaacataactctatggcttaaatatgccgagatggaaatgaagaacagacaggtcaatcatgcccgtaacatctgggacagggctatcacaaccttgccacgagtgaaccagttctggtacaagtacacttatatggaggagatgttgggcaatgtggctggcgcaagacaggtgttcgagcggtggatggagtggcagcccgaagaacaggcgtggcactcctatattaatttcgaattaagatacaaggaggtcgaccgagccaggacaatttacgagcggttcgtcctggtccatcctgatgtaaaaaattggatcaaatacgcaagatttgaggagaagcacgcttatttcgcccatgcacgaaaagtctacgaacgggcagtcgagttttttggagatgagcacatggatgagcacctctatgtggcattcgctaaattcgaagagaaccagaaagagttcgagcgagtccgcgttatctataagtacgcccttgacaggatctcaaagcaagatgcccaggaactgttcaagaattataccattttcgagaaaaaattcggtgaccgcaggggcattgaggacatcattgtctccaaaagaaggttccagtacgaagaggaagtgaaagctaaccctcacaattacgatgcctggtttgactacctgcgcctggtagagtctgatgctgaggctgaagccgtgcgtgaggtttatgaacgcgctatcgccaatgtgcctcccattcaagagaagagacactggaagaggtacatctatttgtggatcaattatgctctatacgaggaactggaggcgaaagacccagagcggactaggcaggtgtatcaagccagcctcgagctcatccctcacaagaaattcacattcgccaagatgtggatcctgtatgcccagtttgaaataagacagaaaaacctttccctggcacgcagggcattggggacatccattgggaaatgccctaaaaacaaactgttcaaggtctacatcgagcttgagctgcagttaagagaattcgaccggtgcagaaaattatacgagaaattcctggaatttggtccggaaaactgtacctcttggatcaagtttgcggagttggagactatcctcggggatatcgaccgggctcgtgctatttacgagcttgcgatctcgcagccaaggttagacatgccagaggtactgtggaagagttacattgatttcgaaatcgagcaggaggaaacggagaggaccagaaacctttatcggaggcttctccagcggacccaacacgtgaaggtatggatctcttttgctcagtttgagttatcatccggcaaagaaggatccctgactaagtgtaggcagatctatgaagaagcaaacaagacaatgcgtaactgcgaggagaaggaggagcggctcatgctcctcgaaagctggcgtagttttgaggaggagttcggaaccgcttcagataaagaaagagtggacaaactcatgccagagaaagtgaaaaagagaaggaaagttcagaccgatgatggatctgatgccggttgggaggaatactttgattatatcttcccagaggacgccgcaaatcagcctaatctcaagctcctggccatggctaaactgtggaaaaagcagcagcaggaaaaggaggacgctgaacaccatccagatgaagacgtggacgagagtgagagttag

SEQ ID NO: 219359 - DNA, 2547 bp, Artificial Sequence
  Description of Artificial Sequence: Synthetic coding sequence
atgacagccacagtggaaaatctgactttccaaaaggataccctcggtaatgctgtggacaaaaatacatctcgactcgagcttcgctcctactcccttgcgggaagacacggctccactgagcccttggtgctggcctggtcctcccagttcagaaggctcacttgggggtgcgccttagacgcgctgcacagatcgccctgtgttgctgcctcccagcatggggttacccacctgataaggtcttcacgcacaccgcacagcactaggtgtcggaaggaagacgctcagcccggacatcacggaaatggtgcagcaagcgtcacagcccaggctcgaggccaaaggtccgtcttacaggtacctctgcccgtgcccaggtcctgcttattctccgagagtttcgtcgtcagcgtctcgtcccagagtagattcctggccagcgtccctggaaccggcgtccaaagatccacggccgcagacatggctgcaagcacagccgctggaaaacagagaattcctaaggtggctaaagtcaaaaataaggctccggctgaggtgcaaattaccgctgagcagcttctgcgcgaggccaaagagcgcgaactcgaacttctcccgcctcccccacagcaaaagattactgatgaggaggaactaaacgattacaagttaagaaaaagaaaaactttcgaggataacatccgcaaaaataggactgtgatctccaactggatcaagtacgcccaatgggaggaaagcttaaaggagatccagagggcacgcagcatttacgagagggccctcgatgtggactatagaaacattacattgtggctcaagtacgcagagatggaaatgaaaaatcggcaggtgaatcatgccaggaacatatgggatagggccatcacaaccttgccaagagtgaatcagttctggtacaaatacacctatatggaggagatgctaggtaatgtggctggggcacggcaggtctttgagaggtggatggagtggcaaccagaagagcaggcttggcatagttacatcaactttgagttgcgctacaaagaggtggaccgggcacgcaccatctatgagcgcttcgtgctcgtccacccagacgtaaagaactggatcaagtatgcaaggtttgaggaaaagcatgcatacttcgcccacgcccgaaaggtctatgaaagggccgtggagtttttcggggacgagcacatggacgagcacctctatgtggctttcgccaaatttgaagagaatcaaaaagagttcgagagagtgagagtcatctataaatacgctcttgacagaatttccaagcaagacgcacaagagctgttcaagaattacactatatttgaaaagaagttcggcgaccgcaggggcatagaggacataattgtttcaaagagacgattccaatatgaggaagaagtaaaagcaaatccccacaattacgatgcttggtttgattatctgcgtctggtggagagtgacgctgaagctgaagcagtccgcgaagtgtatgagagggccattgcaaacgtgcctccaatacaggagaagcgtcactggaagcgatacatctatctgtggattaattacgccttgtacgaggagctggaagccaaggacccagaaagaactaggcaggtctaccaggccagcctcgagttaatcccccacaaaaaatttaccttcgccaaaatgtggatcctctacgcccaattcgagatccggcaaaaaaacctgtctctggctaggcgggctcttggaacaagtatcggcaaatgtcccaagaataaacttttcaaggtgtatatcgaactggaactgcagcttagggagttcgatagatgtcgcaagctctatgagaaatttcttgagttcggacctgagaactgtacgtcatggatcaaatttgctgaactcgaaacaatcctgggcgatatcgacagagcacgcgctatttacgaactggctatttcacaacctaggctggacatgcccgaggtgctgtggaaaagctacatcgactttgagattgagcaggaggagaccgaacgcacccgaaatctgtaccgtcggttgttgcagcgaactcaacacgtgaaggtgtggatttcgttcgcccagttcgaattatcaagcggcaaagagggcagtctgaccaagtgtcgccaaatttacgaagaagccaacaagactatgcgcaattgcgaggagaaggaagagcggctcatgctgctggagtcttggaggtcattcgaggaggaatttggcactgccagtgacaaagaacgggtggataagctgatgcccgagaaagttaagaaacgccgtaaagttcagacagacgatgggtctgacgcgggatgggaagagtacttcgattacatttttccggaggacgccgctaaccagcccaacttaaaactcctcgctatggcaaagctatggaagaagcagcaacaggagaaagaggacgcagaacatcaccccgatgaagacgtggacgagtccgaaagctag

SEQ ID NO: 219360 - DNA, 7025 bp, Artificial Sequence
  Description of Artificial Sequence: Synthetic coding sequence
atgaaaaacatctactgtctgattccaaaactggtcaattttgccaccctggggtgtttgtggattagtgtggtgcagtgtaccgtactgaattcatgcctgaagagctgtgtaactaacttgggccagcagctggatctaggtacccctcacaatctgtctgaaccatgcatccagggatgccacttctggaattcagtggaccagaagaattgcgcactgaaatgtaacgacacatacgccactgtatgcgaaagggagtcctgcgaagtgggctgttcttccgcggagggcgcttacgaagaggaggtgttggaaaatgccgatttgcctactgctcctttcgcctcttccatcggtagccacaatatgacactgcgctggaagtccgccaatttttctggggttaaatacataatccagtggaagtacgctcaactgcttggctcatggacatacacaaagactgtgtcaaggcccagctatgtggtgaaaccgctgcaccccttcactgagtacatcttcagggtggtttggatatttacagcacagctgcagctgtactcaccaccgtctccttcttatagaacacacccccacggcgtgcccgagaccgcccctctgataaggaacatagagagctcaagccctgacacagtcgaggtgtcatgggatcctcctcagtttcctggtgggcctattttgggatacaacctgaggctgatctctaagaatcagaagctggacgctggaacacagcgaaccagcttccagttttactctactttacccaacacaatttataggttcagcattgccgcagtgaatgaggtcggcgaaggaccggaagccgagagctctattaccaccagctcctcagcagtccagcaggaggagcaatggctcttcctgagccggaaaacatcactgagaaagcggagcctcaaacatctggtggatgaagctcattgcctcagactggacgccatttatcacaatatcacaggcatcagcgtagatgtgcatcagcagatcgtgtatttcagtgagggcaccctaatctgggccaaaaaggctgcgaatatgtccgatgtgtctgatctccgaattttctacagaggcagtggactgattagctctatttccatcgattggctgtatcagcgcatgtactttattatggacgagcttgtgtgcgtttgcgacctagaaaattgctccaatattgaggaaattaccccacctagcatcagcgcgccacaaaagattgttgcggactcttacaatgggtacgttttctacctgctgcgcgacggcatatacagagctgacctgcccgttccaagtggtaggtgtgctgaggccgtccggatcgtcgaatcttgtaccttgaaggatttcgccattaagccccaggctaagcggatcatttatttcaacgacacagcccaggtgtttatgtccacgtttcttgatggcagcgcctctcacttaatcctgcccagaatccctttcgccgacgtcaagtcattcgcgtgtgagaataacgattttcttgttacggatgggaaggtgatctttcagcaggatgctctaagcttcaacgaatttatagtgggctgtgacttaagccacatagaggagttcggtttcggaaacctcgtgatcttcggaagtagttctcagctgcaccccctcccagggcgaccacaggagcttagcgtgctgtttggatcgcaccaggccttagtccaatggaaacctccagccctcgctatcggagcgtcaccctcagcctggcaaaactggacctatgaggtaaaagtgtccacccaggatcccccagaagtcacgcatattttcctgaacatctccggcaccatgttaaacgttccagaacttcagagcgcaatgaagtataaggtgagtgttagagctagcagtcctaagcggcctggcccttggagcgagcccagcgtgggaaccactcttgtcccagcatcagagcctcccttcattatggcggtgaaagaggacggactgtggtcaaagccattgaactcatttggccctggtgagtttctaagttctgatatcgggaacgtgtctgatatggactggtacaataactcactgtattattctgacactaagggtgatgtttttgtatggctgctgaacggcaccgacatctccgagaactaccatctcccttcaatagctggtgctggcgcattggccttcgagtggctggggcactttctgtactgggccggtaagacatatgtcattcagagacagagtgtcttgaccgggcacactgacatcgtaacccacgtcaagctattagtcaatgacatggttgtggacagcgtcggcggatatttgtattggaccacactgtactccgtcgaatctacacgtctgaacggagagagctcactggtcctgcagactcagccctggttttccggaaagaaggtgatagctctcactttggacctgagcgacggactgttgtattggctcgtgcaggattctcaatgtatccatctatacacggctgtgttgcggggtcaatcaaccggggatacaaccatcaccgagtttgccgcatggagcacctccgagattagccagaatgccttaatgtattattctggcagactcttttggataaacggctttaggatcatcacaacccaagaaatcggccagaagacgtcagtatcagtgctggagccggctagattcaatcagttcactataatccaaacatccctcaagcctctgcccggaaacttcagtttcactcctaaagttataccagattctgtccaggagtcctcattccggatcgaggggaacgccagcagcttccaaatcctgtggaatgggcctccagctgtggattggggtgtggtcttttacagtgtggaattctccgcgcactccaaattcttagcatctgagcagcactcattgcctgtctttacggttgaaggcctggaaccttatgcccttttcaatctttccgtgacgccgtatacctactggggaaaggggcctaagacaagtctgagcctgagggcccctgagacggtgccatctgcaccggagaaccctcggatatttatcctcccgagcggaaaatgttgcaacaaaaacgaagtggtcgtggagtttcggtggaataaacctaagcacgagaacggcgttcttactaagtttgagatcttctataacatctcaaatcaatcgattaccaacaaaacatgtgaagactggatcgccgtaaatgtaacaccttccgtaatgagcttccagttagagggtatgtcacctagatgctttatcgctttccaggtgcgggcatttaccagcaagggccctgggccttatgcggacgtggtgaagagcacaacatctgaaattaacccctttcctcatctcattaccctactagggaataagatcgtcttcctggacatggatcagaatcaggtggtctggaccttttcagctgaacgcgtaatttccgccgtctgctatacagcagacaacgagatggggtattacgccgagggggattccttattcttactccatctgcacaacaggagcagttccgaattgtttcaggactcgctcgtttttgacattactgtcatcaccattgactggatctctcggcatttatactttgcattgaaggagagtcagaacgggatgcaggtgtttgacgtggatctggaacataaagtgaagtatcccagagaggtaaagatccacaatcggaacagcacaattatttccttctctgtatatccactcttatccagactgtattggaccgaggtgtcgaattttggataccaaatgttttactacagcatcatctcccatactctgcacagaatcctgcagccaactgccactaatcagcaaaataagcgcaaccagtgttcctgcaatgtgacagaattcgagcttagtggagccatggcaattgacacctccaatcttgagaagcccctcatttattttgccaaagcacaggagatttgggccatggacctagagggatgccagtgctggagggttatcacggtccctgcaatgctgggcaagacactggtatccctcactgtcgatggagatctcatctattggatcatcaccgctaaggactccactcaaatctatcaggcaaagaagggtaacggcgctattgtgagccaggtgaaggcccttcggtcccgacacatcctggcgtacagctctgtgatgcagccatttcctgataaggcgttcctgtcccttgcttccgataccgtcgaacccaccatcctcaacgccacgaacacctcgctgacgatccggttaccgctggctaagaccaatctgacctggtatggcattacttctcccactccaacatatctagtgtattatgcagaagtgaatgatagaaaaaattcgagcgatttgaaataccgaatacttgaatttcaggacagcattgccttgatagaggaccttcagccattttcaacctacatgatccaaattgctgtgaagaattattacagcgatcccctggaacaccttcctccaggaaaggagatttggggcaagaccaaaaacggggtccccgaggctgtgcagctcatcaatacgaccgtgcgatccgatacaagcctgatcataagttggagagagagccacaaacctaatggcccaaaagagtcggtgcggtatcaacttgccattagccacttagctctgattcccgaaacccctctgagacaatcagagttccctaacggcaggctcaccctcctagtgaccaggctctcaggaggtaacatctatgtgctgaaggtgctggcttgccattctgaagaaatgtggtgtacagaaagccaccctgtcacagtggaaatgttcaataccccagagaaaccttactctctcgtcccggaaaataccagtcttcagtttaactggaaggccccattaaatgtgaaccttatccgcttttgggtagaactgcagaaatggaagtacaatgaattctatcacgtgaaaacctcctgcagccaagggccagcttacgtgtgcaatatcactaatctgcaaccctatacctcctataacgtgcgcgtagttgtagtgtacaagaccggcgaaaactcaacaagtctgccggaaagtttcaaaaccaaggcaggcgtgccaaacaagcccggtattcccaaactgctcgaggggagtaagaactctattcagtgggaaaaagccgaggacaacggctgcaggataacttattatattcttgagattcgtaagtccaccagcaataacctacagaatcagaacctacgatggaaaatgactttcaacggaagttgcagtagcgtctgcacttggaagtctaaaaacttgaaggggattttccaatttcgcgtggtggcggcaaacaacctgggcttcggggagtactctgggatctccgagaatatcatacttgtaggggacgacttttggattcccgaaacctcctttatactgactatcattgtgggaattttcctcgtggtaactatccctctcactttcgtctggcatcgtagactcaaaaatcagaaaagcgctaaggaaggcgttactgtactcatcaacgaagataaggagctcgctgagctgaggggcttggcagctggcgtgggactagctaacgcctgctacgcgatccacacgctgccgactcaagaagaaattgagaacctccctgctttcccaagggaaaagttgactctccggcttctgctgggctctggcgctttcggagaggtctacgaagggacagcagtggacatactcggtgttggctccggagaaatcaaagtggcggtcaaaacactgaagaagggttctaccgatcaggagaagattgagttcttaaaggaggcacacctgatgtccaagtttaatcacccgaacattctgaaacagctgggagtgtgtctgctaaatgaaccgcagtacataattctggaactcatggagggaggcgatctgctaacctatcttagaaaggccaggatggcaacattttacggacctctgcttacactagtggatcttgtggatctgtgcgtagatatctctaaggggtgcgtgtacctggaaagaatgcattttatacaccgtgatctggccgctcggaattgtctcgtctctgttaaagactacacatccccccgaatcgtgaagatcggggattttggactcgcaagggacatttataagaatgattattatagaaagagaggggaaggactgcttcctgtccgatggatggctcccgaatctttgatggatggaattttcactactcagtcagatgtgtggtcatttgggatattgatctgggagatcctaacactgggacatcagccttatccggcacacagtaatttggacgtgctgaattacgtacaaaccggtggcaggcttgagccccctcgaaactgtccagatgatctttggaatttgatgacccaatgctgggcgcaagaaccagatcagcgcccaactttccaccggattcaagatcagctgcagctgttcagaaatttcttcctgaattcaatctacaaatccagagatgaagccaacaattccggagtgatcaacgagagttttgaaggggaggatggcgatgtgatctgtctcaatagtgatgatataatgcctgtggccctgatggagactaaaaacagagaaggactgaattatatggtgctggcaaccgaatgcggccagggcgaggagaaaagtgaggggccacttgggtcgcaagagtcggaatcttgtggtctgcggaaggaggagaaggagccgcatgccgataaggacttctgccaggagaagcaagtagcctattgcccttctggcaaaccagagggcctgaattacgcttgtctaacgcacagcggatacggggacggatccgatta

SEQ ID NO: 219361 - DNA, 7043 bp, Artificial Sequence
  Description of Artificial Sequence: Synthetic coding sequence
atgaaaaacatatactgcctaattcctaagctcgtgaattttgccacgttggggtgcctgtggataagtgttgtgcagtgcacagtgctgaacagctgcctgaagagctgtgtcactaatcttggccagcaactggatctgggaactccacacaacctgagcgagccatgtatccaaggctgccatttctggaactctgtggaccagaagaactgcgcactcaagtgccgagagagttgcgaagtcggctgctctagtgctgagggggcttacgaggaggaagtgctcgaaaacgcggatcttcctaccgccccattcgcttcttctatcggcagccacaacatgaccttgcgttggaaaagcgccaacttttccggcgtaaagtatatcatacagtggaaatatgcccagctgctcggaagttggacatacacaaagacggtgagtagaccatcatatgtcgtgaaacctctccatccatttactgaatatatatttagggttgtgtggattttcacggctcagctccagctctattcgcctccatccccgtcctatcgcactcatcctcacggtgttcccgagactgcacctcttattaggaatatcgaatcgtcatcccctgatactgtcgaagtcagttgggacccaccacagttcccaggagggccaatcctcggatacaacctcaggctgatctccaaaaaccaaaaattagatgctggcactcagcgcacctccttccagttctacagcactctgcccaatacaatctatcgctttagtattgctgctgttaacgaggtgggagagggtcctgaggctgagagctccatcacaacctcgagctcagcagtccagcaagaggagcagtggctcttcttatcacgcaagacttcactgcgtaagcgcagtctgaaacatttggttgatgaggctcattgccttcgcctggatgccatctatcacaacatcacggggatttcggtcgacgtgcatcagcaaattgtttattttagcgagggtacactgatttgggcaaagaaggccgcaaacatgagtgacgtttccgatctgcgcatcttttatagagggagcggcttgatcagctctatatccatagattggctgtaccagaggatgtactttatcatggacgaactcgtatgtgtatgcgacttagaaaactgtagcaacatcgaagagatcacaccccctagcatatctgccccacagaagatcgtggccgactcctataacggctatgtcttttatctgcttcgggacggcatctacagggcagacttgcccgtgccgtctgggcgatgcgccgaggcagtgcgaattgtggagtcctgcaccttgaaagacttcgccatcaagccccaagctaagcgaattatctattttaacgatacggcacaggttttcatgtccacgttcctggatggctccgcctctcacctgatcctgcccaggattccatttgctgacgtgaaatctttcgcctgtgagaacaatgactttctcgtaactgatggcaaagtgatctttcagcaagacgcactgagtttcaatgaattcatagtggggtgcgacctgtctcatattgaagaatttggcttcggtaatcttgtgattttcggaagcagcagtcaattgcacccactccccggtagaccgcaagagcttagcgtcctgtttggatcccaccaagctctggttcagtggaagcctcctgccttggctatcggagccaatgtgatcctgatttcggacattattgagcttttcgagttggggccttctgcctggcaaaactggacctacgaagttaaagttagtacccaggatcctcctgaggtgacacatatcttcctgaatatctctggaaccatgctgaatgtacctgagctacagagtgccatgaaatataaagtgtctgtgcgagcaagctctcccaaacgccctgggccttggagtgagcctagcgttggaacaaccctggtacccgcatcagagccgcctttcataatggcagtgaaagaagacggattgtggtcgaagccactcaattcctttggacccggagaattcttgagcagtgacattggaaatgtgtcagacatggactggtacaataactccctctattattcagatacaaaaggcgacgtgtttgtatggctgctcaatggaaccgacataagcgaaaattaccacttacccagcatcgctggcgcaggcgcattagcattcgaatggctggggcactttctgtattgggccggtaaaacctacgttattcaacggcagagcgttctcacgggccacacagacatcgtgacacacgtcaaactgctggtgaatgacatggtcgtcgacagtgtgggaggctacctttactggaccactctgtacagcgtggagtccactcgactcaacggcgagtcgtccttggtactacagacacaaccatggttttcaggcaaaaaggtgatcgctctcacactcgacctttctgacggtctcctttattggctggtacaagacagtcagtgtatccatctttacacagcagtgttgcgcggtcagtcaacaggagacacgaccatcacagagttcgcagcctggagtacctctgaaatctctcagaacgccctgatgtactattcagggaggcttttctggattaacggtttcagaataatcacgacacaggagatagggcagaaaacctcagtcagcgttctggagcctgccagatttaaccagttcacaattattcagacatctcttaaacctctacccggaaactttagctttacacccaaggtgataccggatagcgtacaggagagctcttttagaattgagggaaacgccagttctttccagattttgtggaatggaccccctgccgtggattggggcgtagtgttttactctgtggagttctctgcgcacagcaagtttctggctagtgagcagcacagcttgcccgtttttactgttgaaggactcgagccatacgctttgtttaacctgtctgtgaccccctatacatattggggtaaggggcctaaaacctcactcagcttgagagcacctgaaactgtgccatcagcccctgaaaatcccagaatcttcattctgccaagcggcaaatgttgtaacaagaatgaagtggtcgtggagtttaggtggaataagcctaagcacgaaaatggcgttttaacaaaatttgaaattttttataatatctcaaaccaatctatcacaaataagacatgtgaagactggatcgcagtcaatgtaacaccatctgttatgagctttcagctggaaggtatgtcccccaggtgtttcattgctttccaggtgagggctttcacttccaagggacctgggccttacgctgacgttgtcaaaagcactacgagcgagatcaacccgtttccccatctgatcacgcttctgggtaataagatcgtgttcctggacatggaccagaatcaagtggtatggacgttttctgccgaacgcgttatatctgcagtgtgctacacagcagataatgagatggggtactacgccgagggagacagccttttcctcctgcaccttcataaccgcagttcttcagagctcttccaggattctctagtcttcgatataacagtcatcactatcgattggatctcgaggcatctctactttgcgttaaaggaaagccagaatgggatgcaagtgtttgacgttgacctggaacacaaggtgaaatatcctagagaggttaagatacacaacaggaacagtaccatcatctcattcagcgtttacccacttctgtctcgcctctattggaccgaggtgtcgaattttggataccagatgttttattattcgattataagccacacgttacaccgaattcttcaaccaaccgcaactaaccagcagaataaacgcaaccaatgctcatgcaatgtcactgaattcgaactgagtggagcaatggccattgatacatcaaacctagaaaagccgctgatctattttgccaaggcgcaggagatctgggctatggatctggaaggctgccagtgttggagggttataaccgtgcctgctatgctggcaggcaagacactggtgagtctgacagtcgatggcgatctgatctactggataatcacagccaaggactcaacacaaatttaccaggctaaaaaggggaatggggctatcgtgagccaagtaaaagccttgcgatcacgccatattcttgcctattcatccgtcatgcagccttttcccgataaagcttttctttcgctcgcctccgacactgtggagccgactatccttaatgctaccaacactagcctaacaatacgtttgcctctggctaaaactaatctgacatggtacgggattacaagccccactcccacttatttagtgtattacgcagaggtcaacgatcggaagaacagctccgacctgaaatatcggatcttagaattccaggactcgatcgccctcattgaggacctccaaccattctctacttacatgatccagatagcagtaaaaaattattatagcgaccccctcgagcatctgcccccaggaaaagaaatctggggaaagaccaaaaacggggttcccgaagcagtgcagttaattaatacgacagtcagatcagatacctcactgattatctcatggcgggagtcacataagccaaacgggccaaaagaatcggttcggtaccaattggcaatttcccatttagctcttatccccgaaactccgttgcgccagtctgagtttcccaatggcaggcttaccctcctggtcacaaggctgtctggcggaaatatctacgttctcaaggtgctcgcctgccatagcgaagagatgtggtgcacggaatcacaccccgtaacagtcgagatgttcaacactcccgaaaaaccatatagtctggttcctgaaaatacctcactgcaattcaattggaaggccccactgaacgttaatttaattagattttgggtggagctgcagaaatggaaatacaacgaattttaccacgtgaaaacgtcctgtagccaaggtcccgcttacgtttgtaacattacaaaccttcagccctacacctcgtacaacgtccgggtggtggtggtgtacaagaccggcgaaaattccacttccttacctgagagtttcaaaaccaaagccggagtccctaacaagcccggaatccctaagttactggaaggttcaaagaacagcattcagtgggagaaagcagaggacaatggctgtcggatcacctattacattctggaaattcggaagagtactagcaataatctccagaatcagaatctccgatggaagatgacttttaacggcagctgttccagcgtgtgtacgtggaaatcgaaaaacttaaaaggcatctttcagtttcgtgtggtggcagcaaataacctaggttttggggagtatagtggtatctcggaaaatataatcctggtgggcgatgatttctggattccagagacaagcttcatactgactatcattgttgggatctttttggtggtcactattccgcttacatttgtctggcatcggcgattaaagaatcagaagagtgccaaagagggggtgacagttctcatcaacgaggacaaggaattggccgaactgagggggctcgccgcaggggtgggtctggccaatgcctgttacgcgattcatactttaccaactcaggaagaaattgaaaacttgccagccttccccagggaaaagctgactctgcgcctcctactcggatcaggcgcttttggcgaggtctatgagggtacggccgtggatatactgggcgttggctctggggagattaaggtcgctgtgaagacccttaaaaaagggagcactgatcaagagaaaattgaatttttgaaggaagcccacctaatgtcaaaattcaaccaccccaatattctcaagcagctcggggtctgtctgttgaatgagccacagtacatcatcctggaactgatggagggcggtgacttgctgacctacctgcggaaagcaagaatggccaccttttacgggccattgctgaccctcgtggatctggtggatttatgcgttgacatttccaagggatgcgtgtacctggagaggatgcatttcatacaccgagatctggccgcacgaaattgtctcgtttcggtaaaggattacacctcccctcgtattgttaaaattggtgattttggattggcaagagatatttacaagaacgattattacaggaagcgcggtgagggcttgctgcctgtgagatggatggcgcctgaatctctgatggacggcatcttcaccacacagtccgatgtgtggagcttcgggattctcatctgggaaatactgactctcggtcaccagccttatccagcgcacagcaatctagacgtgctgaattacgtgcagaccggcggtagactggagccacctcgtaattgccccgatgatctgtggaatctgatgacccagtgctgggcccaggagcccgatcagcggcctaccttccatcggatccaggatcagcttcaactgttccgcaactttttcctgaattccatatacaagagtcgcgatgaggctaataatagcggcgtgataaacgaatccttcgaaggtgaggatggggacgttatctgcctgaattcggatgatatcatgcctgtggcccttatggagacgaagaaccgcgagggactaaactacatggtgctggccaccgaatgtggccagggcgaggaaaaatcagagggcccactaggatcacaggaatcagagtcatgcggacttcggaaggaggagaaggaaccccacgcagacaaggacttttgccaggagaagcaggtcgcgtactgtccatccgggaagccagagggcctgaattacgcttgtcttacccactccggctacggggatggttcggatta

SEQ ID NO: 219362 - DNA, 294 bp, Artificial Sequence
  Description of Artificial Sequence: Synthetic coding sequence
tggaagtataatgagttctatcatgtgaagaccagttgtagccagggtccagcttacgtttgtaacatcaccaatcttcaaccctatacctcctacaacgttcgggtggttgtagtgtataagacaggagaaaatagcaccagtctcccagagtcattcaagacaaaagcaggtgtgcctaataagccaggaatccccaagctgctcgaaggatccaaaaactcaatccagtgggaaaaagccgaagacaatgggtgccggataacctattatatcctcgaaataagagactag

SEQ ID NO: 219363 - DNA, 2025 bp, Artificial Sequence
  Description of Artificial Sequence: Synthetic coding sequence
atgacatccaacggtgtggccctgctgaacttctacaacatgccttccacaccctcattcgtggggtgcctacaggacatcaagattgactggaatcacattaccttggagaatatcagttcaggttcttccctcaacgtaaaggctggatgtgtgagaaaagactggtgtgagagccagccctgtcagagtcggggaaggtgcatcaatctgtggctgtcctaccaatgcgattgccaccgcccttatgaggggcctaattgtctgcgtgaatacgtagccggtaggttcggtcaggacgattctaccgggtacgtgatattcaccctggatgagagctacggcgacaccatatccctgtctatgtttgtgcggaccctccagccttctggcctgttgctggctttagagaatagtacttaccagtacatccgggtgtggctggagaggggacgcctagccatgctgacacctaatagtcccaagttggtagttaagtttgtactcaatgatgggaatgtgcatttgattagcctgaaaatcaagccatacaaaattgagctttatcagagttctcagaacctgggctttatcagcgcctccacctggaagattgagaaaggagacgtcatatatatcgggggactgcctgacaaacaagagaccgagctgaatggtggtttctttaagggctgtatccaggatgtcagacttaataaccagaatcttgagttcttccctaatccaactaacaacgcaagtctcaatccagtattggtcaacgtcacccagggttgtgcaggcgataatagctgcaaaagcaatccatgccacaacgggggagtctgtcacagtcggtgggacgattttagctgctcatgtcctgccctgacgtcaggcaaggcctgtgaggaagtccagtggtgcggcttctcaccatgtccgcacggcgctcaatgtcaaccggtactgcaaggcttcgagtgtattgctaacgcagtctttaatgggcagagcggccagattctctttcgaagtaatggtaacatcaccagggaactgacaaatatcactttcgggttccggactagggacgcaaatgtaattatcctacatgctgaaaaggaaccagagttcttgaacatctcaatccaggattcacgtctctttttccagttgcagagcggtaattccttttacatgttgtccctgacatcactgcagagcgtgaacgacggcacctggcatgaagtcactctcagtatgactgatccactgagtcagacgtcccgatggcagatggaagtggataatgaaacccctttcgttacctcaaccatcgccacaggcagtcttaattttctgaaggacaacacggatatctatgttggggatcgcgctattgataatataaaaggcctccaggggtgcctgagcaccatcgagataggcggtatatatctaagttacttcgagaacgtgcatggatttataaataaaccacaggaggagcagtttttaaaaatttctactaattccgtggtcacaggatgcctgcagctcaacgtatgtaattcaaacccttgtctgcacggaggcaactgcgaagatatctactcatcataccactgctcttgccctctcggatggagcggtaagcattgcgaattgaacatagatgagtgcttctctaacccatgtatacacggcaactgctcagaccgggtggccgcttaccactgtacctgcgaaccaggctacaccggcgtgaactgtgaggttgatattgacaactgccagagccatcagtgcgcaaacggagccacttgtatctcccatacaaatgggtacagctgtctctgcttcgggaatttcaccggcaagttctgtcggcagagccgactccccagtacagtgtgcggtaacgaaaaaactaacctgacatgttataacgggggtaactgcacagaatttcaaactgagctcaagtgcatgtgtcgacccggatttactggggaatggtag

SEQ ID NO: 219364 - DNA, 4221 bp, Artificial Sequence
  Description of Artificial Sequence: Synthetic coding sequence
atggcactcaagaatatcaattatctgctgatattctacctgtctttctctctcctgatatatatcaaaaactctttttgcaacaaaaacaatacacggtgtttgtctaactcatgtcagaataatagcacctgcaaggacttctctaaagataatgactgctcttgctccgacaccgccaacaaccttgacaaagactgtgataatatgaaagatccttgttttagcaacccttgtcagggctccgcgacctgcgtgaacaccccaggtgagagatctttcctctgtaaatgccctccaggatactcagggaccatctgcgagactaccatagggtcctgtgggaagaacagctgccaacatggcggtatctgccaccaggatcccatctatccagtatgcatttgcccagctgggtatgcaggtcgcttttgtgaaatcgaccacgatgagtgtgccagcagtccttgtcagaatggggcagtctgtcaggatggtattgatggatatagctgtttttgcgtgcccggttaccagggtcgccattgtgacttggaagtcgacgaatgcgcctctgacccatgtaaaaacgaagccacctgtctgaatgagataggccgttacacatgcatctgcccgcataattacagcggggtgaactgcgagctggagattgatgaatgctggtctcagccctgtctcaatggcgcaacctgccaggacgcacttggagcctatttctgcgattgcgctcccggattcttaggtgatcactgcgagctgaatactgacgagtgtgcgagccaaccatgcctgcatggtggtctgtgcgtggacggggaaaataggtactcctgcaattgtactggttcaggcttcacaggcacacactgtgaaactctgatgccgctgtgctggtctaaaccttgtcataataatgccacctgcgaggactcagtcgataattacacgtgtcattgttggcccggatacactggcgctcagtgcgagatagatctcaatgagtgtaactccaacccatgccagtccaatggcgaatgcgtcgaactttcctcagaaaaacagtatggaagaatcactgggctcccatccagttttagctatcatgaagccagtgggtacgtgtgcatatgccagcccggattcaccggcattcactgcgaagaagatgtcaatgaatgctcgagtaatccgtgtcaaaacgggggaacatgcgaaaatctcccaggcaattacacatgccattgtcctttcgataatcttagcaggacattctacggcggaagagactgcagcgatattctactgggctgcacccaccagcaatgccttaacaatggtacctgtatacctcactttcaggacggacagcacggattttcatgtctctgccccagcgggtacacaggcagtctctgcgagatcgcaacaaccttaagcttcgaaggagacgggtttctgtgggtcaagtcaggtagcgtaacgaccaaaggatctgtatgtaatatcgcccttagattccaaaccgttcagccaatggccttgctgctctttagatccaatagggacgtgtttgtcaagctcgagttactctcaggatacatacacttatcaatacaggtgaataatcaatctaaggtgttgctgttcatatcccataatacatcagatggcgaatggcacttcgtagaagtcattttcgcggaagccgtgactctgaccctaattgatgacagttgtaaggagaagtgcatcgctaaggcacctacccccctggagtctgatcagtctatttgtgcctttcagaactctttcttgggtggattgccagttggaatgacatctaacggggtggccctattgaacttttataatatgccatcgacaccctcctttgtcggctgtttacaggatattaagatcgactggaaccatatcaccctggaaaatataagctccggcagctccctgaacgtcaaggccggatgcgtcagaaaagactggtgcgaatctcagccctgtcagtcccgaggcaggtgtatcaacttgtggctgagctatcagtgcgactgccacagaccctatgaaggcccaaactgtctccgagaatatgtggccggtaggtttggccaagacgattcaaccggttatgtgattttcacccttgatgagagttatggagacaccattagcctcagcatgttcgttaggactctccaacccagtggtctgttattggccctggagaactccacctatcagtacattcgagtgtggttggaacgcggacgcctcgccatgctcactccaaacagccctaaactcgtggtcaagttcgtcttgaacgacggaaacgtgcaccttatttcgcttaaaatcaaaccatataagatcgagctgtatcagtcatcacaaaaccttggtttcatctctgccagtacctggaagatcgaaaagggcgacgtaatctatattggcggactcccagacaaacaagaaaccgagctgaacggcggattttttaaagggtgcattcaggacgtgaggctcaataatcaaaacttggaatttttcccaaatccgaccaataacgcttccctgaaccccgtcctagtgaatgtgacccagggctgtgccggtgataatagctgcaaatcaaacccttgccacaacggaggagtgtgccattcccgctgggacgacttttcttgttcctgtccagcactgacgtcaggcaaggcatgcgaagaagtccagtggtgcggcttctccccctgccctcatggggctcagtgccagccagtgctccagggcttcgagtgcatcgctaacgccgttttcaatggacaatcagggcaaattttgttccgttccaatggtaacatcacaagggagctgaccaacataacatttgggttcagaacacgggacgcaaacgttatcatcctgcacgctgagaaagaaccagaattcttaaatatcagtattcaggacagccgcctgtttttccagttgcagagtggaaattcattttacatgttatcactcacatccctccagtctgtcaatgacgggacctggcatgaggtcaccctctccatgaccgatcctctgtctcagacgtcaaggtggcaaatggaagtcgataacgaaacccctttcgtcacatcaaccatcgctaccggtagccttaattttctgaaggacaatacagacatatatgtgggggaccgtgccatagataacatcaagggcctgcagggttgcctgtccaccatagagatcggaggcatttacctgtcatatttcgagaacgtgcacgggtttataaataaaccacaggaggagcagttcttgaaaatttcaaccaattcggtggtcaccggctgtctccagctgaatgtgtgtaacagcaatccctgcttgcatggaggcaactgtgaggatatttattcatcataccactgctcatgtcctttaggctggtccggcaagcactgcgaattaaacatcgatgaatgcttcagtaacccatgtatacacgggaactgctccgatcgggtggcagcctatcattgtacatgcgagcccggttatacaggagtgaattgcgaagtggacatcgataactgtcagtctcatcagtgcgccaacggcgcaacctgcatctcacatacaaatggctatagctgcctttgctttggcaattttactgggaaattttgccgccagtctcgcctgccgtcaacagtgtgtggaaacgaaaagactaacctcacgtgttataatggaggtaactgcacagaatttcagaccgagctcaagtgcatgtgtaggccgggttttacaggagagtggtgcgagaaagacatcgacgaatgcgcgtccgatccatgtgtgaatggaggtctctgtcaggacctgctgaacaagtttcagtgcctctgcgatgtggccttcgctggggagcgctgcgaagttgacctcgctgatgatttaatctctgacatcttcaccactatcggatccgtgactgtggcattgctgctcatactgttactggccatagtcgcgtccgtggtcaccagcaataagcgcgcaacacagggaacctactctcccagcagacaggagaaggagggctctagagtggagatgtggaacctcatgcccccaccagcaatggagcgcctcatatag

SEQ ID NO: 219365 - DNA, 2826 bp, Artificial Sequence
  Description of Artificial Sequence: Synthetic coding sequence
atgattcgtaatagtttgtgccaaccaagcaggtgtctggatggctatctcttcttcaatagaaagatgtttggcgcacgcacccatggcttccatatactgatggcaatgctcattggtatccactgcgaagaggatgtgaacgagtgtagctccaacccttgccagaacggtggcacgtgtgagaatcttccaggcaattatacctgccactgtcctttcgataacctgagtagaactttctacgggggacgcgactgcagcgatattttactgggttgcacccaccagcagtgccttaacaacggaacctgcataccacacttccaggacggtcaacacggtttttcatgtctgtgcccaagtggctacaccgggagcctctgcgagattgctactaccctatcctttgaaggcgacggctttctttgggtaaaatcagggtctgtgacaacgaaaggctctgtgtgtaatatcgccctgcgtttccagacagttcagccaatggctttactcctattccgaagcaaccgcgatgtatttgttaagctggaattgctttcggggtatatacatctctcgattcaggtgaacaaccagagcaaagttctgctgttcatctctcacaacacttctgacggcgagtggcattttgtggaggttatctttgcagaggccgttaccctcactctgattgatgacagctgcaaagaaaaatgtatcgccaaagctccaactccacttgaaagcgaccagtctatctgcgccttccagaacagtttcttgggtggcttacctgtgggaatgacctctaatggcgtggcactgctcaatttttacaacatgccttccactccctcgttcgtgggctgcctgcaagatataaagatcgattggaaccatatcactctggagaacatcagcagcggctctagcctgaatgtgaaggcgggatgcgtgaggaaggactggtgtgagtctcaaccttgccagtctagaggcaggtgtattaacctgtggctgagttaccagtgcgattgtcaccggccttatgaaggtcccaattgcctcagggagtacgttgccggtcgatttgggcaagatgacagcactggatatgtcatctttactctagatgagagttacggagacaccatatccctgtctatgttcgtgaggacactgcagccctcagggcttctgctggccctagaaaattccacctaccaatatattcgggtgtggctggaacgcggaaggcttgcaatgctgacgccaaattccccaaagttggtcgttaagtttgtattgaacgacggcaatgtgcatctcattagtcttaaaatcaaaccatataagatcgagctttaccagagttcccaaaaccttggctttattagtgccagcacctggaagattgagaagggggacgttatttatataggaggcctgcctgataagcaggaaaccgagctaaatgggggatttttcaagggatgtatccaggatgtaagactcaataaccagaacttagaattcttccctaatccgacgaacaatgcctccctcaaccccgttctcgtgaatgtgacccagggttgcgccggagataatagttgtaaatcaaacccctgtcacaatggcggagtgtgccattctcggtgggacgatttttcgtgcagctgccctgctctcacttcaggtaaggcgtgcgaggaggtgcaatggtgcggcttctccccttgtccgcacggcgctcagtgtcaacctgtgttacagggtttcgagtgtatagctaatgcagtcttcaacgggcagagtggacagatactgtttcgttccaacggcaacattacccgtgagctgacgaatattacttttgggttcaggaccagggatgctaacgttataatcttgcatgcggagaaagagccagaatttctgaacatatctattcaggattcaaggctcttttttcagctgcagtcagggaatagtttctacatgcttagcctaactagtctgcagtccgtgaacgacggcacttggcatgaggtaacccttagcatgacagaccccctgagccagactagccgatggcaaatggaagttgataacgaaaccccattcgtgacttccactatcgccaccggtagtctaaattttcttaaggacaatacagacatctatgttggagatcgggcaatcgataacattaagggcttgcaaggctgtctttcgacaatcgagataggcggtatctatctgtcttactttgagaacgtgcatgggttcatcaacaagccccaggaagaacagttcttgaaaatatccacaaatagtgtggtcactggctgcttgcagctgaacgtttgcaattcaaatccatgcctgcacggcggaaactgcgaagacatatacagcagttaccactgctcatgccctttgggttggtctggcaaacactgtgaactcaacatagatgagtgtttcagcaacccctgtatccacggtaattgtagcgacagggtcgcagcgtaccactgcacatgcgaacccggttacaccggagtgaactgcgaggtcgacatcgacaactgccaatctcaccagtgcgccaacggggctacctgtattagccatacaaacggttatagctgcctttgcttcggcaactttacaggcaagttttgtaggcagagcaggctgccatcgactgtttgtggtaacgagaaaactaacttaacatgctataacggcggaaattgcacggaattccagaccgagttgaagtgcatgtgtaggcccggatttacaggcgagtag

SEQ ID NO: 219366 - DNA, 129 bp, Artificial Sequence
  Description of Artificial Sequence: Synthetic coding sequence
gagaaagacatcgacgagtgcgccagtgacccttgcgtgaatggcggactttgccaggaccttctaaataaatttcagtgcctttgtgatgtggcattcgctggggagcgctgcgaggtggattattag

SEQ ID NO: 219367 - DNA, 4149 bp, Artificial Sequence
  Description of Artificial Sequence: Synthetic coding sequence
atgaaagatccatgctttagcaacccttgccagggaagtgccacatgtgtaaatacccccggagagaggagtttcctgtgcaagtgtccgccaggctactcgggaacaatctgtgaaactacaattggcagctgcgggaaaaattcctgccagcacggtgggatatgtcaccaagaccctatctatcccgtgtgcatttgccccgctgggtacgctggcagattttgcgaaatcgaccacgacgagtgcgcgagtagcccctgccaaaacggggcagtgtgccaggatggaattgacggttattcatgtttctgtgtgcccggatatcagggcagacactgtgatctcgaggtcgacgagtgcgcctctgacccctgcaagaatgaagccacctgtcttaacgagataggaagatacacctgcatctgccctcataactactctggcgtgaattgtgaacttgagattgacgagtgctggtcacagccatgtcttaacggagcaacatgtcaggatgccctcggggcatacttttgcgattgtgctcccggtttcctcggcgatcactgtgaactgaatacagatgagtgtgcctcccagccatgtctgcacggtggcctgtgcgtggacggcgagaacagatatagctgcaattgcacagggtccggcttcacaggcacacattgcgaaaccctcatgccactgtgttggtccaaaccctgtcataacaacgcaacttgcgaggacagtgtggacaactacacctgccattgttggcctggctacacaggcgcacagtgcgagatagacctcaatgaatgcaactctaacccctgtcagagtaacggagagtgtgtcgagcttagctcagagaagcagtacgggaggatcacaggcttgccgagcagtttttcttaccacgaggcctctggatacgtctgtatctgtcagccagggtttacagggatccactgcgaggaggacgttaacgagtgctcttcgaacccatgccagaacggaggcacctgcgaaaatctgccgggaaattatacctgtcactgcccttttgacaatctttcgcggaccttttatggtgggagggattgttccgatattctccttggctgcacacaccaacagtgcctgaacaacggcacctgcatccctcatttccaggatgggcagcacggattttcttgcttatgcccgagcggatatactggatcactgtgtgaaatagccacaacactgtctttcgaaggagacggcttcctttgggtgaagtccggaagtgttacaaccaaaggcagtgtttgtaacatcgcattgagattccagacggttcagccaatggccttgctgctgtttcgtagcaatcgggacgtattcgtgaagctggaactgctgtctgggtacattcacctctcaatccaggtcaataaccagtctaaggtgttgctgttcatctcccacaacacttctgacggggagtggcacttcgtggaagttatattcgccgaggcagttaccctgaccctgatagacgatagctgcaaagaaaaatgtatcgcgaaggcccctacacccctggagtcagatcaatccatttgtgcgtttcagaacagctttctcgggggtttacccgtagggatgacttccaatggggtcgctctgttaaacttctacaacatgcccagcactccaagttttgttgggtgcctgcaggacattaaaattgattggaatcacatcacattagagaacatttctagcgggagctcactgaatgtcaaggcagggtgcgtaaggaaagattggtgcgagtcgcagccatgtcagagtcggggtcgttgcatcaacctttggctgtcctaccagtgtgactgccaccgaccttatgaaggcccaaattgcctgcgtgagtatgtggcagggaggttcggccaggacgactctaccggctacgtgatttttaccttagatgagtcttacggggacaccatttctctcagcatgtttgtgcggaccctccaaccatccggcttgctgcttgcactcgaaaatagcacctaccagtatatcagggtgtggcttgaacgcggaaggctcgccatgctcactcccaactctcctaaacttgttgtaaaatttgtgctgaatgacgggaacgttcacctgatatctttgaagataaagccctataaaatcgagctgtaccaatcttctcagaatttgggattcatctctgcttccacatggaagatcgagaaaggagatgtcatttacatcggaggtctccctgataagcaagaaactgagcttaacggaggctttttcaagggctgcattcaggatgtgcggttgaacaatcagaacttagaattctttcccaatccaaccaacaacgccagtttgaaccccgttttggtcaatgttacccagggctgcgccggtgataatagttgcaaaaggcaaacaaatgtggggagagctctgaccgagctagggagtcggggtccgaaatatcaggttagcctctttcggttttgcgtaggcagctgggctacaggcaacacttttttcctttccagcatcaaacctggatccaacccttgtcacaatgggggagtgtgccattccaggtgggacgactttagctgctcctgccccgcattaacgtctggcaaggcgtgtgaggaagtgcagtggtgcggcttctctccatgcccacacggcgcacaatgtcagcctgttctgcaaggatttgaatgcattgccaatgcggtcttcaatggccagagtggtcagatcttatttagatcgaatggtaacatcaccagagagctgacaaacattacatttgggtttagaacgcgcgacgcaaacgtcattatactccacgcagaaaaggaacccgaatttctaaatatatctatccaggatagtagactgttttttcaactacagtccggcaattcattctacatgttatctctgaccagcctccagagcgtgaacgatgggacgtggcatgaagtaaccttatcaatgaccgatcccctgtcccaaacctcaagatggcagatggaggtcgacaacgagaccccctttgtcaccagcaccatcgccacagggtccctgaatttcctaaaggacaataccgacatctatgtgggcgaccgcgctattgataatatcaaagggttgcaaggatgtctttccacaatcgagatcggaggaatatatctgtcatatttcgagaacgtgcatgggttcatcaataagccccaggaggaacaattcctcaaaatttcaaccaactctgtagtgaccggttgtctccaattaaatgtatgtaactctaatccatgccttcatggcggaaactgtgaagacatatattcctcctaccactgcagctgtccactgggatggtcaggaaaacattgcgaactgaatatcgacgaatgtttcagtaatccatgcattcacggaaactgctctgatagagttgctgcttaccattgcacctgcgagcccggatataccggcgtgaattgtgaagtcgatattgacaactgtcagtcccaccagtgcgccaacggcgcaacatgtattagccacacaaatggctatagttgcctatgtttcgggaattttactggtaaattctgccgccagtctagactaccatccaccgtttgcggaaatgagaaaacaaatctcacttgctacaacggaggaaactgcacagaatttcagaccgaactgaaatgtatgtgcagacccggtttcacaggggaatggtgcgaaaaggatatcgatgagtgtgccagtgacccttgtgtgaacggagggctatgccaggacctgctgaataagttccagtgcctgtgtgacgtggcctttgccggtgagaggtgcgaggttgatctggcagatgacctgatttcggatatcttcacaactattggaagcgtcactgtggctctactgctgatcctattgctagctatagtggcctctgtcgtaacaagtaacaagcgcgctacccagggtacttacagtccatctcggcaagagaaagaaggatccagagtggagatgtggaacctaatgccacctcccgcaatggagagactcatatag

SEQ ID NO: 219368 - DNA, 2613 bp, Artificial Sequence
  Description of Artificial Sequence: Synthetic coding sequence
atggctcttaagaacattaattatctgctaattttttatttatccttctcgctcttgatctacattaagaacagtttctgcaataagaataatactaggtgcctgagcaattcttgtcagaataactcaacctgtaaagactttagcaaagacaacgattgtagttgtagcgatactgctaataatctcgacaaggattgcgataatatgaaggacccctgtttctccaacccttgtcaggggagcgccacttgtgtgaatacacccggagaacgctcctttctgtgtaaatgccccccagggtacagtggtacaatttgtgagaccaccattggttcctgcggtaagaattcctgccaacatggtggtatctgccatcaggacccaatatatcctgtctgcatttgccccgcaggatacgccggtcggttctgtgagattgatcacgacgagtgcgccagctctccatgccagaatggcgcagtgtgtcaggacgggatcgacgggtacagctgtttttgtgtgcctgggtatcagggtcggcactgcgacctcgaggtggacgagtgcgctagcgatccctgtaagaatgaggccacatgcctgaatgagattggcaggtatacctgcatctgcccccataactactccggggtcaattgcgagctggaaatcgatgagtgttggagccaaccatgcttgaacggagcgacatgtcaagatgctttgggcgcttacttttgcgactgcgctccgggattcctgggcgatcactgtgagctcaacactgacgaatgcgcctcccagccttgtctccacgggggattgtgcgttgatggcgaaaacagatacagctgcaactgtaccggctccggattcacggggacacactgtgaaaccctaatgcccctgtgctggtctaaaccgtgtcacaataatgctacatgtgaagacagcgtggataattatacctgccattgttggccaggctacaccggagcccagtgcgagatcgacctcaacgaatgcaactcgaatccttgccaaagcaatggcgaatgcgtggaactgtcctctgaaaaacagtacggacgcatcactggattaccatcttcttttagctaccatgaagccagtggctatgtatgtatttgccagccgggattcactggcatccactgcgaagaggacgtgaatgagtgctcatctaatccgtgtcaaaatgggggtacctgtgaaaatttgccaggtaactatacatgccattgtccctttgataatttgagtagaactttctacggagggagagactgttctgatatcctattaggatgcactcaccaacagtgtcttaacaatggaacttgcatccctcacttccaggacgggcagcacggtttctcctgtctttgccctagcggatacacagggagcctgtgcgaaatcgctaccacactctccttcgaaggggatggctttttgtgggtgaaaagcgggagcgtcaccaccaagggctcagtctgcaacatagcgctgcgatttcagacggttcagccaatggcgctgttgctatttcggagtaatagagatgtattcgttaagctggaactcctttctggttatatccacttgtctatccaagtaaataatcagagtaaggtgcttctcttcatatctcataatacatcagacggtgaatggcactttgtcgaagtgatctttgcagaggccgtgacacttaccctgatagatgattcctgcaaggagaaatgcatcgccaaagcccctacccctctcgagtcggaccaatcaatttgtgcctttcaaaatagcttccttggcggtctccccgtggggatgacttcaaacggagtggctctgctcaacttctataatatgccatccaccccctctttcgtagggtgccttcaggatattaaaattgattggaatcatattacattggagaatatttcttctggctccagcttgaacgtcaaagccggatgtgttcgaaaggattggtgcgaaagtcaaccatgccagtcacggggaaggtgtattaatttatggcttagttatcagtgtgattgccaccgaccctacgagggccctaactgtctgagaggaaagttttgtagacagtcaaggctgcctagcacggtctgtggaaatgaaaagaccaacttaacctgttacaacggaggcaactgtacggagtttcaaacagagcttaaatgcatgtgcaggcccggttttacaggagagtggtgcgaaaaggacattgacgaatgtgctagcgacccatgtgttaatggcggactctgccaggatctgttgaataaattccaatgtctctgtgatgtggcgtttgccggagaaaggtgcgaagtggacctggccgacgatctgatttcggatatttttacgaccattgggtccgttaccgttgcccttttgttaattttactactcgcaattgttgcttctgttgtaacctcgaataagagagccacacagggaacttattccccgtcgcggcaggagaaagaaggcagtagagtggaaatgtggaaccttatgccaccccctgccatggaaagactgatatag

SEQ ID NO: 219369 - DNA, 882 bp, Artificial Sequence
  Description of Artificial Sequence: Synthetic coding sequence
atgcctctgtgttggagcaagccttgtcataacaacgctacctgtgaggactccgtggataattacacatgccactgctggcccggttacactggtgcgcagtgtgagatcgacctgaacgagtgcaactccaacccctgtcagtcgaacggggagtgtgttgaactgagttccgaaaaacaatacggaagaataaccggcctcccaagtagctttagctatcatgaggccagcgggtacgtttgcatttgccagccagggtttactggcattcattgtgaagaggatgtgaatgaatgttcttctaacccatgccagaatggcggtacttgtgagaacttgcctgggaattacacttgccactgcccattcgacaacctttcacggaccttctacggtggacgggattgctccgacatcctccttgggtgcactcaccaacaatgccttaataacggcacttgtatccctcacttccaggatggacaacacgggttcagttgtctctgtccatctggatacactggttcactgtgcgagattgccaccactctttcgtttgaaggggacggcttcctgtgggttaaaagtggctcagtcaccaccaagggctctgtatgcaacatcgcccttagattccaaactgtacagcccatggcgctgttactctttcgttcgaatcgggacgtctttgtgaagctcgaactcctgtccggatatatccatctgtccatacaggtaaacaaccaaagcaaagttctgctcttcatctcccataacacaagcgatggcgaatggcatttcgtggaggccgtgagcaaaaccctgaaactgataggtatcactctgccatggcgtaccagccggttggctcatcactag

SEQ ID NO: 219370 - DNA, 2664 bp, Artificial Sequence
  Description of Artificial Sequence: Synthetic coding sequence
atggctctattactgttccggagcaatagggatgtcttcgtgaaattggagttactgagcggctacatccacctgtccattcaagtgaataaccagtccaaggtactgctgttcataagccataatacatccgacggcgagtggcatttcgttgaggtcatcttcgctgaagccgtaacccttaccctgatcgacgatagctgcaaagagaagtgtatagctaaagcgccaactcccctggagagtgatcagagcatctgcgccttccagaactcttttttggggggactcccagtcgggatgacgtcgaacggcgttgccctgttgaatttctacaacatgccctccaccccgtccttcgtgggctgcctgcaagatataaagatcgattggaaccacattaccctggagaatatttcttctggtagctcgctgaacgttaaggcaggttgcgtaagaaaagactggtgcgagagtcagccttgtcagtctagagggagatgcattaacttatggttgtcttaccagtgtgactgtcaccgcccttatgaaggccctaactgcttacgcgagtacgtcgccggacgattcggccaggacgatagcactggatacgttattttcaccttggatgagagctatggagataccataagcctgagtatgtttgtcagaactctccagcctagcggattactgctggctcttgagaactcaacctatcagtatattagagtgtggctcgaacgaggtcggttagcaatgctgaccccgaactccccaaagctggtggtgaaatttgtgctgaacgacggcaatgtacacctgatcagcctgaagataaagccctataagatcgaactttatcagagcagccaaaacctgggtttcatctcagcctccacttggaaaatagaaaaaggagacgtgatctatattgggggtctgcctgataaacaggaaacagaactcaatgggggtttttttaaaggttgcatccaagatgtccggctgaataatcagaatttggagttctttcctaatccaaccaacaatgcatctctgaatcccgtgttggtgaacgtcacacaggggtgcgcaggagacaattcgtgtaagtcaaatccatgccataacggaggcgtgtgtcacagtaggtgggatgattttagctgttcttgtccagctctgacttcaggcaaagcctgtgaagaagtgcagtggtgcggctttagcccctgtcctcatggggcacagtgccagccagtgttgcagggctttgagtgcatagccaacgccgtgtttaacggacagtcgggtcagattctgtttcggtcgaacggcaatatcacgagagaattaactaacatcacgtttggattccggacaagggatgccaacgtgattattctccacgccgagaaagaaccagagttcctcaatatatccatacaggacagccgtttgttcttccagttgcagtccgggaacagtttttatatgcttagcctcacctccctgcaaagcgtgaatgatggcacttggcacgaagttaccctctccatgactgatcccttgagtcaaacaagccggtggcagatggaggtggacaacgagacaccctttgtgacttctaccatcgctaccggaagccttaactttctcaaggataataccgacatttacgtgggcgaccgcgctattgacaatattaaagggctccagggatgcctctctacgatcgagatcgggggtatatatttgagttacttcgagaacgtacatggtttcatcaacaagcctcaagaagagcagttcctgaagattagcaccaattcggtcgtgacagggtgtcttcagttaaatgtctgcaactctaacccttgcctgcacgggggaaattgtgaggacatctacagctcttatcactgcagttgtccactaggatggtccggtaagcactgtgagcttaacattgatgaatgctttagcaacccgtgcattcacggcaattgtagcgatagggttgctgcttaccactgtacctgcgagcccggatacactggggtaaattgcgaggtcgacatcgataactgccagagtcatcagtgtgcgaatggagccacttgtatctcccacaccaacggctacagttgtctctgttttggcaacttcaccggtaaattctgcagacagtccagactgcccagtacagtctgtggaaacgagaaaacaaacctaacctgctataatgggggtaattgtactgagtttcagactgagctgaagtgtatgtgcagaccagggttcactggtgaatggtgcgagaaggacatagacgagtgcgcgagcgacccatgtgtaaacgggggattatgccaagatctgctaaataaatttcagtgcctttgcgacgtggcctttgcaggcgagcggtgtgaggttgacctggcagatgacctaatatccgatattttcaccaccattggctccgtgacagtcgccctgctcctcattttattgttggccatagtcgcttcagtggtgaccagcaacaagcgggcaactcagggcacatacagtccgagcagacaagaaaaggaggggtctagagtcgagatgtggaacctgatgccccctccagctatggaacgcttgatttag

SEQ ID NO: 219371 - DNA, 3885 bp, Artificial Sequence
  Description of Artificial Sequence: Synthetic coding sequence
atggctctgaagaatatcaattatttgttgatcttttaccttagtttttctctcctgatctacatcaagaattcattctgtaacaagaacaacacgcgttgtctgagtaactcttgccagaacaatagcacgtgcaaagatttctccaaggataatgactgcagctgttcggataccgctaacaatttggacaaagattgcgataacatgaaagatccttgcttcagcaatccttgtcagggatctgccacctgcgtcaatactcccggagagaggtccttcctgtgcaaatgcccgccagggtattccggcaccatctgtgagacgacaatcggcagttgcggcaagaacagctgccagcatgggggtatctgccaccaggatccgatatacccagtctgtatttgccctgcaggatacgcaggcaggttttgcgagattgaccatgacgaatgcgcatcgagtccgtgtcagaacggggctgtgtgtcaggatggcattgacggatattcttgtttttgtgtccctggttaccaggggcgtcactgcgacctggaagtggatgagtgcgcctccgacccctgtaagaatgaggccacctgcctcaacgagatcggcagatacacctgcatctgtccccacaattactcaggctataccggggctcagtgcgagatcgacctgaacgaatgtaactccaatccctgtcagtccaatggcgagtgcgtcgagctgtcatctgaaaagcaatacggcagaatcacagggctccctagtagcttttcctaccacgaagctagcggatatgtatgtatttgtcagcctgggttcaccggaatccactgtgaagaagatgtaaatgagtgcagctctaacccttgtcagaacggagggacttgtgaaaacctacctggtaactacacctgccactgcccatttgacaacctttctaggacattctacggcggacgcgattgcagcgatatcctgttaggttgcacacatcaacagtgtctcaacaacggaacgtgcatcccccactttcaggacgggcaacatggatttagctgcttatgtcccagcgggtataccggctccctatgcgagattgccaccactctgtcatttgagggcgacggatttttatgggtaaagtctggttctgtaactaccaagggatcagtctgcaatatcgcccttaggttccaaacggtgcagcctatggccctattgctgtttcggagcaatagggatgtctttgtgaagctcgagttgctgagcggatacatacacctcagcattcaggtcaataatcagtccaaagtgctcctgtttatcagtcataacacaagtgacggcgagtggcacttcgtcgaagtcatattcgcggaggctgtgactctgaccttgattgatgactcctgcaaggaaaaatgtattgcaaaggcgccaaccccacttgagtcagatcagtcaatctgtgccttccagaactcatttctcggagggttgcctgtgggaatgacctccaacggcgtcgcactcctgaatttctacaacatgcctagcacaccgtccttcgtgggatgcctgcaggatatcaaaattgactggaaccacataaccctggagaatataagcagtgggagttccctcaatgtcaaggcaggttgcgtgcggaaggactggtgcgaaagtcagccatgccagtctcggggacggtgcattaatttgtggttgtcataccagtgtgactgccaccgcccatacgaggggccaaattgtctccgtgagtatgtggctgggcgatttgggcaggatgacagcacaggctatgtgatctttaccctggacgaaagctacggggacacaatatcattgtcaatgtttgtccggacactgcagccctctgggctgctgttggcgctagagaacagcacataccagtacattagagtgtggctggaacgtggtcggttggctatgctcacaccaaactcaccgaagctggttgtcaagttcgtgctgaacgatggcaacgtgcatctgataagcctgaaaataaaaccctataagatagaactctatcagtcctcccagaacttggggttcatcagtgcctccacatggaagattgagaagggtgacgtgatttatatagggggactgcctgacaagcaggagacagaactgaatggtggattcttcaaaggatgtatccaggatgttagactaaataaccagaatctggagttcttcccaaatcctactaacaacgcctctctgaaccctgttctcgttaatgtgacgcaaggttgcgccggtgataactcatgcaaatctaacccttgtcacaatggaggtgtgtgtcactcaaggtgggacgatttttcctgctcgtgtcctgcgttgacatccggtaaggcctgcgaagaggtccagtggtgtggcttctcaccatgccctcatggcgctcaatgccaacccgtgctgcagggatttgaatgtatagcaaatgctgtcttcaacgggcagtctggccaaatactcttcaggtccaatggcaatattacacgggaactgaccaacattacttttgggttccggacacgagacgccaacgttataattttacacgcagagaaggagccagagttcctgaacatctcaatccaggattcacggctcttttttcaactccaaagcggcaatagtttctatatgctgtctctaacatccctgcagtcagttaacgacgggacgtggcatgaggtcacgctgtctatgacagatccacttagccagacatctagatggcaaatggaagtcgataacgaaacaccctttgttaccagcacaatcgctacagggtctctgaattttctgaaagataacacggacatctacgttggggaccgggcaatagacaacattaagggactgcaagggtgtctctccactatcgaaatcggcggtatctatttgtcttactttgaaaacgtgcacggattcatcaacaagccccaagaggagcagtttcttaagatcagcactaactcggttgttacgggttgtctgcaactcaatgtctgcaattcaaacccgtgtctgcacggaggaaactgcgaggacatctattcctcctaccattgctcttgccctctgggctggtccgggaaacactgcgagctgaatattgatgaatgcttctcaaatccctgcattcacggaaattgtagtgacagggtggctgcgtatcactgtacctgtgaacctggatacaccggggttaattgcgaagttgacattgacaattgtcaaagccatcagtgtgcgaacggggctacctgtatcagccacaccaacgggtactcatgcctttgtttcgggaatttcacaggcaagttttgtaggcaatctcgtctcccttccacagtttgtggcaacgaaaagacaaatctgacctgctataatggtggaaattgtaccgaattccagaccgagttaaaatgtatgtgccgcccagggtttaccggagagtggtgcgagaaagacatagatgaatgcgcctccgacccatgtgttaatggaggcctatgtcaggatctgcttaataaatttcagtgtctgtgcgacgtggccttcgccggagaaagatgtgaggtggatctggccgacgatcttatcagtgatatctttacaacaataggctccgtgactgtcgcactgctgcttattctgctcctggccatcgttgccagcgtcgtgacttcaaataaaagagctacacagggaacctactcgccctctcgccaggaaaaggagggtagccgcgttgaaatgtggaacctaatgcccccacccgctatggagagactcatttag

SEQ ID NO: 219372 - DNA, 3531 bp, Artificial Sequence
  Description of Artificial Sequence: Synthetic coding sequence
atggctcttgcaaggcccggtacaccagacccccaagcactcgccagcgtgttactgctcctgctctgggcccctgccttatcactactcgccggaacagtcccctcagagccaccgtctgcctgcgcgagcgatccctgcgctcccggaaccgagtgccaggccacagaatcaggcggttacacatgcggacctatggaacctcgtggctgcgcaactcagccgtgccaccacggtgcactctgcgtgccccaggggcctgatccaaccggattccggtgttattgcgtgcctggttttcagggcccaagatgtgaactggatattgacgaatgtgctagtaggccctgtcaccatggggcaacgtgtcgtaacctggctgatcgatatgaatgccactgccctttgggctatgctggcgtaacttgcgaaatggaggtcgacgagtgcgcctccgcaccttgcttacacggcggaagctgtctggatggcgtaggtagctttcgctgcgtgtgcgcacccggatatggtggaactcgctgccaactggatctagacgagtgtcagagtcagccctgcgcccacggcggtacatgtcacgacctggtgaatggattccgctgcgattgcgcagggacaggttatgagggcactcactgtgaacgggaggtccttgagtgtgcttctgctccatgtgagcataacgcctcatgcttagaagggctgggatccttccgatgcctgtgctggcccggatattcgggtgagctctgtgaggtcgacgaagatgagtgtgcgtccagtccttgtcagcacggagggcgttgcctacagagatctgatcctgcattgtacgggggagtgcaagctgccttcccaggagcgttttcctttaggcacgcggctggcttcctatgccattgtcctccgggttttgaaggggcagattgtggggtggaggtcgacgagtgcgccagcagaccctgccttaacggcggacactgccaggacctcccgaacggcttccaatgccattgccctgatgggtatgcgggacctacttgtgaggaggacgttgatgaatgtctgagtgacccctgtcttcacggcggaacctgtagtgatacggtggctggctacatttgtcggtgtcccgagacctgggggggtagagattgtagcgtacaactgaccggttgtcagggacacacctgtccgctagccgcaacctgcatccccatcttcgagtctggtgtgcacagctacgtatgccactgccctccgggaacccatggtcccttttgcggtcagaacactacattctctgtgatggcaggttcgcccatccaggcttctgtcccagccggaggcccattgggtctcgccctcaggtttcgcacaactctccccgctggaacgctggcaaccaggaacgatacaaaagagtctctcgagttggcactcgtcgccgctactctccaggcaaccctttggtcctatagcaccactgtgctggtactgaggctgccagacctggccctgaacgacgggcactggcaccaagtagaggtggtgttgcacctcgctacactcgaattgcgcttgtggcacgagggctgcccagcaagactatgtgtggctagtggacctgtcgccctggcgtcaacagctagcgccacccctctcccagctgggatatcatctgctcagcttggtgacgcgacattcgcaggatgtctgcaagacgtgagagttgatggacacctgttattaccagaagatcttggcgaaaacgtgttgctcgggtgtgagaggcgggagcaatgtaggccgttaccctgtgtccacggcggaagttgcgtcgacctgtggacgcactttcgctgcgattgtgccagacctcatcgcggtcctacatgcgcagatgagatccccgcagccactttcggtcttggtggcgcaccctcaagcgcttcattcctgctgcaagagctacccggtccgaacttgactgtcagtttcctgctgaggacccgcgaatccgcaggcttgcttcttcagttcgctaatgactctgctgctggactgactgtcttccttagtgaagggcgtatacgggcagaggtcccagggtctccagccgtggtgctcccaggcaggtgggacgacgggctgcggcacctcgtgatgctgtcctttggccctgatcagctccaggatttgggacagcatgtgcatgtgggcggtagactcttggccgcagactcccagccgtggggcggaccattccggggttgcctgcaagacctgcggctggacggctgccatctcccattcttccccctcccgctagacaacagcagccagcctagtgagctgggcggtcggcaatcctggaatctgacagccggttgtgtgtctgaggatatgtgcagccctgatccttgctttaatggtggcacatgcctcgtcacttggaatgatttccactgcacttgtcctgctaacttcaccggaccaacctgtgctcagcagttgtggtgccccggtcagccctgtttgcctcccgctacctgcgaagaggtacctgacggattcgtgtgcgttgcagaagccaccttcagagaaggtcccccagctgccttctccggccacaacgcctcaagcggccgtctccttggaggactctccctcgctttccgcacaagggattcggaggcctggctgttgagagctgccgctggggcactggagggcgtatggttggccgtgcggaacggatccctggcgggtggtgtgagaggtgggcacgggctgcccggagcagtcctaccgatcccgggacccagagttgccgacggcgcttggcacagagttcgcctggccatggagagacctgccgctaccacctctagatggttgctgtggctggatggtgcggctacgcccgttgccctgcgcggattggccagtgacttgggctttctgcagggtccaggagccgtacgtatacttttggccgaaaacttcacaggctgtctcggtcgcgtggccctgggtggcttgcctctaccgttggctagaccacgacccggtgccgctcccggtgccagagagcatttcgcaagttggccgggtacgccagctcctatactgggttgtaggggagcccctgtgtgcgctccgtctccatgcctgcacgatggggcttgtcgtgacctctttgatgctttcgcctgtgcctgcggccctgggtgggaaggcccacggtgcgaggcgcacgtcgacccctgtcactccgctccatgtgcgaggggcaggtgccacacccatccagatggacggttcgagtgtcgctgtccccctggttttggcggtcccaggtgtaggtgggatggctgggccggaggctgggccgctaacgccccttggggctatgggggagcggaaaagagcgcgagatcggtggatgagtctctgccatttcccggtccacacgtgctaatctgtgacatgcggaggactgtctag

SEQ ID NO: 219373 - DNA, 2862 bp, Artificial Sequence
  Description of Artificial Sequence: Synthetic coding sequence
atggccatggagcccggtgccctttggactttcctgggacacctgtggctccttgcgggacccacttgcgaagaggacgtggacgagtgtttgagcgacccatgcctccacggaggtacttgctctgacacagtggcaggctatatttgtagatgtcctgaaacttggggaggaagggattgcagcgtccagctgacaggttgtcagggacatacgtgccctctcgccgctacatgtatccctattttcgaatccggcgtccatagctatgtatgtcactgtccaccgggaacacacggacccttctgcggtcagaatactacatttagcgttatggccggatcccccattcaagcttctgtgccggcaggcggaccactggggttagcccttcgcttccgaacaactcttccagcagggactctggctacacgtaacgataccaaagagtccctggagttagccctggtggctgccaccttacaagctacgctgtggagctacagtacgactgtgctggtgttgcgcctccccgacctggctctgaacgatggacactggcatcaggtagaggtggtgctgcatcttgctactctggaactgaggttgtggcatgaaggatgccctgctagactttgtgtagctagtggacccgtggccctggcatccaccgccagcgccactccactgcccgcagggatctcctccgcacagctgggggacgctacattcgctggctgcctccaagatgttagagtggacgggcatctgctgctgccggaagacctaggtgagaatgttcttctcgggtgcgagcgccgagagcagtgccgccctttaccgtgtgtacatggtggatcatgcgtggacctgtggactcacttccgctgtgactgcgcaaggccccatcgcggacccacttgtgcagacgaaattcccgctgccacgtttggacttggcggagcaccaagcagcgctagtttcttgctccaagagcttccaggacccaatctgactgtctctttcttgttgagaactcgggagtcagctggcctcctgctgcagttcgctaatgacagtgctgcaggtctcacagtttttttgtctgagggcagaatcagggccgaggtgcctgggtcaccagccgtggttctgccaggtcgatgggacgacgggcttagacatctggtaatgctctcttttggacctgaccagttgcaggacctggggcagcatgtgcatgtgggcggacggttgctggcagctgattcacaaccctgggggggaccattcagagggtgtctacaggatctgagacttgacgggtgccacctgccatttttcccactccccctggacaactctagccaaccttctgagcttggaggtcgccagtcatggaacctcactgctggctgcgtttcagaagacatgtgcagcccagacccgtgttttaatggcggaacctgtctggtcacatggaacgattttcactgtacctgtccagcaaacttcacagggccaacatgcgctcagcagctttggtgccctggacagccctgtctccctccggcaacctgtgaagaggtgccggacggttttgtctgtgttgccgaagcaacattcagagaagggcctcccgctgcctttagcggtcacaatgcttcttctgggaggttgctcggaggcttgtccctggcgtttcgtaccagggacagcgaggcatggcttttgcgcgctgctgcaggagctttagaaggggtgtggctcgctgttaggaacggaagcctcgcaggtggggtcaggggcggtcatggcctgcctggggctgtgttgcccatccccggacctcgggtggctgacggcgcttggcatcgcgtccggctggccatggagaggcccgctgcaactacttcaagatggctactgtggctcgacggggctgctacccctgtagctttaagggggctcgcttccgacctcggcttcctgcagggccctggagcagtgcgtattctccttgcggagaattttacaggttgcctggggagggtggccttaggcggactacctttgccgctggctagaccccgacccggagccgctcctggggcaagggagcattttgcaagttggcccggaacaccagcaccaatcctgggatgtaggggtgctccggtctgcgctcccagcccatgtttacacgacggtgcgtgcagggacctgttcgatgcgtttgcttgcgcgtgtggcccaggatgggaaggccctagatgtgaggcacatgtcgatccttgtcattccgccccatgcgcaagaggccgatgccacactcatccagacggaagatttgagtgccgctgccctcccggtttcggtggcccacgttgtcgtctgcctgtccccagcaaggaatgcagcttgaacgtaacatgtctggatggctcaccgtgcgagggtggatcccctgccgcaaattgctcttgtcttgagggacttgccggacagaggtgccaggtgcctactctcccctgcgaagctaacccatgtctcaacggaggcacatgcagggctgcaggtggcgtttcagaatgtatctgcaatgctaggttcagcggtcaattttgtgaggtcgctaaagggttgccactccccctcccattccccctgttggaggtggcagtacctgctgcatgtgcttgcttactgctgctgttgctcggactcctctcaggtatcctagccgcacggaaacggaggcagtccgagggaacatactctccaagccagcaagaggtagcaggcgctcgtctggagatggactccgttctgaaggtcccacccgaagagaggctcatttag

SEQ ID NO: 219374 - DNA, 3858 bp, Artificial Sequence
  Description of Artificial Sequence: Synthetic coding sequence
atggctctggcccgtccgggtaccccagacccacaagctctcgcatcggtgcttttactgctgctgtgggctcctgccctaagcctgttggccggtacggtgcctagtgagcccccatctgcctgtgccagtgatccatgcgcgccaggtaccgagtgtcaggccactgagtccggcggttacacttgcgggccaatggaacccaggggttgtgcgacccagccttgccaccatggtgccctttgcgtgccacagggacctgacccaactgggtttagatgctactgcgtgccaggcttccagggcccacggtgcgaacttgacattgacgagtgtgcttccagaccatgccatcacggggcaacttgcagaaatctggccgatcggtacgagtgccactgtcccctcggttatgccggagtaacgtgcgaaatggaagtagatgaatgcgcatctgcaccttgcttgcatgggggaagctgtctggacggcgtagggtcttttaggtgcgtgtgcgcaccagggtatggcggaacacgatgccagctggacctcgacgagtgtcagagccagccatgcgctcatggtgggacctgtcacgaccttgtgaatgggttcagatgtgactgcgccggaacaggatacgaaggcacacattgcgagagagaagtgttggagtgcgcctctgctccgtgtgaacacaatgcttcgtgtcttgagggtctgggctctttccggtgcctatgctggcctgggtactctggtgagctttgtgaagtggacgaagatgagtgcgcctcatccccatgccagcacggcggtcggtgtctgcaacgctcggaccccgctctttatggtggtgttcaggccgcttttcctggggcattctcttttagacacgccgctggctttctgtgccactgtcctcccggattcgagggggctgattgcggtgtcgaagtggacgaatgcgcatctcgtccatgcttgaatggcggtcattgccaggacctgccaaatggatttcagtgtcactgtcctgatggttatgcagggcctacatgtgaagaagacgtcgacgaatgcttgagcgacccatgcctgcacggaggaacctgctctgatacggtagcgggatatatttgccgttgccctgaaacgtgggggggacgcgattgctctgtccagttgaccgggtgccagggccacacatgtcccctggcggcaacgtgcatcccaatctttgagtcaggggtgcacagctatgtgtgccactgtcctcctggcacccatggccctttctgtggccagaacacgacattctctgtcatggctgggtcccccatccaagcttctgtgcccgctggcggaccgctcggactcgcgttgaggttcaggaccaccctccctgcgggaactctggcaacgaggaatgatactaaggagtcacttgaactcgcactggtcgcagccacattgcaagcaacgctgtggagctactccactactgtcctggtgctgcggctgcctgatttggcccttaatgatggtcactggcaccaggtcgaagttgtgctccatttagcaaccctcgagctgcgactgtggcacgaagggtgcccagccaggctctgcgtggcttcaggtccagtcgccctcgcaagtacagcaagtgcgacccctcttcccgctgggattagcagcgcccagctgggggacgcaacttttgccggatgccttcaagacgttagggtcgacgggcacctgctcctccctgaagacctgggtgaaaatgtgttgctaggatgcgagcgccgtgaacagtgccggcctctcccctgcgttcacggtggatcttgtgttgatctgtggacccattttcgctgtgactgtgcacgccctcaccggggacccacctgcgccgatgagatccccgcagccacctttggactgggaggtgctccttcttctgccagtttcttgctacaggaacttcccggaccaaatttgactgtgtccttccttctcagaacacgcgaatcagcgggtctgttgctgcaattcgccaacgatagtgctgctggcctcactgtatttctgagcgaagggaggatccgcgctgaagtgccaggctcaccggctgtcgtactgcctgggagatgggatgatggcctgcggcacctggtcatgctgtccttcggaccggaccagctgcaggatctaggccagcatgtgcatgtgggcggtcggctgctggccgctgattcccagccctggggtggcccttttcgcggttgcttacaggacctgagactggatggttgtcacctgcccttcttccccttgccactcgacaactccagtcagccttcagagctggggggacgccagtcttggaacctgaccgctggctgcgtttcagaggacatgtgcagccctgacccttgtttcaatggcggtacatgccttgtgacttggaacgactttcattgcacctgtcccgcaaattttaccgggccaacctgtgcccagcagttgtggtgtcctgggcagccttgtctgcctccagccacctgtgaggaagtcccggatggctttgtgtgtgtagccgaagccactttccgggagggccctcccgctgcattcagcgggcacaatgctagctcaggaaggctgcttggcggtctctctctcgcattcaggacgcgtgatagcgaggcatggttgctcagggccgctgctggagccctcgagggggtctggttagctgtcagaaatggttcactggccggtggcgttagaggtgggcacgggctgcctggagctgtgctgcctatccctggtcccagggtagctgacggcgcatggcatcgggtccggctagctatggaacgaccagcagcaacaacatcaaggtggctcttgtggctggacggagcagcaacccctgtggcacttcggggtttagcctctgatctgggattcctgcaagggcctggcgctgttagaatcctgttagcggagaacttcaccggatgtctgggccgagtggcactagggggtctgcctttgcctctggcacgtcctaggcctggggcagcgcctggcgcaagggagcacttcgctagctggccaggcacccccgcacctatccttgggtgccgaggggcaccggtgtgtgctccatctccttgtctgcacgacggcgcatgccgtgacctgttcgacgcctttgcatgtgcttgcgggccaggctgggagggccctcggtgcgaagcacacgtagatccgtgccactccgcaccatgcgcgagagggaggtgtcacacccaccctgacgggaggttcgagtgtcgatgcccacctggttttggcggaccccgatgtagattacccgtgccatctaaggaatgctctctgaacgtgacttgcctggatgggtcgccgtgcgaaggtggaagccccgcagccaactgttcgtgcctcgagggcctggcgggacaacgatgccaggtgccgacacttccctgcgaagccaacccttgtctgaatggaggaacatgtcgggctgcaggaggggtgtctgagtgcatttgtaatgccaggtttagcgggcagttttgtgaggtcgctaagggtctgccattgcctctgccattccctctactggaagttgccgtgcccgcagcgtgtgcctgtctcttattgctgctgttggggctcttatccgggatcctcgccgcacggaaaaggcgccagtcggagggaacctatagcccttctcagcaggaagtcgctggtgcacgtctggaaatggattccgttttaaaggtgcctcccgaagagcgactcatttag

SEQ ID NO: 219375 - DNA, 363 bp, Artificial Sequence
  Description of Artificial Sequence: Synthetic coding sequence
atggccaacccaggtctgggcctgcttttagctctaggactgccttttctgctggcgcgatgggggagagcctggggtcagatccaaaccacatcagcgaacgaaaattcaactgtgctgcctagctcaacttcaagctctagcgacgggaatctgaggccggaagcaatcacagctattattgtggtcttttcgttgcttgccgctcttcttctggcagtcgggctggccctgctggtgaggaagctacgagagaaaagacagacagagggaacctatcgtccgtcctcagaggagcaggtaggcgcaagagtccctcccacacccaatctgaaactcccacctgaggagcggctgatctag

SEQ ID NO: 219376 - DNA, 372 bp, Artificial Sequence
  Description of Artificial Sequence: Synthetic coding sequence
atggcaaaccctgggctcggtctcttgctggccttaggcctgccattcttgctcgccagatggggcagagcatggggccaaattcaaacaacctccgccaacgaaaacagtacggtcctccccagtagcactagctcttcatccgacggcaatctgagaccagaagcgattacagctatcatcgtcgtgttcagcctgctcgccgctctgctactggcagtcggcttggcgctcttggtgaggaagctgagagaaaagcgccagactgagggcacttataggccatccagtgaggagcagttttcgcacgccgctgaggcacgcgctcctcaagattctaaagagacagtccagggctgcttacctatttag

SEQ ID NO: 219377 - DNA, 363 bp, Artificial Sequence
  Description of Artificial Sequence: Synthetic coding sequence
atggcgaatcctggcttgggactactgttggccctggggttgccttttctgctggccaggtggggcagggcctggggtcagattcagacaacaagcgccaacgaaaacagcaccgtgttgccaagctctaccagctcctccagcgatggcaacctccggccagaggctatcacagccattattgttgtatttagcttattggccgcactcctgctggctgtaggcctagccctcttagtgcgcaaactcagagagaaaagacaaaccgaaggaacataccggcctagcagtgaagaacaagtgggcgcacgcgtgcctcctaccccgaatctcaaattacctcctgaagaaaggctaatctag

SEQ ID NO: 219378 - DNA, 1599 bp, Artificial Sequence
  Description of Artificial Sequence: Synthetic coding sequence
atgcccgcacctccgggacggacccacacctggttcctcctccagtccttggaggacctggacacatctctgcgcaagctgaacagcagactgttcgtcgtcagggggcagcccgctgatgtgttccctcggctcttcaaggagtggggggtgactaggctgacctttgagtacgacagcgagcctttcggcaaagagcgggatgccgctattatgaagatggccaaagaagctggggtcgaggtggtgaccgagaattcccatacgctgtacgacctcgatcgcattatcgagctaaatggacagaagccccctcttacatataagcgcttccaggccattatcagcagaatggagctgcccaagaaacctgtgggactggttacctctcaacagatggagagctgcagggccgagatccaggagaatcatgatgagacttatggtgtgcccagcctcgaggaactggggttccccacggaagggttgggccctgctgtttggcagggcggtgaaactgaggctctcgcacgacttgataagcatcttgaaaggaaggcatgggttgccaactatgagcggcctcgcatgaacgccaacagcctgctggctagcccaacaggcctctccccttacctccgcttcgggtgcctgagttgtcgtctgttctactaccggttgtgggatctttataaaaaggtgaaaagaaattctaccccccctttaagccttttcgggcagctcctgtggagagagttcttttataccgccgcaaccaacaatccccgatttgaccggatggagggtaatcctatttgcattcagatcccctgggaccggaatccagaggctctcgcaaaatgggccgagggaaaaacaggattcccttggatagatgcaattatgacccagctgcgccaggaaggatggatccatcacctggctcggcacgctgtcgcatgcttcctcactcgtggagacctgtgggtgtcttgggagtctggggtccgcgtgttcgatgagctgctgcttgacgcggactttagcgtgaacgctggctcctggatgtggctgtcatgtagtgcattctttcagcaattcttccactgttattgccccgtcggtttcgggcgaagaaccgaccctagtggcgactacattcgacggtatctgcccaaactgaaagcatttccaagccgatatatttacgaaccttggaacgcaccagaatctattcaaaaagcagccaagtgcatcatcggggttgattatcccaggcctatcgttaatcacgcagaaaccagtcggctgaacattgaacgcatgaaacagatctatcagcagctctctcggtaccgaggactttgcctgctagcttccgtcccttcttgcgtggaggatctgagccacccagtagccgagccatcaagcagccaggctggatccatgtcctcagctggacccaggccactgccaagtggaccagctagccccaagagaaaattggaggctgcggaggaacctcctggcgaggagctgagcaagcgggcaagagtggctgagctgccaacacctgagcttccgagtaaggacgcctag

SEQ ID NO: 219379 - DNA, 1845 bp, Artificial Sequence
  Description of Artificial Sequence: Synthetic coding sequence
atgggtggggtgcacgttgcatacagaggaggggcaggcgttgccggtgccgtgtggaccgtcatggcagctactgtggccacagcagccgctgtcgctcctgctcctgcgccagggactgatagcgcatcatcagtccactggttccgcaaaggacttcggctgcacgataacccggcactgctagcagcagttcgaggcgcaaggtgtgtgaggtgtgtgtacattctcgatccatggttcgctgctagcagctcagtggggatcaaccgctggagatttctcctccagtcactggaggacctggatacttctttgcgtaagctcaactcccggcttttcgttgttcgaggacagccggctgatgtgttccctcggctgttcaaagagtggggcgtcactcgactcacattcgaatatgactccgagcctttcggaaaagagagggacgccgcaatcatgaaaatggccaaagaagccggtgtggaagtggtgacggagaatagtcacacactctacgacctcgatcggattatcgagctcaatgggcagaagcctccgttgacctacaagcgttttcaggcaattatctcccggatggagttgccaaaaaaaccagtgggactcgtgacttcccaacagatggagagctgcagagccgagatacaggaaaatcatgacgagacgtacggtgttccatctttggaagagctcggattcccaacagagggcctcggaccggcagtatggcaaggcggagaaacggaagctcttgctcgactcgacaaacatctggaacgaaaagcatgggtggccaactacgaacgccctcgaatgaacgccaattctctgctcgcttcgcccaccggcttgtcaccttacctgagatttgggtgcttaagttgcaggctattctactacagattgtgggatctctacaaaaaagttaaacgcaactcaactccgccactatccctctttggacaacttctgtggagggagttcttttacacagctgccaccaataatcctcgatttgataggatggagggtaaccccatttgtatccagatcccctgggacagaaaccccgaagcactagccaaatgggcagaagggaagaccgggtttccctggatcgacgcaatcatgacacagctgcgccaggagggatggatacatcatttggccagacatgccgtggcatgttttcttacacgaggcgacctctgggtgtcctgggagagcggggttcgggtttttgacgagctgttactggacgccgacttcagcgtaaacgctggcagctggatgtggctatcctgctctgctttcttccagcagttcttccattgctactgtcccgtcggattcgggcgtcgcactgacccatcaggcgactacattcgtagatacctccctaagctcaaggctttccccagtcgctacatctatgaaccgtggaacgccccagaaagtattcagaaagccgcaaagtgcattattggagtcgactatcccaggccaatcgttaaccatgctgagacctcgcgcttaaacattgagagaatgaagcagatttatcaacagctgtctaggtatcgcggactgtgtctgttagcgagcgtaccgtcctgcgtggaggacttgtcccatcccgtagcagaaccaagttcatcacaggccggttccatgtcctccgcaggcccaaggccgctgcccagcggcccagctagtccgaagcggaaactggaagcggcagaggagcccccaggggaggagttgtccaaacgggcacgggttgccgaactgcctacccctgagcttcctagtaaggacgcctag

SEQ ID NO: 219380 - DNA, 522 bp, Artificial Sequence
  Description of Artificial Sequence: Synthetic coding sequence
atggatgtcactatccagcacccttggtttaagaggaccttagggccattctacccatcaaggctctttgaccagttcttcggcgagggcctgtttgaatatgacttgctcccatttctgagcagtacaattagcccatattatagacagtctctgttcagaactgttctagattctgggatttcagaagtgaggagtgatagggacaaatttgtaatctttctggatgtgaagcacttctcccccgaggacctgacagtgaaggttcaggatgattttgtagaaatacatggaaagcataatgagaggcaagatgaccacgggtacatctcacgggaatttcaccgccgttataggctgccaagcaatgtggaccagtcagcgctcagctgtagtctgagtgcggatggtatgctcaccttttgcgggccaaaaattcagactggcctggacgcaacccacgccgagcgggcaatcccagtcagtcgcgaggaaaagcctactagcgctccctcatcatag

SEQ ID NO: 219381 - DNA, 570 bp, Artificial Sequence
  Description of Artificial Sequence: Synthetic coding sequence
atggcgctggtccggggaggctggctctggcgccagtcaagtattctgcgccgatggaagagaaattggttcgccctgtggctggatgggacccttggctattaccacgacgaaacagcgcaggacgaagaagatagagttcttatacatttcaacgtgcgagatataaagataggtcctgagtgtcacgatgtgcaacccccagagggcaggtctcgtgacggactactcaccgtaaacctacgtgagggtgggcgattgcatttatgcgccgagaccaaggacgatgccttggcttggaaaaccgctctcctcgaggcaaattctactcctgtgagggtctactctccctaccaggattattacgaggtggttccacctaacgcccacgaagctacctatgtacgatcatattacggcccaccctacgcagggccaggcgtcacacatgtgattgtgcgcgaggatccttgttatagcgcaggggctccgttggcaatggggatgctcgccggagccgctacaggggcagccctcggatcactaatgtggagtccatgctggttctag

SEQ ID NO: 219382 - DNA, 528 bp, Artificial Sequence
  Description of Artificial Sequence: Synthetic coding sequence
atggacattgctatccaccacccatggatcagacgacccttctttccatttcattccccctccagacttttcgaccagtttttcggagaacacctcctggagtctgacctttttccaacatccaccagcctgtcccccttttatctgaggccaccatcttttctgcgagccccaagctggttcgacacagggctttccgaaatgcgcctggagaaggatagattttctgtgaatctagacgtaaaacatttctcacctgaggagttgaaggttaaggttctcggtgatgttatcgaggtgcatgggaagcatgaggagaggcaggacgagcatggatttatcagtagggagttccataggaaatatcgcattcccgcagatgttgatccactgacgatcacgagctcactgtcctcggacggggtgttaacagtgaatggtccaaggaagcaggtctctggtccagagcgaaccatcccaatcacacgcgaggaaaagccagccgtgactgccgcaccaaagaaatag

SEQ ID NO: 219383 - DNA, 525 bp, Artificial Sequence
  Description of Artificial Sequence: Synthetic coding sequence
atggacatcgccattcaccatccgtggattcggcgaccctttttcccctttcatagtccgtcccggctatttgatcagttcttcggagagcacctcctggaatctgacctgtttcccaccagcacaagtctgagccccttctatctgcgccctccatctttccttcgggcaccaagttggttcgatacaggcctgtccgagatgagactggaaaaggatcgcttcagcgttaatttggatgtgaagcatttttctccagaggaactgaaagtgaaagtgctcggcgacgtgatcgaggtccacggcaagcacgaggaacgccaggacgaacatggcttcatctctagagagtttcatcgaaagtatcgcatccctgccgatgtggacccgcttaccatcacctcatcattgtcatcggatggtgtgctcacagttaatggtccccgtaaacaggtgtctgggccagagagaacaattcctataacacgagaggagaaacccgcagtaactgccgctcccaagtag

SEQ ID NO: 219384 - DNA, 528 bp, Artificial Sequence
  Description of Artificial Sequence: Synthetic coding sequence
atggacattgcgatccatcacccctggatccggaggccgttcttccccttccattcgccttcccggctcttcgatcaattcttcggcgagcacctcttggagagcgacttgtttcccaccagcacctccctctcaccattctacttgcggccacctagttttctgagagctccatcatggtttgacactggcctgagcgaaatgcgccttgagaaagataggttctcggtgaatttagatgttaaacacttctcaccagaagagctgaaggtcaaggttttgggggacgttattgaagtccacggtaagcacgaggaaagacaggatgagcatgggtttatcagcagggagttccataggaagtatcgaattcctgcggatgttgacccgctgaccatcacttcctcgctgtcatccgacggggtcttgacagtgaatggcccacgaaagcaggtgagcggccctgagaggaccatccccatcactagagaggagaaacccgctgtgaccgccgctcccaaaaagtag

SEQ ID NO: 219385 - DNA, 234 bp, Artificial Sequence
  Description of Artificial Sequence: Synthetic coding sequence
atggacattgcgatccaccacccttggattagacgcccattcttccccttccattcaccttctcgcctgttcgatcagttttttggagaacacctgcttgagagcgatctgttcccgacctcaaccagtttgagccccttttatttgcggccaccgtccttccttagggctccgtcctggttcgacactggactgtctgagatgagactggaaaaggaccgcttttctgtctag

SEQ ID NO: 219386 - DNA, 393 bp, Artificial Sequence
  Description of Artificial Sequence: Synthetic coding sequence
atggacattgctatccatcacccctggataaggcgcccattctttccttttcattctccttcccgcctcttcgatcaattcttcggggaacaccttctggaatccgacctcttcccgacatcaacttctttgagtcccttctatctgcgaccacctagctttctcagagccccatcctggtttgatacaggcctgtcggaaatgcggctggaaaaggatcgcttttccgtgaacttggacgtgaagcactttagtcctgaagagctcaaggtaaaggttctcggagatgtgatcgaggtacacggcaagcacgaggaacgacaagacgaacacggcttcataagccgggagttccatcgcaagtatagaatccccgcagacgtcgacccctag

SEQ ID NO: 219387 - DNA, 528 bp, Artificial Sequence
  Description of Artificial Sequence: Synthetic coding sequence
atggatattgctatccatcacccctggatccggagaccatttttcccctttcatagcccaagtaggctcttcgaccaattctttggcgagcacttactggaaagtgacttattccccaccagtacgtctctgtcaccattttatctacggcctccgagtttcctcagggccccttcctggttcgatactggactctccgaaatgcggctggaaaaggacaggttctccgtcaatctggatgtgaagcacttctcgcccgaagagttgaaagtcaaggtgttaggggacgtgattgaagtccatgggaaacacgaggaacgccaagatgaacacggctttatctccagggagtttcataggaagtatcggatacctgcagatgtagatccactcacaatcacatcatcccttagctccgacggcgtgttaacagtcaacggtcctcggaaacaggtctcgggcccagaacgtaccatccccattacacgcgaggaaaagccggcagtgactgccgctccaaagaagtag

SEQ ID NO: 219388 - DNA, 528 bp, Artificial Sequence
  Description of Artificial Sequence: Synthetic coding sequence
atggacatcgctatacaccacccttggatcaggcggccattttttccctttcacagtccttcaaggcttttcgaccagttttttggcgaacacctcctggagtcagatcttttcccaaccagcacatcactgagcccgttttacctcaggcccccttctttcctccgcgctccctcctggtttgacactgggctgtcagaaatgcggttggaaaaagatcgctttagcgtgaatttagatgtgaaacattttagccccgaggagttaaaggtgaaggtgctgggagatgtcatcgaggtccacggaaagcacgaagagcgccaggatgaacacgggtttatcagcagagagttccatcgaaagtaccgtattccagccgacgtggaccctcttacaatcacatcttccctctcctccgatggagtgcttaccgttaacggcccacgcaaacaagtctctggccctgagcgtaccataccgatcactagagaagagaagcctgcagtaactgccgctccaaagaaatag

SEQ ID NO: 219389 - DNA, 210 bp, Artificial Sequence
  Description of Artificial Sequence: Synthetic coding sequence
atggatatcgctattcaccacccatggatccggaggcccttcttcccatttcacagtccttcacgcctgtttgatcagttcttcggcgagcatctgctggagtcagacctgtttccaacatcaacatccctttcccctttctacctgagacctcccagctttctgcgggctccatcctggttcgacacggggctatcagagatgcgttag

SEQ ID NO: 219390 - DNA, 2148 bp, Artificial Sequence
  Description of Artificial Sequence: Synthetic coding sequence
atgcacctcctgcctgcacttgcaggagtgctcgcaacgcttgtgttagcccaaccatgcgaaggaactgatccggcttctccaggcgctgtcgagacttccgttttgcgcgactgtattgctgaagctaaactgctggtggatgcggcttacaactggacccaaaagtctattaaacagagactgcgtagtgggtcagcctctcctatggatctcctcagctacttcaagcagccggtcgctgcaacacgtacagtggttagggccgcagactacatgcacgtggccttgggacttcttgaagaaaagttacagccacagagatctgggccattcaacgtcaccgatgtgttaaccgagccacaactcaggctgttgtctcaagcttctggttgtgccctgcgtgaccaggcggaacgatgttctgacaaatacaggactatcactggcagatgcaacaacaagcgcagacctttactcggagcgagcaaccaggccctggcccgatggcttccggctgaatacgaagatggattaagcctacctttcggctggaccccatcccggaggcgcaatgggttccttttgcctctggttcgcgcagtttccaatcagattgttcgctttcccaacgaaaggttaacgagtgacaggggcagagccctgatgtttatgcagtgggggcagtttattgaccacgacctggatttctccccagaatcccctgcgagagtagccttcaccgccggagtagattgcgaaagaacgtgtgcccagctcccaccgtgctttcctattaaaatcccccctaacgaccctcgcataaaaaaccagagagattgcattcctttttttcgcagtgcacctagttgtccccagaataagaaccgcgttcggaaccagattaatgctctcacctcatttgtggatgcttctatggtgtatggaagcgaagtctcactgagcctgaggctgaggaatcggacaaattacctgggcctcctggcaatcaaccagagattccaggacaacgggagagcattactgccgttcgacaacctgcacgacgacccgtgtctcctgaccaaccgatctgcaaggatcccatgttttttagccggagatacacgtagtacagaaactccaaagctggccgctatgcacacactctttatgagggaacacaatcggcttgccaccgaacttcggagactgaacccccgatggaatggtgataagctgtataatgaggccaggaaaatcatgggagctatggttcagatcattacatacagggatttccttccattagttttagggaaggcacgcgcacggagaactttgggacattacagaggttattgttccaacgtagacccacgggtcgccaatgttttcactctcgcatttcggtttggccataccatgcttcagccgtttatgtttcgattggattcccagtacagggcttcggctcccaactcccacgtgcctctcagctctgccttctttgcgtcttggcgaatcgtttacgaagggggtatcgatccaatcctgaggggcttaatggccaccccagcaaagctaaataggcaggatgccatgcttgtggacgaactgagggataggctcttccgccaggttcggcgtatcggcctcgaccttgcagccctgaacatgcagcgcagcagagatcacggcctacctggatataatgcttggcggaggttctgtggcttatcacaacccagaaacttagctcagctatctcgggtactgaaaaaccaggacttggccaggaagttcctgaacctgtatggtacacctgacaatatcgacatctggatcggggctatcgcggagccgctgcttcctggggctcgcgtgggtcccctcctcgcttgcttattcgaaaaccagttcagaagagctagagatggcgacaggttttggtggcagaaaagaggggttttcactaaaaggcagcgaaaggcattgagtaggataagcctgagtaggattatctgcgacaacactgggattaccacagtttcaagggatatcttcagggccaacatctaccccagaggctttgtgaattgcagtcgaatcccccgtttgaatctgtctgcatggagagggacctag

SEQ ID NO: 219391 - DNA, 594 bp, Artificial Sequence
  Description of Artificial Sequence: Synthetic coding sequence
atgtccagtgctcctgccccagggcctgccccagcctcgttaacgctgtgggacgaggaagactttcaggggaggcgatgcaggctgctctctgattgcgccaatgtatgcgagagagggggactgcctagagtgaggtctgtgaaggtggaaaatggggtgtgggtggcttttgaataccctgatttccagggacaacagtttattttagagaaaggcgattaccccagatggagtgcatggagcggcagctcatcccataattccaatcagctgttgtcctttcgccctgtgttgtgtgcgaaccacaatgacagcagagttaccctgtttgagggcgataatttccaggggtgtaagtttgacctggtggacgactatccatccctgcctagtatggggtgggctagtaaagacgtcgggtcactcaaagtgtcttccggtgcctgggtagcgtatcaatatccaggctatcggggataccaatacgtcctcgaacgcgatagacacagcggtgagttctgcacgtacggcgagctcggcacccaagcccacacaggccagttgcaaagcatcagaagagttcaacactag

SEQ ID NO: 219392 - DNA, 594 bp, Artificial Sequence
  Description of Artificial Sequence: Synthetic coding sequence
atgagttccgcacctgccccagggccagcccctgcatcactcactctgtgggatgaggaggatttccaagggagacgctgtagattattatccgattgcgctaacgtgtgcgagcggggtggactccctcgagtgcggtccgtcaaggtagaaaacggtgtgtgggtggcattcgaataccccgattttcagggacagcaattcatcctggagaaaggcgactatccgagatggagcgcctggtccggctcttcatcgcacaacagtaaccagctacttagttttcgccctgttctttgcgcaaaccacaatgacagcagggtgaccctgttcgaaggagacaactttcagggctgcaaattcgatctggtggatgactaccctagtctgcctagcatgggatgggcgtccaaagatgtgggaagcctgaaggtttcttccggcgcatgggtcgcataccaatatcctgggtaccgaggatatcagtatgtcctggaaagagaccgccattctggagaattttgcacctatggcgaactcggaactcaggcccatacaggccagttgcagtcaattcgacgggttcagcattag

SEQ ID NO: 219393 - DNA, 390 bp, Artificial Sequence
  Description of Artificial Sequence: Synthetic coding sequence
atgtcctccgcgccagccccaggtccagctcccgcatcactgaccttgtgggacgaggaagacttccagggacgaagatgccggctcctgagcgactgcgcaaacgtctgtgaaagaggaggactcccacgcgtcaggagtgttaaagtcgagaacggggtgtgggtggcctttgaataccccgactttcaaggtcaacagttcatactggaaaagggcgattatcctcgctggagcgcctggagtggaagcagttcccacaatagcaatcaactcttaagctttagaccagtcctgtgtgccaatcacaatgacagtcgggtgacgctgtttgagggtgataatttccagggttgtaagtttgaccttgtggacgattatccaagctag

SEQ ID NO: 219394 - DNA, 591 bp, Artificial Sequence
  Description of Artificial Sequence: Synthetic coding sequence
atgaccctgcagtgcaccaagagcgccggaccctggaaaatggtcgtctgggatgaggatggcttccaaggcagacgccacgagtttactgcggagtgtccgtcagttcttgaactcgggtttgaaacggttcgctctctgaaagtgctttccggggcttgggtcggcttcgagcacgccggattccagggccaacagtatattctggagcggggagagtatccatcttgggacgcttggggtgggaacacagcgtaccctgctgaaagattgacatcattcagaccggcagcctgtgcaaatcaccgtgactctcgcctgaccatctttgaacaggaaaattttctgggaaagaagggagagctgtccgacgactacccctctcttcaagctatgggttgggaagggaacgaagtcggctcattccacgtccatagcggagcatgggtttgtagtcagttcccgggataccgaggattccagtatgtgctggagtgtgatcaccattctggcgactacaaacattttagagagtgggggagtcacgctccaaccttccaggtgcagtctattcgtcgaatacagcagtag

SEQ ID NO: 219395 - DNA, 1614 bp, Artificial Sequence
  Description of Artificial Sequence: Synthetic coding sequence
atggaaagggtgaatgatgctagctgtggacccagcggctgctatacctatcaggtgagtcggcactctacagaaatgttgcataatcttaatcaacagcgtaagaatggtgggagattctgcgacgtgctcctgagagtcggagacgagtcattcccagcccacagagccgtgctcgctgcatgctcggaatacttcgagtccgtcttttccgctcagctgggggatgggggagctgcagacggagggccagccgatgttggcggtgcaactgcagctcccggtggaggagctgggggaagcagagagctggagatgcatactatatcctcaaaggtgttcggtgatattcttgactttgcatacacttctagaattgttgtcaggctcgaatcttttcctgaactgatgacggccgctaagtttctcctcatgcggtctgtaatagaaatctgtcaggaagtgataaaacagtcaaatgttcaaatcctggtgcctcctgcccgtgctgatatcatgctgtttcgcccaccaggaacctcggatctgggttttcctctggatatgactaacggcgctgccctggctgcaaattctaatggcatagccggatccatgcagcccgaggaagaggcagccagggctgcaggagctgccatagccggacaggccagcctgcccgtgctcccaggggtggatagactccccatggttgccggtccactgagcccccagctgctgaccagtcccttcccatcggttgcctcgagtgcaccaccgctcacaggaaagagagggcgtgggcgtccccgaaaggcaaatctgttagattctatgttcgggagccctggaggtctgcgcgaggctggtatcttgccatgtggactgtgtggcaaggtgtttaccgacgcaaaccgtttgagacagcacgaggcacaacacggggtcactagcctgcagcttggctatatcgatttgccgcctccacgactaggagagaatggactgcctatctccgaggatcccgatggtccacgcaaacgctctaggaccagaaagcaggtcgcttgtgaaatttgcggcaaaatctttagagacgtttatcacctgaataggcataaactttcccatagtggtgagaagccctattcttgccccgtctgcggcctaagatttaaacggaaagatcggatgtcctaccacgtgagaagccatgatggttcagttggcaagccatacatttgccagtcttgcggtaagggtttcagccggccagaccacctgaatggtcacatcaaacaggtgcacacgagtgaacggccacataaatgccaggtgtgggtgggaagctcctccggcctgccaccactcgagccattgccgtccgatctgcccagctgggattttgcccaaccggcattatggaggtctagccactcagtacccgatactgccttttcacttagcctcaagaaatcctttccagcactagagaatctgggtccggcacacagctctaacacgttgttttgccctgctccgcctgggtatttgaggcaggggtggacgactcctgagggcagccgcgcattcacccagtggccagttggctag

SEQ ID NO: 219396 - DNA, 618 bp, Artificial Sequence
  Description of Artificial Sequence: Synthetic coding sequence
atggcgtctgatcaccagacacaggccggaaagcctcagtccctgaacccgaagatcattatcttcgaacaggagaactttcagggccacagccacgagttgaatgggccatgtcccaatctgaaagagaccggtgtggagaaagcgggttcagtgctcgtccaggcaggtccatgggtggggtacgagcaggccaattgcaagggagaacagttcgttttcgaaaagggagaatatcctcggtgggactcatggacgagctcaagacgcacagattcgctatccagtctacggcctataaaagtggactcccaagagcacaaaatcattctctacgagaatcccaactttacagggaaaaaaatggaaattatcgatgatgatgtcccttcatttcacgcacatggctatcaggagaaggtgtcatctgtgagggtccagagcggcacttgggtaggataccagtacccagggtatagagggctccagtacctgttagagaaaggcgattataaagattccagtgactttggagctccccacccgcaggtgcagagcgtgagacgcattcgtgacatgcaatggcatcagcggggagcgtttcatccaagtaactag

SEQ ID NO: 219397 - DNA, 1284 bp, Artificial Sequence
  Description of Artificial Sequence: Synthetic coding sequence
atgagacatctgggggcttttctgttccttctcggggtgcttggggctttgacggaaatgtgtgaaatacctgaaatggattcccacttagttgagaaactgggtcagcacctcctcccctggatggaccgcctttccctcgagcacctaaatcctagtatatacgtggggctccgactgtccagtctgcaggccggtactaaggaggacctgtacctgcactccctcaagttaggatatcagcagtgtcttcttggttctgcgtttagtgaagatgatggcgattgccagggaaaaccttctatggggcagcttgcattgtatcttttggccttgagagccaattgcgagttcgtgcggggacataagggagatcggctcgtgtcccaactgaaatggttcctagaagatgagaaaagagctatcgggcacgatcataaaggacaccctcacacatcctattaccagtacggcctcgggatcctggccctgtgcctgcatcagaaacgcgtgcacgactccgtcgtggataagctgctatacgccgtggagccttttcatcagggacatcactctgtcgacactgccgctatggcaggattggccttcacttgtttgaagcgatcaaacttcaatccaggccgaagacaacggatcacaatggctatccgcacagttcgggaagagattctgaaagcccagacaccagaggggcactttggcaatgtatactcaacaccactcgctctccagtttctgatgacctctcctatgcgcggtgccgagctggggacagcctgcttgaaggcccgagtagcactgctggccagcctgcaggatggtgcctttcagaacgctctcatgatctcacagctgctgcccgttcttaatcacaaaacttatattgacctaatttttcccgactgtctggctcctagagttatgcttgagcccgcagccgagactatccctcagacccaggagatcatcagcgtgaccctgcaagtccttagtctgctcccgccatacagacagagtatttcagttctggcgggaagcactgtcgaggatgtcttaaagaaggcccatgaattgggtgggttcacctacgaaacccaagcatccctctctggaccttacttgacctccgtgatggggaaggccgcaggggaacgggagttctggcaactgctgcgtgatcccaacacccctctgctacaagggatcgccgactacaggccaaaggatggggaaaccatcgaactccgcctagtaagttggtag

SEQ ID NO: 219398 - DNA, 525 bp, Artificial Sequence
  Description of Artificial Sequence: Synthetic coding sequence
atgggcaagattaccttctacgaggatagagattttcagggccgatgttacaactgtatttccgactgccccaaccttcgggtgtacttctcccgttgcaatagcatcagagtagacagtggctgctggatgctgtatgagagacccaattaccagggacatcaatacttcctccggagaggaaaatatccagattaccaacactggatgggcctgtctgattctgtccaatcttgtcgaatcattccgcacacctcctctcacaagttacgcctttacgagagagacgactacaggggtctaatgtccgagctgacagatgattgtgcatgcgtaccagaattgtttagactccctgaaatttatagcttacacgtgctggagggttgctgggtcctttacgagatgcccaattatagagggaggcagtacctgctgcgtcccggagactaccgcaggtatcacgattggggtggagcagatgcaaaggtcggcagcctgcggcgtgttaccgacctttactag

SEQ ID NO: 219399 - DNA, 528 bp, Artificial Sequence
  Description of Artificial Sequence: Synthetic coding sequence
atgggaaagattaccttttacgaggaccgagccttccaaggcaggtcctatgaatgtactacggactgtccaaacttacaaccctacttttccaggtgcaatagtattcgggtcgagagtggctgctggatgatttacgagcggccaaattatcaggggcaccagtattttctgagacggggtgagtaccctgattatcagcagtggatgggcttgtctgattcgatccgaagctgctgtctgataccacctcactctggggcataccgaatgaagatctacgaccgagacgagctgaggggacaaatgtccgagctaacagacgattgcatttctgtgcaagatcggttccatctcaccgagattcatagcttgaacgtgctggaagggtcctggattttgtacgagatgcccaactatcggggtcgacagtatctgctgaggcctggggaatacaggcgctttctggactggggtgcccctaatgctaaggtagggtcactgaggcgcgttatggatctttactag

SEQ ID NO: 219400 - DNA, 525 bp, Artificial Sequence
  Description of Artificial Sequence: Synthetic coding sequence
atggggaagatcacattttacgaggacagggccttccaggggagatcttacgagacgacaacagattgccccaatttgcagccatatttttccaggtgtaattctattagagtggaatccgggtgttggatgttatatgaaaggcccaactaccaaggccagcagtacctcctgagacgcggagagtaccccgactaccagcagtggatgggcttatccgatagcataagaagttgttgtcttatcccacaaacagtctctcaccgtttaaggctttacgagagagaggatcacaaaggactgatgatggagttgagcgaagactgtcccagcattcaggaccgcttccacctgtccgaaatacgttctcttcacgtgcttgaaggatgttgggtgctatacgaactccctaactacaggggcaggcagtacttactgaggccacaggagtacagacgatgccaggattggggagctatggacgccaaagctgggtcccttcggagagtggtcgatttatactag

SEQ ID NO: 219401 - DNA, 525 bp, Artificial Sequence
  Description of Artificial Sequence: Synthetic coding sequence
atgggaaaaataacactctatgaggataggggctttcaggggcgacattacgaatgctccagcgaccatccaaatctgcagccctacctgtctaggtgcaatagcgccagagtggatagcgggtgttggatgctttacgaacaaccgaattattctgggctccaatacttcctcaggaggggggactacgccgatcaccagcagtggatggggctgtcagactctgtgcggtcatgcaggttgattcctcactcgggaagtcacagaattcgcttgtacgagcgagaagattaccgtgggcaaatgattgaatttacagaagattgcagctgtctgcaggaccgattcaggtttaatgaaattcactccctgaacgtacttgaagggtcttgggtgctatacgagctcagtaattatcgtggccgtcagtacctgttgatgccgggagactatagacgctatcaggattggggagccaccaacgcacgcgtcggctcactgcgtcgcgttattgatttctcatag

SEQ ID NO: 219402 - DNA, 537 bp, Artificial Sequence
  Description of Artificial Sequence: Synthetic coding sequence
atgtccaaaacggggactaaaatcactttctatgaggacaaaaacttccaaggaaggagatatgactgcgattgcgattgcgctgatttccatacctatttatccaggtgtaactctataaaagtggagggcggaacatgggcggtgtatgagaggccaaacttcgcaggctatatgtacatcctcccccaaggggagtatccagaatatcagaggtggatgggtcttaatgaccgcctcagttcctgccgcgcagtgcacctgccctccggaggtcagtacaagatccagatttttgagaaaggcgacttcagtggacagatgtacgaaaccactgaagactgtccgtctatcatggagcagttccacatgcgtgagattcactcttgcaaggtactcgagggagtgtggatattctacgagttgcccaattatcgaggccgtcagtacctcttggataaaaaagagtataggaagccaatagattggggggctgctagccccgctgtccagtccttcagaagaattgtggaatag

SEQ ID NO: 219403 - DNA, 537 bp, Artificial Sequence
  Description of Artificial Sequence: Synthetic coding sequence
atgagtaagactggaaccaagattacgttttacgaggacaagaatttccaggggcgacgatatgactgcgattgcgattgtgccgacttccacacatatctgtctcgttgtaattccattaaagtggaaggtggtacatgggccgtgtacgaacgtcccaattttgctggatacatgtacattctccctcagggcgaataccctgaataccagcgctggatgggtcttaatgatcggctcagtagttgtcgagctgtgcacctgccctctggagggcagtataaaatacagatttttgagaagggcgatttcagcggtcagatgtatgaaacaaccgaggactgtccatctattatggaacagtttcacatgcgggagattcactcctgcaaggtgctggaaggagtctggatcttctacgaacttccaaattacaggggaaggcagtatttattagataagaaggaatatcggaagcctatcgactggggggcagcctcacctgccgtgcagtccttccgcaggattgtagagtag

SEQ ID NO: 219404 - DNA, 960 bp, Artificial Sequence
  Description of Artificial Sequence: Synthetic coding sequence
atggcaagttcggccgcaggctgtgtggtcatcgtcgggtcaggagtcattggccgatcatgggccatgctgttcgccagtggtggattccaagtaaagctgtatgacatcgaacaacagcagatcagaaatgccttggagaacattaggaaagagatgaagttgctcgaacaggccggaagtctgaaggggagcctctctgtcgaggaacagctgagcctgattagcggttgcccaaatatacaggaagctgtcgaaggcgcaatgcacattcaggaatgcgtccccgaggatctggagctgaaaaagaagatcttcgcccagctggactccatcattgatgatcgggtcattttaagcagtagcacgtcctgcctcatgccttcaaaactgtttgcgggattggtgcacgtgaagcagtgtatcgtcgcccacccagtgaaccccccttactatattcccttagtcgagttagtcccacaccctgagaccgctcccacgaccgtggacaggacacacgcactgatgaagaagattggccagtgccctatgcgcgtccagaaggaggtggccggattcgtgctgaacagactccaatacgctatcatctctgaggcgtggaggcttgttgaagagggtatcgtgagtccctctgatctggacttagttatgagtgaggggctggggatgcgatacgccttcatcggccctctcgaaaccatgcatctaaatgccgaagggatgctgtcttattgcgatcgatacagcgaagggatcaagcacgtgctccagacttttggccctattccagagttctcgcgtgcgaccgcagagaaagtgaatcaggacatgtgtatgaaggttcccgacgaccctgaacatcttgccgcacgtcgccagtggagagatgagtgtctcatgaggctcgctaaacttaagtcccaggtgcagccccagtag

SEQ ID NO: 219405 - DNA, 2346 bp, Artificial Sequence
  Description of Artificial Sequence: Synthetic coding sequence
atggccaagacgccttccgatcatctcctgtccactctggaggaactcgtgccctacgactttgaaaagtttaaatttaaactgcaaaatacctcagtgcagaaagaacacagccgcatacccaggtcacagattcagagggccaggccagtgaagatggccaccctgctcgtgacgtactatggtgaggagtatgctgttcaactgactctccaagtccttagagccattaatcagcggctactggctgaggagctgcacagggcggctatccaggagtatagtacacaggagaacggcaccgatgatagcgccgcaagctcatctctcggtgaaaacaagccgagatcactcaaaacacctgatcaccccgaggggaacgagggtaacggtccaagaccctacggcggtggagccgcatctttaaggtgttcccagccagaggcgggacgaggactttccaggaaacccctgtctaagaggagagagaaagcctcagagggccttgatgcccaggggaagccacgcacacgatctcctgcgcttccaggcggtaggagtcctggcccttgccgggctctggaagggggacaggccgaggtgaggctgcgacggaacgcaagttcggctgggaggctgcaggggctggctggcggagccccaggtcagaaggaatgtcgtcccttcgaggtctacctcccttccgggaagatgaggcccagatctctcgaagtaaccatctctaccggcgaaaaggctcccgctaaccccgagatcttgcttaccctggaggaaaagaccgcagccaatttggattcggctaccgagccacgcgcacgccctactcctgacggtggagcgtccgctgacctgaaagaaggccctggcaaccctgagcatagcgtgacagggaggcccccagataccgctgctagtcccagatgtcatgctcaggaaggggaccccgttgatgggacctgcgtccgggactcatgcagtttccccgaggccgtgagcggacacccccaggcatccggttctcgttctcccggttgcccccgatgtcaggactcgcacgagcgcaaatcacccggttccctgagcccccagcctcttccgcaatgcaagcgccacctaaaacaagtccagctgctcttctgcgaggaccacgacgagcccatatgcctcatctgtagcctgagccaggagcaccaaggccatagagtgcggccaattgaagaagtagcccttgagcataaaaaaaagatccagaaacaattggaacacctaaagaagctcagaaagtccggggaggagcaacgtagctacggagaggagaaggccgtatcctttctgaaacaaaccgaggcactgaaacagcgggtacagaggaaattggagcaagtctattactttcttgaacagcaggagcactttttcgtggcctcattggaggatgtgggtcaaatggtggggcagatcaggaaagcatatgatacccgtgtcagccaggatatagcactgttggacgctttaatcggagagctcgaggcaaaggagtgccaaagtgaatgggagcttctgcaggatattggcgatatactgcatagagcaaagaccgtgccagtaccggagaaatggacaaccccacaggagattaagcagaagattcagttgctgcaccagaagtcagaattcgtagaaaaatctactaaatacttttccgagacgctgcgaagcgaaatggaaatgtttaacgttcctgaattgataggagcacaggcacacgcggtgaacgtcattctggacgcggaaacagcttatcccaacctgatcttttcagatgatctaaagtctgtgcgcctgggaaataaatgggagcgcctgccggatggtcctcaaaggttcgatagctgcattattgtcctgggaagccctagcttcttgtctggtaggcgttactgggaagtcgaggtcggtgataaaactgcttggatcctgggggcatgcaaaacttctataagcaggaagggtaacatgaccctgtccccagaaaatggctattgggttgttattatgatgaaggagaatgaatatcaggcatccagtgtaccccctacccgactcctgatcaaagagccccctaagcgtgtgggtatattcgtggactatcgggtcggcagcataagcttttataacgtgactgcccgttcccacatctacacatttgccagctgttcatttagtggacctctgcaacctatcttcagcccgggaaccagggacggcggtaagaataccgcgcctctcactatctgcccggtcggcggtcaaggcccagattag

SEQ ID NO: 219406 - DNA, 945 bp, Artificial Sequence
  Description of Artificial Sequence: Synthetic coding sequence
atgtccagagtgccggcattcctgtcagcagcagaagtagaggaacacctgagatcaagctccctattgattcccccactcgaaacagctttagctaacttcagttccgggcctgaaggtggggtcatgcaaccggtacgcactgtggtcccagtgactaagcaccgaggctacctcggggtcatgcctgcatattctgcggcagaggacgcgttgactaccaaattggtcaccttttacgaggatagaggcattacctcggttgtgccctcacatcaggcgaccgtgctgctcttcgaacccagcaatgggactcttctggccgttatggatggcaatgtgatcaccgcaaaacgcaccgccgctgtatctgcaatcgctacaaagtttttaaaaccaccgagctcggaggtactgtgcatactgggtgccggagtccaggcctattcacattatgaaatctttactgagcaatttagcttcaaggaggtgcggatatggaataggactaaagagaatgccgaaaagttcgctgatacagtacagggcgaagtgcgtgtgtgttcttccgtccaggaagcggtggcgggagccgatgtgatcatcactgtcacactggccactgagcctattttgttcggagagtgggtgaaaccaggtgcacatattaacgccgtcggcgcttcacggcctgactggcgtgaactcgatgacgagctgatgaaagaagccgtcctgtatgtggattcacaggaggcagccctgaaggagtccggtgacgtgctgctgtcgggggcagaaattttcgctgagctgggggaagtcatcaagggagtgaaacctgcgcattgcgagaagaccactgtgtttaagtccctcggaatggcggtcgaggacactgtagccgctaaactgatctatgacagctggagctccggtaaatag

SEQ ID NO: 219407 - DNA, 819 bp, Artificial Sequence
  Description of Artificial Sequence: Synthetic coding sequence
atgcaaccagtaaggactgtcgttcccgttacgaagcatcgtggttaccttggagtgatgcctgcctactccgccgctgaggatgctctgacaacgaagctggttaccttctatgaagacagaggaattactagcgtcgtgccgagtcaccaggccaccgttctgctttttgagccgtccaacggcacgctcttggcggtcatggacggaaatgtcataacggcaaaaaggactgccgcagtgagcgcaatcgcgaccaagttcttgaagcccccatcaagcgaagtgctatgcatcctcggcgcaggggtccaggcctactcccactacgaaatattcactgagcagttttcatttaaagaagtgcggatctggaataggacaaaggagaacgctgagaagtttgccgataccgtacagggggaggtccgagtatgcagctctgtgcaagaggctgtcgcaggggctgatgttatcatcaccgtgactcttgcgaccgaacctatactgtttggagagtgggtgaaacccggtgcccatattaatgccgtaggcgctagtcggcctgattggcgtgagcttgatgatgaactgatgaaggaggccgtgctgtacgtcgactctcaggaagccgcactcaaggagtctggcgatgtcctgctgtcaggcgcagaaatctttgccgaactcggtgaggtgattaaaggcgtaaagccagctcactgcgagaaaacaacagtttttaagagcctcggtatggcagtggaagacactgtcgcggctaaactgatttacgactcctggtctagcgggaagtag

SEQ ID NO: 219408 - DNA, 945 bp, Artificial Sequence
  Description of Artificial Sequence: Synthetic coding sequence
atgagtcgagtcccagctttcctgagtgctgccgaagttgaggaacatctgcggtcctccagcctattaatcccccctctcgagacagctctcgccaatttcagtagtggacccgagggcggagtaatgcagccagtgcgcacggtggtgcccgtgacaaagcataggggctatttgggcgttatgcccgcttatagcgcagcagaagatgcactgacgacaaaacttgtgacgttttatgaggatcgcggaatcacttctgtcgtcccatcacaccaggctaccgtgttgctgtttgaaccctcgaacggaactctcctagcagtgatggatggcaatgttataacagcgaaacgcacagccgctgtcagcgccatcgccacaaagtttctgaaaccaccaagctcagaggtgttgtgcatcctgggcgctggagtccaggcctactcccactacgaaatattcaccgagcagttttccttcaaagaggtccgaatttggaaccgaactaaggagaatgctgagaagtttgccgacaccgtccagggtgaagttagagtgtgcagcagcgtgcaagaagcggtggccggagcagacgtgatcattacggtcacactcgcgactgagcccattctgttcggcgaatgggtcaagcccggtgcccacataaatgccgtcggagcttcacgccctgactggagggagctggatgacgaactcatgaaggaggctgtgctgtatgtagactcacaggaggccgcactcaaggagagcggcgatgtgctcctgtcaggggctgagattttcgcagaactcggggaagtgataaagggcgtcaaacccgcacactgtgaaaaaactacagtgtttaagtccctgggaatggccgttgaggacactgtagcagcaaaacttatctacgacagttggtccagtgggaagtag

SEQ ID NO: 219409 - DNA, 990 bp, Artificial Sequence
  Description of Artificial Sequence: Synthetic coding sequence
atggccaccggacagaagttgatgcgggctgtgagggtcttcgaatttggcggacctgaagtcctcaagttgcggtccgacatcgctgtcccaatccctaaagaccatcaggttttaattaaggtccatgcttgcggagttaatccagtcgaaacatatatccggagcgggacttattcgaggaagccattgctgccatacacacctgggtctgacgtggcgggagtcattgaggcggtgggagacaacgccagcgctttcaagaagggggacagggtgttcacgtcgagtaccatatctggcggatacgccgaatatgctttggctgcggatcacacagtttacaaactgccagagaagctcgactttaaacagggcgctgcgataggtatcccctacttcactgcctacagggcgttaatacactctgcctgcgtcaaggctggggaaagtgtcctggttcacggtgcctcgggcggagtggggctggctgcctgtcagatcgctcgagcctacggcctgaagattctcggtacggccggaacagaggagggtcaaaaaatagtattacaaaacggagctcatgaggttttcaatcatagagaggtgaactacatcgacaagattaagaaatacgtaggcgaaaaaggaatagatatcattatcgagatgctagcgaatgtgaatctgtcaaaggacttgtccctgctaagccatggcggaagagtgattgtggtggggtctcgaggcacaatagagatcaaccccagagataccatggccaaagagagctcaatcatcggagtcacgctgttctccagcacgaaagaagagttccagcagtacgcagccgctttacaggcgggtatggagattgggtggcttaagcctgtgatcgggtcccaatatcccctggagaaagtagcagaagcgcacgagaacattattcacggtagcggcgcaacaggtaaaatgatcctgctcctgtag

SEQ ID NO: 219410 - DNA, 732 bp, Artificial Sequence
  Description of Artificial Sequence: Synthetic coding sequence
atggcgactggacagaagctcatgagggctgtgcgcgtcttcgaattcggaggacccgaagtgttgaaattgaggtctgacatagccgtcccaatccctaaagatcaccaggtgctaatcaaggttcatgcgtgcggagtgaacccagtcgagacatatattaggagcggaacatatagccggaagcccctgctgccttatacgcccggtagtgacgtggccggtgtcatcgaagctgtgggcgacaacgcatcagcctttaaaaagggcgaccgcgtgtttacgtccagcacaatttctggaggttacgccgagtacgcactcgccgcagaccacacggtgtacaaacttccggagaaactagacttcaaacagggagctgcaataggaattccatacttcacagcctatcgtgccctgattcatagtgcttgtgtgaaagcaggtgagtcagtgctcgtgcacggggcaagcgggggtgtagggttggctgcctgccaaatcgctcgagcgtacgggctaaaaattctagggactgcaggtaccgaagagggtcagaaaattgtacttcagaacggggctcatgaggttttcaaccaccgggaagtgaattacatcgacaagatcaaaaagtacgtgggggaaaaaggtattgacatcatcatagaaatgctcgccaacgtgaacttatctaaggatctgagtctgctgtctcacggtggcagagtttag

SEQ ID NO: 219411 - DNA, 888 bp, Artificial Sequence
  Description of Artificial Sequence: Synthetic coding sequence
atggccacaggccagaagctcatgagggccgtgagggttttcgagttcggcggaccggaagtcctcaaactgcgcagcgatatagccgtcccaatacctaaagatcaccaggtgctgattaaagtccacgcctgtggggtgaaccccgtcgagacgtacatacggtccggtacctatagccgcaagcccttgttaccatacacccctggcagcgacgtggcaggagtcattgaggccgtgggggataatgcaagcgcatttaagaagggcgatcgcgtgttcacgtctagtacaatctcaggtgggtacgccgagtacgctctcgctgccgaccacacggtctacaagctccctgaaaaacttgacttcaagcagggagccgcaattgggatcccctatttcacagcatacagggctttaatacactccgcttgcgttaaggccggagagagtgtactggttcacggcgcttcaggtggcgtaggcctcgccgcttgccaaatcgccagggcttacgggttaaagatcttgggcacggcgggaactgaagaaggccaaaagatagtgctgcagaacggggctcatgaagtgttcaaccatcgggaagtgaattacatagataagattaaagtggtcgggtcccggggtactattgagatcaacccaagggacactatggccaaagagtcctccattataggagtaacactcttctcttccacgaaagaagagttccagcagtacgcagccgcactgcaggctggaatggagattggatggttaaagcctgtcattgggagtcagtacccccttgagaaggtggcggaggcacacgagaacataattcacggttctggagccaccggaaagatgatcctgctgctttag

SEQ ID NO: 219412 - DNA, 579 bp, Artificial Sequence
  Description of Artificial Sequence: Synthetic coding sequence
atgcacctgctgagttccgcctgtgtgaaggccggagaatccgtgctagtgcatggcgcatccggcggagttggtctagcggcatgccagatcgcccgtgcttacgggttgaagattctgggaaccgccggtacagaggaaggtcagaagattgtgctgcagaatggagcccacgaggtttttaatcacagggaagtaaattacatcgataagatcaagaagtacgtgggggagaagggaattgacattattatcgaaatgctggcaaacgtgaacctgagcaaggacctcagcctactttcccatggcggacgagtgatcgttgtgggtagccgaggaaccattgagattaatccccgagatactatggccaaggaaagttcgattattggcgttacccttttctcaagcactaaggaagagttccagcagtatgcagccgcactacaggcgggaatggagattggatggctgaaacctgtaattgggtcccagtatcccctggaaaaggtggcagaggcgcatgaaaacattatccatggatccggcgcaactgggaagatgattctgcttctgtag

SEQ ID NO: 219413 - DNA, 990 bp, Artificial Sequence
  Description of Artificial Sequence: Synthetic coding sequence
atggctacaggccagaagctgatgcgagctgtaagggtgttcgagtttgggggaccagaggtactaaagctcagaagtgatatcgcagtgcctatccctaaggaccatcaggtgctgattaaagtgcacgcatgcggggtaaatcccgtagaaacttacatccgaagcgggacatatagtagaaaaccactcttgccctacacacccggatcagacgtggccggtgtgatagaagcagttggggataatgcaagcgcgttcaagaagggagatcgcgttttcacttcctcaactatctccggtggctatgccgagtatgcactggcagccgatcataccgtctataagctgcctgagaagctggactttaagcagggggcagcaatcggcattccctattttactgcttacagggcactcatacactccgcctgcgtgaaggctggcgaatccgttctagtgcatggggcatccggaggtgtcggactggccgcttgtcaaatcgccagagcctatgggctgaagatcctggggactgcgggtactgaggaggggcagaaaatagtcctccagaatggagcacacgaggtcttcaaccacagggaggtgaactacatcgacaaaatcaagaagtatgtcggagagaagggtatcgacatcatcatcgagatgctggcaaacgtgaatctgtcaaaggacctgagtcttctgtcgcatggaggcagggtaatagtggtcggaagccggggaaccatcgagattaaccctagagacacgatggccaaagaatcttcaatcataggtgtgacactcttctcttctactaaggaggagtttcaacagtacgcagccgcactgcaggccggaatggaaatcgggtggttgaaacccgtgatcggatctcaatacccacttgagaaggtggccgaggcccacgagaacattattcacggcagcggggctactggcaagatgattctgctgctgtag

SEQ ID NO: 219414 - DNA, 621 bp, Artificial Sequence
  Description of Artificial Sequence: Synthetic coding sequence
atggccacggggcaaaagctgatgagagctgttagggtattcgaattcggagggcctgaggtgctaaaactacggagcgatatagcggtccctatcccaaaagaccaccaagtcctcattaaggtgcatgcctgcggcgtaaacccagtcgaaacctacattagatcgggcacatacagcagaaagcctcttctgccttacactccaggctcagatgtggcgggagtcatagaagctgtgggcgataacgcctcggcttttaagaaaggagatagggtgtttacaagttctacaatctcaggaggttacgccgaatatgcgctcgcagctgatcatactgtctacaagctacccgaaaagttggatttcaagcagggcgcagcaattggcattccttacttcacggcttatcgcgctctgatccatagcgcctgtgttaaagcaggtgagagcgttctcgtgcatggcgctagcggcggagttggtctcgcagcatgtcagattgccagagcctacggcttaaaaatcctgggcaccgccggtacggaagaagggcaaaagatagtattgcagaatggggcacacgaagtgtttaaccaccgggaggtgaactatatctag

SEQ ID NO: 219415 - DNA, 1050 bp, Artificial Sequence
  Description of Artificial Sequence: Synthetic coding sequence
atgaagggattgtatttccagcagtcctctactgatgaggagattaccttcgtcttccaagagaaggaggacttgcccgtgacagaggataactttgtgaaattgcaagttaaggcctgcgccctcagtcagatcaataccaaactgctcgctgagatgaagatgaagaaggatctattccctgtagggcgagagatcgctgggatcgttctcgacgtcggttcaaaggtgtcttttttccagcccgacgatgaagtggtgggtatattaccgttggactccgaagacccagggttgtgtgaggtcgttagagtgcacgagcattatctggttcacaagccggagaaggtcacatggaccgaggccgctggctcaatccgcgatggagtgagggcatatacagccttacattatctgagtcatctgtcacccggaaaaagcgtcctgattatggacggggcaagtgcatttggtactatagccatccagttagctcaccataggggcgctaaggtaattagtaccgcctgtagcctcgaggacaaacaatgtcttgagaggtttcgtcccccaattgccagggtgattgacgtgtccaatggcaaggtacacgtagcggagagctgtctggaggagaccggcggattgggcgtcgatatcgtgctagatgcgggtgtgcggctttactccaaggatgacgaaccagctgtgaagctgcagctgctcccccacaagcacgacattataacgttactgggggtgggtggccactgggtgacaacagaagagaatctccagctcgatccgcctgattcccactgtctctttctcaagggggctactctggcctttttaaacgacgaagtgtggaacctcagtaacgtgcaacaggggaagtatctatgtatattgaaggacgtcatggagaaactctccaccggcgtgtttcgaccgcaactcgatgagcccatccccttatatgaggctaaagtgtccatggaagcagttcagaagaatcaggggcgtaagaagcaggtagtgcagttttag

SEQ ID NO: 219416 - DNA, 546 bp, Artificial Sequence
  Description of Artificial Sequence: Synthetic coding sequence
atgaagggcctctattttcagcagtctagtaccgacgaagagatcaccttcgttttccaggaaaaggaagatctccccgttacagaggacaattttgtgaaactgcaagtcaaggcctgcgcactcagccagattaacacgaagctgttggcagagatgaaaatgaaaaaggacttgtttccggtaggccgtgagatagcaggcatcgtcctggatgtcggttcaaaagtttccttctttcagccagatgatgaggtggttggcatactgccactcgactccgaagaccccggactttgcgaggtcgtgcgcgtacacgagcactaccttgtccacaaacccgagaaggttacctggaccgaagcagccggttctatcagggatggggtaagggcctacacagctctgcactacctttcccacctcagccctggcaaatcagtgcttatcatggatggggcttcagcattcggaactatcgccatccagttggctcaccaccgcggagccaaggtcattagtacagcctgttctttagaggactag

SEQ ID NO: 219417 - DNA, 60 bp, Artificial Sequence
  Description of Artificial Sequence: Synthetic coding sequence
atgaagggactgtacttccagcaaagctccactgacgaagaaataacattcgtgttctag

SEQ ID NO: 219418 - DNA, 597 bp, Artificial Sequence
  Description of Artificial Sequence: Synthetic coding sequence
atgaaagggttgtatttccagcagagctccacggatgaggagatcacgttcgtgttccaagagaaagaggatctgcctgtgactgaggacaactttgttaagctccaggtgaaggcttgtgccctctctcaaatcaacacgaagctgctcgctgagatgaaaatgaagaaagatctgttcccagttggtcgggagattgcaggtatcgttctcgatgtggggtccaaggtgtcttttttccagcccgacgacgaggtagtcggcattttacctctggactcggaggaccccggtttgtgtgaagtcgttagggtgcacgagcactatctggtgcacaaacctgaaaaagtcacgtggaccgaagccgcagggtctatcagagacggtgtaagagcatatacagcactccactatctaagtcatttgtctcccggaaagagcgtattaattatggacggcgcatcagcgttcggcactatcgccatacaactcgcgcaccaccggggagcaaaggtcatcagtaccgcatgttctctggaagataagcaatgcctagaacggttccgaccacctatcgagaatagcactattgcttag

SEQ ID NO: 219419 - DNA, 2916 bp, Artificial Sequence
  Description of Artificial Sequence: Synthetic coding sequence
atggagctaagtgacgctaaccttcagactttaacagaataccttaagaaaacattggatcctgacccagccatcaggagaccagccgaaaaatttctggaaagtgtcgagggaaaccagaactaccccctgttgctgctaaccctgctcgaaaaatcgcaagataatgtcattaaggtgtgcgcatctgttacctttaagaactacatcaaacggaactggaggatcgtcgaagatgaaccaaataagatttgcgaagcagacagagtggccataaaggccaatattgttcacctcatgctttcatcgcctgaacaaatccagaaacagttatccgacgctatatccatcattgggcgtgaagactttccacagaagtggcccgacctgctgacagagatggtaaatagatttcagagcggggacttccatgtgattaacggcgtcctgcggactgctcacagcctgttcaagcgttacagacacgaattcaagtctaacgagctgtggactgaaatcaagttggtactggacgctttcgccttacccttaactaacctgtttaaagcgactatagagctctgtagtacgcacgccaatgatgcgagtgcgctgagaattctgttctcttccctgattctgatctccaagctcttttactctcttaactttcaggacttgccagagtttttcgaagataatatggagacgtggatgaacaactttcacaccctgttgacattggacaacaagctgcttcagaccgatgatgaggaggaggccggactcctggagctgttgaagtctcagatctgcgacaatgcagctctttatgcccagaaatatgatgaagaattccaaaggtacctgcctagatttgtaaccgccatctggaatctgcttgtaaccaccggccaggaagtcaaatatgacctgctggtgtctaatgccatccaattcctcgcttctgtctgcgaacggcctcattataaaaacctcttcgaggaccaaaacactctcacctcaatctgcgagaaggtaatagtgcctaatatggagtttagggctgccgacgaggaagcattcgaggacaactcggaagaatatatacggagggatttggagggtagcgatatcgatactcgtaggcgtgctgcttgcgatctggtccgcggtttgtgtaaattcttcgaaggaccagtgaccggaatattctccggctacgtgaattcaatgctgcaggagtacgcgaagaatccaagcgtaaactggaagcacaaagacgccgctatttatttggtgacctccctggcatcaaaggctcagacacagaagcacggcataacccaggcaaacgagctggtgaacctgactgaattctttgtcaatcacattcttcccgatctgaagagcgcaaacgtgaacgagtttcctgttttgaaagccgacgggattaaatatatcatgatctttagaaatcaggtgcccaaagaacacctcctggtgagtattcctttgttaataaatcatctgcaagcagaaagtatagtcgtgcacacctatgcggctcacgcccttgagagacttttcaccatgagaggtccaaacaacgccaccctgttcacggcggcagagatcgctcccttcgttgagatactgttgaccaatctctttaaggctctcaccctgcccggttcctctgagaacgagtatatcatgaaggcgataatgcgctccttcagtctcctccaggaagctattatcccttacattcccactttgattacacagctgactcaaaaactgctggcagtgtccaaaaacccatcaaagcctcactttaaccactacatgtttgaggccatctgtctgtcaatccgcatcacatgcaaggcgaacccagccgcagttgtgaatttcgaggaggccctcttcctggtgtttacggaaatactccagaacgacgtgcaggaatttattccatatgtgtttcaggtgatgagcctgctgctcgagacccacaagaatgatataccaagtagttacatggctttgtttccgcacctgttacagcccgtgctttgggagcgaaccggaaacataccagcgctggttaggctgttgcaggcctttttggagagaggcagcaacacaatcgcctccgcagcagccgacaaaattcctggtcttctgggtgttttccagaagctgatcgcatctaaggccaacgatcatcaaggtttctacctcttgaattccattattgagcacatgccacctgaaagtgtggaccagtatcgcaaacagatcttcatacttctgttccagaggttgcaaaacagcaagaccactaaatttatcaaaagctttctcgtttttatcaatttgtactgcatcaagtacggggctctcgccttgcaagagattttcgatgggatacaacctaagatgtttggcatggttttagagaagatcatcattccggaaattcaaaaggtcagcggtaacgtcgagaagaagatctgcgctgtgggtatcacaaaactcttgactgaatgtccccctatgatggacactgaatacactaagctatggacccctctgctccagtctctgatcggcttgtttgaactgccagaggatgataccattccagacgaagaacatttcatcgacatcgaggacacacctggctatcagaccgccttcagccagcttgctttcgccggtaagaaggagcacgacccagtgggccagatggttaacaatccaaagattcaccttgcacagagccttcataagttgtctaccgcgtgccccggaagggtaccttccatggtcagcacttccctgaacgctgaggctctgcaatatcttcaggggtacctgcaggcagcgtccgtgactctcctgtag

SEQ ID NO: 219420 - DNA, 2748 bp, Artificial Sequence
  Description of Artificial Sequence: Synthetic coding sequence
atggagttgagcgacgccaatctgcaaactctaactgagtacctcaagaagactctggaccctgatccagccattcgcagacccgctgaaaagtttttggagtctgtcgagggtaaccagaactatccactcctgttactgacactgctggaaaaatcacaggacaacgtgattaaggtttgtgcttccgtaacattcaagaattacattaaaagaaattggcgcatcgtcgaggatgaaccgaataagatctgcgaagccgatcgggtggctatcaaagccaatattgtgcacctgatgttgtcatcacctgaacagatccagaagcagctttctgacgccatttccatcatcggcagggaggactttccacagaaatggcccgacctccttacagagatggtaaaccgctttcagtccggcgacttccatgtgatcaacggagtgctccggactgcacacagtctgtttaagaggtatagacacgagttcaaatcgaatgaattatggaccgagatcaagctggtgttggacgctttcgctctgcctctcacaaatctcttcaaggctacaatcgagctatgttccacccacgctaacgacgcctctgccctgagaattctgtttagctctttaatactgatctcaaaattgttttatagccttaattttcaagacctacctgagttttttgaggataatatggaaacctggatgaataacttccatactctcctgactctggataacaagctgcttcaaactgatttggtgtcgaacgccatccagttcctcgcctccgtttgcgagaggcctcactataaaaatctcttcgaggaccaaaacaccctgacctcaatttgtgaaaaagtgattgtccccaacatggagttcagagcagccgatgaggaggcctttgaagataactctgaagagtacattcgcagggacctcgaagggagtgacatcgataccagacgtagagccgcttgcgatcttgtcagagggttgtgcaaattcttcgaagggcctgtgaccggcatattttcaggctatgttaattccatgctccaagagtatgccaaaaaccccagcgttaattggaaacacaaggatgccgctatttatctcgtgacatctctggcttcaaaggctcagacccagaagcacggcatcacacaggccaatgagcttgtgaatctgactgaattttttgtcaaccacatcttgcctgatctgaaaagcgcaaacgtcaatgaattcccagtcctgaaagcagatggcatcaaatatattatgattttccgtaaccaggttccaaaggaacaccttctcgtgtcaataccactactgataaaccacctgcaggctgaatcaattgtagtccatacctacgctgcccacgctctcgaacggctcttcacaatgcgagggcctaacaacgccactctgtttacggccgcagaaattgccccatttgtggagattctgctgactaacctctttaaggccctcaccctcccaggctctagtgagaacgagtacatcatgaaggctatcatgaggagtttctctctccttcaggaggctatcattccctacatacccacactgatcacccagcttactcagaagctcttggctgtatctaagaacccctccaagcctcacttcaatcattacatgttcgaggcgatttgcctctcaattaggataacatgcaaagcaaaccccgcagccgtagttaattttgaggaagctctattcctcgtcttcacggaaattcttcagaacgacgtccaggagttcatcccctacgtgttccaggtgatgtccctgcttctggagacacataaaaacgatatccccagtagctacatggctctgtttccacacttactccagccagtcctgtgggaaagaaccgggaatataccagcactcgttaggctgctgcaggcctttctggagcgcggaagcaatactattgcatctgctgccgctgacaaaatacctgggctgttaggggtgttccagaagctgatagcctctaaggcaaacgatcatcagggcttttacctacttaattcaatcatcgagcacatgccccctgagtctgtggatcagtaccggaagcagatctttatcctgctattccaacgccttcagaacagcaagacgacgaagtttatcaaaagttttttggtgttcatcaatttgtactgtatcaagtacggcgcactagcactgcaggaaatctttgatggtatccagccgaagatgtttggcatggtgcttgagaagatcattatcccagaaatccagaaagtgtctggcaatgttgaaaagaagatctgtgcagtaggaattacaaagctgctcaccgaatgccctccgatgatggatactgaatataccaagctttggactccactactgcagtcattgattggactcttcgagctgcctgaagacgacacgatcccggacgaagaacactttattgacatagaggacaccccaggctaccagacagcattctcacagctcgccttcgctgggaaaaaggaacatgacccagtaggacagatggtgaacaatcctaaaattcaccttgcacagtccctgcacaagcttagtaccgcatgtccaggtagagttccatcaatggttagcactagcctaaacgccgaggcgctgcagtaccttcaggggtatcttcaggccgcatcagtgactttgttatag

SEQ ID NO: 219421 - DNA, 1710 bp, Artificial Sequence
  Description of Artificial Sequence: Synthetic coding sequence
atggagacttggatgaataactttcacaccctgctgacactggacaacaagctgctgcagacagatgatgaagaggaagccggattgctcgaactgctgaagagccagatatgcgacaatgctgctctttatgcacagaaatacgatgaagagtttcagaggtacctgccgagattcgtgaccgccatttggaatctgttagtaaccactgggcaagaagtcaagtatgatctattagtgagtaacgccatccagttcttggcctccgtgtgcgagcggcctcactataaaaacctgttcgaagaccagaatacactgacaagcatttgcgagaagagtatcgtcgtgcacacttacgccgctcacgctctcgagcgactgtttaccatgagaggccctaataatgcgactctatttaccgccgctgagatagcacctttcgtggagatcctcctgacgaatttgttcaaagccctgaccttacctggctcaagcgagaacgaatacataatgaaagccattatgcggtcgttctctctcctgcaggaagcaataatcccatacatccctacactgatcacccagttaactcagaagctactcgctgtgtcaaaaaatcccagtaagccgcattttaaccattatatgttcgaggctatctgcttgtcaattcgaatcacttgtaaggcaaacccggctgcagtggttaactttgaagaggccctcttcctcgtttttactgagatcctgcagaacgacgtccaagagttcattccttacgtgttccaagtcatgagcctcttactggagacacataagaacgacattccaagctcttacatggcactgttcccccacctgctgcagcctgtcttgtgggagcggacagggaacatcccagcattagtgagactactacaagctttcctggagcggggtagcaacacaattgcctccgcagctgccgataaaatccccggattactgggtgtgttccaaaagctgattgcttctaaggccaacgaccaccagggtttctacctacttaactccattattgagcatatgccacccgagagcgttgaccagtacaggaagcagatcttcattttactgtttcagcgtttgcagaactcgaagaccacgaagttcattaaatcctttctggttttcataaatctctattgtatcaagtacggggctctcgcactgcaagagatcttcgatggcattcagcccaagatgtttgggatggttctcgagaagatcataatccctgaaatccaaaaagttagcggaaacgtggagaagaagatttgcgccgtcggaataacaaagctgctcacggaatgtcccccaatgatggataccgagtatacaaagctttggacaccgttgctgcagtcactcatcggtcttttcgaactgccggaggatgatacaattcccgacgaagagcacttcatcgacattgaggacaccccagggtatcagacagcattttcgcaactagctttcgcaggcaaaaaggaacacgacccagttggacagatggtcaacaaccccaagatccacctcgcccagtcattgcacaagttgtctactgcctgtccaggacgcgtgcccagcatggtttcaacgtctctgaatgcagaggccctacagtacctccagggctatctgcaagccgcaagtgtgactttgctctag

SEQ ID NO: 219422 - DNA, 2265 bp, Artificial Sequence
  Description of Artificial Sequence: Synthetic coding sequence
atgctcagtaatctgaacttccaggatctacccgaattttttgaagacaatatggagacgtggatgaataactttcatacgctgctcaccttggacaacaaactcctccaaaccgacgacgaagaggaggcgggtctgctggagctcctgaaatcgcagatctgcgacaatgccgctttatatgcccaaaaatacgatgaggagtttcaacgatatctgcccagatttgtgactgccatttggaacctgttggttaccactgggcaggaagtgaaatacgatcttcttgtatctaatgccattcagttcctagcatcagtgtgtgagcggccacattataagaatctttttgaagatcaaaacaccctgacatccatttgtgaaaaggtgatcgttcctaacatggaatttagagctgccgatgaggaggctttcgaggacaacagcgaggagtacattagacgagatctagaagggtccgatattgacacacggagaagggctgcctgcgatctcgtgcgtggcctgtgcaaattctttgagggccctgtgaccggtatcttctctgggtatgttaactccatgctgcaggaatacgccaagaatccctctgtaaactggaaacacaaagatgctgccatctatctggttacgtccctcgcttcaaaggcacagacacagaagcatgggatcacgcaagcaaacgagctggtcaacctcacagaatttttcgtgaaccacatactgcctgacttgaagtctgcaaacgtgaatgaatttcctgtgcttaaggccgacggcattaagtacattatgatctttagaaatcaggtgccgaaagagcatttgctagtatccattccactactgataaatcatctgcaggccgaaagtattgtagttcacacctacgccgcacatgctctggagcggttattcaccatgcgcggacccaacaatgctacactgtttaccgctgctgaaatcgctcccttcgtcgaaatccttctgaccaacctgtttaaggctctgacacttccgggatcctccgaaaacgagtatatcatgaaagccatcatgcgcagctttagccttctccaggaggccatcattccttacatcccaaccctaatcacacaactcacccagaaactgcttgccgtctccaaaaatccctctaaacctcatttcaaccactacatgtttgaggcgatttgcctttctatacgcatcacatgcaaggccaatccggctgccgtggtaaacttcgaggaagctctgttcctggttttcaccgaaattctgcagaacgatgtccaggagttcattccttatgtgtttcaggtcatgagtctgctgttggaaacgcacaaaaatgacatccccagcagttacatggcactctttccccatctgctccagccagtattgtgggaacgaacaggcaatataccagcattagtgcgcctgctgcaggcatttctcgagcgagggagcaacacaatcgcctccgcagcggctgataaaataccaggcctgctgggcgtcttccagaagctcatagccagcaaagctaacgatcaccagggcttctaccttttaaatagcatcattgagcacatgcctccagaaagcgtggatcagtacagaaagcagatattcattctcctcttccagagactgcagaacagcaagaccaccaaattcattaaaagcttcttggtttttatcaatctgtattgcatcaagtacggtgccctggccctgcaagaaatcttcgatgggatccaacctaagatgttcggaatggtgttagaaaagatcattatccccgaaatccaaaaagttagcggcaatgtggaaaagaaaatttgtgcagtgggcatcacaaaactgctcacggagtgcccgccaatgatggacaccgagtataccaaattgtggacgcctctcctgcagtctctcattgggctgttcgagctgccagaggatgacaccattcccgatgaagaacacttcatcgatattgaggacactcccggttatcagacagcgttttcgcaactggcttttgctggaaagaaagaacatgatccagtcggacagatggttaacaatcccaagatacacttagcccagagtctccataagctgtccacagcttgccccggacgggtccctagcatggtgtcgacttcacttaatgctgaagctctgcaatacctgcaggggtatctgcaagccgcatcagtgacactgctgtag

SEQ ID NO: 219423 - DNA, 888 bp, Artificial Sequence
  Description of Artificial Sequence: Synthetic coding sequence
atgcagccagagggggcagaaaagggcaagtcattcaagcagcggctggtccttaaatcaagtctagccaaggagacccttagcgaattcttaggcaccttcatcctaatagtgctcgggtgtggatgtgttgcgcaagccattctgtcacgcggtcgttttggaggagtcataactatcaacgtgggtttttcgatggccgtggccatggcaatttacgtcgctggtggcgtgtccggcggacatatcaatccagctgtgtccttggcaatgtgtctgttcggccgtatgaaatggtttaagctgcccttttacgtgggcgctcagtttcttggggcttttgttggagccgcaacggtgtttgggatttattacgacggtctgatgagcttcgccggaggcaagctgctcattgtcggagaaaatgccactgctcacattttcgccacgtatccagccccatatctatcactggcgaacgctttcgccgatcaggtcgtcgccaccatgatcctgcttatcattgtctttgctatattcgactcacggaacttgggcgctcccagaggactggaaccaattgccatagggctgctgataatcgtgatcgcttcctctctgggcttgaacagcggctgtgcaatgaacccagcacgagatctgtccccccgtttgttcacggccctcgccggatgggggtttgaggtattcagggccggtaacaacttctggtggattccagtcgtggggcctctggtcggagctgtgatcggtggtctaatttatgtgctcgtgatagaaatccaccatccagagccagattctgtcttcaagaccgaacagtccgaggacaagcccgagaagtacgaactgtctgtaatcatgtag

SEQ ID NO: 219424 - DNA, 1353 bp, Artificial Sequence
  Description of Artificial Sequence: Synthetic coding sequence
atgtcagcaatccaggccgcatggccttctggcacagaatgcatcgctaaatacaatttccatggtaccgccgagcaggatctccctttttgcaaaggcgacgtcctgacgatcgtagccgtgactaaggaccccaattggtacaaggccaaaaacaaagtgggccgtgaaggcatcattccagccaattacgtacagaaaagggaaggggtgaaagcaggaactaagctttccctgatgccatggttccacggcaagatcactcgggagcaggcagagcgactgctgtaccctcccgagacaggcctattcctcgttagggaaagtacgaattacccgggtgactacactctctgtgtgagctgcgacgggaaagtggagcactataggattatgtaccatgcttctaagctaagcatcgacgaggaagtatactttgaaaacctcatgcagttagtcgaacattatacttcagacgccgacggcttatgcactcgcttgatcaaacccaaggttatggaaggaacagtcgccgctcaagacgagttctatcgtagcgggtgggctctgaacatgaaggaactgaagctactccagacgatcgggaagggcgaattcggcgatgtcatgcttggggactaccggggtaacaaagtggcggtgaagtgtattaaaaacgatgccactgctcaagctttccttgcagaggcttcagtaatgacacaactgaggcactccaaccttgttcagctgctcggggttatcgtcgaagaaaaaggcggtctatatattgtgaccgagtacatggcgaaaggcagcttggtcgactaccttagatcccggggtcggagtgtcttgggcggtgactgtctgctgaagttttctctcgacgtgtgtgaggccatggagtacctggaaggcaacaatttcgtgcatagggatctggccgctcggaatgttctggtgtctgaagacaatgtggccaaggtcagcgactttgggctcaccaaagaagccagtagcactcaggataccggcaagcttccagtgaagtggacagctccggaggcgttacgggaaaaaaagttctccactaagagcgatgtgtggtcattcggaattcttctttgggagatctatagcttcggacgcgtaccttaccccaggataccactgaaggatgtcgttccgagagtcgaaaagggatacaagatggatgccccagatggatgtcctcctgctgtatatgaagtgatgaagaattgttggcacctcgacgcggctatgcgaccgagcttcttacagctgcgggagcaactcgaacacatcaagacccacgagctgcatctttag

SEQ ID NO: 219425 - DNA, 1353 bp, Artificial Sequence
  Description of Artificial Sequence: Synthetic coding sequence
atgtccgctattcaagccgcttggcccagcggcactgagtgtatagccaagtataactttcacggtaccgcagagcaggacctccctttctgtaagggggacgtcttaaccattgtggctgtgactaaagatcccaattggtacaaggcaaagaacaaggtcggccgagagggaattatccctgcgaattacgtccagaagcgagagggggttaaggccggaactaagctgagcctcatgccctggttccacggaaagatcacacgtgaacaggctgagcgcttgctctacccccctgaaaccggcctgttcctggtgcgagaatctactaactacccaggtgattataccttgtgcgtaagctgcgatggtaaagtcgagcattaccgcatcatgtatcatgcgagcaagctgagcatcgacgaagaagtgtatttcgagaacctgatgcagctagtggaacattatacttcagatgccgacggcctgtgtacccgactaattaaaccaaaagtgatggaaggcactgtggcggctcaggacgagttctaccgctctggttgggctttgaacatgaaagagctcaagctgctccagaccatcggcaagggagagtttggagatgtgatgctgggcgattaccggggaaacaaagtcgctgtgaagtgcataaaaaacgacgcaaccgcacaagccttccttgccgaagccagcgtgatgacccagcttcggcactccaatctggtgcagctgttgggagtgatagtggaggagaagggaggactgtatattgtcacagaatatatggccaagggaagcctggtggactatcttcgttcaagaggcagaagtgtcttaggcggtgactgtctgctgaagttcagcctcgatgtgtgtgaagcaatggagtatctcgaaggaaacaactttgtgcacagggatttggcggcaaggaacgtgttggtgtctgaggacaatgtggcaaaagtcagcgatttcgggctcaccaaagaggccagttccacccaggatacaggcaagctcccagtgaaatggaccgcgccagaagccttaagggagaagaaattctccactaagtcagacgtctggtcttttggcatccttctttgggagatctatagcttcgggagggtgccttaccccagaatcccactgaaagatgtggtgcccagggtggagaaagggtacaaaatggacgccccagacggatgccctccagcagtttatgaggttatgaaaaattgctggcaccttgatgccgcaatgaggccgagctttcttcagcttagggaacagctcgaacacattaagacccatgagctacatctgtag

SEQ ID NO: 219426 - DNA, 1200 bp, Artificial Sequence
  Description of Artificial Sequence: Synthetic coding sequence
atgtcagccattcaggccgcatggcccagcggaactgagtgtatcgcaaagtataacttccatggcaccgcggaacaggaccttcctttttgtaagggcgacgttttgacaatagttgccgtaacaaaagaccccaattggtataaagccaagaataaagtgggtagagagggcatcattccagccaactatgtccaaaagagggaaggcgtaaaggctgggaccaagctgtccctgatgccttggttccatgggaagctttctatcgacgaggaggtgtacttcgaaaacttaatgcaactcgtcgagcattacacttcagacgccgatggcctctgtacccggctgattaagccaaaagtcatggaggggacggtggcagctcaggacgagttttatcggtcagggtgggcactgaatatgaaggaactcaagttgttgcaaactatagggaaaggcgagttcggtgacgttatgttaggcgattatcgtggaaataaagtggctgtgaaatgcataaagaacgacgccaccgcccaggctttcctggctgaggccagtgtgatgacacagctaaggcattccaacctagtccaactgctaggcgtaatcgtggaggagaaaggcggactgtacatcgtcacagagtacatggctaagggttccctggtggactacttaagatcccggggtaggagcgtgttaggaggcgactgcctgctaaaattttccctggatgtgtgcgaggccatggagtatctcgaaggaaacaatttcgtccatcgggatttggctgccaggaacgtgctcgtgtcggaagataatgttgctaaggtgtccgattttgggctgaccaaggaggcaagctcaacacaggacactggaaagctacctgtgaaatggactgcccctgaggctctcagagaaaagaaattctcaactaagtccgacgtgtggagttttggaatccttctgtgggaaatttacagcttcgggagggtgccttacccgagaatcccgttgaaagacgttgtgccccgagtggagaagggatataagatggatgcacccgatggctgtccgcctgcagtgtacgaagtgatgaagaactgttggcaccttgacgcggcaatgcggccatcatttctgcagcttcgggagcagttggagcatattaagacacacgaactgcatttatag

SEQ ID NO: 219427 - DNA, 783 bp, Artificial Sequence
  Description of Artificial Sequence: Synthetic coding sequence
atggtggcggctccatgggcaacacaggaacaggaagaaggcagggggatccagcccggagacaggggagaccagaaaagcgctgcctcacaaaagcccaggtctagggggatcctccattcactcttttgctgcgtctgccgcgatgatggggaggctctacccgcacatagtggcgcacctctgttagttgaagaaaatggcgcaatccccaagacgcctgtacagtatttacttcctgaggccaaagcacaggattccgacaagatttgtgtagtcatagaccttgacgaaacattagtccacagtagctttaagcctgttaataacgctgacttcataatcccagttgaaatagacggtgtggtccatcaggtgtatgtgctgaaacgtcctcacgtcgacgagttcctgcaacggatgggagagctgttcgagtgtgtgttatttacagcaagcctggctaagtacgctgatcccgtggctgacttgcttgacaagtggggcgcattccgagcgaggttgtttcgcgagtcctgtgtgttccataggggcaattacgttaaggatctgagtcggctaggtcgcgatctccgtcgtgtgttgattttagacaactcacccgcttcatatgtcttccatcccgataacgccgtgccagttgcctcttggttcgataacatgtcggataccgaactccacgatctgttgcccttttttgagcaattatccagggtggacgacgtctacagtgttctccggcagccacgccctggctcatag

SEQ ID NO: 219428 - DNA, 2604 bp, Artificial Sequence
  Description of Artificial Sequence: Synthetic coding sequence
atggaagtgccggcagctgggagagtccctgctgaaggagccccaactgcagccgtggccgaggtgaggtgtcccggtcccgctccgctgcgccttctggagtggagagtcgccgcaggggcagccgtccggatcggctctgtacttgcagtttttgaggcggctgcatccgcacagtccagtggggcttcccagtcccgtgtggccagcgggggttgtgtgcggccagcccgtcccgaaagaagattgcggtcggagcgtgctggcgtggtgcgagagctctgtgcccagcccggacaagtggtggccccaggcgcagtgcttgtcaggctagagggctgcagtcatccagtcgtgatgaaggggctgtgcgccgaatgtggccaggatttgacacagctgcagagcaaaaacgggaagcagcaggtgcccttgtcaaccgctaccgtgagcatggtccattccgtgccagagctcatggtaagctcagagcaggctgagcaactcgggagagaggatcagcaacgtcttcaccggaatcgcaaactggtgctcatggtcgacctggaccagacgttgatccacacgactgaacagcattgtcagcagatgtccaataaaggaatattccacttccaactgggcagaggggagcctatgttgcatactagattacgccctcattgcaaagatttcctggaaaagatagccaagttgtacgagctgcatgtattcacattcggcagcagactgtacgcccataccattgcgggattcttggatcctgagaagaaattattcagtcacaggattctctcaagagatgaatgcatcgatcctttttccaaaacaggtaatctgcgaaacttgttcccatgtggggatagtatggtgtgcattattgatgacagggaggatgtttggaagttcgcgcctaatctaattaccgttaaaaaatatgtttactttcagggcaccggcgacatgaatgcaccaccgggtagcagggagtcacaaacccgtaaaaaggtaaaccactccagggggaccgaagtgtcagagcccagccctcccgtccgggatcccgaaggagtcactcaggccccaggagttgaaccatctaacggcctggaaaagcctgcgagagagctgaacggcagcgaggcggcaactccacgcgactctcctcgaccaggaaaacccgatgagcgggacatctggcccccagcgcaagctccaacaagctcccaggagcttgccggagcccctgagccccagggttcttgcgcacagggcggaagggtggctccgggacaacggcctgctcaaggggctacgggtaccgacctcgactttgatctgagcagcgacagcgagagctcatccgagtcagagggaacaaagtcgtcctctagtgctagtgacggggagagtgagggtaagcgaggcagacagaagccgaaggccgcaccagagggcgcaggtgcgttggcacagggcagcagtcttgagcctggaaggccggctgcgccatccctgcccggtgaggccgaacctggtgcgcacgcaccagacaaagaacctgaactggggggtcaagaggaaggcgagcgtgacggtttatgcggcctgggcaatggatgtgctgatagaaaggaggccgagaccgaaagccagaatagcgaactgagtggcgtaactgcaggggagagtctggatcagtccatggaggaggaagaagaggaggatacagacgaggatgatcaccttatttatttagaagagatcctcgtgagagtccatacagattattacgccaaatatgatcgctacttaaacaaggaaattgaagaagctcccgatattaggaagattgtgccggaactgaagtccaaggtccttgctgacgtggctattatcttctcaggactgcaccccaccaattttccaatcgagaaaacaagggagcattaccatgccaccgcactgggtgcgaagatactcaccagactggtgctgtcccctgatgcgcctgatagagccactcatctgattgcagccagagcaggaacggaaaaagttctgcaggcgcaagagtgtggtcatctgcacgttgtcaaccccgattggttgtggtcgtgtctggagagatgggataaggttgaagagcagttgttcccactgcgcgacgaccatactaaagcacagagagagaattctccagctgcattccctgatagagagggagtccctcctacagccctgtttcacccaatgcccgtcctgcccaaagcccagcccggtccagaggttcgaatctacgattccaataccgggaagttgatccggacaggtgcaaggggtcccccagcaccttcttccagtcttcctatcaggcaggagccctctagcttcaggtggactacttccttggagaaagccgctacgaccgctaccgccagaagaggagggctccggagcagacgtcgttctccgtccccgggaagccaagggcctgcaggctcaggtcgaagtggccatctgaggcccgctcggggagccaggcaaggcgctgggggtcccgaggccaccaggggaagctag

SEQ ID NO: 219429 - DNA, 2886 bp, Artificial Sequence
  Description of Artificial Sequence: Synthetic coding sequence
atggaagtgcccgcagctggtcgcgtgcccgcagagggcgctccaacagccgctgttgcagaggtcagatgccctggtcccgctccactgcgactactggagtggcgcgtcgctgctggagcagctgttcggataggctccgtgctggcagtctttgaagcagcagccagcgcgcagagcagtggagccagccagagccgtgttgccagtgggggttgtgtgagaccagccaggcccgagcgccgtttgcgcagtgaacgcgcaggggtggtacgcgaactgtgtgctcagcctggtcaggtggttgccccaggagccgtgttggtgaggctggagggatgtagccaccctgtcgtgatgaaaggcctgtgcgccgaatgtggccaagaccttacccagctgcaaagtaaaaacggaaaacagcaggtacccctttcaaccgccaccgtttctatggtacacagcgtgccggagctgatggtttcatccgaacaggcagagcagctgggcagagaggaccaacaaaggctgcatagaaatcgtaaattggtactcatggttgatttggaccagactctgattcatacaacagaacaacactgccagcagatgtccaacaagggaattttccattttcagctcggtagaggcgagccaatgctccacacaaggttgcgccctcactgcaaggacttcctcgagaagattgctaaactgtatgaacttcacgtgtttactttcggctctaggttgtacgcgcacaccatcgctgggtttctcgacccggagaagaagctgttttctcacaggattctgtctcgggatgagtgtatagacccattctccaagacaggcaacttgcggaatctattcccttgcggcgattccatggtgtgcataattgatgatcgcgaggacgtgtggaagtttgctccaaatctaatcacagtgaagaaatacgtgtactttcagggcacaggtgatatgaacgccccacctgggtcacgagagtcacagacccgaaagaaggtgaaccattcacgcggaaccgaggtgtccgaacccagccccccagttcgcgatccagaaggcgtgactcaggctccaggggttgaaccctcaaacggactggaaaaacctgcccgagagctgaacggcagcgaagccgctacccctagggacagccccagacccggtaagccagatgagcgggatatatggccacccgcacaagcgcctacttcaagccaggaacttgccggtgctcccgagccacaaggcagctgtgcccaagggggacgagtggctccaggacagcgtccagcccagggggcaacgggaactgaccttgattttgacttgtcttctgattccgaatcttcaagcgagtccgaaggaaccaagagctcctcctcggcctcagatggggagagcgaaggcaagcgcggacggcagaagcccaaagctgcccctgaaggcgctggagccctggcacagggctccagtcttgagcccggtcgtcccgcagccccttccttgcctggtgaggcggagccaggagcacacgccccagacaaagagcctgaattaggcggtcaggaggagggcgagcgggacgggttgtgcggcctgggcaatggttgtgccgacaggaaagaagccgagacggagtcgcagaacagtgagctgtcaggcgtaactgccggagagtcccttgaccagagcatggaggaagaggaggaggaggatacagacgaagacgatcatctgatttatctcgaagaaattcttgtcagagtgcataccgactactatgcaaagtatgaccggtaccttaacaaagagatcgaggaagcacccgatatccgaaagattgtacctgaactgaaaagtaaggttctggctgatgtcgctataatctttagtggactgcacccgacaaacttccctattgaaaagacaagagagcactatcatgcaaccgccctgggagcaaaaatccttacacgcctagtgctgtcaccagatgcccctgatagagctacacatctgatcgcggctcgggcaggaacagagaaggtactgcaggcacaggagtgtggacaccttcatgtggtgaatcctgattggctgtggagctgtcttgagcggtgggataaggtagaggaacagttgttcccactcagagatgatcatacaaaggctcagagggagaacagtcctgccgcatttccagaccgcgagggggtgcctcctacagcattgtttcatccaatgccggtactacccaaagcgcaaccaggaccggaggtccggatctatgattcaaatacaggcaagctcattaggaccggcgctagaggcccaccagcaccatctagctcactgccaattagacaggagccaagcagcttccgggcagttccacccccacagccacagatgttcggagaggaactgcctgatgctcaggacggcgagcaaccaggccctagtcggaggaagagacaaccctccatgagcgagactatgcctctttataccctctgcaaggaggatctggaatcaatggataaggaggtggatgatatcctgggtgaaggcagcgatgactctgatagcgaaaaaaggcgccctgaagaacaagaggaagagccccagccacgtaaacctgggactaggagagagcgcaccctgggcgctcccgcttctagtgaacgctctgctgccggtggccgaggccctcgaggccataaacgaaaactgaacgaggaggatgctgcttccgaaagttcaagagagagctcaaatgaggacgaaggaagcagcagtgaggccgatgagatggctaaggccttggaggccgagttgaatgacctgatgtag

SEQ ID NO: 219430 - DNA, 786 bp, Artificial Sequence
  Description of Artificial Sequence: Synthetic coding sequence
atggacagtagtgccgtaattacccaaatctccaaagaggaagcgaggggacctttgaggggaaaaggagatcagaagagtgcagcctctcagaaaccaagatcccgcggtattttacacagtcttttttgctgtgtgtgtagggatgacggggaagccctccctgcccacagcggagccccactgctagtcgaagagaatggggctatccccaagcagacccctgttcaatatctcctgcctgaagcgaaagcacaggatagtgacaagatctgtgtggtaatcgatttagacgagactctggtgcactcgtcgtttaagccagtcaacaatgccgattttataatcccagttgagatcgatggcgtggtccatcaggtgtatgtgctcaagcgcccacacgtggacgaattccttcagagaatgggcgaactcttcgagtgtgtcctttttactgccagtttagcaaagtacgccgaccccgtggccgatcttcttgacaagtggggagcctttcgcgctcggctatttagagagtcttgtgtttttcatagaggcaactacgtaaaagatctgagccgattgggccgtgacctcaggagggtgctcattctggacaactctccagcctcctacgtgttccatccggataatgcagtgcccgtggcttcttggttcgacaatatgtctgatacagagctgcacgatttattgcctttcttcgagcagctaagcagggtcgacgatgtttacagcgtgctacgacagccaagacctggaagctag

SEQ ID NO: 219431 - DNA, 2928 bp, Artificial Sequence
  Description of Artificial Sequence: Synthetic coding sequence
atggaggattacgagcaagagttgtgtggcgttgaggatgatttccataaccaatttgcagccgagctggaagtactggctgagctcgagggcgctagtacacccagtccatccggggtaccattgttcacagcgggtagacctcccaggaccttcgaggaggcactcgcaagaggagacgctgcgtcctcacccgcacctgcggcatcagtaggttcctcccaggggggagcacggaagcgccaagtggatgcagatctccagcccgctgggtccttgcctcacgcgcctcgcattaagcgccctagactgcaggtggtgaagcggctgaatttcaggtctgaggaaatggaagagccccctcccccagattcttctcctaccgatatcacacctcctccctcccctgaagatcttgctgagctgtgggggcatggggtcagcgaggccgctgctgatgtggggctcacacgggcttctcccgctgccaggaatccggtactgcgacgaccaccaattcttgaagattacgtgcatgttactagcacagagggagtgcgagcatatctcgttctccgcgcagatcccatggcccctggagtgcagggttccctgcttcatgtgccctggagaggtggtgggcaattggatctgctgggcgtcagcttggcctccttgaagaaacaggtagacggggagcggcgagagaggctgttacaggaggctcagaaactgagcgacaccctacacagcctgcgctccggggaggaggaagccgcacagccactgggcgctcctgaggaagagcctaccgacggacaagacgcatcatcacactgtttatgggtcgatgagtttgcacccagacactatacggagcttctttctgacgattttaccaacaggtgtctgctgaagtggctgaagttgtgggatctagttgtctttggacacgaaaggccttccagaaaacctcgcccatcagtcgaaccagccagggtctccaaggaagcgaccgctcctggcaagtggaaatctcacgaacaggtgctggaagagatgctagaggcaggcctggaccccagccaacggccaaagcagaaagtagcactgctatgcggcccacctggactcgggaagaccacattggcccacgtgattgcaaggcacgctgggtacagcgtggtcgaaatgaacgcctcagacgatcgcagccccgaagtgttccgcacccggattgaggccgcaacacagatggaaagcgtactgggcgcaggtggcaaaccaaactgcctggtgattgatgaaattgacggcgcaccggtcgcagcaatcaacgtcctgctgagcatactgaatcggaaagggcctcaggaggtcggacctcagggtccagccgtgccatccgggggaggacgtaggcgccgagccgaaggcggtctcttaatgagacccataatctgcatctgtaacgaccagtttgccccttctctgcgacagctgaagcagcaggcctttttgttacactttccaccaaccctgccttcgagattggtgcaaaggctgcaagaagtgtccctgaggcaaggtatgcgcgcagacccaggcgtcctggccgctctctgtgaaaaaacggataatgacatccgagcgtgtattaataccctgcagttcttatattcacggggtcagagagagctgtcagtccgtgacgttcaggccactagggtcggcctgaaagatcagaggcgaggcttgtttagtgtttggcaggaggtgtttcagctgccgagagcacagcgccgacgggtaggccaggaccctgcactccccgctgataccttgctgttgggagatggagacgccggatctctaacttccgcctctcaacgcttctatagagtgctgcacgcggcagcttctgccggagagcatgaaaaggtcgttcaggggttgtttgataactttcttcgattgcggctgcgtgacagcagtctcggagccgtgtgcgttgctctggattggttggcctttgacgatctgttggcaggcgcagctcaccattctcagtccttccagctactgcgctaccctcctttcctgcccgtggcttttcacgttctgtttgcatcatcgcacactcccagaatcacctttccatctagtcagcaggaggcgcagaacaggatgtcacagatgcgtaacctgatccagacactggttagtggcatcgctcctgctactcgcagtcgcgctactccgcaagccctcctcctcgatgccctctgtctgctgctggatattcttgcgcctaagctgaggccggtgagcacccagctgtatagcacacgagagaaacagcaattagcgagcctcgttgggaccatgctggcatactcactgacctataggcaagagcggactcctgacggacagtacatctatagactggagcccaacgttgaggagctgtgccgattcccagagcttccagcacgtaaacctctgacatatcagactaagcaactcattgcccgagaaatcgaggtggaaaagatgcggagagccgaagccagtgcaagggtggaaaactctccgcaggtcgatggatccccaccaggccttgagggcttgctaggcggaatcggagaaaagggagtccaccgtccggctccacgcaaccacgagcaacgtctcgagcacatcatgcgtagggccgctcgagaagaacagccagagaaagatttctttgggagggtggtcgttagaagcacagcagtgcctagcgcgggtgatacagcacctgaacaggattcagtggaaagacggatggggaccgccgtgggcaggtctgaagtgtggtttcggtttaacgagggtgtgtcgaacgcagttcggaggtctttatacattcgcgacctgctctag

SEQ ID NO: 219432 - DNA, 3555 bp, Artificial Sequence
  Description of Artificial Sequence: Synthetic coding sequence
atgcacgtgaatgcaagtgccagacgctgggggagggggggtgctgcagcattgcctggtcctgctgcttcaccccgaagaccagctccccgtacaggcccagtgggtaggcctacgctggctccatcaccttcgcgcgctcacgcacacgccaaaaccaacctgctgcctggccgtgctgtacaggctcccgatgctgtgccgggagccggatcatcaagggccccagccagatggaggccgagagacccagggtcctctgcacctgacgcctggcagaggttcagaccggcacccctgcgcgcacagccgaggccaccacccaggcctgcaccaggtccaccgccaccgagaaagggcggatgcgggggtcagtggcgggctccccaggatcggaccagggggcttagatcccggaacagccctaggccacctctggcccaacccagactgagacacgctaaccagtggcgcgctcccccaggcacaccggctgctgactggagacgccctgcacgcagcggacgtgcagtgagagatgggggaggcggagctggaggctctgagagagagctggggctagcggacgggatggaggattacgaacaagagctgtgtggcgtggaagacgatttccataatcaattcgccgcagaacttgaggtgcttgccgagttggaaggagcgagcactccctccccaagtggcgtgcctcttttcacagcaggcagacccccacgtaccttcgaggaagctctcgctaggggagatgctgcaagttcccccgctcccgcagctagcgttggctccagtcaggggggtgcaaggaagcgacaggtagatgcagaccttcaacctgccggatcgctgccacatgccccaaggatcaagaggcctcgtctgcaagtggtgaagcggctaaactttcgaagcgaagagatggaggagccacccccacctgattcaagcccaactgatatcacccccccaccatctcccgaagacctggcagagctgtgggggcacggcttcagcgaagctgccgctgacgtgggcctcactcgggcttctcctgccgcaaggaatcctgtcctccgccgtccacctattctggaggattatgttcatgtgacatccaccgagggggtgagagcctatctcgtccttcgagctgatcctatggctccaggagttcagggatccttacttcacgtaccgtggcgagggggtggacaactagatctgctgggcgtgtcactggcatctcttaagaaacaggtggacggcgagaggcgagagaggctgcttcaggaggctcagaaattatctgacactctgcatagatccggcgaggaggaggcagctcaacctctgggggctccagaggaggagcctacggatggccaggatgcctcttcacactgtctgtgggtggacgaattcgcacccagacattatactgagctgctgtctgatgatttcactaaccgatgcctgcttaaatggctgaaactgtgggacctggtagtgtttgggcacgagaggccttcccgcaaaccaaggccgagcgtcgagccggcacgcgtgagtaaagaggcaaccgctcctgggaagtggaaaagccatgaacaggtgttagaggagatgctcgaagccggacttgacccaagccagcgtcccaagcagaaagtggctcttctctgtggtcctcctggcctcgggaagactaccctcgcccacgttatagcaaggcacgctggatacagcgttgtggaaatgaacgcttctgacgacagaagtcctgaggtgttcaggacccggattgaggcagccactcagatggagtctgtgctgggcgcaggaggaaagcccaactgcctcgtgatcgacgaaattgatggagcccctgtggcagctataaacgttcttctgtctatactaaacagaaagggacctcaagaggtcggaccgcaagggcctgcggtgccgagcggcggagggcgtagacggagagctgaggggggtctgctcatgcgccctatcatctgcatttgcaacgaccaattcgctccctctctgaggcagctaaagcagcaggcctttctgctgcatttcccaccaacgcttccaagcaggctggtccaacgcctgcaagagggaatgagggcagacccaggagttctcgctgcattgtgcgaaaagactgacaacgatattagggcttgtatcaacaccttgcaatttctgtactccaggggacaacgcgaactgtcagtgcgagatgtccaggcgacacgtgtcgggctgaaggatcaacgaagagggttgttctctgtgtggcaggaggtgtttcagctgcccagagcacagcgctcctcacagcatgtatccgtgctcacatgccacggaaccccgggagatgcaggacttgtggtgctacaggacatgggcgacgccggtctggggctctgggatgttctgctcttggcgtggacccgcagaggcaccttcccaggcagattctaccgggtgctgcacgctgccgcttcagctggggaacacgagaaagtggtgcagggcctgtttgacaattttctgcgacttagactacgggattcttcgctgggcgcagtgtgcgttgccctagactggctcgctttcgatgacctgctagctggagccgcacaccacagtcagagcttccagctgctcagatacccacctttcttgccggtggcattccacgttttattcgcaagctcacacacaccccgaatcacgtttccaagctcacaacaggaagcccagaatcgcatgagccagatgcgcaatcttatccaaaccctcgtgtctggaattgctccagccacgcgttccagggcgaccccacaggcactcctgctggatgcgctatgcctcctgctggatattctggccccaaagctgcgtcctgtgagcacgcaactgtactccacccgggaaaaacagcagcttgcctctttagtgggcacgatgctggcatatagtctgacgtatcgccaagagcgtacgcccgatggtcaatatatctatagattggaaccaaatgtcgaggagttatgccgctttcccgagctgccagcacggaaacccctgacttatcagaccaaacaactcatcgcgagggagatagaggtggagaagatgagacgggcagaagcctccgcccgtgtcgagaattcaccccaggtcgacggctcccctcctggattagaggggttgctgggaggtatcggagaaaaaggcgtgcatagaccagctccccgaaatcacgagcagagactggagcatattatgcgaagagcagcccgagaggaacagcccgagaaggattttttcggcagagtggttgtacgatcaactgctgtcccttccgccggagatactgcgcctgagcaagacagcgtggagcgccgtatgggcaccgcagtgggcaggtcagaggtttggtttagatttaatgagggagtgagtaatgccgtccgcagatccctctacatacgggacctgctgtag

SEQ ID NO: 219433 - DNA, 3012 bp, Artificial Sequence
  Description of Artificial Sequence: Synthetic coding sequence
atggaggattatgagcaggagctgtgtggggttgaagatgacttccataaccaattcgcagcagagctcgaggtgctcgcagaactggaaggggcttctactccatccccaagtggtgtaccactcttcaccgctgggcgtccacctcgaacgtttgaggaagcgctggcgaggggtgacgcagccagttctcctgcccctgctgccagcgtcggaagctcccagggaggcgcacgaaagagacaggtcgacgccgacctgcagccagcgggtagtcttcctcatgggagactggctgcccttccacaggggctgagatctggacgggaagctgaggaagcatctgggtcgcttcacgtgtcccctcctgcacccagaataaagcgcccaagactccaagtagtgaagaggttgaatttccgctccgaagagatggaagagccaccccctcccgacagctctcctacggatattacacctcctccttcacccgaggacctggcagaactgtggggccacggcgttagcgaggcagcagccgatgtgggcctaacccgagcgagtcctgcagccagaaaccccgtgttgcgcagacccccaattctcgaggattacgtacatgtaaccagcactgagggtgtccgagcttaccttgttctgagagctgaccctatggcccctggggtgcagggatctctcctccatgttccttggaggggcggaggtcagctagaccttttgggagtctcccttgcttcccttaagaaacaagttgacggcgagaggcgtgagagactacttcaggaagcacagaagctctccgatactctccatagcctaaggtcaggcgaagaagaagctgcgcagcctctcggtgcccctgaggaggaaccaactgacgggcaggacgcctccagtcactgtctgtgggtggatgaattcgccccaagacactatactgaattgctttctgatgactttactaataggtgcctgctcaagtggcttaaactgtgggaccttgtagtgtttgggcacgaacgtccgtctcggaaaccgaggccttccgtggagccagcacgggtatccaaagaagctactgccccaggcaagtggaaatcccacgaacaagtgctcgaagaaatgctcgaggcgggtctggatcctagccagagacccaagcagaaggttgccttgctctgcggccctccgggtctcggcaagacaaccctcgcacatgtcattgctcgccacgccggatactccgtggtcgaaatgaacgcctcggacgacaggtctcccgaggtgtttcgaactagaattgaggccgctacccagatggaatcagtcctgggcgcaggaggcaaacctaactgtctggtgattgatgagatcgacggtgcccctgtagccgctatcaatgtcctgttaagtattctcaatcgcaaaggtcctcaggaggtgggccctcagggccctgccgtgccatctggaggtgggagaagacgcagggccgaaggaggattgttgatgagacccatcatttgtatttgcaatgatcaattcgccccatcactgcggcaattgaaacagcaggcattccttttacactttccaccgacgttaccaagcagactggtccaacgcttacaggaggttagtctgcgccaggggatgagggccgatcccggagttcttgcagcactctgtgaaaagacagataacgatattagagcttgtataaacaccctccagtttctatattcgagggggcaacgagagctttcagttcgagacgtccaagccacacgcgtgggccttaaggaccagaggagaggactgttctcagtgtggcaggaggtgttccagctgccacgggcacagagaaggagggtgggccaggaccctgccctgcccgcagacactctgttactgggggatggcgacgccggaagcttgaccagcgcttcccagcgtttttatcgagtactccacgctgctgccagcgccggagagcatgagaaagtagtgcagggcctgtttgataattttctccgcttaaggcttagagattcgtccttgggcgcagtatgcgttgccctggactggctggccttcgatgatctgttggccggagctgctcaccacagccagagttttcagttactgcgctacccgccatttcttcccgtcgcctttcacgttctattcgcttctagccacacccctcggattacttttccgagctctcagcaggaggctcagaacagaatgtctcagatgagaaatctcatacagacattggtctcaggaatcgctccagctaccagatcgagagcaaccccccaggccctcctactcgatgcactctgcctgctcctagatatactggcacccaaattgcgacctgtgtcaacacagctgtactcaactcgtgaaaagcagcagctggcatccctggtgggcaccatgctagcatacagtcttacatatcgacaagaacggactccagatggccagtatatctaccgactcgagccgaacgtggaagagctttgccggttccccgaactccccgctcgaaagcctcttacataccagactaaacagctgatagctcgagagatagaagtagagaagatgagaagagcggaggccagcgcacgggtggagaattccccccaggtcgatggtagcccccctgggttggaaggtcttctgggaggaattggtgagaagggagtacaccgcccagcacctcgaaaccacgagcagaggctggagcacattatgaggcgtgctgcgcgtgaagagcagcccgaaaaggacttctttggacgggtggttgtcagatcgactgctgtgccaagtgcgggagataccgccccagagcaagactccgtggagcggaggatgggcacggcagtcgggagaagcgaagtgtggtttcgtttcaatgaaggagtatctaacgccgtccggagatcgctgtatattagggatctcctgtag

SEQ ID NO: 219434 - DNA, 1575 bp, Artificial Sequence
  Description of Artificial Sequence: Synthetic coding sequence
atgaaagagcctcggatttttcctcgggagaggcccactccttggactagagctccactgccccctcgcggtagattagacgggagtctgggccctcaaggtggtcccgtcctgaatacggggcatccgctaggcgtcaatagcgatccttttctgatggcagccggatccctcgggggtaacttgaccccgttccctcgtaacccgagccccttccccgcaagtagcggatccttggcctccaaccccgctcccttcccagccggagcacgggatccctcaatggcatctttcccgaggggcatgaaccctactggtaccggggcagtctccttcccgagacccggagggcttcttggacctggccctggacccggacccactctaaatcccaggaccggagccttaccaggccctggacccctatccaaccccagactgggagggctgccgggtcccggaccaatgagcaaccctagggcaggagggctgctgggagcaggccctgaccccagagggggaggcccaatgggccctggaagtgggcctaaccttagagccggagttctgctgaccagcggcaacgggccacccaatccacgtccagtgggattaggcccaggcccaaatcccaacctgaggtccgggtttctcggcactaaccccgctcctcggtccggtgtattccctggtccaggtctggggccaaatcccaggccctcgggcctggggcctgggccaaatctggatgcgagagctgggggactcttagggactgggtccggcctcaatctgcgcatggctggaccacaagggctcgacctggccccaattttgagggccgcagggctgctgggcgctaacagtgcctcctttagccaagcatccggtaatatgggcacgtcccctagctcgatggcccgtgtccctgggccaatgggcccaaacagcggtccaagctcccggggaattggcttgccagggccaaacccgtcccccatgagtcgcgctccagggccaattggtcccaattcggcccacttttctcgtcctgtggggcctatgggtgtgaatgcaaaccctttcccacgcggagcgggatcaagcgcctttagccaatcttccggcactctggcatccaatcctgccacatttcaacggtctgctggacttcagggatccaaccctacaatcttccccagggctagtgggcctctgggcccaaacccagccaatttccccagggcgacaggactccaaggacccagccccaccacttttcccaggagcacaggccctctcgggcctgggcaggtgacttttccccgacccgctgccggtcacctgggtccatccccggcaggcccagtcggcatcaacccggctcccttcacacgaccaactgggactctcggcctgaaccctgcaagcttcccaaggatgaatggtccagctggaaaatcgtttgttcccttccctcgagtcggatcgctcccaggcaccaatcccgctgccttccccagacctggcggtcccatggccgctatgtatccaaatggaatgctgccaccctag

SEQ ID NO: 219435 - DNA, 366 bp, Artificial Sequence
  Description of Artificial Sequence: Synthetic coding sequence
atggtgcagatcgtgatttcttcagctcgggcagggggactagcagagtgggttctcatggaattacagggagaaatcgaggcgcgttactcaactggcctggccggtaatttattgggcgatttgcactatacaaccgagggtattcctgtgctgattgttggccaccacatcctttacggtaaaattatccacctcgagaagccattcgctgtactggttaaacacacacccggtgatcaagattgtgatgaattgggcagagaaacgggcacaagatacctggtgacagccctcatcaaggataagattctgtttaaaactaggccaaagcccattatcacgtcagtgccgaagaaggtctag

SEQ ID NO: 219436 - DNA, 366 bp, Artificial Sequence
  Description of Artificial Sequence: Synthetic coding sequence
atggtccagatagttatctcatctgcacgggctggcggacttgccgaatgggttctcatggaactccagggcgagatcgaagcacggtactctacaggcctggcaggaaacctcctgggcgatctccactacaccactgaaggtattccggtcctcatcgtgggacaccacatcctgtatgggaaaattattcacctggagaaaccctttgctgttttagtcaagcatacgcctggcgaccaagactgcgacgagctaggaagagagaccggtacccgctacctggttaccgcccttatcaaggacaaaatcctgtttaagacccgccctaagccaataatcaccagcgtgcccaagaaggtctag

SEQ ID NO: 219437 - DNA, 1776 bp, Artificial Sequence
  Description of Artificial Sequence: Synthetic coding sequence
atgaagtatatactagttactggaggcgtgatctcaggcatcgggaaggggattatcgccagtagcgtgggaactatactgaaaagttgtggattacatgtcacaagcattaagatcgacccttacatcaatattgatgcaggcacattttccccatacgagcatggcgaagtatttgtgctcgatgacggcggagaagtggatctggacctggggaattatgaaagatttcttgatataaggctcaccaaggacaacaatctgaccaccgggaagatctaccagtacgtcataaataaggaaaggaaaggggactacctcggcaaaacagtccaagtggtcccccacattactgacgctattcaggagtgggttatgagacaagcccttattcccgtcgacgaagatggcctggaaccccaagtttgcgtaatcgagctgggaggcactgtgggcgacatagagagcatgcccttcattgaggcattcagacagtttcagttcaaagttaagcgcgagaatttttgtaatatccatgtgtcactggtgccacagccctcatccaccggtgaacagaaaactaagcccacgcagaactccgtgcgagagcttcggggtctgggtctgtcccctgacctcgtggtgtgccggtgttccaatcccttggatacctcagttaaggagaagatctccatgttttgccatgtggagcctgaacaggtgatctgcgtccatgatgtaagttcgatctacagagtcccgctgttgcttgaggaacagggggtggtagactactttctcagaaggctggacctcccgatcgagaggcagccgagaaagatgctgatgaaatggaaagagatggcagacaggtacgaccgcttgctggaaacctgcagtatagcgctggtaggaaagtacactaagtttagcgacagctacgcctccgtcatcaaggccctggaacactcagctctggccataaatcataagctggagataaagtacattgactccgctgatttggaaccgatcaccagccaagaagaacctgtgcgttaccacgaagcctggcaaaaattgtgttcagcccatggagtgctcgtgcctgggggattcggcgttcggggaacagagggcaagattcaggctatagcctgggccagaaaccagaaaaagccattcttgggcgtgtgccttgggatgcagttggccgtagtcgagttctcacgcaacgtcctgggctggcaggatgctaactccaccgaattcgatccgacgacctcccaccccgtggttgtggatatgcctgaacacaacccgggacaaatgggagggacaatgcgactagggaagaggagaaccctgttccagacgaaaaatagcgttatgcgaaaattgtatggcgacgccgattatctcgaggagcggcaccgacatagattcgaggtgaatccggtgtggaagaagtgcctggaagaacaaggcctcaagttcgttggccaagacgtcgaaggcgagcgaatggagattgtggagttggaagaccaccccttcttcgtgggtgtccagtaccatccggaattccttagtcgaccaatcaagccgtctcctccttactttggcctgttgcttgccagcgtgggtagactaagccattatctgcaaaaaggatgccgactgagcccacgcgatacctactcggaccgtagcggttctagtagccccgactccgagattacagaactgaagtttccctcgattaatcatgactag

SEQ ID NO: 219438 - DNA, 1776 bp, Artificial Sequence
  Description of Artificial Sequence: Synthetic coding sequence
atgaaatacattctcgtgacaggcggtgtgatttcgggcatcggcaaagggatcattgcctctagcgttggcactattttgaagtcctgtggactgcacgtgacatctatcaagattgatccatatataaatatcgatgccggtaccttcagcccttacgagcacggcgaggtcttcgtgctggacgacggtggcgaagtggatctcgacctcggcaattacgaacgtttcttagacatacggcttacgaaagataacaatctgacaactggcaaaatctatcaatacgttataaacaaggaacgtaagggagattatttggggaaaactgtacaggtcgttcctcacatcaccgatgccatccaggagtgggtcatgaggcaggcattaatccccgtggacgaagacggactggagccacaggtgtgcgttattgaacttggcggaacagttggggatatagaatctatgccattcatagaagcctttaggcaattccaatttaaggtgaagcgagaaaacttttgcaatatacacgtctccctggtaccgcagccctcgtctaccggtgagcagaagactaaaccaactcaaaattctgtacgtgaattgcggggactcgggctctcacccgacctcgtagtgtgtcgatgcagcaaccccctggatacttccgtcaaagagaaaatctccatgttctgtcacgtggagcctgagcaggtaatatgtgttcatgatgtatcctctatctaccgcgtaccccttctactcgaggaacaaggcgttgtcgactacttccttaggaggttggacctgcctattgagcgccagcctcgcaagatgctgatgaagtggaaggagatggccgatcggtatgaccgactgctggagacgtgttctattgcactcgtaggcaagtacacgaaattcagcgactcgtacgcaagcgtgattaaagcgcttgaacactctgcgttagcgattaatcataaacttgaaataaagtacatagactccgccgacctggaaccaattacttctcaagaagagcctgtgcgctatcacgaggcttggcaaaagttgtgttccgcacatggagtgttggttcctggtggcttcggcgtgcgcggtacggaggggaagatacaagctatcgcctgggccagaaaccagaagaaaccctttctgggtgtttgtcttggcatgcagctggccgtggtagaattttctagaaatgtgcttggatggcaagacgctaactctactgagtttgaccccactacatcccatcccgtggtagtagacatgcccgaacacaacccaggacagatgggcggaacaatgcggctgggcaaacggaggaccctgttccagacaaaaaacagtgtaatgaggaagttgtacggggatgctgactatctggaagaacgccaccgtcataggtttgaggtcaacccggtttggaagaagtgtcttgaggagcagggcctcaagtttgttgggcaggatgtggagggagagcgtatggagatcgtagagctcgaggaccacccgtttttcgtgggggtgcagtatcaccctgaattcctctcaagaccgattaagccttcccccccttatttcggcctcctgctggcaagcgttggacgcttatctcactatcttcaaaagggctgccggctgtcccctagggacacttactccgaccggtctgggtccagctcccccgactccgaaatcacagagcttaaatttccatcaatcaatcacgattag

SEQ ID NO: 219439 - DNA, 1083 bp, Artificial Sequence
  Description of Artificial Sequence: Synthetic coding sequence
atgttttgtcatgtggaacccgaacaggtgatctgcgttcatgacgtctcttctatatatcgggtcccattactcctggaggagcagggtgtggtagactacttcctacggcgactggacctgcccatcgagcggcagccacgcaagatgttgatgaagtggaaagagatggcagatcggtacgatagactgctagagacatgtagcattgcccttgtcggcaaatataccaagttcagcgatagttatgccagcgttatcaaggcacttgaacactccgctttggcaattaatcacaaactggagattaagtacattgactcagccgatctcgaacctattacttcgcaagaggagcctgtgcgctaccatgaggcgtggcagaagctctgcagcgctcacggggttctcgtccctgggggtttcggtgtacgaggcactgagggcaagattcaggcgattgcttgggcccgaaatcagaagaaacctttcctgggggtgtgcctggggatgcagcttgcagtagtggaatttagtagaaacgtgctgggctggcaagacgcaaacagcaccgagttcgaccctactacttcccacccggtcgttgtagacatgcccgagcacaatccgggacagatgggaggaacgatgcgcctaggcaagagaagaactctttttcagacaaaaaactccgtaatgcgcaagctgtatggcgacgccgattaccttgaagagcgccacagacatagattcgaagttaaccccgtctggaagaagtgcctggaggagcaaggcttaaagttcgtgggtcaggacgtggagggcgagcgcatggaaatcgtggaattggaggaccaccccttcttcgtgggcgtacaataccaccctgagttcctttcgcggccaattaagccatctcctccctacttcggccttttactcgccagcgtggggcgtctgtcgcattatctccagaagggatgtagactttctccacgggatacttatagtgatcgaagtggctcttcctcccctgacagcgaaatcaccgagctcaagtttccttctatcaatcatgactag

SEQ ID NO: 219440 - DNA, 945 bp, Artificial Sequence
  Description of Artificial Sequence: Synthetic coding sequence
atgccaaaatcgaagagcaagatgaagtacattctcgtcacagggggagtaatcagcgggattggaaagggtattatcgcttcttccgtcggtaccatactgaaatcttgtggcctccatgtaacctctattaaaatcgatccatacatcaacatcgatgccggaacgttttcaccctacgaacacggcgaggtatttgttctggacgatgggggagaggtcgacttggaccttgggaattatgagcgttttttagacataaggcttactaaagataacaacctcaccacgggtaagatttaccagtatgtcatcaacaaagagaggaaaggggactatcttggaaagaccgtgcaggttgtcccacacattacagacgctattcaggaatgggtcatgcggcaggcattgatcccagtcgatgaggatggcctcgaaccccaggtctgcgtgattgagctcggcggtactgtcggtgacatcgagtccatgccatttatcgaggcgttccgacaatttcagttcaaagtaaaacgggaaaatttctgtaacatacacgtatccctggtcccgcagcccagcagtaccggggaacagaagacaaaacctacccagaatagtgtgagagagctgaggggcctgggcttgtcccctgatcttgtggtgtgtagatgcagtaaccctctggatacaagcgtgaaggagaagatctctatgttttgtcatgttgaaccggagcaggtaatttgcgtccacgacgtctctagtatctacagagtcccccttctcctcgaagagcagggggtagtggactactttcttaggagactcgaccttccaattgaaaggcagccaagaaaaatgttaatgaagtggaaagagatggccgataggtttgcgtgtaacgaagagcttggagttctggccagtttcacattgctgtag

SEQ ID NO: 219441 - DNA, 1761 bp, Artificial Sequence
  Description of Artificial Sequence: Synthetic coding sequence
atgaaatatatcttggtgacaggcggtgttattagcggcataggaaagggcataattgccagctcaatcggaacaatcttaaaatcctgtggcctgagggttacagccatcaagattgacccctacatcaacattgatgctgggactttttcaccctatgaacacggggaagtatttgtactgaatgacggcggagaggtcgatctggacctcgggaattacgagcggtttctcgacatcaacttatacaaggataacaatatcactaccgggaaaatctatcagcatgttattaataaggagaggcgaggcgattacctcgggaagactgtccaagtcgtgcctcatattaccgatgccgtgcaggaatgggtgatgaatcaggctaaggtgccagtggatggcaacaaggaagaaccacagatttgtgttatagaactgggtggaactatcggtgacatcgaggggatgccttttgtggaagcgttccggcagtttcagtttaaggctaaaagagaaaatttttgcaatatacacgtcagccttgtgcctcagctgtcagctaccggggaacagaaaaccaagcccacacagaacagcgtgagagcattacgagggctcggcctgtccccagatctgattgtgtgcagatcatctaccccgatcgaaatggccgtgaaggagaagattagcatgttctgtcatgtgaatcctgaacaggtgatctgcattcacgatgttagtagcacatatagagttcctgtattactcgaggagcagagcatcgtgaagtattttaaggagcgtttacatctacccatcggagactccgcaagcaatctgttattcaagtggaggaatatggccgacagatatgaaagattgcagaaaatttgctccattgcgctcgtaggcaagtataccaagttaagggactgctacgcatccgtgttcaaagcattagaacacagtgcccttgcaattaatcacaagttaaacctcatgtacatcgacagcattgatcttgagaagattactgaaacagaggacccagtcaagtttcacgaggcctggcagaaactatgtaaggccgacggcattctggtgccagggggatttggcatcagaggcaccttgggcaaactgcaggcgatctcctgggcacgcacaaagaaaattccatttctcggagtgtgcctgggcatgcagctcgccgtgattgagttcgctcgtaattgcctgaatctgaaggacgcagactcaacagaatttagacccaatgcccctgtgccgctggtcattgatatgccagagcacaaccctggcaacctcggaggaactatgcggctgggcatccgacgcaccgtgttcaagacagagaatagcatcctaaggaaactgtacggggacgtcccatttatcgaagagcggcaccgacacaggtttgaggttaaccccaatcttatcaaacagtttgaacagaatgacctgagttttgtgggacaagacgtggatggggacaggatggagatcatcgagctcgctaaccacccctacttcgtgggggtgcagttccacccagaattctcctctcgacctatgaagccatctccgccttacttgggtctactgctcgctgcaaccggtaatctcaacgcatacttacaacaaggttgcaagctatcctccagcgataggtattccgatgcgagtgatgactcattcagcgaaccgagaattgccgaactcgagatctcttag

SEQ ID NO: 219442 - DNA, 531 bp, Artificial Sequence
  Description of Artificial Sequence: Synthetic coding sequence
atgtacattgattccattgatttagagaaaattaccgagacagaggaccctgtgaagttccatgaagcttggcagaagctctgcaaagctgacggaatcctggtacctggaggcttcggaattaggggtacgctgggcaagctgcaggcgatctcatgggcaagaaccaagaagattccctttctgggagtctgtctgggtatgcaactggccgttatcgagtttgcccgtaactgcctgaatctaaaggatgccgattccacagagtttagaccgaatgccccagtgccccttgtgatcgacatgccagaacacaacccgggtaatttaggcggtacgatgagactcggcataaggcggaccgtttttaagaccgaaaatagcattctgatttccctgtcactggggctggcgagtgtggagcacacagagtgtcctagcgccttcgacctgagagacagtctgtttattggacttttttgcgagctgccaatgttgctggagatgaatctagactgggatttagactag

SEQ ID NO: 219443 - DNA, 1761 bp, Artificial Sequence
  Description of Artificial Sequence: Synthetic coding sequence
atgaaatatatactggttaccgggggagttatttctggtatcgggaaagggataattgcaagtagtattggcacgatcctcaaatcttgcggactgcgggtcactgccataaagatagacccgtacattaatattgatgctggcacattctcaccatatgagcatggtgaagtgtttgtcttgaatgacggtggggaggtagacctggatctgggtaattacgagcgcttcctggacataaatctatacaaggacaataacatcacaaccggaaaaatttaccagcatgtcatcaacaaggagcgccgaggggactacctgggtaagacagtgcaagtggttcctcacatcactgatgccgtgcaggagtgggtgatgaatcaggccaaagtgccggtcgacggaaacaaagaggagccgcagatttgcgtcatcgagctgggaggaaccataggcgatatcgaggggatgccgttcgtggaagcttttcggcagtttcagttcaaggccaaacgcgagaatttctgtaacattcatgtgtccctagtcccccagctgtctgcaacaggtgaacaaaagaccaagcctacacagaatagcgtgcgcgcattgaggggactggggcttagtcctgatcttatagtttgtaggtccagcaccccaatcgaaatggccgtcaaggaaaaaatctccatgttttgccacgttaacccggaacaagttatctgtatccacgacgtctcgtcaacgtaccgggtgcctgtgctcctagaggagcagagcattgttaaatatttcaaggaacgactgcaccttcccattggggactccgcctctaacctgctcttcaaatggcggaatatggcagatcggtacgagcgacttcagaaaatttgttctatcgcgctggtgggcaagtacacaaagttgagagactgttacgcaagcgtgtttaaagccctggaacactcagcgttggctatcaaccacaaattaaatctgatgtacatcgacagtatcgatttagagaaaatcactgaaacagaagaccctgtgaaatttcacgaggcttggcagaaactgtgtaaagccgatggaatactggttcccggtgggtttggcatcagagggactctcggcaagctccaggcaatctcatgggctcgcaccaaaaaaataccctttctcggggtgtgcctgggaatgcaattggctgttattgagtttgccagaaactgcctaaaccttaaagacgcggactcgacagagtttaggccaaacgctccagtgccattggtcatagacatgccagaacataacccaggcaaccttggcggaacaatgcgcctggggataaggcgaacggtgttcaaaaccgagaactccatactccgaaagttgtacggtgacgtgccatttattgaggaacggcaccgacacaggtttgaggtgaaccctaatctgatcaagcagtttgaacagaacgatttatcgttcgtgggccaggatgttgatggagaccgtatggagatcatcgaactggccaatcacccatatttcgttggagtccaatttcaccctgagttttcaagtaggccgatgaagccctctcctccctacctgggactcctgctggctgcgaccggaaatctgaacgcctatctgcagcaagggtgcaaattgtcctccagcgaccggtactccgatgcatccgacgattccttttccgagcctcgaattgccgaattagagatcagctag

SEQ ID NO: 219444 - DNA, 1761 bp, Artificial Sequence
  Description of Artificial Sequence: Synthetic coding sequence
atgaagtatatcttggtaactggcggagtgatatctggaattggtaagggcatcatagccagttcgatagggactattctgaaatcatgcggccttcgtgtgactgccattaaaattgatccatacatcaacatcgacgcaggaaccttcagtccctacgaacatggcgaggtgttcgtgctcaacgatggcggagaagtggacctcgacctaggaaattatgagaggtttctggatattaacctgtataaggacaacaacatcacaacagggaagatctaccagcacgtcattaataaggagcgtaggggggactacttgggtaagaccgtccaggtcgttccccatattactgacgcggtgcaggagtgggtgatgaatcaggctaaggttccggtcgatgggaacaaggaagaacctcagatatgcgtaattgagcttggcggaacaatcggtgatattgaaggaatgccttttgtggaagcatttcgacaattccagtttaaggccaagcgtgagaatttttgtaatatccacgtgtccttggttccacaactctctgcgacaggtgagcaaaaaaccaagccaactcagaattctgtacgagcgttgagagggctgggtttaagccccgacctgatcgtgtgtaggtcgtctaccccaatcgaaatggcagtcaaggagaaaatatctatgttttgccatgtcaacccagaacaagtgatctgcattcatgacgtctcgtcaacttatcgcgtgcctgtgttactcgaagaacagtctatcgtgaaatatttcaaagagagactccacctgcccattggggactctgccagcaacctgcttttcaagtggagaaatatggctgacaggtacgagcggctgcagaagatttgctccatcgcactagtagggaagtacaccaaactaagagactgttacgcatcagttttcaaagctctggagcactcagcgctcgcaatcaaccacaaactcaacctgatgtacatagactcgatagatcttgaaaaaattacagagaccgaagatcctgttaagtttcatgaggcctggcagaagctgtgtaaagcagacggcatcttggtgcctggcggattcggcatccgaggaactctgggcaagttgcaggcgatcagctgggcacggaccaagaagatcccttttctgggcgtgtgtctcggtatgcagctggctgtaatcgagtttgccaggaattgcctgaacctgaaagacgccgatagtaccgagttccgacccaacgcccctgttcctttggtaatcgacatgcctgagcataatcccggtaaccttggtgggacgatgcgactggggataagaaggactgtgttcaagactgaaaacagtattctccgcaagttgtacggggatgtgcccttcatcgaggagcgccaccgccatcgttttgaagtgaaccctaacttgataaagcagttcgagcagaacgatttgtcatttgtgggacaagacgtggacggcgaccggatggaaataatcgaacttgcaaatcatccgtatttcgtgggcgtccaattccaccccgagttctcgagcagacctatgaagccgagcccgccataccttggacttttgctcgccgctacaggaaacctgaacgcatatttgcagcagggatgtaagctgtcttcatctgatagatattccgacgcctctgatgactcatttagcgagccaagaatagcagagctggaaatctcctag

SEQ ID NO: 219445 - DNA, 399 bp, Artificial Sequence
  Description of Artificial Sequence: Synthetic coding sequence
tgaggtaaacttcaggcaatttcgtgggccaggactaaaaagattccctttctgggcgtgtgcttggggatgcagctcgctgtgatcgaattcgctaggaattgcctgaatctgaaggacgcagattccaccgaattcaggcccaatgcacctgtccctttggtaattgatatgccagaacataatcccggtaacctgggcggtactatgcgccttgggatccgtaggactgtatttaaaactgaaaattcaatccttatatccttgtcactgggcttagccagtgtggagcacacagaatgtcctagcgcattcgatttgagggattctttatttatcggcctgttttgcgagctgccaatgctgctggagatgaatcttgactgggacttagactag

SEQ ID NO: 219446 - DNA, 3654 bp, Artificial Sequence
  Description of Artificial Sequence: Synthetic coding sequence
atggccgcaggcagggctcaggtgccctcaagcgaacaggcttggctggaagacgcccaggtcttcattcaaaagacactgtgtcctgcggtcaaggagcctaatgtgcagttaacacccctagtaattgactgtgtgaagacagtttggctgtcccagggtagaaaccagggaagcacccttccgttgtcctactccttcgtatcagtgcaggatctgaagacgcaccagagattgccttgctgttcccatctgtcttggtcttccagcgcctaccaggcttgggctcaggaggctgggcctaacgggaaccccctacccagggagcagctgcttcttctgggcacactgaccgatcttagtgcagacctcgaacaagagtgtcggaacggatctttatatgtgcgagacaacaccggagtgctaagctgcgaattgatcgacctggatctctcatggctcgggcatctcttcttattcccacgatggtcctacctgcctcctgctagatggaattcatctggagagggccacctcgaactgtgggacgctccagtgcccgttttccctctgactatttcacctggcccagtgacacccattccagttctctacccggagagtgcttcgtgcctgctgcggctgcgaaataagctgaggggtgttcagaggaatctggccggatcgttggttagactgtcagcactcgtaaaaagcaagcagaaagcatacttcattctgagccttgggcgttctcacccagcggtgacacacgtgtccatcatcgtgcaggtccccgcacagctggtgtggcatagggctctgagaccgggaaccgcatatgtgttaactgaattgcgcgtttctaaaataagaggacagcgccagcacgtgtggatgacctctcagagcagtcgtctgctgcttctcaaaccagagtgcgtgcaggaactagaactggagctggagggtcctctgctggaagcagatccgaagccactccccatgccttccaattcagaggacaaaaaagatccggagagcctcgtgcgttattcacgcttactgagctactccggcgctgtgaccggagtgttaaatgagcctgcaggtctgtatgagcttgacggtcaattggggttatgtttggcttaccagcagttccggggactgcgcagggtgatgcgcccaggggtgtgtctgcagctgcaggatgtccatttgcttcaatccgttgggggtggaaccaggaggccagtcttggccccatgtctgagaggggcagtgctcctccagagctttagccggcagaagcccggtgcacacagctctcgccaagcctacggagcttccttatacgagcagctcgtgtgggagcgtcagctcggtctgcctctgtatctttgggcaaccaaagccctggaggaattagcttgcaagctctgtccgcatgtacttagacaccaccaattcttgcagcattcttcaccgggaagcccatctcttggcttgcagcttctggcccctactctggatctcttggcccctccaggatcaccagttaggaacgcccacaacgaaatattggaagagcctcatcattgcccactccagaagtacacccggctgcaaaccccgagcagcttccccactctggcaaccctcaaggaagagggacagaggaaggcgtgggcgtctttcgatcctaaggcacttctccctctgcctgaagcgtcctatctaccctcctgccagcttaatcgacgcctcgcttggtcctggctctgcctgctcccaagcgctttctgccctgcacaagtgctcctcggtgtcctggtcgcatcctcccataaaggctgtctgcagttgagagaccaaagtggctccctaccctgtttactgttggcaaagcattcccaaccactttccgacccgaggctaatcgggtgcctggtgagggctgagcgcttccagcttatcgtcgaaagagacgtcaggtcgtccttcccttcatggaaggagttgtccatgcccggattcatccagaaacagcaggcccgagtgtacgtacagttctttctagctgacgccttaatccttcccgtgcctagaccctgcctgcactctgccactccatccacaccccagacagaccctaccggcccagaaggaccacacctcgggcaatcaaggctttttcttttatgtcataaggaagcattaatgaaacgcaacttttgtgtccccccaggggcaagtcccgaagtgcctaagccagcactgtctttctacgttcttggcagctggctgggcggaactcaaagaaaggaaggcacaggctggggcctgcccgagccacaggggaacgacgacaacgaccagaaggtccacctgattttcttcgggtcatccgtgaggtggtttgagtttttacaccccggacaggtgtaccggttaattgcccctggcccagctacgcctatgcttttcgaaaaggacggaagttcgtgcatctcaagaaggccattggagttagcaggctgcgccagttgtctcactgtccaggataattggaccttagaactcgagagctcacaagatatacaggacgtactggatgctaataaaagcctgcctgaatcctcgctgacagaccttctctccgataatttcacagatagtctggtgagcttttctgccgagatcctatcccgcacattgtgcgaacctctggttgcaagtctgtggatgaagttaggcaatacaggcgctatgagaagatgcgtcaaactcactgtggctctcgagaccgccgaatgcgaatttccgccacacctggatgtctacatcgaagatccacacctgcctccctccctggggctgctacctggagctagagtccatttctcacaactcgagaaaagagtgtctaggagtcataatgtttattgctgttttcggtcatccacctacgtccaagtcctgtctttccccccagaaacaacaattagcattccactaccacatatttacttagccgagttgctgcagggtggacaatccccttttcaggcaaccgccagctgtcacattgtgtccgtttttagcctgcaattgttttgggtgtgcgcatattgcaccagcatatgtagacaggggaaatgtacacggctcggaagcacctgcccgacccaaaccgccataagccaggcgattatccgactcctggtcgaggatgggaccgccgaggctgtggtgacatgccggaaccatcacgtggccgctgctttggggctgtgccccagggaatgggccagcctgctagacttcgtgcaggtcccgggtcgcgtggttctccagtttgctgggccaggcgctcaattggagtcttctgcacgggtagacgagcctatgaccatgtttctgtggactctttgtactagtccctccgtgctgcgacctattgtgctgtcctttgagctggagcgaaaaccatctaagatagttcccttggaaccacctcgtctgcagcgttttcagtgcggagagctgccgttcctcactcatgtgaatccaaggctaagactatcctgcttgtctatccgggagagtgagtactcctcctctttagggatcctggctagttcttgctag

SEQ ID NO: 219447 - DNA, 3096 bp, Artificial Sequence
  Description of Artificial Sequence: Synthetic coding sequence
atggcagccggtcgagcccaggtgccttcctcagagcaggcatggctggaagacgcacaggtcttcattcaaaagactctgtgtccagctgtgaaggagcccaacgtccagctcacacctctagtgatagactgtgtgaagaccgtctggctgtcgcaagggaggaatcagggttctaccctgcccctctcgtatagttttgtgtccgtgcaagacctgaagacccaccaacgactgccctgttgtagccacctgtcttggtcttcgtctgcatatcaggcatgggcccaagaggccggacctaatggcaatcccctgcccagggagcaactgctgttgttgggcaccctgactgatctatcagctgacctcgagcaggaatgtcgaaacggctcactttacgttcgcgataacactggagtgctgtcgtgtgaactaattgacctggacctatcatggctgggacatctatttttattcccaaggtggagctatctcccgccagcccgttggaactcttccggtgagggtcacttagagctctgggatgcccctgtacccgtgtttccacttaccatttcaccagggcctgtgactcctatcccggtgctctaccctgaatctgcgtcctgccttctcagactgagatcccatcccgctgtgacccacgttagcatcatcgtacaagtgcccgctcaactagtgtggcaccgcgcactgcgcccaggaactgcctatgtgctcacagaactacgtgtgtctaagatcagaggccaaagacaacatgtttggatgacatcgcagagcagccgcctcctgttactcaagccagaatgtgtgcaggaactggaattagagctcgaggggccactgctggaggccgatccgaaacccttacctatgccaagcaacagcgaagataaaaaagaccctgagagtctggtacggtactccaggctgctttcgtacagcggggcagtcaccggcgtgttgaatgaacccgcaggcctgtatgaactggacgggcagttgggtctatgtctcgcataccaacaattcaggggactcagaagagtcatgaggccaggggtgtgcctgcagcttcaggatgttcacctcttgcagagtgttgggggaggcacacgtaggccagtgctcgccccttgtcttcggggagcagtgctgctgcagtccttttccaggcagaagcccggtgctcattccagtcgtcaggcctacggtgctagcctgtacgagcagctggtgtgggagagacaacttggtctcccactctacctgtgggccactaaggctttggaagagttggcctgcaagttgtgtccccatgtcctccgtcaccaccagtttctgcagcacagcagtcctggtagtccaagccttggtttgcaacttttggccccaacgttggaccttctagctccccctgggtctcctgtgagaaatgcacacaatgagattctcgaggaacctcatcactgccctctgcaaaaatacactagactgcagactccaagctccttccccacccttgctactctgaaagaggagggacagcggaaggcctgggcctcattcgatcccaaagcgctcctgccattacccgaagcctcatacttgccaagctgccagctcaaccggagacttgcctggtcttggttgtgcctgctgcctagtgctttctgccctgctcaggtattgctgggtgtcttagtagcatcttctcataagggttgcctccagttgcgcgatcaaagtggatcactgccctgtctgctgctggctaagcattctcagcccctttcggatccgcgtctgatcgggtgccttgttcgtgccgagcgctttcagctgatcgtggagcgtgatgtgagatcaagtttccccagctggaaagagcttagcatgccgggatttatccaaaaacagcaggccagggtgtatgtacagttcttcctggcggacgctctgattttacctgtacctagaccctgccttcactctgccacgccaagtactcctcagacggatcccacaggccctgaggggccacatttaggccagagcaggctgtttcttttgtgccataaagaagccctcatgaaacgcaacttttgcgtccctccaggagcgtcaccagaggtgcccaaaccagccttgtccttctacgtgctgggttcttggctgggaggcacccaacggaaggagggcacggggtggggcctgcctgagcctcaggggaatgacgacaatgatcagaaggtccacctgatcttcttcggtagttcagtacgatggttcgaattcctccatccaggacaggtttatcggttgattgccccaggacccgcaacccctatgctgttcgaaaaggacgggtcaagttgtatttcacgtcgaccgctcgaactcgcagggtgcgcttcttgtttgacggtccaggataattggaccctggaattggagtcaagccaggacatccaggacgtgctggatgccaacaaatctctgccggaatcaagcctgacagatttgctatcagataatttcacagattccttggtgtctttcagcgcagagatactatcacgaactctttgcgaaccgctggtggcttccctttggatgaagctgggcaatacgggggctatgcgcaggtgcgtgaaactgacagttgctttggaaacagccgagtgcgaatttcctccccaccttgacgtatatatcgaggatcctcacctccctccaagcctcggtctattaccgggagccagagtccacttcagccagctcgaaaagcgcgtgagccgctcccataacgtgtactgttgcttcaggagcagtacgtatgtccaggtgcttagcttcccccctgagactactataagtatcccactgccccatatctacctcgctgagctcctgcaaggaggccaatctccattccaggcaaccgcctcctgccatatcgtatctgtgtttagcctccaactgttctgggtgtgcgcctactgcactagtatctgtcggcaggctcccggtggcggttgggattgcagaagccggggtgacctgtag

SEQ ID NO: 219448 - DNA, 843 bp, Artificial Sequence
  Description of Artificial Sequence: Synthetic coding sequence
atgcaggccaagtactcaagtaccagggatatgttggacgacgacggcgacactacgatgtctctgcactctcagggttccgcaaccacacgccatcctgagcctcggaggacagagcaccgcgctccctcatccacctggcgccctgtcgctctgaccttgttgactctgtgcttggtactgcttattggactagcagccctgggcttgttattttttcagtactaccagctttcaaatacagggcaggacacgattagtcagatggaggaacgactcggaaacacctcccaagaactgcagtcccttcaggtgcaaaacataaagttagcaggtagcctgcagcatgtggccgagaagctctgccgcgaactgtacaataaggcaggggctcaccgatgctccccttgtacagagcaatggaaatggcacggtgataactgctaccagttttacaaagatagtaagtcgtgggaagactgtaaatacttctgtcttagcgaaaactccactatgttgaaaattaataaacaggaagaccttgagttcgcggcatcacagtcctattcagagttcttttattcctactggacgggcttactgagacccgattctggtaaagcttggctatggatggacggaacccccttcacgtctgagctgttccatatcattattgacgtaacttctcctcggtcacgggattgtgtggccatcctaaatggcatgatcttctctaaagactgtaaagaactaaaacggtgcgtctgcgaacggcgagccggaatggtcaagcctgaatcacttcacgtgccacccgagactctgggagaaggggattag

SEQ ID NO: 219449 - DNA, 213 bp, Artificial Sequence
  Description of Artificial Sequence: Synthetic coding sequence
atgcaggctaaatattcctctacacgggacatgctagacgacgatggagacaccaccatgagcttacattcccaggggagcgctaccactcgtcaccccgaacccaggagaactgagcaccgagccccatcttcaacctggcggccagtggctctgacactcctgaccctctgcctggtgctattgatcggattagccgcactgggactttag

SEQ ID NO: 219450 - DNA, 879 bp, Artificial Sequence
  Description of Artificial Sequence: Synthetic coding sequence
atgacgagaacgtatgagaacttccagtacctcgagaataaagtgaaggtgcagggcttcaaaaacggacccttaccgttgcagtccctcctgcagcggctctgcagtgggccttgccacctcttgctgagcttaggcttaggcctgctgctcctggtgattatttgcgtagtgggcttccagaactctaagtttcaacgagatctggtgacattaaggactgatttctctaatttcacaagcaatacggttgcagagatacaggccctgacgtcacagggatcctcacttgaggagactatcgcatctctcaaggccgaggtagaagggttcaagcaggaaaggcaagctgttcactccgaaatgcttctgcgcgtgcagcaactagtccaggacctgaagaagctcacttgtcaggtggcaactttgaacaataacggagaggaagccagtaccgaggggacctgctgcccagtgaactgggtggagcatcaggactcctgctactggttttctcactctggaatgagctgggctgaggccgagaagtattgccagctcaaaaatgcccacttggtggtgatcaattccagggaagagcagaatttcgtccagaagtacttgggcagtgcatacacatggatggggctgtccgatcctgaaggagcctggaagtgggtggacggaacagactacgcgacagggtttcagaattggaagcccggtcagccagatgactggcagggacatggcctagggggtggagaggactgcgcacatttccatcccgatggcagatggaacgacgacgtatgtcagcgtccatatcattgggtatgtgaggccggtctcggacagaccagccaggagtcccattag

SEQ ID NO: 219451 - DNA, 951 bp, Artificial Sequence
  Description of Artificial Sequence: Synthetic coding sequence
atgaccagaacctacgaaaacttccagtacctggagaataaggttaaggtacaaggattcaagaacggcccactgcctcttcagagtcttctgcagagactttgttctggaccttgccaccttcttctctcccttggcctggggctgctgcttttggtcatcatctgcgtggttggctttcagaactctaagtttcagcgcgacttagtgaccttgagaacagactttagtaactttacatcaaataccgtcgcagagattcaagcactgacgtcacagggtagttcgcttgaggaaactatagcctcactgaaagctgaggtcgaaggttttaagcaggaacggcaggcgggtgtctcggagctgcaggagcatacaacacaaaaggcccacctcgggcattgcccacactgcccaagtgtgtgcgtgcctgtgcactcagaaatgcttctgcgagtacaacagctcgtgcaggacctaaagaagctgacatgccaggtggcaactctgaacaacaacgcatccaccgaaggcacttgttgccccgtaaactgggttgaacatcaggactcttgttattggttctcccattcaggcatgagttgggctgaggccgagaaatactgccagctcaaaaacgcccacctagtcgtaataaatagcagagaagaacaaaatttcgttcagaagtatctgggcagtgcgtacacgtggatggggctgtccgatcccgaaggggcatggaagtgggtcgacggcacggactacgccactggcttccagaactggaaacccggacaaccagacgactggcaggggcacggtctggggggtggcgaggactgtgcccattttcaccccgatggaagatggaacgatgacgtgtgtcagcgtccctaccattgggtctgtgaagctgggctcggtcagactagccaggagagtcactag

SEQ ID NO: 219452 - DNA, 879 bp, Artificial Sequence
  Description of Artificial Sequence: Synthetic coding sequence
atgaccaggacctacgaaaacttccagtatctggagaacaaggtaaaggtccagggctttaagaatgggccactgcccctgcagagtctccttcaacgcctgtgtagtgggccttgccacctgttacttagcctgggactgggacttctcctccttgtgattatttgcgtggtgggttttcagaactcgaaatttcagcgggacttagtcaccttgagaacagactttagtaattttacctccaacacagtggcagagattcaggccttgactagtcaagggtcatcactggaggaaacgatcgcttctttgaaggccgaagttgaggggttcaagcaagaacggcaggccgtccatagtgagatgttactccgcgttcagcagcttgtgcaggatctcaaaaagctgacatgtcaggtagcgacactgaataataatggggaagaagcctctactgagggcacctgctgtcctgtgaactgggtagagcatcaggactcctgttattggttctcacactcaggaatgtcctgggccgaggccgaaaagtattgtcagctgaagaacgcacatctcgtcgtcatcaatagcagagaggaacaaaactttgttcagaaatacctcggatccgcttatacctggatgggcctgagcgatcccgagggagcttggaagtgggtagatggaaccgattatgctaccggatttcagaactggaaacccggacagcctgatgactggcagggccacggactcggtggaggtgaggattgtgcacattttcatcccgacggacgttggaacgacgacgtgtgccaacgcccttatcattgggtctgtgaggctgggctgggacagacctcacaggagtcacattag

SEQ ID NO: 219453 - DNA, 798 bp, Artificial Sequence
  Description of Artificial Sequence: Synthetic coding sequence
atgtcggaagaagtcacctacgcagacttgcagtttcagaattctagcgagatggagaaaatcccagagatcgggaaattcggagagaaggcccctccagccccatcccatgtctggagaccggcagcattgtttctcactctgctttgtctccttctgcttattggcttgggagttctcgcatcaatgtttcacgtcactctcaaaattgagatgaaaaagatgaataagctccagaatatcagcgaagaattacagagaaatattagcctccaattgatgtcgaacatgaacatcagcaataagatacggaacctgtctacaacgctgcaaaccatcgccacaaaactgtgtcgagaactgtattccaaggagcaggagcacaaatgcaaaccctgcccaaggcgctggatatggcacaaggatagctgttatttcttgtcagacgatgtccaaacctggcaggagtccaagatggcatgtgccgctcagaacgccagtcttctgaaaatcaataataagaatgcgctggaattcattaagagccagtcacggtcttatgactattggttggggttatccccagaggaagacagcacaagggggatgcgtgtggacaatattatcaatagttccgcttgggtcattagaaacgcgcctgacctgaataatatgtattgcggctacattaaccggctttacgtccagtactatcactgcacttataagaaacgtatgatctgtgagaagatggctaatccagttcaactggggtccacttactttcgcgaagcctag

SEQ ID NO: 219454 - DNA, 699 bp, Artificial Sequence
  Description of Artificial Sequence: Synthetic coding sequence
atgtctgaagaggtcacatacgccgatctgcagttccagaactcgagcgagatggagaaaattcccgagatcggcaagttcggggagaaagtgcacgtgactctcaagatagagatgaagaagatgaataagctgcaaaatatctcagaggagctgcaaagaaatatttctctacagctaatgagtaacatgaatatctctaataaaattagaaatctgtccacaactctccagaccatagccaccaaactttgccgcgagttatatagtaaagaacaggagcacaaatgcaaaccatgccctcgccgttggatctggcataaggattcatgctacttcctgagtgatgatgttcagacgtggcaggaatccaaaatggcttgcgcagcccagaatgcttcccttctcaagattaacaacaaaaacgctctcgagtttatcaagagtcaatcgcgttcatatgattattggctcggcctgtcacccgaagaagactctacacgaggcatgcgggtcgataacatcatcaacagcagtgcgtgggttataaggaacgcccctgaccttaataacatgtactgtggctacatcaatcggctctacgtgcagtattaccattgcacatacaaaaagcgcatgatctgtgaaaagatggccaacccagttcagcttggctctacatattttcgtgaggcttag

SEQ ID NO: 219455 - DNA, 828 bp, Artificial Sequence
  Description of Artificial Sequence: Synthetic coding sequence
atgtggatcgacttcttcacgtactctagcatgtctgaggaagtcacttatgccgatcttcagttccagaattccagcgaaatggagaagattcccgaaattggcaaatttggggaaaaggctccccctgcccctagtcacgtgtggcggcctgccgctctgttccttacgctgctttgtctgctgttgctcataggccttggagtccttgcctcaatgtttcatgtcacattgaagattgagatgaagaaaatgaacaagctacagaacatcagtgaggaactgcagcgcaatattagcctccagctgatgagtaatatgaacattagcaataagatcaggaacctcagtaccacactgcagaccatcgccacaaagctctgccgggagctgtacagcaaggagcaagagcacaagtgcaagccatgtccgcgaagatggatttggcacaaagatagttgttactttttgagcgatgatgtccagacctggcaagagagcaaaatggcctgcgcagctcagaatgcctccctgctgaaaatcaacaacaaaaacgcattggaattcatcaagtctcagtcgagatcctacgattattggctgggactgtctccggaggaggatagcactcgagggatgcgagttgacaacatcattaactcctcggcgtgggtgattcgaaatgcccctgatctgaacaacatgtactgtggctacatcaatcgcctctacgtgcagtattatcactgtacttacaaaaaacggatgatctgcgagaagatggcgaatcccgtgcagctgggtagtacctactttcgcgaggcgtag

SEQ ID NO: 219456 - DNA, 264 bp, Artificial Sequence
  Description of Artificial Sequence: Synthetic coding sequence
cacaagtgtaagccgtgccctaggagatggatttggcataaggacagttgttactttctgagtgacgatgtgcaaacctggcaggaatcaaaaatggcttgcgcagctcaaaacgcctccctgctaaagattaataataagaatatctttagcgttatcaagaagaagacagaaaaattcttctggctgggcctttcttgggattcttctggaaggtcatggttttgggaggatgggtccgtgccctctccctcactgtactag

SEQ ID NO: 219457 - DNA, 498 bp, Artificial Sequence
  Description of Artificial Sequence: Synthetic coding sequence
atgagtgaagaagtgacatatgccgacctccagttccagaactcatccgagatggagaagataccagagatcggcaaatttggggaaaaagccccacccgctccgtcccacgtgtggagacctgcagcactattcctgaccttgctgtgtctgctgttactaatcggactaggcgtgttagcctctatgttccacgtaactctaaagatagagatgaagaaaatgaataagctgcagaacataagcgaagagctccaaagaaatatatctttgcagcttatgagcaatatgaatatatccaacaaaatcaggaacctgagtacaactttgcagactattgccaccaaattgtgccgcgagctgtatagcaaggaacaggaacacaaatgtaaaccatgccccagaagatggatttggcataaggattcctgctatttcctttctgatgatgtgcaaacatggcaagaatcaaagatggcctgtgctgctcagaactag

SEQ ID NO: 219458 - DNA, 642 bp, Artificial Sequence
  Description of Artificial Sequence: Synthetic coding sequence
atgtctgaagaggtgacctatgcagatctacagtttcagaatagttccgaaatggagaagattcctgagataggaaagtttggagagaaggccccaccggctccatcgcacgtttggcgccctgctgcactgttcctcacactcctctgtctcctgttactgattggactgggagtcctcgccagtatgttccatgttactctcaagatcgagatgaaaaagatgaacaaactgcagaatataagtgaggagctgcaacgaaacatctcccttcagctgatgagtaacatgaacatctccaacaaaattcgtaacctctccaccactctacagaccatcgctactaaattgtgtagagagctctattcaaaggagcaggaacataaatgcaagccctgtccacggaggtggatctggcataaggatagttgctatttcttgtccgatgacgtgcaaacttggcaggagtcgaaaatggcatgtgccgcacagaacgcctctctgcttaagattaataataagaacgccctggagttcattaagtctcaatctaggtcgtatgattactggctaggcctctcaccagaggaagattccacgaggggcatgcgggtggataacatcatcaattcatcggcatag

SEQ ID NO: 219459 - DNA, 423 bp, Artificial Sequence
  Description of Artificial Sequence: Synthetic coding sequence
atggcagcaaccggattcagcgcaccaaatggatcttgtcacggaacgagcaggacagtgaattctgacgcaccgatgtctcccgaattgccaaaaccgcacttacccgatcagctcgtcattgtgaacgagactgaggccgatagcaaaccgagtaaaaatgtggccagaagcgcagcagtcgagacagcttccctgagcccttccctggtaccagctcgccaaccgacaatttccctgttatgcgaggacacggctgacactcttagtgtggaaagtctaacgctggttcctccggtcgacccccatagtttacggtcactcaccgggatgccccctctttctacaccagctgctgcctgtaccgagccagttggggaggaagctgcctgtgcggaacccgttggcactgcagaggattag

SEQ ID NO: 219460 - DNA, 2721 bp, Artificial Sequence
  Description of Artificial Sequence: Synthetic coding sequence
atgtttgggagatcccgctcctgggtgggcggaggccacgggaagaccagccgaaacatccacagcctggatcacctaaagtatctatatcatgtgctgactaaaaacaccaccgtcactgagcagaacagaaatctcctggttgaaacgatccgttcaatcaccgagatcctgatctggggtgatcagaacgattcttcggtgttcgacttctttctggagaaaaacatgttcgtcttctttctgaacatcctgcgccaaaaatccgggagatacgtgtgcgtgcagttactccaaaccctgaacatcctctttgaaaacatcagccatgagacttcactctattacctactgtcaaacaattacgtcaactccatcatcgtgcataaatttgatttcagtgacgaggagataatggcttactacatttcttttctgaaaaccctcagtttaaaactgaacaatcataccgtgcattttttctacaatgagcatacgaatgattttgcactttacactgaggccatcaagttttttaatcatcccgaatctatggtccgcatcgccgtgcgcactatcactctaaacgtgtataaggtggacaatcaagctatgcttcattacatccgtgataagactgccgttccttactttagcaaccttgtgtggttcattggtagccatgtcatcgagctcgatgattgcgtgcagacagatgaagagcacagaaatcgcggaaaactgagtgatctggtcgccgagcaccttgaccacctacactatctcaacgacatcctgataattaactgcgaatttctaaacgacgtactcactgatcatctcctgaatcgtctgtttttgcctctgtacgtatactctctggagaatcaggacaagggaggggagcggcctaaaatctcattaccggtgtccctatacctcctcagtcaagtcttcctcatcatacaccacgccccactggtgaactccttagccgaggtcatcctcaatggagacttgagtgagatgtatgccaagacggagcaagatattcaaagatcaagcgctaaaccgtccatccggtgttttatcaaacctactgagaccctcgagcggtccctcgaaatgaacaagcataagggcaagcgcagagttcagaagcgccctaattataaaaacgtgggggaggaggaggacgaggaaaagggcccaacagaggatgctcaggaggacgccgagaaagcaaaagaaatcgaaatggtgattatggagagaagtaaactttccgagcttgctgccagcactagcgttcaggaacagaacaccaccgatgaggagaagtcggctgccgcaacttgcagtgaaagcacccagtggtctagaccatttttggatatggtttatcatgcccttgacagtcctgatgatgactatcacgccttgttcgtgttatgtctgttatacgccatgtctcacaataagggcatggaccccgaaaaactggagcgtattcaactgcctgttccgaacgcagcggagaagacaacatacaatcacccccttgcggagaggcttatccgtatcatgaataatgccgcacagccagatggcaaaatccgactcgcgacccttgaattgtcctgtctgttgctgaaacagcaggtcctcatgtccgcagggtgtatcatgaaagacgtccatctggcttgcctcgaaggagccagagaggaatcagttcaccttgtccggcatttttataagggtgaagacatctttctcgacatgttcgaagatgagtaccggtcaatgactatgaagccaatgaatgtggagtacctcatgatggatgcaagcatcttgttaccacctacgggcaccccgcttaccggcattgactttgtgaaacgcctcccttgtggagatgtggaaaaaacaaggcgcgctataagagtcttctttatgcttaggtcactgagtctccagctgcggggagaacccgaaacacagctgcccctgaccagagaggaggatctgattaagaccgacgacgttttggacctgaataactctgatcttatcgcttgtaccgttattaccaaagatggaggtatggtccagcggtttctggcagtggacatataccagatgagcctagtggaacctgatgtgagtcggcttggctggggcgtagtgaaattcgcaggattgctgcaggatatgcaggtcaccggcgtggaagatgactcgcgcgcactcaatattaccattcacaagcctgctagttcccctcacagtaagccattccctattctgcaagccacatttatctttagcgaccacattcgctgcataatcgctaagcagcggttggccaagggcagaatacaggcacgacgcatgaaaatgcagcggatcgctgctctgctggacctcccaatccaaccgacgactgaagtccttggctttggacttgggagctctacttccactcagcatctgccattcaggttttatgaccaggggaggcggggatcttctgacccaactgtccagagaagtgtgttcgcgtctgtcgataaagtaccaggggaaccagctccgagacctgctccccagctcgttcatcacggcggtcggtctaggagcttctccctttggagcctctgcgagctgccattcctgtcccaaaagcccagaagattggcagcaccggcttcatag

SEQ ID NO: 219461 - DNA, 3162 bp, Artificial Sequence
  Description of Artificial Sequence: Synthetic coding sequence
atgttcgggagatcacgttcctgggtgggtggcggtcacggcaagacatcgcgaaacatccatagcctggatcacctaaaatatctctatcacgttctcacaaaaaacaccacagtaaccgaacaaaataggaatctgctcgtcgaaactatcagatctatcaccgagatcctcatttggggcgatcagaatgatagcagcgtatttgatttctttctggagaagaacatgttcgttttcttcctcaacatcctgaggcaaaaaagtggtcgctacgtctgcgtgcagctcctgcagacactgaatattctgttcgaaaatataagccacgagaccagcctctattacttgttgtctaataactatgtcaattctatcatcgttcacaaatttgacttctccgatgaagaaattatggcgtactacatatctttcttgaagactttatctcttaaactgaataatcatactgtccactttttctataacgagcatactaacgatttcgctctgtataccgaagctatcaaattttttaatcaccctgagtcaatggtgagaatagcagtgcgcacgattactttgaacgtgtacaaggtgtctcttgacaaccaggccatgctgcattatatcagagacaagacggccgtgccctacttttccaaccttgtatggttcatcgggagtcatgtgatcgaactggatgactgcgtgcagaccgatgaagagcatcgtaataggggcaagctttccgatttagtggctgaacatctggatcaccttcattacctgaacgacatattaatcatcaattgcgagttccttaacgatgtgttgacggaccatcttctcaatcgcctcttcctcccactttatgtgtactctcttgaaaatcaggacaaagggggagaacgaccgaagataagccttccagtgtctctatatttactgtctcaagttttcctgatcatccatcacgcacccctcgttaactcccttgccgaagtaatcctcaacggcgacctgtcggaaatgtacgccaagactgaacaggatatacagcgttcaagcgcgaagccctcgattcggtgtttcattaaacctaccgagactctggagcggagcctggaaatgaacaagcataaaggtaagcgacgcgtgcagaagcgtcccaactataaaaatgtgggagaggaggaagacgaagaaaaaggtccaactgaagacgcccaggaggatgccgaaaaggctaagggtaccgaggggggaagtaagggcatcaagactagcggggagtctgaggagattgagatggtgattatggagagatcaaagctaagtgagctcgccgcttcaacctccgttcaggagcagaatacaaccgatgaggagaagagtgccgcagccacctgcagcgagagcacccagtggtctcgtcccttcttagacatggtgtaccatgccctagatagccccgacgacgactaccacgcgcttttcgtcctgtgtctattatacgctatgagtcacaataagggcatggaccctgagaagctggaacggattcagttacctgtaccaaacgctgccgagaaaaccacttataaccaccccctggccgaaagactgattagaatcatgaataacgccgcacagcccgacggcaaaatccggcttgccacacttgagctgagttgcctcctattgaagcagcaggtgttaatgagcgctggctgtatcatgaaagacgtccatctggcttgcctggagggagcacgggaagagtctgtccatctcgtacgccatttctacaaaggggaggacatctttctggatatgttcgaagacgagtatagatccatgaccatgaagcccatgaacgtggaatatctaatgatggatgcgagcattctgctgccccctacaggcaccccactgactgggatagacttcgtaaagcggttaccttgtggagatgtggaaaagacccgcagggccatccgcgtgttttttatgctcaggtctctgagtctgcaactccgaggggagcccgagacccagctccccctgactcgcgaagaggacctcatcaagacagacgatgtgctggatctgaacaattcagatctcattgcctgcactgtcatcaccaaagacggcggaatggtccaacgcttcttggctgtagatatataccagatgtctctcgtcgagcctgatgtgagtaggctgggatggggggtggtcaaattcgctggcttgctacaggatatgcaggtgaccggagtagaagacgatagccgggctctgaatattactatacataagccagcctcctctccacactctaagccattcccgatcctgcaggcaacattcatctttagcgaccacattaggtgtatcattgctaagcagcgcttggcgaaagggaggattcaggccaggagaatgaagatgcagaggatcgctgctctcctggatctgccaatccagccaaccacggaagtccttggcttcggtcttggaagcagcacgagcacgcagcatctgccattccgcttctacgatcagggcagacgcggaagcagcgatccgaccgtacagcgaagtgtgtttgccagtgtggataaggtgcccggattcgccgtggctcaatgtattaaccagcacagcagccctagccttagcagccaatctcccccatctgcctcaggctctcccagcgggtcagggtctactagccattgtgattcgggcggaacctcaagttcctccactccatctactgcccagagcccagctgacgccccaatgagccctgagcttccaaagcctcacctgcccgatcagctggtgattgtcaatgagaccgaggccgactccaaacccagtaaaaacgtggctcggtcggcagcagtggaaaccgcttctctctcgccttctttggtgccggcacgtcagcctacaatctccctgttatgtgaggatactgcagatacgctgtcagtggagagcctaacactggtgccgccagttgacccgcattctcttcgctctctgactggcatgccacccctgtcgacgcccgcagccgcttgcactgaaccagtaggagaagaggcagcctgtgctgagcctgtcgggactgccgaggattag

SEQ ID NO: 219462 - DNA, 3162 bp, Artificial Sequence
  Description of Artificial Sequence: Synthetic coding sequence
atgtttggcaggtccaggtcgtgggtcgggggagggcatggaaaaaccagccgcaatattcattctttagatcatctcaagtatctgtatcacgttttaaccaaaaacactaccgtcacagaacagaaccggaatctgttagtggaaaccatccgcagcattaccgagattctgatatggggggaccagaatgactcttctgtttttgattttttcctggagaagaacatgttcgtgttctttttaaacatcctaagacagaaaagcggcagatacgtatgcgtgcaactgcttcaaaccttaaatattctgttcgagaacataagccacgaaacttcactgtattatctactgagcaataattatgtgaactctattattgtgcataagttcgactttagtgatgaagagataatggcttattacatatctttcctgaagaccctgtccctgaagctgaataaccacaccgtgcactttttttacaacgaacatacaaatgacttcgcgctctacaccgaagctattaaattctttaaccatccagagtctatggtgaggatcgccgtcagaaccatcaccctcaacgtctacaaagttagcgtcgataatcaggcaatgctgcattacatcagggacaagacagcggtaccctacttttcaaaccttgtgtggttcatcggctctcatgtgatcgagctcgatgactgcgtgcaaacggatgaggaacacagaaataggggaaagttaagcgacctggtagcagagcatctggaccatctccattacctcaatgatatcttgattattaattgcgaatttctgaacgacgttctcaccgatcaccttctcaaccggcttttcctgccgctgtatgtatattctttggaaaatcaggataaagggggtgaacgacctaaaatatctttgcccgttagtctatatcttctgtcacaggtgttcctgatcatccaccatgccccacttgtcaactcactcgcggaggtaatactaaatggtgacctttccgaaatgtacgccaaaactgaacaagatatccaacgatcaagtgcgaaaccatcaatacgctgtttcattaagccaaccgagacactggagcgttcccttgagatgaacaaacataaaggtaaacgtagggtgcagaaacgtcctaactacaagaatgtcggcgaggaggaggatgaggagaaaggacctacggaggatgcacaggaggacgcagagaaggcaaaggggacagaagggggttccaaaggcatcaaaacatccggggagagtgaagagattgagatggtcataatggaacggtccaagctgtccgaactggcagccagcacatcggtccaggaacagaacacgaccgacgaggagaaaagcgccgctgcaacctgttctgaaagtacgcagtggtcacggccatttctggacatggtgtaccacgctttggattctcccgacgatgactatcacgcactgtttgtcttgtgtctcctttatgccatgagtcacaataaaggaatggacccagagaagcttgagcgaatccagctcccagtccccaacgccgcagaaaaaactacctataatcatccgctcgcagaacggctcatccgcattatgaacaacgcggctcagcccgatggtaagatccggctggctactctggaattgtcgtgtcttctcttgaaacagcaggtcctgatgtcagccggatgtattatgaaggacgtccatctagcatgtctggaaggcgcacgtgaggaatccgtacacttggtgaggcacttctacaagggtgaagacatcttcctcgacatgtttgaggatgaatacagatccatgaccatgaagcccatgaatgtagaatatcttatgatggacgcctcaattctgttaccacccacaggcacacccctcacgggcattgacttcgtgaaaagactgccctgcggggacgtcgagaagacccggcgtgccatcagggtctttttcatgctcagatcactgagtcttcagctgcgcggagagcccgagacacagctgcccctcactagggaggaggacctcataaaaactgacgatgttctggacctgaataacagtgatctgatagcctgtactgtgattaccaaggatggcggaatggttcagcgatttttggcagtggatatttaccagatgagtctcgtggaacctgatgtatcccggctcggctggggggtcgtcaagtttgctggcctgttgcaggatatgcaggtgaccggcgtggaagatgattcccgagcactgaacatcacaatccacaagcccgcatcatcgccacattccaaaccctttcccatcctgcaagccaccttcatttttagcgaccacatccgctgcataatcgctaaacagagactcgctaaaggcagaatccaagccagaagaatgaaaatgcaaaggattgctgccctgttagatctgcccattcagcctactaccgaggtgctcggctttggcctggggagcagtacctcgactcagcatctgccatttcggttttacgatcaaggcagaaggggatcatctgaccctactgtgcagaggtccgtgtttgcaagcgtcgacaaagtgcccggattcgctgttgcccagtgtatcaatcaacatagtagtccctcattatcgagtcagagtccaccctcagcatcaggatcacctagtggatccggctcgacatcacattgtgactccgggggaacatcatcatctagtactccgtctaccgcccagtcccctgctgatgcgccaatgtctcccgagctcccgaagcctcatctcccagatcaacttgtgatagtgaacgagaccgaggctgatagtaagccttcgaagaacgtagccaggagcgccgctgtggagacagccagtctgagcccttctctggtacctgcccgtcagcccacaatctccctgctatgtgaagacacggcggataccctttctgtggagtcactgaccttggtgccaccagtggaccctcactccttgcgtagcctgaccggtatgccccctctgtccactcctgcagctgcctgtactgagcccgtcggcgaagaagccgcttgtgccgaacccgttggcaccgccgaagattag

SEQ ID NO: 219463 - DNA, 288 bp, Artificial Sequence
  Description of Artificial Sequence: Synthetic coding sequence
atgcatgatagcaataacgtggaaaaagacattaccccttccgagttgccagcgaatcctgctattcgcgcaaattgccaccaggagccctctgtgtgcctgcaagccgcttgccccgaatcgtggatcgggtttcaaagaaaatgtttctatttttccgacgacacaaaaaactggacctcatcacagcgcttctgcgatagccaggatgccgatctggcccaagtcgagtctttccaggagttagtgtcttaccctggctcccgtcgcgtttgtctgtttgagtag

SEQ ID NO: 219464 - DNA, 525 bp, Artificial Sequence
  Description of Artificial Sequence: Synthetic coding sequence
atgattaaccctgaactacgcgatggtcgggcagacgggtttatccacagaatcgtgcctaaactcatccagaactggaaaatcggccttatgtgttttctgagtattataatcacaaccgtatgcatcatcatgatcgccacttggtcaaagcatgcaaaacccgtcgcatgtagtggcgactggctcggcgtccgcgacaaatgtttttatttttcggacgacacccgtaattggaccgccagtaaaatattctgctctctccagaaggccgagcttgcccaaattgacacacaggaagatatggaattcttgaaacgctacgcaggaacagatatgcattggatcggccttagccgtaaacagggtgatagctggaaatggaccaacggtactaccttcaatggttggtttgaaatcatcggtaatggctcatttgcgttcctttctgcggatggtgtccactcatctaggggcttcatcgatattaaatggatctgcagcaagcccaagtactttctgtag

SEQ ID NO: 219465 - DNA, 2406 bp, Artificial Sequence
  Description of Artificial Sequence: Synthetic coding sequence
atgcatcatagaatgaacgaaatgaacctctcccctgttgggatggaacagcttaccagctcctctgtaagcaatgccctgcccgtgtccggttcccacctggggttggctgcttcccccacccacagcgccatccccgctcccggtctacctgtcgcgatacctaacctgggcccatccctctcatccctgccctccgccctgagcttgatgcttccaatgggaatcggcgatcgtggggtgatgtgcggactgcctgagcgtaactacacgttgccccctcccccttacccccacttagagtctagttacttccggactattctccccggaatcttgagctatctggccgaccggcctcctccccagtacatacaccccaatagcatcaacgtggatggcaacacagctctgtcaattacgaataatccatccgcactcgacccctaccagtctaacggcaatgtggggctggagccagggatcgtctccatcgactccagatccgtgaatacacatggagcccagagcctccacccttccgacggccacgaggtggcgctggataccgctatcacgatggaaaacgtgtcaagagtgactagccctatcagcaccgacggcatggctgaggagctgacaatggacggagttgccggtgagcactctcagatccccaatggaagtcgatcccatgaaccccttagcgttgactccgtttcaaataatctagccgcagacgccgttggccacggaggcgtcattccaatgcatggtaacggactggaattacctgtcgtgatggagactgaccatattgcaagtagagtgaacggcatgtccgacagcgctctgagcgactccattcatactgttgcaatgtcgacaaattccgtgtctgtggcgctctctaccagtcataatcttgcctcattagaatcagtgtccttgcacgaggttggcctgtcattggaacctgtagccgttagttctataacccaagaggtcgcaatggggaccggtcacgtggacgtaagctccgattctctgtccttcgtctcacccagcctccagatggaagactctaatagcaataaggagaatatggcaacgcttttcacgatatggtgtacactatgtgatcgggcatacccaagtgattgccctgaacatggcccagtcacattcgtgcctgataccccaatagaaagccgagctcgcctgtctcttcccaaacagctggtcctcaggcagagcatagtaggcgcagaggtcggggtgtggactggagagactatccctgtgcggacgtgtttcgggccacttattggtcagcagagccactccatggaagttgctgaatggaccgataaggccgttaatcatatctggaagatttaccacaatggagtactggagttctgcattatcaccacagacgaaaatgagtgtaactggatgatgttcgtccgcaaggctaggaaccgcgaagagcagaatctcgtcgcttacccgcacgacggcaagatctttttttgcacctctcaggacatccctcccgaaaacgagctgcttttctattacagccgtgattacgcacagcagatcggcgtgccggaacatcccgatgtgcacctatgtaactgcggaaaggagtgcaactcgtacaccgaatttaaagcccatctcacgtcgcacatacacaaccacctgcctacccaaggtcattccggttctcacgggcctagccactctaaggaacgaaagtggaaatgttctatgtgtcctcaagctttcatttcccccagtaagctgcacgtgcacttcatggggcatatgggaatgaagccccacaaatgcgatttctgctctaaagccttttctgatccctcaaatctcaggacacatctgaagatccataccggacaaaagaattatcgttgtacactgtgcgataagagcttcacacagaaggcacatctggagtcgcatatggtcattcacacaggggaaaagaaccttaaatgcgattactgcgacaaactctttatgaggcgacaggacctcaaacagcacgttctgatccatacccaggagcgccagattaagtgtccaaagtgtgataagctatttctgcggacgaaccatcttaaaaaacacctgaactcccacgaaggtaaaagagattacgtgtgtgagaaatgtacaaaagcatatctgacgaagtaccacctgacccgtcaccttaaaacttgcaaggggcctacaagttcaagctctgctcctgaggaggaagaggaggacgattctgaagaagaggacctagctgactccgtggggactgaagactgcagaatcaactcagccgtgtatagcgcagacgaatcactatccgctcacaagtag

SEQ ID NO: 219466 - DNA, 465 bp, Artificial Sequence
  Description of Artificial Sequence: Synthetic coding sequence
atgcacgattcaaataatgtggaaaaggacatcaccccctctgagttaccagcaaatcccgcaatccgcgcaaactgtcatcaggagcccagcgtttgtttacaggcagcctgtcctgaaagctggatcggatttcaacgcaaatgcttctacttctccgacgacaccaagaattggacctcttcacagagattctgtgactcccaagatgcggacctggcacaagtggagagttttcaggaactgaacttcttgctacgctataaaggaccctccgatcactggataggcttatctcgtgagcagggccagccttggaagtggatcaacggaacagagtggaccagacagttccctatcctaggagccggagagtgcgcttatctcaacgataagggtgctagcagcgcgcgtcactatacagagaggaaatggatatgttctaagtccgatatccacgtgtag

SEQ ID NO: 219467 - DNA, 585 bp, Artificial Sequence
  Description of Artificial Sequence: Synthetic coding sequence
atgcacgattccaacaatgtcgagaaggatatcactccgagtgagctccctgcaaatccaggttgcctgcactcaaaggaacattccatcaaggccaccctcatatggcgtctcttctttctgatcatgtttcttactatcatagtctgcggaatggtggccgctctgagtgccatcagggcaaactgtcaccaggaaccaagcgtgtgtctgcaggccgcttgccctgaatcatggatcggctttcaaaggaagtgcttctacttctccgacgacaccaagaactggaccagttcacagcgcttttgtgattctcaggacgcagatttggctcaggtggagtcttttcaggaactgaacttcctacttaggtataagggaccctccgatcattggatcgggctgtctagggaacaaggacaaccatggaaatggatcaacggcacagagtggactcggcagcttgtgatgaaagaggacggagctaatttgtatgttgctaaagtgtcccaagtacccaggatgaacccgcgtcccgttatggtgtcctaccccggatcacgcagagtctgcctttttgaatag

SEQ ID NO: 219468 - DNA, 576 bp, Artificial Sequence
  Description of Artificial Sequence: Synthetic coding sequence
atgcatgacagcaacaatgtggagaaggacattactccctcagagttgcctgccaacccaggctgcctgcatagcaaagaacactccatcaaggccaccctaatttggcggctgtttttcctcattatgttcctgacgattatcgtgtgtggaatggtagccgcactcagtgctatcagagcaaactgtcatcaagagccctcagtgtgtttgcaggccgcttgccccgagtcttggatcggtttccagcgaaagtgcttttatttctccgatgatacaaaaaactggacctcttctcaaaggttttgtgactcccaagatgcagatctggctcaggtggaatctttccaggagcttaacttcctattaaggtacaagggcccatcggatcactggattggactgtctcgagaacaaggacagccgtggaaatggatcaatgggaccgaatggacaaggcagtttcctattctgggtgctggagagtgcgcatatctgaatgataagggcgcttccagcgcacggcattatactgaaaggaagtggatctgtagtaagtcggatatacacgtctag

SEQ ID NO: 219469 - DNA, 399 bp, Artificial Sequence
  Description of Artificial Sequence: Synthetic coding sequence
atgcacgattcaaataatgtggagaaggatatcacaccctctgagctccccgctaaccccggttgcctccactcgaaggaacattccattaaagctaccctaatttggagactattcttccttatcatgtttcttacgataatagtgtgcggtatggttgccgctctcagcgctatccgcgcaaattgccaccaggaaccatctgtttgtctgcaagccgcatgtcccgagtcatggattggatttcagaggaaatgcttctacttcagcgacgatactaaaaactggacaagctcccagaggttctgtgactcccaggatgccgatctcgcacaagttgagtccttccaggaactggtttcgtatccgggtagccgccgtgtttgccttttcgagtag

SEQ ID NO: 219470 - DNA, 891 bp, Artificial Sequence
  Description of Artificial Sequence: Synthetic coding sequence
atgtctgacagcaaagagccaagggtacaacaactgggactgttggggtgtctcgggcatggagctttagtgcttcagcttctctcctttatgttactagcaggggtcctggtagcaattcttgtccaagtcagcaaagtgcccagcagcctgtcacaggagcaatctgagcaggatgccatttatcaaaatctcacccagctgaaagcagcggtgggcgaactgtccgagaaatctaagctccaggagatctaccaagagctcacgcagttaaaggccgctgtgggagagttgcctgaaaaatctaaacttcaggaaatttatcaggaactcacaaggcttaaagcagctgtgggggaattgccagaaaagtctaagttgcaggaaatctaccaagagttgacgcgccttaaggcagcggtcggagagcttccagagaagagtaagctgcaagagatctaccaggagctgaccagactgaaagccgctgtcggtgagctgcctgagaaaagcaagttacaggagatatatcaggaactgaccgaattgaaggctgcggttggcgaacttccagaaaaatcaaaactgcaggaaatttaccaggaactgacccaactcaaggctgctgtgggggaactgcccgatcagagcaagcagcagcaaatctatcaggagctcactgatctaaagactgcctttgagcgtctgtgcaggcattgcccgaaagactggaccttttttcaggggaattgttattttatgtctaacagccagcgcaactggcacgattctgtcaccgcatgtcaagaggtgagggctcagctggtcgtgataaagacagccgaagaacagctgcccgcagtgctcgagcagtggcggactcaacagtag

SEQ ID NO: 219471 - DNA, 2379 bp, Artificial Sequence
  Description of Artificial Sequence: Synthetic coding sequence
atggccgctccttcacttctcaattggcgaagagtgtcaagcttcactggtcccgtccccagggccagacacgggcacagagctgtggccatacgagagctgatgattatttttggaggcggtaatgagggtatcgccgacgaattacacgtgtataacactgccacaaaccagtggtttctcccggcagtaaggggtgatatccctcctggctgtgctgctcacgggttcgtgtgcgacggaacacgcatactggtctttggaggcatggttgagtatggccgatactctaacgagctgtacgagctgcaggcctcaagatggctgtggaagaaggtgaagccgcatcccccacctagtggactcccaccttgtccccgtctcggacatagctttagcctctatggtaacaaatgctatttgtttggcggattagcaaatgaatcagaggacagtaacaataatgtacctcgctacttgaacgacttctacgagctcgagttgcagcacgggagcggagtcgtgggttggtcaattcctgtgaccaagggcgtggtgcctagtcccagagagtcacatactgccgtgatttactgcaagaaggactctggaagtcccaaaatgtacgttttcggcggaatgtgcggtgctaggctggatgacctatggcagcttgacctagaaacgatgtcatggtccaaacctgagacaaaggggacggtgcctctcccgagatcactgcatactgcttctgtcataggaaacaaaatgtacatctttggcggatgggttccccacaagggtgaaaacactgagacttccccgcacgattgtgagtggaggtgcactagctctttcagctatctaaatctagatactacggaatggacaacccttgtcagcgactcacaggaagataaaaaaaacagccgaccaaggccacgcgctggccactgcgcggtcgcaatcggaacaagactgtatttctggtcaggcagggacgggtacaaaaaggccctcaacagtcaggtttgttgcaaagacctctggtatctggatacagaaaaaccacccgcaccctcccaagtgcagctcattaaggctaccaccaattctttccatgttaaatgggatgaagtctctacggtcgaaggatacttgctgcagctgtctacagatctcccttatcaggctgctagcagcgactctagcgctgcgcctaacatgcagggcgtgcgcatggacccccacaggcagggaagtaataacatagtccccaattccattaatgacaccattaattctactaaaaccgagcaacctgctacaaaggagacctctatgaagaacaaacccgacttcaaggctctcactgactctaatgctatactgtacccatctctggcttccaacgcaagcaatcataattctcacgtggtagatatgttgaggaagaatgagggaccacacacaagcgcgaatgttggcgtgttgtccagctgtttggatgtgcgcacagtgatacccgaaaccagcgttagtagcacagtgtcaagcactcagactatggttacgcagcagaccattaaaacagaaagctcctcaactaacggtgccgtggtgaaggacgagacctcactgaccactttctctaccaagtcagaggtcgacgaaacctacgccctgccggcaaccaaaatttctagagtggagacgcacgctaccgccacccctttctcaaaggagactcctagcaatcccgttgcaaccgttaaggccggagagcgccagtggtgcgatgtaggaatatttaaaaacaacaccgcgttagtaagccaattttacctcttgccaaagggcaagcagagcatctcaaaggtcgggaacgcagacgttcccgattactccctgctcaagaaacaagatctggttcccggaactggttacaggttcagggtcgcagccatcaatggatgtgggatcgggccattctccaaaatcagcgaatttaagacctgcataccgggattccccggtgcaccctcagccgtcagaatcagcaaaaacgtagagggtattcacctttcctgggagcctcctacgtctccttcaggcaatatactggaatattcagcatacttagcgatccggaccgctcagatccaagacaacccttcccaattggtcttcatgaggatctactgtggcctgaagacgtcatgtatagtgacggctggtcagctggccaacgcccatatcgactacacttcgagacccgcaattgtgttcaggattagcgccaagaacgagaagggatacgggcctgccacacaggtgcggtggttgcagggtaataacaagaaagcccctctcaactag

SEQ ID NO: 219472 - DNA, 498 bp, Artificial Sequence
  Description of Artificial Sequence: Synthetic coding sequence
atgacctccgagattacgtatgcagaggtgcgatttaagaatgaatttaagagtagcgggatcaatacggcttcttcggccgaaacagcctggagctgttgtccaaaaaattggaagtccttctcttcaaactgttacttcatctctaccgaatcagcatcttggcaagactctgaaaaggactgcgccaggatggaggcccacctgttggttatcaacactcaggaggaacaggatttcatattccagaatcttcaagaagagagcgcgtactttgtcggactgagcgacccagaagggcagcgccactggcagtgggtagatcagacaccgtataacgaatcatccaccttttggcacccacgggagccctcggaccccaatgagaggtgcgttgtgctgaattttagaaaatctcctaaacgttggggatggaatgatgtcaactgtctcggcccacagagatccgtatgcgagatgatgaagatccatttgtag

SEQ ID NO: 219473 - DNA, 615 bp, Artificial Sequence
  Description of Artificial Sequence: Synthetic coding sequence
atgacaagcgagattacttacgctgaggtgcgatttaaaaatgaattcaagtccagtggcataaacacggcctcatccgctgccagcaaagaacgcaccgcccctcataagtctaatactggttttcctaaactcctctgcgctagtctgctcatattttttcttctccttgctatcagcttctttatcgcattcgtgaagacagcctggtcctgctgccctaaaaactggaagtctttcagttccaactgttacttcattagcacagagtcggctagctggcaagattcagaaaaagactgtgctagaatggaagcacacctactagtgattaacacccaagaggaacaagactttatttttcagaacctgcaggaagagtccgcctactttgtcggcctaagcgaccctgaggggcaacgccactggcagtgggtggaccagaccccatacaacgagtcttccaccttttggcatccacgcgagcccagcgatcccaacgaaaggtgcgtggtgttaaatttcagaaagtctccaaagcggtggggttggaacgacgtgaactgtctgggaccacagcgtagtgtctgtgagatgatgaagattcacctgtag

SEQ ID NO: 219474 - DNA, 597 bp, Artificial Sequence
  Description of Artificial Sequence: Synthetic coding sequence
atgacctccgaaatcacatacgctgaggtgcgattcaaaaacgaattcaagtcgtccggcatcaataccgcatcatctgcagttttttttcagaaatactctcagctgctggaaaaaaaaactaccaaagagcttgtgcatacaaccctcgaatgcgttaaaaagaatatgcccgtggaggaaaccgcttggagctgttgccccaagaactggaagtccttttccagcaactgctacttcatatctacagagagcgccagctggcaggactcggagaaagactgtgccaggatggaggcccacttacttgtgatcaacactcaagaggagcaggacttcattttccagaacctccaagaggaatcagcctatttcgttgggctgagtgatccagagggacagaggcactggcaatgggttgatcagactccctataatgaatcatctacattttggcaccccagagaaccatcagaccctaacgagaggtgtgttgtgctgaacttcaggaagtcaccaaagcggtgggggtggaacgacgtcaattgtctgggaccacagagatccgtgtgcgaaatgatgaaaattcacctttag

SEQ ID NO: 219475 - DNA, 549 bp, Artificial Sequence
  Description of Artificial Sequence: Synthetic coding sequence
atggtgcccgaggaggagcctcaggacagggtccctcataacttcatgtattccaagaccgtcaaaagactatctaagctgcgcgagtaccagcagtaccatccaagtcttacatgtgttatggagggaaaggatatcgaggactggagctgttgcccgactccatggacttcttttcagtcctcctgctacttcatttctacggggatgcaaagttggacaaaatcccaaaagaattgttccgtgatgggggctgatttagtggttattaacactagagaggaacaggattttattatccagaacttgaagaggaatagctcctacttcttgggcctatccgatcctggcggaaggagacattggcaatgggtggatcagaccccctataatgagaacgtgacgttctggcacagtggtgagccaaacaacttagacgaaagatgcgccattattaatttcaggtccagtgaagagtggggatggaacgatatccactgccacgtgccccagaaatccatttgcaaaatgaagaaaatctatatctag

SEQ ID NO: 219476 - DNA, 642 bp, Artificial Sequence
  Description of Artificial Sequence: Synthetic coding sequence
atggtccctgaagaggagccccaggaccgcgagaaaggtctgtggtggttccaacttaaagtttggtctatggccgtcgtgagcatactgctgttgagcgtttgttttactgtgtcctccgtggtacctcataattttatgtatagtaagacggtgaagagacttagtaagctacgggagtaccagcaataccaccctagcttgacctgcgtgatggaagggaaagatatcgaggactggagctgctgccccacaccatggacaagctttcagtcaagctgctatttcatttctacgggtatgcaaagctggactaagagccaaaaaaattgttcagtcatgggtgccgatctggtggtcattaatacccgggaggagcaggatttcattatacagaacctcaagcgcaatagcagttacttcctggggctgagtgacccgggaggcaggcggcactggcaatgggtagaccaaaccccctacaatgagaacgtgacattttggcatagcggcgagccaaacaatttagacgaaagatgtgcaattataaacttccggagcagcgaggaatgggggtggaacgacattcattgtcacgtgccgcaaaagtccatctgtaagatgaagaagatttatatctag

SEQ ID NO: 219477 - DNA, 549 bp, Artificial Sequence
  Description of Artificial Sequence: Synthetic coding sequence
atggtccctgaagaagaaccccaggatagggtccctcacaactttatgtacagcaagaccgttaagcggctgtcaaagcttagagaatatcagcaatatcatccctccctgacttgtgtaatggaagggaaagatatcgaagattggtcttgctgtccaacaccttggaccagctttcagtctagctgttattttatttctacaggcatgcagtcctggaccaagtcccagaagaattgttcagtcatgggagccgatctcgtggttatcaatactcgagaagaacaggactttattattcagaatctcaagaggaacagcagctactttctaggactgagtgacccgggagggcgaagacattggcagtgggtggatcagaccccctacaatgaaaacgtgactttctggcactctggagagccaaacaacttagacgagcggtgcgctataattaacttcaggagttcagaggagtggggatggaatgacattcattgtcacgtgcctcaaaagtccatatgcaagatgaaaaaaatatatatttag

SEQ ID NO: 219478 - DNA, 642 bp, Artificial Sequence
  Description of Artificial Sequence: Synthetic coding sequence
atggtgcccgaggaggaaccacaggatagggagaagggactgtggtggttccagctgaaagtgtggtctatggccgtggttagcatattgctgctgtccgtttgcttcacagtatcgtcagtcgtgccccacaattttatgtactccaagacagtgaaacgtttgagcaagctacgcgagtaccagcagtaccatccatcactgacatgtgttatggaaggtaaagatatcgaggactggagctgctgtcccacaccctggaccagttttcagagctcctgctattttattagtaccggaatgcagagctggactaagagtcaaaaaaattgctcggtgatgggcgctgaccttgtcgttataaacacgcgggaagagcaggatttcataatccaaaatctgaagcggaattcttcttacttcctcggcctatccgatcctggcggtaggaggcactggcagtgggtcgatcagactccttacaacgagaatgtgacgttttggcacagcggtgagcctaataacctagacgaaagatgcgccatcatcaatttcagatcaagtgaagagtggggatggaatgatatccactgtcatgtgccgcagaaatccatctgcaaaatgaagaaaatctatatttag

SEQ ID NO: 219479 - DNA, 648 bp, Artificial Sequence
  Description of Artificial Sequence: Synthetic coding sequence
atgggtctcgaaaagcctcagtctaagttagagggaggtatgcatccacagctgatccccagtgtgattgcggtggtgtttatcctgctcctgtccgtctgcttcattgctagctgtctggttacacaccataatttctcgcgttgtaagagagggacaggagtccacaagctcgagcaccacgctaagttaaaatgcatcaaggaaaaaagtgaactgaaaagtgcagaagggtctacatggaactgctgccccatcgactggcgggcattccagtccaactgctatttccccctgacagacaacaaaacctgggccgaatcggagcgtaactgttccggcatgggggctcacttaatgacaatctccaccgaagccgaacagaattttatcatccaattcttagacaggaggttaagctatttcttaggcttacgagatgagaatgctaagggccagtggcgttgggtcgatcagacaccattcaatccgcgtcgcgtgttctggcacaagaatgagccagacaatagccagggcgagaattgcgttgttctggtatacaaccaggataaatgggcgtggaatgatgtgccgtgcaacttcgaggcatccaggatctgtaaaattccagggactactttgaactag

SEQ ID NO: 219480 - DNA, 435 bp, Artificial Sequence
  Description of Artificial Sequence: Synthetic coding sequence
atggggctggagaaaccacaatcaaaattagagggcggtatgcacccccaactgattccaagcgtcatcgctgtggtattcatcctgctcttatcagtgtgcttcatcgcttcctgtttggtcacgcaccacaatttctccagatgtaaacgcggaacaggggtacataaattggagcaccacgccaagttgaaatgtatcaaagagaagagtgagctcaaaagtgcagaaggctcgacgtggaactgctgccccattgattggcgcgcattccagtccaattgttacttccctttgacagataacaagacatgggctgagtccgagagaaattgcagcggcatgggggcacatctgatgacaatctccaccgaggccgagcagaatttcattatacagtttctcgatcggagactgagctactttctgggctag

SEQ ID NO: 219481 - DNA, 660 bp, Artificial Sequence
  Description of Artificial Sequence: Synthetic coding sequence
atgaactccagcaaatcctccgaaacacagtgcaccgagcggggttgtttctcctcgcagatgttcctgtggactgtcgccggaatcccaatactgtttctctctgcttgctttatcactcgttgcgtcgtgacatttagaatttttcaaacttgcgatgagaagaaatttcaactgcctgagaactttaccgagctgtcctgctacaattatggtagcggatctgtgaagaactgttgccctttaaattgggagtacttccagagttcttgctatttcttttccacggacacgatcagttgggcattgagcctcaagaactgctccgctatgggggcacacctggttgtgatcaattcacaggaggaacaagagtttctttcttacaaaaaacctaaaatgcgagagttctttattggcctgagtgaccaagtagtggaggggcagtggcagtgggtcgatggtacaccacttacaaaatcattatcattctgggatgtcggggagccgaacaacatcgccacattggaggactgcgcaacaatgcgtgattcttccaatccacgccaaaactggaacgacgtgacctgtttcctcaattactttagaatctgcgaaatggttggcattaatccgcttaataaggggaagtcactatag

SEQ ID NO: 219482 - DNA, 1134 bp, Artificial Sequence
  Description of Artificial Sequence: Synthetic coding sequence
atgtccgattctaaagagccaagggtgcagcagctcggcttgctggaggaggatccaactacaagtggtattaggttgttccctcgtgatttccaattccagcagatccacgggcacaaatccagtacaggctgtctcgggcacggcgctttggtactgcagctgcttagttttatgctgctcgccggagtcttggtcgcaatactggtgcaagtatccaaagtgccgagctctctcagccaggagcaatcggaacaggacgccatctatcaaaatttgactcaactgaaggccgctgttggggagctttctgagaagagcaagttacaagagatctaccaggagttaacccaacttaaggccgcagtcgttggcgaattacctgagaaaagcaaactgcaagagatctatcaggaactgacccgactgaaggccgcagtaggcgagttgccagaaaagtctaagctgcaggaaatttatcaggaacttacaaggctgaaagcggctgtgggcgaattgccagagaagtcaaaactccaagaaatttaccaggaactgactgagctcaaagcagctgtcggagagctgccagaaaagtctaaattacaggaaatctatcaggaattgacgcaactcaaggccgctgtcggtgaactcccagaccaaagtaaacagcagcagatctatcaggaattgacagatctgaagactgctttcgagcgtctctgtagacattgtccaaaggactggaccttcttccaggggaactgttacttcatgtccaacagtcagagaaattggcatgactccgtgactgcatgtcaagaagtgagagcccagctggtcgttatcaaaactgccgaggaacaaaattttctgcagctacaaacatcgcgaagtaacagattcagctggatggggctgtcagacctgaaccaggagggtacctggcaatgggtagacggttctcctttgagtccatcatttcagcgctactggaacagcggcgagcccaacaacagtggaaatgaagactgtgcggagttctccggctctggatggaatgacaacagatgtgatgtagataactattggatatgtaaaaaaccggctgcttgttttcgcgacgaatag

SEQ ID NO: 219483 - DNA, 1200 bp, Artificial Sequence
  Description of Artificial Sequence: Synthetic coding sequence
atgtctgactcgaaagagcccagagtacagcaattaggccttttagaggaggatcctacaacctctgggattagattgttccccagagacttccagtttcagcaaatccacggccataagtcaagtacgggatgcctcggccatggagccctcgtgctccagctgctcagttttatgctgttagcaggtgtgctagtggcgatattagtacaggtttccaaggtgccctcctcccttagccaggaacagtctgagcaggatgccatctaccagaacctcacccagttaaaagcagcagtgggcgagttgtcagagaaatctaaattgcaagaaatctatcaggagctgacacagcttaaggccgctgtaggagagctgccggagaaaagtaaattgcaagaaatatatcaggagctgactaggttaaaggctgccgtgggagagttgcctgagaaatccaagctacaggagatctatcaagaattgacacgactgaaggccgctgttggagagcttcctgaaaagtcgaaactgcaggagatctatcaagaattaacgcgtctgaaggctgcggtcggtgagctgccagagaaatccaagctgcaggagatataccaggagcttaccgagctgaaggcggcagtgggcgaactaccagagaagtctaaattgcaggagatttatcaggaactgacccagctgaaggctgctgttggggaactaccagaccaatcgaagcagcagcaaatctaccaggagctcactgatctaaagaccgctttcgagcggttgtgccggcactgccctaaggattggacatttttccagggtaactgttactttatgtctaatagccaaaggaactggcacgactccgttacagcatgtcaagaggtccgggcacaattggtcgtcatcaaaaccgctgaggaacaaaatttccttcaattacagacatcccggtctaatcggttttcgtggatgggtctgagtgacttgaatcaggagggcacctggcaatgggtcgacggttcgccactttctcccagcttccagagatattggaacagtggggagcccaacaactccggcaacgaggattgtgctgagttcagcgggtctgggtggaacgataacaggtgcgatgtggacaactactggatttgcaaaaaaccggctgcatgctttcgtgatgaatag

SEQ ID NO: 219484 - DNA, 1047 bp, Artificial Sequence
  Description of Artificial Sequence: Synthetic coding sequence
atgtccgactctaaggagcctcgcgtccagcagctggggctcctgggatgcctcggccacggtgcattagtgctgcagttgctgagtttcatgctgttggccggagttttagtcgccattctcgtgcaggtttcaaaggtgccgtcaagcctttcacaggagcagagtgagcaggacgcaatttaccagaatcttacgcagttaaaagccgctgttggggaactgagcgagaaaagcaagttacaggagatatatcaggaactaactcagttaaaggccgcagtgggtgaactgccagaaaagtccaagcttcaagaaatttaccaggaactgactcgcctgaaggcagccgtcggggagctgccagaaaaatccaaactccaggagatatatcaggaactgaccagactgaaagccgctgtgggagaactgccagaaaaatcgaagctccaggaaatttaccaagaattgaccgagctgaaggccgcagtcggtgaattgccggagaagtcaaaattgcaggagatctatcaggagctgacgcaactgaaggctgcagtgggagaattgcctgatcaaagcaagcagcagcaaatttaccaggagctgaccgacctgaaaaccgccttcgagagactttgtcgtcactgtcccaaggattggacattcttccaagggaactgttacttcatgagcaatagtcagcgcaattggcatgactctgtaactgcctgccaggaagtccgcgcacagcttgtggtaattaagaccgctgaggagcagaatttcctccagttgcagacatcacggagcaatcggttctcatggatgggactgtccgacctgaatcaagagggtacctggcagtgggtcgatgggtcgcccttatctccaagttttcagcgctactggaacagtggagaacccaacaattctggcaacgaggattgcgccgagttttctggaagtggttggaacgacaatcgttgcgatgttgataattattggatttgtaagaaaccagcagcttgctttagggatgagtag

SEQ ID NO: 219485 - DNA, 975 bp, Artificial Sequence
  Description of Artificial Sequence: Synthetic coding sequence
atgagtgactccaaggaaccaagggtgcagcagctgggcttactcgaggaagatcctacaacttcaggcatccgcctctttcccagggacttccaatttcagcaaatccacggccacaagagttccacgggatgcctaggacatggggctttggtccttcaactccttagttttatgcttctcgctggtgtcctcgttgctattctcgtccaggtttccaaagtcccctcatccctgtcccaggaacaatcggagcaggacgcgatatatcagaaccttacccagctaaaagccgctgtgggcgaactcagcgagaagtccaagctacaggagatttaccaagaactcactcagttgaaggctgctgtgggagagctcccagaaaagagtaagctgcaggaaatttaccaggaattgacgcggttgaaggccgctgtcggggaacttcctgaaaagagtaagctgcaggaaatctaccaggagttgacacggctcaaggccgctgtcggcgagctgcccgaaaaatctaagctacaggaaatttaccaggaacttactcggctgaaagccgctgtgggtgaattacctgaaaagagcaaactgcaggaaatttatcaagaactgactgaactgaaggctgcagttggtgaactccctgaaaagtctaaactgcaagaaatctaccaggagctgactcaactcaaagcggctgtcggcgaacttcccgaccagtccaagcagcagcagatttatcaggaactcaccgatttgaagaccgctttcgaaagactgtgtcgccactgtcctaaagattggacattcttccagggaaactgctacttcatgagtaacagtcagcggaattggcacgactctgtgaccgcctgtcaagaagttcgagcccaattagtcgtcattaaaacagcggaggaacaactccccgctgtgctggaacagtggaggacacaacagtag

SEQ ID NO: 219486 - DNA, 771 bp, Artificial Sequence
  Description of Artificial Sequence: Synthetic coding sequence
atgtctgatagtaaggagccacgtgtgcagcagcttggtttactagtcagcaaggtgcctagcagtctgtctcaggagcagtctgaacaggacgccatttaccagaacctgacccagttgaaggccgctgtaggcgagctttctgagaaaagtaaactccaggagatctaccaagagctaacccagttgaaggccgctgtcggggaactgcctgagaaatcgaagctccaggagatctatcaggagttaactaggctgaaggccgcagtgggcgaactcccagaaaagagtaagctgcaggaaatctaccaagagctgacccggctgaaggctgctgttggcgagctcccggagaaatctaagttgcaggagatctaccaggagcttacacggctgaaagcagccgtcggagagcttcctgagaaaagtaagctgcaggaaatctaccaggagctcaccgaactgaaagctgcagtgggcgagctgcccgaaaagagcaagttacaggaaatctaccaagagctgacccagctcaaggcagctgttggggagctgcctgatcaatcaaaacagcaacagatctatcaagagctcacagatcttaaaactgcctttgaaagactgtgtcggcactgccccaaggattggactttctttcagggaaactgctactttatgagcaactctcagcggaactggcacgattccgtgacggcctgtcaggaggttagggcccagctagttgtgattaagacggctgaagaacagtag

SEQ ID NO: 219487 - DNA, 999 bp, Artificial Sequence
  Description of Artificial Sequence: Synthetic coding sequence
atgtccgattccaaagaacctcgcgtgcagcagctgggattactcgaagaggacccaactacttccggaatcagactgttccctcgggatttccagttccaacagatccacggacacaagagcagcacagtgccgtttctcttgggccctgtgagcaaggtgccaagctccctgagccaggaacagagcgagcaggatgctatttaccagaatctcactcagctgaaggctgctgtcggtgagttatcagagaagagcaagttgcaggagatctaccaagaactgactcagttgaaagctgccgtcggggagctgccggagaaaagtaagctgcaggaaatctaccaggagttaacaaggctgaaagccgcagtaggcgagctccccgaaaaaagcaagcttcaggagatctaccaggaattgactcgcctcaaagccgctgtcggagagctgcctgaaaagtctaaactgcaggagatttatcaggagctaactgaattgaaagccgcagtgggagagctcccagagaagtccaagctccaagaaatataccaggagcttacccagttgaaagctgccgtggagaggctgtgtaggcactgcccgaaggactggacattcttccagggtaactgctactttatgagtaactctcagcggaactggcacgacagcgtaaccgcctgtcaggaggttcgtgcccaactggtggtgattaagaccgcggaagaacagaattttctgcagcttcagaccagcagatcgaacaggtttagctggatggggcttagtgacttgaaccaggaaggtacatggcagtgggtcgacggatccccgctgagtccctcattccaacgctactggaactccggcgagcccaataattcgggaaacgaggactgtgcagagttcagcggatccgggtggaacgacaatcgttgcgacgtggataactattggatctgtaaaaagccggctgcttgtttccgggacgaatag

SEQ ID NO: 219488 - DNA, 1164 bp, Artificial Sequence
  Description of Artificial Sequence: Synthetic coding sequence
atgtccgacagcaaggaacctcgggttcagcagctggggctgctggaggaggatcctactaccaatttccagtttcagcagatccatggtcacaagtcttctaccggatgcttaggccacggagccttagtcctacagctcttgtcatttatgctcctcgccggagtcctcccacggctctcgaaagtccccagcagcctctcccaagaacagagcgagcaagacgctatctaccagaatctgacccagctgaaagccgctgttggggaattgtcagagaagtctaagctccaagagatataccaagagctcactcagctcaaggcagctgtcggcgaacttccagaaaaatccaagctccaggagatctaccaggaactgacaagactgaaggccgcagtcggggagctgccagaaaaatcaaagctgcaggaaatttatcaggagttaacacgtttgaaggcagccgtcggcgagctgcctgaaaaaagtaagttgcaggagatttaccaggagttgacccgacttaaggcagctgtgggagagctgccagagaagagtaaattacaggagatctaccaggaattgacagaactgaaagctgcggtgggtgagctcccagaaaaaagtaagcttcaggagatctatcaagaactcacccagttgaaggctgccgtgggagagctccccgaccaatcaaagcagcagcaaatataccaggaacttaccgacctgaagaccgcgtttgaaagactgtgcaggcactgtcctaaggactggaccttctttcaaggcaattgctactttatgagtaattcccaacgcaattggcacgacagtgtgaccgcatgtcaggaggtaagggcgcaattggtggtcatcaagactgccgaggagcagaactttctgcagcttcagacttcacggtcaaaccggtttagttggatgggacttagtgacttgaaccaggaaggtacgtggcagtgggtggatgggagtcctctgagccctagcttccagagatattggaacagcggagagcccaataactccggcaatgaggactgtgctgagttttctggctcgggatggaacgacaatcggtgtgatgtggacaactactggatctgcaagaagcccgcagcttgctttcgagatgaatag

SEQ ID NO: 219489 - DNA, 567 bp, Artificial Sequence
  Description of Artificial Sequence: Synthetic coding sequence
atgaattggcacatgatcatttccggccttattgtagtggtactaaaagtggtaggtatgaccctttttttgctctatttcccccaaatctttaataagtcaaacgatggcttcactactactcgttcctatgggactgtgtcgcaaatctttggcagtagcagtcccagtcctaacgggttcattactactaggagttatggcacagtgtgtccaaaagattgggaattctaccaggccaggtgtttctttctttccacatccgagagcagctggaacgaaagtagagatttttgtaaagggaagggcagtacactggccatagtcaacacccctgaaaaactgaagtttctacaggacatcactgatgccgaaaagtatttcataggactcatttaccaccgtgaagagaaaagatggcgctggattaacaatagcgtctttaacggaaatgtgactaatcaaaaccagaatttcaactgtgccacgatcggactaaccaaaacttttgacgctgcctcttgtgacatctcttaccgcagaatttgcgagaagaacgccaaatag

SEQ ID NO: 219490 - DNA, 630 bp, Artificial Sequence
  Description of Artificial Sequence: Synthetic coding sequence
atgatgcaagagcagcaacctcagtcaaccgagaaacgtggatggctttccttaaggctctggtcagtggccggaataagtattgctctgctgtccgcctgcttcattgtttcctgtgtagtcacgtaccattttacctacggagagaccggcaaacgactttctgagttgcactcataccattcatccctgacatgcttctccgaggggacaaaagttcccgcttggggatgctgccccgcttcttggaagagcttcggctcaagctgctattttatatcatccgaagagaaagtctggtcgaaatccgaacagaactgcgtggagatgggtgcccacttggtggtgtttaataccgaagccgagcagaacttcatcgttcagcagttgaacgaaagcttcagctactttctagggctgtcagatcctcaggggaataataactggcaatggatagataaaacaccatacgagaaaaatgtgagattttggcatttgggcgagcccaatcactccgccgagcagtgtgccagcatcgtcttctggaagccaacggggtggggttggaatgacgtcatctgcgaaacacggcgaaattccatttgtgagatgaacaagatctacctgtag

SEQ ID NO: 219491 - DNA, 432 bp, Artificial Sequence
  Description of Artificial Sequence: Synthetic coding sequence
atggagtaccaccccgaccttgaaaatctggacgaggacgggtacacccaattgcactttgattctcagagcaacacccggatagccgtggtgtccgaaaagggctcatgcgcggcatcaccgccatggaggctaattgcagtaatactgggcattctctgtttggtgattctggttatagcagtcgtcttggggaccatgggggttctgtccagtccttgccctccaaattggatcatttacgaaaagagctgctatctgttctccatgtccttaaactcttgggatggcagcaaacgtcagtgctggcagctggggagcaacttgctgaagattgattctagcaacgagctgattagtgatcaaaatcactcctacccccgtaaacccatctccaaactttgcatggactccagagtcagccacctctag

SEQ ID NO: 219492 - DNA, 744 bp, Artificial Sequence
  Description of Artificial Sequence: Synthetic coding sequence
atggaataccatcctgatctcgagaatctggacgaggatgggtatacccaactccacttcgactcccagagtaatactaggatcgctgtggtctccgaaaaagggagctgcgccgcttcccccccatggaggttgatagccgtgatcttgggaatcctgtgtctcgtgattctggtgatcgctgttgtactgggcaccatggctatttggaggagcaattcagggagcaataccctggagaacgggtatttcctcagtcgaaataaggagaatcattctcagcctacacagtccagcctcgaggacagcgttactccaacaaaggctgtaaaaacgacaggtgtgctgagtagtccatgccctccgaactggattatttatgagaaatcctgctatctcttcagtatgagtctaaatagttgggacggcagcaaaagacagtgctggcagcttggtagcaatctcttgaagatcgattctagcaacgaactgggattcatcgtgaagcaagtatcaagccaaccagacaatagtttttggatcggcttatctaggcctcaaactgaagtcccctggctctgggaagacggcagcacgttctcatccaacctttttcagattcgcaccactgcgacacaagagaacccttcacccaattgcgtatggatccatgtttcagtaatttatgatcagctctgcagcgttccatcctactctatttgcgagaagaagttttcaatgtag

SEQ ID NO: 219493 - DNA, 234 bp, Artificial Sequence
  Description of Artificial Sequence: Synthetic coding sequence
atggagtatcacccagaccttgaaaatctggatgaggacggatacacgcagctccactttgactctcagtctaacacaaggatagcagtagtaagtgagaagggctcatgtgcagcttcccctccctggaggctgatcgccgtcatcttgggaatcctctgtctcgtgatcttagtgatcgccgttgtgttaggcacaatggcaggctttaaagctgtggagttcaagggatag

SEQ ID NO: 219494 - DNA, 606 bp, Artificial Sequence
  Description of Artificial Sequence: Synthetic coding sequence
atggagtaccatcctgatttggaaaatctcgacgaggacgggtatacacaactacatttcgacagccagagcaacacccggattgcagttgtgtccgagaagggatcatgcgctgcttcgccaccttggagactgatagcagtcattctgggcatcttgtgtttagttattctggtaatcgctgtggtactgggcaccatgggggtattgtcgtccccttgcccacctaattggatcatatatgagaaatcttgctatctcttcagcatgtctctcaacagctgggacggtagcaagagacagtgctggcagctgggcagcaatttgctgaagatcgactcttcgaatgaactggggtttattgtcaaacaggtatcctcccagccggataacagcttctggatcggcttaagccggccacagacagaagtgccctggttgtgggaggacgggtccaccttctcgagtaatctcttccagattcgtactacggctacccaggaaaatccttccccgaactgcgtttggattcacgtatctgtgatctacgaccagctatgttccgttccaagctactccatttgcgagaagaaattctcaatgtag

SEQ ID NO: 219495 - DNA, 507 bp, Artificial Sequence
  Description of Artificial Sequence: Synthetic coding sequence
atggaatatcatccagaccttgaaaacctcgatgaggacggctatactcaactgcacttcgattctcagtctaacacccggatcgccgttgtgagcgaaaagggggtgctatccagcccctgtcctccaaattggataatttacgagaaaagttgctacctgttctccatgtctctgaacagctgggatggaagtaagcgccagtgctggcagcttggctcaaatctgttgaagatcgatagcagtaatgagcttggctttatcgtgaagcaagtctcctctcagcccgataattccttttggattggtctctccagacctcagaccgaggtcccgtggttgtgggaagatgggtccacattttcgtcgaatctttttcagattaggacaacagctactcaggagaatccatctcccaattgcgtctggattcacgtgagcgtcatctatgatcagctatgttccgtaccaagttactccatctgtgaaaagaaattttcgatgtag

SEQ ID NO: 219496 - DNA, 351 bp, Artificial Sequence
  Description of Artificial Sequence: Synthetic coding sequence
atggaataccatcccgacctggaaaatctggatgaagacgggtacactcagttgcattttgactctcagagcaatactagaattgccgtggtgtcagagaaagggagctgcgctgcgagcccaccctggcgcttgattgccgtaatcctcggtatactgtgcttagtaattctggtaatcgctgtggtactaggaaccatgggtacaggacagttcctgaaagatcttagcttcctgaataaccgaagaaagctgtttggggaccctattcaggaagcaactcattggcgcatggctacattctaccaggagatcaagcgtaccaccgtaaatcctcacaatcacctgtag

SEQ ID NO: 219497 - DNA, 744 bp, Artificial Sequence
  Description of Artificial Sequence: Synthetic coding sequence
atggaataccacccggacctcgaaaacctcgatgaggacggttacacgcaactgcacttcgactcacagtcgaacacacgaatcgccgtggtgtccgaaaagggaagctgcgctgcatcacctccttggcggctcatcgcagtgatcctcggaatactctgcctggtgattctggtgatcgccgtggtgctgggcactatggctatatggcgaagcaatagtgggtctaacactctggagaatgggtatttcctgtctcgcaataaggagaaccacagccaaccgacccaatcatctctggaagactccgtgactccaacaaaggcagtgaagactaccggggtgctatctagtccatgcccccctaattggatcatctatgaaaagtcctgctatttgttctcaatgtccctcaactcctgggacggctccaagcggcagtgttggcagcttggctccaatcttctgaaaatagacagctcaaacgagctggggttcattgtaaaacaggtttcgagccagccagacaactccttttggataggcctatcacgcccacagacggaagtaccatggctgtgggaagacggaagcacgttcagttccaatctctttcagatccggaccacagccacccaagaaaacccctcacccaactgtgtgtggatacatgtgtcagtgatatacgaccagctgtgttcggttcccagctattcaatctgtgagaagaagttctccatgtag

SEQ ID NO: 219498 - DNA, 570 bp, Artificial Sequence
  Description of Artificial Sequence: Synthetic coding sequence
atggaatatcatcccgacctggagaatctggatgaggatggatacacacaactgcactttgattctcagagtaacacccgcattgcggttgtgagtgagaagggaagctgtgccgcttctcccccatggcgacttatcgcagtcatcttgggcatcctttgtctagtgattctggtcattgccgtggtcctgggcactatggctatctggagaagcaatagcggcagcaatacgctcgagaatgggtacttcctcagccggaataaagagaaccactcacagccaacacagtcctcattggaagactctgtaaccccgaccaaggctgttaagactaccggagtgctgagtagtccatgtcccccaaattggatcatctacgaaaaatcttgctatctgttctctatgtcactcaattcctgggatggatctaaacgtcagtgctggcaactcggatctaacctgttaaagatagacagcagcaacgagcttatcagcgaccagaaccactcttatccccgtaaaccaatctcaaagctctgtatggactcgcgcgtctcccatctctag

SEQ ID NO: 219499 - DNA, 10281 bp, Artificial Sequence
  Description of Artificial Sequence: Synthetic coding sequence
gtgctacctagccacacctgcggaaacccaggcgaaatcctgaagggagtcctgcacggaaccagatttaatattggggataagattcggtacagttgtctgccgggatacattctggagggtcatgctatactgacgtgcatcgtcagccccggtaacggggcttcatgggatttccccgctcccttttgccgcgcagagggcgcatgtggagggacattgcggggaaccagctctagcatttctagtccacatttcccctcagagtacgagaacaacgcagactgtacatggacaatcctagctgaaccaggtgataccattgcgttggttttcaccgacttccaactggaggaagggtacgactttcttgagatttccggcaccgaggctcccagtatttggctgacaggaatgaacttaccgagtccagtgatttcatccaaaaattggctgaggctacactttacaagcgattctaaccaccggcgtaaggggttcaacgcgcaatttcaggtcaagaaggccatcgagctaaagagtagaggggtcaaaatgctgccgtcaaaggacggtagccacaaaaattccgttctgtcacagggtggcgttgccctcgttagcgatatgtgtcccgatcccggaatccctgaaaacggccgtagggcgggatcagacttctcacgagtgggagctaatgtgcagttctcctgcgaggacaactacgtcctacaagggagtaaatcgattacctgtcagcgtgtcaccgaaactctcgcagcctggagcgaccacaggcccatctgtagagcgcgtacatgtggatcaaacttgcgcggtccatcaggagtcatcacatcacctaactaccccgtacaatacgaagacaacgcccattgtgtctgggttataacaactaccgacccagacaaggtgataaaactagccttcgaggaattcgaactggagcggggatatgatactcttacggttggagatgctggcaaggtaggggacactcgttcagtgctctacgtgctgaccggtagcagcgtgccagatcttattgtctctatgagcaaccagatgtggctgcacttacagagcgatgatagcattggatctcccggttttaaagccgtatatcaggagattgagaaaggtggctgcggagaccctggcatcccagcgtatgggaagagaacaggttcatcttttctccatggtgacaccctcacatttgagtgccccgctgccttcgaacttgttggagaacgggtcataacgtgccagcagaacaatcaatggtctggaaacaagccttcttgcgtgttctcctgcttttttaattttacagccagctctggcataattctctctccgaattacccagaggagtatggaaacaacatgaattgcgtctggcttattatctctgagcccggatctcgcatacacctgatctttaatgatttcgatgtagaaccacagtttgactttttagcagtgaaagatgatggcatctccgatatcaccgtgctggggacattctcagggaacgaggtcccatcccaactcgcgtcatctgggcacatagtccgcctcgagttccagagcgaccactcaactactgggcgtgggttcaacattacttatactacattcggtcagaacgagtgccacgatccagggatcccgattaatgggaggaggtttggtgatcgcttcctcctggggtcttccgtcagcttccattgcgacgatggcttcgtgaagacacagggctccgagagtatcacttgcatcctgcaagacggtaacgtggtgtggagttctaccgtacctagatgcgaagccccatgtggagggcatttgaccgccagcagcggcgtcattctccctccgggatggccaggttactataaggatagcctccactgtgagtggatcattgaagcaaagccaggacactcaatcaagattaccttcgatcgatttcagaccgaggtgaattacgatacccttgaagtgagagacgggccagccagctcttcgccgctgattggcgaatatcatgggacgcaggctcctcagtttctgatctccacagggaactttatgtacctacttttcaccactgataacagcagaagctccatcggcttcctgatccactatgaatctgtcaccctggaatctgactcatgcctggatcccggtatacctgtgaatggacatagacatgggggagactttggtattcgctctacagtcactttctcgtgcgatcccggatatacccttagcgacgacgagcctcttgtgtgcgaacgcaaccaccagtggaatcacgccctcccttcatgcgatgcgctttgtggaggttacatccagggcaagtccggcaccgtgttgtcacctggattccctgacttttaccccaactcacttaactgcacatggactatcgaggtgtcccacggtaaaggagtccagatgatctttcacacatttcatctggaaagttcccatgattatctgttgatcaccgaagacggaagcttctcagaacccgtggctagactcaccgggtccgtgctgcctcatacaattaaggctggcctgttcggcaattttacagctcagcttagattcatctctgacttcagtatctcctatgagggattcaacattaccttttctgagtacgacctggaaccttgtgacgacccgggagtgccagcattctctcgaaggatcggcttccactttggcgtgggcgattctctcacttttagctgttttctgggataccgacttgagggcgcaaccaaactcacttgtctcggtggtggcaggcgtgtatggtctgccccactccctcgatgcgtcgcagagtgcggggcttctgtcaaaggaaacgagggaacactgcttagccctaattttcctagtaattacgataacaaccacgaatgcatctacaagatagaaactgaagccggtaaaggaatccatctaagaacaaggagtttccagctatttgaaggggacaccctcaaggtgtacgacggcaaagattcttccagtcgcccactgggaacatttacaaaaaacgagctgctggggctgattttaaatagcaccagcaaccatttatggctggagtttaacaccaacggatccgatacggatcagggcttccagttaacttatacctcatttgatttggtcaaatgtgaggaccccggtataccaaattacgggtatcgcattcgcgatgaaggtcacttcactgacacagtagtgttgtatagctgtaatccagggtacgccatgcatggttctaacaccttaacgtgtctgagcggggatcggcgagtgtgggacaagcctctgccttcctgtatcgccgaatgcgggggtcagatccatgccgcaaccagcggacgcatactgagtcctggctaccccgctccatacgacaacaacttgcactgcacttggatcattgaggctgacccagggaaaacaatcagcctgcacttcatcgtcttcgacactgaaatggcacacgatattttaaaagtgtgggatggaccagtggactctgacatcctgctcaaagagtggtcagggagtgccctcccagaggatatccattcaacattcaattccctaactctgcagttcgactctgatttttttatcagcaaatccgggttctccatccagttctcaactagcatcgccgctacttgtaatgatcccggaatgccccagaatggcaccaggtacggggactccagggaggccggagatactgtcacatttcagtgtgatccaggctatcagttgcaaggccaggctaaaattacctgcgtgcagctgaataaccggttcttctggcagcctgaccctcccacgtgcatcgcagcctgtggagggaatctgaccggtcctgctggcgtaatactttcccccaattacccccagccatatcctcctggaaaagaatgcgattggagagtaaaggtgaatccagactttgttatagccctgatttttaaaagcttcaacatggagccaagttacgactttttgcatatatatgaaggtgaggactcgaattcccctctcattgggtcctatcagggcagccaggctcctgaacggatcgaaagtagcggcaactccctgttcctggcctttcgcagcgacgcctccgtgggcctgtcagggttcgccatcgaattcaaagagaagcctcgcgaggcttgtttcgaccccggtaacatcatgaatgggacgcgagtggggacagatttcaagctaggtagtaccatcacctatcagtgtgactccggctacaaaatcttagatcccagtagtataacatgtgtcatcggcgcagacggcaagccgagctgggatcaagtgttgccttcatgcaatgcaccttgtggaggacagtacacaggcagcgaaggcgtggtgctgagccctaactacccgcacaactacaccgcaggccaaatttgcctgtatagtatcacagtgccaaaagagtttgtggtgttcggccaattcgcctactttcaaactgccttaaacgatttggctgagctattcgatgggacgcatgctcaggcaagactgctgagctcgctatccgggtctcacagtggggagactctgccactggccactagcaaccagatcctgttgaggttctcagctaagtccggggcatctgctagggggtttcattttgtgtaccaagcggtgcctcggacaagcgacacacagtgctcctccgtgccagaaccccgatacggtcggaggataggctctgagttttctgccggatccattgtcaggttcgagtgcaatcccggatatcttcttcagggttccaccgccctgcattgccaatctgtgccaaatgctctagctcagtggaacgatacaattccctcgtgcgtggtgccctgctcaggtaactttactcaaagacgtggcacgattctttctcccggatatccagaaccctatgggaacaatctgaactgtatttggaagataatagtcacggaaggatctggtatccaagacccaagtgaccagttctgtcatggggcagagctggggctcgagattcatgatgggggagatgtgaccgccccacggctggggtccttttcaggcacaactgtgcccgctctgctaaattccacctccaaccagctttacctccactttcagagcgacatctccgtcgctgcagcgggattccatctggaatacaagacagtggggttagccgcttgtcaggagcccgcattaccctctaatagcattaaaataggggacaggtacatggtgaacgatgtgctgagcttccagtgcgagccgggatacaccttacagggacgcagtcatatttcatgcatgcccggaacagtcaggagatggaattatccctctccactgtgcatagcgacctgcggcggtaccctgtctacattgggaggcgtgatactctccccagggtttccaggcagctatcccaataacctggattgtacctggcgcataagccttcccatagggtacggcgctcacatccagtttctaaatttcagtaccgaagcaaatcacgacttcctggagatccaaaacggtccctaccacacatcacctatgatcggccagttctccggaacagacctgccagcagccttgctgtccaccacccacgaaacactgatccatttttactcggatcactctcagaaccgacagggattcaaactggcctatcaggcctatgaactgcagaattgtcccgatccaccccctttccagaatggttacatgataaacagtgactattccgtcgggcagtcagtctcattcgagtgttatcccggatacattctgattggccacccagttctgacatgtcagcacggcattaaccggaattggaattatccctttccgcgatgcgacgcaccttgtggctacaatgtgacctcccagaacggaaccatctactcccctgggtttcctgacgaatatcccatactgaaggattgcatttggttaattacggttcctccaggtcatggcgtttatatcaacttcacactcctgcagaccgaggcggtaaacgactacattgccgtatgggacggtcctgaccagaactctcctcagctgggggtcttttcgggaaatacggctctggaaacagcatactctagtacgaatcaggtgctcctcaagtttcacagcgacttctcaaatggcggattcttcgttctgaattttcatgcgtttcagttgaaaaagtgccaacccccaccagcggtgccacaggctgaaatgctcacagaggatgatgattttgaaatcggagatttcgtgaagtaccagtgccaccccggatacactctggtgggaacggatatactgacatgcaagctgtccagccaactccagttcgaaggctcattgcccacttgcgaggcccagtgcccagcaaatgaggtgcggactggcagctccggggtcatcttgtctccaggatacccgggtaactactttaacagtcagacatgttcttggtccatcaaagtcgagcccaactataatattaccatcttcgtggatacatttcaatccgagaaacagtttgatgcacttgaggtttttgacggttcaagcggtcaaagcccacttttagtggtgctctcagggaatcatacggaacagtccaacttcactagccggtcaaatcagctttatctgcgctggtctaccgatcatgcaaccagcaaaaaagggtttaaaatccgctatgccgctccatattgttccctcacccaccccctcaaaaacggcggaatcttgaacaggacagctggagctgttggctcaaaagtgcattacttctgcaagccaggttatagaatggtgggacactctaatgctacttgccgccgaaacccattaggcatgtaccaatgggactctttgacgcccctgtgtcaagctgtgagctgcggtatcccggagagcccaggaaatggatccttcacaggcaatgaattcacccttgatagcaaggtggtatatgagtgccacgagggcttcaaactggaaagttcacagcaggccactgccgtgtgccaggaagacggcttatggagcaataagggaaaaccacctacgtgcaagccagtggcatgcccaagtatcgaagcgcagctctcggagcacgtgatttggagattggtatccggtagcctgaacgaatacggcgcacaggtgttactgtcctgctccccaggttattacctcgagggatggcggctgcttagatgtcaggccaacggcacatggaatatcggagacgagcggccttcttgccgggtgatcagctgtggaagtttatcattccccccaaatgggaataaaattggcacgttgaccgtgtacggggcaacagccatctttacctgtaatactggatacaccttagtcggaagccacgtgcgagagtgcttggcgaacggactgtggagcgggagtgagactcgctgcctggctggtcattgcgggagcccggaccctatagttaatggccacatttctggcgacggcttctcctatagggacacagtggtataccagtgtaatcctggatttcgactggtcgggaccagtgtccggatttgtttacaagaccacaagtggagcggtcagacccccgtttgtgtgcctattacgtgtggccatccaggcaatcccgcacacggcttcacaaatgggtcagagtttaacctgaatgatgtggtgaactttacctgtaacactggatacttgcttcagggcgtcagtagagcacagtgtcgttctaacgggcaatggtctagtccccttcccacttgcagagtggtgaactgcagtgatcctggattcgtcgagaacgccatccggcacggccagcagaacttccccgagtcttttgagtacggcatgagcatcctgtaccactgtaagaaaggattctatctgctggggagcagcgcgctgacatgcatggccaacggactctgggacagaagcctgcccaagtgtctagccatttcctgcgggcacccaggagtgcccgctaacgcggtgctgaccggcgaactcttcacttacggggctgttgtgcactatagttgccggggaagcgaaagtctgataggaaacgacacacgtgtatgccaggaggatagtcactggtccggagcgctccctcactgcacaggcaacaatccagggttttgcggggaccctggtacaccagcgcatggtagccgtcttggcgacgatttcaaaaccaaaagcctgctgaggttcagctgcgagatgggccaccagttacgtggatcccccgagcggacatgcctgctcaatggatcctggagtggcctgcagccagtgtgcgaagctgtttcttgtggaaatccaggcacccctactaatgggatgatagtttccagcgacggcatcctgttctcttcctccgtgatttacgcctgttgggaagggtacaaaacaagcgggctgatgaccagacattgtacggcaaacggaacctggacgggcacagccccagactgtactattatctcttgtggagaccccggtaccctagccaatggtatacagttcgggacggactttaccttcaataaaacagtatcctaccagtgcaatcctggttacgtgatggaggctgtgacctctgcgacgatccgctgtaccaaagacgggcgatggaacccctccaagccggtgtgtaaggccgtgctttgccctcagccacctccagtccagaacggaacagtggagggcagtgattttagatggggaagctcaatctcttactcctgcatggatggataccagcttagccacagtgccatcttgagttgcgagggcagaggggtctggaaaggagagatccctcaatgtctccccgtattttgcggggatcccggaattcctgccgagggtaggctaagcggcaagtccttcacctataagtctgaagtgttcttccaatgtaagtcccccttcatactggtggggtcatcccgcagggtgtgccaggccgatggaacctggagcggaatccagccgacgtgtattgaccccgcacacaacacatgccctgatccgggaaccccccatttcgggatacagaatagttcccgcggttacgaggtgggctccaccgtgtttttcaggtgcaggaagggatatcatatccagggttcaaccacgcggacctgtttggctaatctgacatggtccggaatccagaccgaatgcatcccccacgcatgtcgccagccggaaacacctgcacatgcagatgtgagagcaatcgacttacccactttcggttacaccctggtttacacctgccatcccggatttttccttgcaggcggttcggagcaccgaacttgtaaggccgatatgaagtggactggcaagtcacccgtttgtaaatccaaaggggtccgcgaggtgaacgagaccgtgacaaagactcccgtgccctcagacgtgttttttgtcaactctctgtggaagggatactatgagtacctgggtaagcgacagcctgctacactgacagttgactggttcaacgcgacttcatccaaggtcaatgcgacattttccgaagcttcgccggtggaattgaagctgaccggaatttacaagaaggaggaagcacatctgcttctgaaagcatttcaaatcaaggggcaggccgacatttttgtttcaaaattcgagaatgacaattggggcttagacggatacgtttcatccggattggagcggggtggtttcaccttccagggggacattcacggcaaagactttggtaaattcaaattggaacggcaggatcctctaaatcctgatcaggattcctcctctcattaccatggaacatcgagcgggtctgtggctgcagctatactggtaccctttttcgctctcatcttgtcgggctttgccttttacctgtataagcacagaacacggcctaaggtccaatataacggctatgccggtcatgagaactctaatggccaggcaagctttgagaacccaatgtatgataccaacctcaagccgacagaagcaaaagcagtgcggttcgacacaaccctgaatacagtttgcactgttgtctag

SEQ ID NO: 219500 - DNA, 10167 bp, Artificial Sequence
  Description of Artificial Sequence: Synthetic coding sequence
atgacagcatggcggaggtttcagtctctgctgctgctactgggccttcttgtgctgtgtgcgaggctgctaactgctgccaagggtcagaactgcggcggacttgtgcagggccctaatggtactattgagtccccaggttttccccatggatatcccaactacgctaactgcacatggataatcatcactggggagaggaaccgcatccaactctccttccatacatttgcgttagaggaagattttgatattctcagcgtttacgacggccagccacaacagggaaatttgaaagtcaggctatccgggtttcagcttccctccagcattgtgagtaccggctccatcctgacactgtggttcacaacggactttgctgtctccgcccagggctttaaggccctgtacgaggtgctcccttcccatacttgcggaaatccaggagaaatactgaaaggagtgttgcacggtacacgcttcaacatcggagataaaatccgatatagttgcttgcctggttatattctggagggccatgcaatcctgacatgcattgtgagtcccggaaatggggcttcttgggacttccctgcgccattctgccgtgccgaaggcgcatgcgggggtactcttagagggacgtcgagctctatatcgtcacctcactttccgtccgaatacgaaaacaacgccgactgtacttggacaatcctggctgagcccggtgacacgatcgccctggtgttcactgactttcagttggaagagggttatgattttctcgagatctccggaacagaggccccatccatttggttaactgggatgaatctcccctcccctgtaatcagcagcaaaaattggcttcgtttgcacttcaccagcgactcaaatcacagaaggaaagggtttaatgcccaatttcaggtgaagaaagccatcgagttgaaaagccgaggtgttaagatgcttccaagtaaggatggatcccacaagaattccgttctgagccaggggggagtggccctcgtgagtgatatgtgtcctgacccaggaatccccgagaacggtcggcgagccggttccgatttttcaagggtgggtgctaacgtccaattcagctgcgaagataattacgttcttcagggatcaaaaagcattacttgtcagcgagtcactgagactttggccgcatggtcagaccacaggcctatttgccgagcccgtacatgcggatctaacctgcgcggacccagtggcgtgatcacctcacctaactaccctgttcagtacgaggataacgctcattgcgtgtgggttatcactacaacggaccccgataaagttatcaaactggcattcgaggaattcgagctcgagcgcggttacgatacacttacagtgggcgacgcgggtaaggtaggagatactcgcagcgtactctacgtactgacgggaagctccgtcccggacctcatagtgtccatgagtaatcagatgtggctgcatcttcagagcgacgacagtataggcagtcccggatttaaagccgtgtaccaggagattgagaaggggggttgcggagatccgggaattccggcttacggaaaacgtaccggcagtagttttttgcatggtgatacactgaccttcgagtgtcccgctgcctttgagctcgtaggggagagagttatcacctgtcagcagaacaatcagtggtctggaaataaaccctcatgtgtcttcagttgtttttttaattttaccgcctcgtcgggaatcattttgtctcccaattatcctgaggaatacggtaataacatgaactgcgtatggctgattataagtgagcccggatccagaatccatttgatcttcaatgattttgacgttgaaccacagtttgatttcctcgccgtcaaggatgacggcatttctgacatcactgtcctggggaccttttctggaaatgaggtgccatcccagctggcatcttctggacatattgtgaggctagagttccagtctgaccacagcactacaggacgaggatttaatattacatataccaccttcggacaaaacgagtgccatgaccccggtattccaattaacgggcgacgctttggagaccgatttttgctaggctctagcgtgtccttccactgcgatgacggcttcgttaagacacagggctcggaaagcattacatgcatactacaggacgggaatgttgtgtggagctctactgtcccccgttgtgaagccccatgcgggggtcacttaactgccagtagcggtgttatccttcccccaggatggccagggtactataaagattcattgcactgcgagtggataatcgaagcaaagcccggacactccattaagattaccttcgatcggttccagactgaagtcaactacgataccctggaggtgagggacggcccagcatcttcctcaccactcattggagagtaccacgggactcaagctccccagttcctcatcagtacagggaatttcatgtatctgctgtttactaccgataactcccgctcaagcataggatttcttattcactatgaaagtgtgactctcgaatctgacagctgcttagaccccggtatcccggtgaatggacacaggcatgggggagactttggtattcgcagtaccgttacattttcatgtgatcctggctacacactgagtgacgatgagcctttggtctgtgagcgcaaccatcaatggaatcacgccctgccatcctgcgacgctctctgtggcggatatatacagggcaagtccggtactgtgttatcacccggattcccagacttctatccaaactcactgaactgcacatggactattgaggtttcacacggtaaaggggttcagatgatcttccacaccttccacctcgaaagctcccatgactacttgttgataacagaagatggttctttttctgagcccgttgccagactcaccgggtcagtcctcccacatacgataaaggcagggctgttcggcaacttcacagcccagctgcggttcatttcagattttagcattagctacgagggcttcaacattacatttagcgagtacgatttggagccgtgtgatgaccccggagtgccggctttcagcagaagaataggattccattttggcgtgggagacagcctcacattttcctgttttctcggctaccgacttgaaggcgcaacaaaactaacctgtctcggtggaggaaggagagtctggtcagcacctctgccacggtgcgttgccgagtgtggggcttctgtgaagggcaacgagggaactcttcttagcccgaatttcccaagtaactacgataacaaccacgagtgtatttataagatcgagacggaggctggaaaaggaattcacctcagaacaagatcattccagctcttcgagggagacactttaaaggtgtacgacggtaaggactcctccagccggcctctcgggacttttactaagaacgagctgctaggtctgatcctgaactctacttcaaaccacctgtggctggagttcaacacaaatggatccgacacggatcagggattccaactgacttacacatcattcgacctcgtaaagtgcgaagacccaggaattccgaactacggatatcggatccgggatgaagggcactttaccgacacagtggtgctctactcatgtaaccctggttacgccatgcatggcagcaacactctgacatgcctaagtggcgatcgcagagtctgggacaaaccgcttcccagttgtatcgcagagtgcggtgggcaaatccacgctgctacttccggacggattctcagtcccggatatcccgcaccctacgacaataatctgcactgcacatggattattgaagcagacccaggcaagactatatcactgcacttcatcgtgttcgataccgaaatggcgcatgacatcctgaaagtatgggacgggcctgtggactcagatatcttgcttaaagaatggtcgggctcggccctccctgaagatatccattccactttcaatagcctgacactgcagttcgattccgacttctttatctcgaagagcggtttctctatccaattctccacatccatcgcagccacctgtaacgatccaggcatgccccagaacggaacccgttacggcgattcccgcgaagctggcgacacggtgacatttcagtgtgaccccggttaccaactgcagggtcaggctaaaataacttgcgtacagctgaataacagattcttttggcagccggatccgccaacatgtattgccgcatgtgggggaaacctgaccggacctgcgggtgttatcctctcccccaattatcctcagccatatcccccaggcaaagaatgtgactggagggtgaaggtgaacccagactttgtcatcgcactgatctttaagtcttttaatatggaaccatcgtacgactttcttcacatttacgagggagaggattctaacagcccattgatcggatcctaccaggggagtcaggcgcctgagcggattgagagtagcggaaactccctgtttctggcattccggtccgatgcttccgtggggttatcagggttcgccattgagttcaaggaaaagccacgagaagcctgcttcgaccccggtaacatcatgaacgggaccagagtcggcacagacttcaagctggggtctacaataacatatcagtgtgatagcggttataaaatcttggacccaagcagcattacttgtgtgattggagcagacgggaagcctagctgggatcaagtacttccttcatgcaacgctccctgtggaggacagtacaccgggtctgaaggtgtggtgctgagtcctaattatccccacaattacacagccggtcaaatttgcctgtattctattactgtcccaaaggaattcgtggtcttcggccaattcgcttactttcagacagcgctcaatgatcttgcagagctgtttgacgggacccatgcacaggcccgactgctgtcatcactgtcagggtcccattcaggagagaccttacctttggccacaagcaatcagatcctcttacggttttccgcgaaatccggcgctagcgccaggggatttcattttgtgtatcaggcggttccaaggacatctgatacacagtgctccagcgtgccggaacctagatacggcaggcgcatcgggtctgaatttagtgcgggatcaatcgtgaggttcgaatgcaaccctggttacctgttgcagggctccacagctcttcattgtcagtccgtccctaacgctcttgcccagtggaatgataccattccttcatgcgtggtaccatgctctggtaacttcacgcagagacggggtactatactgagtcccggatatccagagccttatggcaacaatctcaattgcatttggaaaattatcgtgacggagggctcaggtatacagatccaagtcatttccttcgcaactgagcagaactgggactcgctggaaattcacgacggcggagacgtcaccgctccacgattggggtcgtttagcggaaccacagtgcccgctctattgaactctacaagcaatcagttatatctacactttcagagcgatattagcgtggccgcagccggattccatctggagtataagacggtgggattggccgcttgtcaggagccagcactcccatctaacagtataaagataggggaccggtacatggttaatgacgtgttgtcattccagtgcgaacccggatatactctgcagggacgctcccacattagctgtatgcctggcaccgtccggcgttggaactacccatctccactgtgcatcgcaacatgtggtgggactctctctacactggggggtgtcatccttagccctggcttccctgggtcgtacccaaacaatctggattgtacatggcgcatttcacttccaatcggctatggggcacatatccagttcctgaatttttcaaccgaagccaatcatgacttccttgagattcagaatggtccttatcatacatctcctatgattggccagtttagcggaacggatctgccagccgctctgttaagtacaacacatgagacactgatccatttttactccgaccattcccaaaaccggcagggtttcaagctggcgtatcaagcctatgagttacagaactgccctgaccccccacccttccagaatggatacatgattaattccgactacagcgtggggcagagcgttagcttcgaatgttacccaggttatatcctgatcggccatcccgtgctgacttgtcagcacggtattaacagaaactggaattatccattccctcgttgcgacgccccatgcgggtacaatgtgacgagtcagaacggaactatatattctccagggttcccagatgaatatccaatactgaaagattgtatttggttgatcactgtacctccagggcacggggtctatattaatttcacactgttgcagacagaagcagtcaatgactacattgctgtgtgggatggcccagatcaaaattcgccacaattgggcgtgttcagtgggaatacggcgttagaaacagcatattcttccacgaatcaagtactgctgaagtttcacagcgatttttccaatgggggattcttcgtgctgaatttccatgcttttcaactgaagaagtgccagcctccaccagccgtgcctcaagccgaaatgctcacagaggacgatgatttcgaaataggcgattttgttaaataccagtgtcatcctgggtacacgctggttggaactgatattctgacttgtaagctgagctcacaactgcaatttgagggatctctgccaacttgcgaggcccaatgcccggcaaacgaagttaggactgggtcctctggagttatcctttctcctgggtaccctggcaattactttaactcccaaacttgttcctggtcaatcaaggtggaacctaactataatattacaatttttgtggacacgttccagtctgagaagcaattcgacgccctggaggtcttcgatgggtcaagtggacagagccccctactggtcgtcctgtcgggaaaccataccgaacagtctaacttcacctctcgcagcaaccaattatacctgaggtggagcactgatcacgctactagcaaaaaggggttcaagatccgctacgccgcaccctattgcagtctgacccaccccctgaagaacggagggatactaaaccggacagccggagctgtgggctcaaaggtacactacttttgcaaacccggatatcggatggtgggccattctaacgcaacttgtaggagaaatccgctgggtatgtaccaatgggacagcctaacacctctttgccaggctgtcagttgcggtatccctgagtcgcctggcaacggatcattcacgggtaacgaatttactctggattcaaaagtagtttacgaatgtcatgagggatttaaactcgagtcgtctcagcaagcgacagctgtatgccaggaggatggtctctggagtaataaggggaagccacctacatgcaaaccggtggcctgtcccagcatcgaggctcagctgtccgaacacgtcatatggcggctggtcagtggcagtctgaatgagtatggcgctcaggtcctgctcagttgctctcccggttactatctcgagggttggcgtctcctgaggtgccaagcaaatggcacgtggaatattggtgatgagcgtccatcatgcagagctgggcactgtggatcaccagaccccatcgtgaatggacatatatccggggatgggttcagctacagggacactgtggtttaccagtgcaaccctggatttcggttggtgggcacctccgttagaatctgcctccaggatcataaatggagcggtcaaacacctgtgtgcgtgcccatcacctgtgggcatcctggtaaccccgcacacggattcactaacggttccgaattcaacctcaatgacgtggtgaactttacttgtaacactggatatctcctgcagggcgtgagccgggctcagtgccggtcgaacggacagtggagtagccctttacctacatgtcgagtggtgaactgctctgatccaggcttcgtcgaaaatgcgattaggcacggtcagcaaaactttcctgagtccttcgagtacggaatgagcatcctgtatcactgtaagaaggggttctatcttttgggaagttctgccctcacgtgcatggcaaacggactgtgggacagatccttacctaagtgtctggctatcagctgcggccatcccggagtacccgctaacgccgtgctcactggagaactgttcacttatggagcagtcgtccactactcctgcaggggatcagagtctctcataggaaacgacactcgcgtctgccaagaggatagccactggtcaggcgctttgccccactgcaccggaaacaatcccggattttgtggagatcctggaacgcctgctcatggctcccggttgggggatgacttcaagaccaaatccctactccgattcagctgtgagatggggcaccagctgcgtgggagcccagaacgcacatgcctgctcaacggcagctggagtggcctccaacccgtctgcgaggcggtgctttgccctcaaccgccacccgtccaaaacgggaccgtggagggttccgatttcagatgggggtcatctattagttatagttgtatggacggctatcagctgtcccacagtgcaatcctctcgtgtgagggccgaggagtgtggaagggcgagatcccacagtgtcttcctgtgttctgcggagatccgggaatcccagcagaaggccgactctctggtaagagcttcacctataagtcagaagtattttttcagtgtaagtcccctttcatacttgtcggctcctcacgacgcgtgtgccaggccgatggaacttggtccggcatccagcctacttgcatagacccagcgcacaacacctgccccgacccaggaacgccgcactttgggattcagaatagttcacggggttacgaagtgggctctaccgtgttctttaggtgccgcaaaggttaccatatccaaggcagcactactagaacttgtctggctaatctgacgtggtccggaatccagacagaatgcatcccacacgcctgccggcagcctgagaccccggctcatgccgacgtgagagcaatcgacttgcctacgttcggatacacactggtttacacctgtcaccctggcttctttctggccggtggctcagagcataggacatgcaaggctgatatgaaatggacgggcaagtctcccgtctgcaagtccaagggcgtgagagaagtaaacgagacggtgaccaaaaccccagtaccttcagacgtgtttttcgtgaacagtctctggaaaggttactatgagtacctcggcaagcgccagcccgctaccctgacggtcgattggtttaatgccacaagttccaaagtgaacgccacgtttagcgaggcaagccccgtggaattgaagcttactggaatctacaagaaggaggaggcccaccttcttcttaaggcattccagatcaagggccaggccgacatttttgtctctaaattcgagaatgacaactggggcctggatggttatgtaagctctggcctggaacggggtgggttcacttttcaaggcgacatccatggaaaagattttggtaaatttaaactggagcgccaggaccccttgaatccagaccaagactcctcatcacactatcacgggacctctagcggttctgttgccgcagcaatcctggttccattcttcgctttaatcctctctgggttcgctttctatctctacaagcaccggacacgacccaaagtgcagtacaatgggtatgcgggtcacgaaaattcaaacggccaggcatcgtttgagaatccaatgtatgataccaatctcaaaccgacagaggccaaggccgtaaggtttgacacaactctgaacaccgtgtgcaccgtggtgtaa

SEQ ID NO: 219501 - DNA, 10698 bp, Artificial Sequence
  Description of Artificial Sequence: Synthetic coding sequence
atgacggcgtggaggaggtttcagtccctcctgcttctcctgggcctcctagtgttgtgtgccaggctgctgactgccgctaaaggccagaattgtggtggattggtgcagggccctaacggcactatagagtccccgggatttccacacggctaccccaactacgctaattgcacttggattatcattacaggcgaaagaaataggatccaactgtccttccacacatttgcgctagaggaggactttgatatactgagtgtctacgatggtcagccccagcagggaaacttaaaagtgaggctgtccggcttccaactcccctcctcgatcgtgtccactggtagtattttaacgctgtggttcactactgacttcgctgtgagcgcccaggggtttaaagctctctacgaagtgctgccttcacatacctgcggcaaccctggggagatccttaagggagtgttgcacggcacccgttttaatattggagacaaaattcgctactcttgcttgccgggatatatattggaggggcatgcaatcttgacttgtatagtaagcccaggcaacggcgcttcatgggatttccccgctccattttgcagagcagagggtgcgtgtgggggaacgctacggggtacctcgtcttcaatcagctctccacatttcccttcagaatacgaaaacaacgcggattgtacctggactatccttgctgagccgggagacaccatcgctcttgttttcacagacttccagttggaggagggttatgatttccttgaaatctcaggcacagaagctccaagcatctggctgaccgggatgaacctgccaagccccgtaatctcctcaaagaattggttaaggctacacttcacatctgactctaaccatcggagaaaaggattcaatgctcagtttcaggtgaagaaggctattgagctcaaatcccgcggtgtaaagatgctcccatccaaagatggcagccacaagaactcggtgctgagccagggcggagtggccttagtttcagatatgtgtcccgatcccggaatccccgagaatggcaggcgcgcaggcagcgatttttctcgggtgggggcaaatgtgcagttttcatgcgaggataactatgttctgcaggggtcaaaatccattacgtgtcagcgggtgaccgagacactcgcagcctggtccgaccacaggcctatttgccgagccagaacttgcggtagtaatctccgcggaccctctggggtcattaccagtccaaactaccccgttcaatatgaggataacgcacactgcgtctgggtgattaccacgacagaccccgataaagtaatcaagcttgcttttgaggagttcgagttagaaagaggttacgacacactgacagtaggcgatgccggaaaggtgggggacaccaggagcgtcctgtacgttctcactggtagcagcgtaccggacctcatagtttcgatgagtaatcagatgtggctccatctgcagagcgatgactccatcgggagtccagggtttaaggccgtataccaagagatcgaaaaagggggttgcggtgaccctggcatacctgcttatggtaaaaggaccggatccagcttcctgcatggtgacactttaacatttgagtgccctgcagctttcgagttggttggtgagagagtgatcacttgccagcagaacaatcagtggagcgggaataagccaagctgcgtgttttcctgttttttcaattttactgcctcttccggcattatactcagtccaaattatcccgaggagtatgggaacaatatgaactgtgtgtggcttataatctcagagcctggttcccggatccaccttatctttaatgattttgacgtggagccccaattcgatttcctcgcagtgaaagacgatggcataagtgatatcacagtcttgggcaccttcagcggcaacgaagtgccatcccagcttgcttcctccggccacattgtgagactggaatttcagtccgatcattcaactaccggccgtgggttcaacatcacttacaccacatttggacagaatgagtgccacgacccgggaattcccatcaacgggagaagatttggcgacagattcctgctcggttctagtgtgagttttcattgcgacgatggctttgtgaagactcagggatcggagtccatcacatgcattctccaagatggcaatgtggtttggtctagtacagtcccacggtgcgaggccccttgtggcggtcatctgaccgcttccagtggagtcatcctccctccgggttggccaggatactacaaggactcgttgcactgtgaatggatcatcgaggccaagccaggtcattctattaagattaccttcgatagattccagactgaggtgaattatgacacgttggaggtgcgtgacggacctgccagctcctcacctttgatcggggagtatcatgggacacaagcgcctcagtttctgattagcaccgggaactttatgtacctactctttaccacagacaatagccgctcatcgataggatttctgattcattatgaaagtgtgactctcgaatccgatagttgcctcgatccaggtattccagtcaatgggcaccgccacggcggagattttggaattagatctaccgtaaccttctcatgtgaccccggttataccctgtctgatgacgagcccctcgtgtgcgagagaaatcaccaatggaatcacgccctgccttcctgtgatgcactgtgtgggggatatatccaaggaaaatcaggaacagtgctgtccccaggcttcccagacttctacccaaatagcctgaattgcacatggactatcgaagtttcccatggcaaaggagtccagatgattttccacaccttccatttggaatcctctcatgactacctgcttataacggaagacgggagcttctctgagcctgtcgcaaggctcacaggcagtgtgcttcctcacaccattaaggcgggtctttttggtaatttcacggcccaacttcgcttcatttccgatttctcaatctcctacgaggggttcaacataaccttttccgagtacgacctggaaccgtgcgatgatcctggagtacctgccttctcacgccgaatcggatttcactttggcgtgggagatagtttaaccttttcctgtttcctgggatatcgactggaaggagctacaaagctgacgtgtctggggggtggtcgacgcgtgtggagcgctccgcttcctcgatgcgtcgcagaatgcggagcgtctgtcaaaggcaatgaagggacattattgtcgcctaatttccccagtaattatgataacaatcatgagtgcatctataaaattgaaactgaagctggaaaaggcattcacttgaggacccgctccttccagctcttcgagggagatacgctcaaggtttacgatggaaaggatagctcttccagaccgctggggactttcaccaaaaatgaactgcttggcctcatcctgaattctacaagcaatcatctatggctggaatttaacacgaacgggtccgacactgatcagggcttccaactgacttacacgagcttcgatctggtgaagtgtgaagatccaggcatccccaattatgggtatcgaataagagatgagggacactttactgatactgtggtgctctacagctgcaaccctggatatgcaatgcatgggtccaatacactgacatgcctgtctggggaccggcgagtctgggataaacctctcccaagttgtatcgcagagtgcggcggtcagatccacgcagccacctctgggcgtatcctgtcaccaggataccctgctccttatgacaataacctccattgcacctggattatcgaagccgatccgggtaagaccattagccttcattttatagtgttcgataccgaaatggctcacgatattctgaaggtttgggacggcccagttgactcagacatcctactgaaagaatggtcagggtcagctctgcctgaggacatacactctactttcaatagtcttacattacaattcgattcagatttttttatctcaaagtcgggcttttccatccaattctctactagcatcgctgccacatgcaatgatccaggcatgccacagaacggtacccgttacggcgattccagagaagcaggcgatacagtgactttccagtgtgaccctggctaccagttgcaagggcaggccaagatcacatgcgtacagctgaacaacaggttcttctggcagccagaccctcccacatgtatcgcagcgtgcggcggtaatctcaccggacccgctggggtaatcctgtctcccaactatccgcaaccctatccacccggaaaagaatgtgactggcgggtgaaagtcaacccagattttgtgatagccctgattttcaagagcttcaacatggaaccatcctatgattttctgcacatttatgagggggaagactctaacagtcctttgatcggtagctaccagggaagccaggctcctgagaggatcgagtcatcagggaattcgctgtttttggcctttcggtcagatgcttctgttggcctgtcaggattcgccattgaattcaaagagaagcctagggaagcttgcttcgacccaggtaatataatgaatggaacacgtgtgggaacggattttaagttaggatccactatcacataccagtgtgattcaggatacaaaatccttgacccaagctcgatcacctgcgtaatcggggctgacggtaagccttcctgggatcaggtactcccttcatgtaatgctccttgcgggggtcagtacacagggtctgaaggcgtggtgctttctcctaactacccacacaattatacggccggacaaatatgcttgtactccatcaccgtacccaaggaattcgtggtattcggccagtttgcctactttcaaacagctctgaacgatctggcggaattgttcgatggtacccatgcccaggccaggctcttgtccagcttgtcagggtcccatagtggggagactcttcccctagcaacatcaaaccagattctcctgcgcttttcagctaagagcggggcatccgccagaggcttccatttcgtgtaccaggcagtgccgcgaacaagcgacactcagtgtagctctgtccccgaacctaggtacgggcgacgcataggatcggaattctcagccggttctatagtacgcttcgaatgtaaccccggatacctgctgcagggaagcaccgctttgcactgccagtctgtccctaacgccctggcccaatggaatgacacaatccctagctgtgtcgtgccatgcagcgggaacttcacacaaaggagagggacaattctgtctcctggataccccgaaccatacggtaataatctgaactgtatatggaagattatcgtaacagagggcagtggaatccaaattcaagtcatcagtttcgccacggagcagaattgggactcacttgagattcacgacgggggagatgtgactgcacctcgtctggggtcctttagcggtaccacagtgccggctctgctaaattctaccagcaatcagctgtacttacacttccaatcagacatttctgtggcggcagccggatttcatctcgagtacaaaaccgttggcttggctgcctgtcaagagccagcgctgccatctaactccataaaaatcggcgatagatacatggtcaatgacgtgctgtcgttccagtgtgagccagggtacacgttgcagggcaggagccatatcagctgcatgccaggcaccgtcagacggtggaactatccctcgccactgtgcattgcgacatgtggcggtacactttcaaccctgggaggtgttatcctctcccccggattccccggatcttatcccaataaccttgactgtacttggagaattagcttgcctatcggctacggtgctcatatccagttcctcaatttcagtaccgaagccaatcacgactttctggagattcagaacggcccttaccacacctctccaatgatcggccagttttccggcacggacctgcctgctgctttgctaagtaccacccatgaaaccctgattcacttctattctgatcactctcagaatcggcagggcttcaagctggcctaccaggcgtatgaactgcagaactgcccagacccacccccatttcaaaatggctacatgatcaactcagattactccgtgggtcagtcagtgagtttcgaatgttatcctgggtatattctcatcgggcaccccgtgttaacttgtcagcacgggataaaccgcaactggaattacccatttccacggtgcgatgctccttgtggctacaatgtcacttcacaaaacgggacaatctattcacccggtttccccgacgagtatccgatactcaaagactgcatatggctgatcactgtgccgcctggccacggagtatacataaatttcacgctcctgcagaccgaagcagttaatgattatattgccgtgtgggacggccctgatcagaactcgccgcagctaggcgtgtttagcggaaatacagccttagagacagcttatagctcaaccaatcaggtgctcttaaaatttcactcagactttagcaacggcggattcttcgtgctgaacttccacgctttccagcttaagaagtgccagccgcctcctgctgtgccacaagccgaaatgctgacagaggatgacgactttgaaataggggactttgtgaagtatcagtgtcatcccggatataccctggtcgggactgacattctaacttgcaaactcagctctcagctacaatttgaggggagcttgccgacctgcgaggcacaatgtcccgcaaacgaagtgcggactggtagttccggagttatcctgtcaccaggctatccgggaaactactttaatagccagacctgttcgtggagtattaaagtcgagcccaactacaacataaccatttttgttgacacattccaaagcgaaaagcaatttgatgctttggaggtgttcgacggaagttctggacaatctccattacttgttgttctgagcgggaaccacactgagcagtcaaattttacaagtagatcaaatcagttatacctgaggtggtctaccgatcacgcgacctctaagaaaggctttaagatcaggtatgccgctccgtactgcagcttaacacacccattgaaaaacggaggcattttgaaccgcacagcaggcgctgtaggctccaaggttcactacttttgcaagccagggtatagaatggtgggacatagcaacgctacctgtagaagaaatccattggggatgtaccagtgggactctctgacacctctttgccaggctgtatcgtgcggaatcccggaatccccgggtaatgggagcttcaccggaaacgaattcaccctcgactctaaggttgtatacgaatgtcacgagggattcaagctcgaaagttcccaacaagccacggcagtgtgccaggaggatggactgtggtctaacaaaggtaagcccccaacgtgtaagcccgtggcttgcccctccatcgaagcccagttgtccgagcacgttatctggagattggtctccgggagcttgaatgaatacggagctcaagtacttctttcttgcagtccgggatactacttggagggctggagattgctgcggtgtcaagccaacggcacatggaatatcggtgatgagagaccctcttgccgtgtgatcagttgtggcagtctctcctttcctccaaatggcaataagatcgggaccctgactgtgtatggtgcaacggcgatcttcacttgcaacaccgggtatacactggtgggcagccacgttagagagtgcctagctaacggactgtggtccggcagtgagaccaggtgtctggcaggtcactgcggctcacccgatcctatcgtgaatggccacattagcggggacggcttctcttatcgagatacagtggtctatcagtgtaatcctggatttcgacttgtcggtacatcagttaggatctgtttacaggaccacaagtggagtgggcagacccccgtctgcgtcccgatcacttgtgggcacccgggtaaccctgctcacggctttactaatggcagtgaattcaacttgaatgatgtggttaactttacttgtaacacaggctacctccttcagggagtctcaagggctcagtgtagaagtaatgggcagtggtcctcaccacttcccacatgtagagtagtgaactgttctgatcccggttttgtcgagaacgctatcaggcatggtcaacagaacttcccagaaagcttcgagtatggcatgtccatcctgtatcactgcaagaaggggttttacctgttaggatcatcagctctcacttgcatggctaacggtctatgggatcgctcactgccaaaatgcctggcaataagttgtggacatccaggagtgccggcaaatgctgtgctcaccggcgaactcttcacctatggggctgttgtgcattacagctgccgcggttctgagtctttaatcggtaatgatacccgggtgtgccaagaggattcccattggtccggcgcactgccccactgcaccgggaataaccccggattctgcggcgaccccggtactccagcacacggctcacgcctcggcgatgattttaagaccaagagtctgctgcgcttttcatgtgagatgggtcatcagctgagaggctcaccggaacgaacatgtctgctcaacggatcgtggtctggtctgcagcctgtgtgcgaagccgtctcatgtggcaatccaggcactcccaccaacggtatgatcgtgagttccgacgggattctgtttagttcctcagtcatctatgcttgctgggagggatacaaaacatcgggacttatgacgaggcactgcaccgccaacggaacgtggacgggaactgctccagactgtacaatcatttcttgcggggatccaggaacacttgccaatggaatccagttcggaactgatttcactttcaataagaccgtctcctaccagtgtaatcctggatatgtgatggaggccgtgacttcggctactatcagatgcaccaaggacggacgctggaaccctagcaagccagtgtgtaaggcggtgttatgccctcagccccctccggtgcagaacggaaccgtggagggcagcgactttcgctgggggtcaagcatttcctattcctgcatggacggctaccagttgtcacattccgccatcctgtcttgcgaaggacgtggggtatggaagggagagatcccccagtgcctgcctgtcttttgtggcgacccgggaataccggcagagggcagactgtccggtaaatcattcacatacaagagcgaagtattctttcagtgcaagtctccttttatcttggtggggtcttctagacgtgtttgccaggctgacggcacgtggtccggcatccagcccacgtgcatagatccagcacacaatacctgcccagatcccggaacgccccacttcggtattcagaatagtagccgcggatacgaggtggggtccactgttttcttcagatgtagaaaagggtaccacattcagggatccactacacgtacctgtctcgctaacctgacgtggtccggcattcagacagagtgcatcccccatgcctgcagacagcctgagactccagctcacgccgacgttagggctattgaccttcctactttcggatataccctggtctacacatgtcatcctggattttttctggctggcggaagcgaacacaggacatgtaaggctgatatgaaatggactggaaaaagtcccgtgtgcaaaagtaagggagtgcgggaggtaaacgagaccgtgacgaagaccccagttccaagcgacgtgttcttcgtgaacagcctttggaaaggatattatgaatatttagggaagcgccagccggcaacactcaccgtcgattggttcaatgccacgtcttctaaagtgaatgcaacattcagcgaggccagccctgtcgagctgaagctgaccggtatatacaagaaagaggaagcccacttgctgctgaaagcttttcaaataaaggggcaggccgatattttcgtgagcaagttcgagaacgataactgggggctggatggatatgttagcagcggactggaaaggggaggctttactttccagggcgacattcacggaaaagactttggaaaatttaagctcgaacgccaagatccgctgaacccggatcaggactcaagctctcactatcatgggacatcgtccggctctgtcgccgcagctatcctggtgccttttttcgccctgattttgtcaggctttgcattttacctatacaaacatcgaactagacctaaggtgcagtacaatggctacgcaggacatgaaaactccaatggacaggcttccttcgagaaccccatgtatgacacaaatctgaagcctacagaagctaaagcagtccggtttgacaccactctcaatacagtctgcacagttgtttaa

SEQ ID NO: 219502 - DNA, 10695 bp, Artificial Sequence
  Description of Artificial Sequence: Synthetic coding sequence
atgacggcgtggagacggtttcagtcgttactactgctgcttggcctgctggtcctatgcgccagactcttgactgctgctaaggggcagaactgcgggggtttagtacaaggccctaacggcaccatcgaatcacctgggttccctcacggatatccaaattacgccaactgtacatggattataataaccggcgagcgaaaccggatacagctctctttccatacctttgctcttgaagaggacttcgacatcctctctgtgtatgacggccagccccaacagggtaacctgaaggtgcgcttatcaggcttccagctgccttcttctatcgtgtcaaccggatctattcttaccctttggtttaccacggacttcgccgtaagtgctcagggtttcaaggccctttacgaggtgctcccctctcatacctgcggtaatcctggagaaatactgaagggcgtcttgcacggcactcgcttcaatattggggacaagatcaggtactcctgtctgccaggctatatactggaagggcacgccatcctcacatgtatagtgagcccgggtaatggggcaagctgggatttccctgctcccttttgtcgggctgagggtgcatgtggtggtacgctgagggggacaagctcaagtatctcgtcaccccacttccctagtgaatacgagaacaatgcagactgcacttggaccatcctggcggagcctggtgatactattgctcttgtgtttaccgatttccagcttgaggagggctacgatttcttagaaatttccggaaccgaggccccatcaatctggttgacagggatgaatctaccctcgccagttatctcctcaaagaattggctgcgtctacattttacctcagatagtaatcataggaggaaggggttcaacgcccagtttcaggttaagaaagctatcgagttgaagtcccgaggtgtgaagatgctgccttctaaagacggctcccacaaaaattcggtgctgagtcaaggtggagtcgctttggtgagcgacatgtgtcccgatccgggaatcccggaaaatggtcgaagagccggttcagacttcagagtcggtgctaatgtccagtttagttgcgaggataactacgtactacagggttccaaatccattacatgccagagggtgacagaaacactagccgcttggagcgatcacaggccaatctgccgagctaggacttgtggcagcaatctgcgtgggccttctggtgtaattacgagtcccaattaccctgtccagtatgaggacaacgcccattgtgtgtgggtcattacaaccacggaccctgataaggtgatcaagttggcctttgaggaattcgagctagagcggggatacgatacattaaccgttggagacgcgggaaaagttggagacacccggagcgtactgtacgtactaacagggagttctgtgcctgacctgattgtgagtatgagtaatcagatgtggcttcacctgcagagcgatgacagcatcggaagcccgggtttcaaggccgtgtaccaggaaattgagaaggggggatgcggagatcctggaatacctgcctacggcaaaagaacaggctcgagtttcctgcacggggacacacttacctttgagtgcccagctgcgtttgaactggtgggcgagcgtgtcataacttgtcagcaaaataatcagtggtccgggaacaaaccgagttgtgttttcagttgcttcttcaacttcactgcaagtagtggaattattctctctcccaactatcctgaggaatacggcaacaacatgaattgcgtgtggctcatcatcagcgagccagggtcaagaatccatctgattttcaacgactttgacgtcgagccccagtttgacttccttgcagtcaaagatgacggcatttcggatatcactgtcctcggaacatttagcggaaatgaagtgccgtcccagttggcttctagtggccatattgttcggctggagttccagagcgatcatagtacaacagggaggggatttaatattacttatactacttttggccaaaatgagtgccatgatccaggcatcccaattaatggaagacggtttggtgataggtttctgcttggcagttcagtttcctttcattgcgatgacggattcgtgaagacccaggggtctgaatcaataacatgtatattacaggatggcaacgtggtttggtcttctactgtccctaggtgtgaagcaccatgcgggggacatctgacggcaagttcaggggtgatcctcccaccgggatggcctggatattacaaggactcactgcactgcgagtggatcattgaggcgaaacccggacactctatcaaaatcacttttgacaggtttcagaccgaagtaaactatgacaccttggaagtcagagacgggccagcgagtagttcacctctgatcggtgagtaccacgggactcaggctccccagtttctcatcagcacaggcaattttatgtacttgctcttcaccaccgataattcaagatcatccattgggtttctgatccattacgaaagcgttacactcgaatctgatagctgtctggaccccggaataccagtgaatggtcatcgccatggcggagattttggtatccggtctaccgtaaccttttcttgcgaccccggttacacactgtctgatgacgagccattagtatgtgagcgcaatcaccagtggaatcacgcactgccttcatgtgacgccctttgtggcggatacatccaggggaaaagtggcaccgttctgagccctggcttccctgacttctatcccaactccctgaattgcacatggactattgaggtgagccacggcaaaggcgtccaaatgatcttccacacttttcatctggagagcagccacgactacctgctaattacagaagacgggagctttagcgaacctgtggcaagactgactggaagcgtgctgccacacaccattaaagcaggactcttcgggaatttcaccgcccagctgcggttcatctctgatttttccatctcttacgaaggtttcaacattactttttccgaatatgatctggagccctgtgatgatcccggagtgccggcattctcacgcaggatcggctttcatttcggtgtcggcgatagtctcaccttctcttgcttcctcgggtaccggctggaaggcgcaacaaagctcacttgtctcggaggcggacgcagggtctggagcgcgcctctgcctcgttgcgtcgcagaatgcggggcttcggtaaaaggcaacgaaggtacgctactgagcccaaactttccttccaactatgataataaccatgaatgtatatataaaattgaaacagaagcaggaaagggcatccacctaagaacacgttcgtttcagctctttgaaggtgatacgctaaaggtttatgacggcaaggatagttcatccaggccattgggaacctttacaaagaacgagcttctgggcctgattctcaattccacaagcaaccatctgtggttagaatttaatacaaacggcagcgacaccgaccaaggattccagttaacctacacctccttcgacctggtcaagtgcgaagacccgggaatccctaactatgggtaccggatccgtgacgaaggtcacttcacagatacggttgtcttatattcttgcaaccctgggtatgccatgcacgggtcgaacaccctgacgtgcctctcaggggatcgcagggtatgggacaagcctcttccaagctgtattgccgagtgcggtggccagattcatgcagccacgtcgggcaggattctgtccccaggttatccggctccctacgacaataacttacactgcacttggattatcgaggctgaccctggcaaaactatatcgctacacttcattgtgttcgacacagagatggcccatgacatcctgaaagtgtgggacggtccggttgatagtgatatactcctgaaggaatggagcggctccgccctgccggaggacatccacagtacattcaattcactgacgcttcagttcgatagcgatttcttcatatccaaatccggcttcagtatccagttctctaccagtattgccgcaacctgtaatgatcctggcatgcctcaaaatgggacccggtacggagatagcagagaagcgggagatactgtaacattccaatgtgacccgggataccaattacagggtcaggccaaaatcacctgtgtgcagctcaataacagattcttctggcaaccagacccgcctacttgtattgctgcatgcggagggaatctgactgggcctgccggagtgatcctgtcgccaaactatccgcagccttatccaccaggcaaggaatgcgattggagagtgaaagtcaatcctgacttcgtgatcgctctgatttttaaaagctttaatatggagccatcatatgactttctgcacatctacgagggcgaggatagtaatagtcccctgatcgggtcatatcaagggtctcaagcccctgagaggattgagagctccggtaacagcttgtttcttgctttccgttccgacgcaagcgtgggattgagcggctttgcaattgagttcaaggagaagccccgagaagcctgttttgatcccggtaatatcatgaacgggactcgcgtgggaactgactttaaacttgggtctacaattacgtatcagtgtgattctggctacaagattctcgacccaagttccatcacatgcgtgataggcgcagacggcaagccctcctgggaccaggttctaccaagctgtaacgcgccttgcggtggccagtataccggatccgagggcgtagtcctatcaccgaattacccccataattacactgccggacagatatgtctgtacagcatcaccgtacccaaggaattcgtggttttcggccaatttgcctatttccagaccgcccttaacgatttggccgaattatttgatgggacccacgctcaggcgagactcttatcttcactgtcaggctcacattctggcgagacgctgcctctcgcaacttccaaccagatattgctgcgcttttctgctaagtcgggggcttccgctcgaggatttcacttcgtgtaccaagcagtacctcggacgtcggatactcagtgctcaagtgtcccagagcctcggtacggtcgcaggatcgggtccgaattcagcgcagggtccattgttagattcgagtgcaacccagggtatcttcttcaaggttctactgcactgcactgtcagtctgtcccgaacgccctggcccagtggaacgacacaataccttcttgcgtcgttccctgcagcggaaatttcacacagcggagaggaacaattctgagtcccggttaccccgagccctatggaaacaacctaaactgcatctggaaaatcatcgtcacagaaggcagcgggatccaaatccaggtgatttctttcgctaccgagcaaaattgggatagtctggaaattcatgatggcggtgatgtgactgctcccaggctgggctccttctcggggaccaccgtccccgctctcctaaattcaacctccaaccagctgtacttacatttccagtcagatatctccgtcgcggcagccggattccatctcgaatacaaaaccgtcggcctcgcggcttgccaagaacctgctctgccaagtaattccattaaaatcggcgaccgatacatggtcaacgacgtcctgagcttccagtgtgagcccggatatacgcttcagggccgaagccacatcagttgtatgcctgggacggtgagaaggtggaattatccttccccactgtgtatcgccacctgtggcggaaccctctccaccctcgggggtgttatactgtccccgggattccccggttcttatcctaataacttagattgtacatggaggatctcactgccgatcggctatggggctcatatccagttcctcaacttctcaactgaggctaaccatgactttctggagatccagaacggaccatatcacaccagtccgatgattggtcagttctcaggcaccgacctgcccgctgcgctcctctctacaacacatgaaaccctcattcatttctacagtgaccattctcagaatcggcagggtttcaagcttgcctaccaggcttacgaactgcagaactgtccggaccctcctcccttccagaatggatacatgataaacagtgattattcagtgggtcagtccgtaagtttcgagtgttatccaggatacatcttaattgggcacccagttctgacatgccagcacggaataaatcgcaattggaactacccctttcccaggtgcgacgcaccttgcggatacaacgtcacctcacagaatggcacaatctactctccgggatttcccgacgagtatccaatcctgaaagattgtatttggttgatcacggtccctcctggtcacggggtctacatcaacttcactcttctacagaccgaggctgtgaatgattatattgccgtttgggatggtccagatcagaactccccacaactcggcgtgttcagcggcaatacagctctggaaactgcctatagcagtacgaaccaggtcttactgaagtttcatagcgacttcagcaacgggggattctttgtgctgaacttccacgcgtttcagctgaagaaatgccagcctccacccgctgtgccacaagccgaaatgctgactgaggacgacgactttgagataggagattttgtcaaataccaatgtcaccccggatacaccctagtgggtacagatattttgacctgtaaactgagtagtcaactgcagtttgagggaagcctgccaacctgcgaggctcagtgcccggctaacgaagttcgcaccggctcctcaggtgtgattttatcccctggttaccctggcaactatttcaattcgcagacatgcagttggtctattaaagtagaacccaactataacatcaccatttttgttgacacttttcagtcggaaaaacagttcgacgctctcgaggtttttgacgggtcatcgggacagtctcccttgctggtcgtgttgtccggcaatcacaccgaacagtccaacttcacctctagatctaaccagctttacctgcggtggagcacggatcatgcaacgtcgaaaaagggcttcaagataagatacgccgcaccttattgcagcctgacacatccactgaagaatggtggtattctcaatagaacggctggggcagttgggagcaaagtgcattacttttgcaaacctgggtataggatggtaggtcattccaatgccacctgtcgcaggaaccctttaggtatgtaccagtgggattcattgactccactgtgtcaggcagtttcttgtgggatccccgagagtcctggcaacggttcattcaccggcaatgaattcaccttggactccaaggtggtttacgaatgtcacgagggctttaagttagagtctagccagcaagccaccgccgtgtgtcaggaggacgggctgtggtcaaataaaggaaagccgcctacatgtaaacctgtggcttgtccatcaattgaggcacagctgagtgagcacgtcatctggcggctggttagcggctctctgaacgagtatggggcacaggtgcttctgtcatgtagccctggttattatttggagggttggagattgctccgctgccaggcaaacggcacgtggaacatcggtgacgaacgcccttcctgtagagtcatctcctgtgggtctctgtcttttcccccaaatgggaacaaaattggtacattgacagtctacggagccactgcgatctttacctgtaacaccggctacaccctagtgggaagccatgtcagggaatgtcttgccaatgggctgtggtctgggtccgaaaccagatgtcttgccggacattgcggtagccctgatcccattgtaaatggccacatctccggcgacggtttcagctatcgcgacaccgttgtgtatcagtgtaatcctgggtttcgattagtgggcacgagtgtgcgtatatgtctgcaggatcataaatggtctggccagacacccgtctgcgtgccaatcacatgcggacatcccggaaacccagcccatggcttcactaatgggagtgaattcaacctcaacgacgtagtgaactttacatgcaacacaggctatctgctccagggcgtcagtcgcgctcagtgtcgatcaaatggacagtggagcagcccactgcctacttgccgagtggtgaattgctccgaccctggattcgttgagaatgctatccgtcacgggcagcagaatttccctgaatcgttcgaatacggcatgtcaatcctgtaccattgcaaaaaaggattttacctgctcgggtcttctgccctcacctgtatggccaatggcctttgggatcgtagcctgccaaagtgtctggccatctcgtgcggccaccctggtgtgccagccaatgccgttctaactggagaattgttcacctacggagctgttgtgcattactcttgtcggggaagcgagagcctgatcggcaacgatactcgtgtgtgtcaagaggactcccattggtccggggctcttccacactgtaccggtaataaccctggcttctgtggagatcccggaaccccagcccacggtagccgattgggcgacgactttaagacgaaaagtcttctaagatttagctgcgaaatggggcaccagcttagggggtcaccagaaaggacgtgcttactgaacgggtcctggtcagggctgcagcctgtgtgcgaagcagtctcctgtggaaaccctggcacgcctactaatggcatgattgtatcatccgatggcattctgttctcaagcagtgtgatctatgcctgttgggaaggatataagacgtctgggcttatgacgagacactgcacagccaatggaacatggactggaacagcaccagactgtaccattatcagctgcggcgaccctggaaccctggctaacggaattcagttcggaaccgattttacgtttaataagacagtgtcctatcagtgcaatcctggctatgtcatggaggccgttaccagcgctacaatcaggtgtacaaaagatggccgttggaatcccagcaaacccgtctgcaaggccgttctctgccctcagccgcctccagtgcaaaatggaacagtcgagggcagcgacttccgctggggcagcagcatctcttactcatgcatggacggctaccagctgtcccattcagccatcctttcctgcgagggacggggagtgtggaagggagagatcccccaatgtctgcccgtgttctgcggggatcctggcattccagccgagggacgtctgagtggcaagagttttacatataagtctgaagtgttcttccagtgcaaatctcccttcatccttgtgggatcctccagaagggtctgtcaggctgacggcacctggtccggtatccagcctacctgcatagacccagcccacaatacatgccccgatccgggtacacctcactttggtatacaaaatagctcaagagggtatgaggtgggttctaccgttttttttcgctgtcggaagggctaccacattcaggggtcaacaacgcgcacatgccttgccaacctcacatggagcgggatccaaacggagtgcattcctcatgcctgccgtcagcccgagacccccgcacacgcagacgtgagagccattgatcttcccacatttggctacacgctggtgtacacctgccaccctgggtttttcttagcaggaggatctgagcacaggacttgtaaagccgatatgaagtggaccggtaagagtcctgtctgcaagtctaaaggagtgcgcgaggttaatgaaaccgtgacaaagactccagttccaagcgatgtcttctttgtgaacagtctgtggaaaggttactatgagtatctgggaaagcgccagccggcaactctaacagttgattggtttaatgctacttcctcaaaggtcaatgcaacgtttagcgaggcctcccctgtggagctcaagctcaccggtatctacaaaaaagaggaggctcacctccttttaaaagcctttcaaataaaagggcaagctgacattttcgtgagcaagtttgagaatgacaattggggtctcgacggatacgtaagtagtggccttgaacgtggcggttttaccttccagggggacatccacggcaaggatttcggaaaattcaaattagagcggcaagatcccctgaacccagaccaggactcgagctcacattaccacggcactagtagcggaagcgtggccgctgccatcctcgtaccattttttgctctaattttgtccggcttcgctttctatctctacaaacatcgtacacgacctaaggttcagtataacggatatgcaggccatgagaattcgaatggtcaggcgtcatttgaaaatccaatgtacgacactaacctcaaaccaacggaagccaaagcagttcgatttgatacgaccctaaatactgtctgcacagtggtgtac

SEQ ID NO: 219503 - DNA, 6329 bp, Artificial Sequence
  Description of Artificial Sequence: Synthetic coding sequence
atgacagcttggcgacggttccaatccctactgctactgctcggtctgctggtgctgtgtgcgagactgcttactgcggctaagggacaaaattgtggtggccttgtccaggggccaaatggcaccattgagtctccaggcttccctcatgggtatccaaattatgcaaattgtacttggatcattattactggggaacggaacagaatccaactgtccttccatacatttgcactagaagaagactttgacatcctctccgtatatgatggtcagcctcaacagggcaaccttaaagtgcggctgtctggctttcagcttccatcctccatcgtctccaccggcagcattctgaccctttggttcacgacagactttgccgtatctgcacagggattcaaggctttgtatgaagttctgccaagtcacacctgcgggaatcccggagaaatcctgaagggagtcctccatggtacccgcttcaatattggagacaaaatccgttatagttgcctacccggatatatactagaagggcatgccattctgacttgtatcgtcagccccggtaacggcgcatcctgggacttccccgctcctttctgtagggccgaaggagcttgcggcggaaccctgcgtggaaccagctcatctatcagcagtccccacttcccctccgaatacgaaaacaacgcagattgtacttggactatcttggctgagcccggagacaccatcgccctagtattcactgacttccaacttgaggagggctatgacttcctggagatcagcggcacagaggctcccagtatctggctgaccggaatgaaccttccgagccctgtaatctcatctaagaattggctgcgacttcatttcaccagtgacagtaatcaccgcaggaagggcttcaatgcacaatttcaagtgaaaaaggctatcgagctcaaaagtcggggtgttaaaatgttgccgagtaaagatgggtcccataaaaacagcgttctgtcacaggggggagtagccctggtgagtgacatgtgtcctgatcccggaatacccgaaaatggcagacgtgctggatctgactttagagtgggtgcaaacgtgcagttctcctgtgaggacaactacgtgctccaaggatctaagtcaataacgtgccagagagtcacagagaccctagccgcatggtcagatcacaggcccatctgccgcgctaggacttgcgggtctaaccttcgcggtcctagcggggtaattacatctcccaattacccggtgcagtacgaggataatgcacactgtgtgtgggtgatcaccaccactgatcccgacaaggtgattaagctggccttcgaagagtttgaactggagcggggttatgataccctgacagtgggagatgccggaaaagtcggcgatacgcggtctgtgctgtatgtgctcactggatctagcgtgcctgatttgatcgttagcatgtcaaaccagatgtggctccatttgcagtctgacgattccattggcagtcccggattcaaagcagtttaccaagagatcgaaaagggcggatgtggcgaccccggtatacctgcctatggaaaacgcaccggctccagtttccttcacggagacactctgaccttcgagtgccctgctgcatttgaactggtgggagaaagagtgatcacatgtcagcagaacaatcaatggtctgggaacaagcctagctgtgtcttttcctgcttttttaatttcacggcaagcagtggaatcatcctgtcccccaactatcccgaggagtacggtaataacatgaattgcgtttggctgataatctcggagcctgggtcacgaatccacctgattttcaatgacttcgacgtggaaccgcagtttgatttcctggccgtgaaggacgacggcatcagcgacattacggtcttgggcacgtttagcggaaatgaggtccctagccagctggcctcttcaggccatatcgtccgactcgagtttcagtcagaccactcaaccaccggcaggggcttcaacatcacatataccacattcgggcagaacgagtgtcacgatccaggtattccgattaacggtcgcaggtttggtgaccggttcctcctgggcagctctgtcagcttccactgcgatgatggtttcgtcaagacgcagggatccgagtccataacctgtattctgcaggatggcaatgtagtgtggagtagcaccgttcctcggtgcgaagctccatgcggcggacacttaacagcaagctctggagtcatattaccaccgggatggcctggatactacaaagacagcttgcactgcgagtggattattgaggccaagccaggtcattccataaaaatcaccttcgaccggttccagacagaggtaaactatgacactctagaggtgagagatggcccagcctctagctctccacttattggggaataccacgggactcaagccccacagtttctgattagcactggaaacttcatgtacctgctctttacaacggataatagtaggagctcaatcggctttttaatccactacgaatccgtgacgctcgagtcagactcatgtctcgatccaggtatcccagtaaatggtcaccggcatggaggcgacttcggcattcgcagtacggtcacattttcttgtgatcctggatacacgttgtcagacgacgagccgttggtgtgtgagagaaaccatcagtggaatcacgccttgccaagctgtgacgctctttgcggtggttacattcaggggaaatcaggtactgtgctcagccccggtttccccgacttctatcccaacagcctaaattgcacatggaccattgaggtaagccacgggaagggagtccaaatgatcttccacaccttccatctcgagtcctcacacgattacctcctaatcacagaggatgggagctttagtgaacccgtcgctcggctaactggctccgtgttgccccacactatcaaagccggattgtttgggaacttcactgcacaactacgatttataagcgactttagcatttcctatgaaggctttaacatcacgttctcagaatacgacctggaaccttgcgacgatcctggcgttcccgctttctctaggcgtataggtttccactttggcgtgggtgattccctgactttcagctgttttctcggctatagacttgaaggcgcaaccaaactgacctgtcttggcggaggaagaagggtgtggtctgcccctctaccacgatgtgtggccgaatgtggcgcatcagtaaagggcaatgaaggtacactcttatcacccaactttccctctaactacgataacaaccatgagtgtatttataaaattgaaacggaggctggaaagggtatacatctgagaacgaggagctttcagttgttcgaaggtgatacacttaaagtctatgatggcaaggattcatcctcacgaccactcggcactttcactaagaatgaactgctgggtcttatcttgaacagcacatccaaccacctttggctggaatttaacaccaatggtagtgataccgaccaaggctttcagctgacttacacttcctttgatttggtgaaatgtgaagaccccggaatcccaaattacggctatcgaatccgcgacgaggggcacttcaccgataccgtcgtcctgtattcttgcaatccaggatatgcaatgcatggatcaaacactctgacttgtctgagcggagatcggcgagtgtgggataagcccttaccatcttgcatcgctgagtgtggtgggcagatccacgccgctacaagcggcagaatcttaagcccgggatatccagccccatatgataacaatttacattgcacctggattattgaagccgaccccggtaagactatttctcttcactttatcgtgtttgacacagagatggcacacgatatcctgaaggtctgggacggacctgtcgattcggatatcttgttgaaggagtggtccggctcagccctcccggaggacatccactcgacatttaactccttgaccctgcagttcgacagcgacttcttcatctcaaaatcaggcttttccatacagttttctacaagtatcgccgctacttgtaatgatccagggatgcctcagaatgggacccggtatggagactcacgggaggctggcgacaccgtgacttttcagtgcgatccaggatatcaactacagggccaggctaaaatcacttgcgtccagctgaataaccgattcttctggcagcccgatccgccaacctgcattgcagcctgcgggggtaatctgactgggcctgccggagtcatcttatcccccaactatcctcaaccctacccgcctggtaaggaatgtgactggagagtgaaggtgaatcctgactttgttatagcactcattttcaagtcatttaacatggagccatcttacgacttcttgcacatctatgaaggtgaagactccaattctcctctcattggctcctaccagggttcacaggcgccagaaagaatagaatccagtggcaattcgctcttcctagctttccggagtgacgcttccgtcgggctcagcgggttcgctattgagttcaaagagaaaccacgggaagcctgctttgatcctggaaacatcatgaacggtacaagagtagggacagattttaagctgggctcaactattacataccagtgtgactctggctacaagatcttggatccctctagcatcacttgtgtgataggggcagatggaaagccttcctgggatcaagtgctgccaagttgcaacgccccttgtgggggacagtacactgggtctgaaggggtggtcctgtccccaaactatccacacaattatactgcaggccaaatctgcctatacagcatcacagttcctaaagagtttgtggtgtttggacaatttgcctactttcagacggctctcaatgacctggcggagctattcgatgggacccacgctcaagctaggctccttagcagccttagcggctcccactccggagagactctgccgctagctacttctaatcaaatcctgctacgtttttccgccaaaagcggcgcatctgccaggggcttccattttgtgtatcaggcagtgcctcgaacgagcgatacacaatgcagctctgttcctgaacctcggtatggccgacgcatagggagcgaattttctgcaggctccatcgtacggttcgaatgtaaccccggatacttgcttcagggatcaaccgccctacattgccagagcgtccccaacgctctggctcaatggaacgacacaatacctagctgtgttgtgccctgctctgggaacttcacccagaggcgcggtactatactgagcccgggatatccagagccctacgggaacaaccttaactgcatatggaaaatcatcgtgaccgaaggttccggcatccaaattcaggtcatctccttcgcaacggaacagaactgggatagtctagagatccatgacggtggagacgtaaccgcccctcggttgggcagcttcagcggcacgaccgttcctgccttgctgaattctacttccaatcagctttatcttcacttccagtcagacatttcggttgcggctgccggatttcatcttgaatacaagaccgtgggcctggccgcatgccaggagcctgcactgccaagtaatagtatcaagatcggagaccgctacatggttaatgacgtcctcagtttccaatgtgaacctggttacaccctgcagggcaggtcacacatttcgtgcatgcctggtacagtcaggcggtggaactacccatcgccactttgtatcgctacatgcggcggaaccttgtccactcttggcggtgtcattttatcacccggttttcccggaagttaccccaataatctggattgcacatggaggatctccctcccgattggttacggcgcacatatacagtttctgaactttagtacggaggccaatcacgacttccttgagattcagaacggtccataccacacctcccccatgataggacagttcagtgggaccgatctccctgcagctttgctgtccactacgcacgaaacccttattcacttttactcggaccactctcaaaaccgccagggcttcaaactggcctatcaggggggttctggcaacatcggcccagcattcccatgcctcgacacaccatttcaggcacgctgccaaggagaagaacgcacattcaacta

SEQ ID NO: 219504 - DNA, 10163 bp, Artificial Sequence
  Description of Artificial Sequence: Synthetic coding sequence
atgaccgcgtggcggagattccaatctctgctgttgttgctcggactgctcgtattgtgtgccaggctgctgacggcggctaaagggcaaaattgcggcggactggtgcagggtcctaatgggacaatcgaatcgcccggttttccacacggatatcctaattacgctaattgcacctggataatcattactggagagcgcaatagaatccagctgtctttccacaccttcgcccttgaggaagattttgatattttatccgtctacgacggtcagccacagcagggcaacctcaaagtgagattatcaggattccagctaccctcaagtattgtgtcgacgggttccattctgaccttgtggtttactacagacttcgccgtgtcagctcaaggctttaaggcactctatgaggtcctgccctcacacacttgcggaaaccccggagaaatccttaaaggagttctacatggcactaggttcaatataggcgacaaaatccgctattcgtgtctccccggatatattctggaaggccacgcaatcctgacctgcattgtgtcccccggtaacggcgcatcctgggatttccccgcacctttttgcagagccgagggagcatgcggaggcacactcagaggaacttctagcagtattagctcgccccatttcccgtctgagtacgagaataatgccgactgcacttggacaatccttgccgagcctggcgatactattgcactcgtgtttaccgatttccaacttgaggaggggtatgattttcttgagatttctggaacagaagcacccagcatctggctgactggcatgaacctgccctctcctgttatatcctccaaaaattggctccggctgcacttcaccagcgactccaaccaccggaggaagggattcaacgcccagtttcaggtcaaaaaagcaatcgagttgaaatcccgaggagtcaagatgctccccagcaaggacgggagtcacaaaaattcggtgctgtcacagggtggggtcgccctggtatccgatatgtgcccagatcccggaatccctgagaacggtcgtcgggcaggctctgactttagggttggggctaacgtacaattctcctgtgaggataattacgtgctgcaaggaagtaaaagtattacctgtcagcgggttactgaaactctggccgcatggtccgaccatagacccatctgcagagcacgtacttgtggctctaatttgagaggaccttcaggtgtgatcaccagtcccaattacccagttcaatacgaggataatgcacactgcgtatgggtgatcaccaccaccgatcccgacaaagtcatcaaactcgctttcgaggagtttgagctggaacgcggatacgacaccctgaccgtaggagacgccggtaaagttggggacacgcgctcggtgttgtatgtgctgacaggatcttctgtcccagatctgattgtgtcgatgtcgaaccaaatgtggcttcacctacagtcagacgacagcatcggcagcccaggatttaaggctgtttaccaagagatcgaaaagggtgggtgtggcgatccaggtattcctgcatatggtaagagaactggaagttccttcctgcacggggacacactgacatttgagtgcccggctgcatttgagctggtgggcgaacgcgtgattacctgccaacagaacaaccagtggtctgggaacaaaccatcctgtgtctttagttgctttttcaatttcaccgctagcagcgggataattctctcccctaactatccagaggagtacgggaataacatgaactgcgtttggttgattatctccgagccgggaagtcgcatccacctcatcttcaatgactttgatgtggagccccagttcgacttcctggccgtgaaggatgatgggataagtgatatcacagtgctaggaacattctcaggcaacgaggttccgtcacagttggccagtagtggccacatcgtgaggctggagtttcagagtgatcactcaacaaccggcagaggcttcaacattacttacaccacatttggccagaacgagtgccacgaccccggaattcccattaacgggaggaggttcggtgacagatttcttctgggtagctccgtttctttccattgtgacgacggttttgtgaaaacccagggctccgaaagcattacgtgcattctgcaggacggtaacgtcgtatggtcatcaaccgtacctcgatgtgaagcgccatgcggtggccacctgactgcctctagcggggtgatcctgccgccagggtggccaggctattacaaggactccctgcactgcgagtggataatcgaggcgaaaccgggtcatagcattaaaattacattcgacagattccaaacggaggtgaattacgatacattggaggtacgggacggaccggcttccagctctcctcttatcggagagtaccatggcactcaggcccctcagttcctcatttccacggggaattttatgtacttgctgtttaccacagacaacagccggagttccatcgggttcttgatccattacgagagcgtgaccctggagtctgactcatgtctggaccctggaattccagtgaacggacatcggcacggcggagattttggaatccgcagcactgtcactttcagttgtgacccaggatacacactctcagatgatgagcctctcgtttgcgaaagaaaccatcagtggaaccacgcccttcctagttgtgatgctctgtgtggcggatatatccagggcaaatcaggcactgtgctatccccgggtttcccagacttctacccaaattctctgaattgcacttggactattgaagtgagtcatggtaaaggggtgcagatgattttccacacattccacctcgaatcctctcacgattatctgctcatcaccgaagacggatcattttctgaacccgtggcgaggctaaccggttcggtactcccccacacaatcaaggctgggctgtttggaaactttacagctcagctccggttcatttcggatttttcaatcagctacgagggcttcaacatcacgttcagcgaatacgatctcgagccttgcgacgatcctggtgtgcccgcattttcacggaggatcggcttccatttcggggtaggagacagtttgacattcagctgtttcttgggctatcgtctggagggggctactaaactcacgtgcttgggtggcggacgccgtgtgtggtcagctccactgccaaggtgtgttgcagagtgcggtgccagcgtgaaggggaatgagggaacccttttgtccccaaatttcccgtccaactatgacaataatcatgagtgcatctacaagattgagacagaagcgggaaaagggattcatctgagaacacggagttttcagctgtttgagggagatacgctgaaggtgtatgatggcaaagactcttcctccaggcctctgggcacattcacgaagaatgagttgctgggcctgattctgaattccacgtccaaccatctatggctcgagtttaacaccaatggaagcgacacagatcaaggttttcagctcacttacacatcattcgatctcgtgaagtgtgaggaccccggaatcccaaattatggctacagaatcagggacgaaggtcactttactgatacagttgtgttgtactcctgcaacccaggttatgcaatgcatgggtctaacacactgacatgcctcagcggtgacagaagagtgtgggacaagcccttaccctcatgtatcgcagaatgtgggggtcagatccacgctgccacaagtggaagaattctgtcccccggatacccagccccatatgacaataatctgcactgcacttggattatcgaggcagatccgggaaagacaataagcctgcattttatcgtcttcgacacagaaatggcccacgatatcctgaaggtatgggacggcccagtggacagcgatatcttgcttaaggagtggagcggtagcgctctccccgaagatattcacagcactttcaactccctcacgcttcagtttgactcagatttctttatttccaaatccgggtttagcatacagttctcgacaagtatagccgcaacctgcaacgacccaggtatgcctcagaatggaactcggtatggagattcaagagaagcaggtgatacagtgacgttccagtgcgacccaggctatcaacttcaaggccaggcgaagattacatgcgtacagcttaataaccggtttttctggcaaccagacccacccacttgcatcgcagcctgcggcggaaatctaaccggaccggctggagtaatcctatcaccgaactacccacagccctacccacctggcaaagaatgtgactggcgggtgaaagttaacccagattttgtaatcgcccttatattcaagtcctttaatatggagccaagttatgactttctgcatatttatgagggagaagactctaactcacctcttatcggctcatatcagggaagtcaagccccagagagaatcgagtcttccggcaattccctgttcttggcctttcgatctgatgcctcagtcggtctatctggtttcgctatcgagttcaaagagaaacctcgtgaagcttgcttcgatcccggaaatatcatgaatggaacccgcgtggggacagacttcaaacttgggagcacaattacataccagtgcgatagcggctataaaatcctggatccatctagcattacatgcgtgataggagctgatggaaagccatcctgggatcaagtgctcccaagctgtaatgccccatgtggcggtcagtatactggctccgagggggtagtactaagtcctaattacccccataattacaccgccggtcaaatctgcctgtatagtataactgtacccaaggaattcgtcgttttcgggcagttcgcttatttccagactgccctcaatgacctggccgagctctttgacggcacgcatgcacaggctaggcttctgtcttccttgtcaggtagtcactctggcgaaacacttcccctcgccacctcaaatcagatcctgctgagattctccgccaaatctggcgcttccgcaagaggtttccacttcgtgtaccaggccgtgccgcgaacatccgacactcagtgctcatctgtgcccgaaccgagatacggaaggcgcattggcagcgaattcagcgctggatccatcgtccggtttgagtgtaaccccggatatctattacaggggtccacggccctccactgtcagtcagtgcccaacgcacttgcacagtggaatgatactattcctagctgtgtggttccgtgctctggcaatttcacccaaaggcgaggaactatactgagccccggttatccggagccgtatggcaacaatttgaactgcatttggaaaatcatcgtgacggaaggctcaggtattcaaatccaggtcatatcctttgccacagaacaaaactgggacagcttagagatccacgacggaggagacgtgacagctccacggctcggctctttttctgggaccaccgtgcccgctctgctgaactctacatcaaaccagctgtaccttcacttccagtcagatatctctgtagcggctgctgggtttcacctcgaatacaagaccgtagggctcgcagcttgccaggagccagccttaccttcaaactccattaaaatcggtgacaggtatatggtcaacgatgtcctgtcattccagtgtgagcccggatatacactccaggggcgaagtcacatcagttgcatgccgggtactgtacgtcgatggaactaccctagcccgctgtgcatcgcgacttgtggcggaaccctgtcgaccctggggggagtgatcttgtcgcctggctttccaggtagttaccccaataatctggactgcacctggcggatcagccttcccatcggatacggcgctcacattcaattccttaacttttcgacggaagccaaccacgactttctcgagattcagaacgggccttatcacacaagtccaatgatcggtcaattcagcgggaccgatctccctgcagccctgttatcaacgacacatgagactctgatccatttctacagcgatcactcacagaataggcagggattcaagctggcatatcaggcgtatgagcttcagaactgccccgatccccctcccttccagaatggttacatgattaactctgattattccgtcggccagagtgtgtcatttgaatgctaccccggatatattctgattggccaccccgtcctcacctgccaacacggaatcaatagaaattggaattacccttttcctcgctgtgatgcaccttgtggctacaatgtcaccagccagaacgggacaatctattctcccggattccccgacgagtacccaattctaaaggactgtatttggttgatcacagttcctccaggacatggtgtatacatcaatttcactctgctccagacggaagcggtcaacgactacattgccgtgtgggacggtcccgaccaaaattcccctcaattaggggtattctctggaaacacagcattggagacagcgtactcgagcacaaatcaagtcctgctcaaattccattccgacttctctaacggcggattcttcgtgctcaactttcacgcttttcagttaaaaaaatgccaaccaccacccgcagttcctcaagccgaaatgttgacagaggatgatgactttgagatcggcgactttgttaaatatcagtgccacccgggatatacacttgtgggcactgatatccttacttgtaagctctctagtcaactgcagtttgagggatccctacctacgtgcgaggcacaatgcccggctaacgaggtgaggactggctcatccggcgtgattctctctcctggctacccaggaaattattttaactcccaaacctgcagctggtccatcaaggtggagcccaactataacattaccattttcgttgacacttttcaatctgaaaagcaatttgatgccctggaggtgtttgatggcagctccggacagagtcccttgctcgttgtgttgtcaggcaaccataccgaacaaagcaactttacttctcgttctaaccagctgtatctgcggtggtctactgatcacgcaacctctaaaaagggtttcaagatacggtatgcggctccatactgttctttaacacatccattaaagaacggaggcatcctcaatcggaccgcaggtgctgtcggatctaaggtgcattacttttgtaagcccggatatcggatggtgggacacagcaatgctacatgcagaaggaatccgctcggtatgtaccagtgggattcgcttacgcctttgtgccaggctgtaagttgtggaattcccgagagcccaggaaatggtagcttcactggcaacgaattcaccttggactctaaagttgtatacgaatgtcatgaggggttcaaactggagtcttcacagcaggctactgctgtctgccaggaggatggtttatggtccaataaggggaaaccacccacatgtaagccagtcgcatgtccctctattgaggctcaactgtctgagcacgtaatatggcgtctagttagcgggagcctgaacgaatatggagcacaggtgctcctgtcctgcagccccggttattatctggaaggctggaggctgttgagatgccaagccaatggtacttggaatataggggacgaacgaccgagctgccgggcaggacactgtggatctcccgatcccattgttaacggacatatctcgggcgacggtttcagctaccgcgatacagtggtatatcagtgtaatcccggatttcgcctcgtcgggacatcagtgcggatatgccttcaggaccacaagtggtccgggcagactcccgtctgtgtcccaataacttgtggacatcctggaaatcctgcgcacggtttcaccaacggctctgaatttaatttgaatgatgtggtgaactttacttgtaatacagggtatctgctacagggcgtcagccgtgcgcagtgccggtctaacggccagtggagtagtcccctgcccacttgccgcgtcgtgaactgctctgacccaggcttcgtggaaaatgccataagacacggccaacagaactttccagagtcatttgagtatggcatgtctatcctatatcattgtaagaagggcttctacctcttgggttccagtgccttaacttgtatggctaatggcctgtgggaccgcagcctgccaaagtgtctagccatcagttgtggccaccccggagtgcccgctaacgccgtcctgacaggcgagctttttacttacggcgcagtggtacattactcctgtcggggaagcgagtctctcatcggcaatgacaccagggtgtgccaagaggatagtcattggagcggcgctcttcctcactgtaccggtaataatcctggcttctgcggtgatccaggaactcccgctcacggcagtaggctgggtgacgatttcaagactaaatctctccttcgcttctcatgtgaaatggggcatcagttgcgagggagccccgagcgcacatgcctgctgaatgggtcgtggtccggattgcagccggtctgtgaagctgtgctgtgcccccaacccccacccgtccagaacggaaccgtggaaggttctgacttccgttggggatccagtatctcttactcctgtatggacggctaccagctgtcccactctgccattctctcctgtgagggacgtggagtctggaagggcgaaatccctcaatgtcttcctgtattctgtggagaccctggcattcccgcagaggggagactgtctggaaagtcctttacatataaaagcgaggtgttcttccagtgcaagtcacccttcatcctcgtgggcagcagccgcagagtgtgccaggctgatggcacctggtctggtatccaaccaacttgcatcgacccagcccacaatacctgtcccgatccaggaactccacactttggcatccaaaattccagccggggatatgaagtcggatctacagtctttttcagatgccggaaaggctatcatatccagggttcaacaaccaggacatgcttggcaaacctcacttggagcggcattcaaactgagtgcatacctcacgcttgccggcaaccagagacgccagcccacgccgacgtccgggcaattgacttaccaacatttggatatactctagtgtatacctgtcatcctggcttcttcttggcaggcggatccgagcaccgtacctgtaaagccgatatgaaatggaccggtaagtcaccggtttgtaaaagcaagggcgtccgggaagtcaatgaaactgtgacgaagacacccgtcccatctgacgtgttttttgtgaacagcctatggaaggggtactacgagtatctgggtaaacggcaaccggcaacactcacagtcgactggttcaatgcaacatctagtaaggtcaatgcgacttttagcgaggcgtctcccgtggaacttaaactgacgggcatctacaaaaaagaggaagctcatctgctgctcaaggctttccagatcaagggacaggctgacatttttgtttctaaattcgagaacgacaactggggcctggacggatacgtctctagtggattggaacgcggaggcttcaccttccagggggacatccatggcaaggactttggcaagtttaagctcgagaggcaggaccctcttaaccctgaccaggattcctcaagccactatcatgggacttcttccggctctgtggctgcagccatcctggtcccgttctttgctctcatcctcagcggctttgccttctatctgtataaacatcgtactcgacccaaggtgcagtacaatgggtatgcgggtcacgagaactcgaacggccaggccagcttcgagaatccgatgtacgacaccaatctgaaacctaccgaggcgaaggcagtgcggtttgacaccaccttaaacactgtttgtacggtcgtata

SEQ ID NO: 219505 - DNA, 10464 bp, Artificial Sequence
  Description of Artificial Sequence: Synthetic coding sequence
atgaggttaatcagcattgccccaggcccacgctggcaggtgcagagtcaccatcctagatccgcgggtcaaaattgtacttttcagctgcacggcccaaacgggaccgtagagtcacctggatttccctacggctaccctaattacgccaactgtacttggacgattacagcagaagagcagcacagaatccaattagtgttccagtcattcgccctggaagaagactttgatgtcttgtccgtctttgatggtccaccacagcctgagaatttaagaacacgactgaccggcttccaactgcccgctacgatcgtgtccgccgctactacgctctcactccgattaatctccgactacgcagtgagcgcgcaggggttccatgccacctatgaagttctgcccagtcacacatgcggcaatcccggtaggctcccaaacggcatccaacagggatctacattcaacctgggcgataaagtcagatactcctgcaatttaggattcttcctcgaaggacacgccgtcttaacatgtcatgctggttctgaaaatagcgccacctgggacttccccttaccttcctgcagggcggacgacgcgtgtgggggaacgttgcgcggacagtcagggattatatcttctcctcattttcccagcgagtaccataacaatgccgattgcacttggaccatcctggccgaactgggagacaccatcgccctggtctttatcgatttccagctcgaggatgggtatgatttcttggaggtcacaggtaccgagggaagctctctgtggttcacaggagcttctcttccagcgccagtcatctccagcaaaaattggctgcgtctccacttcacaagcgacggcaatcataggcagcgaggattttctgcccagtatcaagtgaaaaaacaaatcgaacttaaatcacggggagtcaaactcatgccatcgaaagataacagtcagaaaacaagtgtgctcactcaggtgggggtctcccaaggtcataacatgtgcccagaccccggaattcccgagagggggaagaggctcggaagcgactttaggttaggctcctccgtgcagtttacttgtaatgagggctacgaccttcaggggagcaaacggattacatgcatgaaggtgtccgacatgttcgccgcttggagcgaccatcgaccagtgtgccgcgctagaatgtgtgacgcacacttacgcggaccatcaggaatcattacttcacctaatttccctatccagtacgataataatgctcactgtgtgtggattattacagccctgaacccatcaaaggtgattaagctggctttcgaggaatttgacttggaaaggggatacgatactcttactgtcggtgatggcggtcaagacggcgaccagaagaccgtcctgtacattctaaccggcaccagtgtccccgacttgattgtgagcaccaaccaccagatgtggcttttgttccagacggacgggagcggatcaagccttggattcaaggcctcatacgaggaaatcgagcagggcagttgtggtgatcccggaattcctgcctacggacgacgtgaggggagcaggttccaccacggggacacgttgaaattcgaatgccaaccagcctttgagttggttggacaaaaagccataacttgccagaagaataatcagtggagtgcgaagaaaccaggttgtgtatttagttgtttctttaatttcacaagccctagtggcgtagtcctgtccccaaattatccggaagattacggcaaccacctgcactgcgtgtggctcatcctggcccgacctgaatcacgcatccacctagcgttcaatgacattgacgtcgagccacaattcgattttctcgttatcaaggacggggcaacggcagaggcgcctgtcctgggaaccttttcaggaaatcaattacctagctccatcacatcaagcgggcacgttgccaggcttgagtttcaaacagatcacagtaccgggaaaaggggattcaatattacctttacaaccttccgccacaacgaatgtcccgaccctggtgtaccagtcaacggtaagaggttcggtgattctctgcaactgggcagtagtatttccttcttatgcgacgagggctttcttggaacccagggaagtgaaaccatcacttgtgttctcaaagaggggagcgtggtctggaattctgctgtgttgcgctgcgaagcaccctgtggtggacacctgacaagcccaagtggcaccattctttcccccggttggcccggtttctataaggatgccctgtcttgcgcctgggtcatagaggctcagccgggataccctattaaaattaccttcgatagattcaaaacagaagttaactatgacacgctggaggtccgggatgggagaacatactcggcgccactcattggcgtctaccacggcactcaggtcccccaatttttgattagtacaagcaactatctgtacctgctgttcagtactgataagtcgcattccgatataggttttcaactccggtacgaaactatcactttgcagtctgaccactgcctggacccgggaatacctgtgaatggccagcgccacggcaatgacttctacgtgggcgctttagttactttcagctgcgattctggctacacactctcagacggagagcccttggagtgtgaacctaacttccaatggagtcgcgcactcccatcttgcgaagctctctgtggcggttttattcagggatcttccggcacaattctatcacctggctttccagacttctatccgaataaccttaattgtacatggataatcgagactagccatggaaagggcgtgttcttcacatttcacacttttcacctcgagagcgggcatgactacttgctgatcacagagaatgggtccttcacccagccattgcgtcagctgaccggcagcaggctccccgctcctatcagtgcaggcctgtatggcaattttactgctcaagtccggttcattagcgatttctctatgagttacgaaggtttcaatatcacatttagcgagtatgatctggaaccttgtgaagagcccgaagtaccagcctacagcattcgcaaaggacttcagttcggggtcggcgacactttaacttttagttgcttccccggttaccggcttgaaggcaccgcaagaattacctgcctgggcggacggagacgattatggtcgtcgccacttcccaggtgcgtcgccgaatgtggcaattccgttaccgggactcagggcacactgctctctcccaattttccagttaattacaataacaatcatgaatgtatatatagcatccagacacagcctgggaaaggtatccaactaaaggcccgagccttcgagttatcagaaggagacgttctgaaagtctacgacggcaacaataactcagccagacttttaggagtcttctctcattcagagatgatgggcgtgacccttaatagcaccagctcatcactatggcttgacttcattacagacgcggaaaacacctcaaaggggttcgagttgcatttttcttccttcgagctcatcaaatgcgaagacccaggaaccccaaaattcggatacaaggtccacgatgagggacacttcgccggatcctcagtgagcttctcctgcgacccaggatattccctgaggggttctgaggagctactgtgtctctcaggggagcgaaggacgtgggaccggcctttgccaacctgcgtggctgaatgcgggggtaccgttcgcggagaggtaagcggacaggtgttgagcccagggtaccccgctccctatgaacataacctgaattgcatttggacaattgaagccgaagccggatgtaccatcggcctccacttcctcgtgttcgacaccgaagaagtgcacgacgttctgcgaatttgggacggcccagtggaatcaggtgtgctgcttaaagagctgagcgggcctgccctccctaaggacctgcactcaacattcaacagcgtggtcctacagttcagcacagacttttttacatccaaacaaggtttcgccattcagtttagcgtgagcactgctacttcttgcaatgatcctggcataccccagaatggttctcgcagtggggatagttgggaagccggtgattctaccgtgtttcagtgtgatcccggatacgctctgcaggggtccgctgaaatatcttgtgttaaaatcgaaaataggttcttctggcagccctctccacctacgtgtatcgcaccctgcggtggggacctgactggcccttccggcgttattctgtcgccaaactaccccgagccatatcctcccggtaaagaatgcgattggaaagtgactgtcagcccagattacgttattgctctggtgtttaatatttttaatttggaaccaggctacgactttctacacatctatgacggtcgcgacagtctgagtcctctaataggatctttttatggctcacagctgccgggacggattgagagtagcagcaattccctctttttggcctttcgctcagacgcctccgttagcaacgcaggattcgtcatagattataccgagaatccaagagaatcttgctttgatccaggttctattaagaatgggacccgggtcggaagtgacctcaagctgggctcttcagtgacttactactgccatggtggatacgaggtagaaggcaccagcaccctcagttgtatcctgggcccagatggaaagcctgtttggaataaccccaggccggtttgtaccgcaccatgcgggggtcagtacgtcgggtctgatggcgtggtgctctcccctaactatccgcaaaattacacctcagggcaaatttgcctgtatttcgtgaccgttcccaaagactacgtggtcttcggtcagtttgctttttttcacaccgccctgaatgatgttgtggaagtgcatgatggccactctcagcattctcgcctcctgagttctttgtccggcagtcatactggggaaagcctgccattggctacatccaatcaggtgctgatcaagttcagcgcgaaggggttagcaccagcgcgtggtttccatttcgtgtaccaggccgtcccgaggacttccgccacacagtgctcatctgttccggaaccacgctacgggaaacgccttggctcagacttctctgttggcgctatagtgcgcttcgaatgcaattccgggtacgcacttcaaggctctccggaaattgagtgcctgcctgtcccgggagccttggcccaatggaatgtttccgccccaacttgtgtagtcccatgtggtggcaacttaaccgaacggagggggaccatcctgagccccggtttccctgaaccttacctgaacagcctaaactgcgtgtggaagattgtcgtgcccgaaggcgctggcatccaaattcaggttgtgtccttcgtgaccgaacagaattgggattcactggaggtattcgatggggctgacaacacagtgacaatgctggggtcattcagtggcacgaccgttcctgccctgctgaactcaacctccaaccagttgtatttgcacttttatagcgatatctccgtgagcgccgcaggatttcacctggagtacaaaaccgtgggactgagttcttgtcccgagccggcagtgccttccaatggtgttaagacaggagagaggtatttagtcaatgatgtagtgtctttccaatgcgaaccaggatatgccctccaaggtcatgcacacatttcttgcatgccaggaaccgtgaggagatggaactaccctccacctttatgcatagctcagtgtggaggcacagtggaggagatggaaggcgtgattttgtctccagggttccccggaaattacccttccaatatggattgttcttggaagattgccctgcccgtggggtttggggctcacattcagttcctgaacttttcaaccgaacctaaccacgattatatcgagataaggaatggaccctacgagacgagcagaatgatgggtcgctttagtggctccgagctgccttcatcgctcctgagcacgtcacacgagactaccgtgtatttccactctgaccacagccagaaccgcccagggttcaaactagagtaccaagacctcacctatagtcatcaaatctctagctttcttcgcggtttcgatctgtctgagttggagaggaccaacagtacaccgcctgtagcagcctcctacgtctgggaccttgatccaggatgcgaagcctacgagctccaagaatgcccggaccccgagccatttgccaatggaatcgtgcgcggagcagggtacaatgttggtcaatccgttacttttgaatgcctaccaggttatcaactgactggtcatcctgtgctcacgtgccagcatggtacaaatagaaactgggaccacccgctcccgaagtgcgaggtgccgtgcggagggaatattacttcatctaatggcacagtttattcacccggattcccgtcaccatattcctcctctcaggattgcgtctggttaatcacagtgccaatcggccatggagtcaggctcaacctgtcactgcttcaaactgagccctctggggactttataacaatctgggacggcccacaacagacagctcccagacttggcgtgttcactcgatccatggctaaaaaaaccgttcagagctctagcaaccaggtgctgctgaaatttcacagagatgccgcaaccgggggtatcttcgccatcgccttctctgcctatcctctgacaaagtgtcctcctccaactatacttcccaatgctgaagtggtgactgaaaacgaagaatttaatatcggagacatcgtccgttatcgatgcctccctggcttcaccctggtcggtaatgagatcctgacctgcaaactggggacctatcttcaattcgagggaccccctcccatttgtgaggtgcactgtcctacaaacgaattgttgacagactccacaggcgtgattctatcccagtcctacccaggtagctatccccaattccagacttgctcatggcttgtacgcgtcgaaccagattacaacattagtcttactgttgaatactttctgtcagaaaagcagtatgacgagtttgagatctttgacggcccttctggccagagcccactcctcaaagcactcagcggcaactattctgccccactcattgtgacatcaagctccaattctgtgtatctcaggtggtcctcagaccatgcctacaaccggaaaggctttaagatcagatacagtgctccttactgttcccttccaagagccccacttcacggttttatccttggacaaacttctacgcaaccaggaggttccatccacttcgggtgcaacgctggataccggttagtgggacatagcatggcgatttgtacccgccaccctcaggggtaccacttgtggagtgaagccatacccctctgtcaagctctgtcatgtgggctgccagaggcacccaagaatggcatggtgtttggcaaagaatatacagtcgggactaaagcaatgtatagctgcagcgaaggttaccacctacaagctggcgcagaggccaccgccgaatgcctcgatacaggtctgtggtctaacagaaatgttcctccgcagtgtgtgcctgtgacctgcccggacgtaagcagtatttctgtggagcatggcagatggagactgatattcgagacgcaataccagttccaagcccagcttatgctcatttgcgacccgggatattattacaccggacagagagtcatccgatgtcaggcaaatggcaaatggtctctgggcgacagtacccctacttgcaggatcatttcatgtggcgaattgcccataccccctaatggacaccgtatcggaaccctgtctgtctatggcgctactgctattttttcctgcaacagtggctacacgctggtgggctcgcgggtgcgagagtgcatggctaacgggctgtggagcggtagcgaagttcgctgcctggccggacattgcggcacccccgagcctattgtcaacgggcacatcaacggcgagaactatagctaccgagggagtgtggtgtatcaatgtaacgcaggattccgactgatcggaatgtctgtaaggatttgtcagcaggatcaccattggtctggtaaaactcctttttgcgtgttagtgagctgcggccatccaggatcgccaccccatagtcagatgtcaggcgactcttacacagtaggggctgtcgtgagatactcctgcataggaaagaggactctagtgggcaattccacccgaatgtgtggactggacggccattggaccggctcgctcccgcactgctctggaacgagcgtgggcgtctgcggtgatccagggatccccgcacatggaatcagactgggtgacagcttcgacccaggaactgtgatgcgattttcttgtgaggccggtcatgtgttgcgcggatcctccgagaggacttgccaggccaacggaagctggagcggcagccagcctgagtgtggtgttatcagttgtggcaatccagggacaccgtctaacgcccgagtggtctttagcgacggcctggtgtttagcagcagcatagtttatgagtgtcgagaaggttactacgcgactggactgctgagtcgccactgtagcgtgaatggaacgtggaccggtagcgacccagagtgtctcgtcattaattgtggggaccccggaattccggctaacggactgaggctggggaatgatttccgctataataaaaccgtcacctatcagtgtgtccccggatatatgatggaatcccacagagtcagcgtgctctcttgcacaaaggatcgaacatggaacggaaccaaaccagtctgcaaagcactgatgtgtaaacctccacctttgatcccaaacgggaaagtcgttggatctgacttcatgtggggaagtagcgtaacgtacgcctgcctcgaaggttaccaattgtcactcccggctgtgtttacctgtgaagggaacggctcttggaccggagaattgccacagtgtttccctgttttctgtggagatcctggagtgcccagtagaggacggagagaagacagggggtttagctatcgtagctcagtcagttttagctgtcacccacccctggtgttagtcggctctccaagaagattttgccagagtgacggcacttggtctggcacccagccatcatgcattgatccaacactcaccacctgtgccgacccgggtgtccctcaatttgggatccagaataattcacagggctatcaggtggggtcgaccgtgcttttccggtgccaaaagggttatttacttcagggatcgaccacacgcacgtgcctcccaaatctgacatggtctggcacacccccagactgcgtgccccaccattgccggcagcctgagactccgactcacgccaacgttggcgctctagatctgccgtctatgggctatacgttgatctactcctgccaagagggatttagccttaaggggggatctgagcacagaacctgtaaggccgacggatcttggacaggcaaaccgcctatttgtctagaagtgcggccaagtggccgaccaatcaataccgccagggagccgccactcactcaggcactcattcctggtgacgtgttcgccaaaaactccctgtggaagggagcgtacgaatatcaaggaaagaagcaacctgctatgctgcgggttacagggttccaggtcgctaattcaaaagtgaacgccactatgatcgaccactccggagttgagctccatctggctggaacgtacaagaaggaagatttccacttattgctgcaggtctaccagatcacaggacccgtggagatcttcatgaataaattcaaggacgatcactgggcactggacggccatgtttcttctgagtcctccggcgctactttcatctaccagggctccgtgaaaggacaaggatttggacagttcgggtttcagcgcctggatctacgtctgctcgagtcagaccctgagtcgataggccgacacttcgcaagcaattcttccagcgtggcagccgctatcctggtgcctttcatcgctctgattattgccggttttgttctgtacctttataagcacaggagacgacctaaggtgccattcaatggctatgcaggtcacgagaataccaacgttcgagcaaccttcgagaaccctatgtatgacagaaacatccagccaacagacataatggcatccgaggccgagttcacagtctctaccgtttgtacggccgtctaa

SEQ ID NO: 219506 - DNA, 678 bp, Artificial Sequence
  Description of Artificial Sequence: Synthetic coding sequence
atgtgtgatgcccatctcaggggcccatctggaatcataaccagcccaaattttcccatccagtacgataacaacgcacactgtgtatggataatcaccgccctgaacccttccaaggccggaggagatcccggaaatattcagtgcaataaagagggcttgtctgtggaaacgcagtccctgcggctacgaaatagatcctgtctcttgggaaattcaaaagataacggctgttgcgttccaaacccggtccatggcactgggctgcaggtgattaaattagccttcgaggagttcgatctagagcggggatacgataccctcaccgtgggtgacggaggacaggacggggatcagaaaacagtcctgtatattctgactgggacatccgtgccagatcttattgtgtcaacaaaccaccagatgtggctcttgtttcaaactgatggttcaggcagcagcctgggatttaaagccagttatgaagaaatcgagcaagggtcctgcggggacccaggcatacctgcatatgggagacgggagggaagccgtttccatcacggcgatactctaaaatttgaatgccagcctgcattcgaattagtcggccagaaagctattacatgccagaagaataatcagtggtccgccaagaaacctggatgtgtgtgtaagtag

SEQ ID NO: 219507 - DNA, 1281 bp, Artificial Sequence
  Description of Artificial Sequence: Synthetic coding sequence
atgttgggatccttctcagggaccacggtgccagccctgctgaatagtaccagtaaccagctttacctccatttctattcagacatctccgtgtcagccgcaggatttcacctagaatataagactgtgggcctctcctcgtgccctgagcccgctgtaccatctaacggcgttaagacgggcgagcgttatctggtcaatgatgtggtttccttccagtgtgagcccggttacgccctgcagggccacgctcacattagctgtatgcccggtaccgtgaggcgctggaactatccgcctccgttgtgtatagcccagtgcggaggcaccgttgaggaaatggaaggagtcatcttatcccctggattcccaggaaattatcctagcaatatggattgttcgtggaaaattgccctccccgtaggcttcggtgcccatatccagtttctgaacttctccaccgaacctaatcatgactatatcgagattcggaatgggccttacgagacgtctagaatgatgggaaggttctctgggagcgagttgcccagttcattgctcagtacttctcacgagaccacagtgtactttcacagcgatcatagccagaacaggcccggatttaagctcgagtatcaggcgtacgagcttcaagagtgcccagatccggaacccttcgctaacggcattgtgcgcggagcaggatataatgtgggtcagtcagtcacattcgaatgtttgcctggttaccaactgactggccatccagttctgacctgccagcatggcaccaaccgcaattgggaccatccccttccaaaatgcgaggtgccatgcggaggcaatatcaccagttccaacggaaccgtatactcccctggattcccatccccttactccagctcgcaggattgcgtttggctcatcaccgttccaattgggcacggcgtaagactcaatctgtccctcttgcagaccgaaccttccggagactttatcacaatatgggacggcccacagcagactgcgccaaggctcggagtcttcacccggagcatggctaaaaagaccgtccagtctagtagcaatcaggtgcttctgaaatttcaccgcgatgcggctacgggagggatattcgccatcgcctttagcgatcactgccggtacttcaatcagaaatctgggaagctggactttaccccctcctccaccctggggcagctgtgtaaaacattacatcgtagtctccctcacctgcgactccagtttttacacctgtag

SEQ ID NO: 219508 - DNA, 3504 bp, Artificial Sequence
  Description of Artificial Sequence: Synthetic coding sequence
atggtcatcgtcattcttttccccgctgaatgcggaaactctgtgacgggaactcaggggacactgctgtcgcctaactttcccgtcaactataacaacaaccacgagtgcatctatagcatccaaacacagcctgggaagggtattcagctgaaggcgcgagccttcgaactctctgaaggcgatgtacttaaagtgtatgacggcaataataattcagctcgcctgctgggtgtgtttagccatagcgagatgatgggcgtaaccttaaattcaacgtcgtcatccctctggctcgactttatcaccgacgcggagaatacaagtaaaggtttcgaactccatttttcgagctttgaactgatcaaatgtgaagatcccggtacacctaaattcggctacaaggtccatgacgaggggcacttcgccggatcatccgttagcttttcctgcgatcctgggtattcactccgtggatcggaggaactcctgtgcctctcgggggaaaggagaacctgggatagacccctcccaacctgcgtcgccgagtgcggcggaactgttagaggagaggtgtcaggtcaagtgctgtctccaggataccctgcaccgtacgagcacaacctcaactgtatttggacaatagaggcagaggccggatgcacgataggcttgcatttcctagttttcgatacagaagaagttcacgacgtcttgcgcatttgggacggcccagtggagtccggagttttgctcaaagagctgagcggaccagcactgccgaaggatttacattccactttcaattcagtcgtactgcagttctcgaccgactttttcacgtccaagcagggctttgcgattcagtttagtgtgtcaaccgcaactagttgcaatgatccgggaattccccagaacgggtctcgctctggcgacagttgggaagccggagactccacagttttccaatgtgaccctggctacgcgctccagggatcagccgaaatcagctgcgtgaaaatcgaaaatcgtttcttctggcagcccagccctcccacatgcatagctccttgcggcggagatcttaccgggccaagcggggtcattctaagccccaattaccctgagccctatcctcctggaaaggagtgtgattggaaagttaccgtttctccagattatgtcatagcactggtgttcaatatattcaatctggagcctgggtatgactttcttcatatttatgatggtcgggacagcctgagcccactgattgggtcattctacgggtcacagctgcctggacgcattgagtctagtagtaactcactgttcctagcattccggagcgacgcctcggtttcaaatgccggattcgttatcgactacaccgagaaccctcgggagtcgtgttttgaccctggaagtattaagaacggcaccagggtcggatctgacctgaaactgggctcctccgtgacgtattattgtcacgggggatacgaggtggaagggacttcaacactgtcctgcattctggggcctgatggcaaaccggtctggaacaatccgaggcccgtttgtaccgcaccttgcgggggacagtatgtcgggagcgacggcgttgtcctgagtccgaattaccctcaaaattataccagcggacagatatgcttgtatttcgtgaccgtccccaaggattatgtggtgtttggacaattcgccttcttccacaccgctctaaacgatgtggtcgaagtgcacgacggccattcccagcattctcggctcctaagcagcctgtccggtagccatacaggagaaagcctcccactggctacttctaaccaggtgctcatcaaattcagcgctaagggtttggcacccgctagaggatttcacttcgtgtatcaagccgtcccaagaacgagtgctacacaatgtagtagcgtcccagagcctcgatatggcaagagactcggtagcgactttagtgtgggtgctatcgtgcgattcgaatgcaactctgggtacgccctccagggttctccagaaatcgagtgcctgccggtgccaggcgctcttgcccagtggaacgtatcagcccctacttgcgtggtgccttgtggcggaaacttaactgaacgcagggggacaatcctatcacccggatttccggagccctatcttaatagcttgaattgcgtctggaaaatcgtggtgcccgaaggcgctggtatccagattcaggtggtttctttcgtgacggaacagaattgggactcccttgaggtgttcgacggcgctgacaacaccgtcaccatgttgggctctttttcaggtactactgtgcccgctctgctgaactctaccagcaatcagctgtacctccacttctattcagatatctctgtgtccgccgcaggcttccacctggagtacaaaactgtcggtctgtcttcatgccccgagccagcagtaccgtctaatggcgttaagacaggagagcgctatctggtgaacgacgtggtatcattccaatgcgaacccggatacgctctgcagggccatgctcacatctcctgcatgccaggaacggtccgacggtggaactacccaccacctctatgtatcgcacaatgcgggggtacagtggaggaaatggaaggggtgatcttatctcccggttttccagggaactatccatccaacatggactgcagctggaaaattgcgctgcctgtggggtttggcgcacacattcaattcctgaacttttcaaccgagcccaatcacgattatattgaaattcgcaatggaccctacgaaactagtagaatgatggggagattcagcggcagtgagctacctagctcgttgctgagtacgtctcacgaaacgactgtgtatttccactctgatcacagccaaaatcgcccaggatttaagctagagtaccaagcttacgaactgcaagaatgcccagatccagaacccttcgccaatgggatcgtccgaggggcagggtacaacgtaggacagagtgtgacttttgaatgcttacctggataccagctgaccggccacccagtcctgacttgccagcacggcacaaaccgcaattgggaccatcccctcccaaagtgtgaagtcccatgcggagggaacataactagttctaatggaacagtgtatagtcccggtttcccctctccatattcgtccagccaggattgtgtctggctgataaccgtgcccatcggacacggggttagactgaatctctcccttctacagacagaaccttccggcgacttcattaccatatgggacggccctcaacagactgcccctcgcttaggcgtgttcacacgctccatggctaagaaaacagtacagtcttcatccaaccaagtgttgttaaaattccacagagacgccgcaactggaggcatttttgcaatcgcattcagtgggcacctggccgctgtatgcacactgtag

SEQ ID NO: 219509 - DNA, 10896 bp, Artificial Sequence
  Description of Artificial Sequence: Synthetic coding sequence
atgccacggtctcgcggtagagagcttggacgatgcggttgtcctgcgggacgggctcgcggtgagactgggatatctgcactggtcccaggcgcagggagccgctggggccgacctccccctcctaccccacccccactcttgctgttactcggctgcggacttttatcagtgtccgcagcagccggacagaattgcacgtttcagctgcacgggcctaatggtaccgtggagtcgcccggatttccatacggctatcccaattatgccaattgcacatggactatcacagctgaggagcagcaccggatccaactggttttccagtcgttcgctctggaagaagactttgacgtactgtccgtgttcgatggtccaccccagcctgaaaatcttaggactcgcctgaccggattccagctcccagcaactatcgtcagtgctgccaccaccctctctctacgcctgatcagtgactacgcagtatctgctcaagggttccacgccacctacgaagtccttccatcccatacatgtgggaatccaggacgcttgcccaatggaatccagcagggatcaactttcaacctgggcgataaggttagatactcttgcaacttgggttttttcttggaaggccacgcagtgctgacatgtcatgccggtagcgagaatagcgccacttgggactttccgctgccatcatgccgtgcggatgacgcctgtgggggtaccctgcgcggacagagcggcataatttcttccccccactttccttccgaatatcacaataatgctgactgcacctggactattttggcagagctgggcgacactattgctctggtgtttatcgacttccagctcgaggacgggtacgactttctcgaggtcactggtacagaagggtcctcgctgtggttcacgggggcttcactgcctgcaccggttatatcctctaaaaattggctgagattgcacttcacctcagatggtaaccataggcagcgcggattctcggctcaatatcaagtgaaaaaacagatcgagctgaagagtagaggcgtgaagttgatgcccagcaaagacaattcacagaagacttccgttctgactcaggtgggagtttcccaaggtcataacatgtgcccagacccgggaatccccgaacgcggaaagcgcctcggatccgacttcaggttgggatcatccgtccaatttacttgcaacgaaggttatgacctgcagggttcgaagcgcattacttgcatgaaggtttcagatatgtttgcagcttggagcgatcacagacccgtgtgccgtgccagaatgtgtgatgcgcatctccgcggtccctctggcatcattacctcccctaattttccaattcaatacgacaacaacgcgcactgtgtctggatcataaccgctctgaatccttcaaaagtgatcaagctggcatttgaggagttcgacttggagcgaggctatgacactctcactgttggggatgggggacaggacggcgatcaaaagacagtgctgtacatcctgaccggcacttctgtcccagatcttatcgtctcaacgaatcaccagatgtggctactattccagacagatgggagtggaagctccttaggcttcaaggcctcatatgaggagatcgagcagggatcctgtggggatcctggcatcccagcttacggaaggcgcgaggggagccgcttccatcatggagacaccttaaagttcgagtgccagcccgcatttgaactcgtagggcagaaagctataacctgtcagaaaaacaatcagtggtcggccaaaaaacccggatgcgtgttcagctgcttcttcaacttcacttctccaagcggcgtagttttatcacccaattatccggaggattacggcaaccatctgcattgtgtgtggctgattcttgccaggccggagtcaagaattcatctcgccttcaacgacatcgacgttgaaccccaattcgatttcctggtaattaaggacggggcaaccgctgaggcgcctgtgctcgggacttttagcggcaatcagctgcccagctccatcaccagctctggacatgtcgccaggctggagttccagacagaccactccacaggcaagcgcggattcaatattacttttacaacatttagacacaacgaatgtcctgaccccggtgttccggtgaatggcaagcggtttggcgatagtcttcagttggggtcttccatttcttttctctgtgacgagggattcctgggcacccaggggagcgagaccataacttgcgtcttgaaggaagggtccgttgtgtggaattccgcggtccttcgatgcgaagccccatgtgggggacacctaacctccccctccggaactattttgagtcctggctggcctggcttctataaagatgcattaagctgtgcctgggtgatcgaggctcagccaggttatcccattaagatcacatttgatagattcaaaaccgaggtgaattacgacacacttgaagtgagagacggccgtacctattccgccccactaataggcgtctaccatgggactcaggttccacagtttctgatttctaccagcaattacctctacctgctgttcagtactgataagtctcattccgatatcgggttccagcttcggtatgaaaccatcaccttgcagtccgaccattgtctagatccgggaatccccgtcaatggtcagagacatggaaacgacttttatgtcggtgcgctggttacttttagctgcgactccggctacacactttcagatggagaacctctggaatgtgagcccaattttcagtggtctagggccctcccttcctgtgaagccctgtgtggcggatttattcaggggtctagtggcactattctttctcctggtttccctgacttttacccaaataacctgaattgcacatggattatcgagacatcgcatgggaagggcgtgttttttacttttcacacgtttcacctggaatctggacacgactacctgctgatcaccgaaaatggttctttcacccaaccgctgagacagctaaccggatcgaggctacccgcacctatcagtgcaggcctttacggcaacttcacagcccaggtgcgattcatcagtgatttctctatgtcatatgaggggtttaacataactttttctgagtatgatcttgagccgtgcgaggaaccggaggtacccgcttacagcataaggaaggggttacagtttggagtgggtgacaccctgaccttttcctgctttcccggttataggcttgaaggtaccgctagaattacatgtttaggtggacgcagaagactgtggagctccccactcccccgatgtgtggcagagtgtggaaattccgtcactggaacgcagggaacacttttgagtccaaatttcccagtcaactacaacaataaccatgaatgtatatactcaattcaaacccagcctggaaaggggatccagctcaaggcacgggctttcgagcttagtgaaggtgatgtgttaaaagtatacgacggaaataacaactcagctcggctgcttggcgtgttctcccactccgagatgatgggcgtgacacttaactccacgtccagctcactatggttggatttcattaccgatgccgagaacacatccaaaggatttgaactgcacttctcctccttcgaattgatcaagtgtgaagaccctggtaccccgaagtttggctacaaagttcatgacgaaggccattttgccggaagttcagtcagcttctcatgtgaccctggttactcgctgcgtggaagcgaggaattactctgcctgtctggagaaagaaggacctgggataggcccctgccaacttgcgtagcagagtgcgggggtactgtgcgaggggaagttagtgggcaggtgctgtcccccggttaccctgcgccttacgagcacaatctcaactgcatttggaccatagaggcagaggcaggctgcaccataggcttgcatttcctggtcttcgatacagaagaggttcatgatgtcctccgtatttgggatggaccggtcgagagcggggtgctgctgaaggaactatcgggcccagctttacctaaagatcttcatagcactttcaattcagttgtgctgcaattctccacggactttttcacttcgaaacagggcttcgcaatccaattctcagttagcacagccacctcctgcaacgatccaggcattccacagaacggaagtcggtccggggatagctgggaggcaggagactcaaccgtattccagtgcgatccaggctatgccctgcagggaagtgctgagattagctgtgtgaaaatagagaataggtttttctggcagccgtcaccacctacatgcatcgccccttgcgggggagatctgaccggccctagcggagtgattctgtctccaaattaccccgaaccgtaccccccaggtaaagaatgtgactggaaggtcacagtctcgcccgactacgtgatcgctcttgtcttcaatatcttcaacttagaaccagggtacgacttcctacacatctacgatgggagagatagcttgtctccccttatcgggtcattctacggtagccagctgccaggcagaatagagagcagctcaaactctctgtttctggcctttagaagcgacgccagcgttagtaacgctggctttgtgatcgactacaccgaaaatccacgggagtcctgcttcgatccagggtcaattaagaacggcacacgtgtcggctccgatctcaaattaggcagttccgtgacctactactgccatgggggatacgaggtcgagggcacatctactctgtcctgcatcttgggacccgacggcaaaccggtgtggaacaaccctcgtcccgtctgtacagccccatgtgggggacagtacgttggaagcgacggggttgtgttgtctcctaattatccccagaactataccagcggccagatctgcctctatttcgtcaccgttccaaaagattacgtcgttttcgggcaattcgctttcttccatacagccctgaacgatgtcgtcgaggtgcacgacggacatagtcagcatagccgcctactgtcatccctgagtggctcgcacacgggggagagtctgccattggccacatctaatcaggtgctgatcaaatttagtgctaagggcctggcccctgctagaggcttccactttgtctaccaagccgttcctcgtacatccgccactcaatgttcatctgtccccgagcctcggtatggcaagcgcctcgggtctgactttagcgtgggcgctattgttaggttcgaatgtaatagtggttatgccctccaaggaagcccggaaattgagtgcctacctgtaccgggagccctcgcccagtggaatgtcagcgctcccacctgcgtggttccgtgcggcggtaatcttacagaaaggcgcggaacaatacttagtccaggcttcccagagccttatctgaactccctcaactgtgtgtggaagatcgtggtgccagaaggcgcaggaattcaaatccaggtcgtgtccttcgtcacagagcagaactgggacagtctggaggtgttcgatggggctgataataccgtgacaatgctgggtagcttttccggtaccactgttcctgcactgctgaactccacttctaatcagctgtacctccacttctactcagacattagcgtcagtgcagcagggttccacctggaatacaaaactgttggactgagttcatgcccggaacccgcagttccctccaacggcgtgaagacaggggagagatacctggtgaatgacgtggtctcctttcagtgtgaacccggatatgctcttcagggccatgcacatatcagttgcatgcccggaacggtgcgtcgttggaattaccccccaccactgtgcatcgcgcagtgtggaggtacagtggaggagatggagggggtcattttgagtcctggatttcccggaaactatccctctaacatggattgtagttggaagattgcactgccggtgggattcggagcgcatatacagttcctaaatttcagcacagagcccaatcatgactacatcgaaattcgcaacggtccatatgaaacctccaggatgatgggccgtttctccgggagtgagctgccctcaagtctcctcagtacctcacatgaaaccaccgtgtattttcatagcgaccactcacaaaacaggcccggtttcaaacttgaatatcaggcttatgaactgcaagaatgtccagatcctgagccatttgcgaatgggatcgtacgtggggctggctacaatgtaggacagtccgttacgtttgagtgcctcccgggataccagctgaccggacaccccgtcttgacgtgccagcacggtactaatagaaactgggatcaccccttgcccaagtgcgaggtgccatgcggaggaaacattacttccagtaatggtaccgtgtattctcctggattcccctccccttacagcagcagtcaggattgcgtatggctgatcactgtccctatcggacacggcgtccgcctaaatctgtctctcctccagactgaaccatccggggactttattaccatttgggatggtcctcagcagacagcaccaaggcttggcgtgtttacgcgaagcatggccaagaaaactgtgcagtcctcatccaaccaggttcttcttaagttccacagggatgccgctaccgggggaatttttgccattgctttttcggcctatcccctgacaaaatgcccacctcctacaatcctccctaatgctgaagtggtgactgaaaatgaggaattcaatattggagatatagtccgatataggtgcctccctggcttcactctcgttggaaatgagattctaacatgcaaactcggtacctacctgcagttcgagggcccacctccaatctgcgaagtgcattgccctacaaacgagctgttgacagacagcacaggagtcatcctgtctcagtcctaccccggatcatatccacagttccagacttgctcttggctagtgcgcgtcgagccagattacaacatttcgttgaccgtagagtacttcctcagcgaaaaacaatacgatgaatttgagatcttcgatggcccaagcgggcagtcacctctgctgaaggctctctcaggcaattactctgccccactcatagtaaccagctccagtaattccgtctatctgcggtggtcttcagatcacgcctacaatagaaaagggtttaaaatcagatacagtgctccctattgttctctgcctcgggctcccctgcatggattcatacttgggcagacctctacccagcccggaggctctatacactttggctgtaatgctggataccgcttggtgggacacagcatggcgatctgcacacggcacccccagggatatcacctgtggtctgaagctatccctttatgtcaagccctgagctgtggcctgcccgaagcgcctaaaaatggtatggtctttggcaaagagtacaccgtcggaactaaggccatgtacagttgctcggaaggataccatctgcaggcgggagccgaggcaaccgcggagtgcttagataccggcctgtggtctaacaggaatgtcccgccacaatgcgttcccgtcacctgtccggacgtttccagtatatcagtcgaacacggaagatggaggcttattttcgagactcaataccaattccaagcccagttgatgctgatttgcgatcccggatattactataccggccagcgggtgattcgctgccaggctaacgggaagtggtcgctgggagactcaactcccacgtgtcggataatttcctgcggagagttacccatccccccaaacggacaccgaattggcacactgtccgtgtacggcgctaccgccatattttcatgcaatagcggatacacattggtcgggagtagagtgcgggagtgcatggcaaacggactttggtctgggtctgaggtgagatgcctggcaacgcagacaaagctccactccatcttctataaattactcttcgacgtcctctccagcccctcgctgaccaaggctgggcactgtgggaccccggagcctattgtaaatggccatataaacggagaaaactactcctatcggggatcagtagtgtatcagtgtaatgcaggctttcgcttgatcggcatgtcagtgaggatctgccaacaagatcaccattggtccggtaagacccctttctgcgtgcccattacatgtggacatccgggaaatcctgtaaatggtctcacccaaggaaaccagtttaatctgaacgatgttgtgaagttcgtctgtaaccccggttacatggcagaaggcgcagccaggtctcagtgtctggcttcagggcaatggagcgacatgcttccaacctgtaggatcatcaattgtactgatcccggacaccaagaaaatagtgtcagacaggtgcatgcaagcgggccacatcgttttagcttcggcactactgtaagttatcggtgcaaccatggattctacctgctcggcaccccagttttatcttgtcagggcgacggtacctgggataggcctcggcctcagtgcctgctggtcagttgcggtcatccaggtagccctccgcactcacaaatgagtggtgactcttacaccgtgggagcagtcgttcggtattcatgtatcggcaaacgcacattggtcgggaattctacacgcatgtgtggcctggacgggcattggaccggctccttacctcattgcagtggaactagcgtgggtgtgtgtggggatcccggtatcccagcccatggcatccgactcggtgactccttcgaccctggaacagtcatgcggttttcctgcgaggctggccatgtcctcagaggctctagcgaacggacgtgtcaggccaacggcagctggagcgggtcacaacctgagtgcggcgttatcagttgcgggaaccccggaacaccttcaaatgccagagtagttttctccgacggattggtttttagtagttcaatagtctacgaatgccgcgagggttactatgccacaggcctgttgtctaggcactgctctgttaacggtacgtggacaggcagtgaccctgaatgtcttgtaatcaattgcggagatcccggaatcccagccaacggactgcgcctggggaacgatttcaggtataataagacagtaacatatcaatgcgtgccagggtacatgatggagagtcatagagtgagtgtcctgtcttgcaccaaggataggacgtggaatgggaccaaacccgtgtgcaaggccctgatgtgcaagcctccgcctctgattccaaatggaaaagtggtcggatcagacttcatgtggggatcgtctgtgacgtatgcgtgcctcgagggttatcagctgtctttacctgccgtattcacgtgcgaggggaatggctcctggacaggagagttaccgcaatgttttcccgtcttctgcggagatcccggagtgccctctcggggacgacgcgaagaccggggattctcctatcgcagctctgtgtcattctcctgccacccgccactagtgctagttggaagccctcggcgattctgccagtccgacgggacctggagcggaacacagccttcttgcatcgaccctactctcacgacatgtgccgaccctggagttccccagttcggcattcagaataactctcaggggtaccaggttggctccaccgtgctcttccgatgccaaaagggctacctgcttcaaggttcaaccacccgaacctgtttacccaacctgacctggtcaggaactccacctgattgcgttcctcaccactgtagacagcctgaaacccctacccacgctaacgtgggggctttggatcttccctcaatgggatatacgttaatttattcttgccaggagggattctccctcaagggagggtccgagcataggacatgtaaggctgacggctcctggacaggaaaacctccaatttgcctggaagtgagaccatccggacgtcctatcaataccgccagagaacctccactgacgcaagccctcattccaggcgatgtcttcgctaagaattctctctggaaaggagcctacgagtatcaggggaagaaacagcccgcaatgttacgggttacaggatttcaggtggcaaactctaaggtaaatgccaccatgatcgaccattcgggtgtcgaactccatctggcgggtacgtataaaaaagaagatttccatctgctccttcaggtgtatcaaataacaggccctgtcgaaatcttcatgaacaagtttaaggacgaccactgggccctcgatggccatgtcagtagcgagtcctcgggtgcgacttttatttatcagggaagcgtaaagggacaggggttcggccagtttggcttccagaggctagatctacggcttcttgaatctgacccagagtccattgggagacatttcgccagcaatagctcttctgttgccgcagccattttagtgccctttatagcgctgatcatcgccggattcgtgctctacttgtacaaacaccgaagacgtccaaaggttccgtttaacggatatgcaggccatgagaacacaaacgtcagggccaccttcgagaatccaatgtatgacaggaatatccagcccacggacatcatggcaagtgaggccgagttcacagtttctactgtatgtaccgccgtgtaa

SEQ ID NO: 219510 - DNA, 1281 bp, Artificial Sequence
  Description of Artificial Sequence: Synthetic coding sequence
atgttgggtagtttttcaggcactaccgtaccggcactgctcaacagtacctcgaaccagctgtacctgcacttctatagcgacatctcggtttcagcggcaggtttccacctggaatacaagacagtgggcctatcgagctgccccgaacctgccgttccttccaatggcgttaagacaggagaacggtatcttgtgaacgacgttgtttccttccagtgcgaacccggttacgctctgcagggccatgcacacattagttgcatgccgggtacagtgcggcgatggaactacccgccacccctctgcatcgctcagtgtgggggaactgtcgaagagatggagggcgtgatcctaagccccggttttcccggaaattacccttcaaacatggactgttcatggaagattgcgctgccggtggggtttggggcacacatccagtttcttaacttttcgacagagccgaatcacgattacattgaaattcggaacggtccatacgaaacgtccagaatgatgggacgctttagtggctccgaactcccctcgtctctcctcagtacctcccatgaaacgactgtgtattttcacagcgatcactctcagaacaggccagggttcaagctggaataccaggcctacgagctccaggaatgccctgaccccgagccgttcgcaaacggaatagttcggggtgccggttacaacgtgggacagtcagtcacctttgaatgtctaccaggctatcagctgacgggtcatccagtgctcacatgccagcacggaacaaacagaaactgggatcacccacttccaaaatgtgaggttccttgcgggggtaacataacatcgtctaatgggactgtctactcgcccggattccccagcccatacagtagtagccaagattgcgtgtggctgatcaccgtgcctattggtcacggtgtgcggcttaacctgtcactgttgcaaacagagccatccggggacttcataacaatttgggacggaccacagcagactgctcccaggctgggagtcttcaccaggtccatggcaaagaaaactgtacagtcttccagcaaccaggtcttgttgaagtttcaccgtgatgccgcaacgggcggaatcttcgcaatcgcatttagcgatcactgtcggtatttcaaccagaagagcggtaaactcgatttcacgcctagtagcacacttggtcagttgtgtaaaacgctgcaccgctctctgcctcacctgagactgcagtttctacacttgtag

SEQ ID NO: 219511 - DNA, 11124 bp, Artificial Sequence
  Description of Artificial Sequence: Synthetic coding sequence
atgaaaggcattcgtaaaggagagagcagggccaaggaaagcaagccctgggaacccggaaaacgcagatgtgccaaatgcggaaggctggatttcatcttgatgaaaaagatgggtattaagtcaggcttcaccttctggaatcttgtgttcttattgactgtctcttgtgtgaagggatttatctatacgtgcggaggaaccttaaaagggctgaatggcaccatcgagtctccaggctttccttacggttaccctaatggcgcaaactgcacctgggtcatcattgcagaggaaaggaatagaatccagatcgtcttccagtccttcgctctcgaagaggaatacgactatctctccctgtatgacggccaccctcatcctacgaatttcaggacccgacttacgggcttccacttgcctcccccagtgacaagcaccaagtctgtattctccctgcgtcttacctctgattttgctgttagtgcgcatggcttcaaggtgtactatgaggagcttcagtcctcctcctgcgggaatcctggcgtgcctccaaagggtgttctctatggaacgcggttcgacgtgggagacaaaatcagatacagctgcgttacaggatacattttggacgggcatccccagctcacatgcatagcgaactccgtaaataccgcaagttgggacttcccagtcccgatttgtagagccgaggatgcttgcgggggtactatgcgcggtagctccggaattattagctctcctagttttcccaacgaataccataacaatgccgactgcacttggaccattgtggcagaaccgggtgataccatctctctcatctttactgatttccaaatggaagagaaatacgactatttggaaatcgaaggctctgaacctcccacaatttggctctccggaatgaatattcctccgcctataatatccaataaaaattggcttaggctacactttgtcacagattctaaccataggtaccggggattctcagctccttatcagggaagctccactctgacacataccacttcaaccggggaacttgaggagcataataggacaacgacaggggctatagccgtggcctccactcccgctgacgtcacagtgtcgtctgtgaccgctgtcaccattcatagactcagcgaggagcagcgcgtccaggttacctctcttcgaaactctgggctggatcccaatactagtaaggatggcctgagtccccatccagccgatacccaaagcacacgccgaagaccaaggcacgctgagcaaattgaacgtaccaaggaacttgcagtggtgacccaccgcgtgaagaaagcaatagactttaagtccaggggcttcaaattattccccggtaaagataactctaataagttctctattctgaatgagggcggtatcaagacagcatccaacttgtgccccgacccaggggagcccgagaacggaaaacgtattggctccgatttctctctgggcagcaccgtgcagtttagttgcgacgaggactatgtgctgcagggcgcaaagtcaatcacttgccagagaattgccgaagtgttcgcggcttggtctgatcaccggcctgtatgtaaggtgaagacttgtgggagcaacttgcaggggcctagcggaacgttcacaagccccaattttccattccagtacgacagcaatgcccaatgcgtgtgggtgattaccgcggtcaacacaaataaagtgatccagatcaacttcgaggaattcgacctggagattgggtatgatactctcactatcggcgatggtggggaggtgggggatcccaggactgttctgcaggttctgaccgggagctttgtgccggatctgattgtgtctatgtctagtcagatgtggctccacctgcagaccgatgaatcagtaggatccgttgggttcaaggtgaattataaagaaatcgaaaaagagtcatgcggcgacccaggtacaccgctgtacggaattcgcgaaggtgacggattctccaaccgtgatgtgctccgcttcgaatgtcagtttggtttcgaacttatcggggaaaaatccatagtgtgccaagaaaacaatcagtggtccgctaacattccaatctgtatattcccttgcctgagtaatttcacagcgcctatgggtacggtgttgtcaccagattatccagagggctacggtaacaacttgaactgcatctggactatcatttccgatccgggaagcaggatccatctgtcgttcaatgattttgaccttgaatcgcagtttgactttctggccgtaaaagatggcgattctcctgaaagcccaatcctcggcacttttaccggagccgaagtgccatcccatttgaccagcaactcacatattctacggttggagttccaggcagatcatagtatgtccggacgcggatttaatataacatacaatacattcggacataacgaatgccctgaccctggcattcccataaacgctcgccgatttggcgacaatttccagctcggctccagcatttctgtcatttgcgaggagggttttatcaaaactcagggtactgaaacgattacttgcattctgatggatgggaaggtgatgtggtccgggcttatcccaaagtgcggagctccctgcggtggccatttttcggccccatccggggtgatcctgagtcccggatggccagggtactacaaagattcgctcaattgtgagtgggtcattgaagccgagcccggacattctatcaaaataacattcgaaaggttccagaccgaattgaattacgatgtgctggaggtgcatgatgggcctaatttactatctccattgttggggtcctacaacggaacccaggttccacagtttctgttcagcagctccaactttatctatttgctcttcaccactgacaacagccgaagtaataatgggtttaagattcactatgagagtgtgactgtgaatacatatagctgtcttgaccccggaattccagtccacggtagacgttacggacacgactttagtatcggctcaacggtgagtttcagctgcgactcaggatacagactgtctcatgaagagcctctgctgtgcgaaaagaatcactggtggagccatccactccctacctgcgatgctctctgcgggggtgatgtgagaggaccaagcgggactatcctgtctcctggctaccctgaattttatcccaacagtttgaattgtacatggactgttgacgtaactcatgggaagggggtccagtttaacttccacaccttccacctcgaggatcatcacgactatctgttaatcaccgagaatggcagctttacccaacctctagccagactcaccggatccgatctacctcctacaatcaatgccggactctatggcaacttccgggcacagttgcggttcatcagcgatttcagcataagttatgagggattcaatatcactttctccgaatacaacctcgagccgtgcgaggatccaggtattccccaatacggctcgagaataggcttcaattttgggatcggcgacactctgaccttcagctgctcctctggctaccggctcgagggcacatcagagatcatctgcctgggcggaggacggagggtgtggagcgctccactcccacgttgtgtggccgaatgcggggcatccgccacgaataacgaaggcatcctgttgagccccaactatccactgaattacgaaaataatcatgaatgcatctacagtattcaggtgcaggctggcaaaggcatcaatatcagtgcccgaacgtttcaccttgcccagggcgatgtgctgaaaatttacgacggtaaagataagactacccacctgctgggtgcgtttacaggcgcaagcatgaggggattaacactgtcatcaacttctaatcaactgtggctagaattcaacagcgacaccgaaggaacggatgaagggttccagcttgtatataccagtttcgaactatcgcactgcgaggatcccggaattccccaatttggttacaagatttccgaccagggccatttcgccggatctaccatcatctacggatgcaaccccggatatacccttcacggctctagtctcttgaagtgcatgacaggggaacgcagggcctgggattacccactgccttcctgtatcgccgagtgcggcggacgttttaagggagagtcatcaggacgcattctgagcccgggatatccttttccttatgacaataatctgaggtgcatgtggatgatagaagtcgatcctgggaacattgtttccctccagtttcttgccttcgatacggaagcctctcatgatattctccgcgtctgggatggaccccctgagaacgacatgctgctcaaggaaatctctggatccttgatcccagaggggatccactctaccctgaatatcgtcacaatccagttcgatacagacttctacatcagcaaaagcggtttcgcaatccagttttcctcatccgtggcaacggcttgtagagatcccggtgtgcctatgaacggtacaaggaacggggatgggagggaacctggagacactgttgtgttccagtgtgatcctggttatgaactccaaggggaggaacgaattacctgcatccaagtcgaaaatcggtatttctggcagccttcccctcccgtttgcattgcgccatgtggcggtaacctaaccggctccagcggatttattctgagtccaaatttcccccatccttatccacactcgcgcgattgtgattggacaattaccgtcaacgcagactatgtcataagtctggcattcattagttttagcatagagccaaattacgacttcttgtatatttacgacggcccagatagcaatagccctttaattggttccttccaagactccaagctcccagaacgaattgaatcgtcttcgaacaccatgcacttggcatttcgctctgatggcagtgtatcttataccggattccatctggagtataaggccaaacttcgggaaagctgtttcgaccctggcaatattatgaatggcacacggttagggatggattacaaactcggtagcactgtcacctattattgcgacgcagggtatgtcttacagggctacagtaccttgacctgcataatgggggacgacggacggcctggctggaatagagccctgccctcctgccatgccccttgcggatcgaggtctactggatctgaaggcaccgtgctgtcacctaactatcctaagaattatagtgtgggtcataactgcgtatatagcatcgcagtgccaaaggaattcgtcgtatttggccagttcgttttcttccagacaagtttacacgacgtggtagaagtgtatgacgggcctacccagcaatctagcctcctaagttccctctcaggatcccattctggcgagagcctgccactgtcaagcgggaatcagattaccatcagatttacctctgttgggccaatcacagctaagggattccactttgtgtatcaggcagttccgagaacgagctcgactcagtgctcttccgtccctgagccaaggttcggtcggcgaatcggaaacgaatttgccgtggggagctctgtgttgttcgattgtaaccctggatatatcctgcacggcagtatcgctatcaggtgtgaaacagtgcctaattccctggcccaatggaacgattcgctgcccacctgcatcgttccctgtggcggaatccttacaaagcggaagggcactatcctgtctccaggttaccctgagccatacgataataatcttaactgcgtgtggaaaatcacagtgccggagggtgccggaatccaggtacaggtagtgtctttcgccacggagcataactgggactccctagatttctatgatggtggggataataatgccccaaggctgggatcctacagcggcaccaccataccccacctactaaactctacctccaataacctgtacctgaatttccagtcagatatctcagtgtcggcagctgggttccatcttgaatacacagcaatagggctggactcatgccccgagcctcagacgccaagctcaggaattaagataggtgatcgatacatggtgggagacgttgttagcttccagtgtgatcagggctacagtttgcagggacacagccatatcacatgcatgccgggaccagttcggaggtggaattacccaatcccaatatgtctggcacagtgtggcggtgccatgtcagacttctctggtgttatactctcgcctggctttccaggcaattacccatcgtctcttgattgtacgtggacaattaacttaccgataggattcggcgtacatctgcagtttgtaaacttctcaaccgaaaccattcatgattatctggaggtgcgaagtggatctagcgaaacctctacagtgattggccgtctgagtggcccacagattcccagttctttgttctcaaccactcatgaaaccagtttatacttccactccgattactctcagaataaacaggggtttcatatagtgtaccaggcatatcagctccagtcctgcccagaccctaggccattccggaacgggtttgtaattggtaacgactttactgtgggccaaaccatttccttcgagtgcttccccggttacaccctcataggaaatagtgctctgacatgcctacatggtgtctcccgaaattggaaccatccattacccagatgtgaggccctgtgtggtgggaatatcaccgcgatgaatggcactatctattctcctggctaccccgacgagtatccaaactttcaggactgcttttggctggtgcgcgtgccaccgggtaacgggatttatatcaacttcaccgtgctccagaccgagcctatctacgattttattacagtgtgggacgggccagatcaaaacagcccccaaatcgggcaattctcggggaacacagctttagagtctgtgtattccacaagcaaccaaatcctcatcaagttccacagcgacttcaccacgagcggatttttcgtcctttcttaccatgcctatcagctccgcgtatgccagccacctcctcccgtacccaatgctgaaatcctcactgaggacgacgagtttgaaattggtgatatcatccgataccaatgcctgccaggattcacccttgtaggtaacgctatcttgacatgtcggttgggggagcggctacagatggacggcgctccgcctgtgtgtcaggtgttgtgtcccgctaatgagttgaggctggacagcaccggagtcatccttagtcctggctatccagacagctaccccaacctgcaaatgtgcgcttggtctatatccgtggagaaggggtacaatattaccatgtttgtcgaattcttccagacagaaaaggaatttgacgttctgcaggtgtacgatggcccaaatattcagtcaccggtacttatcagcctgtctggggattactcctcagccttcaatatcacctccaatggacatgaggttttcctgcagtggtctgcagaccatggtaacaacaaaaagggttttcggatcaggtacattgccttctattgctctacaccagagtcgccgcctcatggctacataatatcacagaccgggggtcaacttaacagtgtagttcgatgggcatgcgatcgcggattcagattagtgggaaagtccagcgcagtatgtcgcaagagctcctacggctaccatgcctgggatgcgcctgtccctgcttgtcaggctattagctgcgggatccccaaagccccaaccaacgggggaatactgaccaccgattacctcgtgggcactagggtgacgtacttctgtaacgacggataccgtttgagctctaaggaactgactactgctgtctgccagagcgacggcacctggagtaaccacaataaaacacctaggtgcgttgtcgtaacatgccctagtatcaactctttcatcctagagcacggcagatggagaatcgtgaatgggtcccactatgagtacaaaactaaggtggtatttagctgtgatcccggataccatgggttgggcccagcttccatcgagtgcctgcctaacggaacttggtcgtggcggaacgaaagaccatattgtcagattatctcctgtggtgaactgccaactcctcccaacgggaacaagatcggcactcagacctcctacggtagtaccgcaattttcacctgcgacctgggattcatgctggtaggatctgcagtgcgagaatgtctgtcatccggcctgtggtcagagagcgaaactcgctgtctggccggacattgcggcatccctgaactcatcgttaatggacaggtcattggggaaaattatgggtatcgggatacagtagtctatcaatgcaaccctggctttcgtctgatcggaagctccgttaggatctgccagcaagaccacaactggagcggacaattacccagttgcgtgcccgtttcctgtggccacccagggtcgccaatttatggtcggactagtggcaacgggttcaacttcaatgacgtcgtgacattctcttgcaacatcggctacttgatgcagggtcccacaaaggcccagtgccaggccaatcggcagtggagccatccccctcccatgtgcaaggttgtgaactgttctgatccagggataccagccaatagcaaacgagaaagcaaaattgaacacgggaactttacctacggcacagtggtattctacgattgcaaccctgggtacttcctatttggttcttcagtgttaatctgccagcctaatgggcagtgggacaaacccctacctgaatgcatcatgattgactgcggccacccaggtgtgccgcctaatgccgttttatctggtgaaaagtacacattcggtagtacagtccattactcttgtacaggtaaacgatcgcttctgggccagagtagtcggacctgccagctgaacggccattggtcaggctcccagccgcactgctctggtgatgcaacagggacatgtggtgatcctggtacacctgggcacggatccaggcaggaaagcaacttcaggaccaaatccactgtgagatacgcatgcgacaccggctatatcctccacggaagtgaggagagaacctgtttggcgaatggatcctggacaggtaggcagcccgagtgtaaggccgtccaatgtggtaaccccggaaccactgcgaacgggaaggttttccggatagatgggacaacattctcaagcagtgtgatctacagttgtatggagggctacattctgagcggtcctagcgtgcggcagtgtacagccaatgggacatggtcaggcacacttcccaattgcaccataatttcctgtggagatcccggtatcccagccaacggcttgcggtacggagacgactacgtggtgggacaaaatgtgtcctacatgtgccagcccggatacaccatggagttgaacggctctcgcatccggacgtgtaccatcaacgggacctggtccggtgtgatgcctacttgtagagcggtcacctgtcccacaccgccacagatcagtaatggccgtctggaggggacaaactttgactggggtttctccatctcatacatttgctcaccgggatatgagctgtcatttcctgccgtcttgacatgcgtgggcaacgggacgtggtccggggaagtaccccagtgcttacccaagttctgtggtgaccccggaatcccagcacagggaaaacgcgagggcaagagcttcatttatcagtcggaggtttccttcagctgtaatttcccatttatactggtgggcagtagtactagaatttgtcaggcagacggcacatggtccgggtcttcccctcattgtatagaacccactcagacaagctgtgagaacccaggcgttcctcgccacgggtcccagaacaatacatttggctttcaggtgggcagcgttgtacaattccattgtaaaaaaggccatttactgcaaggttcaacgacacggacctgcctgcccgacctcacttggagtggaattcagcccgagtgtattcctcattcctgtaagcagcccgagactcctgcccacgccaacgtagtgggaatggacttgcccagccacgggtacaccttgatttacacatgccaacccggattcttcctcgcgggtgggactgagcacagagtctgccggtctgacaacacctggaccggcaaagtgcctatctgtgaagctggttcaaaaatcctagtaaaggatcccagacctgcgctcggcaccccgagtcctaaactcagcgtacccgacgacgtctttgcgcagaattacatctggaagggctcttataacttcaagggacgtaaacaaccaatgacactgaccgtgacctctttcaatgcatctacagggagggtgaacgccactctgtccaattctaatatggaattactcttgtctggcgtctacaagtcccaggaagctagattgatgctcagaatctacctgatcaaggtccctgctcacgcatccgtcaagaagatgaaagaggaaaactgggcaatggatggatttgtgagcgccgaaccagatggagcaacatacgtttttcagggcttcattcagggaaaggattatggacaattcggcctacagcggctgggcttgaatatgtccgagggctccaatagctctaaccaaccccacgggacaaatagctcaagcgtggccattgccatcctcgtacctttcttcgcactgatctttgcgggatttggattctacctgtacaaacagcggactgccccaaagacgcagtatactggatgtagtgtgcacgagaataacaatggacaagcagcattcgagaaccccatgtatgatacaaatgccaagtccgtggaggggaaggccgttagatttgaccccaatctgaataccgtgtgcaccatggtatac

SEQ ID NO: 219512 - DNA, 11004 bp, Artificial Sequence
  Description of Artificial Sequence: Synthetic coding sequence
atgtggtcttggttcttgtgctggaagcctgtgcagctggataggcagacagcctccggattcatctacacctgtggcggtacactcaaaggtctgaatggaaccatcgagagtcctgggttcccttatggctatccgaacggagccaactgtacatgggtgatcatcgccgaagaacggaatcgtatccagatcgtattccagtcttttgcactcgaggaggagtacgactacttgagcctgtacgatggccacccacaccccaccaactttcgcactcgtttgacagggtttcatctgccaccccctgtgacctcgacaaaaagcgtgttttcactgcgcctgactagcgacttcgcagtgagtgctcatggttttaaagtctattacgaggagctccagagctcgtcttgcggaaatccaggggttccccctaagggggtactgtatggtaccaggtttgatgttggagataagatcagatattcttgtgtgactgggtatattcttgatggccacccacagctgacttgtattgccaactctgtcaacacagcctcttgggactttcccgtgcccatctgtagagcagaagatgcctgtggcggtacgatgcgtgggagtagtggtatcattagcagtccaagtttcccgaatgagtaccataacaacgccgactgcacgtggacgatagtggcggagccaggtgacaccatctctctgatcttcacagatttccagatggaagagaaatatgactatcttgaaatcgaaggatcagaaccgccaaccatatggctgtctgggatgaacattccccctccaattatatccaataaaaactggctgagattgcacttcgtaaccgacagcaaccatagatatagaggcttttcagccccttaccagggatcttcgaccctgacccataccacttccactggagagctcgaagaacacaataggactacgactggagccatcgcagttgctagcacaccagcggacgttactgtgtcatcagtgactgccgtcacaattcacagattaagcgaagaacaacgggtgcaggtgacatccctgaggaatagcggcctagatcccaacacttcgaaagatggattgtcaccccatccagctgatacccaaagcacacgccgtcggccacggcacgctgaacagatagagcggaccaaagaactggcagtcgttacacatagagtgaagaaggctattgacttcaagtcccgcggatttaaattgttcccaggcaaagacaactctaacaaattctcaattctgaatgaggggggaatcaaaacagcttccaacctgtgtccagaccctggcgaacccgagaacggtaaaagaattggctctgatttctctctggggagtaccgtgcagttcagctgtgatgaggattatgtgttacagggagctaagagcattacatgccagaggattgccgaagtgttcgcagcctggtcagaccacaggcccgtgtgtaaggttaaaacatgtggctctaacctacagggccctagtggcacatttaccagtcctaattttccattccagtacgacagcaacgcccagtgcgtgtgggttataactgccgtgaatactaacaaagtcatccagatcaatttcgaggagttcgaccttgagattggctatgataccctcaccattggcgatggcggagaagtaggcgacccgaggaccgttttgcaggtcctgaccgggagttttgtgccggacctgattgtatcgatgagttctcagatgtggctgcatctgcaaactgacgagagtgtaggatccgtgggctttaaggtcaactacaaagaaattgaaaaggaaagctgcggcgacccgggaacgccactatatgggatcagagaaggggacggcttttccaatagggacgtgctgaggttcgagtgccaatttggattcgaactcattggagaaaagtcaattgtctgtcaggagaacaaccaatggtcagccaatattcctatttgcatcttcccatgcctgagtaacttcactgcgcctatgggaacagtgctcagccctgactacccggaagggtacggtaacaacttgaattgcatctggaccatcatttccgatccaggttcccgcatccatctatccttcaatgatttcgacctggaatcccagtttgatttcctggcagtcaaagacggagatagtcctgagtcccctatccttggcacttttaccggagctgaggttcccagtcacctgacaagcaatagccacatccttaggctggagttccaggctgaccatagcatgagtggacggggttttaacatcacttataatacctttggacataatgaatgtcctgacccgggaatccctataaacgccagaagattcggcgataactttcagctggggtctagcatctccgtgatttgtgaggagggcttcattaagacacaaggaactgaaacaattacatgcatactcatggatggtaaggttatgtggtctgggctgattcctaagtgcggggctccatgcggcggacacttctcggcaccttccggagtaatcttgtcgcctggctggccaggatactacaaagacagcctgaactgtgaatgggtgattgaggcagaaccaggacactccattaagatcacattcgagcggttccaaacggaactaaactatgatgtgctcgaagtgcacgatggtcctaacttgctgtcccctctcttgggatcatacaatggtacccaggttccacagtttctctttagctccagcaattttatttacctgctgttcacgactgacaatagtagatccaacaatggcttcaagatccactatgagagcgtcactgtgaatacgtattcgtgcctggaccccggaattcctgtgcatggcaggcggtacggacacgatttctctataggtagcacggtctctttctcatgcgattccggctataggctgtcacacgaggaaccactgctgtgcgagaaaaaccactggtggtcccacccccttcctacatgtgacgccttgtgtggcggagacgtgcggggtccttccggcaccatcctctcaccgggataccctgagttctacccaaactcattgaattgcacctggacagtggatgtgactcatggcaaaggggtccaattcaactttcacaccttccatttggaagatcaccacgactatctcctgattacagagaacggaagcttcacccagcctctggccagactgacaggatccgatctgcctcccactattaacgcaggtttgtacggaaactttcgggctcagctgaggttcatatccgacttctcgatttcctacgaaggctttaacattacgtttagcgagtacaacctcgaaccttgtgaagaccccggaatcccgcagtacgggtcgaggatcggttttaattttggcatcggagacaccctcacatttagctgcagttccgggtacagattggaggggaccagcgagattatctgcttgggcggaggtaggcgggtgtggagtgccccactccccagatgtgtcgcagagtgcggagcctcagcaaccaataacgaagggatcctcctctctcctaactaccccctgaactacgagaacaaccatgagtgtatatactccatccaggtgcaggcagggaagggaataaatatcagcgctcggacgtttcatctcgctcaaggcgacgttcttaaaatctacgacggtaaagacaagactacccacctattaggggcatttaccggtgccagtatgaggggactaaccctgtcgtctaccagcaatcagctgtggctggagtttaactcggacactgaggggaccgacgaaggcttccaattggtgtataccagttttgagctgtctcactgcgaagatcccggaatccctcagtttggttataagataagcgaccagggtcacttcgccggaagtacaataatttacggctgcaaccctggatacacccttcacggatcgtcgcttctgaagtgcatgactggcgagagaagagcttgggattatcccctgccatcatgcatagctgaatgcggaggaaggttcaagggggagagctcggggaggatcttgagtccaggttatccctttccttatgacaacaacctgcgttgcatgtggatgattgaggtagacccaggtaacatagtgtctctgcagtttctcgcgtttgacacagaggcctcccatgatatacttcgtgtgtgggatgggccacctgaaaacgatatgctactgaaggagatctcaggaagcctaatccccgaaggcatacacagcacgctaaacatagtgacaatccagttcgataccgatttttacatttcgaagtccggctttgccattcaattcagttctagcgtggcgacagcttgtcgggacccaggagtgcctatgaacggaacacggaacggcgatgggagagagcccggagacactgtggtcttccagtgcgatccgggatacgaactacagggggaagagcgcatcacatgcattcaggttgagaaccggtatttttggcagccttcaccaccagtctgtatagccccatgtgggggtaatctaaccgggagctcgggctttatactctctccgaatttccctcacccatacccgcattcacgggactgtgactggacgatcaccgtgaacgcagactatgtgatctctctagcctttatttctttctcaatagagccaaattacgactttctgtacatttacgacggtccagattccaattccccattgattgggagctttcaggattctaagctgccggagcgaatagagagcagctcaaacacaatgcacctggcgttccgcagcgatggaagcgttagctacaccggcttccatctggagtacaaagctaagcttagggaatcatgttttgaccccggaaatattatgaacgggacgaggctgggcatggattacaagctgggatctacagttacttactattgcgatgctgggtacgtcttacaaggctacagtacgctgacctgcatcatgggggacgatggtcgaccaggttggaatagggccttgccttcatgccatgccccatgtggttcacgctccaccggatccgaaggcacggtcttgtcacccaattaccccaagaattatagcgttggccacaattgtgtttacagtatagcggtccccaaggaattcgtggtcttcggccagtttgtttttttccaaacgagtctgcacgatgtcgtggaagtttatgatggtcctactcagcaatcaagcctcctgagctctctgtcagggtctcatagtggggaaagtcttccgctgtcaagcggaaaccagatcaccattaggtttaccagcgtcgggcctatcaccgcgaagggttttcactttgtctaccaagcagtccctcgcaccagcagcactcagtgctccagtgtgccagagccccgattcggcaggaggatcggtaatgaatttgcagtgggctcctcagtgctgtttgactgcaatcccggatatatactgcatggaagtattgctatccgctgtgaaacagtgcccaattcgctggcccaatggaatgactccttgccaacatgtattgttccctgcggtggcattctcacaaagagaaagggaaccatcctttccccgggttacccagagccttatgacaataatttgaattgcgtgtggaaaattaccgtaccagaaggggcaggaattcaggtccaagttgtgtccttcgcaactgaacacaactgggatagcctagatttttatgatggtggcgataacaatgctcctcgcctgggttcttacagcggtactactattccacaccttctgaactcgacctccaacaatctgtatttaaattttcagtctgacatcagcgtgtcagcagcaggattccatctagaatatactgccattggtctcgattcgtgcccggagccgcaaactcccagttcagggatcaagatcggcgatagatacatggtaggggacgtcgtctcctttcagtgcgatcagggttactccctacaggggcatagtcatatcacctgcatgcctggccctgtgcggaggtggaactaccctatccctatttgtcttgcccaatgcgggggagctatgtcagacttttcaggggtgatcttatctcccggttttccaggcaactatccttcctctctggactgtacatggactattaacttgcctatcggctttggcgtccacctgcaattcgtgaacttcagcacagaaaccatccatgactacctagaagtgagatctggttccagtgaaacgagtacagtgattggcagattaagcggtccgcaaatcccgtcatctctgttttccacgacccacgagaccagcctatacttccactccgattattcgcagaataagcagggcttccacattgtgtaccaagcttaccaactgcagtcctgtcctgatccgcgaccgttccgaaatggcttcgtaataggcaatgactttaccgtgggacaaacgatctctttcgagtgtttccctggctatacccttatcggaaactccgcccttacttgcctccacggcgtcagtcgaaattggaatcacccactgcctagatgtgaggctttgtgcggtggtaatattaccgcaatgaatggcaccatttactctcctggttatccagacgaataccctaattttcaagattgtttctggcttgtccgggtgcctcccggtaacggcatttacatcaatttcactgtgcttcaaacagagccaatctatgatttcataacagtgtgggatgggcctgaccagaattccccacagattgggcagttctctgggaacacagccctggagtcggtctattctacgagcaaccaaattctgataaaatttcatagcgacttcactaccagcggctttttcgtgctgtcctaccacgcttaccaactcagagtgtgccagcctccccctccggtgcccaacgctgagattctgacagaggatgacgagttcgaaatcggagacataataaggtaccagtgcttgcccggtttcaccttggtgggcaacgcaatcctgacctgtcgtctgggcgaacgtcttcaaatggatggggcacctcccgtttgccaggttttatgtccagccaacgagcttagactcgattccactggggtcatcctgagtccgggatatccggactcctaccctaaccttcaaatgtgcgcatggagtataagcgttgagaagggatataacattaccatgttcgtggagtttttccaaactgagaaagagtttgatgttctccaggtatatgacgggccaaacattcagagtcctgtcctcatcagtttatctggcgactatagctccgcttttaatataactagtaatggccacgaagtgtttctgcagtggtccgctgatcacgggaataacaaaaaaggcttcagaatccgctacatcgccttttactgctccacaccggagagcccccctcacggctacatcatctcccagactggtggtcagctgaacagtgttgtcaggtgggcttgtgaccggggttttcgcctcgtaggtaagtcatcagcagtctgccgaaaaagctcctatgggtatcacgcatgggacgcaccagtacctgcgtgtcaagctatttcatgcgggattcctaaggcgccaactaacggaggaatcctgacgaccgattacctggttggaacaagggtgacatacttttgcaacgatggctacaggttgagctcaaaggaactgaccacagccgtgtgtcagtcagatggcacctggtctaaccataacaaaactcctcgctgcgtggtcgtgacatgtcccagtattaactccttcatcctggaacacggcaggtggagaatagtcaatggaagtcactatgagtataagacgaaggtagtcttcagttgtgaccccggatatcacgggctgggacctgcgagcattgaatgtctgcctaacgggacatggagctggcggaacgagcggccttactgccagatcatttcctgtggcgaattacccaccccgcctaacggcaacaaaatagggacacagacgtcttacggctccaccgcaatctttacatgcgatctgggctttatgttggtgggtagcgctgtcagagagtgcctcagttccggcctctggtccgaaagcgaaaccaggtgtctcgcaggccactgcggcatccctgagctaatcgtgaatggtcaggttatcggggaaaattacgggtatcgcgacactgttgtctaccagtgtaaccctggattccggctaatcgggagttcggtccggatctgtcaacaggaccacaattggagcggacagttgccaagctgtgtgcctgtctcatgtgggcacccaggttcacctatctatggaaggactagcgggaacggatttaattttaatgacgttgtgacattctcatgcaatattggctatttaatgcaaggtccgacgaaagcgcagtgtcaggcaaaccgacagtggtcacacccacctccaatgtgcaaagtcgtaaactgctctgacccaggcattcccgctaattccaagcgggaatcgaaaattgaacatggcaacttcacctatggaacggtggtcttttacgactgcaatccaggctattttctgttcggctcctcagtgttaatctgccaacccaatgggcagtgggacaagccactgccagagtgcatcatgatcgattgcggacatccaggcgtgccacctaacgcggtgctgtctggagagaagtacacattcgggtctaccgtgcactactcctgtaccggcaagaggagcctattggggcagtccagccgaacctgtcagttgaatggacattggtcagggtcacagccacactgctcaggcgacgcaaccggaacctgcggcgacccaggcacccctggccatggttcgaggcaggaatctaactttcgaactaaatcaactgtgaggtacgcgtgtgacaccgggtacatcttgcacggcagcgaagaaaggacgtgtcttgccaacggaagttggactggcagacaacctgagtgtaaagcggtccaatgcggcaacccaggaaccacggcgaacggtaaggtgtttcgcatcgatggtacaacatttagcagctccgttatctattcctgcatggagggatatattctttcgggccctagcgtgaggcagtgtacagccaacggtacctggtccgggactcttcccaactgcactatcatttcttgcggcgaccctgggatccccgcaaatggtctcaggtacggagatgactatgtcgtggggcagaatgtgtcttatatgtgccaacccggatacaccatggagctgaacggtagcaggatcagaacctgtacaatcaatgggacttggagcggggtgatgccaacgtgtcgggcagtgacatgtccaacgccccctcagatttctaacggcagattggagggtaccaactttgactggggcttttccatttcatatatttgcagtcccggttacgagctgtcttttccagccgtgctgacctgtgtaggcaacggaacatggagtggtgaggtaccacagtgcctgccaaagttctgtggcgatcctggcattcccgcacaaggcaagcgggagggcaaatctttcatctaccaaagtgaggtgtccttcagctgtaacttccctttcatattggtagggtcgagcacacgaatatgtcaggcagacggcacttggagtgggtctagcccccactgcattgagcctacacagaccagctgtgaaaatcctggggtcccccgtcacggcagccaaaataatactttcgggtttcaggttggctccgtggtgcagtttcattgcaaaaagggccacctactgcaggggagtactactcgcacgtgtctgcctgacttaacttggtccggaatccagccagagtgcataccccactcttgcaaacagcccgaaacacctgcacatgccaacgttgtcggaatggacctgccatcacatggatacacgctcatttatacatgccaaccgggtttttttttggcaggcggaaccgagcatcgcgtttgtcggagcgataacacctggaccggcaaagttcccatctgcgaggcgggtagtaagatactagtgaaggatcccaggccagctttaggaactcccagcccgaaattgagtgtaccggatgacgtatttgcccagaattacatttggaagggcagttataactttaagggccgtaaacagcctatgactcttaccgtgaccagctttaatgcttcgaccggccgagtcaacgcaactttgtctaatagcaacatggaactcctcctgtcaggcgtctataagagtcaagaagccaggctcatgctcagaatatatctcatcaaagtcccggctcacgcatccgttaaaaaaatgaaagaagagaattgggccatggacggattcgtatcagctgagccggacggggcaacttacgtttttcaggggtttattcaggggaaagactatggacagtttggtctccaaaggctaggcctcaacatgtccgaaggctctaatagcagtaaccaacctcacggtacgaactcctcttccgtagctatagcaatcttggtgcctttttttgccctcatctttgccggtttcggattctacctgtacaagcagcgaacagctccaaaaactcaatacaccggctgcagtgtgcacgaaaacaacaacgggcaggccgcatttgagaacccaatgtatgataccaacgccaagtccgtcgaaggtaaggctgttcggtttgatcccaacctaaatacggtgtgcacaatggtctaa

SEQ ID NO: 219513 - DNA, 10914 bp, Artificial Sequence
  Description of Artificial Sequence: Synthetic coding sequence
atgaaggggatcaggaagggggagtccagggcgaaggagagtaagccttgggaacccggaaagcgaaggtgtgctaagtgcggcagactggactttatcctgatgaagaagatgggaataaagtccggatttaccttctggaatctggtctttcttctcactgtaagttgtgtcaagggttttatatacacatgcggcggaactctgaaaggccttaatggtacaatcgaaagcccaggttttccctatggttatcctaatggggcaaactgcacgtgggttatcatcgccgaggagcgcaaccggatccaaattgtgtttcaaagcttcgcgctggaggaggagtatgactacctatccctgtatgacgggcacccccatcctacaaacttcagaacacggcttaccggcttccatctgcctccacccgtaacctcaacaaagagcgtcttctcgctccgtctgacatcagatttcgcagtctcggcccacgggttcaaggtttattacgaggagctccagtcaagtagctgcggaaatcccggtgtgccccctaagggcgttttgtacggtacccggtttgatgtcggagacaaaattaggtatagttgtgttaccggctatatcctggatggacatccccagctgacatgtatcgcaaattccgtcaacaccgcttcatgggattttcccgtccccatttgtcgtgccgaggacgcttgcggtggcacaatgcgagggagcagtggtatcatctcctccccaagcttcccaaacgaataccataataacgccgattgcacttggacaattgtggcggaacccggtgacacgatctcactcatttttactgacttccagatggaagaaaagtatgattacctcgaaatcgagggctcagagccgccaacaatatggttatccggcatgaatattccccctccaattatctcaaataagaattggctcaggctacacttcgtcaccgattcaaaccaccgctacagaggtttctctgccccttatcaggggtcgagcacccttactcacaccactagcaccggcgagcttgaggaacacaatcgcacaaccaccggcgctatcgctgtggcttccacacccgctgatgtgacggtgtcctcggttaccgccgtaacgatccatcgcctcagcgaggaacagcgagtgcaggtgacttcccttcggaactctggtctggacccaaatacttccaaagatgggctaagcccccaccctgcggacacacagtcgacaaggagacggccaagacacgctgaacagatcgagaggactaaggaactggccgtagtgacacacagggttaagaaagccatcgatttcaaatcgaggggattcaaactgtttccaggcaaagacaattccaacaagttctccattcttaacgaaggcggaattaaaacagccagtaacctctgcccagaccccggtgagcctgagaacggaaaacggatcggctccgatttcagtctcggatctaccgtacagttttcatgcgatgaggattacgtgctccagggtgctaaatctatcacttgccagcgtatcgctgaggtttttgcagcttggtcagaccacaggcctgtttgcaaggttaagacctgcggatctaatctgcagggtccaagtggcactttcacctctcccaattttccatttcagtacgattccaacgcacagtgcgtgtgggtcattacggcggttaacacaaacaaagtgattcagataaattttgaagaattcgaccttgagattggttatgacacactaactataggagatgggggagaggttggggatcctcgaactgtgctacaggtactgactggtagttttgtaccagatctgatcgtctcaatgtccagccagatgtggctccacttgcaaactgatgaatcggtgggatctgtggggtttaaagtgaattataaggagatcgaaaaggaaagctgtggcgatccgggtactccgctgtatggcatccgcgagggagacggattctctaacagagatgtgctgcgattcgaatgccagttcggctttgagttgatcggagaaaagtccatagtttgtcaggagaacaaccagtggagtgcaaacatcccaatctgtatatttccttgcctgtccaacttcactgccccaatgggcactgtcctctcaccagattaccctgagggttatggcaataatctcaactgtatttggacaataatctcagacccaggcagcaggattcatctgagtttcaacgattttgatctcgaatctcagttcgactttctggccgtgaaagatggtgactcacccgagtccccgatccttggcacttttacaggagccgaagtcccgtctcacttgacatccaactcgcatattctccgactggagttccaggccgatcattctatgagcgggcgtggctttaacatcacatacaatacttttggtcacaacgagtgccctgatcctggaattcctatcaacgcacggagattcggagacaacttccagctgggcagttccattagtgtgatctgtgaagaaggattcatcaagacgcagggaacggagaccattacttgtatcttgatggacggaaaagttatgtggtccgggctgattcctaagtgcggcgctccgtgcggtggtcacttctctgccccttctggcgtgatactgtctcccggatggccagggtactacaaggattctcttaactgtgaatgggtcatcgaagccgagccaggacacagcataaagataacgtttgagaggttccagaccgagctcaattacgatgtgctcgaagtgcacgatggcccaaatctgctaagtcctctcctcggcagctacaacgggacacaggtgccacagttcctattctcctcttctaacttcatctacctgctgtttacaaccgataacagtaggagcaacaacggctttaaaattcactatgaatcagtcaccgtgaacacatactcttgcctggacccaggcattcccgtgcatggtagaaggtatgggcacgatttttctatcggttctacagtcagcttctcctgtgacagcgggtatcggctctcccatgaggagcccctgctgtgtgaaaagaatcactggtggtcccaccccttacccacctgtgacgctctgtgtgggggagatgtgcgaggaccctccggaaccattctgtccccgggttacccagagttctatcctaattcactaaattgtacatggacagttgatgtcactcatggtaaaggcgtgcagtttaatttccacactttccatctggaggatcaccacgattatcttttaatcacggaaaacggcagctttacccaacccctggccaggctgactggaagcgatctcccacccaccataaacgcaggcctgtacggaaatttccgggcacagctccgctttatttctgactttagcataagttacgagggttttaatatcaccttttctgaatataatctggagccatgtgaagaccccggaattcctcagtatggctccagaataggtttcaacttcggaatcggggataccctgacatttagctgctctagcggttatagactggagggtactagcgagattatttgcctgggaggaggacgcagggtgtggtccgctcccctaccaagatgcgtcgccgagtgcggggcaagtgcaaccaacaatgaaggcatcctgctgtcgcccaattacccactcaactacgaaaacaatcacgaatgtatctattccattcaggttcaagcagggaagggcatcaatataagcgcccgaacattccaccttgcccagggagatgtgctgaagatctacgatggcaaggataagaccacccatctgctgggcgcattcactggggcttctatgcgcggtctgaccctgagtagtacaagcaaccagctctggttggagttcaacagtgataccgaggggacagacgaaggtttccagctggtttataccagtttcgagctctcacactgtgaggacccagggatcccccagtttggttacaaaatcagcgatcagggccacttcgctgggtccacaatcatctatggctgtaatccaggctacaccctgcacggttcgtcactgctgaaatgcatgaccggagaaagaagggcatgggattatcccttaccaagctgcatcgcggaatgcggcggtcgatttaaaggagaatcctccggccgaatcctctcccccggatacccattcccatacgataataacttgagatgtatgtggatgatagaggtggatccaggcaacatcgtgtctctccagtttttagctttcgacaccgaagcgtcccatgatattctgagggtctgggatggaccacccgagaacgacatgctgctgaaggagatttctggaagcctcattccagagggcattcactccaccctgaacatcgttacaatacagtttgacaccgatttctatatcagcaagagcggttttgcaatccaattcagcagtagtgtggctaccgcctgcagagacccgggtgtgcccatgaacgggacaagaaacggcgacgggagggagcccggagacactgtggtgttccaatgtgatcccggttacgaactgcaaggagaggaaagaatcacttgcattcaagtggagaacaggtacttttggcagccttcacccccagtctgtatcgccccttgcggtgggaacctgacagggagctctggttttattctgtctccaaattttcctcatccatacccccactctcgcgattgcgattggaccattaccgttaacgctgactatgttataagtttagcctttataagtttttccattgaaccgaactatgacttcctgtatatctatgatggccctgactcgaattctccactgatcggctctttccaggacagcaagctcccggaacgaatcgagtcctcgtctaataccatgcatctcgccttccggtcagatggaagcgtgagctatacaggctttcacctggagtataaggctaaactacgcgagtcctgcttcgatccgggaaacataatgaacggtacgaggctgggcatggactacaagcttgggtctaccgtgacctactactgtgatgcaggctacgtcctacaggggtattcaacattaacctgcatcatgggcgacgatggtcgacccggttggaatagagcgctcccctcttgtcatgccccttgcggaagcagatctacaggttctgaggggactgtcctctcccctaactatcccaaaaattactctgtcggccacaactgcgtttatagcattgctgtgcccaaagaatttgccgtgccgaggactagctccacccagtgctctagtgtgcctgaaccgagatttgggaggcggatcggaaacgagttcgccgtggggagctcagtgcttttcgactgcaaccctggctatatccttcacgggagcatcgccatccggtgtgaaaccgtacccaactcactggcccagtggaacgattctctgcctacttgtatcgtaccttgcggaggaatcctgaccaaaaggaaagggacgattctgtccccaggctatcccgagccatatgacaacaaccttaattgtgtgtggaagataaccgtgcctgagggcgcaggaatccaggtgcaggttgtatctttcgccaccgagcacaattgggactctttagatttttacgatggcggtgacaacaacgctcctaggctgggcagttacagcggaaccacaatacctcaccttcttaactcaacatcgaacaacttatacctcaatttccaaagtgacatatccgtgtctgcagccggtttccacctggagtacaccgccattggtttagatagctgccccgaaccccagactccatcatctgggatcaaaataggtgacagatacatggttggtgatgtggtttcttttcagtgtgatcagggttactcactgcagggccattcccatattacctgtatgccgggaccagtcagacggtggaattatcctatccccatttgcctcgctcagtgcggcggagccatgtctgacttttctggcgtcattttaagcccagggtttcccggaaattatccctctagcctggactgcacatggaccataaatctgcctataggcttcggcgtccacctccaattcgtcaatttttcaacagaaacgatacacgattacctggaggtcaggtctgggtcgtctgagaccagcacggtgattgggagactttcagggccacagatcccttccagcctgttctctacgacgcacgaaacttccctgtacttccatagtgactacagtcagaacaagcagggattccacatcgtctatcaggcttatcagctgcagtcatgtcccgacccgaggccgtttcgtaacggctttgtaatcggaaacgattttactgttgggcaaacaatatcctttgaatgcttccctggctatactctaatcggcaacagtgctctgacctgcttgcacggagtcagccgcaactggaaccacccattgccccgatgtgaggcactgtgcggtggaaatatcaccgccatgaatggcacgatttattcacctggctatcccgacgaataccctaattttcaggattgtttttggttggtacgggtgcctcctggaaacggcatctacatcaacttcactgtcctacaaaccgagcccatctatgacttcatcacagtgtgggacggaccagatcagaatagcccacagatcggacagttctctgggaatacagcgctggaatctgtgtatagtacttcaaatcaaattctcatcaagtttcactctgatttcaccacctcaggattctttgtgctgtcttatcacgcctatcagctgcgggtgtgccaaccaccaccaccagttcccaatgctgaaatcctgaccgaagacgacgagttcgagatcggagacattatcagatatcagtgcctgcccggtttcactctagtgggaaatgcgatccttacttgcaggctgggggagagactgcaaatggacggtgcacccccagtctgccaggtgctttgtcccgctaacgagcttcgtctggattccacgggggttattctctctcctggttaccctgactcatatcctaacttgcagatgtgcgcttggtccatttccgttgaaaagggttataacatcaccatgttcgtggaattctttcagaccgagaaggagtttgatgtgctacaggtctacgacggcccaaacatccaatcgccggtgctgattagtctgtctggcgattatagctctgcctttaatataactagcaacggacatgaagtctttctccagtggagtgcagaccatggcaataacaaaaagggattccgcatacgatatatcgccttttattgctcgacgccagagtctccaccccatggctacatcatcagtcagaccggaggacagcttaacagcgtcgtgcggtgggcttgcgataggggttttagactcgtggggaagtcttctgccgtttgccggaaatctagttacggctatcatgcatgggacgctcctgtgccagcttgtcaggcgattagctgcgggattcccaaggctcccactaacgggggaatcctcacgaccgactacctagtggggactcgcgtgacgtatttctgtaacgacggttaccggttgagctcaaaggaactgactactgctgtatgtcagtctgacggaacttggtcaaatcataataaaaccccaagatgtgtagtggtcacctgtccgagtatcaactcatttatcctggaacatggccgatggaggattgtaaatgggagccactatgaatacaaaaccaaagtcgtgttctcctgtgacccagggtatcacggcctgggaccagcttcaatagagtgcctgcctaacggcacttggtcctggaggaacgaaagaccttattgtcagattatttcttgtggcgagctgccaaccccaccgaacggcaacaagattggcacccagacctcatatggtagcacagctatttttacctgtgatctgggctttatgctggtgggttccgccgtgcgcgagtgtttatcctctggcttatggtccgagagcgagacaaggtgtctcgcgggtcactgcggtattccagaattgatcgtgaatggtcaagtgatcggtgagaactacgggtaccgggataccgtggtgtatcagtgcaacccaggtttcagactaataggctcctccgtccgtatttgccagcaagatcacaattggtccggtcagctgccctcttgcgtgccagtgtcttgcggccatcccggtagtccgatctacgggcgtactagcgggaatgggtttaatttcaacgacgtggtgactttttcctgcaatattgggtatttgatgcagggcccaacaaaagcccaatgtcaggccaatcggcagtggagccatcccccaccaatgtgtaaagtggttaattgttccgacccaggcattcccgctaattcaaagcgggagagcaaaattgagcacggtaacttcacttacgggacagtggtgttctacgactgtaatcccggatatttcttatttggaagttctgtacttatatgtcagcccaatgggcagtgggataaaccccttcctgagtgcattatgatagattgtggtcaccctggcgtacccccaaacgccgtgctatcaggtgagaagtacacttttggtagcaccgtccactactcatgtaccggtaagcggtctttgcttggccaaagtagtcgaacttgccagcttaacgggcactggtcgggatcacagcctcactgcagtggcgatgctaccggaacctgtggggatccgggtactcccggacatggttctaggcaggaaagcaactttaggacaaaaagcaccgtccggtatgcttgcgatacaggctatattctgcacgggagcgaagagagaacctgcctcgccaatggctcatggactggacgccagccagagtgcaaggcagtacagtgtgggaacccaggaaccacagccaatggtaaggtattccgaatcgacggaaccacattcagctcaagcgtgatatatagttgcatggaaggatatatacttagcgggccttctgtgcgtcaatgcaccgcaaatgggacatggtctggcaccctgcccaattgtaccatcatatcctgcggtgaccctggtataccagcaaacggactgcggtatggggatgactacgttgttggtcagaacgtgagctacatgtgccagccaggctatacaatggaactcaatggttcccggattcggacctgtacaatcaatggcacatggtccggggtcatgccgacctgtcgggctgtgacttgtccaaccccccctcaaatttccaacggcagactcgagggcaccaattttgattggggtttcagtatttcctatatttgttcgcctggctatgagttaagctttcctgcggtccttacatgcgtgggaaatggtacttggtctggagaggtgccacagtgtctccctaaattttgtggagatcctgggattcctgcacagggcaaacgtgagggtaaaagcttcatctatcagagtgaggtgtctttttcgtgtaatttccccttcatcttagttgggagttcgaccaggatatgccaggccgatgggacttggtccggctcaagcccacactgtatcgagccaacacagacaagttgtgaaaatccgggagtacccagacacgggtctcagaacaacacatttggttttcaggtgggcagcgtggtccagtttcattgtaaaaagggccatctactccaggggtcgactactaggacgtgtcttcccgatcttacttggagtgggatccagcccgagtgtatccctcattcttgtaagcagcccgagacccccgctcacgccaacgtcgtcggaatggacttaccctcacacggatataccctgatttatacttgccagccagggtttttcttggccggtggaactgaacaccgcgtgtgtcggagcgataacacgtggaccggaaaggtgccaatctgcgaggcgggaagtaaaattttggtcaaggaccccaggcctgcattgggcacaccgtctcccaagctctcagtacctgatgacgtctttgcgcaaaattacatttggaagggttcctataactttaaagggcgaaaacagccgatgaccctgactgtgacctcattcaatgcctctaccggcagagtgaatgctaccctgagtaactccaatatggagcttttactgtctggtgtgtataaatcccaggaagctcggcttatgctgaggatctatctcattaaggttcccgctcacgcctctgtgaaaaagatgaaggaagagaactgggcaatggacggtttcgtgtcagcggagccagatggggctacatatgtgtttcagggcttcattcagggtaaggattacggccagttcggactccaaagactcggactgaatatgagtgaggggagcaatagtagtaatcagccacatggcactaattccagttcggtcgcaatagctattctggtgcctttttttgcacttatctttgctgggtttggcttctacttgtataagcagaggactgcgcctaagactcagtacactggctgttccgttcacgagaataataatgggcaggccgctttcgagaaccccatgtatgatactaatgctaaatctgtggagggtaaagccgtgcgatttgatccaaacctgaacaccgtgtgtactatggtttac

SEQ ID NO: 219514 - DNA, 10617 bp, Artificial Sequence
  Description of Artificial Sequence: Synthetic coding sequence
atgaaaggcattagaaagggggagtctagggccaaggaatccaagccttgggaaccaggtaaaagacgctgcgctaaatgtggcaggctggactttattctcatgaaaaaaatggggattaagtccgggtttaccttctggaatctagtcttcctcttaacggtttcttgcgtgaagggttttatctacacctgtgggggaacccttaagggcctgaacggcacgattgaaagccctggatttccatacggctacccaaacggagccaattgtacgtgggtgatcatcgctgaagagcgcaacaggatacagatagtgttccagtcttttgccttggaggaagagtacgattacttatcgctgtatgatggtcatcctcatcctacaaacttccggactaggctgaccgggtttcaccttccacctcctgtcacttcaacaaagtcagttttctcattgaggctaacaagcgattttgccgtatccgcacacgggtttaaagtgtattacgaagaactgcagtctagctcttgcggtaacccgggagtcccaccaaaaggggtcctctatggaacccgctttgatgtgggcgacaagattcgatactcatgtgttaccggctacatcttggatggtcatcctcagctgacatgcatcgctaactccgtaaatactgccagctgggatttccctgtaccaatctgcagggctgaagacgcctgcggcggtacaatgcggggatccagtgggattatcagcagcccaagcttccctaacgagtaccacaataacgccgattgcacctggacaattgtggcagaacccggtgacacaatatctctgatctttaccgacttccaaatggaagagaagtacgactacctggaaatcgagggctccgagcctccgacaatctggctctctggcatgaatataccacctcccatcatatctaacaaaaactggctgaggctccactttgtaactgactctaaccatcgatatcggggattttctgcaccatatcaggtgaaaaaagccattgacttcaaaagtcggggttttaagctcttccccggtaaagataactctaacaagttcagcatacttaatgaagggggtatcaagaccgcctccaatctctgccctgatccgggagaaccggagaacggcaagcggattgggtccgatttcagcctaggctccactgtgcaatttagttgcgatgaagattacgtgctgcaaggggctaagtccattacttgccagcgaatagccgaagttttcgcggcttggtctgatcacagaccggtgtgtaaagttaagacgtgtggatctaacctccaggggccttctggaacattcacttcccccaatttcccattccagtatgactctaacgcccaatgtgtctgggttataacggctgtgaatactaacaaggtcatacagatcaatttcgaagagttcgatctggagattggatatgacacgttgactatcggcgatggcggagaggttggcgaccccaggaccgtcttacaggttctcaccgggtccttcgtccctgacctgatagtgtctatgtcaagccagatgtggcttcatctccagacggatgaaagcgtgggatcagtgggattcaaggtgaactacaaggaaatagaaaaagaatcttgtggagacccgggtacaccgctatatggcataagggagggagacggtttttctaaccgcgacgttttacgattcgaatgtcagtttgggtttgagttaatcggcgagaagagtattgtatgtcaggagaataatcagtggtcggcaaacatccctatatgcatcttcccttgtctctccaactttaccgcacctatgggcacggtgttaagcccagactacccagagggctatgggaataacctaaattgtatatggacaataatctctgatcccggaagccgtatccatctgtcctttaatgacttcgacctggaatctcaattcgattttttggctgtgaaagacggggacagcccggagtcgcccattctgggaaccttcaccggcgctgaggtgccctcgcatctcacgtctaattctcatatcctgcggctggagtttcaggccgatcactccatgagtggccgagggttcaatattacttacaacacttttgggcacaatgaatgtcctgaccccggaatcccaatcaacgctaggagattcggagacaatttccaactggggtcttcaatcagcgtgatttgcgaggagggctttatcaaaactcaaggtacagaaactattacatgtatcctcatggatggaaaggttatgtggtctggactgattcctaaatgcggcgctccatgcggagggcatttcagtgcgccatcaggcgtgatcttatcacctggctggccaggctactataaggatagcctgaattgcgagtgggtgattgaggcggaaccagggcactccataaaaattacgttcgagcggtttcagacagaattaaattatgacgtccttgaagtccacgacgggcctaatctgctctctccgttactcgggagctataatggtacacaggtgcctcagtttctattcagcagcagtaacttcatctacctcctgttcactacggataattctcgctcgaacaatggctttaagatccattatgaaagcgttactgtcaacacctacagttgcctggacccgggtattccggtccacggcaggagatatggccatgacttttctatcgggtccaccgtgagtttctcttgtgactccgggtatagactaagccacgaggaacccctcttgtgtgaaaaaaaccattggtggagtcaccccctgccgacctgcgacgccctgtgcggtggcgacgtaagaggcccttctggaactatactgtccccgggatacccagagttttatccgaactctctgaactgcacctggacagttgatgttacccacggaaaaggtgtgcagttcaatttccatacattccaccttgaagatcatcacgattatttactcatcactgaaaatggttcattcacacagccattggcacggctcacaggctcagacttaccgcctacaataaacgctggactatacggcaatttcagggcccaactgcggtttatctcagacttctccatatcctacgagggtttcaacattacatttagtgagtataatctcgaaccctgcgaggatcctgggatcccgcagtatggtagccggatcggattcaatttcggtattggggataccctgaccttctcctgttccagcgggtatcgcctggagggcacatccgaaatcatttgcctcgggggaggtaggcgcgtgtggagcgctcccttacccaggtgcgtcgccgagtgcggagcctcagctacgaataatgagggcattcttctcagcccaaactaccccctcaactatgaaaataaccacgaatgtatatattcgattcaggtccaagccggaaagggcattaacatttcggcgaggacgtttcacctcgcgcagggagatgtcctgaagatttacgacgggaaagataagactactcacttactgggcgcttttacaggcgcttcaatgaggggccttactttgagctcgacgagtaatcaattgtggctagaattcaacagcgatacggaaggcaccgacgaagggttccagttggtgtacacctcatttgagctgagtcattgcgaggaccccggtatacctcagttcgggtacaaaatcagcgaccagggccacttcgcgggaagtactatcatctatggctgcaaccccggttatactttacatggcagttctctgctcaagtgcatgactggcgaacgaagagcttgggattacccactcccatcgtgcatagcggaatgcggcggtaggttcaaaggggaatcttcaggaagaatcctgtcccccggttacccattcccatacgataataacttaaggtgtatgtggatgatcgaagtagatcctgggaatatcgtgtccctgcagttcctcgcattcgatactgaagcttctcacgacatccttagggtttgggacggccctccggagaacgacatgttgctgaaagaaatttccggttcactcattcccgaggggatccactccactctcaatattgtgacaattcagtttgacacagatttttatattagcaagtcaggcttcgccatccagttctctagcagcgttgctactgcctgccgcgaccctggggtaccaatgaatggcactcggaatggagacggacgggagcccggtgacaccgtggtcttccagtgtgatcccggatacgagctccagggtgaagagaggataacctgcatacaggtggagaaccgttacttctggcagccatcaccaccagtatgtattgccccttgcgggggtaatttaaccggctcctccggcttcatcctctcacccaactttccccatccgtatcctcactcccgcgactgcgactggaccattaccgtaaacgccgattatgtcattagtctcgcattcataagcttctccatcgagcccaactacgacttcctctatatatacgacggcccagactctaatagccctctgattggatcattccaggactccaaactacctgagcgcattgaatcttcttccaataccatgcacctggcgttcaggtccgacggatcagtgagttacactggatttcatcttgaatataaggcgaagctgagggaatcgtgttttgatccaggcaacattatgaatgggacacgtttaggcatggactacaagctaggaagcacagtgacttactactgcgacgctggatacgtgctgcagggctactccactcttacttgcattatgggcgatgatggacggccaggatggaatcgagccctccctagctgccacgcgccttgcggatctcgttccacggggtcagagggcaccgtgctgagccctaattacccgaaaaattacagtgtggggcacaattgcgtgtactccattgcggtgccaaaggagttcgtagtgtttggccaatttgttttcttccaaacatccctacacgatgtggttgaagtgtacgatggcccaacccaacagagctcgctcttgtcttctcttagcgggtcccactcaggcgaatcactgccactgtcatcagggaatcaaattacaatacggttcactagtgtgggaccaatcacagcaaagggcttccacttcgtgtaccaagcagtgcctagaactagctctactcagtgcagctcagttcctgaacctagatttgggagacgaatcggcaacgagtttgcagtcggctcttccgtgctctttgattgtaatccaggttacattttgcacggatccatcgctatccggtgcgagaccgttccaaactccctcgctcagtggaacgacagtctcccaacttgtatagttccatgcggaggaatcctgaccaagaggaagggaactattctttcccccggatatcctgagccttacgataacaatttgaattgtgtgtggaaaatcacagtgcccgaaggcgcagggatacaggtgcaggtggtgtccttcgcgactgagcacaattgggactcgctagatttctacgatggtggggacaataacgcaccgaggctgggctcatatagtggaacgacgatccctcacctgctgaactcaactagcaacaacctctaccttaatttccagagcgatatttctgtgagcgccgctgggtttcatctggagtacactgccattggcctggacagctgtcccgaaccccagacccctagttccggcattaagattggtgacagatatatggtgggggatgtagtgtcatttcaatgtgatcaggggtacagtctgcagggccactcccatatcacctgcatgcccggaccggttcggaggtggaattatccaattccgatttgtctggcccagtgtggaggtgcgatgtctgatttcagtggcgtaatcctttctccgggattccccggaaactaccccagttctcttgactgtacttggactattaatctacctattggatttggagtccacctccaatttgtaaatttcagcaccgaaacaattcacgactatcttgaggtccggagcggtagcagcgaaacatcaactgtgatcggcaggctgtctggaccgcagataccgtcgtctcttttttctactacccacgagaccagcctgtattttcacagcgactattcccagaacaaacaaggattccacatagtgtaccaggcataccagctgcagagttgtcccgaccccaggccgtttaggaacggattcgtcatcggaaacgacttcacagtaggacagactattagttttgaatgctttcctggttacacgttaatcgggaatagtgctcttacctgcctccacggcgtgagccgcaactggaaccaccctttacctcggtgtgaggcgctctgcggcggtaatatcactgccatgaacggcactatctacagcccgggatacccagacgaataccccaatttccaagattgcttttggctggtacgcgtgccgccaggcaacggcatctatataaattttactgtccttcagaccgagcctatttacgactttattacagtctgggacgggcctgaccagaacagtccacagatcggccagttctccgggaataccgccttggagagtgtttactctacttcaaaccagattttgattaaatttcactctgattttaccacatcgggtttcttcgtgctaagctaccatgcttatcagctgcgagtctgtcagccaccaccgcctgtgcccaacgccgaaattcttactgaggacgatgaatttgagattggtgacattatccggtaccaatgtctgccaggattcacactggtgggcaacgcaatactgacctgtagattgggggagagactgcagatggacggcgcacccccagtgtgccaagttttatgccctgcgaacgaactcaggcttgattccaccggggtgatactgtcgcctggctatcccgactcctatcccaatcttcaaatgtgtgcatggagcatctcggttgaaaaagggtacaacattactatgttcgtggagttcttccaaactgaaaaagagtttgatgtgcttcaggtgtatgatggccctaatatacagtcccccgtgttgatttcactgagtggggactacagcagtgcttttaacattacctccaatggccacgaagtgtttcttcagtggagcgctgatcatgggaacaacaaaaagggattcagaattaggtacattgccttttattgctctacacccgaatccccccctcatggctacatcatctcacaaacgggcggacagctaaactctgtcgtgagatgggcttgcgacaggggatttcggctggtgggaaagtctagcgctgtgtgccgcaagtccagttatggataccacgcctgggatgcccctgtgcctgcctgccaagctatcagctgtggtatcccaaaggctccaaccaatggcggtatcctgactacagactatctcgtgggtacccgtgtaacgtacttttgcaatgatggataccggctcagttcgaaggaactgacaaccgcggtgtgtcagtctgacggaacttggagcaatcacaacaaaaccccccgatgcgtcgtaatcagttgcggcgaactgcccaccccacccaacggcaacaagatcggcacacaaacctcttatggtagtactgccattttcacatgtgacctgggttttatgctagtgggctctgcagtgagagaatgccttagcagcggcctttggtccgagtctgagactaggtgcctggcaggccattgtggcatcccagagctgatcgtgaatggccaggtaatcggggagaactacggctatagagataccgtggtttaccagtgcaatcccggattcaggctgattggatcatctgttaggatctgccagcaggaccataattggtcgggtcagctgcccagttgcgtccctgtgtcttgcgggcatcccggatcccccatctacggtcgcaccagtgggaacggcttcaactttaatgacgtggtcacctttagctgcaatattggatacctcatgcagggcccaacaaaggcacaatgccaagctaatagacagtggtcccaccccccaccgatgtgtaaggtcgttaactgcagcgatcccggaatccccgctaactcaaaacgcgagagcaaaattgagcatggtaacttcacgtatggcactgtggtgttttatgactgtaatccaggatacttcctttttgggtcctccgtgctgatctgtcagcccaatggtcaatgggacaaacccctcccggaatgcattatgatcgactgcggtcatccaggggtgccgcctaacgccgttctatcaggtgagaagtacacattcggcagtaccgtacattattcgtgtaccggtaagcgctctctccttggacagagcagcagaacatgccaactgaacggccattggtctggctcccagcctcactgcagcggcgacgcaaccggcacctgtggcgacccaggcacaccaggccatggcagcaggcaggagtctaatttccggactaaatcaacagtaagatatgcttgtgacactggctatatactccacggatccgaggagcgaacttgccttgccaacggaagctggactggcaggcagcccgagtgtaaggcggtgcagtgtggcaatcctggaacaaccgccaacggcaaagtctttcgcatcgacgggaccacatttagcagcagtgtgatctactcctgtatggagggctatatcctgtccggtcctagcgtcaggcaatgcacagctaacgggacctggagtgggacactgccgaattgcacaattataagctgtggtgatcctggtattcctgctaatggcctccgctatggcgacgattatgtggtcggccagaacgtttcgtacatgtgccaacccggttataccatggagctgaatgggtcaagaatcagaacctgcacaatcaatggcacttggtccggagtgatgcctacttgcagggccgttacctgtcccacacccccacagatttcgaacgggaggcttgagggaacaaatttcgattggggtttctcaatctcctacatatgtagtccaggctatgaacttagttttcctgccgtgttaacttgcgtcggaaatggaacctggtctggggaagtgccacagtgtctgccgaaattttgcggagaccctggaatccccgcacagggtaaacgcgaggggaaatctttcatctatcagagtgaagtgtctttctcctgtaacttccccttcatcctcgttggcagctctactaggatttgtcaggcggatggcacctggagtggtagctcccctcattgcattgaacctacccaaacttcttgtgaaaacccgggagtgccaagacacggatcccagaacaatacatttggttttcaggtgggctctgttgtacaatttcactgcaagaaagggcatttgttacagggctcgactacacgcacgtgcctacccgaccttacgtggtcgggtatccagccggaatgcatccctcactcatgtaaacagcccgaaactcctgcccacgctaatgtggttggcatggacttgccttcccacggctacaccctgatctacacatgtcagcctggcttctttctggccggaggtacagagcacagggtttgtcggagcgacaacacatggacaggcaaagtgcctatatgtgaggccggaagcaaaatcctggtgaaggatccgaggccagcgctgggtacaccctcaccaaagctttccgtccccgatgacgttttcgctcaaaattacatttggaagggcagctacaactttaagggacgaaaacagccaatgacactcactgttaccagtttcaacgcatcgactggcagagtgaacgccaccctgagcaacagcaacatggaattattgctgtccggcgtgtataaatcacaagaggcgcgactaatgctgcggatctacctgattaaagtgcccgctcatgcttctgtcaaaaaaatgaaagaggagaactgggccatggacgggttcgtgtcagctgaaccagacggtgccacatacgtgtttcaggggttcatccaaggtaaagattacggccaatttggtctgcagaggctcggtctgaatatgagtgagggttcaaatagttccaaccagcctcatggtaccaacagcagttcagtcgccatcgcaattctggtgccattcttcgcgctgatctttgcagggttcggtttctacctgtataagcaaaggactgctcctaaaacacaatacaccgggtgctcggtgcacgagaacaataatggacaggccgcttttgagaatcctatgtacgatacaaatgccaaaagcgtggaggggaaggcagttagattcgacccgaatttaaacactgtctgcacgatggtatag

SEQ ID NO: 219515 - DNA, 2511 bp, Artificial Sequence
  Description of Artificial Sequence: Synthetic coding sequence
atggcaggactcaattgtggggtatccattgccctcctcggcgtcttgcttctcggtgccgcaaggctgcccaggggagcagaagccttcgagatcgcactaccgcgagaaagcaacatcacagttctgatcaaactcgggactcctaccctgctggctaaaccatgctacatcgttatatccaagcgccacattacaatgctgtcaatcaagagcggtgagcgtatcgtgttcactttttcctgtcagtccccggaaaatcactttgtaattgagatacaaaagaatatagactgcatgagcggtccctgcccatttggagaagtgcagctgcagccctccaccagtctgcttcctaccttgaataggaccttcatttgggatgtcaaagcgcacaaaagcatcgggcttgaactgcagttctccatccctcgtctccgccaaataggccctggcgagtcatgtccggatggtgtgacccattcgatttccggcagaattgacgccactgtggtccgcattgggaccttctgttcaaacggtacagtgtctcggatcaaaatgcaagagggggtgaaaatggccctacacctaccatggtttcacccaaggaacgtctccggcttttccatcgctaaccggtcgagcatcaaacggctgtgtattattgaatccgtgtttgaaggggagggctccgccactctgatgtctgcgaactacccagagggctttcccgaagacgaactcatgacatggcagtttgtggtacccgctcacctgagagcaagcgtttccttcttaaatttcaatcttagtaactgcgagcggaaggaggagcgagtcgagtactacatccctggaagtacgacaaatcctgaggtcttcaaactggaggacaagcagccagggaatatggccggaaattttaacctgtctctgcaggggtgtgaccaggatgctcagtccccagggattctcagactgcagtttcaagtcttggtgcaacatcctcaaaacgagagtaacaaaatttatgtcgtggatctgagcaatgagcgagctatgtctctcaccatagagccgagacccgtcaagcagagccggaaatttgtgcccggatgcttcgtttgtctggagagccggacttgtagttctaatctaacactcacatctggctccaaacataaaatatcatttctctgtgatgatctaaccagactttggatgaatgttgagaaaaccatttcttgcaccgaccacagatactgccagcgcaagagctatagtcttcaggtgccaagcgacattttgcaccttccggtcgagctccatgatttttcatggaaactgctggttcccaaagatcgactgtcactggtgttagtgccagctcaaaagctccagcagcacactcacgagaaaccctgcaataccagtttttcatacttggtggcatcagcgatcccctcccaagatttgtactttggtagcttctgccccggaggcagtataaagcagatacaggtcaagcagaacatctccgtgacactgaggaccttcgcaccctctttccagcaggaagcaagcagacagggattgactgtgtcctttattccttatttcaaagaggagggcgtgttcaccgtaacgccagacacaaagtccaaggtatatctgcgcacaccaaattgggataggggtctgcccagtctgacatctgtcagttggaacatttccgtcccacgagaccaagtcgcttgtctgaccttttttaaggagcggtctggcgttgtttgccagaccggtcgcgcatttatgatcatccaggaacaacgcactagagccgaggagatcttttcgctggacgaggatgtgctcccaaaacctagcttccaccaccattccttctgggtgaatataagtaattgtagtccaacatcaggcaaacagttggacctgttgttttctgtcacccttaccccccgaactgtggatctcactgtgattcttattgccgctgtcggcggtggagtgctgctactcagtgctctggggcttataatttgctgcgtgaaaaagaagaaaaaaaaaaccaataagggccctgctgtggggatatacaacgacaacatcaacaccgaaatgcctcgccagccaaagaaattccagaagggacgaaaggataatgatagccacgtgtatgccgttattgaagatacaatggtctacggacacttattacaggattcttcaggatcatttctgcaaccagaagtggatacatatagaccatttcagggcacaatgggagtttgtccgccttcccccccaaccatctgtagccgagctccaacggctaagctggccactgaagagccacctccacggagccctcctgaatcggaaagtgagccgtataccttttcccatccaaacaacggtgacgtgagcagcaaagacacagatatcccactgttaaacacccaggaaccaatggagccagctgaatag

SEQ ID NO: 219516 - DNA, 1032 bp, Artificial Sequence
  Description of Artificial Sequence: Synthetic coding sequence
atggctgggctgaattgcggcgtcagtatagctctcctcggtgtgctcctgctcggtgccgctaggctgcctcggggagccgaagccttcgaaatcgctctccctcgtgaatcgaacattactgtgctaattaagctgggcactcctacgctattagctaaaccttgctacatcgtgatatccaagcgacatataacaatgctgtcaatcaagagtggagagcggatcgtgttcaccttcagctgccagtctcccgagaaccactttgttattgagattcaaaaaaacattgattgtatgtccgggccttgtccatttggggaggtgcagttgcagccaagcacaagtctgttgccaacccttaatcgtacatttatttgggacgtcaaggctcacaagtctattggacttgagctccagttcagcatccctcgactgaggcagataggcccaggtgagtcttgccccgacggcgttacccactccatttcaggtcggatagacgccaccgtggtgcggataggcacattttgttccaatggcactgtgtcgcggatcaagatgcaagaaggagtcaagatggctctgcatttgccatggtttcacccacgtaacgttagtggcttcagtatcgcgaacagatcttctattaagagactgtgtatcattgagtccgtgttcgaaggagaaggctcagcaaccctgatgagcgccaattatccagaaggatttccagaagacgagctgatgacctggcagttcgttgtgccagcacacctcagagcatccgtgtcattcctgaactttaatctaagcaactgcgaaagaaaggaagagagggttgaatactacatccctggtagtaccacaaatcccgaggtgttcaagctggaggataagcagcctggtaatatggccggaaatttcaatctgagcttacagggatgcgaccaggacgcccaatcccctggtatactccggctgcaatttcaagtgcttgtgcagcacccccaaaatgaaagtagcgagtag

SEQ ID NO: 219517 - DNA, 513 bp, Artificial Sequence
  Description of Artificial Sequence: Synthetic coding sequence
atgatgaacatgtcactcccattcctctggtcccttctgactctcctcattttcgcagaggttaacggcgaggctggagagctggaacttcaacgccaaaaacgaagcattaacctgcagcagcctcgcatggctacagagcggggaaaccttgtgttcctcactggttcggctcaaaatattgaattcagaacggggagtttggggaaaatcaaactcaacgacgaggatctgagtgagtgtctccatcagatccagaagaacaaggaggatattatagagctcaaagggtccgccataggattacctcagaacatctcaagtcaaatttaccagctcaacagcaaactcgtggatttagagcgcaaatttcagggactccagcagacagtcgacaaaaaggtttgttcgagcaacccttgccaaaatggtgggacctgtctgaaccttcacgactccttcttctgcatctgtcctcctcagtggaaggtgtcgcacctcctgttcgggtag

SEQ ID NO: 219518 - DNA, 10872 bp, Artificial Sequence
  Description of Artificial Sequence: Synthetic coding sequence
atgatgaatatgtctttaccatttctgtggagcctgctgactctcctgattttcgccgaggtcaacggcgaggcgggtgagctggagctccaacgtcaaaagcgatccataaatctgcagcagccccgtatggcaaccgagaggggaaatctcgtgtttctgaccggctcagcccagaatatagaattccggacgggctctcttggcaaaatcaaactgaatgatgaagaccttagcgaatgcctccatcaaattcagaagaataaggaagacataatagagctgaagggcagcgccatcggattgccccagaacataagtagccaaatctaccaactgaatagcaagctcgtggatctggaacggaaattccaggggctgcagcaaaccgtcgacaagaaggtgtgttcaagtaatccctgtcagaacggcggtacttgtttgaatctgcatgactcgtttttctgtatatgcccaccccaatggaagggacctctctgctccgctgacgttaatgagtgcgagatttatagtggaacccccttgtcctgtcagaatggtggaacctgtgttaacactatggggtcatacagttgccattgcccccctgaaacatatggaccccaatgtgccagcaagtacgacgattgtgaaggaggctccgtggctaggtgtgtgcacggtatttgcgaggaccttatgagggagcaagccggagaacctaaatattcatgcgtttgcgacgctgggtggatgttttcacccaactctcctgcttgtaccctcgatagggacgagtgttcatttcaacccggaccatgttcgactctcgtgcaatgcttcaacacacagggcagcttttattgtggggcatgccctactggctggcaaggcaatgggtacatctgcgaagatattaacgaatgtgagattaacaatgggggttgcagcgtggcccctccagtggagtgtgtgaatactccagggtccagccattgccaagcatgtcccccaggctaccagggagatgggagggtttgtacgttgaccgacatctgctcagtgtcaaatgggggatgccatcccgatgcttcctgttcctctacattagggagcctcccattgtgtacatgtttgccgggatacactgggaacgggtatggtccaaatgggtgcgtgcaacttagcaacatctgcctctcacatccctgtttgaacggccaatgcatcgatacagtaagcggctatttttgtaagtgtgactccggatggacaggtgtgaactgcacagagaatatcaatgagtgcttgtcaaatccctgcctgaatggcggtacctgtgtcgatggcgtcgactcgttctcttgcgagtgcacccggctatggactggtgccctgtgtcaggtgccacagcaggtgtgcggggaaagtctgtctgggattaatgggtcgttctcatacaggagcccagatgtaggctacgtgcacgatgtcaattgcttttgggtgatcaagacagagatggggaaagttctgagaattactttcacgtttttccgtctggagtcaatggacaactgcccacatgaatttctgcaggtgtacgacggggattcctcatcggccttccaactggggagattttgtggatcaagcctgccccacgaactgctgagtagtgacaatgcgctgtactttcatctgtattcagagcacctgaggaacggaagaggttttaccgtgcggtgggagactcaacagccggagtgcggtggcatactgaccgggccatatgggtcaatcaagtcccctggttacccagggaactaccccccaggacgcgactgcgtgtggattgtagtgacaagtcccgatttgctggtcacatttacattcggcactttatccttggaacaccatgatgactgcaacaaagattacctagaaatcagagatggtccactttaccaggaccctctgctggggaagttttgcactaccttttcagtccctcccctgcaaactactggtccctttgcgcgtatccattttcattccgatagtcaaattagcgatcaaggatttcacattacctatcttacatctccctccgatctacggtgcggcggaaactatacagatccagaaggtgagttatttttgccggaactgtccggtccttttactcacactcgccagtgcgtgtatatgatgaagcagccacagggcgagcaaattcagatcaattttacccacgtggaattgcagtgccagtcagacagctctcagaattatattgaagtgagagatggagaaacgctactaggaaaggtgtgtggaaatgggacgatctctcacattaagtccattacaaacagcgtgtggatccgttttaaaattgacgcgtcggtggaaaaagctagtttccgcgcagtttaccaagttgcgtgcggtgacgagctgacaggcgagggtgttattcgcagcccctttttccccaacgtctacccgggagagcgcacctgtagatggacgatccaccaaccccagagtcaagttatcctgcttaactttaccgtgtttgagatcggtagctctgctcactgtgaaacagactacgtggagattggttccagttcaattttaggaagtccggagaacaaaaagtactgcggtaccgatattccctctttcattacttcagtctacaattttctatatgttacctttgtgaagtcgtccagtaccgagaaccacgggttcatggcaaaattttcagccgaggatctagcttgtggggaaatactgaccgaatcaactgggaccatccagagcccaggccaccccaacgtgtacccacatggcatcaactgtacatggcacattctcgtccagcccaaccacctgatacatcttatgttcgaaacgtttcatcttgagttccactataattgcacgaacgactacttagaggtttatgacactgatagcgaaaccagcctagggcgttattgcggaaagtccatcccaccatcactcacctcttccggaaattcgctgatgctggtgtttgtgaccgactccgatctcgcgtacgaaggtttccttataaactacgaggcaatttccgcagcgacagcatgtctgcaggactatacagatgatctgggaacttttacctcaccaaacttccccaacaactatccgaacaactgggaatgtatctacaggattacggtgcggactggacagctcatagccgtacacttcactaatttttccttggaggaagcaatcgggaactactacaccgactttttagaaatccgagacggcggttacgagaaatctccactgttggggatcttctacggttccaatcttcccccaactattattagtcacagtaataagctctggctgaaattcaagagcgaccagatcgacacccgctctgggtttagcgcctactgggatggaagctctacggggtgcggcggaaatctcaccaccagcagtggcacttttatcagtcccaactaccccatgccctattatcattcctcagaatgctactggtggctgaagagttcccatggaagcgccttcgagcttgagtttaaagatttccatcttgaacatcacccgaattgcactctggactacctggccgtctatgatggcccttccagcaactcccatctgctaactcaattgtgcggcgacgagaagccacctctgatccgctcatctggggattcaatgttcatcaaactccgcacagacgaaggacagcagggcaggggatttaaggcagaatatagacagacttgtgagaacgtggtaatagtaaaccaaacgtacgggatactagagagtattggataccctaatccatactctgagaaccagcactgcaattggacgatccgggctacaacgggcaacaccgtgaattacacctttctcgcattcgacctggagcaccacattaactgttccacggactatctcgagctttacgacggcccaaggcaaatgggccgttattgcggggtggatctaccccctccgggatccaccacaagttcaaaactccaagttctcctgttgacggatggagtcggtcgcagggagaagggtttccagatgcagtggtttgtctatggatgcgggggagaattgagcggagccactgggtccttctcctcacccggttttcctaaccggtacccaccaaataaggagtgtatttggtacatcagaaccgatccaggttcctcaatccagctgacaattcatgacttcgacgtcgagtaccactctcggtgtaacttcgatgtccttgaaatttacggcggtccagactttcacagtcctcggatcgctcaattatgtacacaaaggagccctgagaacccgatgcaagtatccagcactggaaatgagctagccatcagatttaagactgatctgtccattaacggcaggggctttaatgcatcctggcaggctgtcaccggcggttgcggcggaatttttcaggcaccatccggcgaaatccactccccaaactacccctctccatataggagcaataccgactgctcatgggtgatccgggtcgatcgcaaccaccgcgttctgctcaatttcaccgatttcgacttggagccccaggattcctgcataatggcctatgacggattgtcatctacaatgtcccggctagccaggacctgcggaagggaacagctggctaaccctatcgtgtcctccggaaattctctgtttctgcgattccaatcaggtccctctcgccagaacagaggctttagagctcaatttcggcaagcatgtgggggacacatccttaccagttccttcgatactgtttcttctcctagatttcctgcaaactatcccaacaaccagaattgctcatggattatacaggcccagcccccattgaaccatatcaccttgtcattcacgcacttcgagttggagcggtccacaacttgtgcccgtgatttcgtggagatactggacggagggcacgaggacgctcccctgagaggaagatactgcggaacagacatgcctcatcctattacttctttcagttctgccctgactctgcgctttgtcagtgattcatcaattagcgccggtggcttccatactacagttactgcctcagtcagcgcatgcgggggaaccttttatatggcggaaggcattttcaatagccctggctatccggatatctacccccctaacgttgaatgcgtgtggaatatcgttagtagcccagggaataggctgcagctctcctttatctcatttcaattggaagactcccaggattgcagtagagacttcgtcgaaattagggaaggtaacgcaaccggtcacctggtcggacgctattgtgggaactcttttcccctcaactatagctctatcgtgggccatacgctttgggtgcgattcatctcagacggttcggggtccggaaccggttttcaggcaacatttatgaagatctttggtaacgacaatattgtggggacacatgggaaggtcgctagtccattctggcctgagaactacccccacaactccaattaccaatggacagttaacgtgaatgcttcccacgtggtgcatgggaggatattagaaatggacatagaggaaatccagaactgctactatgacaagctgcggatttatgatggtcccagcattcacgccaggctgatcggtgcctattgtggaacgcagacggaaagttttagctccacaggaaactccctgacatttcacttctacagcgattccagtatttccggcaaagggttcctgcttgagtggtttgctgtcgacgctccagacggggtcctccccaccatcgcccctggcgcttgcgggggttttctcaggacaggtgacgcccctgttttcctcttcagtcccggttggcctgattcttattctaacagggtcgactgcacctggttgatccaggccccagacagtaccgtcgagctgaacatcctgtccctcgacatagaaagtcaccggacgtgtgcctacgattcactggttataagggacggtgacaataacttggcacagcagcttgcagtgctgtgcggcagagaaattcccggacccatccgctccactggagagtatatgttcataagatttacaagcgactcaagtgtgactcgggctggatttaatgctagttttcacaaaagctgcgggggttacctccatgctgatcgcggtatcattacatcccccaagtacccagaaacttaccccagcaacctaaactgcagctggcacgtcctcgtccaatcaggcttgactattgcagttcacttcgagcagccgttccaaataccaaatggcgattcatcatgtaaccaaggagactacctggtgctgcgcaacggaccagatatctgctcaccaccactgggaccacccggaggaaacggccatttctgtggctcacacgcatcaagtacgctatttacctctgacaaccaaatgtttgtacaattcatctcagatcacagcaacgagggccaggggttcaagattaagtatgaggccaagagcctggcatgtgggggtaatgtgtatatccatgacgcagactcagctggctacgttaccagccctaatcaccctcacaattaccccccacacgctgactgtatctggattctggcggcaccaccagaaacacgcattcaactgcaattcgaggaccgctttgatatcgaggtaacaccgaattgtacttcgaattatctcgagttacgagacggggtggattccgacgcgccaatcttgagcaaattttgtgggacgagtctgccctcttcgcaatggtcatccggtgaggtgatgtacttacggttccggtcagataattcacccacacatgttggctttaaagcaaagtatagcatcgcccagtgtggcggaagggtccctggacaatcaggagtagtggaatcaattggccatccgaccctgccgtatagagataacctcttttgtgaatggcaccttcagggactgagtggccattatctgaccatcagcttcgaggattttaacctgcagaattcaagcggctgcgaaaaagattttgtggagatctgggataatcataccagtgggaatattcttggtcgctactgcggtaataccatccctgactccattgatacctctagcaatactgcggtggtgcgattcgtaacagacggcagcgtgaccgcgtccggtttccggctccgtttcgaatccagtatggaggagtgtggcggagatctgcaagggtctattggaactttcacgagccctaactatcccaatcccaatcctcatgggagaatctgtgagtggagaattaccgcccctgagggccgacggatcacactgatgtttaataatctgcggctcgccacgcatccctcctgtaacaatgaacacgtgatcgtcttcaatggtatcaggtcaaactctcctcagctggaaaaattgtgttcttctgtaaacgttagtaacgagattaaatcatctgggaacactatgaaggtgattttctttactgatggctctagaccttatggcggatttaccgcaagttacactagttcggaggacgccgtctgtggcggtagtctccccaatacccccgaggggaatttcactagtcctggctacgacggagttcgcaactacagccgcaacttgaactgtgaatggactttatctaaccctaatcagggaaattcttcaatttccatccacttcgaagatttttacctagagagccatcaggattgtcagttcgacgttctggaatttcgggtgggcgatgctgacggacctctaatgtggcggctctgcggtccttccaagcccacactgcccttggtcatcccgtattctcaggtgtggattcacttcgtcacaaacgaacgggttgagcacatcggattccatgctaaatacagctttaccgattgcggaggcattcaaattggggatagcggggtgatcacatctcctaactatcctaatgcttatgattcccttacgcactgctccagccttctggaggccccacagggtcatactattaccctgacattttctgacttcgacatagagccacacacgacctgtgcgtgggactcggtcactgtgcggaacgggggatccccggagtcacctatcatcggccagtactgcggaaactcaaacccccgtacaattcagagcggaagtaatcagctcgtggtgacttttaatagcgaccactccctgcagggcggaggattttacgccacctggaacacgcagaccctgggttgtggaggcatctttcattccgataacggtaccatccgttctccccactggccacagaattttcctgaaaattccaggtgtagctggacagcaatcacacacaagagcaagcatctggagataagttttgacaacaatttcctaatccccagcggtgatggacagtgccagaattcgttcgtgaaagtttgggccggaactgaagaagtcgataaggcactcctcgccaccgggtgtggtaacgtggctccaggacctgttatcactccaagcaacacattcacggccgttttccagtcacaggaggccccagctcaaggtttttctgcatcattcgtgtctcgctgtgggtctaactttactgggccatcgggctacataatcagccctaactaccctaaacagtacgacaataacatgaactgcacctacgttattgaggccaatccattatcagtggttttactgaccttcgtgtcttttcacttggaagcccgtagcgctgtgaccggttcctgtgtgaatgatggggtgcatatcatacggggatactcggtaatgagcacacccttcgccactgtttgcggggacgagatgcctgcaccacttactattgccggaccggtacttcttaacttttacagtaatgagcagatcacagactttggctttaaattttcttatcgcatcatcagttgtggcggagtttttaatttttcctcagggatcattacaagccctgcttactcctacgcggactatccgaatgatatgcattgtctctataccattactgtgagtgacgataaggtcattgagctgaaattcagcgatttcgatgttgttcctagtactagttgctctcatgattacctggcgatatacgatggagccaacacttccgatcctctgcttggcaagttttgtggttctaaacgccctcccaacgtgaagtcttcgaacaattccatgctgctggtctttaagacagattcctttcaaacagcaaaaggatggaaaatgtctttccgtcagacactcggccctcagcagggctgcgggggatacctgactggcagtaataacacattcgcgtcacctgattccgatagtaatggcatgtacgataaaaatctcaactgcgtgtggatcatcattgcacctgtgaataaggtaattcatctaacgttcaatacttttgcgttggaggccgcttccacccggcagaggtgcctgtatgactatgtcaaactctacgatggtgactccgaaaacgcgaatctcgccggtacgttctgtggtagcaccgttccggctccattcataagctctggcaactttctaactgtgcagtttatttctgacttgacgcttgaaagggagggctttaacgccacctacaccataatggacatgccatgcggcggtacttacaatgccacctggactccccagaacatttcatcaccaaactcatcagatcccgacgtacctttttccatctgtacatgggtcattgactctcctccacaccagcaggtgaaaatcactgtgtgggctctgcagctcacctcacaggattgcactcaaaactacttgcaactgcaggacagtccacaagggcacggcaattctaggtttcagttttgcgggaggaatgcaagcgcagtgcctgtgttttacagctcaatgagcacggccatggttatcttcaagagtggggtcgtcaatagaaatagtcggatgtcgtttacataccaaattgcagattgcaaccgggactatcacaaggctttcggcaacctgcggtcaccaggttggcctgacaactatgacaatgacaaagattgcacagttacattgaccgccccacagaaccacacaataagccttttctttcattctttagggattgagaacagcgtggagtgcagaaatgacttccttgaagtccgcaatgggagtaattctaacagtcccttgctcggtaagtactgcggcacgttgttgccaaatcccgtgtttagccagaacaatgagttgtacttgcggttcaagtcggatagcgtcaccagcgatcgcggatacgagatcatatggacatcttctccctccggctgtgggggtaccctctacggagatagggggagtttcacgagtccaggctacccagggacctatcccaacaatacttactgtgaatgggtgctggttgcacccgctggacgcctggtgacaattaatttttattttatatctatcgacgaccctggagactgcgtacagaactacttgaccctgtacgatggcccaaacgcgtctagccccagcagcgggccatattgtggcggagatacttcaatcgcaccgttcgtggcttccagcaaccaagtctttatcaagttccatgcagattacgccaggcgccctagtgcctttaggctgacatgggattcatac

SEQ ID NO: 219519 - DNA, 318 bp, Artificial Sequence
  Description of Artificial Sequence: Synthetic coding sequence
aattccaagctggtggatttagagcgcaaatttcagggactgcagcaaaccgtcgataaaaaggtgtgcagtagcaatccctgccagaacggaggaacctgtttgaatctccatgattctttcttttgtatatgtcctccacagtggaagggcccactatgttcagccgacgtcaatgaatgcgagatctattccggcactcccttgagctgccagaacggtggtacctgcgtgaacactatggggtcctataggaacccctgcagcaatataccaaaagagccagaagagggttcacgggattggcatcgcgagtag

SEQ ID NO: 219520 - DNA, 267 bp, Artificial Sequence
  Description of Artificial Sequence: Synthetic coding sequence
tctacaggcaacgagctcgctattcggtttaagaccgatctttcaatcaacgggaggggctttaacgctagttggcaggccgtgacggggggttgcggcggaattttccaggccccttcaggtgaaatccacagccctaactatccaagtccctacaggagcaacaccgactgtagctgggtgatcagagtcgacagaaatcaccgcgttttgctcaacttcactgatttcgacttggagccgcaggactcatgtatcatggtgtag

SEQ ID NO: 219521 - DNA, 1395 bp, Artificial Sequence
  Description of Artificial Sequence: Synthetic coding sequence
atgtcccactcgtggaacgtgctctggctgactttctgtagtgactccaatgggatgtatgataagaatctgaattgcgtttggatcattatcgcccctgtgaataaggtgattcatttgacgttcaacaccttcgccctcgaggccgctagcacaagacaacgctgtctgtacgactatgtgaaactctacgacggggactctgagaatgccaaccttgctgggacgttctgcggctctacagtccccgcaccattcatctcttcaggcaacttcctgacagtgcagttcatttccgatctgacactggagcgcgaaggctttaatgcaacctatacgattatggacatgccctgtgggggtacgtacaacgctacgtggacgccccagaatatttcctcgcccaatagcagcgatcctgatgtaccttttagcatctgcacctgggtgattgacagcccgccacaccaacaggttaagatcactgtgtgggctctgcagttaacctctcaggactgcacacaaaactatctgcagctccaggatagccctcagggacacggtaattctaggtttcagttttgcggacgtaacgctagcgcagtccccgtcttttactcctccatgagtaccgctatggtcatctttaagtcaggagtagtgaatcggaatagcagaatgtctttcacttaccagatcgctgactgcaacagggattatcataaggcttttgggaaccttaggtctcccggttggcctgacaactacgataatgacaaggactgcacggtgaccctgaccgcgccacagaatcacactatttccctctttttccatagccttggtatcgagaatagcgtggagtgcagaaatgacttcttggaagtaaggaacggatcgaactccaactcacccttgctggggaaatactgcggtactctcttaccaaatcctgtcttctcccagaataatgagctgtacctgcgtttcaaatccgattctgtgacctcggatagaggatacgaaattatttggacgtcctccccgtctggttgtggcggtacactgtacggcgatcgtggatctttcacgagccccggatatcccggaacgtacccaaataacacgtattgtgaatgggtgctggtggcccctgctggcagactggtgaccattaacttctactttatctccatagatgatcctggagactgtgtccagaactatctgacgctatatgatggccctaatgccagttctccttcttcaggcccttattgcgggggagatacgtctatcgcccctttcgttgccagcagcaatcaggtgtttataaagtttcatgccgattacgctcggcgtcctagtgcgtttaggctgacttgggattcttag

SEQ ID NO: 219522 - DNA, 864 bp, Artificial Sequence
  Description of Artificial Sequence: Synthetic coding sequence
atggagttagaacgaatcgtgtcagccgcacttctcgcgttcgttcagactcatctgccagaggcagacctctctggattagatgaggtaatctttagctatgttctgggcgtgctcgaggatctaggcccaagcgggccttcagaagaaaacttcgatatggaagcgtttacagagatgatggaagcgtacgtacccggttttgctcatatacctcgaggtacaatcggtgatatgatgcagaaactttccgggcagctgtctgacgccaggaacaaagaaaacctccaaccccagtctagtggcgtgcagggacaagtgcctatctcacctgagccgctgcaacgcccagagatgctcaaggaagagacccgctcgagcgcagctgcagcggcagatacacaggacgaggctaccggagccgaggaagagctgttgcccggagtcgatgtgctgcttgaggtctttccaacttgcagtgtggaacaggctcagtgggtgctggccaaagctagaggggatctcgaggaggccgttcagatgttagtggagggcaaggaagagggacctgctgcttgggagggtcctaaccaggatttacctaggcggctgcggggacctcagaaggatgaactgaaatcatttattcttcagaagtacatgatggttgattccgcagaggaccagaagattcatcgtcccatggcaccgaaagaggcacctaaaaagcttattcgctatatcgataatcaggtagtgagcaccaaaggggaacgcttcaaagacgtccgaaaccctgaagcagaggagatgaaagcaacatatatcaacttgaagcccgcacggaagtaccggttccattag

SEQ ID NO: 219523 - DNA, 1365 bp, Artificial Sequence
  Description of Artificial Sequence: Synthetic coding sequence
atggccgctgctccaggtgggtcagcccagccggcaggtcctgggccacgcctggggttttccaccgccgactcaggggtgggaatgtcgggcctcaatccaggaccagctgttccaatgaaggaccacgacgctattaagctgttcgtgggtcagatcccgcgtggcctcgacgaacaggatttaaagcccttattcgaagaatttggcagaatctacgaactcacggtcctgaaggatcggttaacaggtctgcacaagggttgcgcttttctaacttactgtgcaagagattccgcactgaaagcacagagcgcgctgcatgaacaaaaaaccctccccggaatgaacagacccattcaggtaaaacctgcagctagcgaaggcagaggagaagaccgcaagttgtttgtgggcatgttgggcaagcagcagggcgaagaagacgtcagacggctctttcagccatttggccacattgaggagtgtactgttttgcgttcaccggacggtacatctaaagggtgcgcattcgtgaaattcggctcacagggtgaggcacaggctgctatcaggggacttcacgggtcacggaccatggccggtgcttcctcgtcgctggtggtcaagttagccgacaccgaccgagagcgcgcactgcgcagaatgcagcagatggcaggccatctgggcgcattccatccagcgcctctgcccctgggcgcttgtggagcatacactacggcaatcctgcagcatcaagccgctctcctggctgcagcccagggtcctggcctcgggcctgttgctgctgtggctgctcaaatgcagcatgtggccgcattctcattggtggctgccccactgcttcctgctgccgctgccaacagtccccctgggagcgggcctggcacgcttcccggacttccggctccaataggggtcaacggctttggacctcttacgcctcagacgaacggacagccaggaagcgacaccctttataataatggactctctccctacccagcccagtcgcccggagtggccgacccgcttcagcaggcgtatgctggcatgcatcactatgccggacccgaaggatgtaatctgtttatttatcacctgcctcaggagtttggcgatgccgaactgatccagacgtttttacccttcggagctgtggtttccgctaaagtttttgtggaccgcgctactaatcagagcaaatgcttcggtttcgtatcgtttgacaaccctacctctgctcaaaccgccattcaagccatgaacggctttcagattggaatgaaaaggctgaaggtccagctgaaaagacccaaagatgcaaatcggccttactag

SEQ ID NO: 219524 - DNA, 1398 bp, Artificial Sequence
  Description of Artificial Sequence: Synthetic coding sequence
atgaaggagcctgacgccatcaagctgttcgtcggccagattcccagacacctggaggaaaaagacttgaagcctatctttgaacaatttggacggatcttcgagctgactgtaataaaagacaagtacacaggcctgcataaaggctgtgccttcttgacttactgcgcaagagactcagccctgaaagctcagtctgctctgcatgaacagaagactttacccggaatgaatcgaccaattcaggtcaagcctgctgacagcgaatcaagaggtgaggatagaaagttgtttgtgggcatgctgggcaagcagcagacagacgaggatgttcggaaaatgttcgagccctttggtactattgacgaatgtactgtcctccgcggacccgatgggacctcaaaaggctgcgcttttgtaaagttccagacccacgccgaagcgcaggcggcaatcaataccctacactcttcacgcactttgcccggagcctcgtcgagccttgtggttaaattcgcagacacagagaaagagagaggtctgcgtaggatgcagcaggttgcaacacagctgggaatgttctcccccatagcactgcagtttggcgcttattccgcctacacacaagccttaatgcaacagcaggcagctcttgtggctgctcattccgcctatctgagtcccatggctaccatggcggctgtccagatgcagcacatggccgctatcaatgccaacgggctcattgcaacaccaatcaccccttcgtcaggaaccagcacacccccagcgattgctgccacgcccgtatcagctatcccagcagctctcggtgtgaacggttactctcctgtgcctacccagccaacagggcagcccgctcccgatgcactgtatcccaatggagtgcatccatatcccgcacagagcccagcagcgccagtggatccccttcagcaggcttacgccggtatgcagcactacacagccgcatacccagcagcatattcactagttgccccagcttttccgcagccacctgcactggttgctcagcagccaccaccgccaccccagcagcaacagcagcagcaacagcagcagcagcagcagcagcaacgggaaggcccagatggctgcaatatcttcatctaccacctcccccaggagtttacagacagcgagattcttcagatgtttgtgccgtttggccatgtaataagcgcaaaagtatttgtagaccgcgctaccaaccaatcgaagtgttttggatttgtctcctttgataaccccgcatcagcccaggctgctatccaagcaatgaatggtttccaaataggaatgaagcggctgaaggtacagctgaagcggcctaaggatgcaaaccgcccatactag

SEQ ID NO: 219525 - DNA, 1248 bp, Artificial Sequence
  Description of Artificial Sequence: Synthetic coding sequence
atgaaagagcctgatgccatcaaactgtttgtgggccagatccccagacacctcgaagaaaaagacctaaagcccatctttgagcaatttggcagaatttttgaacttacggtgataaaagacaaatacacagggttacacaaaggatgtgccttcttgacttattgcgccagagatagcgctcttaaagcccagagcgctctgcacgagcaaaagacccttcccggtatgaacagacctatccaggtcaagcccgctgattctgaatcacgtggggaagataggaagctgttcgtggggatgcttggcaagcagcagaccgatgaagacgtgcggaagatgttcgagccttttggcaccatcgacgaatgtactgtcctgcgcggtcccgatgggactagcaagggttgtgccttcgtcaaattccagacccacgccgaagctcaggctgcaataaatactctccattcctcacgaactctgccgggagcgtcatcatccctcgttgtgaaatttgctgataccgagaaagaacgaggacttcggcgtatgcagcaggttgccacccagcttggcatgttctccccgatcgctctccaattcggagcgtactctgcatacactcaggcgctcatgcaacagcaggctgcgttggtagccgcacactctgcttacttgagccctatggccacaatggccgcagtgcagatgcagcatatggctgctattaatgctaatgggctcattgctacccctatcacgcccagttctgcccagtcaccagccgcaccagtggaccccttgcagcaggcctatgcgggaatgcagcactatacggctgcgtatcctgcagcttacagtctagttgctccggcatttccccaacctcctgctctcgtggcccagcaacctccccctccaccacagcagcagcagcagcagcaacagcagcaacagcagcagcagcaaagagaggggcctgatggctgcaacatttttatataccacctgccccaagagtttactgactccgaaatcttgcagatgttcgtgccattcggacatgtcatctccgccaaagtgtttgttgatcgggctacaaatcaaagcaaatgttttggatttgtaagttttgacaatccagctagcgcccaggctgcaattcaagccatgaacgggttccagattggaatgaagcgcctcaaagttcaactcaaaagacccaaggatgccaatagaccctattag

SEQ ID NO: 219526 - DNA, 900 bp, Artificial Sequence
  Description of Artificial Sequence: Synthetic coding sequence
atgaaggagcctgacgctatcaaacttttcgtgggacaaataccacgtcacctggaagagaaggaccttaaaccaatattcgaacagtttgggcgtatcttcgagcttactgtgattaaggacaagtatactggactgcataaaggctgtgcttttctaacgtactgcgcgagagactctgccctcaaagcccaatcggctctccatgaacagaagactctgcccggaatgaatcggccaatccaggtaaagcccgctgacagtgaatcacggggagaccgcaagctgtttgtcggaatgcttggaaaacagcagacagacgaagacgtccggaagatgttcgagcctttcggcactattgacgaatgcacagttttgcgcggaccggacggtacctccaaaggctgcgcatttgtcaaattccaaactcatgccgaagctcaggccgctatcaatacacttcactccagtcgcaccctgcccggtgcctcttctagcttggtagtcaagtttgcagatactgaaaaggaacggggacttagaaggatgcaacaggtagcaacccagttaggtatgttcagccccatcgccctgcagtttggcgcatattcggcttatacccaggctctcatgcagcagcaggcagccttagttgcagcccactctgcttacctctccccgatggctactatggctgccgttcaaatgcagcacatggctgccataaacgccaacggcctgattgctacacccattaccccctcctcagccaagggacacggatatgccagtcttgccccacgcgcacacttcttgctcgacgccttactcgctttcgttagagaacgaggaacaggttccaaagctcccggatacttgccatccgccggtctgttgtag

SEQ ID NO: 219527 - DNA, 783 bp, Artificial Sequence
  Description of Artificial Sequence: Synthetic coding sequence
atgcagcaggtcgccacacaattagggatgttcagcccgattgcccttcagtttggagcatactccgcttacacacaggcactgatgcaacaacaggccgcactagtggcagcccatagtgcgtacctgtcgcccatggccacgatggctgccgtgcagatgcaacacatggccgcaattaatgccaacgggctcatcgccacacctatcacaccttccagtggcacctctacgccacctgccattgcggcaacaccggtgtcggccatcccagctgcgctgggggttaatgggtatagtccagtgcccacacagcccacgggccagcctgcacctgatgctctataccccaatggagtacacccgtaccccgcagcctacccagccgcatactctttggtagcacctgcctttcctcagccccctgcactagttgcacagcagccccctcccccaccgcagcagcagcagcagcagcaacagcagcagcaacagcagcagcagcgcgagggacctgatggatgcaatattttcatctaccacctccctcaggagtttacagatagtgaaatcctccagatgttcgtaccctttggacacgttatctccgccaaggtgttcgtcgaccgcgcaacaaaccagagtaagtgtttcggttttgtgagcttcgataatcccgcaagtgcccaggctgcgatccaagccatgaacggatttcagattggcatgaaacgactgaaggttcagctgaagaggcccaaagacgccaaccggccttattag

SEQ ID NO: 219528 - DNA, 1401 bp, Artificial Sequence
  Description of Artificial Sequence: Synthetic coding sequence
tgagtcgaggagagcgccgctggagaacagtcatccggaacgcagatacccagacaccttgaagaaaaggatctgaaacctatcttcgagcaatttggcaggatcttcgaattgacggtgatcaaggataaatacactggtctgcataaaggctgcgctttcctgacctattgcgcacgcgacagtgccctcaaagcccagagtgcactgcacgagcagaagacattgccagggatgaatagacctattcaggtcaagcccgctgattccgagagtcggggtgacagaaagctgtttgtggggatgctgggcaaacagcaaaccgatgaggacgtgcggaagatgtttgaaccctttggcactatcgacgagtgtacagttctccggggtcccgatggaacctcgaagggttgtgcttttgttaagttccaaactcatgcagaagctcaagcagcgatcaacaccctgcactcttctaggaccttgcccggagcatcctcatcactggtagtgaaattcgctgacactgagaaggagcgcggacttcgccgaatgcagcaggtcgctacccaactcgggatgttttcccccattgcattgcagtttggcgcatatagtgcctacacgcaggctctcatgcagcagcaggctgcccttgtcgccgcacactctgcgtacctatctccaatggccacaatggcagccgtgcagatgcagcatatggctgccattaatgccaacgggctgatagccacccctattacccctagtagcggcaccagcactcccccagctattgctgccacacccgtcagtgccattcccgcagccttgggcgttaacggatattctccggttcctacccagcccacaggtcagcctgcgcctgatgcattataccccaatggcgtgcacccctatccggctcagtcacctgctgccccagtggaccccctccagcaggcctatgccggtatgcagcattatacagccgcttatccggcagcttacagtttggtcgcaccagcttttccccagccacccgctttggtggcgcagcagcctcctccgcctccccaacagcagcaacagcagcagcaacaacaacagcaacagcagcagcgtgaaggtccagacggttgtaatatctttatctaccacctgcctcaagaattcaccgactcagaaattcttcagatgttcgtaccattcgggcacgtgatatccgcaaaggtgttcgtggatcgcgcaactaaccagagcaagtgctttggatttgtctcattcgacaaccccgcttcagcccaggccgcaatccaggccatgaacgggtttcagatcggcatgaaaaggctaaaagtccagctgaaaaggcccaaggacgcaaatcgcccttattag

SEQ ID NO: 219529 - DNA, 1347 bp, Artificial Sequence
  Description of Artificial Sequence: Synthetic coding sequence
atgtacatcaagatggctacccttgcgaatgggcaagctgacaacgcttcactctccactaacggactgggctcctcaccagggtccgcaggacacatgaatggcttgagccatagtccagggaacccaagcactattccaatgaaggaccacgatgcaatcaaactttttatcggccagatcccacgaaacctggacgaaaaggatcttaaaccgctgtttgaggaattcggcaaaatctacgagctgacagtgctcaaggatcgattcacaggcatgcacaagggctgtgcgtttttaacttactgtgagagagagtctgctctgaaagcccagtccgctctccatgaacaaaagacactgcccggtatgaatagaccgattcaagtcaagcctgctgactcagagtctcgaggtgaagataggaaactgttcgtgggcatgctgaataagcaacaatccgaggatgatgtgcggaggctcttcgaagcattcgggaatatcgaagaatgcacaatcctccgaggtccagatggtaacagtaagggctgcgctttcgtcaagtatagttctcatgcggaggcccaggcggctataaatgcgttacacgggagtcagactatgccaggcgcttcgtcatccctggtagttaaattcgctgacacagataaagagcgcacaatgcggagaatgcagcaaatggccggtcagatgggcatgtttaaccctatggctattccttttggggcatatggcgcttacgctcaggcgctgatgcagcagcaagctgcactgatggcatcagtggcccaggggggatacctcaatccaatggccgctttcgcagccgcacagatgcagcagatggccgctcttaatatgaacggtctggctgccgctccaatgactcctactagcgggggtagcacacccccagggatcacggctccggctgtccccagtatcccgagtcctattggtgttaacggctttaccgggttgcccccacaagctaatgggcagcccgcagcggaagcagtgttcgctaacggaattcacccctaccccgctcaatctcctactgccgcagatcctctgcagcaagcgtacgccggagtgcagcagtacgcaggtccagccgcttaccccgcagcttatggtcagatatcgcaggctttccctcagccacctccaatgatccctcagcagcagcgtgaaggtttcgttagtttcgataacccagcaagtgcccagactgccattcaggcaatgaacggatttcagatcgggatgaagcggcttaaagtacagctgaagcgaccaaaagatgccaaccgtccctattag

SEQ ID NO: 219530 - DNA, 639 bp, Artificial Sequence
  Description of Artificial Sequence: Synthetic coding sequence
gttagcgcggagggcccagaaagagccgcacgggctgaggactccgctcgggatgagccggctgaccctggagaggcatgcgggcagcgggagccaaaagatcggaagctcttcgtgggcatgctaaataaacagcagtccgaggatgacgtgagacgcctctttgaggcctttgggaatatcgaggaatgcactatcctgagaggaccagatgggaactccaaaggatgtgcatttgtgaagtatagctctcatgcagaggcccaggccgcaatcaacgctctgcatgggagtcaaacaatgcctggtgcttcaagctcactcgtggtgaagtttgcagacaccgataaggaaaggacaatgcggaggatgcagcagatggccggtcagatgggaatgttcaatcctatggccatacccttcggtgcttacggggcttacgcgcaggccttaatgcagcagcaggcagctctgatggcgtccgttgcgcaggggggatacttgaacccgatggctgcattcgcagcggcacaaatgcaacagatggctgctctgaatatgtggcctggaggtagaacatatgacccgaacctcagatggcaacacccttctggacatcactgtacttctagagcttag

SEQ ID NO: 219531 - DNA, 1461 bp, Artificial Sequence
  Description of Artificial Sequence: Synthetic coding sequence
atgtacattaaaatggcaacactggccaatgggcaagcggataatgcttctctcagcaccaatgggttggggagttccccaggctccgccggacatatgaacgggctgagccattccccagggaatccttccactatacccatgaaagaccacgatgccattaaactattcatcgggcagatccccagaaatcttgatgaaaaggatctgaaacctctctttgaggaatttggaaaaatctacgaactcacagtcttgaaagaccgctttacaggtatgcacaaaggctgtgcgttcctcacgtattgtgaaagagagagcgccttgaaagcgcagtcggcgctgcatgagcagaaaacactgccgggtatgaatagacctatccaggtgaagccagccgacagcgagagcaggggagggtccagctgcctgcggcagcctccttcgcaggaccgcaaactgttcgtgggcatgctgaacaagcagcagtccgaagatgatgttaggagactatttgaagcattcgggaatatagaagaatgtaccatcctgcgtggccctgacgggaattccaagggttgcgcctttgtgaaatacagctctcacgcagaggctcaggccgcaattaacgctctgcacgggagccagaccatgcctggagcttcttcttccctggtagtgaagttcgccgataccgacaaggagcgcacgatgcggaggatgcagcagatggcagggcagatgggtatgtttaaccctatggcaatcccctttggcgcttatggggcttacgcgcaggcactgatgcagcagcaggctgccctaatggcctcagtcgcgcaaggcggttatctgaaccctatggccgctttcgcggcagctcaaatgcaacaaatggccgctctgaatatgaatggtttggcagcagctcccatgacacccactagcggcggaagcactccaccaggaattactgccccagccgttcccagtattccctctccaatcggggtcaatgggttcacgggcttgccaccccaggcaaatggccagcctgcggctgaagctgtattcgcgaacggcatccatccataccctgcgcagagccccacagctgccgatcctttgcaacaggcgtacgccggtgttcagcagtatgccggtcccgcagcgtaccccgctgcctacggccagatcagccaggcatttccacaaccccctcctatgatcccgcaacagcaacgcgagggccctgaaggatgcaatttgtttatttaccacctgcctcaggaattcggggatgcggaattgatgcagatgttcctcccatttggcttcgtgagtttcgacaaccccgcaagtgcgcagacagccattcaggcaatgaacgggtttcaaattggaatgaaacgtctcaaagtacaactgaagcggcctaaggacgcaaataggccatattag

SEQ ID NO: 219532 - DNA, 1458 bp, Artificial Sequence
  Description of Artificial Sequence: Synthetic coding sequence
atgtatatcaagatggctacattagccaacggacaggccgacaacgcctcactgagtacaaacgggctgggtagttcgcctggttcggcagggcatatgaacggtttgagtcacagcccaggcaacccttccactatccccatgaaagaccacgatgccattaaactttttattggacagatcccaagaaatttagatgaaaaggacctgaaacctttatttgaggaattcggaaagatctacgagctgacagtgctgaaggacaggttcactggaatgcataaggggtgtgcattcctcacctactgcgagagggaaagtgctctcaaagcccagtcggccttgcacgagcagaagacactacccggaatgaaccggccaatccaggtcaagcccgctgactcagagagccggggtggttcctcttgcttgagacagcccccttcacaggaccgaaagttgttcgtcggcatgcttaacaagcaacagtcagaggatgacgtgcggcgtctctttgaagccttcggaaatatcgaagagtgcacgatcctgcgcggaccagatggcaattctaaaggctgtgcatttgtcaaatattcatcacatgctgaggcacaggcagccataaatgctcttcatgggagtcagacaatgccaggcgcaagttcttctctcgttgttaagttcgctgataccgacaaagagaggaccatgcgaagaatgcagcagatggcaggacagatgggtatgtttaatcccatggcaatcccgtttggggcttacggcgcttacgctcaggctatgcagcagcaggcagcactcatggcatctgtggcgcagggaggctacctaaatcctatggcagccttcgcagccgctcagatgcagcagatggcggctctgaacatgaatggcttggcagccgctcccatgacaccgacgagcggtggttctactccacctggaattactgctccagccgtcccatccatcccatctcccatcggcgtgaatggatttaccggtcttccacctcaggctaatggacagcctgcagccgaggccgtgttcgccaatggaattcatccataccctgctcagtctccaaccgcagctgaccccttgcaacaggcgtacgccggagttcaacagtacgcgggacccgcagcttatccggcagcgtatggacagatcagtcaggcctttccccagccaccaccaatgatcccccaacagcagagggaaggacccgaggggtgcaatttattcatctaccacctaccgcaggagttcggtgacgccgagttaatgcagatgttcctgcccttcggattcgtgagctttgataaccccgctagcgcccagacagctatccaggctatgaacggattccaaatcggaatgaaaaggttgaaggtgcaactgaagcgtccaaaggacgccaacaggccatactag

SEQ ID NO: 219533 - DNA, 1455 bp, Artificial Sequence
  Description of Artificial Sequence: Synthetic coding sequence
atgtatatcaagatggccacattggcaaacggacaagctgacaatgcatccctgtctacgaacgggctgggctcctccccaggaagtgcgggacacatgaatggcctgtcccactccccaggcaatccgagcaccatacccatgaaggatcacgacgctattaagctgttcatcgggcagattcctcgcaacttggatgagaaggatctgaaacccctgttcgaggaatttggtaaaatatatgaattgaccgtacttaaagacaggttcaccgggatgcataaggggtgtgcattcttgacatactgtgaacgagagagtgctcttaaagctcagagtgctctccatgagcaaaagactttgccaggcatgaacagacctatccaggtgaagcccgcagacagtgagtcacgtggtggatctagttgcctgcgacagccaccatctcatcggaagctgtttgtaggaatgctgaataagcagcaaagcgaggacgatgtccgcaggctctttgaggcctttggtaatatcgaggagtgcacgatactcagagggcctgacggaaattcgaagggctgtgcatttgtgaaatacagctctcatgccgaggcccaagccgcaatcaatgccctacacggaagtcaaaccatgccaggtgcctccagcagcctcgtcgtcaagttcgccgatacggacaaagagcgcaccatgcgaaggatgcagcaaatggccggacaaatgggaatgttcaaccccatggcaatccccttcggcgcatacggcgcatatgcacaggcgatgcagcagcaagcagccttgatggcctctgtagcacagggaggctaccttaatcccatggctgctttcgcagcagctcagatgcagcagatggccgctctgaacatgaatgggctggccgcagcacccatgaccccaaccagcgggggttccacaccgcctggcatcaccgcccctgcagtgccaagtatcccgtctcccatcggcgtaaacggcttcactggtcttccacctcaggctaatggtcagccagctgccgaggccgtcttcgccaacggcatccatccttatcctgctcagagtcccacagccgcagatccactccagcaggcctatgccggagtgcaacaatacgcaggccctgccgcatatcccgcagcgtacgggcagatatctcaagcattcccccagccacctcctatgataccccagcaacagcgtgaagggccagaaggctgcaacctcttcatataccacctgccacaggagtttggggatgctgagctaatgcagatgttcctgccgttcggttttgtgagtttcgacaacccagcctctgcccagaccgccattcaggctatgaacggctttcagattggcatgaaaagactgaaggtccagcttaagcgaccaaaggacgctaatcgcccatactag

SEQ ID NO: 219534 - DNA, 1458 bp, Artificial Sequence
  Description of Artificial Sequence: Synthetic coding sequence
atggcgaggctcaccgaatctgaagctcggcgacagcagcagcagctcttgcaaccgagaccctctcccgtggggtccagtgggcctgagccaccgggagggcagccagatggaatgaaggacttggacgccatcaagcttttcgtaggccaaatccctcggcacctggacgaaaaagacttaaagcctctttttgagcagttcggccgaatttacgagctgacagtactcaaagacccatacaccgggatgcacaaaggctgtgccttcctcacctactgtgccagagacagcgccatcaaagctcaaaccgctctgcatgagcagaagacgttgcccggtatggcaagacccatccaagtcaaaccagcagactccgaaagtcggggagggagagatcgaaagctctttgtggggatgttgaataagcaacagagcgaagaggacgttctgcgcctattccagccctttggagtgatagatgagtgcaccgttctgcggggtccagacgggtcctccaaggggtgcgcctttgtcaaattttcatcccatactgaggctcaggcagccatccacgcactgcacggttcccagactatgccaggagcaagcagcagtttggtcgttaaattcgccgacaccgacaaagaacgtaccttgcgcaggatgcagcaaatggtggggcagctgggcattcttaccccatccctgaccttacccttttccccttattccgcttatgcccaagccttaatgcaacagcaaactaccgtcttgagcacttcagggtcttacctttctccaggtgtcgcgtttagcccctgtcacatacaacagattggagccgtgagtctgaatggcctgccggcaacccccatagcccctgcaagcggacttcacagccccccactgctgggcacaacagctgtccctggcctggtggcaccgatcacaaacggcttcgcaggtgtcgtccctttccccggaggccatccggcactggagacagtgtacgctaacggacttgttccctaccccgcacagtctcccacagtcgctgaaactctccacccagccttcagcggcgtgcaacagtacactgccatgtatcctaccgcagctattaccccaattgctcacagcgtacctcagccccctcccctgctgcaacagcaacagcgagagggcccagagggctgtaatctcttcatttatcatctgccacaagagttcggagatacggagcttacacagatgtttcttcctttcgggaatataatctcaagcaaggttttcatggacagggctacaaaccagtcgaagtgcttcggattcgtgtctttcgataaccctgcctcagcccaggcagctattcaagccatgaatgggttccagattggaatgaagcggcttaaggtgcaactgaagcgtcccaaagatcctgggcacccatattag

SEQ ID NO: 219535 - DNA, 963 bp, Artificial Sequence
  Description of Artificial Sequence: Synthetic coding sequence
atggctagacctatccaagtgaaacctgctgactccgagagtagaggcggaagagaccgaaagctgtttgtgggcatgttgaacaagcagcagtcagaagaagacgtcctgaggctgtttcagccctttggcgtcattgatgagtgcacagtgctccggggaccagacggcagctcaaaaggatgtgctttcgttaaattttcctcccacaccgaagcgcaggcggctatccacgccctacatggatctcagacaatgccaggtgcttcctccagtttagtggtaaagttcgcagacacagacaaagaacgaactctgcgcagaatgcagcagatggtgggtcagcttggaatcctgaccccttctttgacattgcccttctcaccatacagtgcttacgcacaggctctcatgcagcagcagactaccgtgctgtcaaccagtgggagttatcttagccccggagtggcattctccccctgtcacatccaacagattggcgctgtcagcttaaacggactaccggcaacaccaatcgctccagcttccgggctacattctcccccattgcttgggaccaccgcagtccccggactcgtggctcccataacaaatggctttgccggagtggtcccttttcccggagggcaccctgcccttgagacggtgtacgcgaatgggctggtgccgtaccccgctcagtccccaacagttgctgagacattacaccccgcattttcaggagtccagcagtataccgccatgtatcccaccgccgctatcactcctatagcccactccgtgccacaacctccccctctgcttcaacagcagcaaagagagggcgtgtggcggcatggcgctgatgccgatgtgccaactctgagacagtaccattttttgcagggggtttacggttcatcataccagcccgagcaggtctttcggctgagagagttgtag

SEQ ID NO: 219536 - DNA, 1230 bp, Artificial Sequence
  Description of Artificial Sequence: Synthetic coding sequence
atggcacgtctaacagaatccgaggctcgccgacagcaacagcagctcctgcagccccgtccctcccccgtcggttcttctggtcctgagccccctggtgggcagcccgatggcatgaaggatctggatgccatcaagctctttgttggacagataccacggcacctcgacgaaaaagacctcaaacccctcttcgagcagttcggccgtatctatgagctgaccgtgctgaaggacccgtacaccggaatgcacaagggttgtgctttcctcacttattgtgccagggacagcgctattaaggctcaaaccgctctgcacgaacaaaaaactctgcccggtatggccaggcctatccaagtcaagccagccgattctgagagtcggggaggaagagaccgcaagctgttcgtcggtatgctgaacaaacagcagtcggaggaggacgtgcttagacttttccagccgttcggcgttattgatgagtgcaccgtgctccgtggccctgatggaagctcaaagggctgtgcctttgtcaaatttagcagccacactgaggcccaggccgcaatccacgccttgcacggcagccagaccatgcctggtgcctcatcgtcactcgttgtgaagtttgccgacacagataaagaacgcactttgagaagaatgcaacagatggtgggacagttagggatcctgactccctccctaacactgccttttagtccatattcagcatacgctcaagctctgatgcagcagcaaaccaccgtactgtctaccagcggttcatatttgagtcccggagtggcctttagcccgtgtcatatacagcaaattggagccgtgtctctgaacggcctacctgccacgcccatagctccggcttcaggagtggtcccttttccgggagggcaccccgctctagaaaccgtctatgccaacggactagttccctacccagctcagagcccgacagtcgcagagaccctacatcccgcattctcgggagtgcaacagtataccgccatgtatccaaccgccgctatcacccctattgctcactcagtcccccagccacccccactgctccagcaacagcagagagaaggagtgtggcgtcatggtgccgatgccgacgtacctacactgcgacaatatcacttcctgcaaggagtctatggctcctcctatcagcctgagcaggtctttagactcagagaactgtag

SEQ ID NO: 219537 - DNA, 1446 bp, Artificial Sequence
  Description of Artificial Sequence: Synthetic coding sequence
atggctgctgctcccggtggctccgctcaacctgccggtcctggccctcgcctgggctttagtactgctgattccggcgtgggaatgagtgggctaaatccagggccagccgtccctatgaaggatcacgacgccattaaactgtttgtcggacagattccccgaggcttggatgaacaggacttaaagcccttgtttgaggagttcgggagaatctatgaattaaccgtgttgaaggataggctgaccggcctccataaggggtgcgcattccttacctattgcgctagagatagcgccctgaaggcccagagtgcactccatgagcagaaaaccttgccgggtatgaatcgacccatccaggtcaagccggctgcgagcgaggggaggggagaggaccggaaactgttcgttggcatgctgggcaagcagcaaggtgaggaggacgtacgccgattattccaacctttcgggcatattgaagaatgcaccgtgctgcgtagcccagatggtaccagtaagggatgcgcgtttgtgaaatttgggagccagggcgaagctcaggctgctattcgcggactacacgggtcgagaacaatggccggagcaagttcctctttggtggtgaagctcgcagacacagacagagagagagccctgaggaggatgcagcagatggcaggccacctgggggcatttcatcccgctccattaccactcggagcatgtggtgcatacaccactgccatccttcaacaccaggctgccctactcgccgcagcccaggggcctgggttaggccctgtggctgctgtggccgcacagatgcagcacgttgcagccttctccctggtggccgcaccactgttgccagccgctgccgcaaatagcccccctggctccggccctggtaccttgccaggactgcccgctcccatcggggtaaacggtttcggccctctcaccccccagaccaatggccaacccggatccgacaccctttataacaacggactatccccctaccccgctcagtcgcctggcgtggcggacccactgcagcaagcatatgccggtatgcatcattatgccgcagcatatccatctgcatatgcgcctgtcagtaccgcatttcctcagcaaccatctgccctgccccagcagcagcgggagggtcctgagggatgtaatttgtttatctatcacctgccccaggaatttggcgatgccgagctgatacagaccttcttgccttttggggcagtagtatcagccaaggtctttgtcgacagggccacgaaccagtcaaagtgcttcggtttcgtctcttttgacaatccaacaagcgctcaaaccgccatacaggcaatgaatggcttccagattggaatgaaacggctgaaagtgcagctgaagcggccaaaagatgccaaccggccatactag

SEQ ID NO: 219538 - DNA, 1107 bp, Artificial Sequence
  Description of Artificial Sequence: Synthetic coding sequence
atgatctcagatcctcccagcaacaacagttggaactccgttctgtacctgctggaggacaggaaactctttgtggggatgttgggtaaacagcaaggggaggaagacgtccggcgactattccagccattcgggcacattgaagaatgtacggtgttgcgatcccctgacggcacaagcaaaggctgcgcatttgtaaaatttggctctcaaggggaagcacaagcggctattagaggcctgcacgggagccgaacgatggccggagccagcagttcactggttgtgaagctggcagacaccgatcgagagcgggcactaagaaggatgcagcagatggcgggacaccttggcgcattccatcccgcaccacttcccctgggggcttgtggtgcttacactacagcgatcttgcagcatcaggccgctttgctcgcagccgctcagggcccaggactcggccctgtcgccgcagtggctgcacagatgcagcatgttgccgcatttagtctcgtcgctgctccactactgcccgcagcggcagctaacagtccacccggtagtgggcctggcacactgcccggtctgcccgctcccattggtgtgaatggattcgggccacttactccccagactaatgggcagcctgggtcagacaccctgtataataatgggctgtccccatatcccgcacagagccccggagtcgctgatccactccagcaggcatacgcagggatgcaccattatgctgccgcatacccgtcggcctatgccccagtgagcactgcctttccccagcagcctagtgcactcccacagcagcagcgcgaaggacccgaaggatgtaacctgttcatttaccacctcccacaagaatttggggacgcggagctgatccagacattcctaccctttggcgctgtggtctctgctaaggtgtttgtggaccgcgctaccaatcagagcaagtgctttggttttgtgtcctttgacaaccctacgtccgcacagactgcaattcaggctatgaatggctttcaaatcggaatgaaacgactaaaagtgcagctgaaaaggccgaaagatgcaaatcgaccatattag

SEQ ID NO: 219539 - DNA, 1365 bp, Artificial Sequence
  Description of Artificial Sequence: Synthetic coding sequence
atggccgcagcccctgggggatctgcgcagcccgcagggccaggtccaaggctggggtttagcacagcagacagcggcgtggggatgagtggtcttaaccccggtccagcagtgcctatgaaggatcacgatgccattaagctgttcgttggacagatccccagaggtcttgacgaacaagacctcaagccactctttgaagaattcggccgaatatatgagttgactgtactgaaggatcggctaactggtcttcataaaggctgtgcctttctgacatactgtgcccgtgactcagcactgaaagctcagagtgctttacacgagcagaagaccctccccggtatgaaccgccctatccaagtcaaacctgccgcaagtgaaggcaggggggaggatcggaagctgttcgttggaatgttgggaaagcaacagggcgaagaagatgtgcgaaggttgtttcagcccttcgggcacattgaggaatgtactgtactgaggagccctgatggaacctccaaaggctgcgcctttgttaaattcggatcgcagggggaagcacaggctgcaattagagggttacacggatctcgcaccatggcaggtgctagtagctcgctcgtcgtaaagttggccgatacagatcgtgagcgagccctccgaagaatgcagcagatggctggccatctaggagcatttcatcctgcccctcttcctctaggagcttgcggcgcatacacaacagctatccttcagcatcaagcagctttgttggcagctgctcaggggccaggtttgggaccagtagctgctgtggccgctcagatgcagcacgttgcagcttttagtcttgtggccgctccgttactacccgcagccgcagccaacagtcctcctggttcaggccctgggacactccccggtttacccgcacccattggagtgaacggtttcggcccactaacccctcagacaaacggccagcctggatctgatacgttgtacaacaacggcctgagcccctacccagcacaatcccctggagtcgccgacccacttcagcaagcctacgcgggaatgcaccactacgcaggcccagaaggttgcaacctgttcatctatcacctacctcaggagttcggtgacgctgaactgatccagacgtttttacctttcggcgctgtcgtttcggcaaaagtgttcgtggacagggcaacaaaccagtcaaagtgtttcggattcgtatcgtttgacaacccaacgtccgcacagacagccatccaggccatgaatggcttccaaataggaatgaaacgcctgaaggttcagctcaagagacccaaggatgcaaataggccttattag

SEQ ID NO: 219540 - DNA, 1029 bp, Artificial Sequence
  Description of Artificial Sequence: Synthetic coding sequence
atgcttggtaaacagcagggcgaggaggacgtccggagattgtttcaaccattcggacacattgaggagtgtactgtcctgagatcaccagatggcactagtaaagggtgcgcttttgtaaaattcggatctcagggagaggcccaggcagccatccgtggcttgcatggatcccggacaatggcgggtgcttcctccagccttgtcgtcaagcttgccgacactgacagagagagagctctgcgcagaatgcagcagatggcaggccatctgggggcattccacccagcacccttgcccttgggcgcttgtggggcttatactacagccatattacagcatcaagccgcactgctagccgcagctcaaggacccggtctgggtcccgtggcagccgtcgccgctcagatgcagcacgtggccgctttttcactggtggccgcacctctgcttcctgctgctgccgcaaacagtccaccgggatctgggccaggaacacttccgggacttcccgctcccattggcgtgaacggtttcggccctctaaccccccagaccaacggtcagcctggctctgatactctctataacaacggcctctctccatacccagcccagagccccggagtggctgatcccctgcagcaagcctacgcaggtatgcatcactatgcagcggcttaccccagtgcttatgccccagtctctactgcattccctcagcaaccttctgccctcccacagcaacagagggaaggcccagaggggtgcaacttgtttatctaccaccttcctcaggaatttggggacgccgagctgatacagacctttttaccatttggcgcagtggtgtcagcgaaagtatttgtggacagggccacaaatcagtcaaagtgttttggttttgtaagtttcgacaaccctacctccgctcaaactgcaatccaggctatgaatggattccagataggaatgaagagactgaaggtgcagctgaagcggcctaaggatgctaaccgcccatactag

SEQ ID NO: 219541 - DNA, 1035 bp, Artificial Sequence
  Description of Artificial Sequence: Synthetic coding sequence
atgaaccgcccaattcaagtcaagcccgctgcttcggaaggcaggggggaggaccggaagcttttcgtggggatgctgggcaagcagcagggcgaggaagatgtaagacggctatttcagccgttcgggcacatcgaagagtgtaccgtcctcagatccccagatggtacatccaagggctgcgcatttgtaaagttcggaagtcaaggagaggcccaggctgctattcggggactacacggctccagaacgatggctggcgcttcttcgtcattagttgtcaagttagctgataccgatagagagagggcactgcgcagaatgcagcagatggctggtcatctcggcgcattccaccccgctccgttgccccttggagcatgcggtgcctacactacagccatcttacaacaccaggccgctctgctcgccgctgcgcagggacccggactgggacccgttgcggctgtcgccgcacagatgcagcatgttgctgccttttcactggtagccgctccactccttccggcagccgcaaattcccctcctggctccgggcctggcactctgccagggctgcctgccccaatcggtgttaacgggtttggaccactcaccccacagacaaatggacagcccggtagcgataccttatacaacaacggcctctctccgtacccggctgcatatccatccgcctatgctccagtctccaccgccttcccccagcagccatctgcgctcccgcagcagcagcgcgaaggtccagaagggtgtaacctcttcatttatcacctgccacaggaattcggtgacgcggagcttatccagacatttctccctttcggagccgttgtatcagcgaaagtgtttgtggacagagccaccaaccagagtaaatgctttggcttcgtgagcttcgacaacccaacaagtgcccaaacggctatccaggccatgaatggcttccagatcggcatgaaaagactgaaggtacagctgaagcgtcctaaggatgccaaccgcccttattag

SEQ ID NO: 219542 - DNA, 1980 bp, Artificial Sequence
  Description of Artificial Sequence: Synthetic coding sequence
atgctctacaagcagctgcggcaggcatgcgaagaccacgtgcaggctcagatccttcctttccgggaggactcgctggacagcgtactattcctgaaaaaaattaacacatgttggcaggatcattgccggcagatgattatgatccgcagcatattcctattcctggatagaacgtacgtgctgcagaacagtacactccctagcatctgggatatgggtctggagctgtttcgtactcatatcatcagcgataaaatggtgcagagcaagacaatcgatgggatcctcctattaattgaaagggaacggagcggggaggctgtggacagatcgcttcttcgcagcctcctgggcatgctttctgatcttcaggtttacaaggattcattcgagctcaaattcctcgaggaaaccaattgtctatacgcggcagaaggtcagcgacttatgcaggagcgggaggtgcctgagtatctgaaccatgtgtccaaacgacttgaggaggagggagacagggtcattacttatctggaccactcgactcagaaaccgttgattgcttgcgtcgaaaaacaattgctgggcgaacacctgacagcaatcctgcagaagggactggatcacttgctggacgaaaatcgggtccctgacttggcgcagatgtatcaactgttcagccgagtgcgcggtgggcagcaagcgctgctgcagcattggtccgagtatattaaaactttcggtaccgcaatagtgatcaacccagaaaaggataaggacatggttcaagatctgctggatttcaaagataaagtggaccacgtcattgaagtttgtttccaaaaaaatgaaagattcgtcaatcttatgaaagaatcatttgagacctttataaacaaacgaccaaataaaccggcagaactaatcgcaaagcatgtggatagcaagctccgcgctgggaacaaagaagcaaccgacgaagagctggagaggacacttgataagataatgatcttatttagattcattcatggaaaagacgtgtttgaggccttttacaaaaaggacctggccaagagactgttggtcggaaagtccgcttccgtggatgccgagaagtcaatgctgtcaaagctcaagcatgaatgcggcgctgcgttcacctcgaagttggagggcatgtttaaggacatggagctgagcaaggacatcatggtacattttaaacagcatatgcagaatcagagcgatagcgggccaatcgacctaactgtaaatatcctgaccatgggttactggcccacctacacccccatggaagtgcacttgacacccgagatgatcaagcttcaggaagtcttcaaggccttctatctcgggaaacatagtggtcgcaaattgcaatggcagacgacgctgggccatgctgtcctcaaggcggagtttaaggagggtaaaaaggaattccaagtatcattatttcaaactctggttcttctgatgttcaatgagggcgatggctttagcttcgaggagataaagatggcgacaggaatcgaagactctgagctgaggaggaccctccaaagccttgcctgcggcaaagctcgagtgcttattaagtctcctaagggaaaagaggtcgaggatggggataagtttattttcaatggtgaatttaagcataagctctttagaatcaagattaatcagatacaaatgaaagagactgttgaggaacaggtttccacaacagaacgggtctttcaagacagacagtaccagattgacgccgcaatcgttagaattatgaagatgcggaagactctggggcataacctattggtcagcgaactgtacaaccagttaaaattccccgtcaagcccggtgacctgaagaagcggatcgagtcccttatcgacagagactacatggagcgagataaggataacccgaatcaatatcactacgtcgcatag

SEQ ID NO: 219543 - DNA, 2280 bp, Artificial Sequence
  Description of Artificial Sequence: Synthetic coding sequence
atggcagatgaggcccctcgtaagggatcattcagcgcattggtgggccgtacaaatgggctgactaagcctgcagccttggctgccgctcccgctaaaccaggaggtgctggcggatccaagaagttagtgatcaagaatttccgagatcgcccaagactgcccgataattacacacaggatacgtggagaaagctacacgaggccgtacgcgcagtgcaaagctcaacatccattaggtacaacctggaggaactgtaccaggcagtggaaaatctctgttcacataaagtgagcccgatgctatacaaacaattgagacaggcatgcgaggaccatgtgcaggcacagatcttgccttttcgggaggacagcttagatagcgtgctttttttgaagaaaattaacacctgttggcaggatcactgtcggcagatgatcatgattcggtctattttcctctttcttgaccgaacctatgtgctccagaactcaacattgccatcaatctgggacatggggcttgagttgttcaggacccacatcatctccgacaagatggtgcagagcaagaccattgatggaattcttctgctcattgagcgagagcgcagcggcgaagcggtggaccgctcactgctccgatcattacttggcatgctcagtgacttgcaggtatataaggactctttcgagttgaagtttttggaagagaccaattgcttgtatgctgccgaaggacagaggctcatgcaggagagagaagttcctgagtatctgaaccacgtgtctaagcggctggaggaggagggagatcgcgtgataacatacctggaccacagcacacagaaacccttgatcgcctgcgtggagaagcagctgcttggcgagcatctcacggccatcctgcagaagggactggaccacctgctggacgagaatcgcgttcccgacttggcgcagatgtaccagctgttcagtcgcgtgcgtggcggacagcaagcactgttgcaacactggagcgagtacatcaaaacctttggaactgccatagtgatcaatcctgagaaagataaagatatggttcaggacctgctggatttcaaagacaaagtggaccatgtcattgaggtttgtttccaaaaaaacgaacggtttgttaatctaatgaaagaatccttcgaaactttcattaataagagacccaacaagccagcagagctgatcgccaaacacgtggactccaagcttcgcgcaggtaacaaagaagctaccgacgaagagctggaaaggacgctagataaaatcatgattctttttcggtttatccacggaaaagatgtgttcgaggcgttttacaaaaaggacctcgctaagcgcttattggtaggaaagagcgcatctgttgacgcagagaaatctatgctctcaaagttgaaacacgagtgcggcgctgcatttacttccaaactcgagggcatgttcaaggacatggaattgagcaaagatataatggttcactttaaacagcacatgcagaaccagagcgatagtgggcctatcgaccttactgtgaatatactgacaatggggtactggcctacgtacacacccatggaggtgcatctgacccctgaaatgatcaagctgcaggaggtctttaaggccttttatctgggcaaacactcagggcgaaagttgcagtggcaaaccaccctgggtcatgccgtgctgaaggcagagtttaaggagggtaaaaaggaattccaggtgtctctatttcagaccctggtactgctaatgttcaacgagggcgatggattcagcttcgaggagattaagatggccacaggcatcgaagactctgaattgcggcgtactttacaatccctcgcctgtggcaaggctagagtgctgataaaaagcccaaagggcaaggaggtagaggatggagacaaattcatctttaatggagagtttaaacacaagctgtttagaattaagattaaccaaattcaaatgaaggagacagttgaggagcaggtctcaacgacagaacgcgtgttccaggataggcagtatcagatcgatgcagcaatagtccgcatcatgaagatgcgcaaaactctcggacacaacttattggtcagtgagctgtataaccagctgaaattccccgtcaaaccaggagacctcaaaaagcgtatcgagtccctgattgaccgcgactacatggaaagagataaggacaacccgaaccagtaccactatgtggcttag

SEQ ID NO: 219544 - DNA, 1980 bp, Artificial Sequence
  Description of Artificial Sequence: Synthetic coding sequence
atgttgtacaagcagcttcgtcaggcgtgcgaggatcatgtgcaagcccagatcctacctttccgcgaggacagcctggacagcgtcctattcttaaaaaaaatcaatacatgttggcaagaccactgtcggcagatgattatgatccgaagtattttcttgtttcttgatcggacgtacgtccttcagaacagtactcttccatcaatatgggatatggggctcgagttgtttaggactcacatcatttctgataagatggttcagtccaagacgatcgatgggatcctgttgcttatcgagcgcgaacggtccggggaagccgtcgatagatcacttcttcggtcgctcctgggcatgctctcggatttgcaggtgtacaaggattctttcgaactaaaattcttggaggagacaaattgcctgtatgccgcagagggacagcgccttatgcaggaaagagaggtgccagagtacttgaatcacgtgtctaaaaggctggaggaagaaggagaccgagtcatcacatatctggaccactccactcagaagcctctgatcgcttgcgtcgaaaagcagctgctgggcgagcaccttacagcaatactgcagaagggtctcgaccatctgctagatgagaatagggtgccagatctagcccagatgtaccagttgttctctcgtgtacgcggagggcagcaggcactcttgcagcattggagcgagtacatcaagacttttggcaccgcgatcgttatcaacccagagaaggataaagatatggttcaggatctgctcgactttaaggacaaggtagaccatgtgatagaagtttgtttccagaagaatgaaaggttcgtaaatctgatgaaggaaagctttgaaacatttattaacaaaagacctaataagcccgcagagttgatcgccaagcacgtcgactctaagctgcgggcaggcaacaaagaagccaccgacgaagagcttgagcgcactctggacaaaatcatgatcctgttcagatttatccatgggaaagacgtattcgaggccttctataagaaagatctggcgaagcgccttctcgtggggaaatccgcttcagtggatgctgagaagagtatgctgtccaaactcaagcacgagtgtggagccgcattcacctcaaaactcgaaggcatgtttaaggacatggaactctctaaggacatcatggtgcacttcaagcagcacatgcagaatcaatcagacagcggacccattgatctcacagtgaatatcctcactatgggctattggcctacctacacacccatggaggtgcacctgacgcccgagatgattaagctccaggaggtatttaaggccttttacttggggaaacattccggtaggaagttgcaatggcagacaaccttgggccacgccgtgctgaaggcagagttcaaagagggcaagaaggagttccaggtgtcgctgttccagaccttggtcttgctcatgttcaacgagggagacggcttcagctttgaagagatcaagatggctacgggcatcgaggattctgaactgcgtaggacactgcagagtctggcttgcgggaaagcccgagtgctcatcaagtcccctaagggaaaagaggtagaagacggggataaatttatctttaacggcgagttcaagcataaactgtttcgcatcaaaatcaaccaaatccaaatgaaggaaaccgtcgaagaacaagtgtcgaccacagaacgagtttttcaagatagacagtaccaaatcgatgccgcaatcgtgcggatcatgaaaatgaggaaaacactcggccataacctgctggtctcagagctgtacaaccagctaaagttccccgtgaagcccggagatttaaagaagcggatagagagcttaattgatcgggactacatggagagagacaaggataatccaaaccaataccactacgtagcttag

SEQ ID NO: 219545 - DNA, 1980 bp, Artificial Sequence
  Description of Artificial Sequence: Synthetic coding sequence
atgctgtataagcaattgcgtcaagcgtgtgaggaccatgtccaggctcaaattctgccctttagagaagattctctcgactccgtcctgttcctgaaaaagatcaacacttgctggcaggaccattgtaggcagatgatcatgatccgatcaatcttccttttcctggatcggacatacgtattgcagaatagcacattacctagcatctgggacatgggcttagagctctttagaactcatatcatcagcgacaagatggtccaaagtaaaacgatcgatgggattctgctactcatcgagagggaaagatccggagaggctgtggatcgcagcctgctgagatccctgcttggaatgcttagcgacctgcaagtctataaggattcctttgaactgaagttcctggaggaaaccaattgcctatacgctgcggagggacaacgtctaatgcaggagcgcgaggtgcccgagtatctcaaccacgtttccaaacgccttgaggaggagggcgaccgagtgatcacctatttggatcacagtacccagaagcccctgattgcatgcgtggaaaagcagcttttgggggaacacctgaccgccatcctccaaaaaggcctcgaccacctactggacgaaaatcgggtccctgacctggctcagatgtatcagctgttttcacgagtacgtggcggacagcaggcccttttgcagcattggagtgaatacatcaagacatttggaacggctattgtcattaaccctgagaaagacaaggatatggtgcaggatctactagattttaaggataaggtcgatcacgttattgaagtgtgtttccaaaaaaacgagcgttttgtgaatcttatgaaagaatcttttgagactttcattaataaacgccctaataagcccgcagagctgatagctaagcatgtagactctaagctccgagccggaaacaaagaagcgactgacgaagagctggaaagaacattggataagattatgatcttatttcggtttatccatggtaaagatgtgttcgaggccttttataagaaagacctggccaaacggctgctggtgggcaagagcgccagcgtcgatgctgagaagagtatgctgtctaaactgaaacatgaatgtggcgcagcattcacatcaaagcttgagggcatgtttaaagacatggagctctcgaaagatatcatggtgcactttaagcagcatatgcaaaaccaatcggacagcggccctatagatctgacggtgaatatcctcactatgggttattggcctacatacactccaatggaggtgcatctgactcctgagatgattaaactgcaagaggtgtttaaagctttttatctggggaaacacagtggccgtaaacttcagtggcaaaccaccttgggacacgcagtccttaaggccgagtttaaagaagggaagaaagagtttcaagttagcctgtttcagaccctggtgctcttgatgttcaacgaaggggatggattcagcttcgaggaaattaagatggccacaggaatcgaggacagtgaactaaggagaaccttacaaagcctcgcatgtggcaaggcacgcgtcttgatcaaaagtcccaagggtaaagaagtggaggacggagacaaatttatcttcaatggggaatttaaacacaaactctttcgaattaaaattaatcaaatacaaatgaaggaaacggtggaggagcaggttagcactaccgagcgggtcttccaagatcggcagtatcaaattgatgccgctatcgtacggattatgaaaatgcgaaagaccctgggacataatcttcttgtgtcggaactgtacaaccagttgaaatttcctgtgaagccaggagatctgaagaaacgcatcgaaagtctaatcgaccgagattacatggagcgtgacaaggataaccccaaccagtaccactacgtcgcttag

SEQ ID NO: 219546 - DNA, 2703 bp, Artificial Sequence
  Description of Artificial Sequence: Synthetic coding sequence
atgaaatctgtatgccccgttacttcgggcttctcgtctccaagcccaagcgcagcagccgctgctcaagaagttcgtagcgccactgacggcaatacaagcaccacaccgcctacttctgcaaagaagagaaagctgaattcttcctccagcagttcaagtaatagcagcaatgaacgggaagactttgattccactagtagctcaagctctactccacctctgcaacctagagacagcgcgtccccaagtacaagctcattctgcttaggtgtgagtgtcgccgcttcttcccacgttcccattcaaaaaaaactcagattcgaggacactcttgagtttgtgggctttgatgctaaaatggccgaagagtccagttcttcgtcaagcagttccagcccaactgctgcaacttcccaacagcagcagctaaagaataaaagtatcctcataagtagcgttgcatctgtccatcacgcaaatggcctggctaagtcctcaactacagtgagctcgttcgctaattcaaagcctggctctgcgaagaagctggtgatcaagaacttcaaagataagcctaaactacctgagaattatacagatgaaacttggcaaaagctgaaggaagccgttgaggcgattcaaaattctaccagcattaagtacaacttggaggaactttaccaggctgtcgagaatctgtgtagctacaagattagcgccaacttgtataaacagcttcgacaaatatgtgaggaccacattaaggcacagattcaccagtttagggaggacagcctcgatagcgtgctgtttctcaaaaaaattgacaggtgttggcagaaccactgcagacagatgatcatgatcaggtcaattttcttgttccttgataggacatacgtgctgcagaactctatgctccccagcatttgggatatgggcttagagttgttccgtgcacatatcatatccgatcagaaagtccagaacaagaccatcgacggaatactgctgttaattgagcgcgaaaggaacggcgaggccattgatcggtcactgctacgctcgctactcagtatgctgtcggacttgcagatctaccaggatagctttgagcagcgctttttggaagagacaaaccgattgtacgccgctgagggccagaaattgatgcaagagcgggaggtgcctgagtacttgcaccacgttaataagcggcttgaagaggaggcagaccgcctaataacctatctagaccagactacccagaaatctctaatagcaaccgtggagaagcagttactgggcgaacacctgacagctatacttcagaaaggcctgaataacctcctggacgaaaatcgcatccaggacctgtctctgctataccagctgttctctcgggtgagggggggagtccaggtgctgttacagcagtggatcgagtatatcaaggccttcggctctacaatcgtaattaatccagaaaaagacaagactatggttcaggaactccttgattttaaagacaaggttgaccacataatcgacatttgtttcttaaagaatgaaaagtttatcaacgctatgaaagaggcattcgaaaccttcattaacaaaagacctaataagcctgccgaactgatagcgaaatacgtcgacagtaagctgagggcaggcaataaagaagcgacagatgaagaactggaaaagatgctcgacaaaattatgatcatattccgtttcatttatggtaaagacgtgttcgaagctttctataagaaagatctggctaaacgcctgctagtgggtaagagtgcatctgttgacgccgaaaaaagcatgctgtcgaaactaaaacacgagtgcggagctgcgttcaccagcaaactggaaggtatgtttaaggatatggagctctccaaggatatcatgatacagtttaagcagtacatgcagaatcagaacgtgcctggaaacattgaattaaccgttaacatactcacaatgggatattggccaacatacgtccccatggaggtccatctgcctcctgaaatggtgaagctgcaggaaatcttcaagaccttttatcttggtaaacacagtggacgaaaactgcagtggcagtcaacgctaggccactgcgtgcttaaggcggaattcaaggagggcaaaaaggaactgcaggtgtcgttgtttcagaccctagtattgctgatgttcaacgagggggaagagttttccctagaagaaatcaagcaagccacagggatcgaagatggtgagctgaggaggactcttcagtctctggcttgcggtaaagcccgtgtgctggctaagaacccgaaagggaaagacattgaagatggcgacaaattcatatgtaatgatgatttcaagcataagctatttcgcatcaaaatcaatcagattcagatgaaagagactgtggaggaacaggctagcactaccgaaagggtcttccaggataggcagtatcagattgatgccgcaattgtccgcatcatgaaaatgaggaagaccctgagccataacctattagtgagcgaagtgtacaatcagttaaaattccctgtgaagcccgctgacctaaagaaaaggatagagagcctgatcgaccgagattacatggagagggataaggaaaatcccaatcagtataattacatcgcatag

SEQ ID NO: 219547 - DNA, 2688 bp, Artificial Sequence
  Description of Artificial Sequence: Synthetic coding sequence
atgttccctactgggttctctagtccgagcccttctgcggcagccgcagcccaagaagtgaggtcggccacagacggaaatacttccaccacccctcccacatcagccaagaaaagaaagttgaattcttcttcatccagctcctccaatagttccaatgagagggaagactttgattctacatcctcctcttcctcaacacccccattgcagcctcgggattctgccagcccgagcacgagctctttttgccttggagtgagcgttgcagcttctagccatgttccgattcagaaaaagttgcgctttgaggatacccttgaattcgtggggttcgatgccaagatggccgaggaatcatcctcgtccagcagttcctcaagccccacggcagccacttcccagcaacaacagctgaaaaataaaagtattcttatcagcagtgtcgcttctgtacaccatgcaaacggactggctaaaagctcaactactgtttcttcatttgcaaattccaagcctgggtctgcaaagaaattggtgatcaaaaattttaaagacaagcctaaactccccgagaattacaccgacgagacatggcaaaagctgaaggaggccgtggaggcaattcagaacagcaccagtattaagtataaccttgaagaactctaccaggcggtcgaaaacttgtgtagctacaagatttccgctaatctttataagcagctgcgacagatctgtgaggaccacatcaaggcccaaattcaccaattcagggaagatagcctggactcagtactcttcctgaaaaaaatcgaccgctgttggcagaaccactgccggcaaatgatcatgatccgcagcatctttctttttttggaccggacatatgtgctacaaaacagtatgctgccgtccatctgggacatgggcctggaactgttccgcgctcatatcatctctgaccaaaaagtgcagaataagactatcgatggcatcttactgctcatcgaaagagaacggaatggtgaggcaatagatcgctcgcttcttaggtctctgctgagcatgttgtccgatcttcagatctaccaggactcgttcgaacagcgctttttggaggaaaccaaccggctgtatgccgctgaggggcagaagcttatgcaggagagggaggtccccgagtacttgcatcacgtgaacaagcggctggaggaagaggcggatcgattgattacatatctggaccagacaactcaaaaatccctaatcgcaactgtcgagaaacagctgctgggcgaacatttgacagctatcctacaaaaggggctgaataacctgttggacgagaaccgcatccaggaccttagcctcctgtatcagcttttctctcgagttcggggaggcgttcaagtgttgctccaacaatggattgagtacataaaagcattcggatcaaccatcgtgattaaccccgagaaggacaagacaatggtccaagaactgctggattttaaggataaagtggatcacattatagatatctgttttctgaagaacgagaagtttattaacgccatgaaagaagcctttgagacgttcataaataagcgtcccaataagcccgcagaattaatagctaaatacgtcgacagcaaactgagggccggtaacaaagaggcaactgacgaggagctcgaaaaaatgctggacaaaatcatgatcatcttcaggtttatctacggcaaagacgtgtttgaggctttttacaagaaagaccttgctaaaaggcttctggtgggaaagtcggcctcagtggatgcggagaagagtatgctgagcaagctcaagcacgagtgcggagctgcatttaccagcaaactggaaggcatgttcaaagatatggagctttcaaaggatattatgatacaattcaaacagtatatgcagaatcagaacgtccccggaaacattgagctgactgtcaatatcctcacaatggggtactggccaacttacgtccccatggaagtgcatcttccacctgagatggtcaaactgcaagagatctttaaaactttttacctcggaaagcactctggaagaaaactgcaatggcagtcaacccttggtcattgcgtgctgaaagcggagtttaaggagggcaaaaaggagttgcaggtttcgctgtttcagaccttggttctgctaatgtttaacgaaggcgaggaattctcactcgaggaaataaagcaggcaacgggcatcgaagatggtgaactgcggcgaacactgcagtctctggcctgtgggaaggctagagtactggcgaagaaccctaagggaaaggacattgaagatggagataagttcatttgcaacgacgattttaagcataaactgttccgaattaaaatcaatcagatccaaatgaaagagacagtggaggagcaggccagcacaaccgaaagggtcttccaggatcggcagtaccagattgatgcagcaatcgtccggattatgaaaatgaggaaaacgctgagtcataatctgctggtgtccgaagtgtacaaccaacttaagttcccagttaagcctgctgatcttaagaaaagaattgagagtctcattgatcgagactacatggagcgtgacaaggagaatccaaaccagtacaattacatcgcctag

SEQ ID NO: 219548 - DNA, 705 bp, Artificial Sequence
  Description of Artificial Sequence: Synthetic coding sequence
atgatagacccagactttgctgacaaacctaaactccctgagaattacacggacgagacctggcagaagctcaaggaggccgtagaagctatccagaattctacatccatcaaatataaccttgaggagttataccaggcagtggagaacctgtgttcttataagatctccgccaacttatataagcagctgcgccagatatgcgaagatcatattaaggcccaaatccatcagttccgggaggacagtctcgacagcgtcttgttcctcaaaaagatcgatcgatgttggcagaaccattgcaggcagatgataatgatccgctccatctttctcttccttgaccgcacctatgtactacagaattcaatgttgcccagcatctgggatatgggacttgagcttttcagggctcacatcattagtgatcagaaggtgcaaaataagaccatcgacggcattctgctactgatcgaacgcgagaggaatggggaggcaatagacagatctctactgcgttcgctgctgtcgatgttgtccgatcttcaaatataccaggactcttttgagcagcgtttcctggaagagacaaatcgcctatacgcagccgaagggcagaaattgatgcaggagcgcgaggtgccagaatatctccaccacgttaacaagcgtctcgaagaagaggctgaccgtcttataacctag

SEQ ID NO: 219549 - DNA, 2742 bp, Artificial Sequence
  Description of Artificial Sequence: Synthetic coding sequence
atgatgagccaatcctccggctcaggtgacggaaatgatgatgaggcaacgactagcaaagatggtggcttttcctccccttctccctcggctgccgcagcggctcaggaggtgcggtctgccactgacgggaacacctctacaactccgcctacttccgccaagaaaaggaaactcaattcttcctcatcaagttcctccaatagcagcaatgagagagaggactttgattctacatctagcagtagcagtacccccccacttcagccaagggatagcgccagtccctccacctcctccttttgcttgggagtcagcgtcgccgcttcctcgcatgtgccaatccagaagaaacttcggttcgaagatactctcgaattcgtggggtttgacgctaaaatggccgaggagagtagttcatctagttcttcctcttcacctaccgccgcaacgtcccagcagcagcagttgaaaaataagtcaatactgatttcctccgtcgcctccgttcaccatgcaaacggtctcgccaagtcgtcgacgaccgtgagcagttttgcaaactcaaagcctgggagcgcaaagaaattggttatcaagaacttcaaggataagccaaaactgccagagaattatacagatgaaacatggcagaaattaaaagaggcggtagaggctatccaaaatagcacttctatcaagtataacctagaggaactttaccaggctgttgagaatttatgttcctacaagatctccgccaatttgtataagcagctgcgtcagatctgcgaggaccacattaaagcacagatccatcagtttagagaggatagcttggatagcgttctgtttctcaagaaaatcgaccgatgttggcaaaatcactgtcgacagatgatcatgatccggtcaatttttctcttcctggacaggacttacgtgctgcagaattctatgctgccttcaatctgggacatgggactggaactttttagagcgcacattatatctgaccagaaggttcaaaacaagacaatagatggtattctgttgctcatcgagagagagcggaatggagaggccattgataggagtctactgcggtcgcttctctctatgctatcagacctgcagatttaccaggattcatttgagcagcggtttctagaggaaaccaacagactatatgccgcagaagggcagaagcttatgcaggagcgggaagtacctgagtatttgcaccacgtgaataagcggttagaggaagaagccgacaggttaattacgtatctcgatcaaaccacccagaaatctttgatcgccaccgtggagaaacaactcttgggagagcacctcacagctatcttacagaaagggctcaacaatcttttggacgagaaccgcatccaggacctcagcctcttgtaccaactcttttctcgtgtccgaggcggagttcaggttctgttgcagcagtggatcgaatacatcaaagcctttggtagcacgattgtcatcaacccagagaaggataagaccatggttcaggaacttctggatttcaaggataaagtcgatcacattattgacatatgtttccttaaaaacgagaaatttattaatgccatgaaagaggcgtttgaaacatttatcaataagcgtccgaacaagcctgccgaactgattgctaagtacgtggacagtaagctccgcgctggaaacaaggaagctactgacgaggaactcgaaaagatgctggacaagattatgataattttccggttcatttatggcaaggacgtgtttgaagctttctacaaaaaagaccttgcaaaaaggctgctggtgggaaagtcagcttctgtcgacgccgaaaagagtatgctgtccaaattgaagcacgaatgtggagccgcattcacctcaaagctagaagggatgtttaaagatatggaactctccaaggacattatgattcagtttaaacagtacatgcaaaatcagaacgtgcccggtaatatcgagttaacagttaacatcctgactatgggttactggcctacatacgtgcctatggaggtacacttgcccccagagatggttaagcttcaggaaatcttcaaaaccttttaccttgggaagcactccggacgtaagctgcaatggcagtctactctgggccattgtgtgctcaaggctgagtttaaggaaggtaaaaaagaactgcaggtgagtctgtttcagaccttggtgctgctgatgttcaatgagggggaggaattcagcctagaggaaatcaaacaggcaaccgggatcgaagacggcgagctcagacgcacactgcaatctctggcttgtgggaaggctcgggttctggctaagaatccgaagggcaaggacattgaggacggagataaattcatttgcaatgacgacttcaagcacaagcttttccgaatcaagatcaaccagatccagatgaaagagactgttgaggagcaggctagcaccaccgagcgcgtgtttcaggaccgacagtatcagatagacgctgccatagtgaggattatgaagatgcgcaagaccctctctcataatttacttgttagcgaggtgtacaatcagctcaagttcccggtcaagcctgctgaccttaagaagcgaatcgagtctttgattgacagagactacatggagcgagataaagaaaatcccaatcagtacaattacatcgcgtag

SEQ ID NO: 219550 - DNA, 2343 bp, Artificial Sequence
  Description of Artificial Sequence: Synthetic coding sequence
atggccacctctaatctcctaaagaacaaaggctccttgcagtttgaggataaatgggattttatgcgaccgatcgtccttaagcttctcaggcaggagtcagtgactaagcaacagtggttcgacctctttagtgatgtgcacgctgtgtgcctttgggatgataaaggccctgctaagatccaccaagctctaaaggaggacatcctcgagttcatcaagcaagcgcaggcgagggtcctcagccatcaggacgatactgccctgctcaaggcttatatagtagagtggcgcaaattttttacccaatgtgatattctgcctaagccattttgtcagttggagatcacactcatgggaaagcagggttctaacaagaaatcaaacgtcgaagactcaattgtaaggaagctgatgctggatacatggaacgagagcatcttcagcaacattaaaaatcgactacaggattctgccatgaaactcgtgcacgccgagaggttaggagaggctttcgatagccaactggtaatcggcgtgcgggaaagctatgtcaacctctgttcaaaccccgaggacaagctacagatttaccgcgataacttcgaaaaggcgtaccttgacagcaccgaaagattctaccggacacaagccccaagttatctccagcagaatggggttcaaaactacatgaagtacgctgacgctaagctgaaagaagaagaaaaaagagccctgcgctacctcgaaacacggagggagtgtaatagcgtggaagctctcatggaatgctgtgttaatgccttagtcacctccttcaaagagaccatcctcgccgaatgtcagggtatgattaagaggaatgagactgaaaaattacacctgatgttttcattgatggataaggtccccaatggcatcgagcctatgctcaaggacctggaagagcacattattagcgcgggtctggcggacatggtcgccgcagcagaaaccatcaccaccgactctgagaaatacgtagaacaactcttaaccctattcaaccggttcagcaaactcgtgaaggaggctttccaggatgatcctagatttttaaccgctagagataaggcctacaaagccgtggtcaacgacgctacaatctttaaactggagctccctctaaagcagaaaggcgtcggtctgaagacgcagccagaaagcaagtgccctgaactgctcgcaaattactgtgatatgctgcttagaaaaacccccctgagcaagaagctaaccagtgaggagatcgaagccaaactgaaggaagtcctcctagtcctcaagtacgttcaaaacaaggatgtcttcatgaggtatcataaggcacacctgactcggcgacttatcctggatatcagtgctgacagcgagattgaagagaacatggtcgagtggttgcgcgaagtgggaatgccagcagattatgtcaataaactggccaggatgttccaggacatcaaggtttccgaagacctgaatcaggcctttaaagagatgcacaagaataacaagctggcattgcctgctgacagcgtgaacattaaaatactgaacgccggagcttggtcccggagcagcgagaaagtgtttgtctccctaccgacggagctcgaggatttgatacccgaggtcgaggaattctacaagaaaaaccacagcggcagaaagctgcactggcaccatttaatgtcaaatgggattattactttcaaaaatgaggttggacagtacgatctggaagtcacaactttccagttggcagtgctattcgcctggaatcagagacccagagagaagattagcttcgaaaacttgaaactggccaccgagctgccagacgcagagctgcggaggaccctctggtctttggtcgcttttccaaaactgaagcggcaggttctactctatgagccccaggtgaactctcccaaagactttacagaggggacacttttttcggtgaaccaggagttcagcctgatcaagaacgctaaggtccaaaaacggggaaaaatcaatctgattggtaggctgcagctcaccacggagcggatgagagaggaagagaacgaagggatagtccagcttcggatcctgagaacacaggaagctatcatccagattatgaaaatgcggaagaagatctctaatgctcagctccaaaccgagcttgttgagattctcaagaacatgtttcttccacagaaaaagatgatcaaagaacagatagaatggctgatcgagcacaagtacattcgacgagacgagagtgacatcaacacattcatctacatggcttag

SEQ ID NO: 219551 - DNA, 2343 bp, Artificial Sequence
  Description of Artificial Sequence: Synthetic coding sequence
atggcaacttcgaatcttcttaaaaataaaggctccctgcagtttgaagacaaatgggatttcatgcgaccaatcgttctgaagcttctgaggcaagaaagtgtgactaaacagcagtggtttgacctgttcagtgacgtgcacgctgtctgcctttgggacgataagggccctgccaaaattcatcaggcccttaaggaagacatcctggagttcataaagcaggctcaggcaagggttctgagccatcaggacgacaccgccctccttaaggcttacatcgtggagtggagaaagttcttcacccaatgtgacattttgcctaagccgttctgccaactggagattacactcatgggaaaacaaggtagcaataagaagtctaatgtggaggattccattgtccggaaactcatgctggatacttggaacgaaagtattttcagcaacatcaaaaacaggttgcaggatagcgctatgaaactagttcacgctgagcgtctcggcgaggcattcgactcccaactggttatcggggtgcgcgaatcatatgtaaacctgtgcagtaatcctgaggataaattacagatctaccgagataactttgagaaagcatacctggatagtactgaaaggttctataggactcaggccccaagttatctgcagcagaatggcgtccagaattacatgaaatatgccgacgccaagttgaaagaagaagagaagcgcgcattgcggtacttagaaactaggcgcgaatgtaattctgtagaggcattgatggagtgctgcgttaatgccttggtcacttcctttaaagagacgatcctggccgagtgtcagggcatgattaagcgcaatgaaacagagaaacttcacttgatgttttcattgatggataaagttccaaacggcatcgaacctatgcttaaggacctcgaagagcacatcatctcagcgggactggcggacatggtggcagccgcagaaacaatcactactgactctgaaaagtatgtcgagcagctgctcactctctttaaccggtttagtaagctcgtgaaggaggccttccaggatgaccctcggttcctaacagcaagggataaggcctataaagccgtggtaaatgacgccactatattcaagttagaactgcctctgaaacagaaaggtgtgggccttaaaacccaacctgagtcgaagtgccctgagctgcttgccaattactgcgacatgctcctccgaaagacccccctgtcaaagaaactgacatcggaggagatagaggccaagctgaaagaggtgctgctcgtgcttaaatacgtgcagaacaaagacgtatttatgcggtaccacaaagcccatctcaccaggaggctgatactggacatctccgcggactccgaaatcgaggaaaacatggtggagtggctccgagaggtgggaatgcctgcggactacgtcaataaactcgcccgaatgttccaagacataaaagtgtcagaagatctcaatcaggcatttaaggagatgcacaaaaacaacaaactggccctaccagctgattccgtcaatatcaagatactaaacgcgggagcctggtcgcggtcctccgaaaaggtatttgtatcccttccgactgagctcgaagatctaattcctgaggttgaagaattctacaaaaagaaccactccgggagaaagctgcattggcatcatctgatgtcgaatggaatcatcaccttcaaaaatgaggttgggcagtatgatctggaagtaacgacatttcaactggccgtactgttcgcgtggaaccagaggccaagagaaaaaatatcatttgaaaatttgaagcttgccacagaactacccgacgcggagctacgcagaactctatggagcctcgttgccttcccaaaactgaaacggcaagtcctgctgtatgagccccaggtgaattccccaaaggatttcaccgaaggaacactgttctctgttaatcaggagttcagcctgattaagaatgcgaaggtgcagaagagggggaagattaacctcatcggccgactccaactgacaacagaaaggatgagagaggaggaaaacgaaggcatcgttcaacttcgcattctgcggacacaggaggctattatccagatcatgaagatgcggaagaaaatttccaatgcgcagctccagacagaattggtcgaaattctgaaaaacatgtttctgccccaaaaaaaaatgataaaggaacagatcgagtggttgatcgagcataagtacataaggagggatgaatcggacatcaataccttcatatatatggcatag

SEQ ID NO: 219552 - DNA, 5097 bp, Artificial Sequence
  Description of Artificial Sequence: Synthetic coding sequence
atggtaggggaattacgctaccgggagttcagagtgcctttaggacctgggctccacgcgtatccagacgagttgatccgccagcgagtaggtcacgatggacacccggagtatcagatccgttggctcatcctgcggcgtggcgacgagggtgatggtggcagcggacaagtcgactgtaaggccgaacacatcctgctgtggatgagtaaggacgagatttacgcaaattgtcataaaatgttaggcgaagacgggcaagttatcggcccttctcaagaatcagccggtgaagtcggtgccctcgataaatctgttttggaagagatggagaccgacgtgaaaagcctgattcagagggcgctcaggcagttagaggaatgcgttgggactatcccccctgccccactgttgcacaccgtccacgtgctgagtgcctacgctagcatcgagccactcactggagttttcaaggatccaagggtactggatcttctcatgcatatgctgtctagccctgactaccagatccggtggagcgcaggtaggatgatacaggccctgagctcacatgacgccggtacccgtacccaaatcctcctatcgctcagtcagcaggaggctattgagaagcatttagactttgatagccgctgcgcactgctcgccctctttgcacaggcaaccctgagtgagcatcccatgtcctttgaggggatacagctgccacaggtcccaggtcgcgtgctgttctccctcgttaagcgctacttacacgtcacctcccttctagatcagctgaatgatagcgccgctgaacctggggcacagaatacaagcgctccggaggaactgtcaggagagcgcggacagttagaacttgaattttccatggcgatgggcaccctgatttcagaactcgtgcaagccatgcggtgggaccaggcgtcagaccgccctagaagttctgcaagaagtcctggatccattttccagccacaactggccgatgtctctccgggtttgcccgcagcgcaggcacagccctcctttcggaggagcaggcggtttaggcccagatccgagttcgcaagcggtaatacctacgcgttgtacgtacgtgatactttgcagcctggaatgcgcgtgcggatgctcgacgactatgaggagatatctgctggcgatgagggcgagttcaggcagagtaacaatggggtgccacccgttcaggtcttctgggagtctactggtagaacctactgggtccattggcacatgcttgagattctgggcttcgaggaggacatcgaggatatggtcgaggccgacgagtaccagggcgcagtggccagccgcgtgctgggcagggccttgccagcatggcgctggcggccaatgacagaactctacgccgtcccatatgtactgccggaagatgaagatacagaggaatgtgagcacctgactcttgccgagtggtgggagctgctgtttttcataaagaagctagatggtcccgatcaccaggaagtgctgcagatcctgcaagaaaacctcgatggcgagattcttgacgacgaaatccttgctgagctggcggtccccatagagctggcccaagatctccttctgactctgcctcaaagacttaatgactccgctttacgagatctgataaactgtcacgtctacaaaaaatatggacccgaagcactggcgggaaatcaggcatacccgtctctgcttgaagctcaggaagacgtgttgctgttggatgctcaggctcaggcaaaggatagcgaggacgcggcaaaggtggaggccaaggagccccctagccagtccccaaacacccccctgcagcgcttggtagagggttacggacccgcagggaaaatccttctcgatctagaacaagctctttcttcagaaggtacccaggaaaataaggttaaaccattgctgcttcagctgcaacggcagccccaaccgtttttggcattgatgcagtctctggacactccagaaacaaatcggacactgcatctgacagttctccggattctgaaacagctggtggacttccctgaggccttactcttgccctggcatgaagcagtcgacgcatgcatggcttgtctgaggtctccaaataccgaccgggaggtgttgcaggaactgatttttttccttcatcgcctaacatccgtgtcccgcgattacgccgtagtccttaaccagctgggcgctagggacgccatcagcaaagcactagagaaacacctggggaagctagaactcgcccaagagctgcgcgacatggtgttcaaatgtgaaaagcatgcacacttgtaccgtaagctgattaccaatatcctcggcggatgcattcagatggtccttgggcaaatagaagatcacagacggacacaccagcccattaatattccgtttttcgatgtgttccttaggtacctgtgccaaggttcttccgtcgaagttaaggaagataagtgttgggagaaagtcgaggtctcctctaacccacatcgagccagcaagctgactgaccacaatcccaaaacctactgggaatcaaacgggtcagccggttcacattacattacactgcatatgcggagagggatcctgatcagacaactgactctcctcgtggctagtgaggattccagctacatgcctgcacgggttgtcgtctgcggcggagacagcacttcttctcttcacacggagcttaactcagtcaacgtaatgccgagcgctagcagagtgatcctgctggaaaatctcacccgcttttggcccataattcagatcagaatcaagagatgccagcagggtgggatagacacccggatccgcggactcgagatcctcgggcctaaacccactttctggccagtgtttcgggaacagctgtgtaggcacactcgtttgttctatatggtccgcgctcaagcttggagccaggacatggccgaagatcggcgatcactcctacacttatcatcacgtttgaacggagctcttcggcaggaacaaaatttcgctgacagattcttgcccgacgatgaggccgctcaggcattgggcaaaacctgttgggaggccctagtgagccccgtggtacagaatataacatctccagatgaggatggtatatcgcccctcggctggctcctggaccagtatctggagtgtcaagaagcagtgttcaatcctcagagccgcggaccagcctttttttctcgtgtgcgcaggctcactcacttgttagtccatgtagaaccatgtgaagctccgccaccagtggtggccacgccacggccaaagggtcgaaaccggagccacgactggtcctctttggctactaggggactgccttcatctataatgcgtaacctcactaggtgctggagagctgttgttgagaaacaggtgaacaacttcctcacttcgtcctggcgggacgatgacttcgtccccagatactgtgagcactttaatatcctgcagaactcctcaagtgagctgttcggccctcgcgcagcttttcttttggcactgcagaacggatgcgcgggagccctgctgaagttacctttcctgaaagccgctcacgtctctgaacaatttgccagacacattgaccagcaaatccaaggcagccgaatcggcggagcccaggagatggagcggctcgctcagctgcagcaatgccttcaagctgtgctcatcttttcgggactggagatcgccaccacattcgagcactattaccaacactatatggccgaccggcttcttggggtggtaagcagctggctggagggcgcagtgctcgaacagataggaccatgttttcccaataggttgccccagcagatgctgcagtcactcagcacatcaaaagaacttcaaaggcaatttcacgtgtaccagcttcagcaactggatcaagagctccttaagctggaagacactgaaaaaaagatccaggtcggacttggcgcaagtggcaaggaacataaatccgaaaaagaagaggaggccggagccgcagctgtggtggacgtggccgaaggcgaggaagaagaggaggagaacgaggacttgtactacgagggcgcaatgcccgaggtgagtgttcttgtcctgagtcggcactcatggcccgtggcaagcatctgccatacattaaacccacgcacatgcctccccagctacttgaggggcaccctgaatcgttacagtaacttctacaataaatcccagtctcacccagctcttgagcggggaagccagagacgcctccagtggacatggctggggtgggctgagctgcaattcggcaaccagactcttcatgtgtccaccgtgcagatgtggctgctgctgtacctcaacgacttgaaagccgtttcggtcgagtccctgttggcgttctctggactgagcgcggacatgctgaatcaggccattggccctctgactagctcacgaggccctcttgacctccatgaacagaaagacatacctggaggagttttgaaaattcgggatggttcaaaggaaccacggagtcgctgggatattgtgcgactaattccaccacagacgtatttacaagctgagggtgaagacgggcagaatttggaaaagcgcaggaatctcttaaattgcctgatcgtaagaattcttaaggcacatggcgacgagggtttgcacatcgaccagttagtgtgtttagttttggaggcgtggcagaagggtccgtgtccgcctagaggcctggtgagctccttggggaaaggatcagcctgcagttctacagacgttctctcctgcatccttcacctgttaggtaagggtactctgcgcaggcacgacgacaggccccaggtgctgagctatgctgtgccagtgaccgtcatggagccgcatacagaaagcttgaatccaggatcctcaggccctaacccaccactgacgtttcacaccctgcagatccggagccgaggcgtgccttatgcatcatgcaccgccacacagtctttcagcactttccggtag

SEQ ID NO: 219553 - DNA, 5348 bp, Artificial Sequence
  Description of Artificial Sequence: Synthetic coding sequence
atgtccagagggttctggttggccgaaccccttgcaggcacagggcctcatccagcacctgttgccgcagattcccgtgggtgctcctcagttccgcgtaggcacgccccatccagattgagcgtcagcacgccctctcggggtccgggtgccaggatggtgggggaattgagatatcgcgaatttcgggtgccactggggcctggcctgcatgcctaccctgatgagctgatccgacagcgggtgggacacgatggccatcccgagtatcagattcgctggttgattctgaggaggggggacgaaggagacgggggatctggtcaggtggactgcaaggctgagcatatcctgctgtggatgtccaaagatgaaatatacgcgaattgtcacaagatgttaggagaggacggacaagtgataggacccagccaagagagcgcaggcgaagtgggggctcttgataagtcagtgctggaagagatggagacagatgttaagagtctgatccagagggcgctgcgccaactcgaggagtgcgtcggcaccattccccctgcaccactcctgcacacggtgcacgtgctgtctgcctacgccagcatagaaccactgacaggggtctttaaggatcctagggttctggacctgttgatgcacatgctgtcatccccagactaccagattagatggtcagccggacgaatgatccaggccttatcatcgcatgacgccggtgaggggcagtgtggtgaagaaggcaaagctggggaaggacttggcaggctgagagattcgcaggacacagtggctggggcaagcgacctaatcaggaccaggacccaaatcctcctctccctgtcccagcaggaagcgatagaaaagcaccttgacttcgacagcaggtgcgccttgcttgctctgttcgcccaggccacccttagcgaacatcccatgtcatttgagggaatccagcttccacaggtgcctggcagggtcttgttttccttagtgaagagatacctgcatgtcaccagcctactggatcagttaaatgattctgcagccgagcccggagcccagaatacaagcgccccagaagagctcagtggcgagcgtggacagctcgaacttgagttctccatggccatggggacactcatttcggaactcgtgcaggccatgcgttgggaccaagcttccgacagacccagatcttcagctagaagccctggctctattttccagccccagctggctgatgtgtcacctggcctgcccgctgcccaggcacagccgtccttcagaagaagtagaaggttccggcctaggtccgagtttgcgagtggtaacacttacgccctttatgtgcgcgacacactgcagcccggaatgagagtccgcatgctggatgactacgaggagatcagcgccggtgacgagggcgagttccgccaatctaacaatggagttcccccagtgcaggtgttttgggagtctaccgggcgaacttattgggtccactggcatatgctggagatcctgggattcgaggaagatatagaagatatggtggaggccgacgagtaccagggcgcagtggcttcaagagttctggggcgtgcccttccagcatggcgttggaggcccatgacggaactgtatgctgtgccgtatgttctgccagaggacgaggacaccgaggagtgtgagcatctaacactggcggaatggtgggaacttctgtttttcatcaaaaagttagacgggcctgaccaccaggaagtcctccagatcctccaagagaaccttgacggggagattcttgatgacgaaatactagctgaactggccgtgcccatcgaactggcccaagacctgttgctaaccttgccccagcgcttgaatgacagcgcattgcgcgatcttataaactgccacgtgtacaagaaatatggtccagaggctctggccggaaaccaggcttatcctagcctgcttgaggcacaggaagacgttctcctgctcgacgctcaagcacaggccaaggattctgaggatgcagcaaaggtggaggccaaggaacccccaagccagagccctaacacacctctgcagaggctggtggaaggatacggaccggcagggaagatactgctcgaccttgagcaagctctctctagcgaaggaactcaggagaataaagtgaaacccctgttgctgcagcttcagcgccagccacagccgttcttggcgctcatgcagagcctagatacccctgagaccaatcgaaccctgcacctgacagtactccgcatattgaaacagttggttgattttcctgaggcactcttgctgccatggcatgaggcggttgacgcttgtatggcctgcctgcggtcccccaacacagaccgagaagtgctacaagagctgatcttcttcctgcatagactgacgagcgtttcacgagattatgctgtcgtgctcaatcagttgggcgcaagggatgctatttcgaaagccctggagaagcacctcggaaaactggagctcgcgcaggagcttcgggacatggtgttcaaatgcgagaagcatgcacatttataccgcaagctcattactaacatattaggaggttgcatacagatggtcctcggtcagatcgaggaccaccgccgaacccaccagccaataaacatacccttctttgacgtttttctgcggtatttgtgccagggttctagtgtcgaggtgaaagaagacaaatgttgggaaaaggtggaggtgtcttcaaatcctcacagagcaagtaagttgaccgatcacaatcccaaaacatattgggaatcaaatggttccgccggatcccattatattaccttgcatatgcgccgtggaatcctcattcggcagcttaccctgctggtggcgtccgaagactcatcttacatgcctgcacgggtcgtggtgtgtgggggtgactcaacctcctccttacatacagagctcaactctgtgaatgtaatgccatcggcttcacgggtaatcctgttggaaaacctcacccgtttctggccaatcatccagattaggatcaagcggtgtcagcagggcggaatcgatacccggattcggggactggaaattctgggcccaaagcctacattttggccggtttttcgcgaacagttgtgccggcatactaggctcttttacatggtgcgggctcaggcttggtcacaagacatggccgaagacaggcggagtctcttacatctcagctctcggctgaatggggcactcaggcaggaacagaatttcgcagaccgctttttaccggacgatgaggcagcccaggccctgggtaaaacctgctgggaggccctggttagcccagtcgttcagaacattacgagcccagacgaggacggcatatctccgcttggatggttgttggaccaatacttggagtgccaggaggctgtatttaacccacagtcgcgcggacccgcatttttttctcgggtaagacggctcactcatctgctcgtacacgtggaaccatgcgaggcccctcctccagttgtggctacaccgagacctaaaggaagaaatagatctcacgattggtcttctctggcaacgagaggactgccttcttcaatcatgcgaaatctaaccagatgttggcgagctgtagtggagaagcaggtgaacaacttcctgacctcctcatggcgcgatgatgactttgtcccgaggtattgcgaacatttcaacattctgcaaaacagtagctcagagctctttggcccaagggcggcatttctacttgccctccagaatgggtgtgccggagctcttcttaagctcccttttttgaaagctgcacacgtgagtgaacaatttgcacgacatattgaccagcagatacagggatctaggatcgggggagcccaagaaatggagcggttagcccagttacagcagtgcctgcaggctgttttaatattcagcggccttgagatagctactacctttgagcattattatcagcactacatggcggaccgcctactgggggtggtcagcagctggcttgaaggtgctgtgctagaacagattggcccatgtttccccaatcgtctgccccagcagatgctccagtctctttccacttccaaagagcttcagcgccagttccacgtgtatcagctacagcaactggatcaggaactgcttaaactggaagacactgagaagaagatccaagtgggtctgggagcatccggcaaggagcacaaatccgagaaggaggaggaggccggagcagctgctgtcgtggatgtggcagagggcgaagaagaggaagaagaaaatgaggatctctactatgaaggggcaatgccagaggtgagcgtgctcgtgctatccagacattcttggccagtcgcgtctatctgccatactctgaacccacggacgtgcctgccgagctatcttagaggaacgctcaatcgttattcgaacttctacaacaagtcacagtctcatccagccttggaacggggatcacaaaggaggctgcagtggacttggctgggatgggctgaactacaatttggaaatcagacactccatgtttcgacagtccaaatgtggctcctgctctatttaaatgatctaaaggcagtatcagtagaatctctgctggccttcagtggactcagcgcagatatgttgaaccaggcaatcggtccattaacgtcttctcgtggtccactggatctgcatgagcagaaggacattccaggcggagttctgaaaattcgtgacgggtccaaggagcctcggtctaggtgggacatagtacgtctcatccctccccagacatatctgcaggctgaaggggaggacggtcagaacttggagaagcgccgtaatttgcttaattgcctcattgtccgtatattaaaagcccatggagatgagggactgcacatcgatcagttggtgtgcctggttctggaggcatggcagaaagggccttgtccacctcgaggccttgtttcatctttggggaaagggtcagcttgttctagtacagatgtgttgtcttgcattctgcacctgctgggcaagggaacgctacggcgacatgatgatagaccccaagtactctcctatgctgtccccgtgacagtgatggaaccacacacggagagccttaatcccggaagttccggaccaaatccacctcttactttccatactctgcagattcgctcccgtggcgtcccgtacgcctcctgtacagcaactcaaagcttcagcactttcagata

SEQ ID NO: 219554 - DNA, 435 bp, Artificial Sequence
  Description of Artificial Sequence: Synthetic coding sequence
atgggagttctgcaggtagtgaaacagagtgtccaaatcccagtattcgtaatgattagacccaggggcggagactttttgtacagcgatcgtgaaatcgaggtaatgaaagcagacatcagactggcaaaactatatggagccgacggcctcgtgtttggagcgctgacggaagacggacatatagacaaagaactctgtatgtcactaatggcgatctgtcgtcccctgcctgttacattccatagagcctttgatatggtgcatgacccaatggcggctttggagaccctgctgacacttggtttcgaacgcgtgttgaccagcggctgcgattcttccgccctggaggggcttcccctgatcaaacgactgattgagcaggccaagggtcgcattgttgtcatgcccggaggtggtattaccgatcgatag

SEQ ID NO: 219555 - DNA, 822 bp, Artificial Sequence
  Description of Artificial Sequence: Synthetic coding sequence
atgaaacggcagggagctagctccgagcgaaaacgcgctcgaatcccttcagggaaggccggagccgcaaacggctttctcatggaggtctgtgtcgattcggtggagtctgcagtgaacgccgagcgtggtggggcagatcggattgaactgtgctcagggctttccgagggcggaacaacacctagcatgggcgttctgcaggtcgtgaaacagtctgtacagattccagtgttcgtgatgattcggcctcggggaggagacttcctgtatagcgatagggaaatcgaggtaatgaaggctgacatcagactggccaaactttatggggctgatgggttggtgttcggtgcacttacagaggacgggcatatcgataaggagttatgcatgagcttgatggctatctgtcggccactgccagtaaccttccacagagcctttgacatggtgcacgatccaatggctgcactagagacgctgctgaccctgggtttcgagagggtactgacttctggttgcgactcatccgctctggaggggctcccactcatcaaacggttgattgagcaagccaaaggcaggatcgtggtgatgcctggcggaggaattaccgaccgcaacctccagagaatcctggagggatccggcgcaaccgagtttcactgttccgcgagaagcacccgcgactctggcatgaagtttcggaatagtagcgtagccatgggcgcttcactcagctgctctgagtatagcttgaaggtgacggacgtgacaaaggtgcgtacgctgaacgccattgccaagaacattctggtatag

SEQ ID NO: 219556 - DNA, 1122 bp, Artificial Sequence
  Description of Artificial Sequence: Synthetic coding sequence
atgtcattactcctcctcctgttacttgtttcctactatgtaggaactctcggaactcacaccgaaatcaaacgagtggccgaggaaaaagtgacattgccttgtcaccaccagcttgggctgccggaaaaagatacgctggacatcgagtggctgctcacagataacgaggggaatcaaaaagtcgtcattacctactcaagcaggcatgtctataacaatcttaccgaggaacagaaaggaagagtggcattcgccagcaactttcttgcgggtgatgcttcgctgcagatcgaaccgctaaagccgagcgacgaaggaagatacacctgcaaggtcaagaacagtggacgctacgtgtggtcacacgtcatcttaaaggtgcttgtcagacctagcaagcccaagtgtgaactggagggagagttaaccgagggtagcgatttgactttacagtgtgaatcttccagcggtactgaaccaattgtctactattggcagcggatcagagagaaagagggggaggatgagagactgcccccaaaatctagaatcgattacaaccatcctggcagggtcctgcttcagaatctgactatgagctactctggcctgtaccagtgtacggctggtaatgaagcaggtaaggaatcctgcgtggtgagggtaacagttcagtatgttcaatctatcggaatggtggctggcgctgttactggcatcgtagcgggagcattgctaattttcttgctggtgtggcttctgattcgccgaaaggataaagagagatacgaagaagaggagcggcctaacgagatccgcgaagatgcggaggctcctaaagctcgtctcgtaaaaccttccagctcctccagcggctcccgaagcagccggtcgggcagttctagcacccgatccaccgccaactctgcttcgagaagtcagcgcacactgtcaactgacgcggctccccagcctggtttggcgactcaggcttactctctggtgggccctgaggtgagggggtccgaacctaagaaggtgcaccatgctaatctgacgaaagccgaaacaaccccatcgatgataccatctcaatctcgggcatttcaaacggtatag

SEQ ID NO: 219557 - DNA, 597 bp, Artificial Sequence
  Description of Artificial Sequence: Synthetic coding sequence
atgcaccacagaaatgacagtcagcggttaggtaaggctgggtgtcctcccgaaccaagcctccagatggccaacaccaatttccttagcactttgtcccccgagcattgccgccctctcgccggtgaatgcatgaacaaactgaaatgtggggctgctgaagctgaaataatgaacctccccgaaagggtgggaactttcagcgccatccccgctctgggaggcataagcctgccccctggcgttatagtcatgacagccttgcatagcccagccgcagcgagcgccgcagtcacggactccgcttttcaaatcgcaaatctggcagactgcccccagaatcatagctcctcctcttccagttcaagcgggggagcaggaggtgctaacccggcaaaaaaaaaacgaaaaagatgcggcgtatgcgtcccctgcaagcggctgataaattgcggggtgtgttcctcctgcagaaatagaaaaaccggacatcagatttgtaaattccgaaagtgcgaggaacttaaaaaaaagcccggtacctcgcttgaaagaacccccgtcccatccgccgaagccttcaggtggttcttttag

SEQ ID NO: 219558 - DNA, 597 bp, Artificial Sequence
  Description of Artificial Sequence: Synthetic coding sequence
atgcaccaccgaaacgacagtcagcgcctggggaaggctggatgtccgccagaaccttcgctacagatggccaatacaaactttctgtcgacgcttagcccagagcactgccgtcccctcgcgggtgaatgcatgaataaactgaaatgcggcgcagccgaggccgagatcatgaatcttccggaaagagttggtacgttttcagcaattccggcattaggtggcatttcacttccccctggtgttattgtgatgactgctctgcattctcctgcagcagcttccgctgctgttacagactcggcgttccagattgcgaacctcgccgattgccctcagaatcactcatcgtcttcatcatcctccagcgggggagccggtggggcaaatcctgcaaaaaaaaagaggaaacggtgcggggtttgcgtgccttgcaagcgattgattaattgcggggtctgctctagttgtagaaatcggaaaacaggccaccagatttgcaagtttcgcaagtgtgaggagttgaagaaaaagcccggtacgagtctggaaaggaccccggtgcctagcgccgaggcctttcgatggtttttctag

SEQ ID NO: 219559 - DNA, 969 bp, Artificial Sequence
  Description of Artificial Sequence: Synthetic coding sequence
atgagcagcctcggcggaggttctcaggatgctggtgggtcctcttcttctagtaccaatggaagcgggggtagtggatcttcaggtcccaaggcaggcgcagccgataaatcagccgtggtggcggcagccgctcctgcatccgttgccgatgacacccctcctcccgaaagacgtaacaaaagcgggattatttccgagcccttgaacaagagcctgcggagaagtcggcctctgagtcattacagttcatttggatcatccggcggtagcgggggtggtagcatgatgggtggtgaatcagcagataaagcaactgctgccgcagctgctgcatcactgctcgccaatggtcacgatctggccgcagccatggccgtcgataagagcaatcctacaagcaagcacaaaagcggtgccgtggcctctctgctgtcaaaggcggagcgggctaccgagttggctgcagagggacagctgactctccaacagtttgctcagagtacagagatgctaaaacgcgttgtgcaagagcatctgcccctgatgagcgaagctggcgctggacttcccgacatggaggccgtagccggagcagaagccctcaatggacagtctgacttcccttacctgggagccttccctatcaacccagggctgttcattatgacacctgctggcgtgtttctggctgaaagtgcgctgcatatggctggattggcagaataccccatgcaaggagaattggctagcgccatcagttccggaaagaagaaaaggaagaggtgcgggatgtgtgcgccatgtaggcgcaggatcaattgtgagcagtgctcatcctgtcgcaaccggaagaccggacaccagatttgcaaatttaggaaatgcgaagaactcaaaaagaagccctccgcagcactggaaaaagtgatgctgcccaccggcgcagcgttccggtggtttcagtag

SEQ ID NO: 219560 - DNA, 210 bp, Artificial Sequence
  Description of Artificial Sequence: Synthetic coding sequence
atgtcgtctctgggcggtggcagccaagacgcaggcggatcctctagctccagtacaaatgggtctggaggctccgggagcagcggcccaaaggctggcgcagcagacaaatccgccgttgtcgccgctgcggcaccggcaagcgtagctgatgacactccacccccagaacggaggaacaagagcggcatcatatccgaacccctgtag

SEQ ID NO: 219561 - DNA, 243 bp, Artificial Sequence
  Description of Artificial Sequence: Synthetic coding sequence
atgtcttcactgggaggcggttcgcaagatgcgggtggtagtagttctagttcgacgaatgggtcagggggatccggctctagtggacctaaggccggtgctgccgacaaaagcgcggtggttgctgccgcagcccctgcctctgtcgccgacgacaccccaccaccggagcggaggaacaaatctgggattatatccgaaccactcaataagtctctacggagaagccggccactgtcatag

SEQ ID NO: 219562 - DNA, 546 bp, Artificial Sequence
  Description of Artificial Sequence: Synthetic coding sequence
atgtccagtctggggggtggaagccaggacgctgggggtagtagctcctcttctactaacgggtcaggcggatccggctcttccggtcctaaggccggagcagccgataaatcggcagtcgtggctgccgctgcccctgcttctgttgcggacgacactccccctccggaaagacgcaacaagagcgggataataagtgaaccactgaacaagtctctcaggcgaagcaggcctctctctcattattcctctttcggaagttctggcggatcaggtggtggcagcatgatgggcggagagagtgccgataaagctaccgccgctgccgctgccgcatccttgctcgccaacggtcatgacctggccgcagccatggccgttgacaaaagcaaccctacctcaaaacacaaatccggggcagttgcaagccttctttccaaagcagagcgggcaactgaacttgcggctgaaggccaactgaccctgcagcaatttgcccaaagtaccgaaatgctgaaacgagttgtgcaggagcatttgccttag

SEQ ID NO: 219563 - DNA, 252 bp, Artificial Sequence
  Description of Artificial Sequence: Synthetic coding sequence
atgtcaagtctcgggggaggtagccaggatgctggcggttcttcctccagcagcactaacggcagtgggggatctggatcctctgggcctaaggctggggcagcagacaagtccgccgtggtggccgcagctgcccctgcgtccgtagccgacgataccccacctcctgagaggaggaacaaaagcggtatcatctcggaaccactgaacaagtctctccgtagatcccgccctctgagccactattcttag

SEQ ID NO: 219564 - DNA, 486 bp, Artificial Sequence
  Description of Artificial Sequence: Synthetic coding sequence
atgtcaagcctgggtggcggatcccaggacgctggcggttcttcgagctcaagtactaacgggagtggcggaagtggatcatcagggcctaaagccggagccgctgacaagtccgccgttgtcgccgcagccgctccagccagtgttgctgatgatactccaccacccgagcgcagaaataagtctgggatcatttctgaaccgctgaataagtcccttaggaggtctcggccattaagccactattcatcatttggctcaagcgggggttctggagggggttcaatgatgggcggagaatcggccgataaagccacagcggctgcggcagcagccagcctgttagccaacggacatgacttggctgctgctatggccgttgataaatccaaccctacatctaagcataaatctggcgcagtggctagcctcttgagcaaggcggagcgagccacggaactggctgctgaggggcaattgacatag

SEQ ID NO: 219565 - DNA, 309 bp, Artificial Sequence
  Description of Artificial Sequence: Synthetic coding sequence
atgagtagcctcggtggaggctcgcaggacgcaggcggatcgtcatctagctccacaaacggaagcggcggtagtggaagctccgggcctaaggccggagccgcagacaaatctgccgtggttgcagccgcagcccctgcgagcgttgccgatgacactccacctcccgagcgcaggaataaatccggaataatatctgagcccttaaacaagagccttcggaggagtagaccgttatctcattattcttcctttggttctagtgggggttctggagggggatctatgatggggggtgagtcagcgtag

SEQ ID NO: 219566 - DNA, 36 bp, Artificial Sequence
  Description of Artificial Sequence: Synthetic coding sequence
atgagtagcctgggtggcggttcgcaggacgcttag

SEQ ID NO: 219567 - DNA, 297 bp, Artificial Sequence
  Description of Artificial Sequence: Synthetic coding sequence
atgagctctctgggtggtggttcccaggacgcgggaggatcttccagtagctccaccaacggcagcggcggatcgggatcttccggtccaaaggccggtgctgctgataaatctgccgtggtagccgcagcagctcccgcttctgtggccgatgatactccgcctccggagagaaggaacaagtcaggcataatctctgaacccttgaacaaaagtctcaggcgctcacgtccgctatcgcactacagttcctttggaagtagcggcggatctggtggaggtagtatgatgggttag

SEQ ID NO: 219568 - DNA, 969 bp, Artificial Sequence
  Description of Artificial Sequence: Synthetic coding sequence
atgtctagcctgggtgggggttcacaggatgccggtggaagctcctcttcctcgacaaacggaagcggcggatcgggaagcagtggacctaaagccggtgccgctgataaaagtgctgtggtggcagccgcagctcctgccagcgtcgctgacgacacgccaccccctgagcgcagaaataagtctgggatcatttccgagcccctcaacaagtcgcttaggcgctcaaggccacttagtcactattcttccttcggatcaagcggcggttcaggtgggggatctatgatgggtggggaaagtgccgacaaagctaccgccgcagccgcagctgccagcctgctcgcaaacggccacgatctcgccgctgccatggcagtggataaatccaacccaacatcaaagcataagtctggcgcagtggcctctcttctaagtaaggcagagcgggctaccgagttggcagccgaaggacagttgaccctgcagcagttcgcccagagcaccgaaatgctcaagagggttgtgcaagagcatcttcctctgatgagtgaagctggagctggactgcctgatatggaagctgtcgcgggtgccgaggccctcaacggccagagcgacttcccgtatctcggggctttcccaatcaatcctggtctttttattatgaccccagccggtgtgtttctcgctgaatctgcccttcatatggcgggacttgccgaatacccgatgcaaggtgagttggcaagtgccataagctctggcaaaaagaagcggaaacgctgcggaatgtgtgccccatgcaggaggagaattaactgcgaacagtgttccagctgtcgcaaccgcaagacaggacaccaaatttgtaagtttcgcaagtgcgaagagctgaagaaaaagcctagcgccgctctcgaaaaagttatgctaccaactggcgctgccttccggtggtttcagtag

SEQ ID NO: 219569 - DNA, 594 bp, Artificial Sequence
  Description of Artificial Sequence: Synthetic coding sequence
atgtcttccctcggaggaggcagccaggacgcagggggaagcagcagttcttcaaccaatgggtcaggtggctccggatcttctggacccaaggccggagccgcagacaagagcgcggttgtcgctgctgcagctcctgcaagtgttgccgacgataccccaccacctgagcgcaggaataaatctggaattatttctgagcctctgaacaagtctctccgaaggagcagaccactgagccattatagttctttcggttctagcggaggatccggaggaggcagcatgatggggggagaatccgccgacaaagccacagccgctgccgcagccgctagtttgcttgccaatggacatgacttggccgctgctatggccgtagacaaatcaaatcccacctcaaagcacaaatctggagctgttgcgagcctcttatcaaaagctgagagggcaaccgaactggctgccgagggacagcttactctccagcaattcgcccagagtaccgagatgctgaaacgggttgtacaggagcacttgcctttgatgagcgaagccggagctggcctgcccgacatggaagctgtggcatag

SEQ ID NO: 219570 - DNA, 27 bp, Artificial Sequence
  Description of Artificial Sequence: Synthetic coding sequence
atgagtagcctcggagggggatcatag

SEQ ID NO: 219571 - DNA, 222 bp, Artificial Sequence
  Description of Artificial Sequence: Synthetic coding sequence
atgtccagcttaggaggaggatctcaggatgccggtggcagctcttcatcgagtactaacggcagcggaggcagtggatcatccggacccaaggcaggcgctgccgacaaatctgccgtcgtggctgctgccgctcccgcttccgtggctgatgacacccctccacctgagcgtcggaacaaaagcgggattatatcagagcctttgaacaagtccctctag

SEQ ID NO: 219572 - DNA, 414 bp, Artificial Sequence
  Description of Artificial Sequence: Synthetic coding sequence
atgagctcactgggcggtggctcccaggacgctggtggatcttcttccagctcaacaaacggaagtggcggatccggttcttctggacccaaggctggcgcagcagacaaaagtgctgttgtggcagccgcagctccggcttcagtggcagatgatacacctccccctgagcgacggaacaagtccggtataatcagcgagcctttaaacaaatccttgcgtagatccagaccgttgtctcactattctagctttgggtcttctggcggttcaggcggaggttcaatgatgggaggggagagcgccgacaaggctactgccgcagctgcagccgcttcccttctggccaacggtcacgacctcgcagcagctatggctgtggacaaatctaacccaactagcaaacataagtag

SEQ ID NO: 219573 - DNA, 2073 bp, Artificial Sequence
  Description of Artificial Sequence: Synthetic coding sequence
atgaagctttctatgaaaaataacattatcaatactcagcaatctttcgtgactatgcctaatgtaattgtgcccgacatcgagaaggagatacgcaggatggagaacggcgcatgctcatccttctccgaggacgatgactcagcatccactagtgaggagtccgagaatgagaatccgcacgcaagagggtctttttcttacaagtccctgaggaagggtgggccatcacagcgggaacagtatctacccggtgccatagcattattcaacgtgaacaacagttccaacaaagatcaggagccagaggagaaaaaaaagaagaaaaaagagaagaagtccaaatcggacgacaagaacgagaacaaaaacgatccagagaagaaaaaaaaaaaaaaagataaagaaaaaaaaaaaaaagaagagaagtcgaaggataagaaggaggaagagaagaaggaggtagtggtgatcgacccttctggtaatacttattacaactggctgttttgtattaccctgcccgttatgtataactggaccatggtgatcgcccgagcttgtttcgatgaattgcagtccgactacctcgagtattggcttattcttgattatgtgtcagatatcgtttacttgatcgacatgtttgttagaacccgtacagggtatctggagcagggactgttggttaaggaagagctgaaactgataaataaatacaagtctaatctgcagtttaaactcgatgtcttgtcgctgatcccgaccgacctgctttatttcaaattgggttggaactatcccgaaatccggctgaataggttactcagattctctagaatgtttgagttttttcagcggactgaaacccggacaaattaccctaatatctttcgcattagcaatctggtgatgtacatcgttattattatacactggaacgcttgtgtgttctattctattagcaaggctatcggttttggtaacgatacttgggtttaccctgatatcaatgaccctgagtttggacgactcgcacgcaaatatgtttatagcctgtactggtcaactctgacactcacaaccatcggcgagacacctccgccagtgcgcgactccgagtacgtttttgtagtagtcgattttctaataggcgtgctgatcttcgcaaccattgtgggcaacattggctcaatgatcagcaacatgaacgccgctcgggcagaattccaggctcggatcgatgcaattaaacagtatatgcactttcgcaacgtctctaaggacatggaaaagagggtcataaaatggttcgattacctgtggacaaacaaaaaaacggtcgacgagaaagaagttttgaaatacctgcccgacaaactcagagcagagatagctatcaatgtgcacttagacactttgaagaaagttagaatctttgctgattgcgaagccggactgctggttgagcttgttcttaaactccagccccaagtctatagccctggagattatatatgcaagaaaggggacattggcagggaaatgtacatcattaaggaaggaaaactggcagtcgtagccgatgacggcgtgacccagtttgtcgtgctgtccgacggctcctactttggcgagattagtatccttaacatcaaagggtccaaagccggaaaccggagaacggcaaacatcaagagcataggttactccgatctattctgtctcagcaaagacgatctcatggaggccctcaccgagtatccagatgcaaaaacaatgcttgaagaaaaaggtaagcagattctaatgaaggacgggctcctggacttgaatatcgccaacgccggtagcgaccctaaggacctagaggagaaggtcacacgcatggaagggtcggtggacctgcttcaaacccgcttcgcccgtatccttgctgaatatgagtccatgcagcaaaaactgaagcagcggctgactaaagttgaaaaatttctgaaaccactgattgacaccgaatttagtagtatcgaaggccctggcgctgagtcaggacccatcgattccacatag

SEQ ID NO: 219574 - DNA, 2280 bp, Artificial Sequence
  Description of Artificial Sequence: Synthetic coding sequence
atggagagccgctcatctccacggcttgagtgcagtggggctatctccgcacattgttctttacacctgcccgacagcagcgacttccagctgatttttgtgttcctggtggagatgggtttccaccacgtgggacaggcaggcctggagttgctgatttcctccgatctccctacatctgcctcacagagcgccggaatcacagatatgaaattgagtatgaaaaataacattatcaatacacaacagagcttcgtcaccatgccaaatgtcattgtgcccgatatcgaaaaggagatccgaaggatggagaacggagcctgttcaagtttctccgaggacgatgacagtgcctccacttctgaggaaagcgagaacgagaacccacacgcgcgtggctcattcagctataaatcccttagaaaggggggacccagccagcgcgaacagtacttgccaggagctatcgccctgttcaatgtaaacaatagtagtaacaaggaccaggagcctgaagagaagaagaaaaaaaagaaagaaaaaaagtctaagtccgatgataagaacgagaataaaaatgacccagagaagaagaaaaagaaaaaagataaggaaaaaaaaaagaaagaagagaaatccaaagataagaaagaagaggagaaaaaggaggtggtcgtgatcgaccccagtgggaatacttactataactggctgttctgtataaccttgccagtaatgtacaattggactatggtgatcgcgagagcttgttttgacgaactacagtcggattacttggagtactggttgatactggattacgttagtgatattgtgtacctcatcgacatgttcgtgcgtacccggactggctatctggagcaaggcctgctcgtgaaagaggagctcaagctgattaataagtacaaatccaaccttcagtttaagctggacgttctaagcctgatcccaaccgacctactgtatttcaaactaggttggaattatcccgagatacgcctgaatagattgctgaggttctcccggatgttcgaatttttccagcgtaccgagacacggactaactatcccaatatcttcagaatttcaaacctggttatgtacatagttattatcatccactggaatgcatgcgttttctactcaatctctaaagccatcgggttcggcaatgacacctgggtttaccctgacatcaacgatccagagttcggccgactcgctaggaaatatgtctacagtctgtattggtccaccctgacattgacgactatcggcgagactccccctcctgtccgtgattcagagtacgtcttcgtcgtcgtagacttcctgatcggcgttttgattttcgccacaattgtggggaacattggttctatgatttccaacatgaatgctgccagggccgaattccaggcccgtatcgacgccattaaacaatacatgcacttcaggaacgtctccaaggatatggagaagagggtcatcaagtggtttgattatctgtggactaataagaagacagtggacgaaaaggaggttctgaagtacttgccagataagctcagagctgagattgcgatcaacgtccatctcgacaccctgaagaaggtgaggatctttgccgattgcgaggcaggtctgttagtggaacttgtgctcaagctgcaaccacaggtctattcacccggagattacatctgcaaaaaaggcgatataggcagggaaatgtatatcataaaagagggtaaactggctgtcgtggctgatgacggcgtgacccagttcgtggtattaagtgacgggagctattttggcgagatatctattctgaatatcaaggggagcaaagcaggaaaccgccgaacagctaacattaagtccatcggatactcagatctattctgcttgtccaaagacgacctgatggaggcattaaccgaataccccgatgccaagaccatgctcgaggagaagggcaaacagatcctcatgaaggatggtctgctggatctgaacattgcaaatgcgggatccgacccaaaagatctggaggaaaaagtgaccaggatggaaggaagcgtggatctgttgcaaactcgctttgccaggatcttggccgaatatgagtccatgcagcagaaattaaagcagaggttgaccaaagtcgaaaagttccttaaaccactgatcgacactgagttcagctccattgagggccctggggctgaaagcggcccaatcgattcaacttag

SEQ ID NO: 219575 - DNA, 2073 bp, Artificial Sequence
  Description of Artificial Sequence: Synthetic coding sequence
atgaagctcagcatgaaaaataatattatcaacacacagcagagcttcgtgacaatgccaaacgtgatcgtgcctgacatcgagaaggagattcgcagaatggagaatggggcatgtagctccttctcggaagacgatgactccgctagcacctctgaagaatccgagaatgagaaccctcacgcccgaggctcctttagttataaatcacttcgcaaggggggtccttcccaaagggagcagtacctacccggagcaatcgccctgttcaacgtaaacaattcctcaaataaagatcaagagcccgaggaaaagaagaaaaagaagaaggaaaaaaagtctaagtccgacgacaaaaatgaaaacaaaaatgatcccgaaaagaagaagaaaaagaaggacaaagaaaaaaagaagaaagaagagaagtccaaagataagaaggaagaggagaagaaggaggtagtggtcatagatccctccggaaatacatattacaattggctgttctgcatcacccttcccgttatgtataactggactatggttattgccagggcgtgttttgatgaattgcagtcggattacctggagtattggcttatcctcgactacgtgagcgacattgtatacctgatcgacatgtttgtgagaacacgcacaggttatctggagcagggcctgctcgttaaggaagagctaaaactgatcaacaagtataaatcaaacctccagtttaaacttgacgtccttagtctgatcccaaccgatttgctgtattttaagctaggctggaattatcccgaaataagactaaaccgccttctgcgctttagccgcatgtttgaattcttccagcggacagaaactaggacaaactatcccaacatttttcgcatcagcaatcttgtgatgtatatcgtaatcatcattcattggaatgcctgcgtgttctactcaatctcaaaagcaatcggattcggaaatgatacctgggtgtaccccgatattaatgatcccgagttcggacggctggcgcgtaaatacgtgtactctttgtattggtctactttgacactgaccaccattggagagacgcccccaccggtgcgagatagcgagtacgtctttgtcgtagtggatttcctgataggagtccttatcttcgccacaattgttggcaacatcggctccatgatctctaacatgaatgcagcaagggcagagtttcaggcacgcatcgatgccattaagcaatacatgcactttcggaatgtctctaaggatatggagaagcgggtgattaaatggttcgactatctttggaccaacaagaaaactgtcgacgagaaagaggtgctcaagtatttgcccgacaagctccgggcagagatcgccatcaacgtccacctggataccctcaagaaagtgagaatcttcgctgattgtgaagccggacttttggttgagctcgtgctaaagctgcaacctcaggtctatagtccgggagactatatctgcaaaaaaggcgacatcggcagagagatgtatatcattaaagaaggaaaactagccgtggtagcagacgatggcgtcacacagtttgtggtcctgtccgacggctcctacttcggagaaatctcgatccttaatatcaaagggtccaaggcgggtaataggcgcacagccaacataaaaagcatcggatacagcgatttattctgtctgagcaaagacgatctgatggaggcactcactgaatatcctgatgctaaaaccatgctcgaagaaaagggcaagcagatcttgatgaaggatggattgctcgatttaaacatagccaacgcgggatcggacccaaaggatctagaggaaaaggtcactcgcatggagggaagtgtggaccttctccagacccgatttgccaggatccttgccgagtatgaaagcatgcaacagaagctaaaacagagactcacaaaagtcgaaaagttcctcaaacctttgatcgacactgagttctcatccatcgagggccctggcgctgaatctggcccaatcgacagcacctag

SEQ ID NO: 219576 - DNA, 387 bp, Artificial Sequence
  Description of Artificial Sequence: Synthetic coding sequence
atgaaacttagtatgaaaaataacatcattaatacacagcagagttttgtcactatgcccaatgtcattgtaccggacattgagaaggaaatcaggcgaatggaaaacggtgcctgttcttcgttttctgaagatgacgactcagcctcaacaagcgaggagagtgaaaacgagaacccccatgccagggggtccttctcttacaagtctctgagaaagggcggaccaagccagcgcgaacaatatctgcctggcgcaattgccctcttcaatgtgaacaactcctcaaacaaggatcaggaacctgaagaaaaaaagaaaaaaaaaaaagaaaagaagtccaagtctgacgataagaacgaaaacaagaatgatcccgagaagtag

SEQ ID NO: 219577 - DNA, 300 bp, Artificial Sequence
  Description of Artificial Sequence: Synthetic coding sequence
atgaaattgtccatgaagaacaatatcattaacacccagcaatcatttgtgacaatgcctaacgtgatcgtccccgatatcgaaaaagagatacggaggatggagaatggcgcatgttcctccttttcggaggatgacgactccgcctcaacgagtgaggaaagcgagaatgagaatcctcacgcacggggatcgttcagttataagagccttaggaagggagggccatctcagcgggaacagtatcttcctggcgctatcgctctgttcaacgtgaacaactccagtaataaagattag

SEQ ID NO: 219578 - DNA, 2073 bp, Artificial Sequence
  Description of Artificial Sequence: Synthetic coding sequence
atgaaacttagcatgaagaacaacataatcaatactcaacaatctttcgtgacaatgcctaatgttatagttccggacatcgagaaagaaattcgtcggatggaaaacggggcatgttctagcttctcagaggacgatgacagcgctagcacttccgaggaatctgagaacgaaaaccctcacgccagaggtagcttttcttataaatctctgcgcaagggcggacccagccagagagaacaatacttacctggagcgatcgctctatttaacgtgaacaatagctctaataaagatcaggagcccgaagaaaaaaagaagaaaaagaaggagaagaagagcaaatctgacgataagaacgagaacaaaaatgaccccgaaaagaaaaaaaagaaaaaggacaaggagaaaaagaaaaaagaggaaaagagtaaagacaaaaaagaagaggagaagaaagaggtggtcgtgatcgacccttctggcaatacatactacaattggctgttttgcattacccttcctgtaatgtataattggaccatggtgatcgcccgagcgtgctttgatgagcttcaaagcgattatttggaatattggctcatcctggattacgttagcgatatagtgtatctgatcgacatgtttgtgaggacccgcaccggatacctggaacaaggattgttggtgaaggaagagctcaagcttattaataagtataagtctaatctgcaattcaaactggacgtgctgtccctaataccgactgacctgctgtactttaaacttggttggaattaccccgaaattcgcctcaacaggctgctgcgcttctcacgcatgttcgagttcttccaaaggaccgaaacacggactaactacccaaatatattccgtattagcaaccttgttatgtatatcgttatcatcatccactggaacgcatgtgtcttctattctattagcaaagctatcggttttggcaatgacacttgggtgtatcctgacatcaacgatccagagttcggaaggcttgcgagaaagtacgtctactccttgtactggagtactcttaccctcaccacaattggtgaaacccccccaccggtgcgagattcggagtatgtgtttgtagtggttgatttcctgatcggggtcttgattttcgcgactattgtggggaacatcgggagtatgatttccaatatgaacgccgcacgcgcagagtttcaagccaggatagatgccattaaacagtacatgcacttcaggaacgtgtctaaagacatggagaagcgtgtgatcaaatggtttgattacttgtggacaaacaagaagaccgttgacgaaaaggaagtgttaaagtacctgccagacaaattacgagccgagattgccatcaatgttcacctggatacactgaagaaagtgagaattttcgcagattgtgaagccggactcttggtagagcttgtcctcaagttacaacctcaggtctactctccaggagattacatctgtaagaaaggggacatcggcagggaaatgtacataatcaaggagggaaagctggccgttgttgctgatgatggcgtgacacagttcgtggtgctgtccgatgggtcgtattttggggaaatcagcatcttgaacattaagggctccaaggccggtaacagacgcaccgcgaatataaagagcattggttactctgatctgttttgtctatctaaagacgatctgatggaggcactgaccgaatatcccgacgcgaaaaccatgctagaggagaagggtaaacagattctgatgaaggatggcctgcttgacctgaacatcgcaaacgccggttctgatcccaaggatctggaggagaaagtcacaagaatggaaggatcagtggatctgttgcagaccagatttgcacgtatcctcgcagagtacgagagtatgcagcagaaactcaaacagcggcttaccaaggtagaaaagttcttaaagccattaatcgacaccgagtttagcagtatcgagggccctggcgctgagagtggacccattgactccacttag

SEQ ID NO: 219579 - DNA, 300 bp, Artificial Sequence
  Description of Artificial Sequence: Synthetic coding sequence
atgaagctgtcaatgaaaaacaacatcataaacacgcagcagtcctttgtaaccatgcccaacgtaattgtgcctgacattgagaaggagattaggcgtatggaaaatggggcttgttcttcattctccgaggacgatgatagcgcttctacatctgaggaatctgaaaacgagaatccccacgctagagggtctttttcttataagagcctccgcaagggtggtccatcacagcgagagcagtaccttcctggggcaatcgccctgtttaacgtcaataacagcagtaacaaggactag

SEQ ID NO: 219580 - DNA, 2073 bp, Artificial Sequence
  Description of Artificial Sequence: Synthetic coding sequence
atgaagttgtccatgaagaataatatcatcaatacccagcagtcttttgttacaatgccaaatgtgatcgtccccgacattgaaaaagagataaggaggatggagaacggcgcttgctcatcgttttcagaagatgacgactcagcctccacatcagaggagtccgaaaacgagaatccccatgcccgtggttccttttcctataagagcctacgtaaagggggaccatctcagcgggagcagtacttgcctggggctatcgctctgtttaacgtcaataattcctccaataaggaccaggaacccgaggaaaagaagaagaaaaagaaggagaaaaagtccaaatccgatgataagaatgaaaataaaaacgatccggagaagaagaagaagaagaaggataaggaaaagaagaagaaggaagagaaaagcaaggataagaaagaggaggagaagaaggaagtcgtcgtcattgacccatctggcaacacttattataactggctcttctgcataacgctgccggtgatgtacaactggacgatggtcatagcgcgagcatgtttcgatgagttgcaatccgattatctggagtattggctcatcttagactatgtgtccgacatcgtctatcttatcgacatgtttgtccgaacgcggacgggttacctggaacagggcctgctggtcaaggaggaattgaaattaatcaacaagtataagtccaacctgcagttcaagcttgatgtccttagtctgattccaaccgacctcctgtactttaagctggggtggaactaccccgagatccgtctcaaccggctgcttagattctcacggatgttcgagttttttcagcgcactgagacgcgcaccaactacccaaacattttcaggattagtaacctggttatgtatattgttatcattattcactggaacgcatgtgtcttctattccatctcaaaggcaattggattcggtaatgacacatgggtctaccccgacatcaatgaccccgaattcggaagacttgctagaaaatacgtgtatagtttatattggagtacactgactctgactacaatcggagaaaccccaccgcctgtgcgcgattccgaatacgtgttcgttgtggttgatttcctcattggagtgctgatatttgctaccattgtcggcaacattgggagcatgatatccaacatgaacgcagcacgcgctgaattccaggctagaatcgatgcgatcaagcagtatatgcacttccggaatgtaagcaaagacatggagaaacgcgtgattaaatggttcgattacttgtggacaaataaaaaaactgttgatgaaaaagaagtgctgaaatatctacccgataagcttcgggcagagatcgcaattaacgttcatctagacactctgaaaaaggtgaggatctttgcagattgtgaggcgggtctcctggtcgaactggtgcttaagttacagccgcaagtttactcgcccggtgactatatctgtaagaagggagatatcggacgcgaaatgtacataatcaaagaaggcaaactggccgtggtggccgatgatggcgtgacacaattcgtagtgttgtctgacgggagctacttcggtgagatctctatactgaacataaagggctccaaggcaggcaatcgacgcactgcaaacattaagtccataggatactcagatctgttttgtctcagcaaagatgatttgatggaggccctgactgagtatcccgatgctaagacaatgctggaggaaaagggaaaacagatcctgatgaaagacgggcttctggatttgaacattgcaaacgccggtagtgaccccaaggatctcgaagagaaggttacacgaatggagggcagcgtggacctgctgcagacaagattcgccagaatcctggccgagtacgagtccatgcagcagaagctgaaacagagactcacaaaggtcgagaagttcctgaaaccccttattgacacggagttttctagcattgagggaccgggagcagagagtggaccgatcgactcaacttag

SEQ ID NO: 219581 - DNA, 1995 bp, Artificial Sequence
  Description of Artificial Sequence: Synthetic coding sequence
atgactgagaagacgaacggcgtgaagagctcaccggcaaataatcacaatcatcacgcacctccggcaattaaggctaacgggaaggatgaccaccgtacatctagcaggccacatagtgctgccgacgacgacacatcatccgagctgcagaggctagccgacgtcgacgccccacagcagggacgctccgggtttaggagaatagtgaggcttgtggggattattcgcgagtgggccaacaaaaatttcagagaggaggagcccaggccagacagcttcctggagaggttcaggggaccagagctgcagaccgtaacaacccaggaaggagacgggaagggcgataaagatggcgaggacaagggcacaaagaaaaaatttgagctttttgtgctcgatcccgcaggagactggtactattgctggctgtttgtaattgcaatgcccgtcctgtacaactggtgtctgctcgtagcacgcgcatgtttctctgacctgcagaaggggtattacttggtatggcttgtcctggactatgtgtccgatgtggtctatattgccgacctgttcattagattgcggaccggcttcctggagcaaggtttactggtgaaggacacaaaaaaactgagagataactacattcacacactgcagttcaaactggacgtggcatcgatcatccctactgatcttatttattttgccgtagatatccacagtcccgaggtgaggttcaatcgtttgctccactttgccagaatgtttgaatttttcgacagaaccgaaaccaggaccaactaccccaatatatttcgaatttccaacctcgtgctgtacatcctggtcatcattcattggaatgcgtgcatttattacgccattagtaagagcattgggtttggcgttgacacttgggtgtaccccaacattacagaccctgagtatgggtacctcgctcgcgaatatatctactgtttgtactggtcgaccctgacgttgacaaccataggcgagactcctccccctgttaaggatgaagaatatcttttcgttatattcgacttcctgatcggagtgctgatcttcgcaaccatcgtgggtaacgtaggatcaatgatcagcaacatgaacgctacaagggcggagttccaggccaaaatagatgccgtgaagcattatatgcagtttcgtaaggtaagcaaaggtatggaggcaaaggtaattagatggtttgactacttatggacaaataagaaaaccgtggacgaaagagaaattttaaaaaaccttcccgcaaagcttcgtgctgagatcgccataaacgtgcatctgtccacattgaaaaaagtgaggatctttcacgactgcgaggccggactccttgtagaactcgtgctgaaactccgcccacaagtgttctccccaggcgactatatctgtcgcaaaggggacattggaaaggaaatgtatatcatcaaagaaggaaagctcgccgtagtggccgacgatggtgtgacacagtacgcccttctaagtgccggttcttgttttggggagatctcaatcttaaacataaagggtagcaagatgggaaatagaaggaccgccaacatcaggagcctgggctatagtgacttgttctgcctgagcaaggacgatctcatggaagccgtaaccgagtaccctgacgctaagaaggtgcttgaggagcgtggcagggagattttaatgaaagaagggctcctggacgaaaacgaagtggccacctcaatggaggtggacgtgcaagagaagctaggacagctagaaactaacatggaaacactctacacaaggtttgggagattactggctgagtatacaggtgcccagcagaagctgaaacagcgcataaccgttctggaaactaaaatgaaacagaataacgaggatgactacttaagtgatgggatgaactcacccgagttggccgcagcggacgagccctag

SEQ ID NO: 219582 - DNA, 2085 bp, Artificial Sequence
  Description of Artificial Sequence: Synthetic coding sequence
atggctaagatcaatacccagtactcacacccctcaagaactcacctgaaagtcaaaacaagcgaccgcgacctaaaccgtgcggagaatggcctatctcgcgctcacagctcaagcgaggagaccagttctgtactccagcctgggatagcaatggaaacgagggggctcgctgactcagggcaaggttcattcaccggtcaaggcatcgcaaggctcagtagactgatctttctgctgagacgttgggcagccaggcatgtgcaccatcaagatcaaggaccagactcattccctgatagattcagaggtgcagagcttaaggaagtctcaagtcaggagtccaatgcacaggcaaacgttggttcacaagagcccgctgaccgaggcagaagcgcctggcctctagccaagtgcaatactaacacgtccaacaataccgaagaagaaaagaagactaaaaagaaagacgctattgtcgtggatccctcctcgaacctgtactacagatggctgaccgccattgccttgccagttttctataactggtatctactcatttgtcgtgcttgtttcgacgagctacagtccgagtacctcatgctttggctggtcctcgattacagcgccgacgtcctctatgtgcttgacgttctcgtacgcgcacgtaccggttttctagaacaagggctgatggtcagtgataccaataggctttggcagcattataaaacaacaactcagttcaagctggatgtgctgtcgttagttcctactgatcttgcgtatttgaaagtcgggactaactacccggaggtgaggtttaaccgcctgttaaaattctccaggctgttcgagttcttcgacaggaccgagacccgaactaactacccaaacatgtttcgcattggcaacctcgttctgtatatattaatcatcatccactggaatgcctgtatttacttcgccattagcaagttcataggatttgggaccgattcatgggtttaccccaatatcagcatcccagagcatggcaggctgtctagaaaatacatctactctctgtactggtccaccctgaccctcaccactatcggagagacaccaccacccgtaaaggatgaggagtacctgtttgtcgtagtcgatttcctggtaggcgtgttgatatttgccaccattgtcggtaatgtaggcagcatgatatctaacatgaatgccagtcgggctgaatttcaagccaagatcgacagcatcaagcagtatatgcaattccgcaaggtgactaaagacctagaaacgagggtaatcaggtggttcgactacctgtgggcaaacaagaagaccgttgatgagaaagaagtactgaaatcactccctgataagctgaaggcagagattgcaataaatgtgcatctcgacacactgaagaaagtgcgaatttttcaggactgtgaggcaggcttgttggtagaactggtgttaaagttaaggccaacggtattcagccccggagattacatttgtaagaagggggatatcgggaaagagatgtatattattaacgagggcaaactagccgttgtggctgatgatggcgtgacgcagttcgtagttctttccgacggctcatacttcggtgagatcagtatcctcaacattaaagggagtaagtccggtaatcggagaacagcaaacatccgctctataggatattctgacctcttttgtctgtccaaagacgatttgatggaagcactgaccgaataccctgaagccaaaaaggcccttgaggagaagggccgacagatcttaatgaaagataacctaatcgacgaggagctagcacgtgccggtgctgatcccaaggaccttgaggagaaagtggaacaactggggtcctccttagacacactgcagaccaggttcgcgagactgttggctgagtacaatgccacacagatgaagatgaagcagcgtctgagccagctcgaaagtcaagtgaagggcggtggagacaagcccctggcggatggcgaagttcccggagacgccaccaaaactgaagataagcagcaatag

SEQ ID NO: 219583 - DNA, 2085 bp, Artificial Sequence
  Description of Artificial Sequence: Synthetic coding sequence
atggctaaaatcaatacacagtattctcatcccagcagaactcacctgaaagtcaaaacaagcgaccgggaccttaatagggccgaaaatggcctctctcgcgcacattctagttccgaggagacgagcagtgtcctgcagcccggtatcgccatggaaacccgtgggctcgcagactcaggccaggggtctttcacaggtcagggcattgctagactgtcacgactgatctttctgctgagacgatgggctgcccgacacgtgcaccaccaggatcagggtccagacagctttccagatcggtttcgcggtgccgagttaaaagaagttagctctcaagaaagcaatgcccaggccaatgtgggaagccaggagcctgctgacagggggagatccgcgtggcccttggctaagtgcaacaccaatacctccaataatacagaggaggagaaaaagacaaaaaaaaaggatgcgattgtggtggaccccagctcaaatctctactaccggtggctgaccgccattgcccttccggtattttacaactggtacctcttgatctgcagagcttgtttcgacgagctccaatcagagtatctgatgctgtggctagtcctggactactccgccgatgtgctctatgtgctcgatgtgctcgttcgagccaggacaggcttcctcgagcagggattgatggtgtcagacaccaatcgactttggcagcattataaaacaaccactcagttcaagctcgatgttctcagcttagtgccgactgacctcgcatatttaaaggtcgggaccaactatcctgaagtcagattcaaccggctgttgaaattttcaagattgtttgagttttttgaccggactgagacaaggactaattacccaaatatgtttcggattggaaatctcgttctatacattctaataattatacattggaatgcctgcatctactttgctatctcgaaatttatcggttttggcactgatagttgggtctatccaaacattagcatccccgagcatggtaggctgtcgcgcaagtatatttattcactgtactggtctactcttaccctcaccacaataggtgagaccccaccacctgtcaaggacgaggagtacctctttgtggtggtagatttcctagtcggtgtcttgattttcgccaccattgtaggcaatgtgggatccatgatttcgaatatgaatgcatccagagccgagtttcaggccaaaatcgactcgataaaacagtacatgcagttccgcaaagttacaaaagatctcgaaacccgagtgatcagatggttcgactatctttgggccaacaagaagacggttgacgaaaaagaggttctcaagagtctgcccgataaacttaaggccgagatcgctatcaacgtgcacctagatactctgaaaaaagtcagaatcttccaggattgcgaggctgggctgctggttgaactggtcttgaaactgagaccaaccgtgttctcaccgggtgactacatttgcaaaaaaggcgatatcggtaaagaaatgtatatcataaacgaggggaaactggcagtcgtagcagatgacggagtcacgcagtttgttgtgctctccgacggatcttatttcggcgagattagtatccttaatatcaaaggaagtaagtcagggaatagaaggactgctaacattcgctcaattgggtattcagatctgttttgcctcagtaaggatgatctgatggaagctcttactgaatatcccgaggctaagaaagcgctagaggagaaaggtcgacagatcttaatgaaggacaatcttatcgacgaagagctggcacgggcaggagccgatcctaaggatcttgaagagaaagtggagcagctcggcagttctctggacactcttcagactagatttgctcgcctgcttgccgagtacaatgcaacacaaatgaaaatgaagcagcgcctctcccagctggaatcccaggtaaagggcggaggcgataaacctctcgctgatggagaggtgccaggagatgcaacgaaaacagaagataaacaacaatag

SEQ ID NO: 219584 - DNA, 2031 bp, Artificial Sequence
  Description of Artificial Sequence: Synthetic coding sequence
atggccaagattaacacccagtacagccatcctagtcggacacacctcaaggttaagacatcagatcgggatctgaatcgagcagagaacgggctgtcgcgggcacatagttcctccgaagagacttcttcagttttgcaacctggaatcgcaatggagaccaggggtctggcggattccggccagggtagcttcacaggccaggggatagccagactgagccgcctgatattcctgcttcgcaggtgggctgccagacacgttcaccatcaagatcaaggaccagatagcttccctgacagattccgtggggctgaattaaaggaggtttcatcccaggaatccaacgctcaagctaatgtgggtagccaggagccagcagaccgaggacggaggaagaagacaaaaaagaaggatgccatcgtggtggaccccagctcgaatctgtattaccgatggctgacagcaatcgcactgccagtcttttataattggtatttgttaatttgtcgagcctgttttgatgaactgcaatcagagtatcttatgttgtggttggtcttagattacagtgcggatgtgctctacgttcttgacgtgctggtgagggcacggaccggttttctggaacagggactgatggtctcagataccaatcgcctttggcaacactacaagacaacgacgcagttcaagctggacgtgctgagcctggtgccaacagatctggcatatttgaaagtgggtaccaactatcccgaggtgaggttcaacagactgctgaagtttagtagattgtttgagttcttcgatagaactgaaacaaggactaactaccccaatatgttcaggattggaaatttggtgctgtatatccttataatcatccattggaacgcctgcatttactttgctatttctaagtttatcggctttggcacggacagttgggtctatcctaacatttccattccagagcatggacggttgagccgcaaatacatttactccctttactggtcgactctgaccctcacaactatcggggaaactcctccaccggtgaaagacgaggaatatctttttgttgtggttgattttctcgtcggcgtcctcatcttcgctaccatagttggtaacgtgggaagtatgatttctaacatgaacgcatctcgcgctgagtttcaagcaaaaatagattccatcaagcagtatatgcaatttcggaaggtcaccaaagatctcgaaacacgggtcattagatggtttgactatttgtgggcaaacaaaaaaaccgtggatgagaaggaggtgctgaaatctttgcccgacaaattgaaggctgagatagccattaacgtgcatctggatactctgaaaaaggtcaggatatttcaggattgtgaggctggcctgttggtggagctagtactaaagctccgcccaacggtgtttagtcccggagattacatttgcaaaaaaggagatattggtaaagagatgtacattataaacgagggaaaattagctgtcgtcgccgacgacggtgtcactcagttcgttgtgctcagtgacggctcctacttcggcgaaatttccatcctgaatatcaaggggagtaagtcaggaaatcgtcgcacagctaatatccggtcaattggctactccgatctgttctgcctctctaaggatgatcttatggaggctcttaccgagtaccccgaagcaaagaaggccctggaggagaagggtcgccagatcctgatgaaagacaacctcatcgacgaggagctggcccgtgctggcgctgaccccaaagacctggaggaaaaagtggagcagcttggtagtagtctggacaccctccagacaagattcgcccgtttactagctgaatacaatgcaacccaaatgaagatgaagcagagactgagtcaattagaatcgcaggtgaagggagggggagataagccgttggcagacggggaggttccaggggatgctacaaaaactgaggataagcaacaatag

SEQ ID NO: 219585 - DNA, 3756 bp, Artificial Sequence
  Description of Artificial Sequence: Synthetic coding sequence
atgctgggatgggtacagcgagtgttgccccagccccctggcacccctcggaagactaaaatgcaggaagaagaggaggttgagccagagccggaaatggaagccgaggtggagccagagccaaaccccgaagaagctgaaactgaaagcgaatctatgccaccagaagagagctttaaagaagaggaagtggccgtggccgacccttccccacaggaaaccaaggaggctgcgctcaccagcaccatttcactcagggcacaaggagccgaaatctccgaaatgaattctccctcaaggagagtgctgacttggctcatgaaaggggtcgagaaagtgatccctcagcctgttcactctatcactgaggatcctgctcagattttaggccacggatccaccggtgacaccggctgcactgacgagccaaatgaggctctggaagctcaggacaccaggccgggactgcggctgttgctatggctcgaacagaacttggagcgtgtcctcccacagccaccgaaatctagcgaggtatggcgcgatgagcctgctgtggcaactggggcagccagtgaccccgctccacccggacgcccacaggaaatgggtcccaaactgcaggcaagagaaactcctagtctgcccacacccattcccttacagcctaaagaggaaccaaaggaggcgccagcccctgagcctcagcccggatcccaggcccagacctccagcctgccccctaccagagacccagcacgactggtggcctgggtcttacataggcttgagatggccttacctcaacctgtgttgcatgggaagatcggggagcaggagcctgactcaccgggaatttgcgatgtacagacgatatctatcttgcccggtggacaggtggagccagaccttgtcctagaggaggtcgagcccccttgggaggacgcccaccaagatgtgtctacctcccctcaggggaccgaagtggtgcccgcatacgaggaagaaaacaaggcggtggaaaagatgcccagggagctgagtaggatagaggaagagaaagaagacgaagaggaggaggaggaggaagaagaggaggaggaggaggaagaggtaaccgaggtgctgcttgacagctgtgttgtgtctcaggtgggggtcggacagagcgaagaagatgggacccggccacagtccaccagcgatcagaagttatgggaggaagtaggtgaagaggccaaaaaagaggcagaggaaaaggccaaagaggaagccgaagaagtggccgaagaggaggcagagaaggaaccccaggactgggcagaaaccaaggaagaaccggaggctgaagctgaggctgccagttcgggcgtgcccgctactaagcaacatcccgaggttcaggtcgaggataccgatgcagacagttgcccgctaatggcagaagaaaatccacccagcaccgtactgccacctcccagccccgctaaaagcgataccctgatagtgccatcaagtgccagcggaacacacaggaagaaactgccatctgaggatgatgaagctgaagaactgaaggccctttcgcccgcagaaagccccgtcgttgcttggtccgatcccaccacacctaaagacaccgatgggcaggatcgagcggcttctacagcaagtacaaatagcgcaatcattaatgaccggctgcaagaacttgttaagttgttcaaagagaggacagaaaaggtcaaggaaaaattaattgaccctgacgtaacaagtgatgaagaatcaccaaaaccatcccctgctaagaaggcccctgaaccggctcccgatacaaaaccggcagaagctgaacctgttgaggaagaacactactgcgatatgctttgttgtaaatttaagcaccgcccatggaagaagtatcagttcccccaatctatcgaccctctgacaaacttaatgtacgttctgtggttgttcttcgtcgtcatggcttggaactggaactgttggctcattcctgtgaggtgggctttcccctaccagacgcccgataacatccaccattggctcttgatggactatttgtgcgacctgatatatttcctggacattaccgtgtttcagacgaggttgcagttcgtcagaggcggagacataattacggacaaaaaggacatgcggaataattacttgaaatctagacggtttaaaatggatttactatcccttttaccccttgactttttatacttgaaagtgggggtgaatcctctgcttcggctgcctcgctgtttgaagtacatggcattttttgaattcaattcaaggctagaatctatcctctccaaggcttacgtctacagggtgatccgcacgaccgcctaccttctgtattcccttcacctgaactcttgcctgtactactgggcaagtgcttaccaaggccttggctccactcactgggtgtatgacggcgtagggaactcttatataagatgctactactttgcagtgaagacgctcataacgattggaggactgcctgatcctaagacgctctttgaaatcgtgttccagctgcttaactattttacgggcgtcttcgctttctccgttatgatcgggcagatgcgggacgttgtgggagccgctaccgcaggtcagacctattatagaagttgtatggattctaccgttaaatatatgaacttttataaaattcctaagtctgtacagaaccgtgtaaagacctggtacgagtacacatggcacagccagggcatgctagatgagtcagaattaatggtccaactgcctgataagatgcgtctcgacctcgccattgacgtcaactataacattgtttccaaggtcgcgctgttccagggttgtgataggcagatgatatttgacatgctgaagcgattgagaagtgtggtgtacctccctaatgactacgtgtgcaaaaaaggcgagatcggacgggaaatgtatatcatccaagcaggccaggtccaggtgttagggggaccggacggtaaatctgtgctggtgacacttaaggccggaagcgtcttcggggagatatctctgctcgccgtggggggtggcaatcgcagaactgccaatgtggtggcccacggctttacaaacctgtttatactggacaagaaagatctcaatgaaattctggtgcattaccccgaatcacaaaagttgttaagaaaaaaggctcgaaggatgttgaggtccaacaataagcccaaagaagagaaatctgtcctgattctcccacctcgtgctgggactccaaaactcttcaatgctgctctagccatgacaggtaagatgggaggtaagggcgctaaagggggaaaacttgcccatcttcgggcaagattaaaggaactcgcagcccttgaagccgctgctaagcagcaggaacttgtcgagcaggccaagtccagccaggacgtcaagggagaggagggaagtgccgcacctgaccagcatacccaccccaaggaggctgccacagatccgccagctccgaggaccccacccgagcccccaggttcccctccatccagtccaccaccggcttctctggggagaccggagggagaggaagaggggcctgccgaaccggaggagcattccgtgagaatttgtatgtcccccggtcctgagcctggggagcagatactgtctgttaaaatgccagaggagcgcgaggaaaaagctgaatag

SEQ ID NO: 219586 - DNA, 900 bp, Artificial Sequence
  Description of Artificial Sequence: Synthetic coding sequence
atgctgggatgggtccaacgcgtcctgcctcagcctcctgggaccccaaggaagactaaaatgcaagaagaagaggaagtggagccagaacctgagatggaggccgaggtggaacccgagcccaacccagaagaggccgagaccgagagcgaatctatgccccctgaagagagctttaaagaggaagaagtcgcagtggccgatccttccccacaggagactaaagaagcggctctgactagcacaatttccctccgcgcacagggggctgagattagcgagatgaacagcccatccagaagggtgctgacttggctgatgaagggcgttgaaaaagtcatcccacagccggtgcacagcatcactgaagaccccgcacagattctgggtcacggctctactggggacacggggtgtacggatgaacccaacgaagcactggaggcccaggacacaaggcccggattaagattattgctgtggttggaacagaatctggagcgtgtgctgccacagcctccaaagtcctctgaggtttggagggatgagcccgcagtcgccaccggcgcagcctcagatcccgctccgccaggtcggcctcaggagatgggcccaaagctgcaggcacgcgaaactccatccttacccacccccattccgctgcagccaaaggaagaacctaaggaagcaccagcacccgagcctcagcctggttctcaagcccaaaccagcagcctgcccccaactagagatccagccaggctggtcgcctgggtcctgcatcggttggaaatggctctcccacagcctgttctccacggaaagattggagagcaggagccggacagtcctggaatttgcgatgtccaaaccagggtgatgggagctgggggtctctag

SEQ ID NO: 219587 - DNA, 2430 bp, Artificial Sequence
  Description of Artificial Sequence: Synthetic coding sequence
atgttcaagtctcttaccaaagtgaacaaagtgaagccaattggggagaacaacgagaacgagcaatctagcagacggaatgaggaaggaagccacccctcaaaccagagccagcagacaacagcccaggaggaaaacaaaggtgaggaaaagagtctgaaaactaaatcaactccagtgacctcagaggaaccgcatactaatattcaggacaagttgtccaagaaaaattccagcggcgacctgaccactaatcctgacccacagaacgcagccgagcctacaggtaccgtgcccgaacagaaagaaatggaccctggcaaggaaggacccaatagtccgcagaataagcctcctgctgcccctgtcatcaatgagtatgctgatgcccagctgcataatttggttaagcgcatgcggcagcggaccgccctctacaagaaaaaacttgtggagggggatttatcgagcccagaagctagcccacagacagctaagcccaccgccgtgccacctgtgaaggaatcagatgacaagcctacagaacattactatagacttctgtggtttaaagtgaaaaagatgcctctgacagagtatctgaagcgtatcaaactgccaaattccattgattcctacactgatcggctgtaccttctttggctgctgctggtgactctagcatacaattggaactgctgttttatcccattacggctcgtttttccctatcagaccgcggacaacatacattactggctgatcgccgatataatctgcgacataatctatttgtatgacatgttgttcattcagcctcggctccagtttgtacggggtggggacattatcgtggattccaatgaactgagaaaacattaccgcacctctaccaaattccagctggatgtcgcatctataatccccttcgacatctgctacctgttcttcggcttcaatccaatgtttcgcgcaaatcgtatgctcaagtacacatctttctttgaattcaatcatcatctcgagtcgatcatggacaaggcctatatctacagggtaataaggaccactggttatctgctctttatcctgcatattaacgcctgcgtgtactactgggcctcaaactacgaaggaattggaacgacacgatgggtgtacgacggcgaggggaacgagtacctacgatgctattactgggcagtgagaacgctgatcaccatagggggactgccagagccccagaccttgttcgagattgtattccagcttctcaactttttctcaggagtatttgtcttctcctcattgattggccagatgcgggatgttattggggcagcgaccgctaatcagaattatttcagagcatgtatggatgacacaattgcctacatgaataactattccatccctaaattagtacagaaacgggtgagaacttggtatgagtatacctgggactcccaacggatgttggatgagagcgatctgctcaagacgttaccaaccactgtgcagttagcactggcgatcgacgtcaatttctctattataagcaaagtggatctcttcaaaggatgtgatacccagatgatttatgatatgttattaagacttaagagcgtcctgtatcttcctggcgatttcgtttgcaagaagggtgagatcggtaaggagatgtacattatcaagcatggtgaagttcaggtcctaggcggacctgatggaactaaagtactagtgacactgaaggctgggagcgtttttggcgagatttcacttttggccgctggaggtggtaatcgtaggaccgccaatgtggtcgcacatggtttcgcaaatcttctgacattggacaaaaagaccttgcaggaaatcttagttcactaccctgactccgagaggattcttatgaaaaaggcccgtgttctcctcaagcagaaggccaagacagctgaggctacacctcccaggaaggatttggccttgctgtttccacctaaggaagaaacccccaagctttttaaaactcttctcggcggtaccggcaaggccagtctggcgagactgctgaagcttaaaagagaacaggctgctcagaaaaaggaaaactccgaaggcggtgaagaagaaggcaaagaaaatgaagacaaacagaaggagaatgaggataagcagaaagaaaacgaggacaaaggcaaagaaaatgaagacaaagacaagggtcgcgagccagaagagaagccattggacagaccagagtgcactgcatctccgatcgccgttgaagaagaacctcacagcgtacggcgtaccgtccttcccagagggacctccagacagtccctgatcatttctatggcaccttccgccgagggtggggaggaagtcctaactattgaagtgaaggagaaggcaaagcagtag

SEQ ID NO: 219588 - DNA, 4188 bp, Artificial Sequence
  Description of Artificial Sequence: Synthetic coding sequence
atgctgttaccactgcccccacagagctccaagccagtgcctaagaaatctcaatcgtccaaaatcgtgccatcccaccacgaccccagcgagaaaaccggcgagaactgccagaccaagatttcacccagtagcctgcaggaatccccatccagtctccaaggggcactgaagaaacggagcgcttttgaggatctgaccaacgcatctcagtgccagccagtgcaaccgaagaaggaagcaaacaaagagttcgtgaaggtagtgtctaagaagatcaaccggaatactcatgccttggggttggcgaaaaagaacaaaagaaacctaaaatggcataagttggaggttactcctgtcgtggcatccacgaccgttgtccccaatattatggagaaacccttaattctagacatcagcaccacatccaagacgccaaatacagaggaggcgtcgttgtttcgcaaacctttggtgcttaaagaggagccgacaattgaagatgaaaccctaataaataaatccctctccttgaagaaatgctctaaccatgaggaggtctctcttctcgagaagctccagccactccaggaagagagcgactccgatgatgcattcgtcatcgagccaatgacgttcaaaaagactcataagacagaagaggcagccattaccaagaagacactgagcttgaaaaagaaaatgtgcgcctcccagcgcaagcagtcttgccaggaagagagtttggctgtgcaggacgtcaatatggaggaagactctttcttcatggaaagtatgagttttaagaaaaaaccgaagactgaagagtccatcccaacccacaaactgtcttctttgaaaaagaagtgcactatttacggaaagatatgccactttaggaagcctcctgtcttgcaaaccacaatatgtggagccatgagtagtatcaaaaagcccaccaccgaaaaggaaacgctgtttcaagaactgtctgtgttgcaggagaagcataccaccgaacacgagatgagcatcctgaaaaagtccctagctctgcaaaagacaaatttcaaggaggattctctggtcaaggagtccctggcttttaagaagaaaccatctactgaagaagccatcatgatgcctgtgattttgaaggagcaatgcatgactgaaggaaaaagaagcagacttaagcccctggtgctgcaggagattaccagtggtgaaaagtcactcatcatgaaacctcttagcatcaaggagaagccttctactgagaaggagtcattctcacaggagccatccgccctgcagaagaaacacaccacccaagaggaagtgtccattctgaaggaaccctcaagcttgttgaagtccccaacagaagagtcaccgtttgacgaggcccttgcctttaccaaaaaatgcaccattgaggaggccccacccactaagaaaccattgatcctaaaacgtaagcatgccacacagggcactatgagtcacctgaagaaaccactgatcctccaaacaacaagtggtgaaaagtctctgattaaagaaccattaccctttaaggaggagaaggtcagtctgaagaagaagtgcacgacccaggagatgatgtccatatgtcctgagttgctggactttcaggacatgattggggaggacaaaaactctttctttatggaaccaatgtctttccggaagaacccaaccactgaagaaacagtcctcaccaagacaagcctctccctccaggagaagaagatcacgcagggcaagatgtcccacctgaaaaagcccctggtgctgcagaaaattacatccgaggaggagagcttctacaagaagctgctgccgttcaagatgaagtctaccaccgaagaaaaattcttgtcgcaagagccatctgccttaaaggagaaacacaccactctccaagaagtgtctctctctaaggagtcattggcgatccaagagaaggctacgacagaagaggagttctcacaagagctgttttcactgcacgtgaaacacactaataaatcggggagcttgtttcaggaggctctggtgctgcaggagaaaaccgacgccgaggaagactccctgaaaaatctcctggctctccaggaaaaatctactatggaagaggagtcactgatcaacaagttgctcgccttgaaagaggaattatccgcagaagccgcaacgaacatccagactcagcttagcctgaaaaagaagtctacctcccatggtaaagtgtttttcctaaagaaacagcttgccctgaacgagaccattaacgaagaggagttcctaaataaacaaccactggccctggagggctaccccagcattgccgagggggagacgctgttcaaaaagctgctggccatgcaggaggaaccatctatcgaaaaggaggcagttcttaaagagccgacaatcgacaccgaagctcactttaaggaacccctcgccctgcaagaggagccaagtacagagaaggaggcagtcctgaaagagccatcggtcgataccgaggctcactttaaggaaaccctcgcattgcaggaaaagccgagcatcgagcaggaggcactcttcaaacgccatagcgccctgtgggaaaaaccttctacagaaaaagagacaatttttaaggagtcactggacctgcaggagaaacccagtatcaaaaaagaaactctcctgaagaagccccttgccctgaagatgagcaccattaatgaggcagtgctatttgaggatatgatcgcactcaacgaaaagccaacaacaggcaaagagttgtccttcaaagagccccttgcgttacaggaatcgccaacctataaggaggacacctttttgaaaacactgctggtaccccaggttggcacttcgcctaacgtttccagcaccgcacccgaaagtataacctcgaaaagcagcatagccacaatgacctctgtcggtaaaagcggaacaataaacgaagcctttctctttgaagatatgataaccctcaacgagaagccgactacggggaaggagctgtcattcaaagaacccctagcccttcaggagagtccaacttgcaaggaggacacgttcctggaaaccttcctgattcctcagatcgggacctccccatatgtcttcagcactacacctgagtccataaccgagaagtcaagcatcgccacaatgacatctgtgggcaagtctcgaacaaccactgagagtagcgcctgcgaaagcgcctccgacaaaccagttagcccacaggccaagggaactcccaaagagattacccctcgggaggatattgacgaagattcttcagacccatcatttaatcccatgtacgcgaaagaaattttttcctacatgaaggaaagagaggagcagttcattctgaccgactatatgaatagacagatagaaattacatcggacatgagagccatcttggtcgattggttagtcgaggtacaggtttcttttgagatgacgcacgaaacgctctatcttgctgtcaagctcgtggatttgtacctgatgaaggccgtctgtaaaaaggacaaactgcagctactcggagccaccgctttcatgatcgctgcaaaatttgaagagcacaactcccccagagtagatgattttgtctacatctgtgacgacaactatcaaaggagcgaggttcttagcatggaaattaacatcctaaacgttctgaagtgcgacattaacatccccattgcttatcattttcttcgaagatacgctagatgcattcacacaaacatgaagaccttaacactctcacggtacatctgcgagatgacgctgcaggagtaccactatgtacaggaaaaagcttcaaaattagcagccgcatccctgcttctggctctttatatgaaaaagctgggctactgggtgccctttctggagcactacagcggctacagtatctctgaactgcatcctcttgttcgccagctgaataagcttctgactttcagctcatacgatagcttgaaggccgtttactacaaatatagccacccggtgttctttgaagtggcaaagattccagctctcgacatgctaaagcttgaagagattctgaattgcgattgcgaagctcagggcctcgtgctttag

SEQ ID NO: 219589 - DNA, 876 bp, Artificial Sequence
  Description of Artificial Sequence: Synthetic coding sequence
atgctgttgcccctgccacctcaatcttcaaagccagttcctaagaaatcgcaaagtagcaagattgtcccttcacatcatgacccatctgagaagaccggagagaattgtcagactaagatctctcccagcagtctccaggagtctccatcttctctgcagggggcactcaagaagcggagcgccttcgaggacctcactaacgtttcctttgaaatgacacatgagactctatacctcgccgtgaagttggtagatctgtacctgatgaaagccgtgtgcaaaaaggataaactccagctgctgggtgcgacagctttcatgatcgctgccaagttcgaggaacacaactctcctagagtggatgactttgtgtacatttgcgatgataactatcagcggagcgaggtgcttagtatggagatcaatatcctcaacgtgcttaagtgcgacatcaacattccaattgcataccactttctcaggaggtacgcacgctgtatccatacaaacatgaagactcttactctttctcgatacatttgcgagatgaccttgcaggaataccactatgtacaggaaaaggcctcaaaactagctgccgcttctttactgttggcgctgtatatgaaaaaactgggctattgggtcccattcttggagcactattccgggtatagcatctccgagctgcaccctttagtaaggcaactaaataaattactgaccttcagttcttatgactcacttaaagctgtatactacaagtacagtcaccctgtgtttttcgaagttgcgaagatccctgcactcgacatgctgaaacttgaggagatactcaactgcgactgcgaggcccaaggactagttctatag

SEQ ID NO: 219590 - DNA, 876 bp, Artificial Sequence
  Description of Artificial Sequence: Synthetic coding sequence
atgttgttgcccttaccccctcagagcagtaagcctgtccccaaaaaatctcaaagtagcaaaatcgtgccaagccaccacgacccctccgaaaaaacaggagaaaactgtcagactaagatcagcccttccagcttgcaggagtccccatcatcgctgcagggcgctctgaaaaaaagaagcgctttcgaggacctgacaaatgtgagtttcgagatgacccatgaaacactgtatctggcggtaaaactagtggatctatacctgatgaaagctgtttgtaagaaagataaactgcagctacttggagccacagcgttcatgatcgcagccaagttcgaggaacacaactcccctcgggtcgacgacttcgtgtacatttgtgacgataactaccagcgctctgaggtgttatctatggagataaacattctgaatgtcctgaaatgtgacataaacattcccattgcttaccatttcctgcggaggtacgccagatgcatccacacaaacatgaagacactgaccttgtcacgttatatttgtgagatgactcttcaagaataccactatgtgcaggaaaaagcatccaaactggcggcagccagcctcctgctggccctctatatgaagaaactggggtactgggtgcctttcctggagcattacagcgggtattccattagcgagctccatcctttggtgcggcaattaaataagctgttaaccttctcttcctatgattccttgaaggccgtgtattataagtatagtcatcccgtcttctttgaggtggcaaagattcctgctctggatatgctgaagctggaagagattctcaattgtgattgcgaggcccaggggctggttctgtag

SEQ ID NO: 219591 - DNA, 4188 bp, Artificial Sequence
  Description of Artificial Sequence: Synthetic coding sequence
atgctcttgccgctcccccctcagtcctcaaaacctgtgcctaagaagtcacagtctagcaagatcgtgccttcacaccacgatcctagcgagaagacaggagaaaactgtcagaccaagataagcccaagctcactgcaggaaagccccagctcactgcagggcgctttgaaaaaaaggtcggctttcgaggacctgactaacgcctcgcagtgccaaccagtccagcctaaaaaggaagccaataaggagtttgttaaggttgtcagcaagaagatcaaccgaaatactcacgccctcggcctcgccaaaaaaaacaaacggaacctcaaatggcacaaacttgaggtgacgccggtcgtggcttctaccacggtggtcccaaacattatggagaagccactcattctagatattagcactaccagcaagacaccaaatactgaggaagctagcttattcaggaagccgctcgtgctgaaggaggagcctacaattgaagatgaaactttgataaataagtcgctgagtttgaagaagtgctcaaatcacgaagaggtgtctctcttggaaaaacttcagccactccaggaggagtctgatagtgatgacgcatttgtgatcgagccaatgactttcaaaaaaacacataagactgaagaggccgcaatcacgaaaaaaactctcagcctgaaaaaaaagatgtgcgcgagtcagcggaaacagagctgccaggaagaaagcctggcagtgcaagatgtgaatatggaggaggattccttcttcatggaatcgatgagctttaagaaaaaaccgaagacagaggaatcaatcccaacccacaagctttcttcactgaaaaagaaatgcacaatatatggaaaaatctgtcactttcgtaagccccctgtgttacagactacaatttgtggagcaatgtctagcataaagaagcctaccaccgagaaagaaacacttttccaggaactttcggtgctccaagagaagcatactaccgagcacgagatgtctatcttgaaaaagagtctcgctctccagaagactaattttaaagaggactcccttgtcaaggaaagtctggctttcaagaagaagccatccacggaagaggctatcatgatgcctgtcatcttgaaagagcagtgtatgaccgagggaaagcggagccggctgaagccactggtattgcaggaaatcacttctggcgagaaaagcctgataatgaagcccctatctattaaggaaaaaccaagcaccgaaaaagaatcctttagccaggaacctagtgcactgcagaaaaaacataccacccaagaagaagtgagtatcctcaaagaaccctcctctctgctgaaatcaccaacagaggagtcacccttcgacgaagccttggcattcaccaagaaatgcacgatcgaggaagccccaccaacgaaaaaaccattaatcctgaagcggaaacacgccacacaggggactatgtcccatctcaagaaaccactgattcttcaaactactagcggcgaaaaaagcctaattaaggagccgctccctttcaaagaggagaaggtatctttgaagaagaaatgcaccacacaggagatgatgagtatctgccccgagctcctagattttcaagacatgattggagaggacaagaactccttctttatggaacccatgtctttcaggaagaatcccacaactgaagaaacagttttgactaagacttccctctcactgcaagagaagaaaatcacacagggaaaaatgagccatctgaagaaacctcttgtgctgcagaagataaccagcgaggaagaatccttctataaaaaactgttgccgtttaaaatgaaaagtacaactgaagagaaattcctgtcccaggaacccagtgccctgaaagagaaacacacaacgttgcaggaggtgtcactgagcaaggagtctctggctatccaggaaaaggccacgacagaggaagaattttctcaggagctgttcagcctgcacgtcaagcacactaacaagagtggaagcctgttccaggaagccctagtgttgcaggagaaaaccgatgcagaggaggactccctcaaaaacctgctggctttgcaggaaaagagcaccatggaagaagagtccctcatcaataagctcttggctttaaaggaagaattgagcgccgaggccgctaccaatatccagactcagctaagcctcaaaaaaaaaagtaccagtcatggtaaagtattcttcctcaagaagcagcttgcgttaaatgaaacgatcaacgaggaagaatttctgaataagcagcccctagccctcgaaggctacccttcgatcgctgagggcgagacattatttaaaaagctgttggccatgcaggaggaaccttcaatcgagaaggaggcagttctaaaggaacccactatcgatacggaagctcacttcaaggagcccctagctttacaggaagagccctcaactgagaaagaggcagtgctgaaagaaccgagtgttgataccgaagcccacttcaaagagaccttggcactccaggagaagccaagcatcgaacaggaggcgctctttaagaggcacagtgccctgtgggaaaaacctagcacggagaaggagacaatatttaaggaatcgttagatctgcaagagaaaccatctatcaagaaagagaccctgttgaaaaagccgctcgctctcaaaatgtccacgattaatgaggcggtgctctttgaggacatgatagctcttaacgagaaaccaacaacgggcaaagaactctctttcaaggaaccactggcccttcaggaaagccctacctataaggaagataccttcctcaaaacactgctcgttccacaagtgggaacctcccccaacgtgagctctaccgcccctgagtccatcacctccaagagttctattgctaccatgacaagcgttggaaagagcggaaccatcaacgaagcttttctattcgaagatatgatcacacttaacgaaaagcctacaactgggaaggagttgagtttcaaagaaccattagccttgcaagagtcgccaacgtgtaaagaggacacttttcttgagacatttcttattccacagatagggacttccccttacgtattttccaccactcctgagtcaataacagagaagtctagcatcgctaccatgacatccgtgggaaaaagccgcacgactaccgaatcatcagcctgtgagtcagctagtgacaagcccgtttcgcctcaggctaagggtactcccaaggagataactcccagggaggacattgatgaggacagtagtgatccttccttcaatccaatgtacgcaaaggagatatttagttatatgaaggagagggaggaacagttcatcttaacagattatatgaataggcagatcgagatcacaagcgacatgagagctatcctcgttgactggcttgttgaagtgcaggtgtctttcgagatgacacatgagacgttgtacctcgctgtgaagctggttgatctctatctgatgaaggccgtgtgcaagaaagataagctgcaactcctcggagccacagcctttatgattgctgcaaagttcgaagaacacaacagcccaagagttgatgatttcgtgtatatctgcgacgataattatcagaggtcagaggtgctctctatggagatcaacattttgaatgtgctcaaatgtgatattaacatcccgatagcataccactttttacggaggtacgctcgatgtatacataccaacatgaaaaccctcactctctcccgttacatctgcgagatgacgcttcaggagtatcattacgtgcaagaaaaagctagcaaattagcagccgcttctctgctgctggctctgtatatgaagaagctcggctactgggtccctttcctagagcactactctggctacagcatcagcgagttgcatcctctggtgaggcagttgaacaagctgcttacatttagctcctacgactcactgaaggctgtgtattacaaatactcacaccctgtattttttgaagtcgcaaagatcccagccttggacatgcttaaacttgaggagattctcaattgcgattgtgaggcgcagggcctggtgctgtag

SEQ ID NO: 219592 - DNA, 336 bp, Artificial Sequence
  Description of Artificial Sequence: Synthetic coding sequence
atgttactccccctccccccacagagctcaaaacctgtgcccaaaaagtctcagagctccaagatcgtgcctagccaccatgacccaagcgagaaaactggtgaaaactgccagactaagatttcaccttcgagcctgcaggagtctccctcctccctgcaaggtgctcttaagaaacgcagcgcttttgaggatcttaccaacgcaagtcagtgtcagccagtgcagccaaaaaaagaggccaataaggaatttgtcaaggtggtgtcaaaaaagattaaccgaaatacacacgcgctgggacttgccaagaagaataaacgcaaccttaagtag

SEQ ID NO: 219593 - DNA, 1083 bp, Artificial Sequence
  Description of Artificial Sequence: Synthetic coding sequence
atggctagcgcgactgcccctgctgcagcagtacccacactggctagccctctggagcagcttcgtcatttagctgaggaactccgccttctactgcctcgagtgcgcgtaggtgaggcacaagagaccaccgaggaatttaacagagagatgttttggcgtcggctaaatgaggctgcggtgactgtaagccgggaagctaccacacttaccatagtattcagtcaactcccactgccatcacctcaggagacccaaaaattctgtgaacaggtgcacgccgctatcaaagccttcatcgcggtctactacttgttgcctaaagatcagggaattaccctgaggaagcttgtccggggagccacactggatattgtggacggcatggcccagctgatggaagttctaagcgtgacgcccactcagagccccgaaaacaacgacctgatctcttacaatagtgtgtgggtggcctgtcagcagatgccccagatccccagggacaataaagcagctgctctactaatgttaacaaagaacgttgacttcgtcaaggatgcccacgaggaaatggagcaggccgtggaagaatgcgacccctacagcggcttactgaacgacaccgaggaaaacaactctgataatcacaaccatgaagacgacgttctggggttcccgtctaaccaagatctctattggagtgaagacgaccaggagctcatcataccttgccttgccttggtgcgtgcaagtaaagcttgcctgaagaagatccggatgcttgtggcagaaaatggcaagaaagaccaggtcgcacaactagatgacatcgtcgatataagcgacgagattagtccatctgtggacgacctggctcttagcatttaccccccaatgtgccacctgaccgtgagaatcaacagcgctaagctggttagtgtcctgaagaaggccctggagataactaaggcatcacatgtcactcctcaaccagaggattcgtggattccacttctgattaacgctattgaccactgtatgaaccgcattaaggagctgacacaatccgagctggaattgtag

SEQ ID NO: 219594 - DNA, 600 bp, Artificial Sequence
  Description of Artificial Sequence: Synthetic coding sequence
atgccccagatccccagggacaacaaggctgccgcactgctcatgttaaccaaaaacgtcgacttcgtgaaggacgctcatgaagaaatggagcaagccgtggaagagtgtgacccctattcgggtctgctcaatgatactgaagagaacaacagcgacaatcataaccatgaagatgacgtgcttgggttcccatccaaccaagatctttattggtctgaagatgatcaggagcttataattccttgcctcgccctggtgagggcctcaaaagcctgcctgaagaagattagaatgcttgtggccgagaatggaaaaaaggaccaggttgcacagctggatgatatcgtggatatttccgacgagatcagcccctcagttgatgatctggccctgtccatctacccacctatgtgccacctcacagtccggatcaacagcgcaaaactggtcagcgtgcttaaaaaggcactcgagatcaccaaagcgtcacatgtgaccccacaaccagaagattcttggattcctctgctgatcaatgctattgaccattgtatgaaccgcatcaaagagcttactcagagtgaattggaattgtag

SEQ ID NO: 219595 - DNA, 699 bp, Artificial Sequence
  Description of Artificial Sequence: Synthetic coding sequence
atggcccagctgatggaggttcttagtgtgacgccaacgcagagccctgagaacaatgacctaatctcctataattcagtgtgggtggcttgccaacagatgccccagattccacgcgataataaagctgcagccctgctcatgcttacaaagaacgttgactttgtgaaggacgcccacgaggagatggagcaggccgtcgaagagtgcgacccgtacagcggcctactgaacgatacagaggagaataattccgacaatcacaaccacgaggatgacgtgcttggcttcccatctaaccaagatttgtactggagtgaggatgatcaggagctgattattccctgcttggccctggtgcgggcttctaaagcctgtctgaagaaaattcgcatgctagtagccgaaaatggcaagaaagatcaagtggcacagctcgacgatattgtggatattagtgatgagatctcgcccagcgtggacgatctggcactctccatttaccccccaatgtgtcacctcacagttcggataaactctgctaaactggttagtgtgctgaagaaggctctggagatcaccaaagcctctcatgtgacgcctcagcccgaagacagttggattcccctcctcatcaacgcaatagatcactgtatgaacaggatcaaggaactcacgcagtcagaactggaactgtag

SEQ ID NO: 219596 - DNA, 3936 bp, Artificial Sequence
  Description of Artificial Sequence: Synthetic coding sequence
atgtctctgctgcagagcgcgctagacttcctagcaggaccgggttcccttggcggagcgtctggaagagatcagtccgatttcgtaggccagactgtggagctgggggaactcaggttgagagtccggagggtgctcgccgagggtggcttcgcattcgtctatgaagctcaggacgtgggtagtggaagagagtacgccctgaagcgcctgttaagcaatgaagaggagaagaacagggctataatccaagaggtatgtttcatgaaaaagttatctggacacccaaatattgtgcagttctgttcggccgcttcaattggcaaagaagagagtgatactggccaggcagagttcttactcctcactgagttgtgcaagggccagctggtagagttcctgaagaagatggaatctcgaggtcccctgtcgtgcgacacggtcctcaagatcttttatcagacctgccgggcagtccagcatatgcacagacagaagccccctatcattcaccgtgacctgaaggttgagaatctgttgctctctaatcagggaacgatcaaactgtgcgacttcggttcagcaactacaatatcccattatcccgactattcttggagcgcccagcggagagcgcttgtcgaagaagagatcactagaaataccaccccaatgtatcgaacccctgagattattgacctttattccaatttccccataggtgaaaagcaggacatatgggcactggggtgcattttatacttattatgcttccggcagcatcctttcgaagacggtgctaaattgaggatcgtcaacggtaagtattccattcctccgcatgacacccagtacaccgtgtttcactcattaatccgcgctatgctccaggtcaacccggaggagaggctctccatcgctgaagttgtgcatcaactccaggagatcgccgcagcgagaaatgtgaacccaaaatcaccaattacagagctcctggagcaaaacggcggatacggctccgccacactttctcgtggcccaccgcctccggtcggccctgctgggtcaggctacagtggaggactggcattagcagaatatgatcaaccctacggaggattcctggacatactgcggggaggaacagaacggctcttcaccaacctcaaagatacgagctctaaagttatccagagcgtagctaattacgccaaaggggatctcgacatctcctacattacttcacgaattgcggtgatgagtttcccggctgaaggagtggaaagtgccctgaagaataatattgaggatgtccgactttttctcgatagcaaacacccaggtcattatgcagtgtacaatctgagccctcggacttatcggccttctaggtttcataaccgcgtttccgagtgcgggtgggcggcacggagagcaccgcacttacacacgctatataacatttgtcggaacatgcacgcctggttgcggcaagaccataagaatgtgtgcgttgtgcactgtatggatggtagggctgcctccgcagtggctgtctgttctttcctctgcttctgtcgtctgttcagtacagctgaggccgctgtgtacatgttttcgatgaagcgctgtccccctggcatctggccgtcccataagaggtatatcgaatacatgtgcgacatggttgcagaagagcctatcacgccccactccaagcccatcttggtgcgtgcggtcgtgatgacgcccgtgcccctcttttccaaacagcggtcgggctgtcgccctttttgcgaagtttacgtgggtgacgagcgggtggccagcacctcacaagaatacgataagatgcgggacttcaaaatagaggatggcaaggcggtgatacccctgggcgtgaccgtccaaggggatgtgctcatagtgatttatcatgccaggagcacattagggggacgactacaggccaagatggctagtatgaagatgtttcagatacagtttcataccggcttcgtccctcgcaacgctaccaccgtgaagtttgcaaagtacgaccttgacgcatgcgatatacaggaaaagtaccctgaccttttccaggtgaacctggaagtggaggtggaacctcgagacagaccaagcagagaggcaccaccatgggagaatagctcaatgcggggacttaaccccaaaatcctgttcagcagccgggaggaacagcaggatatattgagcaaatttggcaagcccgagttacctcgacagcctggctctactgctcaatatgatgctggcgctggctcacctgaagccgagcccacagacagtgactctcccccatcctcgtccgctgacgctagtaggttcctgcatacactggactggcaagaagagaaggaggccgaaacaggcgctgagaatgcctccagtaaagagtctgaaagtgccctcatggaggaccgagacgagagtgaggtgagcgacgaaggtggaagccctatctcaagcgaaggccaagaacccagggcagatcccgagcccccaggattggccgctggcctcgtacagcaagatctggtttttgaggtggagacacccgctgttttgccagaacctgtgccccaggaagatggcgtggatctgttgggtctccactccgaggtcggggctgggccagctgtccctcctcaggcttgtaaagctccatcttcaaacactgatcttctgtcatgtctgctcggccctcccgaggccgcatctcagggacccccagaggatctgctctccgaagatcccctgctgctggcgtcaccagcacccccactgtccgttcagagcacccccaggggagggccaccagccgctgccgaccccttcggccctctgctaccaagcagtggcaataactcccaaccctgctccaatcccgatctgtttggtgaatttctgaatagcgattccgtgaccgtacctccatcattcccttcagcacactctgcacccccaccatcttgtagtgctgattttctgcatcttggggacctgcccggtgagccttcaaagatgacagcaagttccagcaatccagatcttctcggaggatgggctgcttggactgaaaccgctgcttcagcagtagctccaacccccgcaacagagggacctttattctcccccggagggcaacctgctccctgcggctctcaggcctcttggacgaaatctcagaatccagatccttttgcggatctaggagacctcagctccggactccagggatctccagccggatttccgccaggcggattcatacccaagaccgccacaacccctaaggggtcctcatcctggcagacctcacgccctcctgcccagggtgccagttggccacctcaagctaagccacccccaaaggcttgtactcaacctaggccaaactacgcttcaaacttttcggtgatcggagccagagaagaaagaggcgtccgcgctccatcgtttgcacagaaaccaaaggtgtccgaaaacgacttcgaggatctgcttagcaaccaaggtttttcctcaagatccgacaagaaaggccctaaaacaattgcagagatgcgaaaacaggatttggccaaagacactgaccctttaaaactgaagttgctcgactggatagaagggaaggagcgaaatatacgtgcactcctgagcacacttcacactgtactttgggacggagagagccggtggactcctgtcgggatggccgatctggtggccccagagcaggtgaaaaagcattacaggagggcagtactggccgtccatcccgataaggccgctggtcagccctacgagcagcacgcaaagatgatatttatggaattgaacgatgcctggtcagagttcgaaaaccaaggctccaggccgcttttttag

SEQ ID NO: 219597 - DNA, 1764 bp, Artificial Sequence
  Description of Artificial Sequence: Synthetic coding sequence
atgtcactgctgcagtctgcgttggactttctggctgggccaggctccctaggtggggcatcagggagagaccagtccgactttgtcggccaaacagtggagctgggtgagcttcgactgagagtcagacgggttttggccgaaggcggattcgcattcgtctacgaggcacaagacgtcggcagtgggcgagagtacgcactcaagcggctcctgagtaatgaggaagagaagaatcgcgcaattattcaggaggtgtgctttatgaaaaaactgagtggccacccgaacattgttcagttctgctccgcagcctctatcgggaaggaggagagcgacacgggccaagccgaattcttgctcctcacagagccaccagggcttgccgcaggtctggtccagcaagacctggtatttgaggtggaaacccctgcagtgcttccagaacccgtgccccaggaagacggggtggacctcttagggcttcacagcgaagtgggcgcagggcctgcggtcccaccccaggcctgtaaggcccctagttccaacacagacctcctgtcctgccttctcgggccacctgaggctgcttcgcagggtccacccgaagacctactctctgaggaccctctattactcgcatcccccgcaccccctcttagcgtccagagcacccccagaggcggtccaccagccgctgcagatccattcggccctctgctgccatcctctggaaacaattcccagccttgctcaaaccccgacctctttggggagttcctgaactccgactcggtgactgttcctccgagcttcccatccgcacactcggctcctccgccttcctgctccgcggacttcctccatctgggagatctgccaggggagccttccaagatgactgcatccagctcaaatcctgacctcttaggaggatgggccgcatggaccgagaccgctgcttccgcggtggcgccaactccagcaacggaagggccacttttttcccctggcggacaaccagccccttgtgggtctcaggcatcatggacaaaatcacaaaatccggatccctttgctgacctcggcgacctgagctctgggctgcaggggtcccctgcgggttttcctcccggtggttttatacccaagaccgccactaccccaaagggcagctcctcatggcaaaccagtaggcccccagcccaaggagcatcctggcccccacaggccaaaccacctccaaaagcgtgcacccagccaagacctaactatgccagcaatttctctgtgattggggcacgtgaagagcgtggagtacgcgcaccatctttcgcacagaaacctaaggtctcagagaacgattttgaggacctcctgagcaaccagggcttctctagtcggtctgataaaaagggacccaagacaatcgccgaaatgagaaagcaggatttagctaaagacactgacccacttaaactgaaactgctcgattggatcgaaggaaaggagaggaacattagggcgttactttctacgcttcacacagtactctgggatggcgagtctagatggacccccgtcggtatggcagatctcgttgcaccagagcaggttaaaaagcactatcggcgagctgtgctggctgtgcacccagacaaggccgctggtcaaccttatgagcaacacgccaaaatgatcttcatggaactgaatgatgcttggtctgagtttgagaaccagggctctagacccttattttag

SEQ ID NO: 219598 - DNA, 2238 bp, Artificial Sequence
  Description of Artificial Sequence: Synthetic coding sequence
atgcccttcccggtgactacccaaggttctcagcagacccagccaccccagaaacattacggcatcactagtccaatatccctcgctgccccaaaagagacggactgtgtcctcacacagaagctcattgaaacccttaaacctttcggagtctttgaggaggaagaggagctgcagagacgcatcctcattctgggtaaactgaataatctggtgaaagagtggattcgggaaatctctgagtcaaaaaacctgccacagtcagtcatcgaaaatgtcggtggtaaaattttcacctttggttcttacaggctcggagtgcatacgaagggtgcggatattgacgcgctgtgcgtggcacctagacatgtggatcgcagtgacttctttacctctttctatgacaaacttaagctgcaggaagaggttaaggacctgagggcggtggaagaggcctttgtccccgtcattaagctctgcttcgacggtattgagattgatatattgttcgcaagattggccctgcagacgatacccgaggacctggatctgcgcgatgatagcttgctcaaaaaccttgatataaggtgcatcaggtcactgaatggctgccgggtgacagatgaaatactccacttggttcccaacatcgataactttcgtctgacactgcgggctattaaattatgggcaaagcgccacaatatttatagtaacattcttggattcctgggaggtgtgagctgggccatgctggtcgccagaacctgccagttgtaccccaatgcaatcgcgtccactctcgtccacaagttctttctcgtatttagtaagtgggagtggcctaatccagtactgctgaaacagcctgaggaatgcaacctgaatctcccggtctgggatcccagggtcaatcccagcgaccggtaccatctgatgccaattattacacctgcctaccctcagcagaattccacttacaacgtgtctgtctccactaggatggtgatggtggaagagtttaaacagggtttagccatcacagatgaaatactcttaagcaaagcggagtggtccaaactcttcgaagctcctaactttttccagaagtacaaacactacatcgtgttgctcgccagcgcgccaaccgagaagcagaggcttgagtgggtgggcctcgtagagtccaagatccgtatcctggtcggaagcctggaaaagaacgagttcatcacactagcccatgttaaccctcagtccttccccgctcccaaggaaaaccccgacaaggaggagtttaggaccatgtgggttatcggtttggtttttaaaaaaaccgaaaactcagagaacttgtctgtcgatctgacctatgatattcagagctttaccgacactgtgtaccgccaggccatcaactcaaagatgttcgaagtggacatgaaaattgccgcaatgcacgtcaagcgaaaacagctccatcaactgctgcctaatcatgtgctccaaaagaaaaagaagcattccactgaaggagtgaaattaacggctctgaatgattcttcattggacttgtccatggatagtgataatagcatgtctgtgccttcgcctacatccgccacaaagactagccctttgaatagctctgggtcaagccaggggagaaactcacctgcccctgcggttactgccgcaagcgtcaccaatatccaggccactgaagtctcagtgcctcaggtcaatagctccgaatcctctggaggcactagtagtgagagtatacctcaaacagctacgcagcctgctatttctcctccgcctaagcctactgtttcgcgagtcgtgtctagtacgaggctcgtgaatcccccaccccgttcctctggaaatgccgctaccagtggcaacgctgcgaccaagatcccaactcctatcgtgggagtcaaacggacaagtagtccgcataaggaggagagtcccaagaaaacaaagaccgaggaggatgagaccagcgaggacgccaactgtcttgctttaagcggtcatgacaaaactgaagcaaaggaacagctggacaccgagacatccacgacccagagcgagaccattcagacagctgcgtcactcctcgcctcccagaagacatcaagcaccgatcttagcgatattccggcactgcccgcaaatcctatccccgtcattaagaactcaattaagctccgcctcaacaggtag

SEQ ID NO: 219599 - DNA, 1080 bp, Artificial Sequence
  Description of Artificial Sequence: Synthetic coding sequence
atgaaagaaaataaagagaacagctctccatcggtgactagcgcaaatctggatcacacaaaaccctgttggtactgggacaaaaaagacttagctcacacccctagccagctggaaggattggaccctgctaccgaggctagatataggcgggaaggggcacggttcatattcgatgtggggacgaggctggggttacactatgacacactggcaaccggaattatttactttcaccgtttctatatgttccactcattcaaacagttcccgcgttatgtcaccggggcttgctgtttgtttttagccggaaaggtcgaagaaactcccaagaaatgcaaagatatcattaagactgcaagatccctgctgaacgacgtgcagttcggacagtttggagatgatccaaaagaagaagtgatggtcttggaaagaattctgctgcaaaccattaagttcgacttgcaggtagagcacccctatcagtttttgctcaagtacgcaaaacagcttaagggcgacaagaataagatccagaagctggtgcagatggcctggactttcgtcaatgaccgtaccagtttgtgcaccacactgtctcttcagtgggagcccgagatcatcgcagtggccgtgatgtacctcgcgggacgcctgtgcaaattcgaaattcaagagtggactagcaagcctatgtacagacgatggtgggagcaattcgtgcaggacgttcccgtggacgtgctggaagacatctgtcaccagatcctcgacctgtactcacaagggaaacagcagatgccccaccataccccccaccagctgcagcagcccccaagcctccaaccaacgccccaagtgccacaagtccagcagtcccaaccatcccaaagtagcgaacctagccagcctcagcaaaaagatccacagcaaccagcccagcagcaacagccggcacagcagcccaaaaagcctagccctcagcctagtagtccaagacaggtgaagcgggcagttgttgtgagtccaaaagaggagaacaaagcagccggaaaagccagtttgaaacatacttggtag

SEQ ID NO: 219600 - DNA, 1743 bp, Artificial Sequence
  Description of Artificial Sequence: Synthetic coding sequence
atgaaagagaataaggaaaattcaagtcccagtgtcacctccgcaaacctcgatcatacaaaaccctgctggtactgggataaaaaagacctagcccacacaccttctcagctcgagggacttgaccctgcaaccgaggccaggtatcgcagggagggcgcaagatttatctttgacgtgggcactagactggggctgcattacgacaccctggcaaccggtataatttattttcaccgattctacatgttccactcatttaagcaattcccgagatacgtgaccggggcttgctgcctgttcctggccggaaaggttgaggagacgccgaaaaagtgcaaggacataattaaaaccgctagaagcctcttgaacgacgttcagtttggacaatttggagacgacccaaaagaggaggtgatggtactggagcgaatcctccttcagacgatcaaattcgatttgcaggtcgaacatccctaccagttcctgctgaaatacgcgaagcaactgaagggtgataagaacaagatccaaaagttggtccagatggcttggacctttgtgaacgactccttgtgtacaaccctgtctttgcagtgggagccagagatcattgctgttgctgtcatgtatctagccggtcggctctgcaaatttgagattcaggagtggacctctaaacccatgtaccgacggtggtgggagcagtttgtccaggacgtgcccgtagatgtgctggaagatatctgccatcagatattggatctgtacagtcagggcaaacagcaaatgccacatcatacccctcatcagctgcagcagccacccagtcttcaacccacaccccaagttccacaggttcagcagtcacagcccagtcagagttcagaaccctcacagccgcaacagaaggatccccagcaaccagcacagcagcagcagcctgcacagcaaccaaagaaaccctctccccaaccttcgagtccaagacaggtgaaacgcgcagtggtagtgtcaccgaaggaggagaacaaagctgcagaaccacctccacccaaaattcctaagattgagactacccatcccccactgccacccgctcaccccccacctgatcggaagcctccccttgcggctgcccttggcgaggccgaacctcccggtccagtggatgcaacagatttgccaaaggttcagattccgcctcccgcacatcctgcccctgttcatcagcctccaccattgcctcatcgtccaccccctcctccccctagctcctatatgacagggatgtccacaacctcctcctatatgtcaggggaaggctatcagtctttacagagtatgatgaagacagaaggcccaagttatggtgccttgcccccagcctatggccctcctgcacacctgccctaccatccacacgtataccctcctaatcccccaccgcctcctgtgccccctccccctgcttcctttccacccccagctatccctcctcccacccctggataccccccaccccctccaacatacaatcccaatttcccccctccgcctccccgactcccccctacccatgcagttccaccccacccgccaccgggacttggactcccacccgcatcctaccccccacccgctgtgccacccggaggccagcctcctgtgcctcccccaatcccaccgccagggatgcccccagtgggtgggctgggcagggctgcctggatgcgctag

SEQ ID NO: 219601 - DNA, 1803 bp, Artificial Sequence
  Description of Artificial Sequence: Synthetic coding sequence
atgaaagagaataaagagaatagttctccctcggtgactagcgccaaccttgaccacacaaaaccatgttggtattgggacaaaaaagacctagcacatacacccagccagctcgagggtctcgaccctgccacagaagcgaggtacagacgagagggggcaaggttcatctttgacgtcggcactcggcttggactgcactacgacacactggcgaccggcatcatatattttcaccgcttctacatgtttcacagttttaagcaattccctcggtacgtaactggagcctgttgtttgtttctggccggaaaagtagaggagaccccgaagaagtgcaaagatatcatcaaaaccgcgagatctctcttgaacgacgtgcagttcggacagtttggggatgaccccaaggaggaggtgatggtgcttgagcgcattctcctacagactatcaagttcgatctgcaggttgaacatccttaccagtttttgctgaagtatgccaaacagcttaagggggacaaaaacaaaatccaaaagctggtgcaaatggcttggacatttgttaacgactccctgtgcaccacgctgtctctccagtgggagcctgaaataattgcggtggccgttatgtatctggccggaagactgtgcaaattcgagatccaggagtggacctcaaagccaatgtataggaggtggtgggagcagttcgttcaggatgtcccagttgatgtgttggaggacatttgtcatcagattcttgacttgtatagtcaaggaaagcaacagatgccgcaccacacaccccatcaactgcagcagccgccatctttgcagcctaccccccaagtcccccaagtgcaacagtctcagccttcgcagtccagtgagccatcacagccccagcagaaggacccacaacagcccgctcagcagcagcagcctgcccagcagcctaaaaaacctagcccgcagccgtcaagtccacgacaggtgaagcgcgcagtcgtgtctgggctaaaacaggcactgggacgtgctggctttcctggtggtggcaacactacagtggtctcccccaaggaggagaataaggccgcagagcctccgcctccaaaaatccctaagatcgagactacgcatcctccactgccccctgcccatccccctccagaccgcaagcctccactggccgctgctctgggagaagctgaaccacccggaccagtcgatgctacggatctaccaaaagttcagatccctccacctgcccatcctgctccagtgcatcaacctccaccccttccacaccggcctccacctccaccaccaagctcctatatgaccggaatgtctaccactagttcctacatgtcaggtgaagggtaccagagtctccaaagcatgatgaaaacagagggtccatcctacggcgcactgccacccgcatatggccctcctgcgcaccttccatatcaccctcatgtgtaccccccaaatccacctccccctcctgtgcctccaccccctgcgtcttttcctccccctgcaattccccctcccaccccaggctaccctccgccaccccctacctacaaccccaattttccgccaccacccccaagattgcctcccacgcacgcggtacccccacaccctccacccggactggggctccccccagcctcctaccctccacccgcagtccctccgggaggtcagccgccagtgcctccaccaataccccctccaggcatgcccccagtggggggtttaggaagagcagcctggatgcgctag

SEQ ID NO: 219602 - DNA, 333 bp, Artificial Sequence
  Description of Artificial Sequence: Synthetic coding sequence
atgaaggagaataaggaaaacagctcaccttcggttaccagtgccaaccttgaccacacaaagccttgctggtactgggacaagaaagatctcgcacacacgccaagccaactggaaggcctggatcctgccaccgaagcaaggtaccggagggaaggggctcgtttcatttttgacgtcgggactcgattagggctgcattatgacacactggcgactggcatcatttacttccacagattctatatgttccattcctttaaacagttccccaggtatgtaactggagcctgttgtctattcctggcaggtaaggttgaggaaaccccctag

SEQ ID NO: 219603 - DNA, 684 bp, Artificial Sequence
  Description of Artificial Sequence: Synthetic coding sequence
atgaaggaaaacaaggaaaatagctccccatccgtgacaagtgcaaatttagatcacacaaagccgtgttggtactgggataagaaagatctggcccacacgccctctcagctggagggactggaccccgcaactgaggcacgttatagacgcgaaggagctcggttcattttcgatgtgggcactcgccttggactccactacgacaccttggcgactggtatcatctacttccacagattctatatgttccactctttcaagcagtttccgagatacgtcacaggagcttgctgcttatttctggccggtaaggtagaagagactccgaaaaaatgcaaggacattattaagacagccagaagcttactcaatgatgttcaattcggccagttcggggatgaccccaaggaagaggtaatggtcttggagcgaatcctcctgcagacaatcaagttcgacctgcaggtggagcacccataccagtttcttctaaaatatgcaaagcaactgaaaggtgataagaataagatccagaaactggtccagatggcctggacttttgtgaacgattcattgtgtactaccctgtccctgcagtgggagccggaaataatcgcagtggcagtcatgtatcttgcaggcaggctctgcaagtttgagatccaggaatggacctcctag

SEQ ID NO: 219604 - DNA, 519 bp, Artificial Sequence
  Description of Artificial Sequence: Synthetic coding sequence
atggccagcggtcctcactctacagccactgcagccgctgctgcgagcagcgctgccccttctgcgggaggcagtagcagcggaacaacaacaactaccactactaccactgggggtatactgatcggagacagactatactccgaggtctctctcactattgaccacagccttattcccgaggaaagattgtctccaaccccctcaatgcaggatggattggatctgcctagcgaaacagatctccgcattctgggatgtgagctgatacaagcagccggaattctgctacgtctgccccaggtggccatggccacaggccaggtactttttcacagatttttctattccaaaagcttcgtgaaacactcttttgaaatcgttgcaatggcttgtattaacctggcatccaaaatcgaagaagcaccgcgtagaataagggacgtgattaatgttttccatcacctgcgccagctcaggggcaaaagtgaccaactgcatctgcctaaacctgggtag

SEQ ID NO: 219605 - DNA, 1581 bp, Artificial Sequence
  Description of Artificial Sequence: Synthetic coding sequence
atggccagtggccctcattccaccgcgactgctgctgccgctgcttcttcagctgcacctagcgctggtggctcctcaagcggtactactaccaccaccacgaccaccacgggcggaatcttaatcggtgatcggctgtattccgaggtgtctttaacaattgaccacagcttaattccagaagaaaggctgtcacctactccctcaatgcaggacggcctggatttaccatcggagactgacctcagaatattgggctgcgagctgatacaggctgcaggcattctgcttcgccttccgcaggtggccatggcaaccggccaggtgcttttccataggtttttttactcgaaaagttttgtgaaacacagcttcgaaatagtggcgatggcttgcataaatctcgcctcaaagatcgaggaagcaccaagacgaattcgagacgtaatcaacgtgttccatcatctccgtcagctgcggggaaagcgtactccttccccattgatactcgaccaaaattatataaatacaaagaaccaggtgataaaagccgagcgacgggtgctcaaagagctggggttctgtgtccatgttaaacacccccacaagattatcgttatgtacctgcaagttctggaatgcgaacgcaatcagacactcgttcagacagcttggaattacatgaatgattccctgagaaccaatgtgttcgtgcgcttccaaccggagaccattgcatgtgcttgcatctacctagcagcccgtgccttgcaaatccccctgcccacaaggccccactggttcctactgtttgggactactgaggaggaaattcaagagatttgtatcgagacactgaggctctacacccgcaaaaagcccaactatgagctcctggaaaaggaggtggaaaaaaggaaggtggcattgcaggaggccaagctcaaagccaaaggccttaaccctgatggcacaccagctctttccacactgggtggattcagccccgcttcgaagccttcttcgcctcgcgaggtcaaagctgaggaaaaatcccccatttcaattaatgtgaagaccgtaaaaaaagaacccgaggatcggcaacaggcctctaaatcaccgtacaatggggtgcgcaaggattcaaaacgcagtaggaactcccgctccgccagccgatccaggtcccggaccaggagccgctctcggtcccacactccacggcgacattacaacaacagaaggtcacggtccggcacctattcatccagatcacgcagtcggagtcgaagtcactcagagtcacctcgcaggcaccacaaccacggctctccccatctgaaggcaaaacatacccgggatgaccttaagagttcgaataggcatggacataaacggaagaaatctagatccagaagtcagagtaagtcccgcgatcactctgatgccgcaaaaaagcacagacatgaacgcggtcaccatcgggatcgacgggaacgaagccgctcttttgaacggtcccacaagagtaagcaccacggcggttcacgcagcggtcacggcaggcataggcggtag

SEQ ID NO: 219606 - DNA, 1563 bp, Artificial Sequence
  Description of Artificial Sequence: Synthetic coding sequence
atggcggcagcggcagccgctgcaggcgctgccggttcagcagctcccgctgctgcggctggcgcaccaggatccgggggagccccatccgggagccagggcgtgttgatcggagacagactttactctggcgtcctgattacactggagaattgtcttctacctgatgataaattgcgcttcacccccagcatgtcttctgggcttgacacagacaccgagacagatctgagagtggtgggctgcgagttgatacaggctgccggtattctcctgagattgcctcaagtggcaatggcaaccggtcaggtgctgtttcagcggtttttttacaccaaatctttcgtgaagcattccatggaacatgtttccatggcctgtgttcacttggcgagcaaaatagaggaggctcctcgaaggatccgcgatgtgattaacgtgtttcacaggctaagacagctacgggacaaaaaaaaacccgtacctctgcttctggaccaagactacgtaaacctcaaaaatcagataatcaaagctgagaggagggttctgaaagagctgggattctgcgttcacgttaaacacccacataagatcatcgtcatgtacttgcaggtcttggagtgtgaaagaaaccagcacttagtgcagacctcgtggaactatatgaatgattcccttcgcaccgacgtttttgtgcggttccagcctgagtccatagcctgcgcctgcatttacctggctgcaaggacactggagatccctctacccaatcgacctcactggttcctgctattcggggcaacagaggaagaaatacaagagatttgtctcaaaatactgcagctctacgctagaaaaaaagtggatctgacgcacttggagggggaggtggaaaaacgcaaacatgccatcgaagaagccaaggcccaggctagggggctcctgcccggagggacacaggtattggacggaacatctggctttagtccagccccaaagcttgtggaaagtccaaaggaagggaagggatccaaaccaagccctctgtctgtcaaaaacaccaaacgtaggctggaaggagctaaaaaagcaaaagctgactcaccagtgaacggactcccaaagggcagagaatcaagatctaggtccaggtcccgggaacagagctacagcagatcaccaagcaggagcgccagtcccaagaggagaaagtcagatagcgggtcgacctctggagggagtaagagccaaagccgatcgcggtccagaagtgacagcccaccaaggcaggcgccaaggagcgcaccgtataagggatcagaaattcgcggttcccggaaaagcaaggactgtaagtatccacagaagccacataaatcccgatctcgatcgtcaagtcggagccgctcacggagccgggagagggcggataatccaggcaagtataagaagaaaagtcactattacagggaccaacgcagagagcgcagcaggtcatacgaacgcacgggcagacggtacgagcgcgatcatcctggtcactcaaggcaccgcagatag

SEQ ID NO: 219607 - DNA, 681 bp, Artificial Sequence
  Description of Artificial Sequence: Synthetic coding sequence
atggccgcagccgctgctgcagccggagccgcaggcagcgccgcacctgctgccgctgccggagccccaggctctggcggtgcgccaagcggtagtcagggcgtcctgatcggcgacagactctactctggcgtgcttatcaccctggagaattgcttgctgcctgacgataagttgcgctttactccgagcatgtcttccggattggacactgacactgagacagacctacgcgtggtcggctgtgaactgatccaggctgcaggaatcctgctccgcttaccacaggtggccatggccactggccaggttctgttccagaggtttttctacactaagagttttgtgaagcactccatggagcacgtgtctatggcatgcgttcatcttgccagtaagattgaggaggcccctcggaggatacgagacgtaatcaacgtttttcaccgtttacggcagttgcgggacaagaaaaaaccagtcccattactgcttgatcaagattatgtaaaccttaagaaccagatcatcaaggcagagaggagggttctgaaagaattaggcttttgtgtacatgtgaagcatccccacaaaattattgtgatgtaccttcaggttttggagtgcgaaaggaaccagcatctggtccaaaccagctgggtcgcgagtgagggcaagtag

SEQ ID NO: 219608 - DNA, 1044 bp, Artificial Sequence
  Description of Artificial Sequence: Synthetic coding sequence
atgaacgacagccttcgcacagatgtgttcgtgaggttccaacccgagagtattgcctgtgcgtgtatctacttggccgctcgcaccttggaaatccccctaccaaaccgacctcattggtttctactcttcggcgctaccgaagaggagatccaggaaatctgtctgaagatcctccagctgtacgccaggaaaaaagtcgatctgacccaccttgagggcgaggtggaaaagaggaaacacgccatcgaagaggggccttctccgggaccagttgcttgggggcataccggagcaggatggtacctgggtgtgctgtcgtgccctcaggctggctgttgggactactcccttgagtgttcgggtgcaatatgggatcattgcaagctcaggctgccagactcaggtgatagttgtgcctccgcatcacaagtggcaggaattgccggtgcccatcaccatgcgcagagccttgctgtccttcccgtggaatcacctaaggaaggcaaaggttccaaaccaagcccgctgtccgtgaaaaacacaaaacgcagacttgaaggagctaagaaggcaaaggctgatagccccgtcaacggtcttccaaaaggacgggagtccagatccaggagtcggagtagagaacaatcttacagtagatctccctccagatccgctagccccaagaggagaaaatcggactctggaagcacttcaggaggctccaagtcacaatctaggagccgtagtagatccgactctcccccacgacaggccccacgttccgccccatacaaaggatcagaaattaggggctcaaggaagtcaaaggactgcaagtacccccaaaagcctcacaagtctcgctctaggtcttccagtcgcagcagaagcagatcacgggagagagctgacaatcccggaaagtataagaagaagtcccactattatcgggaccagcggagggagcgatctagatcatacgagcgcaccgggaggcgttacgagcgggaccacccaggtcattcgcgccatcggagatag

SEQ ID NO: 219609 - DNA, 2856 bp, Artificial Sequence
  Description of Artificial Sequence: Synthetic coding sequence
atggccgctgctgctgctgccgcagctgccgtcggggtccgcctccgggattgctgctctcgcggagccgttctactcctgttttttagcctgagccctagacctcctgcagccgctgcatggctactgggcctcagacctgaagacaccgcagggggaagagtgtctctggaagggggaacacttagagccgcagaaggtaccagtttcctgctacgcgtctatttccagcccggacctcccgctaccgccgcacctgttcccagccctacactgaatagtggcgaaaatggtacaggagactgggcgcctagactggtcttcatcgaagagcctcctgggggaggaggtgtggcgccaagcgccgtgccaactaggcctcctggcccacaacggtgcagagagcagagtgactgggcgtctgacgtagaagtgttaggaccgctgaggcccggaggagtggccggaagcgcactggtccaagtgagagttcgggagctccggaagggcgaggctgagcggggaggggctggcggaggcggaaagctcttcagcttgtgtgcatgggacggacgagcctggcatcaccacggagccgcagggggatttttacttcgagtcagacccaggctgtacggcccaggcggtgacctgcttcctccggcttggctccgggcattgggagccttgctcctgctcgcactaagtgcgctgttctccggcctgcgcctgtcactgttgtctctggatcccgtggagctgcgggtgctgagaaacagcggatccgccgctgagcaggagcaggccagaagagttcaagccgtaagggggcgaggaacacacttactctgcactcttttacttggacaagccggtgctaacgcagctctggctgggtggttatatacttctctgccccctggctttggcggaacaggcgaggattactcagaggaggggatccattttccttggctccccgctttggtctgcactggagccgtgtttttgggagccgagatatgcccgtattctgtttgctctaggcacgggctcgcaatagccagtcatagtgtttgcctgacccgtctcttgatggccgctgcatttcccgtgtgttacccactaggaagactgctggattgggccctccgacaggaaatctcaactttctatacccgggagaaactcttagaaactctgcgagcagccgatccctattcggacctcgtgaaggaggagttgaatattattcagggtgcccttgagctccgcaccaaggtggttgaagaggtgcttacccctctgggcgactgtttcatgctgcgatctgacgccgttctggattttgccactgtaagcgaaatcctccggtccgggtatacccgaatcccggtgtacgagggcgaccagaggcacaacattgtagacatattgtttgtcaaggacttagcctttgtggaccctgacgattgcactccactactgaccgtaaccagattctataacaggcccttacattgtgttttcaatgataccagacttgacacagtgctagaagaattcaagaagggcaagtctcacctggctattgttcagagggtgaataatgagggggagggtgacccattctatgaggtgatgggcatcgtgacgttggaggatatcatcgaagagattattaagtcagaaattctggacgaaactgacttgtacaccgataatagaaaaaagcaacgggtgccccagagagaaagaaagaggcacgactttagccttttcaaactttcagacacggagatgcgcgttaagataagcccacaattactgcttgccacgcaccggttcatggcaacagaagtggagccatttaagagcctgtacttatcagaaaagatcctgctcagactcttaaagcatcctaacgtgatccaggagctcaagtttgacgagaaaaataagaaggctcccgaacattatttataccagcggaatagaccggtggattattttgtactgcttcttcaaggtaaggtggaggtcgaggtgggaaaggagggcctgagattcgagaacggtgcctttacatattatggggtgcccgctattatgaccactgcttgctcagacaacgatgtgcggaaggtcggatcattagcaggatcatcagtatttcttaaccgctcccccagcagatgctcaggcctgaataggagcgagtctccgaaccgggagcggagcgacttcggcggaagcaacactcagctctatagcagctcaaataacttgtatatgccagactactcggtgcatatcctcagtgatgtccagtttgttaaaattacacgccagcagtaccagaacgctcttaccgcctgtcacatggacagctccccccagagtccagatatggaggcgtttaccgatggcgattctacaaaagccccaacaacccgcggtactccacagacacccaaagatgatcccgctataaccctattgaacaatcgcaattcacttccatgctcaagatccgatggcttgcggagcccttctgaggtggtgtacttacgaatggaggagctggctttcacacaggaagagatgacagacttcgaagaacatagcactcagcagttgaccctctctcccgcagccgtgcccacacgagcagcgtctgattccgaatgctgtaacattaacttggacaccgaaactagcccatgctcatctgactttgaggagaatgttgggaaaaagctgctgcgaaccctgtcaggccagaagaggaaacgatcacctgagggcgagcgcactagcgaggataatagcaacttaacgcctctgataacgtag

SEQ ID NO: 219610 - DNA, 2493 bp, Artificial Sequence
  Description of Artificial Sequence: Synthetic coding sequence
atggctgccgcagccgcagccgcagctgcagtaggcgtacggctgagagactgctgtagcaggggggcagtcctcctgttgtttttttccctgtccccaagaccccctgccgcagctgcctggctgctcggtctgagaccagaagacaccgccggaggaagagtctccttagaaggcggtacactgagagccgctgagggtacctcttttcttcttagggtctactttcagcctgggcctccaagatgtcgggagcagtccgactgggccagcgatgtggaagttctgggacctctgaggcctggaggcgttgccggtagcgccctggttcagctgttttcactgtgcgcatgggacggaagggcatggcaccatcatggcgctgcgggaggtttccttcttcgcgtgagacctcggctgtatggcccagggggtgacctattgccccctgcatggttaagggctttgggagccttgctgttactggctctgagcgccctgttcagtgggcttcggctttccctgctctccctcgaccctgttgagttaagggtgttgcgcaactctgggagtgctgcagagcaggagcaggcaaggcgcgtgcaagctgttcgtggtagaggtacgcatctcctttgcaccctcttgctaggccaggccggagccaacgccgctctggccggatggttgtatacttctctgccccctggatttggcggtactggagaggactactccgaggaaggaatccatttcccatggctccctgccctggtgtgtactggcgcagtctttctgggagccgaaatttgtccgtactccgtctgtagtcggcacgggctggcaatcgcatcgcactcagtatgtctgaccaggttgctcatggccgcagcattccctgtgtgttatccacttggtaggttgctcgactgggctctgcgccaggagatctccacattctatacgcgagagaagctgttagaaaccctgcgcgcagctgacccttactctgacctcgtgaaggaggagctgaacattattcagggagctctggagctgcgtactaaagttgtcgaggaagtgctgactcccctgggagactgcttcatgttgcggtcagacgccgtgctggattttgcgaccgtttccgagattctgagaagtgggtataccaggatccccgtgtatgaaggcgaccaaagacataacattgtggacatactgttcgtcaaggatctagccttcgttgatccggatgattgtacaccgctgcttacagtcactaggttctacaataggcccttacattgcgtgttcaacgacacaagactggacactgtgctggaggaatttaagaagggcaaatcccacttggcaatagttcagcgcgtgaacaacgagggagaaggagacccattttacgaggtgatgggcatcgtgaccctggaagatattattgaggagatcataaagtccgagattctcgacgagaccgacctatataccgataacaggaaaaagcagagagtgcctcaacgtgagaggaagagacatgacttcagcctctttaaactatctgatacagagatgagggtgaagatttcgccacagctcctgctggcgacccataggttcatggccacagaggtcgagcctttcaagtctctatacctgtcagagaagattcttctgagattgctcaagcacccaaatgtgattcaggaactgaagttcgatgagaaaaataagaaagcaccagagcactatctttaccagagaaatcgccctgttgattacttcgtgctgttgttgcaggggaaggtcgaggtggaggtggggaaagaaggacttcggtttgagaatggagctttcacctattatggcgtacccgctattatgacgactgcttgcagtgataatgacgtgcgaaaggttgggtccctggcaggcagtagcgtgttcttgaatcgcagtccctctcgctgcagcggcctcaacaggagcgagtcccctaacagagagagatcagactttggcggatcaaatacacaactgtattctagttctaacaacttgtacatgcctgattatagcgtccacattcttagcgacgtgcagtttgtgaaaataacaaggcagcaataccagaacgccctgacggcttgccatatggattcttcaccacaatctccagacatggaggcttttaccgatggcgattcgacaaaggcaccaaccacgcgtgggacgccacagacccccaaagatgaccctgccatcactctgcttaataaccggaactctttgcccagctccgacagcgagtgctgtaatataaatttagacacggagactagcccctgtagctccgactttgaggagaatgtgggaaagaaactactaaggaccctctcaggtcagaaacggaaacgaagccccgagggtgaacggacctcagaggataactcaaatttgactccactcatcacctag

SEQ ID NO: 219611 - DNA, 1824 bp, Artificial Sequence
  Description of Artificial Sequence: Synthetic coding sequence
atggctgccgctttccccgtctgttatcctttagggcgattattagattgggccttaagacaggagatcagtacgttctacacccgagagaagctgttggagaccctccgcgcagccgacccttatagtgatctcgtgaaagaggaactgaacataatccagggcgctctggaactccgtaccaaggtagtagaagaggtactcacacccctgggtgactgtttcatgttgcgatcagacgccgtactagacttcgcaactgtttccgagatcctgcgcagtggttacacacgtattccggtatacgaaggtgatcaaaggcacaacatcgttgatattctgtttgtgaaagatcttgcgtttgtcgaccccgatgactgtacaccacttctgacagtaacaaggttttacaatcgacccttgcactgtgtattcaatgacactcgactcgacacggtgttagaggagttcaagaaggggaagagtcatctggccattgttcaacgggtaaataatgagggggagggcgatccattttacgaagtgatgggaattgtcactcttgaggatataattgaggagattattaagtcagaaatcttggacgagacggacctctatactgacaacagaaaaaaacagcgtgtcccccagcgagaacgcaaaagacatgacttttcgttatttaagctgtctgacactgaaatgagggtcaaaatctcacctcagttgttgttggccacacatagatttatggccacagaggtcgaaccatttaaatccctctatctttccgaaaagatcctgctgagactactgaagcacccaaacgtaattcaggaactgaagttcgacgagaagaacaaaaaggcacctgagcactatctgtatcaaaggaatcggcctgtagactattttgtactgctgttgcaggggaaggtggaggtggaagtggggaaggagggcctgcgcttcgagaatggggcttttacctattatggcgtgcctgcaatcatgacaacagcttgtagcgataacgacgtgagaaaggtcggaagcctggcaggctcttctgtgtttctgcctgtgtcagtatccagaacctttgcggtcagtaggggggatagtttggcgggaagtccggtgaacaggtccccatcccgatgctctgggctcaaccgcagcgaatctcctaaccgggagcgatccgatttcggaggcagcaacacccaattatactccagttccaacaatctgtacatgcctgattactcggtgcacatcctctccgatgtgcagttcgtgaaaattactagacaacagtaccaaaacgctctgaccgcctgccacatggacagcagcccacaatcgcctgatatggaggcctttactgatggggattccaccaaggctccgaccacaagaggtacaccccagaccccgaaggacgaccccgctatcaccttgttaaataaccggaactcgctgccgtgctcaaggtctgacggtctgcggtcaccatccgaggttgtgtatttgcggatggaggaactcgcttttacccaagaggagatgacggattttgaagagcacagcacacagcagctcactctgtcccccgctgccgtcccaacccgggcagcttcagattctgagtgctgcaacataaatctagacacggagacctcaccttgctcaagcgattttgaagagaacgtggggaagaaacttctacgcacccttagtgggcagaaacgaaaacgcagcccagaaggcgagagaacatcagaggacaactctaatcttacccccctgatcacatag

SEQ ID NO: 219612 - DNA, 2643 bp, Artificial Sequence
  Description of Artificial Sequence: Synthetic coding sequence
atggccgctgccgcagccgcagccgctgctgtaggtgtgagacttcgtgattgctgcagccgcggagccgtcctgctactgttcttttctctgtccccccgtccgcctgctgctgcagcctggctcctgggtcttagaccagaggatactgccggaggtagggtgagcctggaggggggaactctacgggctgctgaaggtaccagtttcttgcttagggtctatttccaacccggacctcctcgttgcagagagcaatcggactgggcttccgacgtcgaggtgctggggccactgaggcccggtggggtggccggtagcgctttggtgcagctgttcagtctgtgcgcttgggacgggagagcatggcaccatcatggcgctgctggcggtttcctgctccgggtccgccctaggctgtacgggcctggaggggacctcctgcctccagcgtggctacgggctctgggggcactacttctcctggctctcagcgccctgttctctggactgcggttgtccctcctatccctggatcccgtggaactgagagttcttagaaactccggttctgctgcagagcaagaacaggcgaggcgcgtacaagctgtgcgcggacgcggtactcacctgctttgcacgcttctgttgggacaggcgggtgccaacgctgcactagccggttggctttacacttccctgcctccgggttttgggggtactggagaagactactctgaggaaggcatccatttcccttggctgcccgctctggtctgcacgggcgcagtctttctaggggcagaaatctgcccatactcagtttgcagtagacacggactggcaatcgcttcacactcagtttgtctcacgcgtctgcttatggcagccgcatttcctgtctgttaccctctgggcaggttactcgactgggcgctacggcaggaaatcagcaccttttatacccgcgagaagctcctggaaaccctgcgggcagctgatccttactctgacttggtgaaagaagagcttaatatcatccagggtgcattagagctacgtacgaaggttgtcgaggaggttctcacccccctgggggattgcttcatgctgagaagtgacgccgtcctcgatttcgccaccgtgagtgagatcttgcgctcaggttacacccggattccagtttatgaaggagatcagcggcataacattgtggacatcctcttcgtcaaggatctagcattcgtggatcctgacgactgcacccctctgctcaccgttacaaggttctacaacaggcccctgcactgtgtgttcaacgacaccaggttagatacggtcttagaagaatttaaaaaaggaaagagtcacctggcgatcgttcagagggtcaacaatgaaggggagggtgatcctttctacgaagtaatgggcatagtgactctggaggacatcattgaggagatcatcaagtcagagatactggatgagaccgacctatacacggataatcgaaagaaacagcgagtgccgcagcgtgagcgcaagcggcatgatttttctttatttaaactgtccgataccgagatgcgcgttaagattagtcctcagctgctgttagccacccacaggttcatggccaccgaggtggagccttttaaatcactatatctgtccgagaagatcctactgcggttattgaagcaccccaacgtcattcaggaattgaagttcgacgagaagaataagaaagctccagagcactacctgtaccaacggaacagacctgtggactatttcgtcctgctgctacaggggaaggtggaggtcgaggtaggaaaggagggtctgcgatttgagaacggcgctttcacctactacggagtccccgctataatgaccaccgcatgctccgacaatgatgtcaggaaagtagggtctctggccggatcttcggtgttcctcaaccggtccccatcgcgttgttcaggcctcaaccgcagcgaatctccaaaccgcgaacgatcagatttcggaggcagtaatactcagctctactcatcaagtaataacctctatatgcccgactatagcgtacacatactatctgacgtgcagttcgtgaagatcacccggcagcagtaccagaatgctctgactgcctgccatatggattcctcaccacaatcaccagatatggaagcttttaccgatggcgactcaacaaaagcaccaactacccggggaaccccacaaactcccaaggatgaccccgctatcaccctcctcaacaaccgaaacagtctcccgtgtagtcggagcgacggcctgcgctccccatccgaagtggtatatcttaggatggaagaactcgcgtttactcaggaagaaatgaccgattttgaagagcacagcactcagcaactgaccctgagccccgctgcagttcctactcgcgcagcctccgacagcgagtgttgtaatatcaacttggacactgagacctcaccctgcagtagtgactttgaggaaaatgtagggaaaaagctgttacgaaccctttccgggcagaagcggaaacgcagtcctgagggagaacggacgagtgaagacaattcaaatctgacccctcttattacgtag

SEQ ID NO: 219613 - DNA, 1215 bp, Artificial Sequence
  Description of Artificial Sequence: Synthetic coding sequence
atggggatcgttactctggaagatattatagaggaaataatcaagtccgagatcttggacgagactgacctgtacacagataatcgtaaaaaacagagggtaccccagagggagagaaaacggcatgacttttctctatttaagctgagtgatacggaaatgcgggtcaagatttctccacagctactgctggctacccaccggtttatggctaccgaagtggaaccattcaaaagtctttacctgtccgaaaagattttgctgcgattgctcaagcatccgaatgtgatccaagagttgaaatttgatgaaaaaaacaaaaaagctcctgagcattatctatatcagagaaatagaccggtagactacttcgtcttgcttcttcagggaaaggtggaggtggaggtcggaaaggaaggattaagattcgagaacggggcattcacctactacggagtccctgcaattatgaccaccgcctgttcggataacgatgtacggaaggtgggttcgctcgcgggatccagtgtctttctgaaccggtcaccgtcgcgctgttctgggttaaatagatcagagagccccaaccgggagcggtcagactttggtggctcaaacacacagttgtattcgagttcgaacaatctgtacatgcctgactacagcgtacacatcctgagtgacgtacagtttgtaaaaattacacgtcagcagtaccagaatgctctgaccgcctgccatatggattcctctccgcagtcacccgacatggaagcatttactgatggagacagtaccaaagccccaacaacgagggggacgccgcagacccctaaggacgacccggcaatcactctgctgaacaacaggaacagcctcccatgctctagatcagacgggcttcggagcccctcagaagtcgtctacttgcgcatggaggagctggcgtttacgcaagaggaaatgaccgattttgaggagcattccacacagcagttgacactcagccccgctgcagtgccaacaagagccgcatctgactctgagtgttgtaacataaatctggacacagagacaagcccctgcagctcagacttcgaggaaaatgtgggcaaaaagctgctcaggactttgagtggccagaagcggaaacgtagcccggaaggggaaaggacctcggaggataactcgaatttaacccccttgattacctag

SEQ ID NO: 219614 - DNA, 2562 bp, Artificial Sequence
  Description of Artificial Sequence: Synthetic coding sequence
atgatagggtgcggcgcatgcgagccaaaggtgaaaatggctgggggtcaggccgctgcagccctgccaacatggaagatggctgccagaaggtcattatccgccaggggccgagggattcttcaggctgcggctggcagactgctgcctttgctactgctgtcctgctgctgcggggcaggcggatgtgccgcagtgggggagaacgaagaaactgtgattattggcttgcgcctggaggatactaatgatgtgtctttcatggaaggaggggcactgagggtgtcggaacgcactagggttaagcttagggtgtacgggcagaacatcaataacgagacttggtccaggatcgctttcacagagcatgagagacggaggcacagccccggtgaacggggactcggtggtcctgccccaccagaacctgatagcggaccacagcgatgcgggattcggaccagcgatattatcattctcccccatattattcttaaccgcaggacatctggtattatagaaatcgagatcaagccgcttcgaaagatggagaaatccaagtcatactacctctgcacaagtctgtccacccccgctttgggcgctgggggaagcggcagtaccgggggagctgtcggaggcaagggcggatccggggttgccggactgcctccccctccgtgggccgaaacgacatggatctaccatgatggtgaagatactaagatgatcgtgggagaagaaaaaaagttcttgctgcccttctggttgcaggtgatattcattagcttattgctgtgcttgtcggggatgtttagcggactgaaccttgggttgatggctttggacccaatggaactcagaattgtccaaaactgcggtactgagaaagagaagaattatgcgaagagaatcgaaccagtgcggaggcagggcaactacctgctgtgtagtctattgctgggaaacgtattagtcaacaccaccctgactatcctgctggacgacatagctggcagcggattggttgccgtggtcgtcagcactataggcatcgtgatttttggcgagatcgtgccgcaggccatttgttctcgacacggattggctgtgggcgctaacacaatcttcctgactaaattcttcatgatgatgactttccccgcatcctaccccgtgtctaaactgctcgactgcgtcctgggccaggaaattgggactgtgtacaacagggagaagctgctagagatgttgcgcgtaactgatccttacaatgatctggtcaaggaggaacttaacatcatacaaggagcccttgaactgaggaccaagacagtggaagacgtgatgaccccccttagagattgcttcatgatcaccggggaggcaatcctggacttcaataccatgtctgagattatggagagcgggtacacacggatccccgtgtttgagggtgaaaggagtaatatcgtagacctcctctttgtgaaagatctggcctttgtggaccctgacgactgtacgccccttaagactataaccaagttctacaatcacccgctgcacttcgtttttaacgacactaagcttgatgcaatgctcgaagagttcaagaaggggaaaagtcacctggccattgtgcagagagtgaacaatgaaggcgagggtgaccccttttacgaagtcttaggaatcgttacactagaagatgttattgaagagatcatcaaatcggagattttagatgagactgacctgtataccgacaacagaacgaagaagaaagtggctcaccgcgagaggaagcaggactttagcgcctttaagcaaacggattctgaaatgaaagtaaaaatctctccacagctcttactggccatgcaccgattcttagccacggaggtcgaggcctttagtccgtcccagatgtctgagaagatattgttgagactccttaagcacccaaacgtaattcaggaattaaagtacgacgagaaaaacaagaaagcaccagaatattatctctaccagcgcaacaagccagtggattacttcgttctcatactgcaaggcaaggtggaagtagaagcaggcaaggagggaatgaagttcgaggcttcagctttcagctattacggagtgatggcgctcactgcgtcccctggcgaaaataaaagcccgccaaggccatgcggactgaaccattccgattccctcagtagatccgatcgcatcgacgctgtcacaccaaccctcggcagtagcaataatcaactcaattccagccttctgcaggtgtacatacccgactatagtgtaagggcactcagtgatctgcagttcgtgaagatttctaggcagcagtaccaaaacgccttgatggcctcccgtatggacaaaactccacaaagttccgactccgagaataccaaaattgaacttactctgacagaattacatgacggtctgccagacgagactgcaaatctactaaacgaacagaactgtgtgacccactccaaggctaatcattctctgcacaacgaaggcgctatttag

SEQ ID NO: 219615 - DNA, 1659 bp, Artificial Sequence
  Description of Artificial Sequence: Synthetic coding sequence
atgattggctgcggggcatgtgaacctaaagtgaagatggcaggaggccaggcagccgctgccctgccgacctggaagatggccgcaagaagatcactctccgcaagaggaaggggcattctgcaggccgctgcgggacgactgctcccacttctgttattatcatgctgttgcggtgccggaggttgcgctgcagtgggcgagaacgaagaaaccgtcatcatcggactacgcctggaggacacgaacgacgtcagctttatggaaggcggtgcactgcgcgtcagcgaacgcacaagagtcaagttgagagtctacgggcagaacattaataatgagacctggagtcgaatcgctttcaccgagcacgagcggaggagacacagcccgggtgagaggggcctggggggtcctgcccctcccgaacctgatagcggaccccaacgttgcggcattagaacctctgacattatcatcctaccccatatcatccttaacagacgtacatctgggattatcgagattgagataaaacctctgagaaaaatggagaagtctaaatcctattacttgtgtacgagcctgtctactcccgcactcggagccggaggaagtggctctactggcggagcggtgggcggaaaagggggttcgggcgtagctgggctgcccccacctccttgggctgagaccacttggatctaccatgacggagaagacacaaagatgatcgtgggcgaggagaaaaagtttctcctgcccttttggctgcaagtcatttttatttctttactgctctgtctgtcgggaatgttttccgggcttaatttgggattgatggccctggatccgatggagctgcggatcgtacagaattgtggaactgaaaaggagaaaaactacgccaaacgtatcgagccagtccgacgccagggaaattatctgctgtgttcacttcttctggggaacgtgctggtgaataccacactcacaatcctgctagatgatatcgcaggctctgggttagtggcagtggtggtaagcacaatcggcattgtcattttcggcgagatagtccctcaggccatctgttctcgacatggcctggccgtgggggctaacactatattccttacaaaatttttcatgatgatgacgttcccagctagctatccggtatcaaaactcctggattgcgtgttggggcaggaaattgggaccgtgtacaatagagaaaagttactggaaatgttaagagtgacagacccctacaacgatttggtgaaagaagagttgaacatcatccagggggctttagagctccgaactaaaaccgtggaggatgtgatgactccactccgagattgtttcatgatcaccggtgaggctatcttagatttcaacaccatgagcgaaatcatggagtccggatacacgcggattccggtgttcgaaggagagcgctctaacatcgttgacctgctctttgtaaaggacttagcctttgtcgatcctgatgattgtactccgctgaagacaattaccaaattctataatcacccactccacttcgtcttcaatgataccaaattggacgctatgttagaagaatttaagaaggaacatacgaataagaagccgaagagctaccagcattag

SEQ ID NO: 219616 - DNA, 2628 bp, Artificial Sequence
  Description of Artificial Sequence: Synthetic coding sequence
atgatcggctgtggcgcatgtgagcccaaggtgaaaatggcaggcggacaggccgctgctgccctccctacatggaagatggcggcacggaggagcctgtcagcaagagggcgagggatattgcaggcagcagcgggtcggctgctacctctgctcctccttagttgctgctgcggcgctggcggttgcgctgctgttggagagaacgaagagaccgtcataattggcctgcggctggaggataccaatgatgttagctttatggaagggggtgcactgagagtgtcagagagaacaagagtcaagttacgtgtgtatggccaaaacataaacaatgagacctggagtcgcatcgcctttactgaacacgagaggcgtagacattccccaggagaacgaggactaggcggaccagccccaccagaacctgacagcgggcctcagcggtgtggaattcgaacctctgacatcatcatcctaccacatataattttgaaccggagaacatcaggcattattgagatcgagataaagccccttcggaagatggagaaatccaaatcttattacttgtgcacaagcctttctacaccggctctgggggctgggggatccgggagcacgggaggggctgtgggaggaaagggagggagcggtgtggccggtttacctccccctccctgggccgaaaccacatggatatatcatgatggcgaggacacaaagatgattgtgggcgaggaaaaaaagtttttgctgccattctggctgcaggtgatctttatttctcttcttctgtgtctctccggcatgttcagcgggctaaatcttgggctaatggctttagaccctatggagctgagaatagtccaaaactgtggtaccgagaaagaaaaaaactacgcaaagcgcatcgagcctgtgaggagacagggtaattatctgctgtgctcactgctactggggaatgtcttggtgaacaccacactaactatcctcttggatgacattgcaggttctggcctggttgctgtggtcgtttccacaatcggcattgtcatttttggcgaaatcgtgccccaagccatctgctcgcgccacggtttggccgtgggggctaatactatctttttgaccaagttcttcatgatgatgacgttccccgcttcataccctgtctccaagctcctggattgcgtgctcggccaggaaatcggaactgtatacaacagagagaaactactcgagatgctgcgcgtgaccgacccgtataatgatctcgtcaaagaagagctgaatatcattcagggagccctggaactgaggacaaagaccgtggaagacgtgatgaccccactccgcgattgtttcatgattaccggagaagccattttagacttcaataccatgtccgagattatggagtcagggtacacccgcatcccggtgttcgaaggcgaacggagcaacatagttgatctgttattcgtaaaggatctagcgttcgtagaccctgatgattgtacacctctgaaaacaatcacaaaattttataaccaccccctacacttcgtgtttaacgatactaagttagatgcaatgttagaggagttcaaaaaagggaagtcgcatctcgcgatcgttcagcgagtgaataacgaaggggagggcgatcccttttacgaagtactgggcatcgtgacactggaggacgtcatcgaggaaataatcaagagcgagattctggatgagacagacctgtacactgataatcggactaaaaagaaagtagcccatcgtgagcggaagcaggacttctccgcatttaagcagacggattccgaaatgaaggtgaagattagcccccaacttctcctggccatgcaccggtttctcgccaccgaagtcgaggccttttcaccgtcacagatgtccgagaaaattctgctgaggctgctcaaacaccctaatgtcattcaggagttaaaatacgacgagaagaataagaaggcacccgagtactatttgtaccaaagaaacaaacctgtcgactacttcgttctgatcctacaggggaaggtcgaggtggaagctggaaaggagggcatgaagtttgaagcatcagccttctcttactatggggttatggctttaactgcatcccctgtgcctttaagcttatcccgaactttcgtagtcagtagaacggaattattggctgcgggaagtccaggcgaaaacaaatccccccctcggccttgtggcctgaaccatagtgattcattaagcaggtcggataggatcgacgcagtgacacccactcttggttcatcaaataaccagctgaattcatctctccttcaagtgtatataccagactattctgtgcgtgcgctgagcgacttgcagtttgttaaaatttctaggcagcagtatcagaacgcacttatggcttcccggatggacaagacgccacaaagctcagattctgagaataccaagatcgagttaaccctcaccgagttacatgatggtctgccagacgaaacggctaatttgctgaatgaacaaaattgtgtcacccatagtaaggcaaaccactctcttcataacgaaggggctatctag

SEQ ID NO: 219617 - DNA, 2565 bp, Artificial Sequence
  Description of Artificial Sequence: Synthetic coding sequence
atgatcggttgcggtgcatgcgaacctaaagtgaaaatggccggaggtcaagcggctgccgcattacctacgtggaagatggccgctcggaggtccctgtctgctcgtggccgtggcatccttcaggctgccgctggacggctgctgcctctcctcttactgtcctgttgctgtggcgcaggaggttgtgccgctgtaggcgaaaatgaggaaacggtaattatagggttaaggcttgaagacacgaatgacgtgtcctttatggaaggaggagcccttcgagttagcgagaggacgcgtgtgaaactcagggtctacggacagaacatcaacaatgagacctggtctcgtattgccttcaccgagcatgagcggaggaggcactcccctggagagcgcggattgggcggtcctgccccaccagaacccgacagcggccctcaacggtgtggtatcaggaccagtgatatcataatactccctcacataatcctgaacaggcgcacctccgggattatcgaaatagagatcaagcccctgaggaagatggaaaaatcaaagtcatactacctttgtaccagtctttctactccggcactcggggcaggcggatcaggaagcacgggaggcgctgtgggtggcaaaggtgggtccggagtggccggactcccgcctcccccatgggccgagacgacttggatctatcatgacggcgaagataccaagatgattgttggtgaggagaaaaaattcctgctgccattctggctgcaggtgatattcatctctctgcttctttgcttaagcggcatgttctcaggtctgaacctgggcctgatggcactcgacccgatggagctgaggatcgtccaaaactgcggcactgaaaaggaaaaaaactacgccaagcggatcgaacccgtgcggcgacaaggcaactacctcctctgctcattgcttttagggaacgtgttagtgaataccacacttactatactgctggacgatatcgcgggtagcgggctggtggcggttgtggtcagcaccattggtatcgtcattttcggcgagatcgtcccacaggcaatctgcagccggcatgggttagccgtcggagccaacacaatttttttgacaaagttctttatgatgatgacattccccgcatcttacccagtgtcaaagctcttagattgtgtcctaggacaagagattggcactgtgtataatcgggagaaactgctggagatgctgcgcgtgactgacccttacaatgatctcgtgaaagaggaactgaatatcattcagggagctttagaattgcgcacgaagacggtggaggatgtgatgactccgctgcgcgactgtttcatgataactggcgaggctatcctcgattttaatacaatgtctgaaatcatggaaagcggctacacgagaattcccgtcttcgagggggagagaagcaatattgtggatctcctgtttgtgaaagaccttgcttttgtagacccagatgattgtacaccactcaagaccatcacaaagttttacaaccacccgttgcacttcgtttttaacgacacgaagctggacgctatgctagaagaattcaagaaggggaaaagtcatctcgcaatcgtgcagagagtcaacaatgagggcgagggtgaccccttttacgaggtgctcgggatagtcaccctcgaagatgtgatagaagaaataatcaaatccgaaatccttgatgagacagatctgtacacagacaaccgtactaagaagaaggtggcccatcgtgagcggaaacaggacttttctgcctttaaacagacggacagcgaaatgaaggtgaaaatttctccacagctgctgctggcgatgcatcttgtattcatatctattgaggtggaggcgttttcacccagtcagatgagtgaaaaaatcttgctccgtctgctgaaacatcccaatgttatacaggagttgaaatacgatgagaagaacaagaaggcccctgaatactacctctaccaaagaaacaagccagtcgactactttgttctgatcttgcaggggaaggtggaagtagaggctggcaaagaggggatgaagttcgaggctagtgcattctcatactacggcgtgatggccctcactgctagcccaggcgagaacaagagtcctcccagaccttgcggcctgaatcactctgactcactgagtcgttcggataggattgatgccgtcacacccaccctgggctcctcaaataaccaactcaacagcagcctgttgcaggtctacataccagactactctgtacgcgctttatctgatctgcagttcgtcaagataagcagacagcagtatcagaatgcgttgatggcaagcagaatggataaaacaccacaaagcagcgattcagaaaatactaagattgaacttacgttaactgagctccatgacggactgcctgacgagaccgccaacttactgaatgagcagaattgcgtgacccactccaaggctaaccattcattgcacaatgagggcgctatatag

SEQ ID NO: 219618 - DNA, 2631 bp, Artificial Sequence
  Description of Artificial Sequence: Synthetic coding sequence
atgatcgggtgtggtgcatgtgaaccaaaggtaaaaatggccggtggacaggcagctgcagctctcccaacatggaagatggctgctcgacgatcgctgtccgccagagggagaggcatcctccaagccgctgcgggaagattgctccctctgctcctcctgagctgctgctgcggcgctgggggatgcgccgctgttggcgagaatgaagaaactgtaataatcggactacgactggaggatacaaacgacgtgagctttatggagggaggcgcattaagagtgtcagagcgcacccgcgtaaaactgagggtctacggacagaacattaataatgaaacctggagccgcatcgctttcaccgaacacgagcgtcggcgacactcgcctggcgagagaggtctgggcggacccgcacctcccgaaccagatagcggcccacagcgatgcggcattcggacctctgacatcatcatcctacctcacataatcctaaaccggaggacttcggggattattgagatagaaatcaaacccctccgcaagatggaaaaaagcaagagctattatctctgtaccagtctgtcaacgccagctctgggcgcaggcggtagcgggtcaacggggggagcggtgggtgggaagggtggatccggcgtggccggtctgccgcctcctccgtgggctgagactacctggatctatcatgatggcgaggacaccaagatgatagtgggtgaagaaaaaaagttcctgctgccattttggttacaggtgatttttatctctcttctgctctgccttagcggcatgtttagtggcctcaatctgggccttatggcccttgaccctatggagttgcgcatcgttcaaaattgcggcaccgagaaggagaaaaattatgcaaaacggatcgagcccgtgcggaggcagggaaactacctcttgtgcagtcttctcttaggtaacgtcctcgtgaataccaccttaacgatcctgctggatgatatcgctggctccggccttgtggcagttgtggttagtaccattggtatcgtgatctttggcgagatagtcccacaagcaatatgttcaagacatggcctggccgtgggcgcaaacacaattttcctcaccaagttttttatgatgatgacatttccggcaagctatccagtctccaaactgttggattgtgtactcggtcaggagatcggcaccgtctataaccgcgaaaaactgctggagatgctgcgcgtaactgacccatacaatgatcttgtgaaagaagagctgaacattatacagggtgccctggagctgcggaccaagaccgtggaggatgtgatgactcccctaagggactgttttatgatcacaggcgaagctatcctagatttcaatactatgtccgagatcatggaaagtgggtacaccaggattccagtctttgaaggcgaacggagtaacatagtcgacctactctttgttaaagatttagcttttgtcgatccagacgattgcacacctctgaagaccatcaccaaattctataaccacccacttcactttgtgttcaacgatacaaagctcgatgctatgctggaggagtttaaaaaaggaaagagtcatttggcaattgtacagagggttaacaacgagggagaaggcgaccctttttacgaagttcttggtatcgtgaccctagaagacgtaatcgaggaaatcatcaagagcgaaatcctggatgaaaccgatctctatacagacaaccgtactaaaaagaaggtggcgcaccgcgaacgcaagcaagatttttccgccttcaaacagaccgactccgagatgaaagtcaaaatctctcctcagcttctcttggcaatgcaccttgtgttcatctccatagaggtggaagcattcagtcccagccagatgagcgagaagatcctgctgagattactcaagcatcccaacgtgatacaggaactaaagtacgatgaaaagaataaaaaagcacccgagtattatctgtaccaaagaaataaaccagtagattattttgtgttgatcctgcaggggaaagttgaggtggaagctggcaaagaagggatgaagttcgaggccagcgcgttcagctattacggggttatggccctaaccgccagccctgtaccactgtcactctccaggacctttgttgtgagtagaaccgaacttctcgccgctgggagccccggagaaaataaatctcccccacggccttgtggacttaaccattccgacagtctctcccggagtgataggatcgatgccgtgactccaactttaggctcttcaaacaaccagctgaatagctcactcctgcaggtgtacataccggactactctgttagagcgctgagtgatctgcaatttgtgaaaatcagtagacaacaatatcagaatgccctcatggcttcgcggatggataaaaccccacaaagttcagatagcgaaaacaccaaaatcgaactgacactgactgaactgcatgatggtctccccgatgaaacggccaatctccttaatgaacagaattgtgtcacacactcaaaagcaaatcacagtctgcacaatgagggcgctatctag

SEQ ID NO: 219619 - DNA, 1725 bp, Artificial Sequence
  Description of Artificial Sequence: Synthetic coding sequence
atgataggctgcggcgcatgtgaaccaaaagttaagatggccggaggacaggctgccgcagcccttccgacatggaaaatggcagctcgccgatctcttagcgccagaggtcggggtattctgcaggccgctgccggacggctgctgccgcttttgctcctctcctgctgttgcggggcaggagggtgtgccgcagtcggagaaaatgaggaaactgtcatcattggtctccgtttggaagacacaaacgacgtctcctttatggaagggggagctctgagggtgagcgagagaacccgcgtcaaactacgggtatacggccagaacataaacaacgagacttggtcacggattgccttcactgagcatgaaaggaggcgacacagcccgggagagagaggcctcggcggtcctgccccacccgagccggactcagggcctcagcgttgcgggatacgcacaagcgatattatcatcttaccacacattatattgaataggaggacgtctgggataattgagatcgaaataaaaccactgcgtaaaatggagaagtcaaaatcatattatctgtgcacttccctctccactcctgccttgggagccggtgggtcaggatctacgggcggagcagtcggtggcaaggggggatcaggggtggctgggctgccaccgcctccctgggcagaaaccacctggatataccatgacggagaggacacaaagatgattgtaggagaggagaagaaatttttgttgcccttctggttacaagtgatttttatcagcttgcttctttgcctgtcaggaatgttcagtggtctcaacctgggactgatggccctcgaccctatggaactgcgtattgtgcagaactgtgggactgagaaggaaaaaaactatgcaaaacgcatcgaaccagtcaggcggcaaggcaattacctcctgtgcagcctgctgctgggaaacgtgctggttaataccaccctgactattctcctggatgacatcgcaggaagtggcttggtagctgtcgtcgtgagtaccatcggcattgtgattttcggggagatcgtcccccaggcgatttgcagccggcatggattagctgtgggtgctaatactatctttctcaccaagttcttcatgatgatgacatttcccgcaagctatcctgtttccaagttgctggattgtgtcctaggtcaggagatcgggaccgtgtacaatcgcgagaagttgctagaaatgcttcgagtgacggatccctacaatgatctcgtaaaggaggagctgaacatcatccaaggtgctcttgagctccgaaccaaaaccgtcgaggatgtaatgacccctctgagggattgttttatgattacgggcgaggcaattctcgatttcaacacaatgtcagagattatggagagtggctatacgcgcatccccgtttttgaaggcgaacgctccaatatcgttgaccttctttttgtgaaagacctggcttttgttgacccggatgactgcactcctctcaaaaccattaccaagttctataatcaccctttacatttcgtcttcaacgacaccaaactggacgcgatgttggaagaattcaaaaaggaacacaccaacaagaagcccaaaagctaccagcactgtaatgaacagaattgcgtgacacatagcaaagcaaaccacagcttgcataacgagggagccatctag

SEQ ID NO: 219620 - DNA, 2124 bp, Artificial Sequence
  Description of Artificial Sequence: Synthetic coding sequence
atggctgccgcagtggctgctgccggaaggctgggatggctttttgccgctttgtgtttaggcaatgctgcaggtgaagccgctccaggtccgagagtcctcggattctgtttggaggaggatggggcagccggagcagggtgggtccggggaggcgctgccagggatacccccgatgcaacgttcttgctgcggctgttcggccctggtttcgctaactcctcatggagttgggttgcaccggaaggcgctggctgccgcgaagaagccgcaagcccagctggggaatggcgagcactgctacggctgaggcttcgggcagaagccgttagaccgcatagcgcactgttggcggttagagtcgaacccggaggaggagcggctgaggaggcagctccaccatgggccctcggtctaggtgctgcgggtttacttgccctggctgccctggctaggggacttcagttaagcgctttagctctagcacccgcagaagttcaggtcctcagggaaagtggcagtgaagcagaaagggcggcagctagacggctggagcccgctagaaggtgggcgggatgcgccctaggtgccctgctcctactggcctcccttgcacaggcagccctggccgttttgctgtaccgcgcagccggacagcgggctgtccctgccgtgcttgggagcgccggactggtgtttttagtgggagaagtggtacccgcagccgtctccgggaggtggactctcgccctcgcccctagagccctcggactgtccagacttgcagtcctactgacactccccgtggcgctgcctgtgggacagctccttgagttagccgctagaccaggtcgtctccgggaacgcgtccttgagctagctcgcggtggcggagatccctactctgacctatccaagggagtgctcagatgccgtaccgtcgaagacgtcctgactcctttagaagactgtttcatgctcgatgcctcaactgtgctggattttggtgttctggcatctataatgcagtcaggccatacacgcatccccgtttacgaagaagagaggagcaacatcgtggatatgttgtacttaaaggatttggcctttgtggatccggaggactgtacacccttgtcaactataactcgcttttataatcaccctctgcacttcgtttttaacgacactaaactagacgcagtcctcgaggaatttaagcggggaaagagtcacttagcaatcgtccagaaagtgaataatgaaggagagggtgaccctttctacgaggtgctcggtcttgtgacgctggaagatgtgatagaggagatcatccgttctgaaatcctggatgaaagtgaagactaccgcgatactgtggtgaagcggaagccagcctcattaatggccccacttaaaaggaaagaagagttctccctgtttaaagtgagcgacgacgaatataaggtgaccatttctccgcagctattgttggcgactcaaagatttttaagccgcgaggttgatgtcttctctcccctgcggatctcagaaaaggttctgcttcatctgctcaaacatccgtcagtcaatcaggaggtcagattcgatgagtctaataggctggctactcatcactacctgtaccagcgcagccagcctgtggactactttattttgatcctgcaggggagagtggaggtagagatcggaaaagaaggtctgaagttcgaaaatggggcattcacatattacggagtttccgctctaactgtgcctagtagcgtacaccagtcaccagtcagcagtctccagccaatccgtcacgacttgcaacccgatcccggagacggcacccacagtagtgcttactgccctgactatactgtcagggcactttccgacctgcagctgattaaagtcactagattgcagtacctaaacgcgttattagcgacacgcgctcagaatttgccacagagtcctgagaacaccgacttgcaggttattccagggagccagacaaggctcctcggggagaaaaccactacggctgcagggagtagccattctcggccaggcgtacctgtcgagggaagtcctggtcggaatcccggagtatag
